United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 10

SEQ ID NO: 368988 - RNA, 15 nt, Bordetella pertussis
ccggcgcgcaucguc

SEQ ID NO: 368989 - RNA, 11 nt, Bordetella pertussis
ccggcgcgccc

SEQ ID NO: 368990 - RNA, 13 nt, Bordetella pertussis
ccggcgcgcccag

SEQ ID NO: 368991 - RNA, 21 nt, Bordetella pertussis
ccggcgcgcccaggggccggc

SEQ ID NO: 368992 - RNA, 16 nt, Bordetella pertussis
ccggcgcgcccuugcc

SEQ ID NO: 368993 - RNA, 18 nt, Bordetella pertussis
ccggcgcgcccuugccgu

SEQ ID NO: 368994 - RNA, 12 nt, Bordetella pertussis
ccggcgcgccgc

SEQ ID NO: 368995 - RNA, 13 nt, Bordetella pertussis
ccggcgcgccggc

SEQ ID NO: 368996 - RNA, 14 nt, Bordetella pertussis
ccggcgcgccggcc

SEQ ID NO: 368997 - RNA, 17 nt, Bordetella pertussis
ccggcgcgccggccgcc

SEQ ID NO: 368998 - RNA, 18 nt, Bordetella pertussis
ccggcgcgccggccgcca

SEQ ID NO: 368999 - RNA, 17 nt, Bordetella pertussis
ccggcgcgccggccugc

SEQ ID NO: 369000 - RNA, 20 nt, Bordetella pertussis
ccggcgcgccgggccagacc

SEQ ID NO: 369001 - RNA, 15 nt, Bordetella pertussis
ccggcgcgccucggc

SEQ ID NO: 369002 - RNA, 18 nt, Bordetella pertussis
ccggcgcgccucggcgcg

SEQ ID NO: 369003 - RNA, 16 nt, Bordetella pertussis
ccggcgcgcgcaggcg

SEQ ID NO: 369004 - RNA, 18 nt, Bordetella pertussis
ccggcgcgcgcaugcccg

SEQ ID NO: 369005 - RNA, 20 nt, Bordetella pertussis
ccggcgcgcgcaugcccgac

SEQ ID NO: 369006 - RNA, 17 nt, Bordetella pertussis
ccggcgcgcgcgcgccg

SEQ ID NO: 369007 - RNA, 18 nt, Bordetella pertussis
ccggcgcgcgcgcgccgc

SEQ ID NO: 369008 - RNA, 22 nt, Bordetella pertussis
ccggcgcgcggaugaucgcgca

SEQ ID NO: 369009 - RNA, 14 nt, Bordetella pertussis
ccggcgcgcggccg

SEQ ID NO: 369010 - RNA, 14 nt, Bordetella pertussis
ccggcgcgccugcc

SEQ ID NO: 369011 - RNA, 15 nt, Bordetella pertussis
ccggcgcgccugccg

SEQ ID NO: 369012 - RNA, 18 nt, Bordetella pertussis
ccggcgcgccuggcgcgc

SEQ ID NO: 369013 - RNA, 14 nt, Bordetella pertussis
ccggcgcggacaga

SEQ ID NO: 369014 - RNA, 12 nt, Bordetella pertussis
ccggcgcggccu

SEQ ID NO: 369015 - RNA, 15 nt, Bordetella pertussis
ccggcgcggcgcgcg

SEQ ID NO: 369016 - RNA, 19 nt, Bordetella pertussis
ccggcgcggcgcgcgccgu

SEQ ID NO: 369017 - RNA, 22 nt, Bordetella pertussis
ccggcgcggcgcggccggcuug

SEQ ID NO: 369018 - RNA, 21 nt, Bordetella pertussis
ccggcgcggcgguccucgccg

SEQ ID NO: 369019 - RNA, 14 nt, Bordetella pertussis
ccggcgcgguaugg

SEQ ID NO: 369020 - RNA, 20 nt, Bordetella pertussis
ccggcgcgguauggccgccc

SEQ ID NO: 369021 - RNA, 22 nt, Bordetella pertussis
ccggcgcgguauggccgcccag

SEQ ID NO: 369022 - RNA, 20 nt, Bordetella pertussis
ccggcgcggugaggcggccg

SEQ ID NO: 369023 - RNA, 16 nt, Bordetella pertussis
ccggcgcgguggccau

SEQ ID NO: 369024 - RNA, 21 nt, Bordetella pertussis
ccggcgcgguggccaugcugg

SEQ ID NO: 369025 - RNA, 17 nt, Bordetella pertussis
ccggcgcguccacgccg

SEQ ID NO: 369026 - RNA, 20 nt, Bordetella pertussis
ccggcgcguccacgccgugg

SEQ ID NO: 369027 - RNA, 13 nt, Bordetella pertussis
ccggcgcgucgcg

SEQ ID NO: 369028 - RNA, 15 nt, Bordetella pertussis
ccggcgcgucgcgcg

SEQ ID NO: 369029 - RNA, 18 nt, Bordetella pertussis
ccggcgcgucgcgcggcg

SEQ ID NO: 369030 - RNA, 21 nt, Bordetella pertussis
ccggcgcgucgcgcggcggca

SEQ ID NO: 369031 - RNA, 14 nt, Bordetella pertussis
ccggcgcgugcugg

SEQ ID NO: 369032 - RNA, 18 nt, Bordetella pertussis
ccggcgcgugcuggcgca

SEQ ID NO: 369033 - RNA, 18 nt, Bordetella pertussis
ccggcgcguugcggaugg

SEQ ID NO: 369034 - RNA, 17 nt, Bordetella pertussis
ccggcgcuacagggugc

SEQ ID NO: 369035 - RNA, 14 nt, Bordetella pertussis
ccggcgcucagcgc

SEQ ID NO: 369036 - RNA, 18 nt, Bordetella pertussis
ccggcgcucagcgcgccg

SEQ ID NO: 369037 - RNA, 17 nt, Bordetella pertussis
ccggcgcucgccccggc

SEQ ID NO: 369038 - RNA, 19 nt, Bordetella pertussis
ccggcgcucgccccggcgc

SEQ ID NO: 369039 - RNA, 22 nt, Bordetella pertussis
ccggcgcucgccccggcgcgca

SEQ ID NO: 369040 - RNA, 14 nt, Bordetella pertussis
ccggcgcugcgguc

SEQ ID NO: 369041 - RNA, 12 nt, Bordetella pertussis
ccggcgcugcug

SEQ ID NO: 369042 - RNA, 15 nt, Bordetella pertussis
ccggcgcuggccgcc

SEQ ID NO: 369043 - RNA, 17 nt, Bordetella pertussis
ccggcgcuggccgccau

SEQ ID NO: 369044 - RNA, 18 nt, Bordetella pertussis
ccggcgcuggcgcauggc

SEQ ID NO: 369045 - RNA, 23 nt, Bordetella pertussis
ccggcggaucacccagcggcugg

SEQ ID NO: 369046 - RNA, 15 nt, Bordetella pertussis
ccggcggcacgcugc

SEQ ID NO: 369047 - RNA, 16 nt, Bordetella pertussis
ccggcggcacgcugcg

SEQ ID NO: 369048 - RNA, 17 nt, Bordetella pertussis
ccggcggcacggccggc

SEQ ID NO: 369049 - RNA, 17 nt, Bordetella pertussis
ccggcggcauucagcgc

SEQ ID NO: 369050 - RNA, 19 nt, Bordetella pertussis
ccggcggcauucagcgcug

SEQ ID NO: 369051 - RNA, 19 nt, Bordetella pertussis
ccggcggccugcacggugg

SEQ ID NO: 369052 - RNA, 18 nt, Bordetella pertussis
ccggcggccugcaggccg

SEQ ID NO: 369053 - RNA, 15 nt, Bordetella pertussis
ccggcggccuggacc

SEQ ID NO: 369054 - RNA, 21 nt, Bordetella pertussis
ccggcggcgagcgcggcgcgc

SEQ ID NO: 369055 - RNA, 24 nt, Bordetella pertussis
ccggcggcgcauugccgucggccg

SEQ ID NO: 369056 - RNA, 14 nt, Bordetella pertussis
ccggcggcgcgccg

SEQ ID NO: 369057 - RNA, 21 nt, Bordetella pertussis
ccggcggcgcggaugaucucg

SEQ ID NO: 369058 - RNA, 12 nt, Bordetella pertussis
ccggcggcgcgc

SEQ ID NO: 369059 - RNA, 13 nt, Bordetella pertussis
ccggcggcgcgcc

SEQ ID NO: 369060 - RNA, 14 nt, Bordetella pertussis
ccggcgggcaggcg

SEQ ID NO: 369061 - RNA, 13 nt, Bordetella pertussis
ccggcgggccgca

SEQ ID NO: 369062 - RNA, 15 nt, Bordetella pertussis
ccggcgggccgcugu

SEQ ID NO: 369063 - RNA, 20 nt, Bordetella pertussis
ccggcgggcggcugcccggg

SEQ ID NO: 369064 - RNA, 21 nt, Bordetella pertussis
ccggcgggcggcugcccgggc

SEQ ID NO: 369065 - RNA, 18 nt, Bordetella pertussis
ccggcguauggcccgcca

SEQ ID NO: 369066 - RNA, 13 nt, Bordetella pertussis
ccggcgucacgcg

SEQ ID NO: 369067 - RNA, 19 nt, Bordetella pertussis
ccggcgucacgcggccggg

SEQ ID NO: 369068 - RNA, 20 nt, Bordetella pertussis
ccggcguccacggcaucggc

SEQ ID NO: 369069 - RNA, 16 nt, Bordetella pertussis
ccggcgugacgcgcgg

SEQ ID NO: 369070 - RNA, 17 nt, Bordetella pertussis
ccggcgugacgcgcggg

SEQ ID NO: 369071 - RNA, 14 nt, Bordetella pertussis
ccggcgugacgcug

SEQ ID NO: 369072 - RNA, 17 nt, Bordetella pertussis
ccggcgugacgcugacc

SEQ ID NO: 369073 - RNA, 13 nt, Bordetella pertussis
ccggcgugacgug

SEQ ID NO: 369074 - RNA, 14 nt, Bordetella pertussis
ccggcgugagcgcc

SEQ ID NO: 369075 - RNA, 16 nt, Bordetella pertussis
ccggcucaggccagcg

SEQ ID NO: 369076 - RNA, 23 nt, Bordetella pertussis
ccggcucauucggcgcgcucggc

SEQ ID NO: 369077 - RNA, 22 nt, Bordetella pertussis
ccggcuccagucccgcaccggg

SEQ ID NO: 369078 - RNA, 18 nt, Bordetella pertussis
ccggcucccgcgcugccg

SEQ ID NO: 369079 - RNA, 23 nt, Bordetella pertussis
ccggcucccgcgcugccgcugca

SEQ ID NO: 369080 - RNA, 14 nt, Bordetella pertussis
ccggcucggcggca

SEQ ID NO: 369081 - RNA, 15 nt, Bordetella pertussis
ccggcucguacggcg

SEQ ID NO: 369082 - RNA, 19 nt, Bordetella pertussis
ccggcuggcaugcggcgga

SEQ ID NO: 369083 - RNA, 13 nt, Bordetella pertussis
ccggcugggcguu

SEQ ID NO: 369084 - RNA, 16 nt, Bordetella pertussis
ccgggaaguccgccgc

SEQ ID NO: 369085 - RNA, 14 nt, Bordetella pertussis
ccgggacaggcacc

SEQ ID NO: 369086 - RNA, 22 nt, Bordetella pertussis
ccgggauccacgccgccggcca

SEQ ID NO: 369087 - RNA, 20 nt, Bordetella pertussis
ccgggaugccguaggugcgc

SEQ ID NO: 369088 - RNA, 18 nt, Bordetella pertussis
ccgggcagcaucacggug

SEQ ID NO: 369089 - RNA, 13 nt, Bordetella pertussis
ccgggcagcccgc

SEQ ID NO: 369090 - RNA, 19 nt, Bordetella pertussis
ccgggcagcgggccgcagc

SEQ ID NO: 369091 - RNA, 12 nt, Bordetella pertussis
ccgggcaggccg

SEQ ID NO: 369092 - RNA, 14 nt, Bordetella pertussis
ccgggcaggccgcg

SEQ ID NO: 369093 - RNA, 20 nt, Bordetella pertussis
ccgggcaggcucagcccggc

SEQ ID NO: 369094 - RNA, 17 nt, Bordetella pertussis
ccgggcaugcaccaggc

SEQ ID NO: 369095 - RNA, 21 nt, Bordetella pertussis
ccgggcauugccggagcagca

SEQ ID NO: 369096 - RNA, 14 nt, Bordetella pertussis
ccgggccacgcgca

SEQ ID NO: 369097 - RNA, 16 nt, Bordetella pertussis
ccgggccacgcgcaca

SEQ ID NO: 369098 - RNA, 15 nt, Bordetella pertussis
ccgggcccgcgccga

SEQ ID NO: 369099 - RNA, 12 nt, Bordetella pertussis
ccgggccgcugg

SEQ ID NO: 369100 - RNA, 14 nt, Bordetella pertussis
ccgggccgcuggcc

SEQ ID NO: 369101 - RNA, 18 nt, Bordetella pertussis
ccgggccgcuggcccggg

SEQ ID NO: 369102 - RNA, 14 nt, Bordetella pertussis
ccgggccgcgccgc

SEQ ID NO: 369103 - RNA, 21 nt, Bordetella pertussis
ccgggccggccugcgucgcca

SEQ ID NO: 369104 - RNA, 13 nt, Bordetella pertussis
ccgggccggcggg

SEQ ID NO: 369105 - RNA, 16 nt, Bordetella pertussis
ccgggccgucgccgcg

SEQ ID NO: 369106 - RNA, 17 nt, Bordetella pertussis
ccgggccgucgccgcgc

SEQ ID NO: 369107 - RNA, 20 nt, Bordetella pertussis
ccgggccgucuacaggccca

SEQ ID NO: 369108 - RNA, 17 nt, Bordetella pertussis
ccgggccgugcgccggg

SEQ ID NO: 369109 - RNA, 14 nt, Bordetella pertussis
ccgggccuagcccg

SEQ ID NO: 369110 - RNA, 22 nt, Bordetella pertussis
ccgggccucaaucgaugaugug

SEQ ID NO: 369111 - RNA, 15 nt, Bordetella pertussis
ccgggcgcgcgccgg

SEQ ID NO: 369112 - RNA, 18 nt, Bordetella pertussis
ccgggcgcgcugcccagc

SEQ ID NO: 369113 - RNA, 13 nt, Bordetella pertussis
ccgggcgcgcugu

SEQ ID NO: 369114 - RNA, 16 nt, Bordetella pertussis
ccgggcgcggcccggc

SEQ ID NO: 369115 - RNA, 12 nt, Bordetella pertussis
ccgggcgcgcug

SEQ ID NO: 369116 - RNA, 15 nt, Bordetella pertussis
ccgggcgcuugccgu

SEQ ID NO: 369117 - RNA, 20 nt, Bordetella pertussis
ccgggcgugaacucggggug

SEQ ID NO: 369118 - RNA, 19 nt, Bordetella pertussis
ccgggcuccucgcccgacc

SEQ ID NO: 369119 - RNA, 18 nt, Bordetella pertussis
ccgggcucgaugaccagc

SEQ ID NO: 369120 - RNA, 15 nt, Bordetella pertussis
ccgggcucgcugacc

SEQ ID NO: 369121 - RNA, 14 nt, Bordetella pertussis
ccgggcucggccac

SEQ ID NO: 369122 - RNA, 22 nt, Bordetella pertussis
ccgggucgcugugcgcggcgaa

SEQ ID NO: 369123 - RNA, 21 nt, Bordetella pertussis
ccgggucgggcgucugcccgc

SEQ ID NO: 369124 - RNA, 13 nt, Bordetella pertussis
ccgggucgucggg

SEQ ID NO: 369125 - RNA, 19 nt, Bordetella pertussis
ccggguggguucgggcguu

SEQ ID NO: 369126 - RNA, 15 nt, Bordetella pertussis
ccgggugguccaugc

SEQ ID NO: 369127 - RNA, 14 nt, Bordetella pertussis
ccggguggucgcgc

SEQ ID NO: 369128 - RNA, 21 nt, Bordetella pertussis
ccggguguggggggucaggcc

SEQ ID NO: 369129 - RNA, 18 nt, Bordetella pertussis
ccggguguuccggcgcgc

SEQ ID NO: 369130 - RNA, 22 nt, Bordetella pertussis
ccggguuggcguccaggcgcgc

SEQ ID NO: 369131 - RNA, 15 nt, Bordetella pertussis
ccggguugucgccca

SEQ ID NO: 369132 - RNA, 15 nt, Bordetella pertussis
ccggguuuccagccc

SEQ ID NO: 369133 - RNA, 19 nt, Bordetella pertussis
ccggguuucucgacgcaau

SEQ ID NO: 369134 - RNA, 23 nt, Bordetella pertussis
ccggguuucucgacgcaaucggc

SEQ ID NO: 369135 - RNA, 22 nt, Bordetella pertussis
ccgguaaggcgcuugcgcaggg

SEQ ID NO: 369136 - RNA, 15 nt, Bordetella pertussis
ccgguacgccugcac

SEQ ID NO: 369137 - RNA, 16 nt, Bordetella pertussis
ccgguacgccugcacc

SEQ ID NO: 369138 - RNA, 21 nt, Bordetella pertussis
ccgguacgccugcaccgccgc

SEQ ID NO: 369139 - RNA, 13 nt, Bordetella pertussis
ccgguacgcgcag

SEQ ID NO: 369140 - RNA, 13 nt, Bordetella pertussis
ccgguagcgcugg

SEQ ID NO: 369141 - RNA, 22 nt, Bordetella pertussis
ccgguaggccuggucggggucg

SEQ ID NO: 369142 - RNA, 15 nt, Bordetella pertussis
ccgguagucgccggc

SEQ ID NO: 369143 - RNA, 17 nt, Bordetella pertussis
ccgguaucgacgcgcgu

SEQ ID NO: 369144 - RNA, 16 nt, Bordetella pertussis
ccgguaucgcggcgca

SEQ ID NO: 369145 - RNA, 15 nt, Bordetella pertussis
ccgguaugccugcca

SEQ ID NO: 369146 - RNA, 13 nt, Bordetella pertussis
ccggucagcaggg

SEQ ID NO: 369147 - RNA, 15 nt, Bordetella pertussis
ccggucagcccaggc

SEQ ID NO: 369148 - RNA, 18 nt, Bordetella pertussis
ccggucagcccaggcggg

SEQ ID NO: 369149 - RNA, 13 nt, Bordetella pertussis
ccggucaggaugc

SEQ ID NO: 369150 - RNA, 24 nt, Bordetella pertussis
ccggucaggaugcgcgccaggcug

SEQ ID NO: 369151 - RNA, 22 nt, Bordetella pertussis
ccggucagggaggcuguccccg

SEQ ID NO: 369152 - RNA, 23 nt, Bordetella pertussis
ccggucaugaaguccgacaggca

SEQ ID NO: 369153 - RNA, 23 nt, Bordetella pertussis
ccggucaugcaccugcaggguca

SEQ ID NO: 369154 - RNA, 12 nt, Bordetella pertussis
ccgguccagaug

SEQ ID NO: 369155 - RNA, 13 nt, Bordetella pertussis
ccgguccaggccg

SEQ ID NO: 369156 - RNA, 14 nt, Bordetella pertussis
ccgguccaggccga

SEQ ID NO: 369157 - RNA, 20 nt, Bordetella pertussis
ccgguccgacgguagccggg

SEQ ID NO: 369158 - RNA, 14 nt, Bordetella pertussis
ccgguccgccucgc

SEQ ID NO: 369159 - RNA, 18 nt, Bordetella pertussis
ccggucgacccucagccc

SEQ ID NO: 369160 - RNA, 23 nt, Bordetella pertussis
ccggucgacccucagcccgcacc

SEQ ID NO: 369161 - RNA, 18 nt, Bordetella pertussis
ccggucgaucagggcgcg

SEQ ID NO: 369162 - RNA, 18 nt, Bordetella pertussis
ccggucgcccgccgcgua

SEQ ID NO: 369163 - RNA, 22 nt, Bordetella pertussis
ccggucgcgauccggugaucau

SEQ ID NO: 369164 - RNA, 13 nt, Bordetella pertussis
ccggucgcgcgug

SEQ ID NO: 369165 - RNA, 20 nt, Bordetella pertussis
ccggucgcgcgugcaggccg

SEQ ID NO: 369166 - RNA, 14 nt, Bordetella pertussis
ccggucgcggcguu

SEQ ID NO: 369167 - RNA, 18 nt, Bordetella pertussis
ccggucggcccaggucau

SEQ ID NO: 369168 - RNA, 21 nt, Bordetella pertussis
ccggucuccagcgcgucggcc

SEQ ID NO: 369169 - RNA, 14 nt, Bordetella pertussis
ccggugaacaccag

SEQ ID NO: 369170 - RNA, 14 nt, Bordetella pertussis
ccggugaccgccag

SEQ ID NO: 369171 - RNA, 13 nt, Bordetella pertussis
ccggugccugccc

SEQ ID NO: 369172 - RNA, 19 nt, Bordetella pertussis
ccggugcgauagcgccgcg

SEQ ID NO: 369173 - RNA, 21 nt, Bordetella pertussis
ccggugcgcgcagggcggccg

SEQ ID NO: 369174 - RNA, 19 nt, Bordetella pertussis
ccgguggaaauacagaucg

SEQ ID NO: 369175 - RNA, 15 nt, Bordetella pertussis
ccggugggagccagu

SEQ ID NO: 369176 - RNA, 15 nt, Bordetella pertussis
ccgguggugcugcug

SEQ ID NO: 369177 - RNA, 21 nt, Bordetella pertussis
ccgguggugcugggcggcggg

SEQ ID NO: 369178 - RNA, 18 nt, Bordetella pertussis
ccgguggugucgaacagc

SEQ ID NO: 369179 - RNA, 20 nt, Bordetella pertussis
ccgguuccugcaaggccggc

SEQ ID NO: 369180 - RNA, 23 nt, Bordetella pertussis
ccgguuccugcaaggccggcggc

SEQ ID NO: 369181 - RNA, 14 nt, Bordetella pertussis
ccgguucgcccacc

SEQ ID NO: 369182 - RNA, 23 nt, Bordetella pertussis
ccguagcgcaucgcgaugcgcag

SEQ ID NO: 369183 - RNA, 19 nt, Bordetella pertussis
ccguagcgcgccagccgcg

SEQ ID NO: 369184 - RNA, 12 nt, Bordetella pertussis
ccguagcguugg

SEQ ID NO: 369185 - RNA, 20 nt, Bordetella pertussis
ccguagcguuggcggccggc

SEQ ID NO: 369186 - RNA, 17 nt, Bordetella pertussis
ccguaggcggcccaggc

SEQ ID NO: 369187 - RNA, 14 nt, Bordetella pertussis
ccguaggcgccggc

SEQ ID NO: 369188 - RNA, 21 nt, Bordetella pertussis
ccguauagcgguacucgcgcg

SEQ ID NO: 369189 - RNA, 22 nt, Bordetella pertussis
ccguauagcgguacucgcgcgg

SEQ ID NO: 369190 - RNA, 23 nt, Bordetella pertussis
ccguaguugaugcuugcuugcca

SEQ ID NO: 369191 - RNA, 14 nt, Bordetella pertussis
ccgucaccggcuac

SEQ ID NO: 369192 - RNA, 13 nt, Bordetella pertussis
ccgucacgcguga

SEQ ID NO: 369193 - RNA, 17 nt, Bordetella pertussis
ccgucacgcgcaaggcg

SEQ ID NO: 369194 - RNA, 14 nt, Bordetella pertussis
ccgucacgcgcugg

SEQ ID NO: 369195 - RNA, 14 nt, Bordetella pertussis
ccguccacgaaggc

SEQ ID NO: 369196 - RNA, 13 nt, Bordetella pertussis
ccguccacgccca

SEQ ID NO: 369197 - RNA, 14 nt, Bordetella pertussis
ccguccacgccgcg

SEQ ID NO: 369198 - RNA, 15 nt, Bordetella pertussis
ccguccacgccgcgc

SEQ ID NO: 369199 - RNA, 18 nt, Bordetella pertussis
ccguccacgccgcgcgcg

SEQ ID NO: 369200 - RNA, 20 nt, Bordetella pertussis
ccguccacgccgcgcgcguc

SEQ ID NO: 369201 - RNA, 15 nt, Bordetella pertussis
ccguccacggccugc

SEQ ID NO: 369202 - RNA, 22 nt, Bordetella pertussis
ccguccagcauuucucgggcgc

SEQ ID NO: 369203 - RNA, 15 nt, Bordetella pertussis
ccguccagcgcggca

SEQ ID NO: 369204 - RNA, 16 nt, Bordetella pertussis
ccguccagcgcggcgc

SEQ ID NO: 369205 - RNA, 21 nt, Bordetella pertussis
ccguccaggcgccgcacgccg

SEQ ID NO: 369206 - RNA, 19 nt, Bordetella pertussis
ccguccagucccguggcgc

SEQ ID NO: 369207 - RNA, 16 nt, Bordetella pertussis
ccguccggccgugccg

SEQ ID NO: 369208 - RNA, 12 nt, Bordetella pertussis
ccguccgggccg

SEQ ID NO: 369209 - RNA, 14 nt, Bordetella pertussis
ccguccgucgggca

SEQ ID NO: 369210 - RNA, 21 nt, Bordetella pertussis
ccguccuggcgaccggcggca

SEQ ID NO: 369211 - RNA, 19 nt, Bordetella pertussis
ccguccuuacuugcgcacg

SEQ ID NO: 369212 - RNA, 18 nt, Bordetella pertussis
ccguccuugagcgccagc

SEQ ID NO: 369213 - RNA, 19 nt, Bordetella pertussis
ccgucgaucccaucgcgcg

SEQ ID NO: 369214 - RNA, 18 nt, Bordetella pertussis
ccgucgaugaccagcgcc

SEQ ID NO: 369215 - RNA, 20 nt, Bordetella pertussis
ccgucgaugaccagcgccgg

SEQ ID NO: 369216 - RNA, 21 nt, Bordetella pertussis
ccgucgaugaccagcgccggc

SEQ ID NO: 369217 - RNA, 13 nt, Bordetella pertussis
ccgucgaugaugc

SEQ ID NO: 369218 - RNA, 16 nt, Bordetella pertussis
ccgucgauuucgggug

SEQ ID NO: 369219 - RNA, 12 nt, Bordetella pertussis
ccgucgccagcg

SEQ ID NO: 369220 - RNA, 15 nt, Bordetella pertussis
ccgucgccgaucggc

SEQ ID NO: 369221 - RNA, 15 nt, Bordetella pertussis
ccgucgccgcccaug

SEQ ID NO: 369222 - RNA, 22 nt, Bordetella pertussis
ccgucgccgcccaugcgcaugg

SEQ ID NO: 369223 - RNA, 18 nt, Bordetella pertussis
ccgucgccgcccugcugc

SEQ ID NO: 369224 - RNA, 16 nt, Bordetella pertussis
ccgucgccgcgcggcg

SEQ ID NO: 369225 - RNA, 14 nt, Bordetella pertussis
ccgucgcgccaggc

SEQ ID NO: 369226 - RNA, 16 nt, Bordetella pertussis
ccgucgcgccaggccg

SEQ ID NO: 369227 - RNA, 18 nt, Bordetella pertussis
ccgucgcgccaggccggc

SEQ ID NO: 369228 - RNA, 14 nt, Bordetella pertussis
ccgucgcgcgcacg

SEQ ID NO: 369229 - RNA, 21 nt, Bordetella pertussis
ccgucgcgcucggacgccgcg

SEQ ID NO: 369230 - RNA, 22 nt, Bordetella pertussis
ccgucgcgcucggacgccgcgc

SEQ ID NO: 369231 - RNA, 23 nt, Bordetella pertussis
ccgucgcgcugcaauugcgcggc

SEQ ID NO: 369232 - RNA, 22 nt, Bordetella pertussis
ccgucgcgcucgagcaucuggc

SEQ ID NO: 369233 - RNA, 12 nt, Bordetella pertussis
ccgucgggacag

SEQ ID NO: 369234 - RNA, 16 nt, Bordetella pertussis
ccgucgggcaggucgg

SEQ ID NO: 369235 - RNA, 21 nt, Bordetella pertussis
ccgucgggcgccgcaacgccg

SEQ ID NO: 369236 - RNA, 15 nt, Bordetella pertussis
ccgucgggguggcgu

SEQ ID NO: 369237 - RNA, 15 nt, Bordetella pertussis
ccgucgugcgccugg

SEQ ID NO: 369238 - RNA, 16 nt, Bordetella pertussis
ccgucguugacgggga

SEQ ID NO: 369239 - RNA, 13 nt, Bordetella pertussis
ccgucuacaggcc

SEQ ID NO: 369240 - RNA, 17 nt, Bordetella pertussis
ccgucucgaacgccgcg

SEQ ID NO: 369241 - RNA, 18 nt, Bordetella pertussis
ccgugaccugcgucugcg

SEQ ID NO: 369242 - RNA, 19 nt, Bordetella pertussis
ccgugaccugcucgucgcc

SEQ ID NO: 369243 - RNA, 20 nt, Bordetella pertussis
ccgugaccugcucgucgcca

SEQ ID NO: 369244 - RNA, 20 nt, Bordetella pertussis
ccgugacgcugauggccgcc

SEQ ID NO: 369245 - RNA, 18 nt, Bordetella pertussis
ccgugacguugagcgccg

SEQ ID NO: 369246 - RNA, 20 nt, Bordetella pertussis
ccgugacguugagcgccggg

SEQ ID NO: 369247 - RNA, 18 nt, Bordetella pertussis
ccgugacuucggccgcca

SEQ ID NO: 369248 - RNA, 13 nt, Bordetella pertussis
ccgugagcgccgc

SEQ ID NO: 369249 - RNA, 19 nt, Bordetella pertussis
ccgugauauagaccagcag

SEQ ID NO: 369250 - RNA, 23 nt, Bordetella pertussis
ccgugaucuugaugccgcccagc

SEQ ID NO: 369251 - RNA, 15 nt, Bordetella pertussis
ccgugaugccgcccg

SEQ ID NO: 369252 - RNA, 15 nt, Bordetella pertussis
ccgugaugcgcgccg

SEQ ID NO: 369253 - RNA, 16 nt, Bordetella pertussis
ccgugaugcgcgccgc

SEQ ID NO: 369254 - RNA, 20 nt, Bordetella pertussis
ccgugcagacggcggcugga

SEQ ID NO: 369255 - RNA, 16 nt, Bordetella pertussis
ccgugcaucggcacgg

SEQ ID NO: 369256 - RNA, 16 nt, Bordetella pertussis
ccgugcgaggcgaaca

SEQ ID NO: 369257 - RNA, 21 nt, Bordetella pertussis
ccgugcgaggcgaacaggcac

SEQ ID NO: 369258 - RNA, 22 nt, Bordetella pertussis
ccgugcgcaacgcgcgcgcgca

SEQ ID NO: 369259 - RNA, 18 nt, Bordetella pertussis
ccgugcgccagcgccagc

SEQ ID NO: 369260 - RNA, 19 nt, Bordetella pertussis
ccgugcgcggcgagccgcg

SEQ ID NO: 369261 - RNA, 19 nt, Bordetella pertussis
ccgugcgcgggcgcggcag

SEQ ID NO: 369262 - RNA, 20 nt, Bordetella pertussis
ccgugcgcgggcgcggcagg

SEQ ID NO: 369263 - RNA, 22 nt, Bordetella pertussis
ccgugcgcgggcgcggcaggcg

SEQ ID NO: 369264 - RNA, 21 nt, Bordetella pertussis
ccgugcgggccugcaguucgg

SEQ ID NO: 369265 - RNA, 18 nt, Bordetella pertussis
ccgugcggggaccggcac

SEQ ID NO: 369266 - RNA, 23 nt, Bordetella pertussis
ccguggcggguccacguggcgac

SEQ ID NO: 369267 - RNA, 16 nt, Bordetella pertussis
ccguggcgugcaggcc

SEQ ID NO: 369268 - RNA, 18 nt, Bordetella pertussis
ccguggcgugcaggccgg

SEQ ID NO: 369269 - RNA, 23 nt, Bordetella pertussis
ccguggcguugacggcccagcuc

SEQ ID NO: 369270 - RNA, 20 nt, Bordetella pertussis
ccguggcugaaaucccccgc

SEQ ID NO: 369271 - RNA, 18 nt, Bordetella pertussis
ccgugggacaggcacccu

SEQ ID NO: 369272 - RNA, 18 nt, Bordetella pertussis
ccguggggacaggcaccu

SEQ ID NO: 369273 - RNA, 14 nt, Bordetella pertussis
ccgugguacgugga

SEQ ID NO: 369274 - RNA, 16 nt, Bordetella pertussis
ccguggucgccagcac

SEQ ID NO: 369275 - RNA, 23 nt, Bordetella pertussis
ccguggucgccagcacgcgcagc

SEQ ID NO: 369276 - RNA, 17 nt, Bordetella pertussis
ccguucggugcgcagcg

SEQ ID NO: 369277 - RNA, 16 nt, Bordetella pertussis
ccguucucaggccgag

SEQ ID NO: 369278 - RNA, 12 nt, Bordetella pertussis
ccguucuggcag

SEQ ID NO: 369279 - RNA, 20 nt, Bordetella pertussis
ccguucuggcugcgcgccug

SEQ ID NO: 369280 - RNA, 16 nt, Bordetella pertussis
ccguugcagcccagcg

SEQ ID NO: 369281 - RNA, 21 nt, Bordetella pertussis
ccguugcccagauccagcuug

SEQ ID NO: 369282 - RNA, 14 nt, Bordetella pertussis
ccguugccgcgcgc

SEQ ID NO: 369283 - RNA, 15 nt, Bordetella pertussis
ccguugccgcgcgcg

SEQ ID NO: 369284 - RNA, 16 nt, Bordetella pertussis
ccguugccgcgcgcga

SEQ ID NO: 369285 - RNA, 14 nt, Bordetella pertussis
ccguugcgccugcc

SEQ ID NO: 369286 - RNA, 23 nt, Bordetella pertussis
ccguuggcaggccagcauggccg

SEQ ID NO: 369287 - RNA, 15 nt, Bordetella pertussis
ccguuggccgcgcgg

SEQ ID NO: 369288 - RNA, 23 nt, Bordetella pertussis
ccguuggcgauggcgcggccgga

SEQ ID NO: 369289 - RNA, 15 nt, Bordetella pertussis
ccguuggcgcccagc

SEQ ID NO: 369290 - RNA, 18 nt, Bordetella pertussis
ccguuggcgcccagcgcc

SEQ ID NO: 369291 - RNA, 15 nt, Bordetella pertussis
ccguuguccgccugc

SEQ ID NO: 369292 - RNA, 21 nt, Bordetella pertussis
ccguuuacuccccagacgcag

SEQ ID NO: 369293 - RNA, 18 nt, Bordetella pertussis
ccguuucguaaggcugcg

SEQ ID NO: 369294 - RNA, 14 nt, Bordetella pertussis
ccguuucgucggcg

SEQ ID NO: 369295 - RNA, 14 nt, Bordetella pertussis
ccguuugcgcagcu

SEQ ID NO: 369296 - RNA, 22 nt, Bordetella pertussis
ccguuuuauuuggcaaggcccg

SEQ ID NO: 369297 - RNA, 20 nt, Bordetella pertussis
ccuaaauugccgcgaggcgc

SEQ ID NO: 369298 - RNA, 16 nt, Bordetella pertussis
ccuaugaagacgcgcu

SEQ ID NO: 369299 - RNA, 19 nt, Bordetella pertussis
ccuaugaagacgcgcucgc

SEQ ID NO: 369300 - RNA, 16 nt, Bordetella pertussis
ccuauguaggcgccgc

SEQ ID NO: 369301 - RNA, 15 nt, Bordetella pertussis
ccucaaccgcgcgua

SEQ ID NO: 369302 - RNA, 23 nt, Bordetella pertussis
ccucaaccuucucgaugcgcgcc

SEQ ID NO: 369303 - RNA, 15 nt, Bordetella pertussis
ccucaacuggccggc

SEQ ID NO: 369304 - RNA, 19 nt, Bordetella pertussis
ccucacuccauagcgccgc

SEQ ID NO: 369305 - RNA, 21 nt, Bordetella pertussis
ccuccagcagggacuugggca

SEQ ID NO: 369306 - RNA, 18 nt, Bordetella pertussis
ccuccagcaucgccgcca

SEQ ID NO: 369307 - RNA, 18 nt, Bordetella pertussis
ccuccagcuccagcgcgc

SEQ ID NO: 369308 - RNA, 14 nt, Bordetella pertussis
ccuccaggcccagg

SEQ ID NO: 369309 - RNA, 21 nt, Bordetella pertussis
ccuccaggcggcggugccagc

SEQ ID NO: 369310 - RNA, 22 nt, Bordetella pertussis
ccucccagaaacuggcgcugcc

SEQ ID NO: 369311 - RNA, 14 nt, Bordetella pertussis
ccuccgacaggcgc

SEQ ID NO: 369312 - RNA, 16 nt, Bordetella pertussis
ccuccgacaggcgccg

SEQ ID NO: 369313 - RNA, 14 nt, Bordetella pertussis
ccucgaagcccggc

SEQ ID NO: 369314 - RNA, 19 nt, Bordetella pertussis
ccucgaccagcccggccgc

SEQ ID NO: 369315 - RNA, 20 nt, Bordetella pertussis
ccucgaccagcccggccgcc

SEQ ID NO: 369316 - RNA, 21 nt, Bordetella pertussis
ccucgaccagcccggccgcca

SEQ ID NO: 369317 - RNA, 13 nt, Bordetella pertussis
ccucgaccggcga

SEQ ID NO: 369318 - RNA, 23 nt, Bordetella pertussis
ccucgacgaugcccugcgccagc

SEQ ID NO: 369319 - RNA, 24 nt, Bordetella pertussis
ccucgacgaugcccugcgccagcg

SEQ ID NO: 369320 - RNA, 13 nt, Bordetella pertussis
ccucgacgcgcau

SEQ ID NO: 369321 - RNA, 13 nt, Bordetella pertussis
ccucgacggccgc

SEQ ID NO: 369322 - RNA, 14 nt, Bordetella pertussis
ccucgacggccgcc

SEQ ID NO: 369323 - RNA, 22 nt, Bordetella pertussis
ccucgacgggauccucgcucuu

SEQ ID NO: 369324 - RNA, 19 nt, Bordetella pertussis
ccucgacguaagugcccag

SEQ ID NO: 369325 - RNA, 17 nt, Bordetella pertussis
ccucgcugccagggugc

SEQ ID NO: 369326 - RNA, 18 nt, Bordetella pertussis
ccucgcuggagaccggca

SEQ ID NO: 369327 - RNA, 19 nt, Bordetella pertussis
ccucgcuggagaccggcau

SEQ ID NO: 369328 - RNA, 21 nt, Bordetella pertussis
ccucgcuggagaccggcaugg

SEQ ID NO: 369329 - RNA, 13 nt, Bordetella pertussis
ccucgcuggcgaa

SEQ ID NO: 369330 - RNA, 13 nt, Bordetella pertussis
ccucgcugcgggc

SEQ ID NO: 369331 - RNA, 14 nt, Bordetella pertussis
ccucgcugcgggcg

SEQ ID NO: 369332 - RNA, 23 nt, Bordetella pertussis
ccucggacgagacaggcgcgcca

SEQ ID NO: 369333 - RNA, 14 nt, Bordetella pertussis
ccucggcacggcca

SEQ ID NO: 369334 - RNA, 17 nt, Bordetella pertussis
ccucggcauggcgcgcg

SEQ ID NO: 369335 - RNA, 18 nt, Bordetella pertussis
ccucggcauggcgcgcgc

SEQ ID NO: 369336 - RNA, 12 nt, Bordetella pertussis
ccucggccucgc

SEQ ID NO: 369337 - RNA, 15 nt, Bordetella pertussis
ccucggccugccggc

SEQ ID NO: 369338 - RNA, 15 nt, Bordetella pertussis
ccucggccugcgguu

SEQ ID NO: 369339 - RNA, 18 nt, Bordetella pertussis
ccucggcgaagugcccgc

SEQ ID NO: 369340 - RNA, 18 nt, Bordetella pertussis
ccucggcgggcggcgcca

SEQ ID NO: 369341 - RNA, 16 nt, Bordetella pertussis
ccucggcuugcgcggc

SEQ ID NO: 369342 - RNA, 18 nt, Bordetella pertussis
ccucggcuugcgcggcgc

SEQ ID NO: 369343 - RNA, 12 nt, Bordetella pertussis
ccucggcgucgc

SEQ ID NO: 369344 - RNA, 23 nt, Bordetella pertussis
ccucgggcgacaggcgcgcccgc

SEQ ID NO: 369345 - RNA, 18 nt, Bordetella pertussis
ccucggggcgcggccggu

SEQ ID NO: 369346 - RNA, 13 nt, Bordetella pertussis
ccucguaucgccu

SEQ ID NO: 369347 - RNA, 23 nt, Bordetella pertussis
ccucguccgucucgcccaggccc

SEQ ID NO: 369348 - RNA, 17 nt, Bordetella pertussis
ccucguccucgucggcg

SEQ ID NO: 369349 - RNA, 16 nt, Bordetella pertussis
ccucguccugcaggcg

SEQ ID NO: 369350 - RNA, 20 nt, Bordetella pertussis
ccucgucgcgcaacgccggg

SEQ ID NO: 369351 - RNA, 19 nt, Bordetella pertussis
ccucgucggccaugcgcgc

SEQ ID NO: 369352 - RNA, 11 nt, Bordetella pertussis
ccugaccggcg

SEQ ID NO: 369353 - RNA, 16 nt, Bordetella pertussis
ccugacgccugcgccg

SEQ ID NO: 369354 - RNA, 21 nt, Bordetella pertussis
ccugacgcgcaagcggcccca

SEQ ID NO: 369355 - RNA, 21 nt, Bordetella pertussis
ccugacgcucauccaggcgcg

SEQ ID NO: 369356 - RNA, 22 nt, Bordetella pertussis
ccugacggccccguugucgccg

SEQ ID NO: 369357 - RNA, 23 nt, Bordetella pertussis
ccugagcacaugcccggccacca

SEQ ID NO: 369358 - RNA, 20 nt, Bordetella pertussis
ccugagccgauacaggcgcu

SEQ ID NO: 369359 - RNA, 16 nt, Bordetella pertussis
ccugaggccaggccgg

SEQ ID NO: 369360 - RNA, 18 nt, Bordetella pertussis
ccugaggccaggccggau

SEQ ID NO: 369361 - RNA, 17 nt, Bordetella pertussis
ccugcaaccagcucagc

SEQ ID NO: 369362 - RNA, 20 nt, Bordetella pertussis
ccugcaaccagcucagcuug

SEQ ID NO: 369363 - RNA, 19 nt, Bordetella pertussis
ccugcaaccccaccggcaa

SEQ ID NO: 369364 - RNA, 24 nt, Bordetella pertussis
ccugcaacuggugcacgaugccca

SEQ ID NO: 369365 - RNA, 16 nt, Bordetella pertussis
ccugcaaggccggcgg

SEQ ID NO: 369366 - RNA, 20 nt, Bordetella pertussis
ccugcaaggccggcggcacg

SEQ ID NO: 369367 - RNA, 14 nt, Bordetella pertussis
ccugcaccgccgcg

SEQ ID NO: 369368 - RNA, 16 nt, Bordetella pertussis
ccugcaccgucacgcg

SEQ ID NO: 369369 - RNA, 22 nt, Bordetella pertussis
ccugcaccucaggaugcccggg

SEQ ID NO: 369370 - RNA, 23 nt, Bordetella pertussis
ccugcacgaagcggaugcgccgc

SEQ ID NO: 369371 - RNA, 12 nt, Bordetella pertussis
ccugcacgcgcg

SEQ ID NO: 369372 - RNA, 22 nt, Bordetella pertussis
ccugcaggaaauacucgagccg

SEQ ID NO: 369373 - RNA, 23 nt, Bordetella pertussis
ccugcaggaacucgcacacgcgc

SEQ ID NO: 369374 - RNA, 20 nt, Bordetella pertussis
ccugcaggaagccugcgcgc

SEQ ID NO: 369375 - RNA, 18 nt, Bordetella pertussis
ccugcaggaaggccgccg

SEQ ID NO: 369376 - RNA, 19 nt, Bordetella pertussis
ccugcaggaaggccgccgc

SEQ ID NO: 369377 - RNA, 22 nt, Bordetella pertussis
ccugcaggaaggccgccgcgug

SEQ ID NO: 369378 - RNA, 22 nt, Bordetella pertussis
ccugcaggaugggccguccggc

SEQ ID NO: 369379 - RNA, 13 nt, Bordetella pertussis
ccugcaggcccag

SEQ ID NO: 369380 - RNA, 22 nt, Bordetella pertussis
ccugcaggcccagcacgcgcgc

SEQ ID NO: 369381 - RNA, 14 nt, Bordetella pertussis
ccugcaggcccggc

SEQ ID NO: 369382 - RNA, 17 nt, Bordetella pertussis
ccugcaggcccggcgcg

SEQ ID NO: 369383 - RNA, 13 nt, Bordetella pertussis
ccugcaggccgcc

SEQ ID NO: 369384 - RNA, 14 nt, Bordetella pertussis
ccugcaggccgccg

SEQ ID NO: 369385 - RNA, 18 nt, Bordetella pertussis
ccugcaggccgccggcca

SEQ ID NO: 369386 - RNA, 12 nt, Bordetella pertussis
ccugcaggccgg

SEQ ID NO: 369387 - RNA, 15 nt, Bordetella pertussis
ccugcaggcggcgca

SEQ ID NO: 369388 - RNA, 22 nt, Bordetella pertussis
ccugcagggcgucugcucgccg

SEQ ID NO: 369389 - RNA, 20 nt, Bordetella pertussis
ccugcagggucagcccgcca

SEQ ID NO: 369390 - RNA, 22 nt, Bordetella pertussis
ccugcagggucagcccgccauc

SEQ ID NO: 369391 - RNA, 23 nt, Bordetella pertussis
ccugcagggucagcccgccaucg

SEQ ID NO: 369392 - RNA, 12 nt, Bordetella pertussis
ccugcagggcgu

SEQ ID NO: 369393 - RNA, 15 nt, Bordetella pertussis
ccugcaguucggccg

SEQ ID NO: 369394 - RNA, 18 nt, Bordetella pertussis
ccugcaguucggccgcca

SEQ ID NO: 369395 - RNA, 16 nt, Bordetella pertussis
ccugcgacagcaccgg

SEQ ID NO: 369396 - RNA, 16 nt, Bordetella pertussis
ccugcgaugccggcgu

SEQ ID NO: 369397 - RNA, 21 nt, Bordetella pertussis
ccugcgaugccggcguggcgc

SEQ ID NO: 369398 - RNA, 15 nt, Bordetella pertussis
ccugcgcaccggccg

SEQ ID NO: 369399 - RNA, 17 nt, Bordetella pertussis
ccugcgcaccggccggc

SEQ ID NO: 369400 - RNA, 19 nt, Bordetella pertussis
ccugcgcaccggccggccg

SEQ ID NO: 369401 - RNA, 15 nt, Bordetella pertussis
ccugcgccaccgcau

SEQ ID NO: 369402 - RNA, 13 nt, Bordetella pertussis
ccugcgccaccug

SEQ ID NO: 369403 - RNA, 20 nt, Bordetella pertussis
ccugcgccaccuggcgcccg

SEQ ID NO: 369404 - RNA, 22 nt, Bordetella pertussis
ccugcgccacguccagcacggc

SEQ ID NO: 369405 - RNA, 15 nt, Bordetella pertussis
ccugcgccagccgcg

SEQ ID NO: 369406 - RNA, 17 nt, Bordetella pertussis
ccugcgccagccgcgcc

SEQ ID NO: 369407 - RNA, 13 nt, Bordetella pertussis
ccugcgccagcgc

SEQ ID NO: 369408 - RNA, 23 nt, Bordetella pertussis
ccugcgccagcgccucgcgcucg

SEQ ID NO: 369409 - RNA, 19 nt, Bordetella pertussis
ccugcgcaucgaucagcgc

SEQ ID NO: 369410 - RNA, 15 nt, Bordetella pertussis
ccugcgccaggugcu

SEQ ID NO: 369411 - RNA, 17 nt, Bordetella pertussis
ccugcgccaggugcuug

SEQ ID NO: 369412 - RNA, 20 nt, Bordetella pertussis
ccugcgccgaggcgggcagc

SEQ ID NO: 369413 - RNA, 11 nt, Bordetella pertussis
ccugcgccgcc

SEQ ID NO: 369414 - RNA, 14 nt, Bordetella pertussis
ccugcgccgccgcg

SEQ ID NO: 369415 - RNA, 16 nt, Bordetella pertussis
ccugcgccgggcgcgg

SEQ ID NO: 369416 - RNA, 20 nt, Bordetella pertussis
ccugcgccggguccggccgc

SEQ ID NO: 369417 - RNA, 17 nt, Bordetella pertussis
ccugcgccgucugcgcc

SEQ ID NO: 369418 - RNA, 20 nt, Bordetella pertussis
ccugcgccgucugcgccgcc

SEQ ID NO: 369419 - RNA, 23 nt, Bordetella pertussis
ccugcgccgucugcgccgccgcg

SEQ ID NO: 369420 - RNA, 18 nt, Bordetella pertussis
ccugcgcgaugcgcgcgc

SEQ ID NO: 369421 - RNA, 19 nt, Bordetella pertussis
ccugcgcgaugcgcgcgcg

SEQ ID NO: 369422 - RNA, 16 nt, Bordetella pertussis
ccugcgcgaccgccgc

SEQ ID NO: 369423 - RNA, 15 nt, Bordetella pertussis
ccugcgcgccgccgg

SEQ ID NO: 369424 - RNA, 23 nt, Bordetella pertussis
ccugcgcgccgccucgauugacc

SEQ ID NO: 369425 - RNA, 13 nt, Bordetella pertussis
ccugcgcgccggc

SEQ ID NO: 369426 - RNA, 16 nt, Bordetella pertussis
ccugcgcgccggcaug

SEQ ID NO: 369427 - RNA, 17 nt, Bordetella pertussis
ccugcgcgccggcaugg

SEQ ID NO: 369428 - RNA, 14 nt, Bordetella pertussis
ccugcgcgcgcugg

SEQ ID NO: 369429 - RNA, 19 nt, Bordetella pertussis
ccugcgcgccgaccagguc

SEQ ID NO: 369430 - RNA, 21 nt, Bordetella pertussis
ccugcgcugcauacgccgcug

SEQ ID NO: 369431 - RNA, 16 nt, Bordetella pertussis
ccugcgcguacguggc

SEQ ID NO: 369432 - RNA, 18 nt, Bordetella pertussis
ccugcggacccaguucgg

SEQ ID NO: 369433 - RNA, 18 nt, Bordetella pertussis
ccugcggcagcgacucgc

SEQ ID NO: 369434 - RNA, 14 nt, Bordetella pertussis
ccugcggcaggccg

SEQ ID NO: 369435 - RNA, 16 nt, Bordetella pertussis
ccugcggcaggccgca

SEQ ID NO: 369436 - RNA, 19 nt, Bordetella pertussis
ccugcggcgccagcgccgc

SEQ ID NO: 369437 - RNA, 13 nt, Bordetella pertussis
ccugcggcgcggc

SEQ ID NO: 369438 - RNA, 15 nt, Bordetella pertussis
ccugcggcgcggcca

SEQ ID NO: 369439 - RNA, 23 nt, Bordetella pertussis
ccugcggcgcggccgacguggac

SEQ ID NO: 369440 - RNA, 17 nt, Bordetella pertussis
ccugcggcggcagcuug

SEQ ID NO: 369441 - RNA, 16 nt, Bordetella pertussis
ccugcggcgucaggcc

SEQ ID NO: 369442 - RNA, 22 nt, Bordetella pertussis
ccugcgggccgggcaggccgcg

SEQ ID NO: 369443 - RNA, 18 nt, Bordetella pertussis
ccugcgggcgcagcgccg

SEQ ID NO: 369444 - RNA, 14 nt, Bordetella pertussis
ccugcgggcgccgc

SEQ ID NO: 369445 - RNA, 15 nt, Bordetella pertussis
ccugcgggcgccgcg

SEQ ID NO: 369446 - RNA, 22 nt, Bordetella pertussis
ccugcgggcugaugcaggccug

SEQ ID NO: 369447 - RNA, 15 nt, Bordetella pertussis
ccugcguccagccga

SEQ ID NO: 369448 - RNA, 16 nt, Bordetella pertussis
ccugcguccagccgag

SEQ ID NO: 369449 - RNA, 17 nt, Bordetella pertussis
ccugcgucugcgugccg

SEQ ID NO: 369450 - RNA, 15 nt, Bordetella pertussis
ccugcgugauggcgu

SEQ ID NO: 369451 - RNA, 15 nt, Bordetella pertussis
ccugcguggccgcgu

SEQ ID NO: 369452 - RNA, 21 nt, Bordetella pertussis
ccugcguggcgcagugggcca

SEQ ID NO: 369453 - RNA, 17 nt, Bordetella pertussis
ccugcguggcgggccgc

SEQ ID NO: 369454 - RNA, 19 nt, Bordetella pertussis
ccugcguggcgggccgcgc

SEQ ID NO: 369455 - RNA, 22 nt, Bordetella pertussis
ccugcguggcgggccgcgccgc

SEQ ID NO: 369456 - RNA, 23 nt, Bordetella pertussis
ccugcguggcgggccgcgccgcg

SEQ ID NO: 369457 - RNA, 15 nt, Bordetella pertussis
ccugcucacgccccg

SEQ ID NO: 369458 - RNA, 20 nt, Bordetella pertussis
ccugcucccacgaacgccac

SEQ ID NO: 369459 - RNA, 22 nt, Bordetella pertussis
ccugcucgcccacauagcggcc

SEQ ID NO: 369460 - RNA, 22 nt, Bordetella pertussis
ccugcucgccggccagcgcggu

SEQ ID NO: 369461 - RNA, 15 nt, Bordetella pertussis
ccugcucgcgcagcg

SEQ ID NO: 369462 - RNA, 20 nt, Bordetella pertussis
ccugcucggugcucuggccc

SEQ ID NO: 369463 - RNA, 20 nt, Bordetella pertussis
ccugcugcaauucgccgaug

SEQ ID NO: 369464 - RNA, 15 nt, Bordetella pertussis
ccugcugcccgccgc

SEQ ID NO: 369465 - RNA, 12 nt, Bordetella pertussis
ccugcugcgccu

SEQ ID NO: 369466 - RNA, 13 nt, Bordetella pertussis
ccugcugcggcac

SEQ ID NO: 369467 - RNA, 18 nt, Bordetella pertussis
ccugcugcggcacggcca

SEQ ID NO: 369468 - RNA, 14 nt, Bordetella pertussis
ccugcuggccgccg

SEQ ID NO: 369469 - RNA, 16 nt, Bordetella pertussis
ccugcuggccgccggc

SEQ ID NO: 369470 - RNA, 21 nt, Bordetella pertussis
ccugcuggcguuugcgcgcgc

SEQ ID NO: 369471 - RNA, 22 nt, Bordetella pertussis
ccugcuggcguuugcgcgcgcg

SEQ ID NO: 369472 - RNA, 17 nt, Bordetella pertussis
ccugcuggcgcgcacca

SEQ ID NO: 369473 - RNA, 22 nt, Bordetella pertussis
ccugcugugccccacacgcgcg

SEQ ID NO: 369474 - RNA, 21 nt, Bordetella pertussis
ccugcugugcgauggcacggc

SEQ ID NO: 369475 - RNA, 16 nt, Bordetella pertussis
ccugcuggucggcgug

SEQ ID NO: 369476 - RNA, 13 nt, Bordetella pertussis
ccugcugguggcg

SEQ ID NO: 369477 - RNA, 23 nt, Bordetella pertussis
ccugcugggguggagcgcggcgc

SEQ ID NO: 369478 - RNA, 16 nt, Bordetella pertussis
ccugcuugaagacgcc

SEQ ID NO: 369479 - RNA, 20 nt, Bordetella pertussis
ccugcuugaagacgcccagg

SEQ ID NO: 369480 - RNA, 14 nt, Bordetella pertussis
ccugcuuggccgcg

SEQ ID NO: 369481 - RNA, 15 nt, Bordetella pertussis
ccugcuuggcgcgca

SEQ ID NO: 369482 - RNA, 17 nt, Bordetella pertussis
ccugcuuggcgcgcagc

SEQ ID NO: 369483 - RNA, 18 nt, Bordetella pertussis
ccugcuuguacaggcgcg

SEQ ID NO: 369484 - RNA, 21 nt, Bordetella pertussis
ccugcuuguacaggcgcggca

SEQ ID NO: 369485 - RNA, 20 nt, Bordetella pertussis
ccuggaacuugggaucggcc

SEQ ID NO: 369486 - RNA, 19 nt, Bordetella pertussis
ccuggaagugaugccgccg

SEQ ID NO: 369487 - RNA, 23 nt, Bordetella pertussis
ccuggaagugaugccgccggcgg

SEQ ID NO: 369488 - RNA, 18 nt, Bordetella pertussis
ccuggacagugcccugac

SEQ ID NO: 369489 - RNA, 20 nt, Bordetella pertussis
ccuggacgcgcuggccgaca

SEQ ID NO: 369490 - RNA, 14 nt, Bordetella pertussis
ccuggacgggcugg

SEQ ID NO: 369491 - RNA, 15 nt, Bordetella pertussis
ccuggacggggugcg

SEQ ID NO: 369492 - RNA, 22 nt, Bordetella pertussis
ccuggaccugacccccgaacug

SEQ ID NO: 369493 - RNA, 16 nt, Bordetella pertussis
ccuggagcuuggccgg

SEQ ID NO: 369494 - RNA, 16 nt, Bordetella pertussis
ccuggaggccgagcgc

SEQ ID NO: 369495 - RNA, 19 nt, Bordetella pertussis
ccuggaggccgagcgcgag

SEQ ID NO: 369496 - RNA, 21 nt, Bordetella pertussis
ccuggaggccgagcgcgagca

SEQ ID NO: 369497 - RNA, 22 nt, Bordetella pertussis
ccuggaucacgugccagccgaa

SEQ ID NO: 369498 - RNA, 24 nt, Bordetella pertussis
ccuggaucaggaugggcgcggcgc

SEQ ID NO: 369499 - RNA, 16 nt, Bordetella pertussis
ccuggaucagggugag

SEQ ID NO: 369500 - RNA, 18 nt, Bordetella pertussis
ccuggauggcggccgcca

SEQ ID NO: 369501 - RNA, 20 nt, Bordetella pertussis
ccuggauggcggccgccagc

SEQ ID NO: 369502 - RNA, 21 nt, Bordetella pertussis
ccuggaugugcgcgggcgcgg

SEQ ID NO: 369503 - RNA, 22 nt, Bordetella pertussis
ccuggaugugcgcgggcgcggg

SEQ ID NO: 369504 - RNA, 17 nt, Bordetella pertussis
ccuggcaaugcguggcc

SEQ ID NO: 369505 - RNA, 20 nt, Bordetella pertussis
ccuggcaaugcguggccggc

SEQ ID NO: 369506 - RNA, 18 nt, Bordetella pertussis
ccuggcaaggggguucgc

SEQ ID NO: 369507 - RNA, 17 nt, Bordetella pertussis
ccuggcacgacguggcc

SEQ ID NO: 369508 - RNA, 20 nt, Bordetella pertussis
ccuggcagaugcgcgccagg

SEQ ID NO: 369509 - RNA, 22 nt, Bordetella pertussis
ccuggcagaugcgcgccaggcg

SEQ ID NO: 369510 - RNA, 23 nt, Bordetella pertussis
ccuggcagaugcgcgccaggcgc

SEQ ID NO: 369511 - RNA, 13 nt, Bordetella pertussis
ccuggcagcuggc

SEQ ID NO: 369512 - RNA, 20 nt, Bordetella pertussis
ccuggccacaagcggcccca

SEQ ID NO: 369513 - RNA, 19 nt, Bordetella pertussis
ccuggccagauagcccagg

SEQ ID NO: 369514 - RNA, 21 nt, Bordetella pertussis
ccuggccagauagcccaggcg

SEQ ID NO: 369515 - RNA, 16 nt, Bordetella pertussis
ccuggcauugagcacu

SEQ ID NO: 369516 - RNA, 23 nt, Bordetella pertussis
ccuggcccacaucgucgcgcugg

SEQ ID NO: 369517 - RNA, 13 nt, Bordetella pertussis
ccuggcccagcuc

SEQ ID NO: 369518 - RNA, 20 nt, Bordetella pertussis
ccuggcccaugaacaggcac

SEQ ID NO: 369519 - RNA, 15 nt, Bordetella pertussis
ccugucgcgcugcuu

SEQ ID NO: 369520 - RNA, 19 nt, Bordetella pertussis
ccugucggccgaaccgcgc

SEQ ID NO: 369521 - RNA, 22 nt, Bordetella pertussis
ccugucggugaugauccugcug

SEQ ID NO: 369522 - RNA, 14 nt, Bordetella pertussis
ccugugggggacag

SEQ ID NO: 369523 - RNA, 22 nt, Bordetella pertussis
ccuguucgcggugucgcaccgc

SEQ ID NO: 369524 - RNA, 14 nt, Bordetella pertussis
ccuguucggccacg

SEQ ID NO: 369525 - RNA, 14 nt, Bordetella pertussis
ccuguucggccggg

SEQ ID NO: 369526 - RNA, 18 nt, Bordetella pertussis
ccuuacgcggcgcgcgcc

SEQ ID NO: 369527 - RNA, 20 nt, Bordetella pertussis
ccuucccgcuuuccgccgag

SEQ ID NO: 369528 - RNA, 21 nt, Bordetella pertussis
ccuuccuccgacaggcgccgc

SEQ ID NO: 369529 - RNA, 17 nt, Bordetella pertussis
ccuuccugggcgccggc

SEQ ID NO: 369530 - RNA, 18 nt, Bordetella pertussis
ccuucgacggcgggaccg

SEQ ID NO: 369531 - RNA, 13 nt, Bordetella pertussis
ccuucgaggccgg

SEQ ID NO: 369532 - RNA, 16 nt, Bordetella pertussis
ccuucgaggccggcgu

SEQ ID NO: 369533 - RNA, 20 nt, Bordetella pertussis
ccuucugcaaggccugcugc

SEQ ID NO: 369534 - RNA, 18 nt, Bordetella pertussis
ccuucugcgccagcggau

SEQ ID NO: 369535 - RNA, 14 nt, Bordetella pertussis
ccuucuucagcuug

SEQ ID NO: 369536 - RNA, 18 nt, Bordetella pertussis
ccuugcgcgaaggccgcc

SEQ ID NO: 369537 - RNA, 13 nt, Bordetella pertussis
ccuugcgcggcca

SEQ ID NO: 369538 - RNA, 16 nt, Bordetella pertussis
ccuugcggccgccgaa

SEQ ID NO: 369539 - RNA, 14 nt, Bordetella pertussis
ccuugcggccgcgc

SEQ ID NO: 369540 - RNA, 14 nt, Bordetella pertussis
ccuugcggccgccg

SEQ ID NO: 369541 - RNA, 23 nt, Bordetella pertussis
ccuuggccagcagcgcaucgcgc

SEQ ID NO: 369542 - RNA, 20 nt, Bordetella pertussis
ccuuggccgcagccggcugc

SEQ ID NO: 369543 - RNA, 12 nt, Bordetella pertussis
ccuuggcgcgca

SEQ ID NO: 369544 - RNA, 18 nt, Bordetella pertussis
ccuuggcgcgcagacgcg

SEQ ID NO: 369545 - RNA, 15 nt, Bordetella pertussis
ccuuggcgccggcga

SEQ ID NO: 369546 - RNA, 14 nt, Bordetella pertussis
ccuuggcggcuggc

SEQ ID NO: 369547 - RNA, 19 nt, Bordetella pertussis
ccuuggcggcuggcgcggc

SEQ ID NO: 369548 - RNA, 17 nt, Bordetella pertussis
ccuuggcguccggcccc

SEQ ID NO: 369549 - RNA, 18 nt, Bordetella pertussis
ccuuggggcggcccagcg

SEQ ID NO: 369550 - RNA, 14 nt, Bordetella pertussis
ccuuggugccguaa

SEQ ID NO: 369551 - RNA, 18 nt, Bordetella pertussis
ccuugguggggucgaugc

SEQ ID NO: 369552 - RNA, 15 nt, Bordetella pertussis
ccuugugcgccagcg

SEQ ID NO: 369553 - RNA, 16 nt, Bordetella pertussis
ccuugugcgccgucgc

SEQ ID NO: 369554 - RNA, 14 nt, Bordetella pertussis
ccuugugcgcgcca

SEQ ID NO: 369555 - RNA, 19 nt, Bordetella pertussis
ccuugugcguuggcgcggc

SEQ ID NO: 369556 - RNA, 15 nt, Bordetella pertussis
ccuuuugcgcggccg

SEQ ID NO: 369557 - RNA, 21 nt, Bordetella pertussis
ccuuuuuguuuuggcgcacgc

SEQ ID NO: 369558 - RNA, 16 nt, Bordetella pertussis
cgaaacuggccgacga

SEQ ID NO: 369559 - RNA, 16 nt, Bordetella pertussis
cgaaagccagcgccug

SEQ ID NO: 369560 - RNA, 23 nt, Bordetella pertussis
cgaaagccagcgccugcgcggcc

SEQ ID NO: 369561 - RNA, 22 nt, Bordetella pertussis
cgaacaccggcuuggccucggc

SEQ ID NO: 369562 - RNA, 15 nt, Bordetella pertussis
cgaacacgccgaccg

SEQ ID NO: 369563 - RNA, 14 nt, Bordetella pertussis
cgaacacgcgcgcc

SEQ ID NO: 369564 - RNA, 19 nt, Bordetella pertussis
cgaacacgucgcgggcgau

SEQ ID NO: 369565 - RNA, 19 nt, Bordetella pertussis
cgaacagauccacgcccgc

SEQ ID NO: 369566 - RNA, 22 nt, Bordetella pertussis
cgaacagcauggcggcgcccgc

SEQ ID NO: 369567 - RNA, 15 nt, Bordetella pertussis
cgaacagcgccaggc

SEQ ID NO: 369568 - RNA, 17 nt, Bordetella pertussis
cgaacaggccaucgccg

SEQ ID NO: 369569 - RNA, 22 nt, Bordetella pertussis
cgaacaugacguucuccagcgc

SEQ ID NO: 369570 - RNA, 15 nt, Bordetella pertussis
cgaacauggccgaga

SEQ ID NO: 369571 - RNA, 23 nt, Bordetella pertussis
cgaacauguuguuggucgccacg

SEQ ID NO: 369572 - RNA, 20 nt, Bordetella pertussis
cgaaccacaggguggcgccc

SEQ ID NO: 369573 - RNA, 18 nt, Bordetella pertussis
cgaaccacccggccaucg

SEQ ID NO: 369574 - RNA, 22 nt, Bordetella pertussis
cgaaccagaucaggucgaugcc

SEQ ID NO: 369575 - RNA, 15 nt, Bordetella pertussis
cgaaccagcgcacca

SEQ ID NO: 369576 - RNA, 16 nt, Bordetella pertussis
cgaaccagcgcaccac

SEQ ID NO: 369577 - RNA, 17 nt, Bordetella pertussis
cgaaccaguugcgggcc

SEQ ID NO: 369578 - RNA, 22 nt, Bordetella pertussis
cgaacccgccgcgaucagcgcg

SEQ ID NO: 369579 - RNA, 20 nt, Bordetella pertussis
cgaaccgaaaugccgcagca

SEQ ID NO: 369580 - RNA, 21 nt, Bordetella pertussis
cgaaccgaaaugccgcagcac

SEQ ID NO: 369581 - RNA, 23 nt, Bordetella pertussis
cgaaccgaaaugccgcagcacca

SEQ ID NO: 369582 - RNA, 13 nt, Bordetella pertussis
cgaaccgaccgcc

SEQ ID NO: 369583 - RNA, 17 nt, Bordetella pertussis
cgaaccgaccgccacga

SEQ ID NO: 369584 - RNA, 15 nt, Bordetella pertussis
cgaaccgauccagcc

SEQ ID NO: 369585 - RNA, 22 nt, Bordetella pertussis
cgaaccgcggcgcagguccacc

SEQ ID NO: 369586 - RNA, 23 nt, Bordetella pertussis
cgaaccgcucagcccuugacgcg

SEQ ID NO: 369587 - RNA, 16 nt, Bordetella pertussis
cgaacgacacccgguc

SEQ ID NO: 369588 - RNA, 19 nt, Bordetella pertussis
cgaacgacucgucgaccac

SEQ ID NO: 369589 - RNA, 14 nt, Bordetella pertussis
cgaacgccacgccc

SEQ ID NO: 369590 - RNA, 16 nt, Bordetella pertussis
cgaacgccacgcccgu

SEQ ID NO: 369591 - RNA, 13 nt, Bordetella pertussis
cgaacgcccggcc

SEQ ID NO: 369592 - RNA, 18 nt, Bordetella pertussis
cgaacgcccggcccaggc

SEQ ID NO: 369593 - RNA, 20 nt, Bordetella pertussis
cgaacgcccggcccaggccg

SEQ ID NO: 369594 - RNA, 16 nt, Bordetella pertussis
cgaacgccgcgucgcu

SEQ ID NO: 369595 - RNA, 21 nt, Bordetella pertussis
cgaacgccucgggcgcaacgu

SEQ ID NO: 369596 - RNA, 13 nt, Bordetella pertussis
cgaacgcgcagcg

SEQ ID NO: 369597 - RNA, 24 nt, Bordetella pertussis
cgaacgcgcagcgaacggcccacg

SEQ ID NO: 369598 - RNA, 12 nt, Bordetella pertussis
cgaacgcgccgg

SEQ ID NO: 369599 - RNA, 15 nt, Bordetella pertussis
cgaacgcgcgccggc

SEQ ID NO: 369600 - RNA, 17 nt, Bordetella pertussis
cgaacgcgcgccggcca

SEQ ID NO: 369601 - RNA, 18 nt, Bordetella pertussis
cgaacgcgcgccggccag

SEQ ID NO: 369602 - RNA, 20 nt, Bordetella pertussis
cgaacgcggccagaccuugc

SEQ ID NO: 369603 - RNA, 12 nt, Bordetella pertussis
cgaacggccgcc

SEQ ID NO: 369604 - RNA, 22 nt, Bordetella pertussis
cgaacggccgcccggcaugggc

SEQ ID NO: 369605 - RNA, 17 nt, Bordetella pertussis
cgaacgggaauggcgga

SEQ ID NO: 369606 - RNA, 18 nt, Bordetella pertussis
cgaacgggguggccggcg

SEQ ID NO: 369607 - RNA, 22 nt, Bordetella pertussis
cgaacgggguggccggcgcgcg

SEQ ID NO: 369608 - RNA, 15 nt, Bordetella pertussis
cgaacggggacuggc

SEQ ID NO: 369609 - RNA, 13 nt, Bordetella pertussis
cgaacugccggcg

SEQ ID NO: 369610 - RNA, 14 nt, Bordetella pertussis
cgaacugggcgucg

SEQ ID NO: 369611 - RNA, 15 nt, Bordetella pertussis
cgaacugucgcgcca

SEQ ID NO: 369612 - RNA, 17 nt, Bordetella pertussis
cgaacugucgcgccacg

SEQ ID NO: 369613 - RNA, 19 nt, Bordetella pertussis
cgaacugucgcgccacggc

SEQ ID NO: 369614 - RNA, 15 nt, Bordetella pertussis
cgaacuucagcccgg

SEQ ID NO: 369615 - RNA, 18 nt, Bordetella pertussis
cgaacuuggccaugccaa

SEQ ID NO: 369616 - RNA, 20 nt, Bordetella pertussis
cgaagaacaccgccgcgccg

SEQ ID NO: 369617 - RNA, 21 nt, Bordetella pertussis
cgaagaacaccgccgcgccgc

SEQ ID NO: 369618 - RNA, 15 nt, Bordetella pertussis
cgaagaucagggugg

SEQ ID NO: 369619 - RNA, 18 nt, Bordetella pertussis
cgaagaucccgccggacu

SEQ ID NO: 369620 - RNA, 17 nt, Bordetella pertussis
cgaagaucucgacgucg

SEQ ID NO: 369621 - RNA, 21 nt, Bordetella pertussis
cgaagauuuccucgcgcacca

SEQ ID NO: 369622 - RNA, 23 nt, Bordetella pertussis
cgaagauuuccucgcgcaccagc

SEQ ID NO: 369623 - RNA, 14 nt, Bordetella pertussis
cgaagccacggccc

SEQ ID NO: 369624 - RNA, 16 nt, Bordetella pertussis
cgaagccacggcccgc

SEQ ID NO: 369625 - RNA, 23 nt, Bordetella pertussis
cgaagggauagcgccguaccagc

SEQ ID NO: 369626 - RNA, 14 nt, Bordetella pertussis
cgaagggcagcagc

SEQ ID NO: 369627 - RNA, 20 nt, Bordetella pertussis
cgaagggucucagaccaucu

SEQ ID NO: 369628 - RNA, 23 nt, Bordetella pertussis
cgaaggugggcgaaccgcggcgc

SEQ ID NO: 369629 - RNA, 22 nt, Bordetella pertussis
cgaagguuucguagccgccgac

SEQ ID NO: 369630 - RNA, 15 nt, Bordetella pertussis
cgaaguacucgccgg

SEQ ID NO: 369631 - RNA, 24 nt, Bordetella pertussis
cgaaguaguuggucgagcgcucgc

SEQ ID NO: 369632 - RNA, 15 nt, Bordetella pertussis
cgaaguccgcgcgca

SEQ ID NO: 369633 - RNA, 17 nt, Bordetella pertussis
cgaaguccgcgcgcagc

SEQ ID NO: 369634 - RNA, 15 nt, Bordetella pertussis
cgaaguccugcaugc

SEQ ID NO: 369635 - RNA, 17 nt, Bordetella pertussis
cgaaguccugcaugcca

SEQ ID NO: 369636 - RNA, 19 nt, Bordetella pertussis
cgaaguccugcaugccaug

SEQ ID NO: 369637 - RNA, 13 nt, Bordetella pertussis
cgaaguugcggcc

SEQ ID NO: 369638 - RNA, 15 nt, Bordetella pertussis
cgaauccggccagca

SEQ ID NO: 369639 - RNA, 16 nt, Bordetella pertussis
cgaauccggccagcac

SEQ ID NO: 369640 - RNA, 22 nt, Bordetella pertussis
cgaauccggccagcacgccggc

SEQ ID NO: 369641 - RNA, 18 nt, Bordetella pertussis
cgaaucgaacuuggcgcg

SEQ ID NO: 369642 - RNA, 21 nt, Bordetella pertussis
cgaaucguaggcgcuguuggc

SEQ ID NO: 369643 - RNA, 16 nt, Bordetella pertussis
cgaaugcccgcccuug

SEQ ID NO: 369644 - RNA, 13 nt, Bordetella pertussis
cgaaugccggccg

SEQ ID NO: 369645 - RNA, 21 nt, Bordetella pertussis
cgaaugccugguaggcgagca

SEQ ID NO: 369646 - RNA, 23 nt, Bordetella pertussis
cgaaugccugguaggcgagcagg

SEQ ID NO: 369647 - RNA, 17 nt, Bordetella pertussis
cgaauggcugcgcgccg

SEQ ID NO: 369648 - RNA, 18 nt, Bordetella pertussis
cgaauggcugcgcgccgu

SEQ ID NO: 369649 - RNA, 19 nt, Bordetella pertussis
cgaauggguccgcgugggc

SEQ ID NO: 369650 - RNA, 19 nt, Bordetella pertussis
cgaauggucggccucggcg

SEQ ID NO: 369651 - RNA, 14 nt, Bordetella pertussis
cgacacccgcggcc

SEQ ID NO: 369652 - RNA, 15 nt, Bordetella pertussis
cgacacccgcggcca

SEQ ID NO: 369653 - RNA, 16 nt, Bordetella pertussis
cgacacccgcggccag

SEQ ID NO: 369654 - RNA, 14 nt, Bordetella pertussis
cgacacccuugcgc

SEQ ID NO: 369655 - RNA, 19 nt, Bordetella pertussis
cgacaccgcggccuugccg

SEQ ID NO: 369656 - RNA, 24 nt, Bordetella pertussis
cgacaccgugaaggugccggacgc

SEQ ID NO: 369657 - RNA, 12 nt, Bordetella pertussis
cgacacgcccag

SEQ ID NO: 369658 - RNA, 13 nt, Bordetella pertussis
cgacacgcccagc

SEQ ID NO: 369659 - RNA, 16 nt, Bordetella pertussis
cgacacgcccagcagg

SEQ ID NO: 369660 - RNA, 17 nt, Bordetella pertussis
cgacaccuggacccgcu

SEQ ID NO: 369661 - RNA, 14 nt, Bordetella pertussis
cgacacgcucaagg

SEQ ID NO: 369662 - RNA, 17 nt, Bordetella pertussis
cgacacggggcaaccgg

SEQ ID NO: 369663 - RNA, 22 nt, Bordetella pertussis
cgacacggggcaaccggccuug

SEQ ID NO: 369664 - RNA, 13 nt, Bordetella pertussis
cgacagcccggga

SEQ ID NO: 369665 - RNA, 20 nt, Bordetella pertussis
cgacagccgcgccagcgccu

SEQ ID NO: 369666 - RNA, 21 nt, Bordetella pertussis
cgacagccuuuccuccugccg

SEQ ID NO: 369667 - RNA, 22 nt, Bordetella pertussis
cgacagccuuuccuccugccgg

SEQ ID NO: 369668 - RNA, 13 nt, Bordetella pertussis
cgacagcgccagc

SEQ ID NO: 369669 - RNA, 13 nt, Bordetella pertussis
cgacagcgccccg

SEQ ID NO: 369670 - RNA, 21 nt, Bordetella pertussis
cgacagcgcgcaggaucagcu

SEQ ID NO: 369671 - RNA, 14 nt, Bordetella pertussis
cgacagcgcgcccg

SEQ ID NO: 369672 - RNA, 18 nt, Bordetella pertussis
cgacagcgcugguggcca

SEQ ID NO: 369673 - RNA, 19 nt, Bordetella pertussis
cgacagcgcugguggccag

SEQ ID NO: 369674 - RNA, 21 nt, Bordetella pertussis
cgacagcgcugguggccagau

SEQ ID NO: 369675 - RNA, 20 nt, Bordetella pertussis
cgacagcggcgagcgcggcg

SEQ ID NO: 369676 - RNA, 17 nt, Bordetella pertussis
cgacagcgucgagcuga

SEQ ID NO: 369677 - RNA, 22 nt, Bordetella pertussis
cgacaggaaggcgagcgcggca

SEQ ID NO: 369678 - RNA, 21 nt, Bordetella pertussis
cgacaggaucgaaggcagcgc

SEQ ID NO: 369679 - RNA, 14 nt, Bordetella pertussis
cgacaggcccgcgg

SEQ ID NO: 369680 - RNA, 17 nt, Bordetella pertussis
cgacaggcccgcggccg

SEQ ID NO: 369681 - RNA, 19 nt, Bordetella pertussis
cgacaggcccgcggccgcg

SEQ ID NO: 369682 - RNA, 17 nt, Bordetella pertussis
cgacaggccgaugcugg

SEQ ID NO: 369683 - RNA, 24 nt, Bordetella pertussis
cgacauacgcgaugccgaucgccg

SEQ ID NO: 369684 - RNA, 21 nt, Bordetella pertussis
cgacauagacgcgcagcggca

SEQ ID NO: 369685 - RNA, 21 nt, Bordetella pertussis
cgacauagagauuguccagcg

SEQ ID NO: 369686 - RNA, 23 nt, Bordetella pertussis
cgacauagaucuccggcgccugg

SEQ ID NO: 369687 - RNA, 14 nt, Bordetella pertussis
cgacauagcgcugg

SEQ ID NO: 369688 - RNA, 14 nt, Bordetella pertussis
cgacaugcccgccg

SEQ ID NO: 369689 - RNA, 17 nt, Bordetella pertussis
cgacaugcccgccggca

SEQ ID NO: 369690 - RNA, 19 nt, Bordetella pertussis
cgacaugccgccccaggcg

SEQ ID NO: 369691 - RNA, 17 nt, Bordetella pertussis
cgacaugcuggcccagc

SEQ ID NO: 369692 - RNA, 13 nt, Bordetella pertussis
cgacaugucgccg

SEQ ID NO: 369693 - RNA, 17 nt, Bordetella pertussis
cgaccaaccugaccgcc

SEQ ID NO: 369694 - RNA, 16 nt, Bordetella pertussis
cgaccaacucgaggcg

SEQ ID NO: 369695 - RNA, 19 nt, Bordetella pertussis
cgaccaacucgaggcggcg

SEQ ID NO: 369696 - RNA, 18 nt, Bordetella pertussis
cgaccacaucugccggua

SEQ ID NO: 369697 - RNA, 13 nt, Bordetella pertussis
cgaccaccagcac

SEQ ID NO: 369698 - RNA, 15 nt, Bordetella pertussis
cgaccaccagcacca

SEQ ID NO: 369699 - RNA, 15 nt, Bordetella pertussis
cgaccaccagcaccg

SEQ ID NO: 369700 - RNA, 18 nt, Bordetella pertussis
cgaccaccagcaucgcgc

SEQ ID NO: 369701 - RNA, 14 nt, Bordetella pertussis
cgaccaccagcggc

SEQ ID NO: 369702 - RNA, 22 nt, Bordetella pertussis
cgaccaccagcgucaccagcag

SEQ ID NO: 369703 - RNA, 22 nt, Bordetella pertussis
cgaccaccgauccgaugaugcc

SEQ ID NO: 369704 - RNA, 14 nt, Bordetella pertussis
cgaccacgaccuug

SEQ ID NO: 369705 - RNA, 17 nt, Bordetella pertussis
cgaccacgcgcgcgccg

SEQ ID NO: 369706 - RNA, 16 nt, Bordetella pertussis
cgaccacgcugggcca

SEQ ID NO: 369707 - RNA, 14 nt, Bordetella pertussis
cgaccacgccggcg

SEQ ID NO: 369708 - RNA, 17 nt, Bordetella pertussis
cgaccacgccggcggcc

SEQ ID NO: 369709 - RNA, 14 nt, Bordetella pertussis
cgaccacuggaagc

SEQ ID NO: 369710 - RNA, 21 nt, Bordetella pertussis
cgaccacuggaagcugcggcc

SEQ ID NO: 369711 - RNA, 20 nt, Bordetella pertussis
cgaccagcagcacguucuug

SEQ ID NO: 369712 - RNA, 14 nt, Bordetella pertussis
cgaccagcagccgg

SEQ ID NO: 369713 - RNA, 23 nt, Bordetella pertussis
cgaccagcagccgguuggcgccu

SEQ ID NO: 369714 - RNA, 17 nt, Bordetella pertussis
cgaccagcaggcccacc

SEQ ID NO: 369715 - RNA, 15 nt, Bordetella pertussis
cgaccagcccggccg

SEQ ID NO: 369716 - RNA, 20 nt, Bordetella pertussis
cgaccagcccggccgccagc

SEQ ID NO: 369717 - RNA, 17 nt, Bordetella pertussis
cgaccagcgcacggucg

SEQ ID NO: 369718 - RNA, 15 nt, Bordetella pertussis
cgaccagcgcgcgcc

SEQ ID NO: 369719 - RNA, 16 nt, Bordetella pertussis
cgaccagcgcgcgccg

SEQ ID NO: 369720 - RNA, 19 nt, Bordetella pertussis
cgaccagcgcgcgccggcc

SEQ ID NO: 369721 - RNA, 20 nt, Bordetella pertussis
cgaccagcgcgcggugccgc

SEQ ID NO: 369722 - RNA, 15 nt, Bordetella pertussis
cgaccagcucgacgc

SEQ ID NO: 369723 - RNA, 16 nt, Bordetella pertussis
cgaccagcucgacgcc

SEQ ID NO: 369724 - RNA, 19 nt, Bordetella pertussis
cgaccagcucgacgccauc

SEQ ID NO: 369725 - RNA, 13 nt, Bordetella pertussis
cgaccaggcccgc

SEQ ID NO: 369726 - RNA, 19 nt, Bordetella pertussis
cgaccaggcccgccacggc

SEQ ID NO: 369727 - RNA, 20 nt, Bordetella pertussis
cgaccaggcccgccacggcg

SEQ ID NO: 369728 - RNA, 19 nt, Bordetella pertussis
cgaccaggccguggcccag

SEQ ID NO: 369729 - RNA, 21 nt, Bordetella pertussis
cgaccaggccguggcccagcc

SEQ ID NO: 369730 - RNA, 22 nt, Bordetella pertussis
cgaccaggccguggcccagccg

SEQ ID NO: 369731 - RNA, 17 nt, Bordetella pertussis
cgaccaggcccacgacg

SEQ ID NO: 369732 - RNA, 12 nt, Bordetella pertussis
cgaccaggcggg

SEQ ID NO: 369733 - RNA, 16 nt, Bordetella pertussis
cgaccaggcugcgcgc

SEQ ID NO: 369734 - RNA, 21 nt, Bordetella pertussis
cgaccaggcugcgcgccggcg

SEQ ID NO: 369735 - RNA, 14 nt, Bordetella pertussis
cgaccagguaucga

SEQ ID NO: 369736 - RNA, 12 nt, Bordetella pertussis
cgaccaggucga

SEQ ID NO: 369737 - RNA, 18 nt, Bordetella pertussis
cgaccaggucgccguacu

SEQ ID NO: 369738 - RNA, 15 nt, Bordetella pertussis
cgaccaggugcgggc

SEQ ID NO: 369739 - RNA, 16 nt, Bordetella pertussis
cgaccaggugcgggcc

SEQ ID NO: 369740 - RNA, 19 nt, Bordetella pertussis
cgaccaggugcgggccgcu

SEQ ID NO: 369741 - RNA, 17 nt, Bordetella pertussis
cgaccaguucggccagc

SEQ ID NO: 369742 - RNA, 19 nt, Bordetella pertussis
cgaccaguucggccagcag

SEQ ID NO: 369743 - RNA, 16 nt, Bordetella pertussis
cgaccaucauggccag

SEQ ID NO: 369744 - RNA, 18 nt, Bordetella pertussis
cgaccaucauggccaggg

SEQ ID NO: 369745 - RNA, 20 nt, Bordetella pertussis
cgaccaucauggccagggcc

SEQ ID NO: 369746 - RNA, 17 nt, Bordetella pertussis
cgaccaugcggccgucg

SEQ ID NO: 369747 - RNA, 18 nt, Bordetella pertussis
cgaccaugcggccgucgc

SEQ ID NO: 369748 - RNA, 15 nt, Bordetella pertussis
cgaccauguccgcgc

SEQ ID NO: 369749 - RNA, 23 nt, Bordetella pertussis
cgaccauuucgauuucggcggcc

SEQ ID NO: 369750 - RNA, 16 nt, Bordetella pertussis
cgacccaccuggccac

SEQ ID NO: 369751 - RNA, 19 nt, Bordetella pertussis
cgacccaccuggccacaag

SEQ ID NO: 369752 - RNA, 20 nt, Bordetella pertussis
cgacccacuugagcagcgcc

SEQ ID NO: 369753 - RNA, 22 nt, Bordetella pertussis
cgacccagaacccggccggcgc

SEQ ID NO: 369754 - RNA, 13 nt, Bordetella pertussis
cgacccaggccgg

SEQ ID NO: 369755 - RNA, 14 nt, Bordetella pertussis
cgacccaggccggc

SEQ ID NO: 369756 - RNA, 21 nt, Bordetella pertussis
cgacccaggccggcgccagcc

SEQ ID NO: 369757 - RNA, 14 nt, Bordetella pertussis
cgacccccggcccg

SEQ ID NO: 369758 - RNA, 15 nt, Bordetella pertussis
cgacccccggcccgc

SEQ ID NO: 369759 - RNA, 19 nt, Bordetella pertussis
cgaccccgccgugccgggc

SEQ ID NO: 369760 - RNA, 14 nt, Bordetella pertussis
cgaccuccaggccc

SEQ ID NO: 369761 - RNA, 13 nt, Bordetella pertussis
cgaccucggcggc

SEQ ID NO: 369762 - RNA, 23 nt, Bordetella pertussis
cgaccucuucguugucgcgcgcg

SEQ ID NO: 369763 - RNA, 13 nt, Bordetella pertussis
cgaccugaucgcg

SEQ ID NO: 369764 - RNA, 18 nt, Bordetella pertussis
cgaccugaucgcgcagcg

SEQ ID NO: 369765 - RNA, 15 nt, Bordetella pertussis
cgaccugcccgagac

SEQ ID NO: 369766 - RNA, 19 nt, Bordetella pertussis
cgaccugcccgagaccgcc

SEQ ID NO: 369767 - RNA, 22 nt, Bordetella pertussis
cgaccugcccgagaccgcccgc

SEQ ID NO: 369768 - RNA, 14 nt, Bordetella pertussis
cgaccugccgcccg

SEQ ID NO: 369769 - RNA, 17 nt, Bordetella pertussis
cgaccugcgcaccggcc

SEQ ID NO: 369770 - RNA, 18 nt, Bordetella pertussis
cgaccugcgcaccggccg

SEQ ID NO: 369771 - RNA, 16 nt, Bordetella pertussis
cgaccugcgcgaccgc

SEQ ID NO: 369772 - RNA, 15 nt, Bordetella pertussis
cgaccugcgggcgca

SEQ ID NO: 369773 - RNA, 21 nt, Bordetella pertussis
cgaccugcgggcgcagcgccg

SEQ ID NO: 369774 - RNA, 22 nt, Bordetella pertussis
cgaccugcgggcgcagcgccgc

SEQ ID NO: 369775 - RNA, 21 nt, Bordetella pertussis
cgaccugcuggcgcgcaccau

SEQ ID NO: 369776 - RNA, 18 nt, Bordetella pertussis
cgacgaacacgcgcgccg

SEQ ID NO: 369777 - RNA, 13 nt, Bordetella pertussis
cgacgacagcggc

SEQ ID NO: 369778 - RNA, 14 nt, Bordetella pertussis
cgacgacagcggcg

SEQ ID NO: 369779 - RNA, 15 nt, Bordetella pertussis
cgacgacagcggcga

SEQ ID NO: 369780 - RNA, 21 nt, Bordetella pertussis
cgacgaccgaaccgauccagc

SEQ ID NO: 369781 - RNA, 14 nt, Bordetella pertussis
cgacgacggccggc

SEQ ID NO: 369782 - RNA, 12 nt, Bordetella pertussis
cgacgagcgcac

SEQ ID NO: 369783 - RNA, 16 nt, Bordetella pertussis
cgacgaggagccggcg

SEQ ID NO: 369784 - RNA, 14 nt, Bordetella pertussis
cgacgaggcgcugu

SEQ ID NO: 369785 - RNA, 21 nt, Bordetella pertussis
cgacgaggggguguucuccaa

SEQ ID NO: 369786 - RNA, 17 nt, Bordetella pertussis
cgacgaugucgccgccg

SEQ ID NO: 369787 - RNA, 21 nt, Bordetella pertussis
cgacgcaacagacccgggccg

SEQ ID NO: 369788 - RNA, 18 nt, Bordetella pertussis
cgacgcagcacggcuugc

SEQ ID NO: 369789 - RNA, 16 nt, Bordetella pertussis
cgacgcagcagccgcu

SEQ ID NO: 369790 - RNA, 14 nt, Bordetella pertussis
cgacgcagcgugcg

SEQ ID NO: 369791 - RNA, 14 nt, Bordetella pertussis
cgacgcaggcgccg

SEQ ID NO: 369792 - RNA, 19 nt, Bordetella pertussis
cgacgcauauccaggcggc

SEQ ID NO: 369793 - RNA, 21 nt, Bordetella pertussis
cgacgcauauccaggcggcgc

SEQ ID NO: 369794 - RNA, 18 nt, Bordetella pertussis
cgacgcaugucagcgccu

SEQ ID NO: 369795 - RNA, 20 nt, Bordetella pertussis
cgacgcaugucagcgccugg

SEQ ID NO: 369796 - RNA, 14 nt, Bordetella pertussis
cgacgccagcauga

SEQ ID NO: 369797 - RNA, 20 nt, Bordetella pertussis
cgacgcccaugcgaucggcc

SEQ ID NO: 369798 - RNA, 23 nt, Bordetella pertussis
cgacgcccaugcgaucggccucg

SEQ ID NO: 369799 - RNA, 15 nt, Bordetella pertussis
cgacgcccgggcggc

SEQ ID NO: 369800 - RNA, 16 nt, Bordetella pertussis
cgacgcccgggcggcu

SEQ ID NO: 369801 - RNA, 14 nt, Bordetella pertussis
cgacgcccuggccu

SEQ ID NO: 369802 - RNA, 19 nt, Bordetella pertussis
cgacgccgcggugcugggc

SEQ ID NO: 369803 - RNA, 18 nt, Bordetella pertussis
cgacgccggcucaggcca

SEQ ID NO: 369804 - RNA, 20 nt, Bordetella pertussis
cgacgccggcucaggccagc

SEQ ID NO: 369805 - RNA, 21 nt, Bordetella pertussis
cgacgccggcucaggccagcg

SEQ ID NO: 369806 - RNA, 17 nt, Bordetella pertussis
cgacgccguacugggca

SEQ ID NO: 369807 - RNA, 18 nt, Bordetella pertussis
cgacgccguacugggcac

SEQ ID NO: 369808 - RNA, 13 nt, Bordetella pertussis
cgacgccggcgac

SEQ ID NO: 369809 - RNA, 14 nt, Bordetella pertussis
cgacgccgugcuga

SEQ ID NO: 369810 - RNA, 17 nt, Bordetella pertussis
cgacgcgccgggccacg

SEQ ID NO: 369811 - RNA, 17 nt, Bordetella pertussis
cgacgcgcgccggcgcu

SEQ ID NO: 369812 - RNA, 21 nt, Bordetella pertussis
cgacgcgcgucgugcccgcca

SEQ ID NO: 369813 - RNA, 15 nt, Bordetella pertussis
cgacgcgcucgucga

SEQ ID NO: 369814 - RNA, 14 nt, Bordetella pertussis
cgacgcgcuugacg

SEQ ID NO: 369815 - RNA, 20 nt, Bordetella pertussis
cgacgcgcuugacguccagc

SEQ ID NO: 369816 - RNA, 13 nt, Bordetella pertussis
cgacgcggcaugc

SEQ ID NO: 369817 - RNA, 12 nt, Bordetella pertussis
cgacgcggccag

SEQ ID NO: 369818 - RNA, 13 nt, Bordetella pertussis
cgacgcggccagc

SEQ ID NO: 369819 - RNA, 16 nt, Bordetella pertussis
cgacgcggccagcggc

SEQ ID NO: 369820 - RNA, 18 nt, Bordetella pertussis
cgacgcggccagcggcgc

SEQ ID NO: 369821 - RNA, 19 nt, Bordetella pertussis
cgacgcggccagcggcgcu

SEQ ID NO: 369822 - RNA, 14 nt, Bordetella pertussis
cgacgcggccgacc

SEQ ID NO: 369823 - RNA, 17 nt, Bordetella pertussis
cgacgcuggcgaugccc

SEQ ID NO: 369824 - RNA, 21 nt, Bordetella pertussis
cgacgcuguagaggcgcggcu

SEQ ID NO: 369825 - RNA, 15 nt, Bordetella pertussis
cgacgcuugccggcg

SEQ ID NO: 369826 - RNA, 12 nt, Bordetella pertussis
cgacggacuggc

SEQ ID NO: 369827 - RNA, 23 nt, Bordetella pertussis
cgacggcaagaucgccggcuacg

SEQ ID NO: 369828 - RNA, 17 nt, Bordetella pertussis
cgacggcaaugccugcg

SEQ ID NO: 369829 - RNA, 14 nt, Bordetella pertussis
cgacggcagccccg

SEQ ID NO: 369830 - RNA, 13 nt, Bordetella pertussis
cgacggcauggcc

SEQ ID NO: 369831 - RNA, 15 nt, Bordetella pertussis
cgacggcauggccgg

SEQ ID NO: 369832 - RNA, 18 nt, Bordetella pertussis
cgacggcauggccggcag

SEQ ID NO: 369833 - RNA, 12 nt, Bordetella pertussis
cgacggccagcg

SEQ ID NO: 369834 - RNA, 14 nt, Bordetella pertussis
cgacggccagcgcg

SEQ ID NO: 369835 - RNA, 15 nt, Bordetella pertussis
cgacggccagcgcga

SEQ ID NO: 369836 - RNA, 13 nt, Bordetella pertussis
cgacggccccagc

SEQ ID NO: 369837 - RNA, 16 nt, Bordetella pertussis
cgacggccccagcgcc

SEQ ID NO: 369838 - RNA, 17 nt, Bordetella pertussis
cgacggccccagcgccg

SEQ ID NO: 369839 - RNA, 21 nt, Bordetella pertussis
cgacggccccagcgccgcgag

SEQ ID NO: 369840 - RNA, 15 nt, Bordetella pertussis
cgacggccggggccc

SEQ ID NO: 369841 - RNA, 23 nt, Bordetella pertussis
cgacggccucccgccgcccggcc

SEQ ID NO: 369842 - RNA, 17 nt, Bordetella pertussis
cgacggccuccgcgccg

SEQ ID NO: 369843 - RNA, 18 nt, Bordetella pertussis
cgacggccuccgcgccga

SEQ ID NO: 369844 - RNA, 19 nt, Bordetella pertussis
cgacggccuccgcgccgac

SEQ ID NO: 369845 - RNA, 17 nt, Bordetella pertussis
cgacggccucggccagg

SEQ ID NO: 369846 - RNA, 17 nt, Bordetella pertussis
cgacggcgauguccugg

SEQ ID NO: 369847 - RNA, 13 nt, Bordetella pertussis
cgacggcgccgau

SEQ ID NO: 369848 - RNA, 12 nt, Bordetella pertussis
cgacggcgcccu

SEQ ID NO: 369849 - RNA, 14 nt, Bordetella pertussis
cgacggcgcccugc

SEQ ID NO: 369850 - RNA, 19 nt, Bordetella pertussis
cgacggcgcccugcagggc

SEQ ID NO: 369851 - RNA, 17 nt, Bordetella pertussis
cgacggcgccgugcugg

SEQ ID NO: 369852 - RNA, 23 nt, Bordetella pertussis
cgacggcgccuauugcgacgccg

SEQ ID NO: 369853 - RNA, 14 nt, Bordetella pertussis
cgacggcgccuggc

SEQ ID NO: 369854 - RNA, 22 nt, Bordetella pertussis
cgacggcgccuggcgcaugacg

SEQ ID NO: 369855 - RNA, 15 nt, Bordetella pertussis
cgacggcgcgcccgc

SEQ ID NO: 369856 - RNA, 17 nt, Bordetella pertussis
cgacggcgcgcccgccg

SEQ ID NO: 369857 - RNA, 12 nt, Bordetella pertussis
cgacggcgcggc

SEQ ID NO: 369858 - RNA, 22 nt, Bordetella pertussis
cgacggcgcggcgaucggcccg

SEQ ID NO: 369859 - RNA, 12 nt, Bordetella pertussis
cgacggcggcgc

SEQ ID NO: 369860 - RNA, 13 nt, Bordetella pertussis
cgacggcgugcug

SEQ ID NO: 369861 - RNA, 18 nt, Bordetella pertussis
cgacgguccugcgcgccg

SEQ ID NO: 369862 - RNA, 17 nt, Bordetella pertussis
cgacggugcgcgccacg

SEQ ID NO: 369863 - RNA, 22 nt, Bordetella pertussis
cgacgguggcuggggcuggcau

SEQ ID NO: 369864 - RNA, 18 nt, Bordetella pertussis
cgacguagucggcgccca

SEQ ID NO: 369865 - RNA, 20 nt, Bordetella pertussis
cgacguagucggcgcccagc

SEQ ID NO: 369866 - RNA, 22 nt, Bordetella pertussis
cgacguagucggcgcccagcuc

SEQ ID NO: 369867 - RNA, 19 nt, Bordetella pertussis
cgacguccacgaugucguc

SEQ ID NO: 369868 - RNA, 22 nt, Bordetella pertussis
cgacguccagcccgugggcggc

SEQ ID NO: 369869 - RNA, 15 nt, Bordetella pertussis
cgacgucccaggccg

SEQ ID NO: 369870 - RNA, 16 nt, Bordetella pertussis
cgacgucccaggccga

SEQ ID NO: 369871 - RNA, 19 nt, Bordetella pertussis
cgacgucccaggccgaagc

SEQ ID NO: 369872 - RNA, 13 nt, Bordetella pertussis
cgacguccgcccg

SEQ ID NO: 369873 - RNA, 12 nt, Bordetella pertussis
cgacgucggccu

SEQ ID NO: 369874 - RNA, 14 nt, Bordetella pertussis
cgacgucggccucg

SEQ ID NO: 369875 - RNA, 23 nt, Bordetella pertussis
cgacgucggugacggcguagccg

SEQ ID NO: 369876 - RNA, 18 nt, Bordetella pertussis
cgacgucguagugcgcgc

SEQ ID NO: 369877 - RNA, 20 nt, Bordetella pertussis
cgacgucguagugcgcgccg

SEQ ID NO: 369878 - RNA, 17 nt, Bordetella pertussis
cgacgugucggccacca

SEQ ID NO: 369879 - RNA, 19 nt, Bordetella pertussis
cgacguggcgcuccaugcg

SEQ ID NO: 369880 - RNA, 21 nt, Bordetella pertussis
cgacguggcgcuccaugcggc

SEQ ID NO: 369881 - RNA, 18 nt, Bordetella pertussis
cgacucgaaacgggcggc

SEQ ID NO: 369882 - RNA, 12 nt, Bordetella pertussis
cgacucggcauc

SEQ ID NO: 369883 - RNA, 22 nt, Bordetella pertussis
cgacucgucgaccaccagcauc

SEQ ID NO: 369884 - RNA, 17 nt, Bordetella pertussis
cgacucuuuuggagaug

SEQ ID NO: 369885 - RNA, 17 nt, Bordetella pertussis
cgacugcagcaggcugg

SEQ ID NO: 369886 - RNA, 19 nt, Bordetella pertussis
cgacugccccauggcaugc

SEQ ID NO: 369887 - RNA, 15 nt, Bordetella pertussis
cgacugcgcaugguc

SEQ ID NO: 369888 - RNA, 16 nt, Bordetella pertussis
cgacugcgcauggucg

SEQ ID NO: 369889 - RNA, 18 nt, Bordetella pertussis
cgagagcgccacgccagc

SEQ ID NO: 369890 - RNA, 19 nt, Bordetella pertussis
cgagagcgccacgccagcg

SEQ ID NO: 369891 - RNA, 16 nt, Bordetella pertussis
cgagagcuccagccgg

SEQ ID NO: 369892 - RNA, 17 nt, Bordetella pertussis
cgagagcuccagccggg

SEQ ID NO: 369893 - RNA, 17 nt, Bordetella pertussis
cgagauccgccggcgau

SEQ ID NO: 369894 - RNA, 15 nt, Bordetella pertussis
cgagaugcccgacgc

SEQ ID NO: 369895 - RNA, 14 nt, Bordetella pertussis
cgagaugccgucga

SEQ ID NO: 369896 - RNA, 18 nt, Bordetella pertussis
cgagaugccgucgaaggc

SEQ ID NO: 369897 - RNA, 21 nt, Bordetella pertussis
cgagaugccgucgaaggccgc

SEQ ID NO: 369898 - RNA, 22 nt, Bordetella pertussis
cgagauggccuuuuccaggcgu

SEQ ID NO: 369899 - RNA, 17 nt, Bordetella pertussis
cgagauggcgcaggcgc

SEQ ID NO: 369900 - RNA, 19 nt, Bordetella pertussis
cgagauggcgcaggcgcgc

SEQ ID NO: 369901 - RNA, 20 nt, Bordetella pertussis
cgagauguccauggccugca

SEQ ID NO: 369902 - RNA, 19 nt, Bordetella pertussis
cgagcaaaggacacgcgcg

SEQ ID NO: 369903 - RNA, 20 nt, Bordetella pertussis
cgagcaccuugacggucacg

SEQ ID NO: 369904 - RNA, 18 nt, Bordetella pertussis
cgagcacgcggcgcggca

SEQ ID NO: 369905 - RNA, 18 nt, Bordetella pertussis
cgagcacggcguggcgcg

SEQ ID NO: 369906 - RNA, 20 nt, Bordetella pertussis
cgagcacggcguggcgcgca

SEQ ID NO: 369907 - RNA, 22 nt, Bordetella pertussis
cgagcacggcguggcgcgcaca

SEQ ID NO: 369908 - RNA, 15 nt, Bordetella pertussis
cgagcacggccugcu

SEQ ID NO: 369909 - RNA, 17 nt, Bordetella pertussis
cgagcacuucgagcgac

SEQ ID NO: 369910 - RNA, 18 nt, Bordetella pertussis
cgagcaggccgccgccgg

SEQ ID NO: 369911 - RNA, 12 nt, Bordetella pertussis
cgagcaggcgcg

SEQ ID NO: 369912 - RNA, 15 nt, Bordetella pertussis
cgagcaggcgcgcgg

SEQ ID NO: 369913 - RNA, 15 nt, Bordetella pertussis
cgagcaucauggcgc

SEQ ID NO: 369914 - RNA, 23 nt, Bordetella pertussis
cgagcaucccggcgcucagcgcg

SEQ ID NO: 369915 - RNA, 23 nt, Bordetella pertussis
cgagcaucuggcgcauggccggc

SEQ ID NO: 369916 - RNA, 14 nt, Bordetella pertussis
cgagcaugcgggcc

SEQ ID NO: 369917 - RNA, 23 nt, Bordetella pertussis
cgagcaugcgcagcgcgucggcg

SEQ ID NO: 369918 - RNA, 18 nt, Bordetella pertussis
cgagcccgacgcgaggca

SEQ ID NO: 369919 - RNA, 14 nt, Bordetella pertussis
cgagcccggcacca

SEQ ID NO: 369920 - RNA, 19 nt, Bordetella pertussis
cgagcccgcgucggcgcgg

SEQ ID NO: 369921 - RNA, 18 nt, Bordetella pertussis
cgagcccuggcuuggccg

SEQ ID NO: 369922 - RNA, 20 nt, Bordetella pertussis
cgagccgaaguacacggcca

SEQ ID NO: 369923 - RNA, 22 nt, Bordetella pertussis
cgagccgaaguacacggccagc

SEQ ID NO: 369924 - RNA, 23 nt, Bordetella pertussis
cgagccgaaguacacggccagca

SEQ ID NO: 369925 - RNA, 16 nt, Bordetella pertussis
cgagccgacgcuccag

SEQ ID NO: 369926 - RNA, 15 nt, Bordetella pertussis
cgagccgcaggucca

SEQ ID NO: 369927 - RNA, 17 nt, Bordetella pertussis
cgagccgcccacgggcg

SEQ ID NO: 369928 - RNA, 18 nt, Bordetella pertussis
cgagccgccccggcgcgg

SEQ ID NO: 369929 - RNA, 15 nt, Bordetella pertussis
cgagccuucggccgg

SEQ ID NO: 369930 - RNA, 19 nt, Bordetella pertussis
cgagcgcaagcaccgccug

SEQ ID NO: 369931 - RNA, 22 nt, Bordetella pertussis
cgagcgcaagcaccgccugcug

SEQ ID NO: 369932 - RNA, 15 nt, Bordetella pertussis
cgagcgcacaggcgg

SEQ ID NO: 369933 - RNA, 16 nt, Bordetella pertussis
cgagcgcacaggcggc

SEQ ID NO: 369934 - RNA, 20 nt, Bordetella pertussis
cgagcgcacaggcggcgccg

SEQ ID NO: 369935 - RNA, 23 nt, Bordetella pertussis
cgagcgcacaggcggcgccggca

SEQ ID NO: 369936 - RNA, 13 nt, Bordetella pertussis
cgagcgcaccaug

SEQ ID NO: 369937 - RNA, 16 nt, Bordetella pertussis
cgagcgcaccccggcc

SEQ ID NO: 369938 - RNA, 21 nt, Bordetella pertussis
cgagcgcagcaagcugcugcu

SEQ ID NO: 369939 - RNA, 21 nt, Bordetella pertussis
cgagcgccacauaaucgucgg

SEQ ID NO: 369940 - RNA, 17 nt, Bordetella pertussis
cgagcgcgcgcaugcgc

SEQ ID NO: 369941 - RNA, 19 nt, Bordetella pertussis
cgagcgcggaucgaaguug

SEQ ID NO: 369942 - RNA, 20 nt, Bordetella pertussis
cgagcgcggcauagcccagg

SEQ ID NO: 369943 - RNA, 21 nt, Bordetella pertussis
cgagcgcggcauagcccaggc

SEQ ID NO: 369944 - RNA, 22 nt, Bordetella pertussis
cgagcgcggcauagcccaggcc

SEQ ID NO: 369945 - RNA, 14 nt, Bordetella pertussis
cgagcgcggccagg

SEQ ID NO: 369946 - RNA, 15 nt, Bordetella pertussis
cgagcgcggccaggc

SEQ ID NO: 369947 - RNA, 14 nt, Bordetella pertussis
cgagcgcggcgcgc

SEQ ID NO: 369948 - RNA, 15 nt, Bordetella pertussis
cgagcgcggcgcgcg

SEQ ID NO: 369949 - RNA, 21 nt, Bordetella pertussis
cgagcgcggcgggugccgcga

SEQ ID NO: 369950 - RNA, 22 nt, Bordetella pertussis
cgagcgcggcgggugccgcgag

SEQ ID NO: 369951 - RNA, 17 nt, Bordetella pertussis
cgagcgcgguggccgcu

SEQ ID NO: 369952 - RNA, 19 nt, Bordetella pertussis
cgagcgcguggaaccgccg

SEQ ID NO: 369953 - RNA, 21 nt, Bordetella pertussis
cgagcgcguggaaccgccgcu

SEQ ID NO: 369954 - RNA, 22 nt, Bordetella pertussis
cgagcgcguggaaccgccgcuu

SEQ ID NO: 369955 - RNA, 14 nt, Bordetella pertussis
cgagcgcucccgcc

SEQ ID NO: 369956 - RNA, 16 nt, Bordetella pertussis
cgagcgcugcgccaac

SEQ ID NO: 369957 - RNA, 21 nt, Bordetella pertussis
cgagcguguugcgugcgagca

SEQ ID NO: 369958 - RNA, 15 nt, Bordetella pertussis
cgagcucggcauggc

SEQ ID NO: 369959 - RNA, 12 nt, Bordetella pertussis
cgagcucgucgg

SEQ ID NO: 369960 - RNA, 23 nt, Bordetella pertussis
cgagcugagcaccagcagcccca

SEQ ID NO: 369961 - RNA, 14 nt, Bordetella pertussis
cgagcugcagcccg

SEQ ID NO: 369962 - RNA, 15 nt, Bordetella pertussis
cgagcugcagcccgg

SEQ ID NO: 369963 - RNA, 16 nt, Bordetella pertussis
cgagcugcucgagcau

SEQ ID NO: 369964 - RNA, 21 nt, Bordetella pertussis
cgagcugcucgagcaugcggg

SEQ ID NO: 369965 - RNA, 15 nt, Bordetella pertussis
cgagcuggcccacgc

SEQ ID NO: 369966 - RNA, 18 nt, Bordetella pertussis
cgagcuggcccacgccca

SEQ ID NO: 369967 - RNA, 13 nt, Bordetella pertussis
cgagcuggccggc

SEQ ID NO: 369968 - RNA, 17 nt, Bordetella pertussis
cgagcuggugauggugu

SEQ ID NO: 369969 - RNA, 19 nt, Bordetella pertussis
cgagcuggugauggugucg

SEQ ID NO: 369970 - RNA, 20 nt, Bordetella pertussis
cgaggaaagcggccuguucg

SEQ ID NO: 369971 - RNA, 15 nt, Bordetella pertussis
cgaggaaccagccgu

SEQ ID NO: 369972 - RNA, 13 nt, Bordetella pertussis
cgaggaaggcccg

SEQ ID NO: 369973 - RNA, 16 nt, Bordetella pertussis
cgaggaaggcccgcgu

SEQ ID NO: 369974 - RNA, 16 nt, Bordetella pertussis
cgaggacaaccaggaa

SEQ ID NO: 369975 - RNA, 14 nt, Bordetella pertussis
cgaggacaggccag

SEQ ID NO: 369976 - RNA, 21 nt, Bordetella pertussis
cgaggacaggccagugccugg

SEQ ID NO: 369977 - RNA, 17 nt, Bordetella pertussis
cgaggacaggggccuca

SEQ ID NO: 369978 - RNA, 22 nt, Bordetella pertussis
cgaggacaggggccucaugacg

SEQ ID NO: 369979 - RNA, 15 nt, Bordetella pertussis
cgaggaccugaccgu

SEQ ID NO: 369980 - RNA, 19 nt, Bordetella pertussis
cgaggaccuguggcgcacc

SEQ ID NO: 369981 - RNA, 20 nt, Bordetella pertussis
cgaggaccuguggcgcaccc

SEQ ID NO: 369982 - RNA, 24 nt, Bordetella pertussis
cgaggacgaccaacucgaggcggc

SEQ ID NO: 369983 - RNA, 14 nt, Bordetella pertussis
cgaggacgaccuug

SEQ ID NO: 369984 - RNA, 17 nt, Bordetella pertussis
cgaggaggugcgccgcu

SEQ ID NO: 369985 - RNA, 21 nt, Bordetella pertussis
cgaggauauccaucuggcccg

SEQ ID NO: 369986 - RNA, 16 nt, Bordetella pertussis
cgaggaucaaggcccg

SEQ ID NO: 369987 - RNA, 18 nt, Bordetella pertussis
cgaggaucuggccggcgc

SEQ ID NO: 369988 - RNA, 23 nt, Bordetella pertussis
cgaggcaaucagccccaggcgcg

SEQ ID NO: 369989 - RNA, 23 nt, Bordetella pertussis
cgaggcagaaguggucgcgcagg

SEQ ID NO: 369990 - RNA, 13 nt, Bordetella pertussis
cgaggccaccuug

SEQ ID NO: 369991 - RNA, 15 nt, Bordetella pertussis
cgaggccaggcugac

SEQ ID NO: 369992 - RNA, 16 nt, Bordetella pertussis
cgaggcccggccugcg

SEQ ID NO: 369993 - RNA, 19 nt, Bordetella pertussis
cgaggccgaguagcggcgc

SEQ ID NO: 369994 - RNA, 20 nt, Bordetella pertussis
cgaggccgaguagcggcgca

SEQ ID NO: 369995 - RNA, 21 nt, Bordetella pertussis
cgaggccgaguagcggcgcaa

SEQ ID NO: 369996 - RNA, 17 nt, Bordetella pertussis
cgaggccgaguggccgc

SEQ ID NO: 369997 - RNA, 23 nt, Bordetella pertussis
cgaggccgcuucgugcggccgca

SEQ ID NO: 369998 - RNA, 16 nt, Bordetella pertussis
cgaggccggcgucugg

SEQ ID NO: 369999 - RNA, 14 nt, Bordetella pertussis
cgaggcgaacaggc

SEQ ID NO: 370000 - RNA, 16 nt, Bordetella pertussis
cgaggcgauggucggc

SEQ ID NO: 370001 - RNA, 15 nt, Bordetella pertussis
cgaggcgcagcgcag

SEQ ID NO: 370002 - RNA, 15 nt, Bordetella pertussis
cgaggcgcaggccga

SEQ ID NO: 370003 - RNA, 18 nt, Bordetella pertussis
cgaggcgcaggccgacgc

SEQ ID NO: 370004 - RNA, 21 nt, Bordetella pertussis
cgaggcgcaguccagcgugga

SEQ ID NO: 370005 - RNA, 14 nt, Bordetella pertussis
cgaggcgcgcagca

SEQ ID NO: 370006 - RNA, 12 nt, Bordetella pertussis
cgaggcgcugcc

SEQ ID NO: 370007 - RNA, 14 nt, Bordetella pertussis
cgaggcgcuggccg

SEQ ID NO: 370008 - RNA, 15 nt, Bordetella pertussis
cgaggcgcuggccgg

SEQ ID NO: 370009 - RNA, 13 nt, Bordetella pertussis
cgaggcggcaagc

SEQ ID NO: 370010 - RNA, 17 nt, Bordetella pertussis
cgaggcggcaagcggcg

SEQ ID NO: 370011 - RNA, 14 nt, Bordetella pertussis
cgaggcggcgcagg

SEQ ID NO: 370012 - RNA, 15 nt, Bordetella pertussis
cgaggcggcggccgg

SEQ ID NO: 370013 - RNA, 18 nt, Bordetella pertussis
cgaggcggcggccggggc

SEQ ID NO: 370014 - RNA, 21 nt, Bordetella pertussis
cgaggcggggcuggcgcggcu

SEQ ID NO: 370015 - RNA, 20 nt, Bordetella pertussis
cgaggcggugggcagggcgg

SEQ ID NO: 370016 - RNA, 15 nt, Bordetella pertussis
cgauagauggccagg

SEQ ID NO: 370017 - RNA, 18 nt, Bordetella pertussis
cgauagauggccaggugg

SEQ ID NO: 370018 - RNA, 19 nt, Bordetella pertussis
cgauagauggccagguggc

SEQ ID NO: 370019 - RNA, 16 nt, Bordetella pertussis
cgauagccgcgcgccu

SEQ ID NO: 370020 - RNA, 16 nt, Bordetella pertussis
cgauagccgcggcgcc

SEQ ID NO: 370021 - RNA, 18 nt, Bordetella pertussis
cgauagccgugaccugcu

SEQ ID NO: 370022 - RNA, 13 nt, Bordetella pertussis
cgauagcgccgcg

SEQ ID NO: 370023 - RNA, 19 nt, Bordetella pertussis
cgauagcgcuugccugacg

SEQ ID NO: 370024 - RNA, 17 nt, Bordetella pertussis
cgauagcgggccugcag

SEQ ID NO: 370025 - RNA, 19 nt, Bordetella pertussis
cgauagcgggccugcagca

SEQ ID NO: 370026 - RNA, 15 nt, Bordetella pertussis
cgauaggugcgcagc

SEQ ID NO: 370027 - RNA, 16 nt, Bordetella pertussis
cgauaggugcgcagcc

SEQ ID NO: 370028 - RNA, 17 nt, Bordetella pertussis
cgauaggugcgcagccg

SEQ ID NO: 370029 - RNA, 16 nt, Bordetella pertussis
cgauauccaggcgcgu

SEQ ID NO: 370030 - RNA, 15 nt, Bordetella pertussis
cgauauccaucggcg

SEQ ID NO: 370031 - RNA, 17 nt, Bordetella pertussis
cgauaucccaugggacg

SEQ ID NO: 370032 - RNA, 12 nt, Bordetella pertussis
cgauaucgccau

SEQ ID NO: 370033 - RNA, 18 nt, Bordetella pertussis
cgaucaacgugcgccagg

SEQ ID NO: 370034 - RNA, 15 nt, Bordetella pertussis
cgaucaccaccggca

SEQ ID NO: 370035 - RNA, 18 nt, Bordetella pertussis
cgaucaccacgcccgcgc

SEQ ID NO: 370036 - RNA, 20 nt, Bordetella pertussis
cgaucaccacgcccgcgccg

SEQ ID NO: 370037 - RNA, 22 nt, Bordetella pertussis
cgaucaccacgcccgcgccgca

SEQ ID NO: 370038 - RNA, 19 nt, Bordetella pertussis
cgaucaccugcaggcccac

SEQ ID NO: 370039 - RNA, 14 nt, Bordetella pertussis
cgaucacgaacagc

SEQ ID NO: 370040 - RNA, 19 nt, Bordetella pertussis
cgaucacgaacagcgccag

SEQ ID NO: 370041 - RNA, 20 nt, Bordetella pertussis
cgaucacgaagcccaguucg

SEQ ID NO: 370042 - RNA, 18 nt, Bordetella pertussis
cgaucacggcgcgcgccu

SEQ ID NO: 370043 - RNA, 16 nt, Bordetella pertussis
cgaucagcaggucggc

SEQ ID NO: 370044 - RNA, 21 nt, Bordetella pertussis
cgaucagcaggucggcgcggc

SEQ ID NO: 370045 - RNA, 16 nt, Bordetella pertussis
cgaucagccagccggc

SEQ ID NO: 370046 - RNA, 23 nt, Bordetella pertussis
cgaucagccagccggcggccagc

SEQ ID NO: 370047 - RNA, 20 nt, Bordetella pertussis
cgaucagcgaaugcgacagc

SEQ ID NO: 370048 - RNA, 22 nt, Bordetella pertussis
cgaucagcgacagcagggucgg

SEQ ID NO: 370049 - RNA, 22 nt, Bordetella pertussis
cgaucaguaucucggcgcccgc

SEQ ID NO: 370050 - RNA, 15 nt, Bordetella pertussis
cgaucaucaggucca

SEQ ID NO: 370051 - RNA, 23 nt, Bordetella pertussis
cgaucauccaggccgugagcgcc

SEQ ID NO: 370052 - RNA, 24 nt, Bordetella pertussis
cgaucauccaggccgugagcgccg

SEQ ID NO: 370053 - RNA, 20 nt, Bordetella pertussis
cgauccagccguuggcgccc

SEQ ID NO: 370054 - RNA, 18 nt, Bordetella pertussis
cgauccagcagcguggcc

SEQ ID NO: 370055 - RNA, 11 nt, Bordetella pertussis
cgauccaggcc

SEQ ID NO: 370056 - RNA, 13 nt, Bordetella pertussis
cgauccaggccac

SEQ ID NO: 370057 - RNA, 16 nt, Bordetella pertussis
cgauccagggccgcag

SEQ ID NO: 370058 - RNA, 17 nt, Bordetella pertussis
cgauccagggccgccag

SEQ ID NO: 370059 - RNA, 18 nt, Bordetella pertussis
cgauccagggccgccagc

SEQ ID NO: 370060 - RNA, 20 nt, Bordetella pertussis
cgauccagggccgccagcac

SEQ ID NO: 370061 - RNA, 21 nt, Bordetella pertussis
cgauccagggccgccagcacc

SEQ ID NO: 370062 - RNA, 23 nt, Bordetella pertussis
cgauccagggccgccagcaccug

SEQ ID NO: 370063 - RNA, 22 nt, Bordetella pertussis
cgauccggcgugguaucgcgcc

SEQ ID NO: 370064 - RNA, 12 nt, Bordetella pertussis
cgauccggugau

SEQ ID NO: 370065 - RNA, 19 nt, Bordetella pertussis
cgauccugcccaccgccgc

SEQ ID NO: 370066 - RNA, 14 nt, Bordetella pertussis
cgauccuucgcggc

SEQ ID NO: 370067 - RNA, 16 nt, Bordetella pertussis
cgauccuucgcggccg

SEQ ID NO: 370068 - RNA, 15 nt, Bordetella pertussis
cgaucgaacgcggcc

SEQ ID NO: 370069 - RNA, 17 nt, Bordetella pertussis
cgaucgaacgcggccag

SEQ ID NO: 370070 - RNA, 21 nt, Bordetella pertussis
cgaucgccaggucggccagcc

SEQ ID NO: 370071 - RNA, 12 nt, Bordetella pertussis
cgaucgccgaca

SEQ ID NO: 370072 - RNA, 16 nt, Bordetella pertussis
cgaucgccgcaugggc

SEQ ID NO: 370073 - RNA, 22 nt, Bordetella pertussis
cgaucgccuguaucugcgccgu

SEQ ID NO: 370074 - RNA, 16 nt, Bordetella pertussis
cgaucgcgauggcccg

SEQ ID NO: 370075 - RNA, 17 nt, Bordetella pertussis
cgaucgcgccggccugg

SEQ ID NO: 370076 - RNA, 12 nt, Bordetella pertussis
cgaucgcgccgu

SEQ ID NO: 370077 - RNA, 15 nt, Bordetella pertussis
cgaucgcgucggcca

SEQ ID NO: 370078 - RNA, 18 nt, Bordetella pertussis
cgaucggagaaaucgccg

SEQ ID NO: 370079 - RNA, 19 nt, Bordetella pertussis
cgaucggagaaaucgccgc

SEQ ID NO: 370080 - RNA, 18 nt, Bordetella pertussis
cgaucggauagcggugca

SEQ ID NO: 370081 - RNA, 23 nt, Bordetella pertussis
cgaucggcccgggcguggcgucg

SEQ ID NO: 370082 - RNA, 14 nt, Bordetella pertussis
cgaucggcgccgcg

SEQ ID NO: 370083 - RNA, 21 nt, Bordetella pertussis
cgaucggcgccgcgcgcggcc

SEQ ID NO: 370084 - RNA, 17 nt, Bordetella pertussis
cgaucggcgccuggccg

SEQ ID NO: 370085 - RNA, 23 nt, Bordetella pertussis
cgaucggcgccuggccgcccagc

SEQ ID NO: 370086 - RNA, 13 nt, Bordetella pertussis
cgaucggcgcgcc

SEQ ID NO: 370087 - RNA, 14 nt, Bordetella pertussis
cgaucggcgcgccc

SEQ ID NO: 370088 - RNA, 18 nt, Bordetella pertussis
cgaucggcgcgcccgcca

SEQ ID NO: 370089 - RNA, 21 nt, Bordetella pertussis
cgaucggcgcgcccgccacgu

SEQ ID NO: 370090 - RNA, 15 nt, Bordetella pertussis
cgaucggccggccgg

SEQ ID NO: 370091 - RNA, 15 nt, Bordetella pertussis
cgaucgggagccucu

SEQ ID NO: 370092 - RNA, 21 nt, Bordetella pertussis
cgaucgucaccaucgccgcgu

SEQ ID NO: 370093 - RNA, 14 nt, Bordetella pertussis
cgaucucgcgcgcg

SEQ ID NO: 370094 - RNA, 22 nt, Bordetella pertussis
cgaucucgcgcgcgcgguccau

SEQ ID NO: 370095 - RNA, 14 nt, Bordetella pertussis
cgaucucgggcagg

SEQ ID NO: 370096 - RNA, 18 nt, Bordetella pertussis
cgaucucgggcaggucgg

SEQ ID NO: 370097 - RNA, 14 nt, Bordetella pertussis
cgaucucggccucg

SEQ ID NO: 370098 - RNA, 12 nt, Bordetella pertussis
cgaucucgucga

SEQ ID NO: 370099 - RNA, 19 nt, Bordetella pertussis
cgaucuucucgacggcgcg

SEQ ID NO: 370100 - RNA, 19 nt, Bordetella pertussis
cgaucuucucgccgcgcgu

SEQ ID NO: 370101 - RNA, 20 nt, Bordetella pertussis
cgaucuucuggacgcugacc

SEQ ID NO: 370102 - RNA, 14 nt, Bordetella pertussis
cgaucuugccgcaa

SEQ ID NO: 370103 - RNA, 23 nt, Bordetella pertussis
cgaugaacaagguacccgcgccg

SEQ ID NO: 370104 - RNA, 19 nt, Bordetella pertussis
cgaugaagacgaugguggc

SEQ ID NO: 370105 - RNA, 18 nt, Bordetella pertussis
cgaugaagcccgagcggc

SEQ ID NO: 370106 - RNA, 20 nt, Bordetella pertussis
cgaugaagcccgagcggcgc

SEQ ID NO: 370107 - RNA, 22 nt, Bordetella pertussis
cgaugaagcccgagcggcgcca

SEQ ID NO: 370108 - RNA, 18 nt, Bordetella pertussis
cgaugaagucgcggcccg

SEQ ID NO: 370109 - RNA, 20 nt, Bordetella pertussis
cgaugaauuccagccaggcc

SEQ ID NO: 370110 - RNA, 23 nt, Bordetella pertussis
cgaugaauuccagccaggccucg

SEQ ID NO: 370111 - RNA, 14 nt, Bordetella pertussis
cgaugaauugcgcc

SEQ ID NO: 370112 - RNA, 13 nt, Bordetella pertussis
cgaugacaucgcc

SEQ ID NO: 370113 - RNA, 15 nt, Bordetella pertussis
cgaugacaucgccgc

SEQ ID NO: 370114 - RNA, 16 nt, Bordetella pertussis
cgaugacaucgccgcu

SEQ ID NO: 370115 - RNA, 19 nt, Bordetella pertussis
cgaugacaucgccgcugcg

SEQ ID NO: 370116 - RNA, 23 nt, Bordetella pertussis
cgaugacaucgccgcugcgcagc

SEQ ID NO: 370117 - RNA, 19 nt, Bordetella pertussis
cgaugaccagcagcgccgg

SEQ ID NO: 370118 - RNA, 16 nt, Bordetella pertussis
cgaugaccagccagcc

SEQ ID NO: 370119 - RNA, 17 nt, Bordetella pertussis
cgaugaccagccagccg

SEQ ID NO: 370120 - RNA, 12 nt, Bordetella pertussis
cgaugaccagcg

SEQ ID NO: 370121 - RNA, 17 nt, Bordetella pertussis
cgaugaccagcgccggc

SEQ ID NO: 370122 - RNA, 14 nt, Bordetella pertussis
cgaugacgcgccgc

SEQ ID NO: 370123 - RNA, 18 nt, Bordetella pertussis
cgaugacgcgccgcgccu

SEQ ID NO: 370124 - RNA, 20 nt, Bordetella pertussis
cgaugacggcuucgaccacg

SEQ ID NO: 370125 - RNA, 22 nt, Bordetella pertussis
cgaugacggcuucgaccacgcg

SEQ ID NO: 370126 - RNA, 17 nt, Bordetella pertussis
cgaugagcuggcgcagg

SEQ ID NO: 370127 - RNA, 18 nt, Bordetella pertussis
cgaugagcuggcgcaggu

SEQ ID NO: 370128 - RNA, 14 nt, Bordetella pertussis
cgaugaggccaggg

SEQ ID NO: 370129 - RNA, 15 nt, Bordetella pertussis
cgaugaucacgcgcu

SEQ ID NO: 370130 - RNA, 13 nt, Bordetella pertussis
cgaugaucgccuc

SEQ ID NO: 370131 - RNA, 18 nt, Bordetella pertussis
cgaugaucgcgccgacga

SEQ ID NO: 370132 - RNA, 17 nt, Bordetella pertussis
cgaugaugagcgcgccg

SEQ ID NO: 370133 - RNA, 15 nt, Bordetella pertussis
cgaugaugcccagga

SEQ ID NO: 370134 - RNA, 15 nt, Bordetella pertussis
cgaugauggcguccg

SEQ ID NO: 370135 - RNA, 17 nt, Bordetella pertussis
cgaugauggcguccgcg

SEQ ID NO: 370136 - RNA, 21 nt, Bordetella pertussis
cgaugauggugaacgccacca

SEQ ID NO: 370137 - RNA, 16 nt, Bordetella pertussis
cgaugcccagcaccgc

SEQ ID NO: 370138 - RNA, 18 nt, Bordetella pertussis
cgaugcccagcaccgcca

SEQ ID NO: 370139 - RNA, 15 nt, Bordetella pertussis
cgaugcccagcgccg

SEQ ID NO: 370140 - RNA, 17 nt, Bordetella pertussis
cgaugcccagcgccgcc

SEQ ID NO: 370141 - RNA, 15 nt, Bordetella pertussis
cgaugcccaggcccg

SEQ ID NO: 370142 - RNA, 19 nt, Bordetella pertussis
cgaugccccaguccaggcc

SEQ ID NO: 370143 - RNA, 22 nt, Bordetella pertussis
cgaugccccaguccaggccggc

SEQ ID NO: 370144 - RNA, 18 nt, Bordetella pertussis
cgaugcccagggccgcgc

SEQ ID NO: 370145 - RNA, 20 nt, Bordetella pertussis
cgaugcccagggccgcgccg

SEQ ID NO: 370146 - RNA, 22 nt, Bordetella pertussis
cgaugccccgguagucgccggc

SEQ ID NO: 370147 - RNA, 14 nt, Bordetella pertussis
cgaugcccgacgac

SEQ ID NO: 370148 - RNA, 18 nt, Bordetella pertussis
cgaugcccgcgcaccagg

SEQ ID NO: 370149 - RNA, 19 nt, Bordetella pertussis
cgaugcccgcgcaccaggc

SEQ ID NO: 370150 - RNA, 17 nt, Bordetella pertussis
cgaugcccucgcgcacg

SEQ ID NO: 370151 - RNA, 14 nt, Bordetella pertussis
cgaugcccugcgcc

SEQ ID NO: 370152 - RNA, 15 nt, Bordetella pertussis
cgaugcgucaggggc

SEQ ID NO: 370153 - RNA, 19 nt, Bordetella pertussis
cgaugcguccgccgugcag

SEQ ID NO: 370154 - RNA, 20 nt, Bordetella pertussis
cgaugcguccgccgugcagg

SEQ ID NO: 370155 - RNA, 15 nt, Bordetella pertussis
cgaugcguucgcccg

SEQ ID NO: 370156 - RNA, 18 nt, Bordetella pertussis
cgaugcguucgcccgugc

SEQ ID NO: 370157 - RNA, 19 nt, Bordetella pertussis
cgaugcucgccggcgccgc

SEQ ID NO: 370158 - RNA, 21 nt, Bordetella pertussis
cgaugcuggcgcggaccugcu

SEQ ID NO: 370159 - RNA, 22 nt, Bordetella pertussis
cgaugcuggcgcggaccugcuc

SEQ ID NO: 370160 - RNA, 17 nt, Bordetella pertussis
cgauggccacgaagacg

SEQ ID NO: 370161 - RNA, 17 nt, Bordetella pertussis
cgauggccacgcgcugu

SEQ ID NO: 370162 - RNA, 18 nt, Bordetella pertussis
cgauggcccgcagguggg

SEQ ID NO: 370163 - RNA, 19 nt, Bordetella pertussis
cgauggccgacaugucgug

SEQ ID NO: 370164 - RNA, 24 nt, Bordetella pertussis
cgauggccgacaugucgugcuggc

SEQ ID NO: 370165 - RNA, 21 nt, Bordetella pertussis
cgauggccgggagcggccagc

SEQ ID NO: 370166 - RNA, 14 nt, Bordetella pertussis
cgauggcggccagg

SEQ ID NO: 370167 - RNA, 13 nt, Bordetella pertussis
cgauggcggcgcu

SEQ ID NO: 370168 - RNA, 13 nt, Bordetella pertussis
cgauggcggcggc

SEQ ID NO: 370169 - RNA, 21 nt, Bordetella pertussis
cgauggcgggguuggccgcca

SEQ ID NO: 370170 - RNA, 22 nt, Bordetella pertussis
cgauggcgguggugggcagaac

SEQ ID NO: 370171 - RNA, 17 nt, Bordetella pertussis
cgauggcguacagcagg

SEQ ID NO: 370172 - RNA, 18 nt, Bordetella pertussis
cgauggcguacagcaggg

SEQ ID NO: 370173 - RNA, 15 nt, Bordetella pertussis
cgauggcguccagca

SEQ ID NO: 370174 - RNA, 19 nt, Bordetella pertussis
cgauggcguccagcagcag

SEQ ID NO: 370175 - RNA, 19 nt, Bordetella pertussis
cgauggcgucgauuucguc

SEQ ID NO: 370176 - RNA, 18 nt, Bordetella pertussis
cgauggcguugcgcacca

SEQ ID NO: 370177 - RNA, 20 nt, Bordetella pertussis
cgauggucacacugucgcca

SEQ ID NO: 370178 - RNA, 23 nt, Bordetella pertussis
cgauggucaccacccgcacgccg

SEQ ID NO: 370179 - RNA, 15 nt, Bordetella pertussis
cgauggucagcggca

SEQ ID NO: 370180 - RNA, 15 nt, Bordetella pertussis
cgauggucggccgga

SEQ ID NO: 370181 - RNA, 23 nt, Bordetella pertussis
cgauggucggccggaugcgcagg

SEQ ID NO: 370182 - RNA, 18 nt, Bordetella pertussis
cgauggugccggccgucu

SEQ ID NO: 370183 - RNA, 15 nt, Bordetella pertussis
cgauggugccgggcu

SEQ ID NO: 370184 - RNA, 17 nt, Bordetella pertussis
cgauggugcgcaggggc

SEQ ID NO: 370185 - RNA, 22 nt, Bordetella pertussis
cgauggugcgggcgauuucguc

SEQ ID NO: 370186 - RNA, 14 nt, Bordetella pertussis
cgaugucgaacagc

SEQ ID NO: 370187 - RNA, 14 nt, Bordetella pertussis
cgaugucgcccaug

SEQ ID NO: 370188 - RNA, 20 nt, Bordetella pertussis
cgaugucguacacaugcuug

SEQ ID NO: 370189 - RNA, 16 nt, Bordetella pertussis
cgaugucguccagcuc

SEQ ID NO: 370190 - RNA, 18 nt, Bordetella pertussis
cgaugucguccagcucca

SEQ ID NO: 370191 - RNA, 24 nt, Bordetella pertussis
cgaugucgugaucgccagcgccgg

SEQ ID NO: 370192 - RNA, 19 nt, Bordetella pertussis
cgauuccaggacgacaggc

SEQ ID NO: 370193 - RNA, 18 nt, Bordetella pertussis
cgauucccuggcgcgcca

SEQ ID NO: 370194 - RNA, 20 nt, Bordetella pertussis
cgauucccuggcgcgccagc

SEQ ID NO: 370195 - RNA, 23 nt, Bordetella pertussis
cgauucccuggcgcgccagcucg

SEQ ID NO: 370196 - RNA, 17 nt, Bordetella pertussis
cgauuccgccuacuggc

SEQ ID NO: 370197 - RNA, 21 nt, Bordetella pertussis
cgauuccgccuacuggcgcgc

SEQ ID NO: 370198 - RNA, 18 nt, Bordetella pertussis
cgauucgaccugcuuggc

SEQ ID NO: 370199 - RNA, 22 nt, Bordetella pertussis
cgauucgaccugcuuggcgaac

SEQ ID NO: 370200 - RNA, 19 nt, Bordetella pertussis
cgauugcagguggccagcc

SEQ ID NO: 370201 - RNA, 22 nt, Bordetella pertussis
cgauugcagguggccagcccgg

SEQ ID NO: 370202 - RNA, 20 nt, Bordetella pertussis
cgauugcaguacccaguacg

SEQ ID NO: 370203 - RNA, 13 nt, Bordetella pertussis
cgauugcgccagc

SEQ ID NO: 370204 - RNA, 14 nt, Bordetella pertussis
cgauugucgucgcg

SEQ ID NO: 370205 - RNA, 16 nt, Bordetella pertussis
cgcaaaaacgcccggc

SEQ ID NO: 370206 - RNA, 20 nt, Bordetella pertussis
cgcaaaacgcaugaccugcg

SEQ ID NO: 370207 - RNA, 18 nt, Bordetella pertussis
cgcaaaagcaacaaccgc

SEQ ID NO: 370208 - RNA, 17 nt, Bordetella pertussis
cgcaaaccgacgcggcc

SEQ ID NO: 370209 - RNA, 22 nt, Bordetella pertussis
cgcaaaccgacgcggccagcgg

SEQ ID NO: 370210 - RNA, 21 nt, Bordetella pertussis
cgcaaccaggggcggcgcggc

SEQ ID NO: 370211 - RNA, 22 nt, Bordetella pertussis
cgcaaccaggggcggcgcggcg

SEQ ID NO: 370212 - RNA, 18 nt, Bordetella pertussis
cgcaacccacccccagca

SEQ ID NO: 370213 - RNA, 12 nt, Bordetella pertussis
cgcaacccagca

SEQ ID NO: 370214 - RNA, 17 nt, Bordetella pertussis
cgcaacccagcagcggc

SEQ ID NO: 370215 - RNA, 15 nt, Bordetella pertussis
cgcaacccggccucg

SEQ ID NO: 370216 - RNA, 23 nt, Bordetella pertussis
cgcaaccggucggccggcagcgg

SEQ ID NO: 370217 - RNA, 14 nt, Bordetella pertussis
cgcaacgucgaaca

SEQ ID NO: 370218 - RNA, 13 nt, Bordetella pertussis
cgcaacuccagca

SEQ ID NO: 370219 - RNA, 15 nt, Bordetella pertussis
cgcaagacgcggcag

SEQ ID NO: 370220 - RNA, 14 nt, Bordetella pertussis
cgcaaggcaugcgc

SEQ ID NO: 370221 - RNA, 18 nt, Bordetella pertussis
cgcaaggcaugcgccagc

SEQ ID NO: 370222 - RNA, 19 nt, Bordetella pertussis
cgcaaggcaugcgccagcg

SEQ ID NO: 370223 - RNA, 14 nt, Bordetella pertussis
cgcaaggcggcccg

SEQ ID NO: 370224 - RNA, 17 nt, Bordetella pertussis
cgcaaggcggcccggcc

SEQ ID NO: 370225 - RNA, 18 nt, Bordetella pertussis
cgcaaggcgggcuggucg

SEQ ID NO: 370226 - RNA, 16 nt, Bordetella pertussis
cgcaaggggccggcgc

SEQ ID NO: 370227 - RNA, 18 nt, Bordetella pertussis
cgcaaggggccggcgccg

SEQ ID NO: 370228 - RNA, 21 nt, Bordetella pertussis
cgcaagggggacuggcaccgg

SEQ ID NO: 370229 - RNA, 22 nt, Bordetella pertussis
cgcaaggguuguggccguggcg

SEQ ID NO: 370230 - RNA, 16 nt, Bordetella pertussis
cgcaagugcuggcccg

SEQ ID NO: 370231 - RNA, 17 nt, Bordetella pertussis
cgcaagugcuggcccgc

SEQ ID NO: 370232 - RNA, 23 nt, Bordetella pertussis
cgcaagugcuggcccgccagcaa

SEQ ID NO: 370233 - RNA, 18 nt, Bordetella pertussis
cgcaaguucaucaucgcc

SEQ ID NO: 370234 - RNA, 23 nt, Bordetella pertussis
cgcaaguucaucaucgccgacgc

SEQ ID NO: 370235 - RNA, 20 nt, Bordetella pertussis
cgcaauaccuucagcccggc

SEQ ID NO: 370236 - RNA, 19 nt, Bordetella pertussis
cgcaauagcucgcauccau

SEQ ID NO: 370237 - RNA, 14 nt, Bordetella pertussis
cgcaaugcgcggcg

SEQ ID NO: 370238 - RNA, 19 nt, Bordetella pertussis
cgcaauggacacagcggcg

SEQ ID NO: 370239 - RNA, 23 nt, Bordetella pertussis
cgcaauugcgugguggccuugcu

SEQ ID NO: 370240 - RNA, 19 nt, Bordetella pertussis
cgcacaaccugguacggca

SEQ ID NO: 370241 - RNA, 20 nt, Bordetella pertussis
cgcacaagggccccgcgagg

SEQ ID NO: 370242 - RNA, 15 nt, Bordetella pertussis
cgcacacauggcgca

SEQ ID NO: 370243 - RNA, 18 nt, Bordetella pertussis
cgcacacgcgcugggcgu

SEQ ID NO: 370244 - RNA, 15 nt, Bordetella pertussis
cgcacacuggccagc

SEQ ID NO: 370245 - RNA, 14 nt, Bordetella pertussis
cgcacagcaugcgc

SEQ ID NO: 370246 - RNA, 18 nt, Bordetella pertussis
cgcacagcauggccacca

SEQ ID NO: 370247 - RNA, 14 nt, Bordetella pertussis
cgcacagcaccugg

SEQ ID NO: 370248 - RNA, 13 nt, Bordetella pertussis
cgcacagcgcgca

SEQ ID NO: 370249 - RNA, 14 nt, Bordetella pertussis
cgcacagcgcggcg

SEQ ID NO: 370250 - RNA, 19 nt, Bordetella pertussis
cgcacagcgcggcgaugcc

SEQ ID NO: 370251 - RNA, 14 nt, Bordetella pertussis
cgcacagcguggcg

SEQ ID NO: 370252 - RNA, 22 nt, Bordetella pertussis
cgcacaggcgcucgcccucgcg

SEQ ID NO: 370253 - RNA, 21 nt, Bordetella pertussis
cgcacaguugcaggccaugcu

SEQ ID NO: 370254 - RNA, 22 nt, Bordetella pertussis
cgcacaguugcaggccaugcuc

SEQ ID NO: 370255 - RNA, 22 nt, Bordetella pertussis
cgcacagggcgucgcgaugcgc

SEQ ID NO: 370256 - RNA, 20 nt, Bordetella pertussis
cgcacauacaaggcgcggca

SEQ ID NO: 370257 - RNA, 20 nt, Bordetella pertussis
cgcacaucaggucgaccugc

SEQ ID NO: 370258 - RNA, 23 nt, Bordetella pertussis
cgcacaucaggucgaccugcuug

SEQ ID NO: 370259 - RNA, 16 nt, Bordetella pertussis
cgcacaucgcccgugc

SEQ ID NO: 370260 - RNA, 14 nt, Bordetella pertussis
cgcacaugaugccc

SEQ ID NO: 370261 - RNA, 17 nt, Bordetella pertussis
cgcacaugaugcccagc

SEQ ID NO: 370262 - RNA, 20 nt, Bordetella pertussis
cgcaccaaucuugccaggcc

SEQ ID NO: 370263 - RNA, 13 nt, Bordetella pertussis
cgcaccaccagca

SEQ ID NO: 370264 - RNA, 16 nt, Bordetella pertussis
cgcaccaccuggcuga

SEQ ID NO: 370265 - RNA, 17 nt, Bordetella pertussis
cgcaccagcgaggcggc

SEQ ID NO: 370266 - RNA, 20 nt, Bordetella pertussis
cgcaccagcgcauugccgcc

SEQ ID NO: 370267 - RNA, 19 nt, Bordetella pertussis
cgcaccagcgccgacggca

SEQ ID NO: 370268 - RNA, 12 nt, Bordetella pertussis
cgcaccagcgcg

SEQ ID NO: 370269 - RNA, 14 nt, Bordetella pertussis
cgcaccagcgcgcc

SEQ ID NO: 370270 - RNA, 15 nt, Bordetella pertussis
cgcaccagcgcgccg

SEQ ID NO: 370271 - RNA, 14 nt, Bordetella pertussis
cgcaccagcccgcc

SEQ ID NO: 370272 - RNA, 12 nt, Bordetella pertussis
cgcaccaggccc

SEQ ID NO: 370273 - RNA, 13 nt, Bordetella pertussis
cgcaccaggccca

SEQ ID NO: 370274 - RNA, 16 nt, Bordetella pertussis
cgcaccaggcccauga

SEQ ID NO: 370275 - RNA, 23 nt, Bordetella pertussis
cgcaccaggcccaugaaggcggc

SEQ ID NO: 370276 - RNA, 20 nt, Bordetella pertussis
cgcaccaggccgcggcgccc

SEQ ID NO: 370277 - RNA, 13 nt, Bordetella pertussis
cgcaccaggcgcg

SEQ ID NO: 370278 - RNA, 19 nt, Bordetella pertussis
cgcaccaggcgcucgcgcg

SEQ ID NO: 370279 - RNA, 18 nt, Bordetella pertussis
cgcaccaggcuggggccg

SEQ ID NO: 370280 - RNA, 19 nt, Bordetella pertussis
cgcaccaguuucucggcca

SEQ ID NO: 370281 - RNA, 18 nt, Bordetella pertussis
cgcaccaugccgauggcg

SEQ ID NO: 370282 - RNA, 19 nt, Bordetella pertussis
cgcaccaugccgauggcgg

SEQ ID NO: 370283 - RNA, 16 nt, Bordetella pertussis
cgcaccaugcgcagca

SEQ ID NO: 370284 - RNA, 12 nt, Bordetella pertussis
cgcaccauggcg

SEQ ID NO: 370285 - RNA, 17 nt, Bordetella pertussis
cgcaccauggcgcccac

SEQ ID NO: 370286 - RNA, 21 nt, Bordetella pertussis
cgcaccauggcgcccacggcc

SEQ ID NO: 370287 - RNA, 20 nt, Bordetella pertussis
cgcaccaugggcgucgucgc

SEQ ID NO: 370288 - RNA, 22 nt, Bordetella pertussis
cgcaccaugggcgucgucgccg

SEQ ID NO: 370289 - RNA, 19 nt, Bordetella pertussis
cgcaccauucucgcccugc

SEQ ID NO: 370290 - RNA, 14 nt, Bordetella pertussis
cgcacccaggccca

SEQ ID NO: 370291 - RNA, 20 nt, Bordetella pertussis
cgcaccccggccgacggcaa

SEQ ID NO: 370292 - RNA, 19 nt, Bordetella pertussis
cgcacccgucccuggucca

SEQ ID NO: 370293 - RNA, 21 nt, Bordetella pertussis
cgcacccgucccugguccagc

SEQ ID NO: 370294 - RNA, 22 nt, Bordetella pertussis
cgcacccgucccugguccagca

SEQ ID NO: 370295 - RNA, 21 nt, Bordetella pertussis
cgcacccguuccagcaugucc

SEQ ID NO: 370296 - RNA, 20 nt, Bordetella pertussis
cgcaccgaccagcgcgcgcc

SEQ ID NO: 370297 - RNA, 13 nt, Bordetella pertussis
cgcaccgacacca

SEQ ID NO: 370298 - RNA, 13 nt, Bordetella pertussis
cgcaccgaccagc

SEQ ID NO: 370299 - RNA, 19 nt, Bordetella pertussis
cgcaccgcaugggccaggc

SEQ ID NO: 370300 - RNA, 14 nt, Bordetella pertussis
cgcaccgccgccgg

SEQ ID NO: 370301 - RNA, 18 nt, Bordetella pertussis
cgcaccgccgccggcccg

SEQ ID NO: 370302 - RNA, 12 nt, Bordetella pertussis
cgcaccgcccgc

SEQ ID NO: 370303 - RNA, 14 nt, Bordetella pertussis
cgcaccgccugcgg

SEQ ID NO: 370304 - RNA, 17 nt, Bordetella pertussis
cgcagaaggcgaacugg

SEQ ID NO: 370305 - RNA, 15 nt, Bordetella pertussis
cgcaccgccugcugc

SEQ ID NO: 370306 - RNA, 17 nt, Bordetella pertussis
cgcagaccacgccggcg

SEQ ID NO: 370307 - RNA, 22 nt, Bordetella pertussis
cgcagacgacgcagcgugcgac

SEQ ID NO: 370308 - RNA, 23 nt, Bordetella pertussis
cgcagacgaugaagacgauggug

SEQ ID NO: 370309 - RNA, 17 nt, Bordetella pertussis
cgcagacggucgacacc

SEQ ID NO: 370310 - RNA, 21 nt, Bordetella pertussis
cgcagauccucgaacaggcca

SEQ ID NO: 370311 - RNA, 15 nt, Bordetella pertussis
cgcagauggccagca

SEQ ID NO: 370312 - RNA, 16 nt, Bordetella pertussis
cgcagauggccagcag

SEQ ID NO: 370313 - RNA, 17 nt, Bordetella pertussis
cgcagauggccagcagc

SEQ ID NO: 370314 - RNA, 22 nt, Bordetella pertussis
cgcagauggcggcgaugccgcu

SEQ ID NO: 370315 - RNA, 19 nt, Bordetella pertussis
cgcagauggcguaggcggc

SEQ ID NO: 370316 - RNA, 17 nt, Bordetella pertussis
cgcagaugggcggcgac

SEQ ID NO: 370317 - RNA, 16 nt, Bordetella pertussis
cgcagauugcgcucgg

SEQ ID NO: 370318 - RNA, 20 nt, Bordetella pertussis
cgcagauugcgcucggucau

SEQ ID NO: 370319 - RNA, 16 nt, Bordetella pertussis
cgcagcaagcugcugc

SEQ ID NO: 370320 - RNA, 22 nt, Bordetella pertussis
cgcagcaauucaagccgcacca

SEQ ID NO: 370321 - RNA, 15 nt, Bordetella pertussis
cgcagcaggcgcgcg

SEQ ID NO: 370322 - RNA, 20 nt, Bordetella pertussis
cgcagcaggcgcucggccag

SEQ ID NO: 370323 - RNA, 21 nt, Bordetella pertussis
cgcagcaggcgcucggccagc

SEQ ID NO: 370324 - RNA, 16 nt, Bordetella pertussis
cgcagcagggccuggc

SEQ ID NO: 370325 - RNA, 18 nt, Bordetella pertussis
cgcagcagggcggcgguu

SEQ ID NO: 370326 - RNA, 17 nt, Bordetella pertussis
cgcagcagguggaucga

SEQ ID NO: 370327 - RNA, 21 nt, Bordetella pertussis
cgcagcagguggaucgacgag

SEQ ID NO: 370328 - RNA, 13 nt, Bordetella pertussis
cgcagcaguucgg

SEQ ID NO: 370329 - RNA, 19 nt, Bordetella pertussis
cgcagcaguucggucagcg

SEQ ID NO: 370330 - RNA, 20 nt, Bordetella pertussis
cgcagcaucuugcgccgcug

SEQ ID NO: 370331 - RNA, 21 nt, Bordetella pertussis
cgcagcaugagcugaugcucg

SEQ ID NO: 370332 - RNA, 15 nt, Bordetella pertussis
cgcagcauggcgcca

SEQ ID NO: 370333 - RNA, 12 nt, Bordetella pertussis
cgcagcccagcg

SEQ ID NO: 370334 - RNA, 20 nt, Bordetella pertussis
cgcagcccacucagggcggg

SEQ ID NO: 370335 - RNA, 17 nt, Bordetella pertussis
cgcagcccggcgugccc

SEQ ID NO: 370336 - RNA, 18 nt, Bordetella pertussis
cgcagcccuucggagcca

SEQ ID NO: 370337 - RNA, 14 nt, Bordetella pertussis
cgcagccgacaggc

SEQ ID NO: 370338 - RNA, 19 nt, Bordetella pertussis
cgcagccgacaggcgcgca

SEQ ID NO: 370339 - RNA, 13 nt, Bordetella pertussis
cgcagccgcagua

SEQ ID NO: 370340 - RNA, 15 nt, Bordetella pertussis
cgcagccgccagcgc

SEQ ID NO: 370341 - RNA, 21 nt, Bordetella pertussis
cgcagccgccauaggcgcgca

SEQ ID NO: 370342 - RNA, 13 nt, Bordetella pertussis
cgcagccgcccgg

SEQ ID NO: 370343 - RNA, 14 nt, Bordetella pertussis
cgcagccgcccggc

SEQ ID NO: 370344 - RNA, 14 nt, Bordetella pertussis
cgcagccgcgcgcc

SEQ ID NO: 370345 - RNA, 15 nt, Bordetella pertussis
cgcagccgcuccagc

SEQ ID NO: 370346 - RNA, 16 nt, Bordetella pertussis
cgcagccgcuccagcc

SEQ ID NO: 370347 - RNA, 20 nt, Bordetella pertussis
cgcagccgcuccagccacca

SEQ ID NO: 370348 - RNA, 21 nt, Bordetella pertussis
cgcagccgcuccagccaccac

SEQ ID NO: 370349 - RNA, 12 nt, Bordetella pertussis
cgcagccggccg

SEQ ID NO: 370350 - RNA, 14 nt, Bordetella pertussis
cgcagccggccggu

SEQ ID NO: 370351 - RNA, 14 nt, Bordetella pertussis
cgcagcgcggcacg

SEQ ID NO: 370352 - RNA, 14 nt, Bordetella pertussis
cgcagcgcggcguu

SEQ ID NO: 370353 - RNA, 17 nt, Bordetella pertussis
cgcagcgcgucggcgcg

SEQ ID NO: 370354 - RNA, 16 nt, Bordetella pertussis
cgcagcggaugccgcc

SEQ ID NO: 370355 - RNA, 19 nt, Bordetella pertussis
cgcagcggaugccgcccgu

SEQ ID NO: 370356 - RNA, 22 nt, Bordetella pertussis
cgcagcggaugccgcccgugca

SEQ ID NO: 370357 - RNA, 15 nt, Bordetella pertussis
cgcagcggcagcgca

SEQ ID NO: 370358 - RNA, 18 nt, Bordetella pertussis
cgcagcggcagcgcaccg

SEQ ID NO: 370359 - RNA, 18 nt, Bordetella pertussis
cgcagcggcaggcccugc

SEQ ID NO: 370360 - RNA, 16 nt, Bordetella pertussis
cgcagcggcaggcggc

SEQ ID NO: 370361 - RNA, 15 nt, Bordetella pertussis
cgcagcgggcccguc

SEQ ID NO: 370362 - RNA, 21 nt, Bordetella pertussis
cgcagcgggcccgucgcgcca

SEQ ID NO: 370363 - RNA, 19 nt, Bordetella pertussis
cgcagcggggacaggcgcc

SEQ ID NO: 370364 - RNA, 23 nt, Bordetella pertussis
cgcagcggggacaggcgcccgug

SEQ ID NO: 370365 - RNA, 15 nt, Bordetella pertussis
cgcagcgucgcggcg

SEQ ID NO: 370366 - RNA, 18 nt, Bordetella pertussis
cgcagcgucgcggcgucg

SEQ ID NO: 370367 - RNA, 17 nt, Bordetella pertussis
cgcagcgucucgcccac

SEQ ID NO: 370368 - RNA, 18 nt, Bordetella pertussis
cgcagcgugcggaccagc

SEQ ID NO: 370369 - RNA, 16 nt, Bordetella pertussis
cgcagcucccccacgc

SEQ ID NO: 370370 - RNA, 21 nt, Bordetella pertussis
cgcagcucccccacgccgccg

SEQ ID NO: 370371 - RNA, 22 nt, Bordetella pertussis
cgcagcuccguauccuggucga

SEQ ID NO: 370372 - RNA, 15 nt, Bordetella pertussis
cgcagcucguggcgc

SEQ ID NO: 370373 - RNA, 17 nt, Bordetella pertussis
cgcagcucguggcgcgc

SEQ ID NO: 370374 - RNA, 22 nt, Bordetella pertussis
cgcagcucguggcgcgccucca

SEQ ID NO: 370375 - RNA, 16 nt, Bordetella pertussis
cgcagcugccugagca

SEQ ID NO: 370376 - RNA, 21 nt, Bordetella pertussis
cgcagcuucuaucugccgcgc

SEQ ID NO: 370377 - RNA, 23 nt, Bordetella pertussis
cgcagcuguucagacugcugccg

SEQ ID NO: 370378 - RNA, 16 nt, Bordetella pertussis
cgcagcuugcccgcgc

SEQ ID NO: 370379 - RNA, 21 nt, Bordetella pertussis
cgcagcuugcccgcgcgcacg

SEQ ID NO: 370380 - RNA, 22 nt, Bordetella pertussis
cgcaggaaguucagggcgaacu

SEQ ID NO: 370381 - RNA, 20 nt, Bordetella pertussis
cgcaggaauccuggugccag

SEQ ID NO: 370382 - RNA, 15 nt, Bordetella pertussis
cgcaggacaaggcgc

SEQ ID NO: 370383 - RNA, 21 nt, Bordetella pertussis
cgcaggaauuccucgcggcug

SEQ ID NO: 370384 - RNA, 16 nt, Bordetella pertussis
cgcaggccugcggcga

SEQ ID NO: 370385 - RNA, 12 nt, Bordetella pertussis
cgcaggccugcu

SEQ ID NO: 370386 - RNA, 18 nt, Bordetella pertussis
cgcaggccugcugcagcg

SEQ ID NO: 370387 - RNA, 19 nt, Bordetella pertussis
cgcaggccguuggccgcgc

SEQ ID NO: 370388 - RNA, 13 nt, Bordetella pertussis
cgcaggcgccgca

SEQ ID NO: 370389 - RNA, 15 nt, Bordetella pertussis
cgcaggcgccgcacc

SEQ ID NO: 370390 - RNA, 16 nt, Bordetella pertussis
cgcaggcgccgcaccc

SEQ ID NO: 370391 - RNA, 17 nt, Bordetella pertussis
cgcaggcgccgcacccg

SEQ ID NO: 370392 - RNA, 15 nt, Bordetella pertussis
cgcaggcgccgcagu

SEQ ID NO: 370393 - RNA, 14 nt, Bordetella pertussis
cgcaggcgcgcgcc

SEQ ID NO: 370394 - RNA, 16 nt, Bordetella pertussis
cgcaggcgcguggcca

SEQ ID NO: 370395 - RNA, 18 nt, Bordetella pertussis
cgcaggcgcguggccacg

SEQ ID NO: 370396 - RNA, 15 nt, Bordetella pertussis
cgcaggcgcucgagg

SEQ ID NO: 370397 - RNA, 17 nt, Bordetella pertussis
cgcagggcgaacguggc

SEQ ID NO: 370398 - RNA, 13 nt, Bordetella pertussis
cgcagggcggccg

SEQ ID NO: 370399 - RNA, 22 nt, Bordetella pertussis
cgcagggcggccucgacggccg

SEQ ID NO: 370400 - RNA, 14 nt, Bordetella pertussis
cgcagggcggccgg

SEQ ID NO: 370401 - RNA, 15 nt, Bordetella pertussis
cgcagggcggccggc

SEQ ID NO: 370402 - RNA, 24 nt, Bordetella pertussis
cgcaggguggcaucguggaagauc

SEQ ID NO: 370403 - RNA, 23 nt, Bordetella pertussis
cgcaggguuuccgacaccgucag

SEQ ID NO: 370404 - RNA, 16 nt, Bordetella pertussis
cgcaguagcguugcag

SEQ ID NO: 370405 - RNA, 18 nt, Bordetella pertussis
cgcaguaucccggccagg

SEQ ID NO: 370406 - RNA, 21 nt, Bordetella pertussis
cgcaguaucccggccaggcgc

SEQ ID NO: 370407 - RNA, 21 nt, Bordetella pertussis
cgcagucccaguccggcagca

SEQ ID NO: 370408 - RNA, 17 nt, Bordetella pertussis
cgcaguccugcgaucag

SEQ ID NO: 370409 - RNA, 16 nt, Bordetella pertussis
cgcagucgagcaccgc

SEQ ID NO: 370410 - RNA, 19 nt, Bordetella pertussis
cgcagucgagcaccgcgcg

SEQ ID NO: 370411 - RNA, 14 nt, Bordetella pertussis
cgcagucggggccg

SEQ ID NO: 370412 - RNA, 13 nt, Bordetella pertussis
cgcaguggaaauc

SEQ ID NO: 370413 - RNA, 14 nt, Bordetella pertussis
cgcagugggccagu

SEQ ID NO: 370414 - RNA, 15 nt, Bordetella pertussis
cgcaguuccggcggg

SEQ ID NO: 370415 - RNA, 18 nt, Bordetella pertussis
cgcaguuccggcgggccg

SEQ ID NO: 370416 - RNA, 22 nt, Bordetella pertussis
cgcaguuugacgucauggccga

SEQ ID NO: 370417 - RNA, 18 nt, Bordetella pertussis
cgcauacagggcggugcg

SEQ ID NO: 370418 - RNA, 14 nt, Bordetella pertussis
cgcauaccggccgc

SEQ ID NO: 370419 - RNA, 20 nt, Bordetella pertussis
cgcauaccuuggcgcccagc

SEQ ID NO: 370420 - RNA, 21 nt, Bordetella pertussis
cgcauacgacacgucaucgug

SEQ ID NO: 370421 - RNA, 21 nt, Bordetella pertussis
cgcauacgcggguucgacgcc

SEQ ID NO: 370422 - RNA, 22 nt, Bordetella pertussis
cgcauacgcggguucgacgccg

SEQ ID NO: 370423 - RNA, 21 nt, Bordetella pertussis
cgcauacggacgagcgcagca

SEQ ID NO: 370424 - RNA, 19 nt, Bordetella pertussis
cgcauacucgaugcccagc

SEQ ID NO: 370425 - RNA, 20 nt, Bordetella pertussis
cgcauacucgaugcccagca

SEQ ID NO: 370426 - RNA, 17 nt, Bordetella pertussis
cgcauaggacgccacca

SEQ ID NO: 370427 - RNA, 15 nt, Bordetella pertussis
cgcauagguaucggc

SEQ ID NO: 370428 - RNA, 22 nt, Bordetella pertussis
cgcauagguaucggcccgcgcc

SEQ ID NO: 370429 - RNA, 17 nt, Bordetella pertussis
cgcauauccaggcggcg

SEQ ID NO: 370430 - RNA, 18 nt, Bordetella pertussis
cgcauauccaggcggcgc

SEQ ID NO: 370431 - RNA, 16 nt, Bordetella pertussis
cgcaucacgcuggccg

SEQ ID NO: 370432 - RNA, 20 nt, Bordetella pertussis
cgcaucacgcuggccgcgcc

SEQ ID NO: 370433 - RNA, 24 nt, Bordetella pertussis
cgcaucagcgcauugcgguccagg

SEQ ID NO: 370434 - RNA, 15 nt, Bordetella pertussis
cgcaucagcgcgccc

SEQ ID NO: 370435 - RNA, 17 nt, Bordetella pertussis
cgcaucagcgcgcccgc

SEQ ID NO: 370436 - RNA, 16 nt, Bordetella pertussis
cgcaucaugaggcggc

SEQ ID NO: 370437 - RNA, 15 nt, Bordetella pertussis
cgcauccaggugccg

SEQ ID NO: 370438 - RNA, 15 nt, Bordetella pertussis
cgcaugagccggcag

SEQ ID NO: 370439 - RNA, 17 nt, Bordetella pertussis
cgcaugaugcugccggg

SEQ ID NO: 370440 - RNA, 19 nt, Bordetella pertussis
cgcaugaugcugccgggca

SEQ ID NO: 370441 - RNA, 14 nt, Bordetella pertussis
cgcaugauggccgg

SEQ ID NO: 370442 - RNA, 17 nt, Bordetella pertussis
cgcaugauggccggccu

SEQ ID NO: 370443 - RNA, 18 nt, Bordetella pertussis
cgcaugauggccggccug

SEQ ID NO: 370444 - RNA, 21 nt, Bordetella pertussis
cgcaugauuccugucgcgcug

SEQ ID NO: 370445 - RNA, 18 nt, Bordetella pertussis
cgcaugcaagacaggccg

SEQ ID NO: 370446 - RNA, 19 nt, Bordetella pertussis
cgcaugcaagacaggccgc

SEQ ID NO: 370447 - RNA, 21 nt, Bordetella pertussis
cgcaugcaagacaggccgcua

SEQ ID NO: 370448 - RNA, 23 nt, Bordetella pertussis
cgcaugcaagacaggccgcuacg

SEQ ID NO: 370449 - RNA, 13 nt, Bordetella pertussis
cgcaugccagcuu

SEQ ID NO: 370450 - RNA, 15 nt, Bordetella pertussis
cgcaugccagcuugc

SEQ ID NO: 370451 - RNA, 17 nt, Bordetella pertussis
cgcaugccgucgagcgc

SEQ ID NO: 370452 - RNA, 14 nt, Bordetella pertussis
cgcaugcgccuguc

SEQ ID NO: 370453 - RNA, 22 nt, Bordetella pertussis
cgcaugcgccugucccaggcgc

SEQ ID NO: 370454 - RNA, 20 nt, Bordetella pertussis
cgcaugcgcgcggcucgccg

SEQ ID NO: 370455 - RNA, 18 nt, Bordetella pertussis
cgcaugcgguuucucagc

SEQ ID NO: 370456 - RNA, 20 nt, Bordetella pertussis
cgcaugcgugaagcccaugg

SEQ ID NO: 370457 - RNA, 15 nt, Bordetella pertussis
cgcaugcgugcgcau

SEQ ID NO: 370458 - RNA, 20 nt, Bordetella pertussis
cgcaugcugcagcugcuugc

SEQ ID NO: 370459 - RNA, 17 nt, Bordetella pertussis
cgcauguccgccacgcc

SEQ ID NO: 370460 - RNA, 22 nt, Bordetella pertussis
cgcauuaucgcuaggaucgcga

SEQ ID NO: 370461 - RNA, 15 nt, Bordetella pertussis
cgcauucgccggaca

SEQ ID NO: 370462 - RNA, 22 nt, Bordetella pertussis
cgccaaagaucaaaaaggcccu

SEQ ID NO: 370463 - RNA, 13 nt, Bordetella pertussis
cgccaacgcggcg

SEQ ID NO: 370464 - RNA, 13 nt, Bordetella pertussis
cgccaacggugcc

SEQ ID NO: 370465 - RNA, 19 nt, Bordetella pertussis
cgccaacgucggcagccag

SEQ ID NO: 370466 - RNA, 16 nt, Bordetella pertussis
cgccaagggcgcgcca

SEQ ID NO: 370467 - RNA, 17 nt, Bordetella pertussis
cgccaccgugauggcgc

SEQ ID NO: 370468 - RNA, 16 nt, Bordetella pertussis
cgccaccguggccacg

SEQ ID NO: 370469 - RNA, 18 nt, Bordetella pertussis
cgccaccguggccacggc

SEQ ID NO: 370470 - RNA, 20 nt, Bordetella pertussis
cgccaccguggccacggccg

SEQ ID NO: 370471 - RNA, 13 nt, Bordetella pertussis
cgccaccguggcg

SEQ ID NO: 370472 - RNA, 17 nt, Bordetella pertussis
cgccaccguggcgucca

SEQ ID NO: 370473 - RNA, 14 nt, Bordetella pertussis
cgccaccucgauca

SEQ ID NO: 370474 - RNA, 14 nt, Bordetella pertussis
cgccaccucggcgu

SEQ ID NO: 370475 - RNA, 18 nt, Bordetella pertussis
cgccaccuggcgcccggc

SEQ ID NO: 370476 - RNA, 19 nt, Bordetella pertussis
cgccaccuggcgcccggcg

SEQ ID NO: 370477 - RNA, 14 nt, Bordetella pertussis
cgccaccugggccg

SEQ ID NO: 370478 - RNA, 17 nt, Bordetella pertussis
cgccaccuucgccgcgc

SEQ ID NO: 370479 - RNA, 20 nt, Bordetella pertussis
cgccaccuucgccgcgcaca

SEQ ID NO: 370480 - RNA, 20 nt, Bordetella pertussis
cgccacgccuuguucgcgcg

SEQ ID NO: 370481 - RNA, 22 nt, Bordetella pertussis
cgccacgccuuguucgcgcgcg

SEQ ID NO: 370482 - RNA, 14 nt, Bordetella pertussis
cgccacgcgcacgg

SEQ ID NO: 370483 - RNA, 15 nt, Bordetella pertussis
cgccacgcgcacggc

SEQ ID NO: 370484 - RNA, 21 nt, Bordetella pertussis
cgccacgcgcacggccagcau

SEQ ID NO: 370485 - RNA, 22 nt, Bordetella pertussis
cgccacgcgcggaucggccacg

SEQ ID NO: 370486 - RNA, 24 nt, Bordetella pertussis
cgccacgcgcggaucggccacgau

SEQ ID NO: 370487 - RNA, 14 nt, Bordetella pertussis
cgccacgcuggccg

SEQ ID NO: 370488 - RNA, 20 nt, Bordetella pertussis
cgccacgucacggaucagcc

SEQ ID NO: 370489 - RNA, 16 nt, Bordetella pertussis
cgccacgucgaccucg

SEQ ID NO: 370490 - RNA, 20 nt, Bordetella pertussis
cgccacgucgaccucgagca

SEQ ID NO: 370491 - RNA, 23 nt, Bordetella pertussis
cgccacgucgaccucgagcaccu

SEQ ID NO: 370492 - RNA, 15 nt, Bordetella pertussis
cgccacgucgccggc

SEQ ID NO: 370493 - RNA, 15 nt, Bordetella pertussis
cgccacgugcugcug

SEQ ID NO: 370494 - RNA, 17 nt, Bordetella pertussis
cgccacgugcugcugga

SEQ ID NO: 370495 - RNA, 20 nt, Bordetella pertussis
cgccacguugaagcgcagcc

SEQ ID NO: 370496 - RNA, 23 nt, Bordetella pertussis
cgccacguugaagcgcagccacg

SEQ ID NO: 370497 - RNA, 17 nt, Bordetella pertussis
cgccacugccaggcgcc

SEQ ID NO: 370498 - RNA, 20 nt, Bordetella pertussis
cgccacugccaggcgcccca

SEQ ID NO: 370499 - RNA, 13 nt, Bordetella pertussis
cgccagcaaggcg

SEQ ID NO: 370500 - RNA, 22 nt, Bordetella pertussis
cgccagcaaggcgucggccagg

SEQ ID NO: 370501 - RNA, 14 nt, Bordetella pertussis
cgccagcaccggca

SEQ ID NO: 370502 - RNA, 15 nt, Bordetella pertussis
cgccagcaccggcac

SEQ ID NO: 370503 - RNA, 16 nt, Bordetella pertussis
cgccagcaccggcacg

SEQ ID NO: 370504 - RNA, 20 nt, Bordetella pertussis
cgccagcaccggcacgcgcc

SEQ ID NO: 370505 - RNA, 23 nt, Bordetella pertussis
cgccagcaccggcacgcgccagg

SEQ ID NO: 370506 - RNA, 13 nt, Bordetella pertussis
cgccagcaccggc

SEQ ID NO: 370507 - RNA, 12 nt, Bordetella pertussis
cgccagcacgaa

SEQ ID NO: 370508 - RNA, 16 nt, Bordetella pertussis
cgccagcacgcgcagc

SEQ ID NO: 370509 - RNA, 22 nt, Bordetella pertussis
cgccagcacgcgcagcuugccc

SEQ ID NO: 370510 - RNA, 17 nt, Bordetella pertussis
cgccagcacgguggcgc

SEQ ID NO: 370511 - RNA, 19 nt, Bordetella pertussis
cgccagcacgguggcgccc

SEQ ID NO: 370512 - RNA, 13 nt, Bordetella pertussis
cgccagcauccag

SEQ ID NO: 370513 - RNA, 15 nt, Bordetella pertussis
cgccagcaugcgcgc

SEQ ID NO: 370514 - RNA, 17 nt, Bordetella pertussis
cgccagcaugcgcgcgg

SEQ ID NO: 370515 - RNA, 18 nt, Bordetella pertussis
cgccagcaugcgcgcggc

SEQ ID NO: 370516 - RNA, 20 nt, Bordetella pertussis
cgccagcaugcgcgcggccu

SEQ ID NO: 370517 - RNA, 17 nt, Bordetella pertussis
cgccagcauggcggcca

SEQ ID NO: 370518 - RNA, 18 nt, Bordetella pertussis
cgccagcauggcggccag

SEQ ID NO: 370519 - RNA, 16 nt, Bordetella pertussis
cgccagcauggcgucg

SEQ ID NO: 370520 - RNA, 18 nt, Bordetella pertussis
cgccagccacgcgcgcug

SEQ ID NO: 370521 - RNA, 14 nt, Bordetella pertussis
cgccagccagcgca

SEQ ID NO: 370522 - RNA, 18 nt, Bordetella pertussis
cgccagccagcgcaugcc

SEQ ID NO: 370523 - RNA, 13 nt, Bordetella pertussis
cgccagccgcgcc

SEQ ID NO: 370524 - RNA, 20 nt, Bordetella pertussis
cgccagccgcgccugcagca

SEQ ID NO: 370525 - RNA, 22 nt, Bordetella pertussis
cgccagccgcgccugcagcagc

SEQ ID NO: 370526 - RNA, 23 nt, Bordetella pertussis
cgccagccgcgccugcagcagcg

SEQ ID NO: 370527 - RNA, 14 nt, Bordetella pertussis
cgccagccgcgcga

SEQ ID NO: 370528 - RNA, 19 nt, Bordetella pertussis
cgccagccgcgcgaccuug

SEQ ID NO: 370529 - RNA, 13 nt, Bordetella pertussis
cgccagccgcugc

SEQ ID NO: 370530 - RNA, 17 nt, Bordetella pertussis
cgccagccgcugcagcg

SEQ ID NO: 370531 - RNA, 17 nt, Bordetella pertussis
cgccagccgcuggcgcg

SEQ ID NO: 370532 - RNA, 18 nt, Bordetella pertussis
cgccagccgcuggcgcgc

SEQ ID NO: 370533 - RNA, 20 nt, Bordetella pertussis
cgccagccgcuggcgcgccg

SEQ ID NO: 370534 - RNA, 13 nt, Bordetella pertussis
cgccagccgcuug

SEQ ID NO: 370535 - RNA, 16 nt, Bordetella pertussis
cgccagccgcuugccc

SEQ ID NO: 370536 - RNA, 12 nt, Bordetella pertussis
cgccagccggcc

SEQ ID NO: 370537 - RNA, 18 nt, Bordetella pertussis
cgccagccggcccagcac

SEQ ID NO: 370538 - RNA, 22 nt, Bordetella pertussis
cgccagccggcccagcacgccg

SEQ ID NO: 370539 - RNA, 22 nt, Bordetella pertussis
cgccagccguugcgccagcggc

SEQ ID NO: 370540 - RNA, 14 nt, Bordetella pertussis
cgccagcgccucca

SEQ ID NO: 370541 - RNA, 23 nt, Bordetella pertussis
cgccagcgccuccaucagcagca

SEQ ID NO: 370542 - RNA, 23 nt, Bordetella pertussis
cgccagcgccucgcgcucgagcg

SEQ ID NO: 370543 - RNA, 13 nt, Bordetella pertussis
cgccagcgccugg

SEQ ID NO: 370544 - RNA, 15 nt, Bordetella pertussis
cgccagcgccuggac

SEQ ID NO: 370545 - RNA, 18 nt, Bordetella pertussis
cgccagcgccuggaccug

SEQ ID NO: 370546 - RNA, 20 nt, Bordetella pertussis
cgccagcgccuggaccugga

SEQ ID NO: 370547 - RNA, 20 nt, Bordetella pertussis
cgccagcgccugggucaggu

SEQ ID NO: 370548 - RNA, 23 nt, Bordetella pertussis
cgccagcgccugggucaggucgg

SEQ ID NO: 370549 - RNA, 13 nt, Bordetella pertussis
cgccagcgccggg

SEQ ID NO: 370550 - RNA, 20 nt, Bordetella pertussis
cgccagcgccggggucagcg

SEQ ID NO: 370551 - RNA, 19 nt, Bordetella pertussis
cgccagcgcgccgcccacc

SEQ ID NO: 370552 - RNA, 12 nt, Bordetella pertussis
cgccagcgcgcg

SEQ ID NO: 370553 - RNA, 22 nt, Bordetella pertussis
cgccagcgcgcgauagauggcc

SEQ ID NO: 370554 - RNA, 21 nt, Bordetella pertussis
cgccagcgcgcgcgaggcggc

SEQ ID NO: 370555 - RNA, 12 nt, Bordetella pertussis
cgccagcgcggc

SEQ ID NO: 370556 - RNA, 14 nt, Bordetella pertussis
cgccagcgcggcca

SEQ ID NO: 370557 - RNA, 16 nt, Bordetella pertussis
cgccagcgcggccagc

SEQ ID NO: 370558 - RNA, 19 nt, Bordetella pertussis
cgccagcgcggccagcgcg

SEQ ID NO: 370559 - RNA, 13 nt, Bordetella pertussis
cgccagcgcggcg

SEQ ID NO: 370560 - RNA, 13 nt, Bordetella pertussis
cgccagcgcgcca

SEQ ID NO: 370561 - RNA, 20 nt, Bordetella pertussis
cgccagcgcgccauggccgg

SEQ ID NO: 370562 - RNA, 20 nt, Bordetella pertussis
cgccagcgcggcgggccggu

SEQ ID NO: 370563 - RNA, 13 nt, Bordetella pertussis
cgccagcguggcc

SEQ ID NO: 370564 - RNA, 14 nt, Bordetella pertussis
cgccagcguggccg

SEQ ID NO: 370565 - RNA, 17 nt, Bordetella pertussis
cgccagcguggccgagg

SEQ ID NO: 370566 - RNA, 18 nt, Bordetella pertussis
cgccagcguggccgaggu

SEQ ID NO: 370567 - RNA, 19 nt, Bordetella pertussis
cgccagcuccagccgcagg

SEQ ID NO: 370568 - RNA, 16 nt, Bordetella pertussis
cgccagcucgcgcagc

SEQ ID NO: 370569 - RNA, 17 nt, Bordetella pertussis
cgccagcucgcgcagca

SEQ ID NO: 370570 - RNA, 11 nt, Bordetella pertussis
cgccagcucgg

SEQ ID NO: 370571 - RNA, 14 nt, Bordetella pertussis
cgccagcucggccu

SEQ ID NO: 370572 - RNA, 15 nt, Bordetella pertussis
cgccagcucggccug

SEQ ID NO: 370573 - RNA, 17 nt, Bordetella pertussis
cgccaggcccagggcca

SEQ ID NO: 370574 - RNA, 19 nt, Bordetella pertussis
cgccaggcccagggccagg

SEQ ID NO: 370575 - RNA, 20 nt, Bordetella pertussis
cgccaggcccagggccaggu

SEQ ID NO: 370576 - RNA, 16 nt, Bordetella pertussis
cgccaggccgcgcagg

SEQ ID NO: 370577 - RNA, 18 nt, Bordetella pertussis
cgccaggccgcgcagggc

SEQ ID NO: 370578 - RNA, 12 nt, Bordetella pertussis
cgccaggccggc

SEQ ID NO: 370579 - RNA, 14 nt, Bordetella pertussis
cgccaggccggcgg

SEQ ID NO: 370580 - RNA, 17 nt, Bordetella pertussis
cgccaggcgauggccgg

SEQ ID NO: 370581 - RNA, 14 nt, Bordetella pertussis
cgccaggcgccggg

SEQ ID NO: 370582 - RNA, 15 nt, Bordetella pertussis
cgccaggcgccgggc

SEQ ID NO: 370583 - RNA, 17 nt, Bordetella pertussis
cgccaggcgccgggccg

SEQ ID NO: 370584 - RNA, 19 nt, Bordetella pertussis
cgccaggcgaaccuggcgg

SEQ ID NO: 370585 - RNA, 20 nt, Bordetella pertussis
cgccaggcgcgcaucgcgcg

SEQ ID NO: 370586 - RNA, 14 nt, Bordetella pertussis
cgccaggcgcucgg

SEQ ID NO: 370587 - RNA, 16 nt, Bordetella pertussis
cgccaggcgcugcgcg

SEQ ID NO: 370588 - RNA, 21 nt, Bordetella pertussis
cgccaggcgguacaggccggc

SEQ ID NO: 370589 - RNA, 23 nt, Bordetella pertussis
cgccaggcgguacaggccggcgg

SEQ ID NO: 370590 - RNA, 20 nt, Bordetella pertussis
cgccaggcugaaugccgccg

SEQ ID NO: 370591 - RNA, 19 nt, Bordetella pertussis
cgccaggcugucgucgucg

SEQ ID NO: 370592 - RNA, 22 nt, Bordetella pertussis
cgccaggcugucgucgucggca

SEQ ID NO: 370593 - RNA, 13 nt, Bordetella pertussis
cgccagggccagg

SEQ ID NO: 370594 - RNA, 14 nt, Bordetella pertussis
cgccagggccaggc

SEQ ID NO: 370595 - RNA, 22 nt, Bordetella pertussis
cgccagggccaggccgccgccg

SEQ ID NO: 370596 - RNA, 14 nt, Bordetella pertussis
cgccagggccgccg

SEQ ID NO: 370597 - RNA, 15 nt, Bordetella pertussis
cgccagggccgccgc

SEQ ID NO: 370598 - RNA, 22 nt, Bordetella pertussis
cgccagggccuccucggucggg

SEQ ID NO: 370599 - RNA, 16 nt, Bordetella pertussis
cgccagggcgccgcgg

SEQ ID NO: 370600 - RNA, 20 nt, Bordetella pertussis
cgccagggccccuccggcgc

SEQ ID NO: 370601 - RNA, 22 nt, Bordetella pertussis
cgccagggccccuccggcgccg

SEQ ID NO: 370602 - RNA, 17 nt, Bordetella pertussis
cgccagggucugcuggu

SEQ ID NO: 370603 - RNA, 24 nt, Bordetella pertussis
cgccagggucugcuggucgcgggc

SEQ ID NO: 370604 - RNA, 16 nt, Bordetella pertussis
cgccagguaggccggc

SEQ ID NO: 370605 - RNA, 23 nt, Bordetella pertussis
cgccagguaggccggcgcgaccg

SEQ ID NO: 370606 - RNA, 14 nt, Bordetella pertussis
cgccaggucggcca

SEQ ID NO: 370607 - RNA, 16 nt, Bordetella pertussis
cgccaggucggccacc

SEQ ID NO: 370608 - RNA, 18 nt, Bordetella pertussis
cgccaggucggccaccgc

SEQ ID NO: 370609 - RNA, 17 nt, Bordetella pertussis
cgccaggucggccagcc

SEQ ID NO: 370610 - RNA, 18 nt, Bordetella pertussis
cgccaggucggccagccg

SEQ ID NO: 370611 - RNA, 20 nt, Bordetella pertussis
cgccaggucggccagccggc

SEQ ID NO: 370612 - RNA, 21 nt, Bordetella pertussis
cgccaggucggccagccggcc

SEQ ID NO: 370613 - RNA, 14 nt, Bordetella pertussis
cgccaggucgcgca

SEQ ID NO: 370614 - RNA, 17 nt, Bordetella pertussis
cgccaggucgcgcacca

SEQ ID NO: 370615 - RNA, 14 nt, Bordetella pertussis
cgccaggugggcca

SEQ ID NO: 370616 - RNA, 21 nt, Bordetella pertussis
cgccaggugcuugcggcuguc

SEQ ID NO: 370617 - RNA, 19 nt, Bordetella pertussis
cgccagguucgccuggcgg

SEQ ID NO: 370618 - RNA, 16 nt, Bordetella pertussis
cgccaguagcgccggc

SEQ ID NO: 370619 - RNA, 19 nt, Bordetella pertussis
cgccaguagcgccggcuug

SEQ ID NO: 370620 - RNA, 13 nt, Bordetella pertussis
cgccaguccagcg

SEQ ID NO: 370621 - RNA, 22 nt, Bordetella pertussis
cgccaguccccaugcggggacu

SEQ ID NO: 370622 - RNA, 22 nt, Bordetella pertussis
cgccaguccgcgcucgcccagc

SEQ ID NO: 370623 - RNA, 15 nt, Bordetella pertussis
cgccagucgcgcagc

SEQ ID NO: 370624 - RNA, 22 nt, Bordetella pertussis
cgccaguucaaggcgcgaguau

SEQ ID NO: 370625 - RNA, 21 nt, Bordetella pertussis
cgccaguucgaguuccgcgac

SEQ ID NO: 370626 - RNA, 23 nt, Bordetella pertussis
cgccaguucgaguuccgcgacgc

SEQ ID NO: 370627 - RNA, 17 nt, Bordetella pertussis
cgccaguugcggggcgc

SEQ ID NO: 370628 - RNA, 20 nt, Bordetella pertussis
cgccaguugcggggcgccca

SEQ ID NO: 370629 - RNA, 22 nt, Bordetella pertussis
cgccaguugcggggcgcccagc

SEQ ID NO: 370630 - RNA, 21 nt, Bordetella pertussis
cgccauaggcgcgcaccagcc

SEQ ID NO: 370631 - RNA, 22 nt, Bordetella pertussis
cgccauaggcgcgcaccagccc

SEQ ID NO: 370632 - RNA, 22 nt, Bordetella pertussis
cgccauagcguucgguggcgug

SEQ ID NO: 370633 - RNA, 19 nt, Bordetella pertussis
cgccauauugaugcagcac

SEQ ID NO: 370634 - RNA, 18 nt, Bordetella pertussis
cgccaucaagagcaccgu

SEQ ID NO: 370635 - RNA, 22 nt, Bordetella pertussis
cgccaucacggugucgaugggc

SEQ ID NO: 370636 - RNA, 16 nt, Bordetella pertussis
cgccaucauggcgucg

SEQ ID NO: 370637 - RNA, 22 nt, Bordetella pertussis
cgccaucauggcgucggccacg

SEQ ID NO: 370638 - RNA, 14 nt, Bordetella pertussis
cgccauccuggccg

SEQ ID NO: 370639 - RNA, 16 nt, Bordetella pertussis
cgccauccuggccgcc

SEQ ID NO: 370640 - RNA, 17 nt, Bordetella pertussis
cgccauccuggccgccg

SEQ ID NO: 370641 - RNA, 23 nt, Bordetella pertussis
cgccauccuggccgccgcgggcg

SEQ ID NO: 370642 - RNA, 19 nt, Bordetella pertussis
cgccaucgacgcuugccgg

SEQ ID NO: 370643 - RNA, 22 nt, Bordetella pertussis
cgccaucgacgcuugccggcga

SEQ ID NO: 370644 - RNA, 22 nt, Bordetella pertussis
cgccaucggcauuucgcauacc

SEQ ID NO: 370645 - RNA, 14 nt, Bordetella pertussis
cgccaucggccggc

SEQ ID NO: 370646 - RNA, 21 nt, Bordetella pertussis
cgccaucgucguagcgccagc

SEQ ID NO: 370647 - RNA, 20 nt, Bordetella pertussis
cgccaucucaaccacgaaca

SEQ ID NO: 370648 - RNA, 23 nt, Bordetella pertussis
cgccaucucaaccacgaacacga

SEQ ID NO: 370649 - RNA, 12 nt, Bordetella pertussis
cgccaucucgcg

SEQ ID NO: 370650 - RNA, 15 nt, Bordetella pertussis
cgccaucucgcgcgc

SEQ ID NO: 370651 - RNA, 14 nt, Bordetella pertussis
cgccaucucgucgg

SEQ ID NO: 370652 - RNA, 22 nt, Bordetella pertussis
cgccaucucgucggucaugccc

SEQ ID NO: 370653 - RNA, 13 nt, Bordetella pertussis
cgccaucugcugc

SEQ ID NO: 370654 - RNA, 22 nt, Bordetella pertussis
cgccaucugcugcgagacgcgc

SEQ ID NO: 370655 - RNA, 18 nt, Bordetella pertussis
cgccaucuugcaggcgcc

SEQ ID NO: 370656 - RNA, 16 nt, Bordetella pertussis
cgccaugaacucgcgc

SEQ ID NO: 370657 - RNA, 22 nt, Bordetella pertussis
cgccaugaacucgcgcucggcg

SEQ ID NO: 370658 - RNA, 12 nt, Bordetella pertussis
cgccaugagcgc

SEQ ID NO: 370659 - RNA, 20 nt, Bordetella pertussis
cgccaugcaacacgaccagc

SEQ ID NO: 370660 - RNA, 22 nt, Bordetella pertussis
cgccaugcaacacgaccagcag

SEQ ID NO: 370661 - RNA, 15 nt, Bordetella pertussis
cgccaugcacgggcc

SEQ ID NO: 370662 - RNA, 13 nt, Bordetella pertussis
cgccaugcagcug

SEQ ID NO: 370663 - RNA, 20 nt, Bordetella pertussis
cgccaugcagcuggauggcc

SEQ ID NO: 370664 - RNA, 17 nt, Bordetella pertussis
cgccaugccgcgcccgc

SEQ ID NO: 370665 - RNA, 17 nt, Bordetella pertussis
cgccaugccggccccgu

SEQ ID NO: 370666 - RNA, 12 nt, Bordetella pertussis
cgccaugccggg

SEQ ID NO: 370667 - RNA, 18 nt, Bordetella pertussis
cgccaugcgacagcccgg

SEQ ID NO: 370668 - RNA, 15 nt, Bordetella pertussis
cgcccccgcccagca

SEQ ID NO: 370669 - RNA, 16 nt, Bordetella pertussis
cgcccccgccgcacgg

SEQ ID NO: 370670 - RNA, 15 nt, Bordetella pertussis
cgcccccgccgccau

SEQ ID NO: 370671 - RNA, 23 nt, Bordetella pertussis
cgccccgaucagcaagggcccca

SEQ ID NO: 370672 - RNA, 13 nt, Bordetella pertussis
cgccccgaucggc

SEQ ID NO: 370673 - RNA, 17 nt, Bordetella pertussis
cgccccgaucggcgccg

SEQ ID NO: 370674 - RNA, 21 nt, Bordetella pertussis
cgccccgaucggcgccgcgcg

SEQ ID NO: 370675 - RNA, 20 nt, Bordetella pertussis
cgccccgccucgacgaugcc

SEQ ID NO: 370676 - RNA, 15 nt, Bordetella pertussis
cgccccgcaguuuga

SEQ ID NO: 370677 - RNA, 14 nt, Bordetella pertussis
cgccccgcuggccg

SEQ ID NO: 370678 - RNA, 17 nt, Bordetella pertussis
cgccccgcuucgggccg

SEQ ID NO: 370679 - RNA, 14 nt, Bordetella pertussis
cgccccggcgcggc

SEQ ID NO: 370680 - RNA, 22 nt, Bordetella pertussis
cgccccggcgcggcgcgcgccg

SEQ ID NO: 370681 - RNA, 16 nt, Bordetella pertussis
cgcccgaccugcuggc

SEQ ID NO: 370682 - RNA, 22 nt, Bordetella pertussis
cgcccgacgaggagccggcggg

SEQ ID NO: 370683 - RNA, 13 nt, Bordetella pertussis
cgcccgacggcgc

SEQ ID NO: 370684 - RNA, 19 nt, Bordetella pertussis
cgcccgacggcgcgcccgc

SEQ ID NO: 370685 - RNA, 17 nt, Bordetella pertussis
cgcccgacgguaucuca

SEQ ID NO: 370686 - RNA, 15 nt, Bordetella pertussis
cgcccgagagcugcg

SEQ ID NO: 370687 - RNA, 20 nt, Bordetella pertussis
cgcccgagagcugcgucuug

SEQ ID NO: 370688 - RNA, 19 nt, Bordetella pertussis
cgcccgagauggcgcaggc

SEQ ID NO: 370689 - RNA, 13 nt, Bordetella pertussis
cgcccgagcgcca

SEQ ID NO: 370690 - RNA, 15 nt, Bordetella pertussis
cgcccgagcgccaca

SEQ ID NO: 370691 - RNA, 17 nt, Bordetella pertussis
cgcccgagcuggccggc

SEQ ID NO: 370692 - RNA, 20 nt, Bordetella pertussis
cgcccgagcuggccggcgac

SEQ ID NO: 370693 - RNA, 17 nt, Bordetella pertussis
cgcccgaggcgcgcagc

SEQ ID NO: 370694 - RNA, 16 nt, Bordetella pertussis
cgcccgaucggccggc

SEQ ID NO: 370695 - RNA, 18 nt, Bordetella pertussis
cgcccgaucggccggccg

SEQ ID NO: 370696 - RNA, 16 nt, Bordetella pertussis
cgcccgaugcucgccg

SEQ ID NO: 370697 - RNA, 22 nt, Bordetella pertussis
cgcccgaugcucgccggcgccg

SEQ ID NO: 370698 - RNA, 17 nt, Bordetella pertussis
cgcccgaugccuuggug

SEQ ID NO: 370699 - RNA, 16 nt, Bordetella pertussis
cgcccgcaacgggccg

SEQ ID NO: 370700 - RNA, 13 nt, Bordetella pertussis
cgcccgcccgcug

SEQ ID NO: 370701 - RNA, 13 nt, Bordetella pertussis
cgcccgccgacga

SEQ ID NO: 370702 - RNA, 15 nt, Bordetella pertussis
cgcccgccgacgaaa

SEQ ID NO: 370703 - RNA, 13 nt, Bordetella pertussis
cgcccgccgcgcc

SEQ ID NO: 370704 - RNA, 14 nt, Bordetella pertussis
cgcccgccgggccg

SEQ ID NO: 370705 - RNA, 17 nt, Bordetella pertussis
cgcccgccugcagcagc

SEQ ID NO: 370706 - RNA, 21 nt, Bordetella pertussis
cgcccgccugcagcagcgccu

SEQ ID NO: 370707 - RNA, 15 nt, Bordetella pertussis
cgcccgccugccggc

SEQ ID NO: 370708 - RNA, 17 nt, Bordetella pertussis
cgcccgccugccggccu

SEQ ID NO: 370709 - RNA, 13 nt, Bordetella pertussis
cgcccgcggccag

SEQ ID NO: 370710 - RNA, 14 nt, Bordetella pertussis
cgcccgcggccagc

SEQ ID NO: 370711 - RNA, 15 nt, Bordetella pertussis
cgcccgcggccagcc

SEQ ID NO: 370712 - RNA, 16 nt, Bordetella pertussis
cgcccgcggccagcca

SEQ ID NO: 370713 - RNA, 13 nt, Bordetella pertussis
cgcccgcggccug

SEQ ID NO: 370714 - RNA, 15 nt, Bordetella pertussis
cgcccgcggccugca

SEQ ID NO: 370715 - RNA, 14 nt, Bordetella pertussis
cgcccgcggcgccc

SEQ ID NO: 370716 - RNA, 15 nt, Bordetella pertussis
cgcccgcggcgccca

SEQ ID NO: 370717 - RNA, 17 nt, Bordetella pertussis
cgcccgcggcgcccagc

SEQ ID NO: 370718 - RNA, 14 nt, Bordetella pertussis
cgcccgcggaucgg

SEQ ID NO: 370719 - RNA, 14 nt, Bordetella pertussis
cgcccgcgucacga

SEQ ID NO: 370720 - RNA, 19 nt, Bordetella pertussis
cgcccgcuugggccgcgcc

SEQ ID NO: 370721 - RNA, 16 nt, Bordetella pertussis
cgcccggaugggcggc

SEQ ID NO: 370722 - RNA, 14 nt, Bordetella pertussis
cgcccggcucgcug

SEQ ID NO: 370723 - RNA, 19 nt, Bordetella pertussis
cgcccgggccggcuacagc

SEQ ID NO: 370724 - RNA, 13 nt, Bordetella pertussis
cgcccgggcgccg

SEQ ID NO: 370725 - RNA, 15 nt, Bordetella pertussis
cgcccgggcgccggc

SEQ ID NO: 370726 - RNA, 16 nt, Bordetella pertussis
cgcccgggcgccggca

SEQ ID NO: 370727 - RNA, 15 nt, Bordetella pertussis
cgcccguccacggcc

SEQ ID NO: 370728 - RNA, 14 nt, Bordetella pertussis
cgcccgucccgacc

SEQ ID NO: 370729 - RNA, 20 nt, Bordetella pertussis
cgcccgugcagaagcugacc

SEQ ID NO: 370730 - RNA, 14 nt, Bordetella pertussis
cgcccgugcgcggc

SEQ ID NO: 370731 - RNA, 15 nt, Bordetella pertussis
cgcccgugcgcggcg

SEQ ID NO: 370732 - RNA, 16 nt, Bordetella pertussis
cgcccgugcgcggcga

SEQ ID NO: 370733 - RNA, 22 nt, Bordetella pertussis
cgcccgugcgcggcgagccgcg

SEQ ID NO: 370734 - RNA, 14 nt, Bordetella pertussis
cgcccgugucgccg

SEQ ID NO: 370735 - RNA, 18 nt, Bordetella pertussis
cgcccgugucgccgucgg

SEQ ID NO: 370736 - RNA, 14 nt, Bordetella pertussis
cgcccgugucggua

SEQ ID NO: 370737 - RNA, 17 nt, Bordetella pertussis
cgcccucaguccagcug

SEQ ID NO: 370738 - RNA, 14 nt, Bordetella pertussis
cgcccucgcgccac

SEQ ID NO: 370739 - RNA, 18 nt, Bordetella pertussis
cgcccucuuccguuggcc

SEQ ID NO: 370740 - RNA, 19 nt, Bordetella pertussis
cgcccugaacuauggcgcg

SEQ ID NO: 370741 - RNA, 13 nt, Bordetella pertussis
cgcccugacgacc

SEQ ID NO: 370742 - RNA, 17 nt, Bordetella pertussis
cgcccugacgaccaacc

SEQ ID NO: 370743 - RNA, 12 nt, Bordetella pertussis
cgcccugacgcc

SEQ ID NO: 370744 - RNA, 19 nt, Bordetella pertussis
cgcccugacgccugcgccg

SEQ ID NO: 370745 - RNA, 21 nt, Bordetella pertussis
cgcccugacgccugcgccggg

SEQ ID NO: 370746 - RNA, 23 nt, Bordetella pertussis
cgcccugacgccugcgccggguc

SEQ ID NO: 370747 - RNA, 14 nt, Bordetella pertussis
cgcccugcagggca

SEQ ID NO: 370748 - RNA, 13 nt, Bordetella pertussis
cgcccugcacgcg

SEQ ID NO: 370749 - RNA, 19 nt, Bordetella pertussis
cgcccuggccuucgaccug

SEQ ID NO: 370750 - RNA, 12 nt, Bordetella pertussis
cgcccuggcgca

SEQ ID NO: 370751 - RNA, 15 nt, Bordetella pertussis
cgcccuggcgcaggc

SEQ ID NO: 370752 - RNA, 18 nt, Bordetella pertussis
cgcccuggcgcaggccgg

SEQ ID NO: 370753 - RNA, 19 nt, Bordetella pertussis
cgcccuggcgccgcggccg

SEQ ID NO: 370754 - RNA, 20 nt, Bordetella pertussis
cgcccuggcgccgcggccgg

SEQ ID NO: 370755 - RNA, 12 nt, Bordetella pertussis
cgcccuggcgcg

SEQ ID NO: 370756 - RNA, 15 nt, Bordetella pertussis
cgcccuggcgcgagg

SEQ ID NO: 370757 - RNA, 20 nt, Bordetella pertussis
cgcccuggccguacauggcc

SEQ ID NO: 370758 - RNA, 23 nt, Bordetella pertussis
cgcccuggccguacauggccagg

SEQ ID NO: 370759 - RNA, 16 nt, Bordetella pertussis
cgcccuggcguggcgc

SEQ ID NO: 370760 - RNA, 18 nt, Bordetella pertussis
cgcccuggcguggcgcgc

SEQ ID NO: 370761 - RNA, 19 nt, Bordetella pertussis
cgcccuggcguggcgcgcg

SEQ ID NO: 370762 - RNA, 17 nt, Bordetella pertussis
cgcccuggcugagcgac

SEQ ID NO: 370763 - RNA, 16 nt, Bordetella pertussis
cgcccuggcuggcggc

SEQ ID NO: 370764 - RNA, 14 nt, Bordetella pertussis
cgcccuggccgcgc

SEQ ID NO: 370765 - RNA, 16 nt, Bordetella pertussis
cgcccuggccgcgccg

SEQ ID NO: 370766 - RNA, 20 nt, Bordetella pertussis
cgcccugucggugaugaucc

SEQ ID NO: 370767 - RNA, 14 nt, Bordetella pertussis
cgccgaaccagcgc

SEQ ID NO: 370768 - RNA, 15 nt, Bordetella pertussis
cgccgaaccagcgca

SEQ ID NO: 370769 - RNA, 15 nt, Bordetella pertussis
cgccgaacgacuugg

SEQ ID NO: 370770 - RNA, 16 nt, Bordetella pertussis
cgccgaacgacuuggc

SEQ ID NO: 370771 - RNA, 19 nt, Bordetella pertussis
cgccgaacgacuuggcgca

SEQ ID NO: 370772 - RNA, 15 nt, Bordetella pertussis
cgccgaacggggccg

SEQ ID NO: 370773 - RNA, 18 nt, Bordetella pertussis
cgccgaacggggccgccu

SEQ ID NO: 370774 - RNA, 14 nt, Bordetella pertussis
cgccgaacggcagc

SEQ ID NO: 370775 - RNA, 17 nt, Bordetella pertussis
cgccgaacggcagcagc

SEQ ID NO: 370776 - RNA, 14 nt, Bordetella pertussis
cgccgaacugccgg

SEQ ID NO: 370777 - RNA, 16 nt, Bordetella pertussis
cgccgaacugccggcg

SEQ ID NO: 370778 - RNA, 17 nt, Bordetella pertussis
cgccgaacugccggcgc

SEQ ID NO: 370779 - RNA, 19 nt, Bordetella pertussis
cgccgaacugccggcgcgg

SEQ ID NO: 370780 - RNA, 15 nt, Bordetella pertussis
cgccgaacugcuugc

SEQ ID NO: 370781 - RNA, 17 nt, Bordetella pertussis
cgccgaacugcuugcgc

SEQ ID NO: 370782 - RNA, 20 nt, Bordetella pertussis
cgccgaaggcggcgccggug

SEQ ID NO: 370783 - RNA, 17 nt, Bordetella pertussis
cgccgaagggcaggucg

SEQ ID NO: 370784 - RNA, 21 nt, Bordetella pertussis
cgccgaagggcaggucgucga

SEQ ID NO: 370785 - RNA, 16 nt, Bordetella pertussis
cgccgaagucggcgcg

SEQ ID NO: 370786 - RNA, 17 nt, Bordetella pertussis
cgccgaagucggcucgu

SEQ ID NO: 370787 - RNA, 17 nt, Bordetella pertussis
cgccgaaguugcggccg

SEQ ID NO: 370788 - RNA, 17 nt, Bordetella pertussis
cgccgaccagcucgacg

SEQ ID NO: 370789 - RNA, 19 nt, Bordetella pertussis
cgccgaccagguaucgacc

SEQ ID NO: 370790 - RNA, 14 nt, Bordetella pertussis
cgccgaccucggca

SEQ ID NO: 370791 - RNA, 18 nt, Bordetella pertussis
cgccgaccucggcaccga

SEQ ID NO: 370792 - RNA, 20 nt, Bordetella pertussis
cgccgaccucggcaccgagg

SEQ ID NO: 370793 - RNA, 23 nt, Bordetella pertussis
cgccgaccucggcaccgaggccg

SEQ ID NO: 370794 - RNA, 16 nt, Bordetella pertussis
cgccgaccuggcgccc

SEQ ID NO: 370795 - RNA, 18 nt, Bordetella pertussis
cgccgaccuggcgcccga

SEQ ID NO: 370796 - RNA, 20 nt, Bordetella pertussis
cgccgacgaaaugccggcga

SEQ ID NO: 370797 - RNA, 21 nt, Bordetella pertussis
cgccgacgaaaugccggcgaa

SEQ ID NO: 370798 - RNA, 13 nt, Bordetella pertussis
cgccgacgaccga

SEQ ID NO: 370799 - RNA, 22 nt, Bordetella pertussis
cgccgacggcgcccugcagggc

SEQ ID NO: 370800 - RNA, 14 nt, Bordetella pertussis
cgccgacggcggcg

SEQ ID NO: 370801 - RNA, 18 nt, Bordetella pertussis
cgccgacggcggcgcggc

SEQ ID NO: 370802 - RNA, 13 nt, Bordetella pertussis
cgccgacggcgcc

SEQ ID NO: 370803 - RNA, 14 nt, Bordetella pertussis
cgccgacgggccgg

SEQ ID NO: 370804 - RNA, 20 nt, Bordetella pertussis
cgccgagcggggccgcgccg

SEQ ID NO: 370805 - RNA, 11 nt, Bordetella pertussis
cgccgagcggc

SEQ ID NO: 370806 - RNA, 15 nt, Bordetella pertussis
cgccgagcggcaucu

SEQ ID NO: 370807 - RNA, 15 nt, Bordetella pertussis
cgccgagggccgcgc

SEQ ID NO: 370808 - RNA, 13 nt, Bordetella pertussis
cgccgagucggcg

SEQ ID NO: 370809 - RNA, 19 nt, Bordetella pertussis
cgccgagucggcgauggcg

SEQ ID NO: 370810 - RNA, 20 nt, Bordetella pertussis
cgccgauaccacgcgcggcg

SEQ ID NO: 370811 - RNA, 22 nt, Bordetella pertussis
cgccgauaccacgcgcggcggc

SEQ ID NO: 370812 - RNA, 13 nt, Bordetella pertussis
cgccgaucgagca

SEQ ID NO: 370813 - RNA, 18 nt, Bordetella pertussis
cgccgaucgagcaggccg

SEQ ID NO: 370814 - RNA, 17 nt, Bordetella pertussis
cgccgaucgcgcacagc

SEQ ID NO: 370815 - RNA, 23 nt, Bordetella pertussis
cgccgaucgcgcacagcauggcc

SEQ ID NO: 370816 - RNA, 16 nt, Bordetella pertussis
cgccgaucggcaaagc

SEQ ID NO: 370817 - RNA, 14 nt, Bordetella pertussis
cgccgaugaccagc

SEQ ID NO: 370818 - RNA, 14 nt, Bordetella pertussis
cgccgcagugcgcg

SEQ ID NO: 370819 - RNA, 17 nt, Bordetella pertussis
cgccgcagugcgcgcgc

SEQ ID NO: 370820 - RNA, 21 nt, Bordetella pertussis
cgccgcaucauguaaggcgca

SEQ ID NO: 370821 - RNA, 16 nt, Bordetella pertussis
cgccgcaugcggcggc

SEQ ID NO: 370822 - RNA, 17 nt, Bordetella pertussis
cgccgcaugcggcggcu

SEQ ID NO: 370823 - RNA, 18 nt, Bordetella pertussis
cgccgcaugcggcggcug

SEQ ID NO: 370824 - RNA, 17 nt, Bordetella pertussis
cgccgcaugggcgcgcc

SEQ ID NO: 370825 - RNA, 19 nt, Bordetella pertussis
cgccgcaugggcgcgcccg

SEQ ID NO: 370826 - RNA, 21 nt, Bordetella pertussis
cgccgcaugggcgcgcccggc

SEQ ID NO: 370827 - RNA, 22 nt, Bordetella pertussis
cgccgcaugggcgcgcccggcg

SEQ ID NO: 370828 - RNA, 21 nt, Bordetella pertussis
cgccgcauuuccucgaccagc

SEQ ID NO: 370829 - RNA, 23 nt, Bordetella pertussis
cgccgcauuucguaaagccgcac

SEQ ID NO: 370830 - RNA, 19 nt, Bordetella pertussis
cgccgccacaggcugacgc

SEQ ID NO: 370831 - RNA, 20 nt, Bordetella pertussis
cgccgccacaggcugacgcc

SEQ ID NO: 370832 - RNA, 17 nt, Bordetella pertussis
cgccgccaccagcggcg

SEQ ID NO: 370833 - RNA, 16 nt, Bordetella pertussis
cgccgccaccucggcg

SEQ ID NO: 370834 - RNA, 20 nt, Bordetella pertussis
cgccgccacgcgcacggcca

SEQ ID NO: 370835 - RNA, 23 nt, Bordetella pertussis
cgccgccacgcgcacggccagca

SEQ ID NO: 370836 - RNA, 13 nt, Bordetella pertussis
cgccgccacgcug

SEQ ID NO: 370837 - RNA, 15 nt, Bordetella pertussis
cgccgccacgcuggc

SEQ ID NO: 370838 - RNA, 16 nt, Bordetella pertussis
cgccgccagcacgcca

SEQ ID NO: 370839 - RNA, 16 nt, Bordetella pertussis
cgccgccagcagcgcc

SEQ ID NO: 370840 - RNA, 13 nt, Bordetella pertussis
cgccgccagcagc

SEQ ID NO: 370841 - RNA, 18 nt, Bordetella pertussis
cgccgccauagcugcgcc

SEQ ID NO: 370842 - RNA, 20 nt, Bordetella pertussis
cgccgccauggcggcgccca

SEQ ID NO: 370843 - RNA, 20 nt, Bordetella pertussis
cgccgccauggucgcgacca

SEQ ID NO: 370844 - RNA, 23 nt, Bordetella pertussis
cgccgccauggucgcgaccaccg

SEQ ID NO: 370845 - RNA, 19 nt, Bordetella pertussis
cgccgccauggugccgcgc

SEQ ID NO: 370846 - RNA, 20 nt, Bordetella pertussis
cgccgccauggugccgcgca

SEQ ID NO: 370847 - RNA, 23 nt, Bordetella pertussis
cgccgccauggugccgcgcaggc

SEQ ID NO: 370848 - RNA, 13 nt, Bordetella pertussis
cgccgcccaccac

SEQ ID NO: 370849 - RNA, 22 nt, Bordetella pertussis
cgccgccccgucaucgggugcg

SEQ ID NO: 370850 - RNA, 21 nt, Bordetella pertussis
cgccgcccgacagcacgcccg

SEQ ID NO: 370851 - RNA, 23 nt, Bordetella pertussis
cgccgcccgcaggcauugcgcca

SEQ ID NO: 370852 - RNA, 14 nt, Bordetella pertussis
cgccgcccgccagg

SEQ ID NO: 370853 - RNA, 16 nt, Bordetella pertussis
cgccgcccgcccgccg

SEQ ID NO: 370854 - RNA, 14 nt, Bordetella pertussis
cgccgcccgccuca

SEQ ID NO: 370855 - RNA, 14 nt, Bordetella pertussis
cgccgcccggcaac

SEQ ID NO: 370856 - RNA, 14 nt, Bordetella pertussis
cgccgcccggccgg

SEQ ID NO: 370857 - RNA, 15 nt, Bordetella pertussis
cgccgcccggccggc

SEQ ID NO: 370858 - RNA, 15 nt, Bordetella pertussis
cgccgcccgggccgg

SEQ ID NO: 370859 - RNA, 16 nt, Bordetella pertussis
cgccgcccgggccggc

SEQ ID NO: 370860 - RNA, 17 nt, Bordetella pertussis
cgccgcccgggccggcu

SEQ ID NO: 370861 - RNA, 19 nt, Bordetella pertussis
cgccgcccguccgggcggc

SEQ ID NO: 370862 - RNA, 15 nt, Bordetella pertussis
cgccgcccgugccag

SEQ ID NO: 370863 - RNA, 13 nt, Bordetella pertussis
cgccgccggcgcg

SEQ ID NO: 370864 - RNA, 14 nt, Bordetella pertussis
cgccgccggcgcgg

SEQ ID NO: 370865 - RNA, 15 nt, Bordetella pertussis
cgccgccggcgcggu

SEQ ID NO: 370866 - RNA, 13 nt, Bordetella pertussis
cgccgccggcgac

SEQ ID NO: 370867 - RNA, 14 nt, Bordetella pertussis
cgccgccggcgaca

SEQ ID NO: 370868 - RNA, 13 nt, Bordetella pertussis
cgccgccggcgga

SEQ ID NO: 370869 - RNA, 17 nt, Bordetella pertussis
cgccgccggcggccugg

SEQ ID NO: 370870 - RNA, 13 nt, Bordetella pertussis
cgccgccggcggc

SEQ ID NO: 370871 - RNA, 19 nt, Bordetella pertussis
cgccgccgggccugcccgc

SEQ ID NO: 370872 - RNA, 18 nt, Bordetella pertussis
cgccgccgggcgcgcgcc

SEQ ID NO: 370873 - RNA, 19 nt, Bordetella pertussis
cgccgccgggcgcgcgccg

SEQ ID NO: 370874 - RNA, 12 nt, Bordetella pertussis
cgccgccgggcu

SEQ ID NO: 370875 - RNA, 15 nt, Bordetella pertussis
cgccgccggucaccg

SEQ ID NO: 370876 - RNA, 23 nt, Bordetella pertussis
cgccgccucaggccggcgccugg

SEQ ID NO: 370877 - RNA, 18 nt, Bordetella pertussis
cgccgccucgcgcuccag

SEQ ID NO: 370878 - RNA, 14 nt, Bordetella pertussis
cgccgccucgggca

SEQ ID NO: 370879 - RNA, 18 nt, Bordetella pertussis
cgccgccucgggcacggc

SEQ ID NO: 370880 - RNA, 13 nt, Bordetella pertussis
cgccgccugcgca

SEQ ID NO: 370881 - RNA, 13 nt, Bordetella pertussis
cgccgccugcgcg

SEQ ID NO: 370882 - RNA, 16 nt, Bordetella pertussis
cgccgccugcgcgaaa

SEQ ID NO: 370883 - RNA, 12 nt, Bordetella pertussis
cgccgccugcgg

SEQ ID NO: 370884 - RNA, 13 nt, Bordetella pertussis
cgccgccugcggc

SEQ ID NO: 370885 - RNA, 15 nt, Bordetella pertussis
cgccgccugcggcgc

SEQ ID NO: 370886 - RNA, 13 nt, Bordetella pertussis
cgccgccuggccc

SEQ ID NO: 370887 - RNA, 14 nt, Bordetella pertussis
cgccgccuggccca

SEQ ID NO: 370888 - RNA, 22 nt, Bordetella pertussis
cgccgccuggcuuacaggccca

SEQ ID NO: 370889 - RNA, 16 nt, Bordetella pertussis
cgccgcgaacuggcgg

SEQ ID NO: 370890 - RNA, 19 nt, Bordetella pertussis
cgccgcgacacaaggcggc

SEQ ID NO: 370891 - RNA, 21 nt, Bordetella pertussis
cgccgcgaccaccagcaccau

SEQ ID NO: 370892 - RNA, 12 nt, Bordetella pertussis
cgccgcgaccgg

SEQ ID NO: 370893 - RNA, 16 nt, Bordetella pertussis
cgccgcgaccgggccg

SEQ ID NO: 370894 - RNA, 15 nt, Bordetella pertussis
cgccgcgacgcucga

SEQ ID NO: 370895 - RNA, 14 nt, Bordetella pertussis
cgccgcgaucagcg

SEQ ID NO: 370896 - RNA, 18 nt, Bordetella pertussis
cgccgcgaucagcgcggc

SEQ ID NO: 370897 - RNA, 20 nt, Bordetella pertussis
cgccgcgaucagcgcggccg

SEQ ID NO: 370898 - RNA, 16 nt, Bordetella pertussis
cgccgcgauggcgccg

SEQ ID NO: 370899 - RNA, 13 nt, Bordetella pertussis
cgccgcgauugca

SEQ ID NO: 370900 - RNA, 23 nt, Bordetella pertussis
cgccgcgcacagcccgaucgacg

SEQ ID NO: 370901 - RNA, 17 nt, Bordetella pertussis
cgccgcgcaccaccgag

SEQ ID NO: 370902 - RNA, 15 nt, Bordetella pertussis
cgccgcgcacgaugg

SEQ ID NO: 370903 - RNA, 16 nt, Bordetella pertussis
cgccgcgcacgggcgc

SEQ ID NO: 370904 - RNA, 14 nt, Bordetella pertussis
cgccgcgcagcagc

SEQ ID NO: 370905 - RNA, 12 nt, Bordetella pertussis
cgccgcgcagcc

SEQ ID NO: 370906 - RNA, 13 nt, Bordetella pertussis
cgccgcgcagccg

SEQ ID NO: 370907 - RNA, 21 nt, Bordetella pertussis
cgccgcgcaggaugacguggc

SEQ ID NO: 370908 - RNA, 13 nt, Bordetella pertussis
cgccgcgccagcu

SEQ ID NO: 370909 - RNA, 14 nt, Bordetella pertussis
cgccgcgccagcug

SEQ ID NO: 370910 - RNA, 13 nt, Bordetella pertussis
cgccgcgccaggc

SEQ ID NO: 370911 - RNA, 13 nt, Bordetella pertussis
cgccgcgccaggu

SEQ ID NO: 370912 - RNA, 13 nt, Bordetella pertussis
cgccgcgcccagc

SEQ ID NO: 370913 - RNA, 18 nt, Bordetella pertussis
cgccgcgcccagcagcgc

SEQ ID NO: 370914 - RNA, 14 nt, Bordetella pertussis
cgccgcgcccagcc

SEQ ID NO: 370915 - RNA, 12 nt, Bordetella pertussis
cgccgcgcccca

SEQ ID NO: 370916 - RNA, 12 nt, Bordetella pertussis
cgccgcgcccgc

SEQ ID NO: 370917 - RNA, 19 nt, Bordetella pertussis
cgccgcgcccuggcgcggc

SEQ ID NO: 370918 - RNA, 11 nt, Bordetella pertussis
cgccgcgccga

SEQ ID NO: 370919 - RNA, 21 nt, Bordetella pertussis
cgccgcgccgaacgcgcagcg

SEQ ID NO: 370920 - RNA, 13 nt, Bordetella pertussis
cgccgcgccgccg

SEQ ID NO: 370921 - RNA, 13 nt, Bordetella pertussis
cgccgcgccgcug

SEQ ID NO: 370922 - RNA, 14 nt, Bordetella pertussis
cgccgcgccgcugg

SEQ ID NO: 370923 - RNA, 14 nt, Bordetella pertussis
cgccgcgccggcgc

SEQ ID NO: 370924 - RNA, 15 nt, Bordetella pertussis
cgccgcgccggcgcg

SEQ ID NO: 370925 - RNA, 17 nt, Bordetella pertussis
cgccgcgccggggcggc

SEQ ID NO: 370926 - RNA, 16 nt, Bordetella pertussis
cgccgcgccggucagg

SEQ ID NO: 370927 - RNA, 13 nt, Bordetella pertussis
cgccgcgccucgg

SEQ ID NO: 370928 - RNA, 15 nt, Bordetella pertussis
cgccgcgccuugccc

SEQ ID NO: 370929 - RNA, 16 nt, Bordetella pertussis
cgccgcgcgccgcggc

SEQ ID NO: 370930 - RNA, 16 nt, Bordetella pertussis
cgccgcgcgcgacgcg

SEQ ID NO: 370931 - RNA, 15 nt, Bordetella pertussis
cgccgcgcgcggccc

SEQ ID NO: 370932 - RNA, 14 nt, Bordetella pertussis
cgccgcgcgcggcg

SEQ ID NO: 370933 - RNA, 21 nt, Bordetella pertussis
cgccgcgcgcgucgccgcugg

SEQ ID NO: 370934 - RNA, 14 nt, Bordetella pertussis
cgccgcgcgcuggc

SEQ ID NO: 370935 - RNA, 12 nt, Bordetella pertussis
cgccgcgcggcg

SEQ ID NO: 370936 - RNA, 15 nt, Bordetella pertussis
cgccgcgcggcgagg

SEQ ID NO: 370937 - RNA, 22 nt, Bordetella pertussis
cgccgcgcggcgaggcguccag

SEQ ID NO: 370938 - RNA, 13 nt, Bordetella pertussis
cgccgcgcggucg

SEQ ID NO: 370939 - RNA, 18 nt, Bordetella pertussis
cgccgcgcggugcucggc

SEQ ID NO: 370940 - RNA, 18 nt, Bordetella pertussis
cgccgcgcucaccgaggg

SEQ ID NO: 370941 - RNA, 14 nt, Bordetella pertussis
cgccgcgcucagca

SEQ ID NO: 370942 - RNA, 17 nt, Bordetella pertussis
cgccgcgcucagcacca

SEQ ID NO: 370943 - RNA, 21 nt, Bordetella pertussis
cgccgcgcuucgucggcgucg

SEQ ID NO: 370944 - RNA, 16 nt, Bordetella pertussis
cgccgcgcucgcgcca

SEQ ID NO: 370945 - RNA, 14 nt, Bordetella pertussis
cgccgcggaggcga

SEQ ID NO: 370946 - RNA, 13 nt, Bordetella pertussis
cgccgcggaucgu

SEQ ID NO: 370947 - RNA, 23 nt, Bordetella pertussis
cgccgcggcaggccccggcccgg

SEQ ID NO: 370948 - RNA, 14 nt, Bordetella pertussis
cgccgcggccacgc

SEQ ID NO: 370949 - RNA, 13 nt, Bordetella pertussis
cgccgcggccagc

SEQ ID NO: 370950 - RNA, 17 nt, Bordetella pertussis
cgccgcggccagcgccg

SEQ ID NO: 370951 - RNA, 14 nt, Bordetella pertussis
cgccgcggccagcg

SEQ ID NO: 370952 - RNA, 20 nt, Bordetella pertussis
cgccgcggccggcggcgccg

SEQ ID NO: 370953 - RNA, 13 nt, Bordetella pertussis
cgccgcggccggg

SEQ ID NO: 370954 - RNA, 13 nt, Bordetella pertussis
cgccgcggccucg

SEQ ID NO: 370955 - RNA, 17 nt, Bordetella pertussis
cgccgcggccucggccg

SEQ ID NO: 370956 - RNA, 14 nt, Bordetella pertussis
cgccgcggccuggc

SEQ ID NO: 370957 - RNA, 16 nt, Bordetella pertussis
cgccgcggccuggccg

SEQ ID NO: 370958 - RNA, 15 nt, Bordetella pertussis
cgccgcggccugucc

SEQ ID NO: 370959 - RNA, 21 nt, Bordetella pertussis
cgccgcggcgaugccggccag

SEQ ID NO: 370960 - RNA, 22 nt, Bordetella pertussis
cgccgcggcgaugccggccagc

SEQ ID NO: 370961 - RNA, 16 nt, Bordetella pertussis
cgccgcggcggcgagg

SEQ ID NO: 370962 - RNA, 12 nt, Bordetella pertussis
cgccgcggcggg

SEQ ID NO: 370963 - RNA, 22 nt, Bordetella pertussis
cgccgcggcguccgaauacgcc

SEQ ID NO: 370964 - RNA, 18 nt, Bordetella pertussis
cgccgcggcuugccgcgg

SEQ ID NO: 370965 - RNA, 19 nt, Bordetella pertussis
cgccgcgggcaaagcccag

SEQ ID NO: 370966 - RNA, 20 nt, Bordetella pertussis
cgccgcgggcaaagcccagc

SEQ ID NO: 370967 - RNA, 21 nt, Bordetella pertussis
cgccgcgggcaaagcccagca

SEQ ID NO: 370968 - RNA, 22 nt, Bordetella pertussis
cgccgcgggcaaagcccagcaa

SEQ ID NO: 370969 - RNA, 22 nt, Bordetella pertussis
cgccgcgggccuacuugccggc

SEQ ID NO: 370970 - RNA, 17 nt, Bordetella pertussis
cgccgcgggcggccacg

SEQ ID NO: 370971 - RNA, 18 nt, Bordetella pertussis
cgccgcgggcgccgcgca

SEQ ID NO: 370972 - RNA, 22 nt, Bordetella pertussis
cgccgcgggcgccgcgcacgca

SEQ ID NO: 370973 - RNA, 17 nt, Bordetella pertussis
cgccgcgggcugcgaca

SEQ ID NO: 370974 - RNA, 23 nt, Bordetella pertussis
cgccgcgggcugcgacaggcgca

SEQ ID NO: 370975 - RNA, 18 nt, Bordetella pertussis
cgccgcggucgcagacga

SEQ ID NO: 370976 - RNA, 22 nt, Bordetella pertussis
cgccgcgucaacuacacggugg

SEQ ID NO: 370977 - RNA, 19 nt, Bordetella pertussis
cgccgcgucauggcgugcg

SEQ ID NO: 370978 - RNA, 16 nt, Bordetella pertussis
cgccgcguccgcccgc

SEQ ID NO: 370979 - RNA, 13 nt, Bordetella pertussis
cgccgcguccggc

SEQ ID NO: 370980 - RNA, 15 nt, Bordetella pertussis
cgccgcguccggcgc

SEQ ID NO: 370981 - RNA, 16 nt, Bordetella pertussis
cgccgcguccggcgcc

SEQ ID NO: 370982 - RNA, 17 nt, Bordetella pertussis
cgccgcguccucggccu

SEQ ID NO: 370983 - RNA, 19 nt, Bordetella pertussis
cgccgcguccucggccugg

SEQ ID NO: 370984 - RNA, 22 nt, Bordetella pertussis
cgccgcguccucggccuggccc

SEQ ID NO: 370985 - RNA, 17 nt, Bordetella pertussis
cgccgcgucgcuggccg

SEQ ID NO: 370986 - RNA, 18 nt, Bordetella pertussis
cgccgcgucgcuggccgg

SEQ ID NO: 370987 - RNA, 16 nt, Bordetella pertussis
cgccgcgucggcgccg

SEQ ID NO: 370988 - RNA, 17 nt, Bordetella pertussis
cgccgcgucggcgccga

SEQ ID NO: 370989 - RNA, 15 nt, Bordetella pertussis
cgccgcgucgguggc

SEQ ID NO: 370990 - RNA, 16 nt, Bordetella pertussis
cgccgcucagcgcggc

SEQ ID NO: 370991 - RNA, 20 nt, Bordetella pertussis
cgccgcucagcgcggcgcgg

SEQ ID NO: 370992 - RNA, 21 nt, Bordetella pertussis
cgccgcucagcgcggcgcggc

SEQ ID NO: 370993 - RNA, 15 nt, Bordetella pertussis
cgccgcucgacgucg

SEQ ID NO: 370994 - RNA, 22 nt, Bordetella pertussis
cgccgcugcgaaaaagcccgcg

SEQ ID NO: 370995 - RNA, 15 nt, Bordetella pertussis
cgccgcugcgcagca

SEQ ID NO: 370996 - RNA, 16 nt, Bordetella pertussis
cgccgcugcgcagcag

SEQ ID NO: 370997 - RNA, 15 nt, Bordetella pertussis
cgccgcuggccacgu

SEQ ID NO: 370998 - RNA, 23 nt, Bordetella pertussis
cgccgcuggccacguugucgcgc

SEQ ID NO: 370999 - RNA, 13 nt, Bordetella pertussis
cgccgcuggccag

SEQ ID NO: 371000 - RNA, 13 nt, Bordetella pertussis
cgccgcuggcggc

SEQ ID NO: 371001 - RNA, 16 nt, Bordetella pertussis
cgccgcuggcguccag

SEQ ID NO: 371002 - RNA, 17 nt, Bordetella pertussis
cgccgcuggcguccagg

SEQ ID NO: 371003 - RNA, 14 nt, Bordetella pertussis
cgccgcugucgcug

SEQ ID NO: 371004 - RNA, 17 nt, Bordetella pertussis
cgccgcuguggacgccg

SEQ ID NO: 371005 - RNA, 22 nt, Bordetella pertussis
cgccgcuguggacgccgccggc

SEQ ID NO: 371006 - RNA, 18 nt, Bordetella pertussis
cgccgcuguugcccacca

SEQ ID NO: 371007 - RNA, 19 nt, Bordetella pertussis
cgccgcuguugcccaccag

SEQ ID NO: 371008 - RNA, 14 nt, Bordetella pertussis
cgccggacagcugc

SEQ ID NO: 371009 - RNA, 17 nt, Bordetella pertussis
cgccggacagcugcggg

SEQ ID NO: 371010 - RNA, 18 nt, Bordetella pertussis
cgccggacggcgccuuga

SEQ ID NO: 371011 - RNA, 21 nt, Bordetella pertussis
cgccggacguagucgcacgcg

SEQ ID NO: 371012 - RNA, 13 nt, Bordetella pertussis
cgccggauugacg

SEQ ID NO: 371013 - RNA, 18 nt, Bordetella pertussis
cgccggauugacguccau

SEQ ID NO: 371014 - RNA, 22 nt, Bordetella pertussis
cgccggcaaucgaaaagcccgc

SEQ ID NO: 371015 - RNA, 17 nt, Bordetella pertussis
cgccggcaccagcgcca

SEQ ID NO: 371016 - RNA, 19 nt, Bordetella pertussis
cgccggcaccagcgccacg

SEQ ID NO: 371017 - RNA, 17 nt, Bordetella pertussis
cgccggcacgacgaucg

SEQ ID NO: 371018 - RNA, 12 nt, Bordetella pertussis
cgccggcacgcg

SEQ ID NO: 371019 - RNA, 14 nt, Bordetella pertussis
cgccggcacgcgcg

SEQ ID NO: 371020 - RNA, 13 nt, Bordetella pertussis
cgccggcacgcug

SEQ ID NO: 371021 - RNA, 23 nt, Bordetella pertussis
cgccggcacgcugaucgccggcg

SEQ ID NO: 371022 - RNA, 23 nt, Bordetella pertussis
cgccggcagccccagcgcccagg

SEQ ID NO: 371023 - RNA, 13 nt, Bordetella pertussis
cgccggcagcgca

SEQ ID NO: 371024 - RNA, 19 nt, Bordetella pertussis
cgccggcaggcgcgccagc

SEQ ID NO: 371025 - RNA, 18 nt, Bordetella pertussis
cgccggcagggccagcgc

SEQ ID NO: 371026 - RNA, 19 nt, Bordetella pertussis
cgccggcagggugcuguuc

SEQ ID NO: 371027 - RNA, 15 nt, Bordetella pertussis
cgccggcagugccug

SEQ ID NO: 371028 - RNA, 13 nt, Bordetella pertussis
cgccggcaucggc

SEQ ID NO: 371029 - RNA, 16 nt, Bordetella pertussis
cgccggcaucggcggc

SEQ ID NO: 371030 - RNA, 14 nt, Bordetella pertussis
cgccgggcagcccg

SEQ ID NO: 371031 - RNA, 15 nt, Bordetella pertussis
cgccgggcagcccgc

SEQ ID NO: 371032 - RNA, 22 nt, Bordetella pertussis
cgccgggcagcccgcgcacgcc

SEQ ID NO: 371033 - RNA, 17 nt, Bordetella pertussis
cgccgggcagcgggccg

SEQ ID NO: 371034 - RNA, 23 nt, Bordetella pertussis
cgccgggcagcgggccgcagcau

SEQ ID NO: 371035 - RNA, 19 nt, Bordetella pertussis
cgccgggccaaggugccug

SEQ ID NO: 371036 - RNA, 24 nt, Bordetella pertussis
cgccgggccagaccuggugaucgc

SEQ ID NO: 371037 - RNA, 21 nt, Bordetella pertussis
cgccgggcccggccacggccg

SEQ ID NO: 371038 - RNA, 17 nt, Bordetella pertussis
cgccgggccgcgcccac

SEQ ID NO: 371039 - RNA, 16 nt, Bordetella pertussis
cgccgggccgcgccgc

SEQ ID NO: 371040 - RNA, 14 nt, Bordetella pertussis
cgccgggccggcgg

SEQ ID NO: 371041 - RNA, 15 nt, Bordetella pertussis
cgccgggccggcggg

SEQ ID NO: 371042 - RNA, 17 nt, Bordetella pertussis
cgccgggccgucgugcg

SEQ ID NO: 371043 - RNA, 15 nt, Bordetella pertussis
cgccgggccgugcgc

SEQ ID NO: 371044 - RNA, 18 nt, Bordetella pertussis
cgccgggccuagcccggc

SEQ ID NO: 371045 - RNA, 22 nt, Bordetella pertussis
cgccgggccuagcccggcgcca

SEQ ID NO: 371046 - RNA, 22 nt, Bordetella pertussis
cgccgggccugcccgcauccga

SEQ ID NO: 371047 - RNA, 14 nt, Bordetella pertussis
cgccggggcaggcu

SEQ ID NO: 371048 - RNA, 15 nt, Bordetella pertussis
cgccggggcggcgca

SEQ ID NO: 371049 - RNA, 19 nt, Bordetella pertussis
cgccggggcggcgcagcau

SEQ ID NO: 371050 - RNA, 16 nt, Bordetella pertussis
cgccggggcguggccg

SEQ ID NO: 371051 - RNA, 18 nt, Bordetella pertussis
cgccggggcguggccgca

SEQ ID NO: 371052 - RNA, 21 nt, Bordetella pertussis
cgccggggucagcgccggcac

SEQ ID NO: 371053 - RNA, 22 nt, Bordetella pertussis
cgccggggggcgcacgccgcgc

SEQ ID NO: 371054 - RNA, 18 nt, Bordetella pertussis
cgccggguguuccggcgc

SEQ ID NO: 371055 - RNA, 15 nt, Bordetella pertussis
cgccggguugcggcg

SEQ ID NO: 371056 - RNA, 19 nt, Bordetella pertussis
cgccggguugcggcggaca

SEQ ID NO: 371057 - RNA, 21 nt, Bordetella pertussis
cgccggguuuuuacaugccgc

SEQ ID NO: 371058 - RNA, 13 nt, Bordetella pertussis
cgccgguccagcg

SEQ ID NO: 371059 - RNA, 16 nt, Bordetella pertussis
cgccgguccagcgccc

SEQ ID NO: 371060 - RNA, 17 nt, Bordetella pertussis
cgccgguccagcgcccg

SEQ ID NO: 371061 - RNA, 14 nt, Bordetella pertussis
cgccgguccgacgg

SEQ ID NO: 371062 - RNA, 12 nt, Bordetella pertussis
cgccggucgccg

SEQ ID NO: 371063 - RNA, 14 nt, Bordetella pertussis
cgccggucgcggcg

SEQ ID NO: 371064 - RNA, 17 nt, Bordetella pertussis
cgccggucgcggcguug

SEQ ID NO: 371065 - RNA, 13 nt, Bordetella pertussis
cgccggucggccg

SEQ ID NO: 371066 - RNA, 16 nt, Bordetella pertussis
cgccggucguggucga

SEQ ID NO: 371067 - RNA, 15 nt, Bordetella pertussis
cgccggucugggcgc

SEQ ID NO: 371068 - RNA, 17 nt, Bordetella pertussis
cgccggucugggcgcgg

SEQ ID NO: 371069 - RNA, 17 nt, Bordetella pertussis
cgccggugaccgccagc

SEQ ID NO: 371070 - RNA, 19 nt, Bordetella pertussis
cgccggugaccgccagcag

SEQ ID NO: 371071 - RNA, 23 nt, Bordetella pertussis
cgccggugauaugcgccaggccc

SEQ ID NO: 371072 - RNA, 15 nt, Bordetella pertussis
cgccggugaugcgau

SEQ ID NO: 371073 - RNA, 22 nt, Bordetella pertussis
cgccggugauguacgcaucggc

SEQ ID NO: 371074 - RNA, 16 nt, Bordetella pertussis
cgccggugcaccaggc

SEQ ID NO: 371075 - RNA, 19 nt, Bordetella pertussis
cgccggugcaccaggccac

SEQ ID NO: 371076 - RNA, 20 nt, Bordetella pertussis
cgccggugcaccaggccacc

SEQ ID NO: 371077 - RNA, 13 nt, Bordetella pertussis
cgccgguucgacg

SEQ ID NO: 371078 - RNA, 15 nt, Bordetella pertussis
cgccgguucgacgcu

SEQ ID NO: 371079 - RNA, 17 nt, Bordetella pertussis
cgccgguucgacgcuga

SEQ ID NO: 371080 - RNA, 15 nt, Bordetella pertussis
cgccgguucggucga

SEQ ID NO: 371081 - RNA, 17 nt, Bordetella pertussis
cgccgguucggucgacg

SEQ ID NO: 371082 - RNA, 18 nt, Bordetella pertussis
cgccgguucggucgacga

SEQ ID NO: 371083 - RNA, 20 nt, Bordetella pertussis
cgccgguucggucgacgacg

SEQ ID NO: 371084 - RNA, 18 nt, Bordetella pertussis
cgccgguuucggugaagc

SEQ ID NO: 371085 - RNA, 15 nt, Bordetella pertussis
cgccguacagccgcg

SEQ ID NO: 371086 - RNA, 17 nt, Bordetella pertussis
cgccguacagccgcggc

SEQ ID NO: 371087 - RNA, 18 nt, Bordetella pertussis
cgccguacagccgcggca

SEQ ID NO: 371088 - RNA, 19 nt, Bordetella pertussis
cgccguacagccgcggcag

SEQ ID NO: 371089 - RNA, 16 nt, Bordetella pertussis
cgccguacagggccgc

SEQ ID NO: 371090 - RNA, 18 nt, Bordetella pertussis
cgccguacagggccgcga

SEQ ID NO: 371091 - RNA, 14 nt, Bordetella pertussis
cgccguaccccagc

SEQ ID NO: 371092 - RNA, 15 nt, Bordetella pertussis
cgccguaccccagca

SEQ ID NO: 371093 - RNA, 16 nt, Bordetella pertussis
cgccguaccccagcau

SEQ ID NO: 371094 - RNA, 20 nt, Bordetella pertussis
cgccguaccugcagcaggcg

SEQ ID NO: 371095 - RNA, 22 nt, Bordetella pertussis
cgccguaccugcagcaggcgca

SEQ ID NO: 371096 - RNA, 15 nt, Bordetella pertussis
cgccguacucgccgg

SEQ ID NO: 371097 - RNA, 13 nt, Bordetella pertussis
cgccguacugggc

SEQ ID NO: 371098 - RNA, 13 nt, Bordetella pertussis
cgccguagccgcu

SEQ ID NO: 371099 - RNA, 15 nt, Bordetella pertussis
cgccguagccgcugc

SEQ ID NO: 371100 - RNA, 18 nt, Bordetella pertussis
cgccguagccgcugcgcg

SEQ ID NO: 371101 - RNA, 13 nt, Bordetella pertussis
cgccguagcgcgc

SEQ ID NO: 371102 - RNA, 19 nt, Bordetella pertussis
cgccguaggcuugcagcuu

SEQ ID NO: 371103 - RNA, 19 nt, Bordetella pertussis
cgccgucagcagcgcggcg

SEQ ID NO: 371104 - RNA, 21 nt, Bordetella pertussis
cgccgucagcagcgcggcgcc

SEQ ID NO: 371105 - RNA, 14 nt, Bordetella pertussis
cgccgucagcucga

SEQ ID NO: 371106 - RNA, 17 nt, Bordetella pertussis
cgccgucagcucgauca

SEQ ID NO: 371107 - RNA, 18 nt, Bordetella pertussis
cgccgucagcucgaucag

SEQ ID NO: 371108 - RNA, 20 nt, Bordetella pertussis
cgccgucaggaucaggccgg

SEQ ID NO: 371109 - RNA, 22 nt, Bordetella pertussis
cgccgucaggaucaggccggcg

SEQ ID NO: 371110 - RNA, 12 nt, Bordetella pertussis
cgccguccagcg

SEQ ID NO: 371111 - RNA, 22 nt, Bordetella pertussis
cgccguccagcgcggcaugccg

SEQ ID NO: 371112 - RNA, 20 nt, Bordetella pertussis
cgccguccaggcgccgcacg

SEQ ID NO: 371113 - RNA, 23 nt, Bordetella pertussis
cgccguccaggcgccgcacgccg

SEQ ID NO: 371114 - RNA, 19 nt, Bordetella pertussis
cgccguccgcaucgcgcaa

SEQ ID NO: 371115 - RNA, 21 nt, Bordetella pertussis
cgccguccgugagugcagcgc

SEQ ID NO: 371116 - RNA, 18 nt, Bordetella pertussis
cgccguccucaggcccgc

SEQ ID NO: 371117 - RNA, 19 nt, Bordetella pertussis
cgccgucgaagccggcgcc

SEQ ID NO: 371118 - RNA, 20 nt, Bordetella pertussis
cgccgucgaagccggcgcca

SEQ ID NO: 371119 - RNA, 18 nt, Bordetella pertussis
cgccgucgaccccgucga

SEQ ID NO: 371120 - RNA, 13 nt, Bordetella pertussis
cgccgucgacgcc

SEQ ID NO: 371121 - RNA, 21 nt, Bordetella pertussis
cgccgucgagcaucccggcgc

SEQ ID NO: 371122 - RNA, 14 nt, Bordetella pertussis
cgccgucugcgccg

SEQ ID NO: 371123 - RNA, 15 nt, Bordetella pertussis
cgccgucugcgccgc

SEQ ID NO: 371124 - RNA, 22 nt, Bordetella pertussis
cgccgucugcgccgccgcgugg

SEQ ID NO: 371125 - RNA, 19 nt, Bordetella pertussis
cgccgucugugcgccccgc

SEQ ID NO: 371126 - RNA, 16 nt, Bordetella pertussis
cgccgucuucgguggc

SEQ ID NO: 371127 - RNA, 18 nt, Bordetella pertussis
cgccgucuucgguggccc

SEQ ID NO: 371128 - RNA, 20 nt, Bordetella pertussis
cgccgugacguugagcgccg

SEQ ID NO: 371129 - RNA, 20 nt, Bordetella pertussis
cgccgugacuucggccgcca

SEQ ID NO: 371130 - RNA, 22 nt, Bordetella pertussis
cgccgugacuucggccgccagc

SEQ ID NO: 371131 - RNA, 23 nt, Bordetella pertussis
cgccgugacuucggccgccagcc

SEQ ID NO: 371132 - RNA, 18 nt, Bordetella pertussis
cgccgugaugccgcccgc

SEQ ID NO: 371133 - RNA, 19 nt, Bordetella pertussis
cgccgugaugccgcccgca

SEQ ID NO: 371134 - RNA, 15 nt, Bordetella pertussis
cgccgugcagacggc

SEQ ID NO: 371135 - RNA, 18 nt, Bordetella pertussis
cgccgugcagacggcggc

SEQ ID NO: 371136 - RNA, 17 nt, Bordetella pertussis
cgccgugcaggcccggg

SEQ ID NO: 371137 - RNA, 13 nt, Bordetella pertussis
cgccgugcagggc

SEQ ID NO: 371138 - RNA, 17 nt, Bordetella pertussis
cgccgugcagggccagg

SEQ ID NO: 371139 - RNA, 16 nt, Bordetella pertussis
cgccgugcccggcggg

SEQ ID NO: 371140 - RNA, 17 nt, Bordetella pertussis
cgccgugcccggcgggc

SEQ ID NO: 371141 - RNA, 15 nt, Bordetella pertussis
cgccgugccgggccu

SEQ ID NO: 371142 - RNA, 17 nt, Bordetella pertussis
cgccgugcgagcacggc

SEQ ID NO: 371143 - RNA, 18 nt, Bordetella pertussis
cgccgugcgagcacggcg

SEQ ID NO: 371144 - RNA, 21 nt, Bordetella pertussis
cgccgugcgagcacggcgugg

SEQ ID NO: 371145 - RNA, 22 nt, Bordetella pertussis
cgccgugcgcgggcgcggcagg

SEQ ID NO: 371146 - RNA, 13 nt, Bordetella pertussis
cgccgugcugauc

SEQ ID NO: 371147 - RNA, 23 nt, Bordetella pertussis
cgccgugcugaucgacaugcugg

SEQ ID NO: 371148 - RNA, 21 nt, Bordetella pertussis
cgccgugcuggaggugccguc

SEQ ID NO: 371149 - RNA, 15 nt, Bordetella pertussis
cgccgugcugggcgg

SEQ ID NO: 371150 - RNA, 20 nt, Bordetella pertussis
cgccgugcugggcggccagg

SEQ ID NO: 371151 - RNA, 13 nt, Bordetella pertussis
cgccgugcuguac

SEQ ID NO: 371152 - RNA, 17 nt, Bordetella pertussis
cgccguguaggcggucu

SEQ ID NO: 371153 - RNA, 19 nt, Bordetella pertussis
cgccguucagggacgggcc

SEQ ID NO: 371154 - RNA, 23 nt, Bordetella pertussis
cgccguucagggacgggccagcc

SEQ ID NO: 371155 - RNA, 13 nt, Bordetella pertussis
cgccguucaugcg

SEQ ID NO: 371156 - RNA, 16 nt, Bordetella pertussis
cgccguuccugcagcg

SEQ ID NO: 371157 - RNA, 14 nt, Bordetella pertussis
cgccguucgucgcg

SEQ ID NO: 371158 - RNA, 19 nt, Bordetella pertussis
cgccguucgucgcgcagca

SEQ ID NO: 371159 - RNA, 18 nt, Bordetella pertussis
cgccguucuggcugcgcg

SEQ ID NO: 371160 - RNA, 20 nt, Bordetella pertussis
cgccguucuggcugcgcgcc

SEQ ID NO: 371161 - RNA, 18 nt, Bordetella pertussis
cgccuacacgguggcggu

SEQ ID NO: 371162 - RNA, 19 nt, Bordetella pertussis
cgccuacagcagcggcucg

SEQ ID NO: 371163 - RNA, 13 nt, Bordetella pertussis
cgccuacggcggc

SEQ ID NO: 371164 - RNA, 14 nt, Bordetella pertussis
cgccuacggcggcg

SEQ ID NO: 371165 - RNA, 18 nt, Bordetella pertussis
cgccuacggcggcggcca

SEQ ID NO: 371166 - RNA, 14 nt, Bordetella pertussis
cgccuacuggcgcg

SEQ ID NO: 371167 - RNA, 16 nt, Bordetella pertussis
cgccuacuggcgcgcg

SEQ ID NO: 371168 - RNA, 17 nt, Bordetella pertussis
cgccuauaucgacggcg

SEQ ID NO: 371169 - RNA, 18 nt, Bordetella pertussis
cgccuauaucgacggcgc

SEQ ID NO: 371170 - RNA, 13 nt, Bordetella pertussis
cgccuaccggcgc

SEQ ID NO: 371171 - RNA, 17 nt, Bordetella pertussis
cgccuauugcgacgccg

SEQ ID NO: 371172 - RNA, 19 nt, Bordetella pertussis
cgccucaaccuucucgaug

SEQ ID NO: 371173 - RNA, 15 nt, Bordetella pertussis
cgccucaccgcgccg

SEQ ID NO: 371174 - RNA, 18 nt, Bordetella pertussis
cgccucaccgcgccgggc

SEQ ID NO: 371175 - RNA, 20 nt, Bordetella pertussis
cgccucagcguuuccagggc

SEQ ID NO: 371176 - RNA, 16 nt, Bordetella pertussis
cgccucaggccggcgc

SEQ ID NO: 371177 - RNA, 17 nt, Bordetella pertussis
cgccucaggccggcgcc

SEQ ID NO: 371178 - RNA, 20 nt, Bordetella pertussis
cgccucgaacguccgcccca

SEQ ID NO: 371179 - RNA, 18 nt, Bordetella pertussis
cgccucgaagaccucggc

SEQ ID NO: 371180 - RNA, 23 nt, Bordetella pertussis
cgccucgaagaccucggcgcuca

SEQ ID NO: 371181 - RNA, 21 nt, Bordetella pertussis
cgccucgacgaugcccugcgc

SEQ ID NO: 371182 - RNA, 13 nt, Bordetella pertussis
cgccucgacgccc

SEQ ID NO: 371183 - RNA, 16 nt, Bordetella pertussis
cgccucgaccggcgaa

SEQ ID NO: 371184 - RNA, 16 nt, Bordetella pertussis
cgccucgaucgccagg

SEQ ID NO: 371185 - RNA, 17 nt, Bordetella pertussis
cgccucgaucgccaggu

SEQ ID NO: 371186 - RNA, 20 nt, Bordetella pertussis
cgccucgaugauggcguccg

SEQ ID NO: 371187 - RNA, 19 nt, Bordetella pertussis
cgccucgaugcccucgcgc

SEQ ID NO: 371188 - RNA, 23 nt, Bordetella pertussis
cgccucgaugcccucgcgcacgg

SEQ ID NO: 371189 - RNA, 18 nt, Bordetella pertussis
cgccucgcgacggccucc

SEQ ID NO: 371190 - RNA, 22 nt, Bordetella pertussis
cgccucuucgaugaugagcgcg

SEQ ID NO: 371191 - RNA, 21 nt, Bordetella pertussis
cgccugacguucggggcgucg

SEQ ID NO: 371192 - RNA, 22 nt, Bordetella pertussis
cgccugacguucggggcgucgc

SEQ ID NO: 371193 - RNA, 23 nt, Bordetella pertussis
cgccugagcacaugcccggccac

SEQ ID NO: 371194 - RNA, 16 nt, Bordetella pertussis
cgccugagcugccagg

SEQ ID NO: 371195 - RNA, 17 nt, Bordetella pertussis
cgccugagcugccaggc

SEQ ID NO: 371196 - RNA, 22 nt, Bordetella pertussis
cgccugccagaacagccgcgag

SEQ ID NO: 371197 - RNA, 19 nt, Bordetella pertussis
cgccugccaguucgaugcg

SEQ ID NO: 371198 - RNA, 18 nt, Bordetella pertussis
cgccugcccaggccagcg

SEQ ID NO: 371199 - RNA, 20 nt, Bordetella pertussis
cgccugcccaggccagcgcc

SEQ ID NO: 371200 - RNA, 14 nt, Bordetella pertussis
cgccugccccgccg

SEQ ID NO: 371201 - RNA, 15 nt, Bordetella pertussis
cgccugccccggcag

SEQ ID NO: 371202 - RNA, 13 nt, Bordetella pertussis
cgccugcccgcaa

SEQ ID NO: 371203 - RNA, 22 nt, Bordetella pertussis
cgccugcccgcaacgccgcccg

SEQ ID NO: 371204 - RNA, 19 nt, Bordetella pertussis
cgccugcccgcacgggccg

SEQ ID NO: 371205 - RNA, 22 nt, Bordetella pertussis
cgccugcccgcacgggccgacg

SEQ ID NO: 371206 - RNA, 23 nt, Bordetella pertussis
cgccugccgaucgugcacgcccg

SEQ ID NO: 371207 - RNA, 13 nt, Bordetella pertussis
cgccugccgcgcc

SEQ ID NO: 371208 - RNA, 16 nt, Bordetella pertussis
cgccugccgcgcccgg

SEQ ID NO: 371209 - RNA, 17 nt, Bordetella pertussis
cgccugccgcgcccggc

SEQ ID NO: 371210 - RNA, 22 nt, Bordetella pertussis
cgccugccgcgcccggcggcca

SEQ ID NO: 371211 - RNA, 23 nt, Bordetella pertussis
cgccugccgcgugcccgcgucca

SEQ ID NO: 371212 - RNA, 12 nt, Bordetella pertussis
cgccugccggcc

SEQ ID NO: 371213 - RNA, 19 nt, Bordetella pertussis
cgccugccggccuggcuca

SEQ ID NO: 371214 - RNA, 19 nt, Bordetella pertussis
cgccugccguuauauauag

SEQ ID NO: 371215 - RNA, 22 nt, Bordetella pertussis
cgccugcgagagauagcccagc

SEQ ID NO: 371216 - RNA, 14 nt, Bordetella pertussis
cgccugcgccaccu

SEQ ID NO: 371217 - RNA, 18 nt, Bordetella pertussis
cgccugcguggcgggccg

SEQ ID NO: 371218 - RNA, 21 nt, Bordetella pertussis
cgccugcguggcgggccgcgc

SEQ ID NO: 371219 - RNA, 20 nt, Bordetella pertussis
cgccugcguugcgaucagcg

SEQ ID NO: 371220 - RNA, 17 nt, Bordetella pertussis
cgccugcucacgccccg

SEQ ID NO: 371221 - RNA, 18 nt, Bordetella pertussis
cgccugcucacgccccgc

SEQ ID NO: 371222 - RNA, 19 nt, Bordetella pertussis
cgccugcucguacagcggc

SEQ ID NO: 371223 - RNA, 13 nt, Bordetella pertussis
cgccugcugcaug

SEQ ID NO: 371224 - RNA, 11 nt, Bordetella pertussis
cgccugcugcg

SEQ ID NO: 371225 - RNA, 14 nt, Bordetella pertussis
cgccugcugcgccg

SEQ ID NO: 371226 - RNA, 16 nt, Bordetella pertussis
cgccugcugcgccguc

SEQ ID NO: 371227 - RNA, 19 nt, Bordetella pertussis
cgccugcugcgccgucugu

SEQ ID NO: 371228 - RNA, 19 nt, Bordetella pertussis
cgccugcugcgccuggccg

SEQ ID NO: 371229 - RNA, 14 nt, Bordetella pertussis
cgccugcugggccg

SEQ ID NO: 371230 - RNA, 15 nt, Bordetella pertussis
cgccugcugggccgc

SEQ ID NO: 371231 - RNA, 19 nt, Bordetella pertussis
cgccugcuggucggccucg

SEQ ID NO: 371232 - RNA, 21 nt, Bordetella pertussis
cgccuggaccggcuccggccg

SEQ ID NO: 371233 - RNA, 20 nt, Bordetella pertussis
cgccuggaccugacccccga

SEQ ID NO: 371234 - RNA, 14 nt, Bordetella pertussis
cgccuuggccguca

SEQ ID NO: 371235 - RNA, 15 nt, Bordetella pertussis
cgccuuggccgucaa

SEQ ID NO: 371236 - RNA, 13 nt, Bordetella pertussis
cgccuuggcgcgc

SEQ ID NO: 371237 - RNA, 15 nt, Bordetella pertussis
cgccuuggcgcgcag

SEQ ID NO: 371238 - RNA, 17 nt, Bordetella pertussis
cgccuuggccugggcgc

SEQ ID NO: 371239 - RNA, 15 nt, Bordetella pertussis
cgccuugucggggaa

SEQ ID NO: 371240 - RNA, 22 nt, Bordetella pertussis
cgccuuugccgcuggacgcgcc

SEQ ID NO: 371241 - RNA, 23 nt, Bordetella pertussis
cgccuuugccgcuggacgcgccg

SEQ ID NO: 371242 - RNA, 14 nt, Bordetella pertussis
cgccuuuucgcagc

SEQ ID NO: 371243 - RNA, 15 nt, Bordetella pertussis
cgcgaaagcgcugcg

SEQ ID NO: 371244 - RNA, 16 nt, Bordetella pertussis
cgcgaaagcggcgugu

SEQ ID NO: 371245 - RNA, 19 nt, Bordetella pertussis
cgcgaaauccagcgcgccc

SEQ ID NO: 371246 - RNA, 14 nt, Bordetella pertussis
cgcgaacgccugcc

SEQ ID NO: 371247 - RNA, 15 nt, Bordetella pertussis
cgcgaacgccugcca

SEQ ID NO: 371248 - RNA, 14 nt, Bordetella pertussis
cgcgaacgcgccgg

SEQ ID NO: 371249 - RNA, 15 nt, Bordetella pertussis
cgcgaacgcgccggc

SEQ ID NO: 371250 - RNA, 18 nt, Bordetella pertussis
cgcgaacgcgccggccca

SEQ ID NO: 371251 - RNA, 15 nt, Bordetella pertussis
cgcgaacgcgcgccg

SEQ ID NO: 371252 - RNA, 17 nt, Bordetella pertussis
cgcgaacgcgcgccggc

SEQ ID NO: 371253 - RNA, 20 nt, Bordetella pertussis
cgcgaacgcgcgccggccag

SEQ ID NO: 371254 - RNA, 23 nt, Bordetella pertussis
cgcgaacgcgcgccggccagcgg

SEQ ID NO: 371255 - RNA, 14 nt, Bordetella pertussis
cgcgaacgcggcca

SEQ ID NO: 371256 - RNA, 16 nt, Bordetella pertussis
cgcgaacgcggccaug

SEQ ID NO: 371257 - RNA, 17 nt, Bordetella pertussis
cgcgaacggcaggugca

SEQ ID NO: 371258 - RNA, 14 nt, Bordetella pertussis
cgcgaagugccugu

SEQ ID NO: 371259 - RNA, 14 nt, Bordetella pertussis
cgcgaaguggccac

SEQ ID NO: 371260 - RNA, 17 nt, Bordetella pertussis
cgcgacagcaggccggu

SEQ ID NO: 371261 - RNA, 19 nt, Bordetella pertussis
cgcgacagcaggccgguca

SEQ ID NO: 371262 - RNA, 19 nt, Bordetella pertussis
cgcgacagccgcgccagcg

SEQ ID NO: 371263 - RNA, 13 nt, Bordetella pertussis
cgcgacagcgcug

SEQ ID NO: 371264 - RNA, 14 nt, Bordetella pertussis
cgcgacagcgcugg

SEQ ID NO: 371265 - RNA, 16 nt, Bordetella pertussis
cgcgacagcgcuggug

SEQ ID NO: 371266 - RNA, 16 nt, Bordetella pertussis
cgcgacaggcccgcgg

SEQ ID NO: 371267 - RNA, 19 nt, Bordetella pertussis
cgcgacaggcccgcggccg

SEQ ID NO: 371268 - RNA, 20 nt, Bordetella pertussis
cgcgacaggcggugcgcgcg

SEQ ID NO: 371269 - RNA, 23 nt, Bordetella pertussis
cgcgacaggcggugcgcgcggcc

SEQ ID NO: 371270 - RNA, 23 nt, Bordetella pertussis
cgcgaccggcgcgaacaccggca

SEQ ID NO: 371271 - RNA, 12 nt, Bordetella pertussis
cgcgaccgggcc

SEQ ID NO: 371272 - RNA, 17 nt, Bordetella pertussis
cgcgaccuccaguaucg

SEQ ID NO: 371273 - RNA, 14 nt, Bordetella pertussis
cgcgaccuccggca

SEQ ID NO: 371274 - RNA, 16 nt, Bordetella pertussis
cgcgaccuccggcaac

SEQ ID NO: 371275 - RNA, 20 nt, Bordetella pertussis
cgcgaccuccggcaacagca

SEQ ID NO: 371276 - RNA, 17 nt, Bordetella pertussis
cgcgaccugcgcgaccg

SEQ ID NO: 371277 - RNA, 12 nt, Bordetella pertussis
cgcgacgaagcc

SEQ ID NO: 371278 - RNA, 15 nt, Bordetella pertussis
cgcgacgacagcggc

SEQ ID NO: 371279 - RNA, 14 nt, Bordetella pertussis
cgcgacgcccuggc

SEQ ID NO: 371280 - RNA, 15 nt, Bordetella pertussis
cgcgacgccugcgcc

SEQ ID NO: 371281 - RNA, 13 nt, Bordetella pertussis
cgcgacgcgccgg

SEQ ID NO: 371282 - RNA, 17 nt, Bordetella pertussis
cgcgacgcuacagcguc

SEQ ID NO: 371283 - RNA, 16 nt, Bordetella pertussis
cgcgacggccucccgc

SEQ ID NO: 371284 - RNA, 13 nt, Bordetella pertussis
cgcgacggcgccg

SEQ ID NO: 371285 - RNA, 12 nt, Bordetella pertussis
cgcgacggcgau

SEQ ID NO: 371286 - RNA, 20 nt, Bordetella pertussis
cgcgacgguccugcgcgccg

SEQ ID NO: 371287 - RNA, 16 nt, Bordetella pertussis
cgcgacuuccucgacc

SEQ ID NO: 371288 - RNA, 22 nt, Bordetella pertussis
cgcgacuuccucgacccgcgcc

SEQ ID NO: 371289 - RNA, 15 nt, Bordetella pertussis
cgcgacuggcccagg

SEQ ID NO: 371290 - RNA, 16 nt, Bordetella pertussis
cgcgacuggcccaggc

SEQ ID NO: 371291 - RNA, 15 nt, Bordetella pertussis
cgcgagaaccaggcc

SEQ ID NO: 371292 - RNA, 16 nt, Bordetella pertussis
cgcgagcaugcgcagc

SEQ ID NO: 371293 - RNA, 18 nt, Bordetella pertussis
cgcgagcagggcaucacc

SEQ ID NO: 371294 - RNA, 14 nt, Bordetella pertussis
cgcgagcccaucag

SEQ ID NO: 371295 - RNA, 19 nt, Bordetella pertussis
cgcgagcccaucagguggg

SEQ ID NO: 371296 - RNA, 17 nt, Bordetella pertussis
cgcgagcgcacaggcgg

SEQ ID NO: 371297 - RNA, 15 nt, Bordetella pertussis
cgcgagcgccgggcg

SEQ ID NO: 371298 - RNA, 18 nt, Bordetella pertussis
cgcgagcgccgggcgccg

SEQ ID NO: 371299 - RNA, 21 nt, Bordetella pertussis
cgcgagcgccgggcgccgcgc

SEQ ID NO: 371300 - RNA, 20 nt, Bordetella pertussis
cgcgagcgcguggaaccgcc

SEQ ID NO: 371301 - RNA, 15 nt, Bordetella pertussis
cgcgagcggcggccg

SEQ ID NO: 371302 - RNA, 23 nt, Bordetella pertussis
cgcgagcggcggccgcguccagc

SEQ ID NO: 371303 - RNA, 18 nt, Bordetella pertussis
cgcgagcuggucgaacgc

SEQ ID NO: 371304 - RNA, 22 nt, Bordetella pertussis
cgcgagcuggucgaacgcuucc

SEQ ID NO: 371305 - RNA, 14 nt, Bordetella pertussis
cgcgaggcgcaggc

SEQ ID NO: 371306 - RNA, 14 nt, Bordetella pertussis
cgcgaggcggcggc

SEQ ID NO: 371307 - RNA, 17 nt, Bordetella pertussis
cgcgaggcggcggccgg

SEQ ID NO: 371308 - RNA, 18 nt, Bordetella pertussis
cgcgaggcggcggccggg

SEQ ID NO: 371309 - RNA, 18 nt, Bordetella pertussis
cgcgagggcuucgacucc

SEQ ID NO: 371310 - RNA, 20 nt, Bordetella pertussis
cgcgagguauuggccuugcc

SEQ ID NO: 371311 - RNA, 14 nt, Bordetella pertussis
cgcgaggugccgga

SEQ ID NO: 371312 - RNA, 19 nt, Bordetella pertussis
cgcgaggugccggacgccg

SEQ ID NO: 371313 - RNA, 21 nt, Bordetella pertussis
cgcgagguggcgcucgcgccc

SEQ ID NO: 371314 - RNA, 17 nt, Bordetella pertussis
cgcgaguauucacgccg

SEQ ID NO: 371315 - RNA, 17 nt, Bordetella pertussis
cgcgauagauggccagg

SEQ ID NO: 371316 - RNA, 21 nt, Bordetella pertussis
cgcgauauugaaggccgaggc

SEQ ID NO: 371317 - RNA, 16 nt, Bordetella pertussis
cgcgaucagcgcggcc

SEQ ID NO: 371318 - RNA, 17 nt, Bordetella pertussis
cgcgaucagcgcggccg

SEQ ID NO: 371319 - RNA, 15 nt, Bordetella pertussis
cgcgauccuggggca

SEQ ID NO: 371320 - RNA, 18 nt, Bordetella pertussis
cgcgauccuucgcggccg

SEQ ID NO: 371321 - RNA, 14 nt, Bordetella pertussis
cgcgaucgccagca

SEQ ID NO: 371322 - RNA, 22 nt, Bordetella pertussis
cgcgaucgccagcaggcgcugg

SEQ ID NO: 371323 - RNA, 13 nt, Bordetella pertussis
cgcgaucgccgca

SEQ ID NO: 371324 - RNA, 15 nt, Bordetella pertussis
cgcgaucgucgaccg

SEQ ID NO: 371325 - RNA, 16 nt, Bordetella pertussis
cgcgaucgucgaccgc

SEQ ID NO: 371326 - RNA, 22 nt, Bordetella pertussis
cgcgaucucagccaucaucauc

SEQ ID NO: 371327 - RNA, 19 nt, Bordetella pertussis
cgcgaucucgggcaggucg

SEQ ID NO: 371328 - RNA, 22 nt, Bordetella pertussis
cgcgaucucguggcccagcacc

SEQ ID NO: 371329 - RNA, 23 nt, Bordetella pertussis
cgcgaugcaugaaccgcagcgcc

SEQ ID NO: 371330 - RNA, 14 nt, Bordetella pertussis
cgcgaugcgcagca

SEQ ID NO: 371331 - RNA, 23 nt, Bordetella pertussis
cgcgaugcgccaggcgcucggcg

SEQ ID NO: 371332 - RNA, 13 nt, Bordetella pertussis
cgcgaugcgcgcg

SEQ ID NO: 371333 - RNA, 17 nt, Bordetella pertussis
cgcgaugcgcgcgugca

SEQ ID NO: 371334 - RNA, 14 nt, Bordetella pertussis
cgcgaugcgcggcc

SEQ ID NO: 371335 - RNA, 18 nt, Bordetella pertussis
cgcgaugcgcggcccggc

SEQ ID NO: 371336 - RNA, 16 nt, Bordetella pertussis
cgcgaugcgggucugg

SEQ ID NO: 371337 - RNA, 23 nt, Bordetella pertussis
cgcgaugcgguugagcacauuga

SEQ ID NO: 371338 - RNA, 14 nt, Bordetella pertussis
cgcgaugcgucagg

SEQ ID NO: 371339 - RNA, 14 nt, Bordetella pertussis
cgcgaugcugcgca

SEQ ID NO: 371340 - RNA, 15 nt, Bordetella pertussis
cgcgaugcugcgcaa

SEQ ID NO: 371341 - RNA, 13 nt, Bordetella pertussis
cgcgauggcgccg

SEQ ID NO: 371342 - RNA, 13 nt, Bordetella pertussis
cgcgauggcggca

SEQ ID NO: 371343 - RNA, 13 nt, Bordetella pertussis
cgcgaugggccug

SEQ ID NO: 371344 - RNA, 19 nt, Bordetella pertussis
cgcgaugggccugcccaug

SEQ ID NO: 371345 - RNA, 17 nt, Bordetella pertussis
cgcgauggucaccaccc

SEQ ID NO: 371346 - RNA, 19 nt, Bordetella pertussis
cgcgauggucaccacccgc

SEQ ID NO: 371347 - RNA, 20 nt, Bordetella pertussis
cgcgauggucaccacccgca

SEQ ID NO: 371348 - RNA, 20 nt, Bordetella pertussis
cgcgaugucgcccaugcuga

SEQ ID NO: 371349 - RNA, 16 nt, Bordetella pertussis
cgcgaugucgcgcgcg

SEQ ID NO: 371350 - RNA, 17 nt, Bordetella pertussis
cgcgauucccuggcgcg

SEQ ID NO: 371351 - RNA, 20 nt, Bordetella pertussis
cgcgauucccuggcgcgcca

SEQ ID NO: 371352 - RNA, 22 nt, Bordetella pertussis
cgcgauucccuggcgcgccagc

SEQ ID NO: 371353 - RNA, 23 nt, Bordetella pertussis
cgcgauucccuggcgcgccagcu

SEQ ID NO: 371354 - RNA, 18 nt, Bordetella pertussis
cgcgauugaguucgcgcg

SEQ ID NO: 371355 - RNA, 21 nt, Bordetella pertussis
cgcgauugaguucgcgcgccg

SEQ ID NO: 371356 - RNA, 18 nt, Bordetella pertussis
cgcgauugcagguggcca

SEQ ID NO: 371357 - RNA, 22 nt, Bordetella pertussis
cgcgauugcagguggccagccc

SEQ ID NO: 371358 - RNA, 18 nt, Bordetella pertussis
cgcgauuuccuugcgccg

SEQ ID NO: 371359 - RNA, 17 nt, Bordetella pertussis
cgcgauuucguccgggg

SEQ ID NO: 371360 - RNA, 23 nt, Bordetella pertussis
cgcgcaaaccgacgcggccagcg

SEQ ID NO: 371361 - RNA, 13 nt, Bordetella pertussis
cgcgcaacacgcg

SEQ ID NO: 371362 - RNA, 14 nt, Bordetella pertussis
cgcgcaacaggucg

SEQ ID NO: 371363 - RNA, 18 nt, Bordetella pertussis
cgcgcaaccaggggcggc

SEQ ID NO: 371364 - RNA, 16 nt, Bordetella pertussis
cgcgcaacgcaugcgc

SEQ ID NO: 371365 - RNA, 16 nt, Bordetella pertussis
cgcgcaacgccggguc

SEQ ID NO: 371366 - RNA, 14 nt, Bordetella pertussis
cgcgcaacgccgcc

SEQ ID NO: 371367 - RNA, 15 nt, Bordetella pertussis
cgcgcaacgccgcca

SEQ ID NO: 371368 - RNA, 16 nt, Bordetella pertussis
cgcgcccauuucgaug

SEQ ID NO: 371369 - RNA, 20 nt, Bordetella pertussis
cgcgcccauuucgauggcca

SEQ ID NO: 371370 - RNA, 23 nt, Bordetella pertussis
cgcgcccauuucgauggccaggg

SEQ ID NO: 371371 - RNA, 15 nt, Bordetella pertussis
cgcgcaacuccagca

SEQ ID NO: 371372 - RNA, 15 nt, Bordetella pertussis
cgcgcaacucggcca

SEQ ID NO: 371373 - RNA, 19 nt, Bordetella pertussis
cgcgcaacucggccaccug

SEQ ID NO: 371374 - RNA, 18 nt, Bordetella pertussis
cgcgccccaucaccaugg

SEQ ID NO: 371375 - RNA, 22 nt, Bordetella pertussis
cgcgccccaucaccauggccga

SEQ ID NO: 371376 - RNA, 13 nt, Bordetella pertussis
cgcgcccccacgc

SEQ ID NO: 371377 - RNA, 15 nt, Bordetella pertussis
cgcgcccccacgccg

SEQ ID NO: 371378 - RNA, 16 nt, Bordetella pertussis
cgcgcccccacgccgc

SEQ ID NO: 371379 - RNA, 20 nt, Bordetella pertussis
cgcgcccaucucggccgcgg

SEQ ID NO: 371380 - RNA, 19 nt, Bordetella pertussis
cgcgccccgcuucgggccg

SEQ ID NO: 371381 - RNA, 16 nt, Bordetella pertussis
cgcgccccgucggccg

SEQ ID NO: 371382 - RNA, 17 nt, Bordetella pertussis
cgcgccccuagcgccgc

SEQ ID NO: 371383 - RNA, 13 nt, Bordetella pertussis
cgcgcccgagcgc

SEQ ID NO: 371384 - RNA, 15 nt, Bordetella pertussis
cgcgcccgagcgcca

SEQ ID NO: 371385 - RNA, 14 nt, Bordetella pertussis
cgcgcccgaggcgc

SEQ ID NO: 371386 - RNA, 16 nt, Bordetella pertussis
cgcgcccgaggcgcgc

SEQ ID NO: 371387 - RNA, 17 nt, Bordetella pertussis
cgcgcccgaggcgcgca

SEQ ID NO: 371388 - RNA, 15 nt, Bordetella pertussis
cgcgcccgcaggcgg

SEQ ID NO: 371389 - RNA, 17 nt, Bordetella pertussis
cgcgcccgcaggcggcg

SEQ ID NO: 371390 - RNA, 17 nt, Bordetella pertussis
cgcgcccgccgcgucgg

SEQ ID NO: 371391 - RNA, 22 nt, Bordetella pertussis
cgcgcccgccgcgucggcgccg

SEQ ID NO: 371392 - RNA, 17 nt, Bordetella pertussis
cgcgcccgccguggcca

SEQ ID NO: 371393 - RNA, 19 nt, Bordetella pertussis
cgcgcccgccuucggcggc

SEQ ID NO: 371394 - RNA, 21 nt, Bordetella pertussis
cgcgcccgcuugcggccggcg

SEQ ID NO: 371395 - RNA, 19 nt, Bordetella pertussis
cgcgcccgcguacagcccg

SEQ ID NO: 371396 - RNA, 13 nt, Bordetella pertussis
cgcgcccggccgg

SEQ ID NO: 371397 - RNA, 13 nt, Bordetella pertussis
cgcgcccggcgcg

SEQ ID NO: 371398 - RNA, 14 nt, Bordetella pertussis
cgcgccgaccaccu

SEQ ID NO: 371399 - RNA, 20 nt, Bordetella pertussis
cgcgccgacgaccgaaccga

SEQ ID NO: 371400 - RNA, 13 nt, Bordetella pertussis
cgcgccgacgacc

SEQ ID NO: 371401 - RNA, 20 nt, Bordetella pertussis
cgcgccgacggcggcgcggc

SEQ ID NO: 371402 - RNA, 23 nt, Bordetella pertussis
cgcgccgacggcggcgcggcgcc

SEQ ID NO: 371403 - RNA, 19 nt, Bordetella pertussis
cgcgccgaggaucuggccg

SEQ ID NO: 371404 - RNA, 21 nt, Bordetella pertussis
cgcgccgaggaucuggccggc

SEQ ID NO: 371405 - RNA, 22 nt, Bordetella pertussis
cgcgccgaggaucuggccggcg

SEQ ID NO: 371406 - RNA, 21 nt, Bordetella pertussis
cgcgccgaguuuccgcacccg

SEQ ID NO: 371407 - RNA, 20 nt, Bordetella pertussis
cgcgccgaucaccacgggca

SEQ ID NO: 371408 - RNA, 22 nt, Bordetella pertussis
cgcgccgaucaccacgggcacg

SEQ ID NO: 371409 - RNA, 17 nt, Bordetella pertussis
cgcgccgcccgcggcca

SEQ ID NO: 371410 - RNA, 15 nt, Bordetella pertussis
cgcgccgcccgggcc

SEQ ID NO: 371411 - RNA, 20 nt, Bordetella pertussis
cgcgccgccgccggcccgcc

SEQ ID NO: 371412 - RNA, 16 nt, Bordetella pertussis
cgcgccgccgccuggc

SEQ ID NO: 371413 - RNA, 13 nt, Bordetella pertussis
cgcgccgccgcgc

SEQ ID NO: 371414 - RNA, 14 nt, Bordetella pertussis
cgcgccgccgcgcu

SEQ ID NO: 371415 - RNA, 14 nt, Bordetella pertussis
cgcgccgccgggcc

SEQ ID NO: 371416 - RNA, 16 nt, Bordetella pertussis
cgcgccgccgggccug

SEQ ID NO: 371417 - RNA, 16 nt, Bordetella pertussis
cgcgccgccggugcac

SEQ ID NO: 371418 - RNA, 23 nt, Bordetella pertussis
cgcgccgccguaggacagcccca

SEQ ID NO: 371419 - RNA, 14 nt, Bordetella pertussis
cgcgccgccuacca

SEQ ID NO: 371420 - RNA, 15 nt, Bordetella pertussis
cgcgccgccucgcgc

SEQ ID NO: 371421 - RNA, 9 nt, Bordetella pertussis
cgcgccgcg

SEQ ID NO: 371422 - RNA, 14 nt, Bordetella pertussis
cgcgccgcgaaacg

SEQ ID NO: 371423 - RNA, 18 nt, Bordetella pertussis
cgcgccgcgacgcucgag

SEQ ID NO: 371424 - RNA, 13 nt, Bordetella pertussis
cgcgccgcgccgg

SEQ ID NO: 371425 - RNA, 14 nt, Bordetella pertussis
cgcgccgcgccggg

SEQ ID NO: 371426 - RNA, 13 nt, Bordetella pertussis
cgcgccgcgccuu

SEQ ID NO: 371427 - RNA, 21 nt, Bordetella pertussis
cgcgccgcgcgcacggcgccc

SEQ ID NO: 371428 - RNA, 22 nt, Bordetella pertussis
cgcgccgcgauggcgccggcca

SEQ ID NO: 371429 - RNA, 18 nt, Bordetella pertussis
cgcgccgggccacgagca

SEQ ID NO: 371430 - RNA, 14 nt, Bordetella pertussis
cgcgccgggccaga

SEQ ID NO: 371431 - RNA, 23 nt, Bordetella pertussis
cgcgccgggcccggccacggccg

SEQ ID NO: 371432 - RNA, 14 nt, Bordetella pertussis
cgcgccgggccggc

SEQ ID NO: 371433 - RNA, 20 nt, Bordetella pertussis
cgcgccgggccuagcccggc

SEQ ID NO: 371434 - RNA, 21 nt, Bordetella pertussis
cgcgccgggccuagcccggcg

SEQ ID NO: 371435 - RNA, 14 nt, Bordetella pertussis
cgcgccgggcgaac

SEQ ID NO: 371436 - RNA, 19 nt, Bordetella pertussis
cgcgccgggcgaaccggug

SEQ ID NO: 371437 - RNA, 14 nt, Bordetella pertussis
cgcgccgggcgcgc

SEQ ID NO: 371438 - RNA, 16 nt, Bordetella pertussis
cgcgccgggcgcgccg

SEQ ID NO: 371439 - RNA, 21 nt, Bordetella pertussis
cgcgccgggcgcgccggcggg

SEQ ID NO: 371440 - RNA, 19 nt, Bordetella pertussis
cgcgccggcuaccgcgcca

SEQ ID NO: 371441 - RNA, 15 nt, Bordetella pertussis
cgcgccggcucguac

SEQ ID NO: 371442 - RNA, 14 nt, Bordetella pertussis
cgcgccggggcggc

SEQ ID NO: 371443 - RNA, 20 nt, Bordetella pertussis
cgcgccggggcggcgcagca

SEQ ID NO: 371444 - RNA, 15 nt, Bordetella pertussis
cgcgccggggcggcu

SEQ ID NO: 371445 - RNA, 21 nt, Bordetella pertussis
cgcgccggggcggcucggccc

SEQ ID NO: 371446 - RNA, 23 nt, Bordetella pertussis
cgcgccggguuuuuacaugccgc

SEQ ID NO: 371447 - RNA, 19 nt, Bordetella pertussis
cgcgccggucaggcgucgu

SEQ ID NO: 371448 - RNA, 16 nt, Bordetella pertussis
cgcgccggucacgcug

SEQ ID NO: 371449 - RNA, 17 nt, Bordetella pertussis
cgcgccggucacgcugg

SEQ ID NO: 371450 - RNA, 20 nt, Bordetella pertussis
cgcgccggucgccgcgggca

SEQ ID NO: 371451 - RNA, 15 nt, Bordetella pertussis
cgcgccgguggccag

SEQ ID NO: 371452 - RNA, 17 nt, Bordetella pertussis
cgcgccgguggccagca

SEQ ID NO: 371453 - RNA, 20 nt, Bordetella pertussis
cgcgccgguggccagcagcu

SEQ ID NO: 371454 - RNA, 18 nt, Bordetella pertussis
cgcgccguacagccgcgg

SEQ ID NO: 371455 - RNA, 17 nt, Bordetella pertussis
cgcgccguacagggccg

SEQ ID NO: 371456 - RNA, 22 nt, Bordetella pertussis
cgcgccguaccccagcaugugc

SEQ ID NO: 371457 - RNA, 18 nt, Bordetella pertussis
cgcgccguaccugcagca

SEQ ID NO: 371458 - RNA, 19 nt, Bordetella pertussis
cgcgccguaccugcagcag

SEQ ID NO: 371459 - RNA, 15 nt, Bordetella pertussis
cgcgccguccgggcc

SEQ ID NO: 371460 - RNA, 16 nt, Bordetella pertussis
cgcgccguccgggccg

SEQ ID NO: 371461 - RNA, 16 nt, Bordetella pertussis
cgcgccgucggcgucg

SEQ ID NO: 371462 - RNA, 19 nt, Bordetella pertussis
cgcgccucgaugauggcgu

SEQ ID NO: 371463 - RNA, 20 nt, Bordetella pertussis
cgcgccucggacgccuggcg

SEQ ID NO: 371464 - RNA, 19 nt, Bordetella pertussis
cgcgccucgugcgaggcca

SEQ ID NO: 371465 - RNA, 23 nt, Bordetella pertussis
cgcgccucgugcgaggccacggc

SEQ ID NO: 371466 - RNA, 14 nt, Bordetella pertussis
cgcgccugagcugc

SEQ ID NO: 371467 - RNA, 13 nt, Bordetella pertussis
cgcgccugcagca

SEQ ID NO: 371468 - RNA, 23 nt, Bordetella pertussis
cgcgccugcagcacggccacggc

SEQ ID NO: 371469 - RNA, 15 nt, Bordetella pertussis
cgcgccugcagcagc

SEQ ID NO: 371470 - RNA, 19 nt, Bordetella pertussis
cgcgccugcagcagcggca

SEQ ID NO: 371471 - RNA, 15 nt, Bordetella pertussis
cgcgccugcaugucc

SEQ ID NO: 371472 - RNA, 21 nt, Bordetella pertussis
cgcgccugcauguccagcggc

SEQ ID NO: 371473 - RNA, 22 nt, Bordetella pertussis
cgcgccugcauguccagcggcg

SEQ ID NO: 371474 - RNA, 14 nt, Bordetella pertussis
cgcgccugcccagg

SEQ ID NO: 371475 - RNA, 17 nt, Bordetella pertussis
cgcgccugcccaggcca

SEQ ID NO: 371476 - RNA, 16 nt, Bordetella pertussis
cgcgccugcccgcaac

SEQ ID NO: 371477 - RNA, 20 nt, Bordetella pertussis
cgcgccugcccgcaacgccg

SEQ ID NO: 371478 - RNA, 14 nt, Bordetella pertussis
cgcgccugcgcgcc

SEQ ID NO: 371479 - RNA, 21 nt, Bordetella pertussis
cgcgccugcucguacagcggc

SEQ ID NO: 371480 - RNA, 14 nt, Bordetella pertussis
cgcgccuggcgcgc

SEQ ID NO: 371481 - RNA, 21 nt, Bordetella pertussis
cgcgccuuacgcggcgcgcgc

SEQ ID NO: 371482 - RNA, 21 nt, Bordetella pertussis
cgcgccuuccugggcgccggc

SEQ ID NO: 371483 - RNA, 20 nt, Bordetella pertussis
cgcgccuucgaggccggcgu

SEQ ID NO: 371484 - RNA, 17 nt, Bordetella pertussis
cgcgccuucggcaggcg

SEQ ID NO: 371485 - RNA, 19 nt, Bordetella pertussis
cgcgccuucggcaggcgcc

SEQ ID NO: 371486 - RNA, 15 nt, Bordetella pertussis
cgcgccuucggcgcg

SEQ ID NO: 371487 - RNA, 16 nt, Bordetella pertussis
cgcgccuucggcgcgc

SEQ ID NO: 371488 - RNA, 19 nt, Bordetella pertussis
cgcgccuucggcgcgcacg

SEQ ID NO: 371489 - RNA, 20 nt, Bordetella pertussis
cgcgccuucggcgcgcacgc

SEQ ID NO: 371490 - RNA, 23 nt, Bordetella pertussis
cgcgccuugaaccccggcugcgc

SEQ ID NO: 371491 - RNA, 15 nt, Bordetella pertussis
cgcgcgaacacugga

SEQ ID NO: 371492 - RNA, 16 nt, Bordetella pertussis
cgcgcgaccacuggca

SEQ ID NO: 371493 - RNA, 18 nt, Bordetella pertussis
cgcgcgaccacuggcaga

SEQ ID NO: 371494 - RNA, 14 nt, Bordetella pertussis
cgcgcgaccaggcu

SEQ ID NO: 371495 - RNA, 16 nt, Bordetella pertussis
cgcgcgacgacagcgg

SEQ ID NO: 371496 - RNA, 16 nt, Bordetella pertussis
cgcgcgaccucgggac

SEQ ID NO: 371497 - RNA, 13 nt, Bordetella pertussis
cgcgcgacggcgc

SEQ ID NO: 371498 - RNA, 18 nt, Bordetella pertussis
cgcgcgacgugucggcca

SEQ ID NO: 371499 - RNA, 22 nt, Bordetella pertussis
cgcgcgacgugucggccaccac

SEQ ID NO: 371500 - RNA, 18 nt, Bordetella pertussis
cgcgcgacuuccucgacc

SEQ ID NO: 371501 - RNA, 19 nt, Bordetella pertussis
cgcgcgacuuccucgaccc

SEQ ID NO: 371502 - RNA, 15 nt, Bordetella pertussis
cgcgcgacuucgccg

SEQ ID NO: 371503 - RNA, 23 nt, Bordetella pertussis
cgcgcgagaauggcgcgauccag

SEQ ID NO: 371504 - RNA, 15 nt, Bordetella pertussis
cgcgcgagaccagcg

SEQ ID NO: 371505 - RNA, 13 nt, Bordetella pertussis
cgcgcgagcaguc

SEQ ID NO: 371506 - RNA, 15 nt, Bordetella pertussis
cgcgcgagcagucga

SEQ ID NO: 371507 - RNA, 22 nt, Bordetella pertussis
cgcgcgagcggcggccgcgucc

SEQ ID NO: 371508 - RNA, 17 nt, Bordetella pertussis
cgcgcgagcggcgugcg

SEQ ID NO: 371509 - RNA, 19 nt, Bordetella pertussis
cgcgcgaucgccagcaggc

SEQ ID NO: 371510 - RNA, 14 nt, Bordetella pertussis
cgcgcgauccgcgc

SEQ ID NO: 371511 - RNA, 15 nt, Bordetella pertussis
cgcgcgauccgcgcc

SEQ ID NO: 371512 - RNA, 16 nt, Bordetella pertussis
cgcgcgauccgcgcca

SEQ ID NO: 371513 - RNA, 19 nt, Bordetella pertussis
cgcgcgauccgcgccaggc

SEQ ID NO: 371514 - RNA, 15 nt, Bordetella pertussis
cgcgcgauccggcgu

SEQ ID NO: 371515 - RNA, 20 nt, Bordetella pertussis
cgcgcgauagauggccaggu

SEQ ID NO: 371516 - RNA, 19 nt, Bordetella pertussis
cgcgcgaucucgggcaggu

SEQ ID NO: 371517 - RNA, 16 nt, Bordetella pertussis
cgcgcgaugcgcaggc

SEQ ID NO: 371518 - RNA, 17 nt, Bordetella pertussis
cgcgcgaugcgcggccc

SEQ ID NO: 371519 - RNA, 22 nt, Bordetella pertussis
cgcgcgaugcgcggcccggccg

SEQ ID NO: 371520 - RNA, 17 nt, Bordetella pertussis
cgcgcgauguucaggcc

SEQ ID NO: 371521 - RNA, 18 nt, Bordetella pertussis
cgcgcgauguucaggccg

SEQ ID NO: 371522 - RNA, 17 nt, Bordetella pertussis
cgcgcgcaagccgccgc

SEQ ID NO: 371523 - RNA, 16 nt, Bordetella pertussis
cgcgcgcacaggcgcu

SEQ ID NO: 371524 - RNA, 14 nt, Bordetella pertussis
cgcgcgcacgacca

SEQ ID NO: 371525 - RNA, 22 nt, Bordetella pertussis
cgcgcgcacgaccaccagcgca

SEQ ID NO: 371526 - RNA, 12 nt, Bordetella pertussis
cgcgcgcacgcg

SEQ ID NO: 371527 - RNA, 13 nt, Bordetella pertussis
cgcgcgcacggcg

SEQ ID NO: 371528 - RNA, 14 nt, Bordetella pertussis
cgcgcgcaccggcu

SEQ ID NO: 371529 - RNA, 20 nt, Bordetella pertussis
cgcgcgcagacgcgcucagg

SEQ ID NO: 371530 - RNA, 13 nt, Bordetella pertussis
cgcgcgcaucacg

SEQ ID NO: 371531 - RNA, 13 nt, Bordetella pertussis
cgcgcgcauccag

SEQ ID NO: 371532 - RNA, 13 nt, Bordetella pertussis
cgcgcgcaucggc

SEQ ID NO: 371533 - RNA, 14 nt, Bordetella pertussis
cgcgcgcaucggcc

SEQ ID NO: 371534 - RNA, 16 nt, Bordetella pertussis
cgcgcgcaucggccgg

SEQ ID NO: 371535 - RNA, 13 nt, Bordetella pertussis
cgcgcgcaugcgc

SEQ ID NO: 371536 - RNA, 15 nt, Bordetella pertussis
cgcgcgcaugcgcac

SEQ ID NO: 371537 - RNA, 16 nt, Bordetella pertussis
cgcgcgccaccaccuc

SEQ ID NO: 371538 - RNA, 14 nt, Bordetella pertussis
cgcgcgcagggcga

SEQ ID NO: 371539 - RNA, 13 nt, Bordetella pertussis
cgcgcgcaguccu

SEQ ID NO: 371540 - RNA, 13 nt, Bordetella pertussis
cgcgcgccagcgc

SEQ ID NO: 371541 - RNA, 15 nt, Bordetella pertussis
cgcgcgccagcgccu

SEQ ID NO: 371542 - RNA, 14 nt, Bordetella pertussis
cgcgcgccagcgcg

SEQ ID NO: 371543 - RNA, 16 nt, Bordetella pertussis
cgcgcgccagcgcggc

SEQ ID NO: 371544 - RNA, 14 nt, Bordetella pertussis
cgcgcgcaggcgcu

SEQ ID NO: 371545 - RNA, 13 nt, Bordetella pertussis
cgcgcgccagcug

SEQ ID NO: 371546 - RNA, 22 nt, Bordetella pertussis
cgcgcgccaguugcgcaccgcu

SEQ ID NO: 371547 - RNA, 15 nt, Bordetella pertussis
cgcgcgccaucgacg

SEQ ID NO: 371548 - RNA, 14 nt, Bordetella pertussis
cgcgcgcccccagc

SEQ ID NO: 371549 - RNA, 18 nt, Bordetella pertussis
cgcgcgcccccagcgccg

SEQ ID NO: 371550 - RNA, 12 nt, Bordetella pertussis
cgcgcgccccgc

SEQ ID NO: 371551 - RNA, 22 nt, Bordetella pertussis
cgcgcgccccgcuucgggccgg

SEQ ID NO: 371552 - RNA, 17 nt, Bordetella pertussis
cgcgcgcccaccgagac

SEQ ID NO: 371553 - RNA, 16 nt, Bordetella pertussis
cgcgcgcccaggccag

SEQ ID NO: 371554 - RNA, 13 nt, Bordetella pertussis
cgcgcgccgcacg

SEQ ID NO: 371555 - RNA, 14 nt, Bordetella pertussis
cgcgcgccgcauca

SEQ ID NO: 371556 - RNA, 11 nt, Bordetella pertussis
cgcgcgccgcc

SEQ ID NO: 371557 - RNA, 12 nt, Bordetella pertussis
cgcgcgccgccg

SEQ ID NO: 371558 - RNA, 19 nt, Bordetella pertussis
cgcgcgccgccucagcccg

SEQ ID NO: 371559 - RNA, 13 nt, Bordetella pertussis
cgcgcgccgcgcc

SEQ ID NO: 371560 - RNA, 15 nt, Bordetella pertussis
cgcgcgccggccagc

SEQ ID NO: 371561 - RNA, 19 nt, Bordetella pertussis
cgcgcgccggccagcggca

SEQ ID NO: 371562 - RNA, 13 nt, Bordetella pertussis
cgcgcgccggccg

SEQ ID NO: 371563 - RNA, 13 nt, Bordetella pertussis
cgcgcgccggcgc

SEQ ID NO: 371564 - RNA, 14 nt, Bordetella pertussis
cgcgcgccggcgcc

SEQ ID NO: 371565 - RNA, 21 nt, Bordetella pertussis
cgcgcgccggcucgaacaggc

SEQ ID NO: 371566 - RNA, 16 nt, Bordetella pertussis
cgcgcgccugcaugcc

SEQ ID NO: 371567 - RNA, 12 nt, Bordetella pertussis
cgcgcgccugcg

SEQ ID NO: 371568 - RNA, 14 nt, Bordetella pertussis
cgcgcgccugcucg

SEQ ID NO: 371569 - RNA, 14 nt, Bordetella pertussis
cgcgcgggcgcgca

SEQ ID NO: 371570 - RNA, 16 nt, Bordetella pertussis
cgcgcgggcgcgcagc

SEQ ID NO: 371571 - RNA, 12 nt, Bordetella pertussis
cgcgcgggcggc

SEQ ID NO: 371572 - RNA, 17 nt, Bordetella pertussis
cgcgcggggcaggccga

SEQ ID NO: 371573 - RNA, 19 nt, Bordetella pertussis
cgcgcgggggugcgcgaca

SEQ ID NO: 371574 - RNA, 19 nt, Bordetella pertussis
cgcgcgggguaggccucga

SEQ ID NO: 371575 - RNA, 16 nt, Bordetella pertussis
cgcgcggguccaggcc

SEQ ID NO: 371576 - RNA, 17 nt, Bordetella pertussis
cgcgcggguccaggccc

SEQ ID NO: 371577 - RNA, 19 nt, Bordetella pertussis
cgcgcggguccaggcccga

SEQ ID NO: 371578 - RNA, 15 nt, Bordetella pertussis
cgcgcgucgugcccg

SEQ ID NO: 371579 - RNA, 19 nt, Bordetella pertussis
cgcgcgugcagcgccgcgc

SEQ ID NO: 371580 - RNA, 14 nt, Bordetella pertussis
cgcgcgugcaggcc

SEQ ID NO: 371581 - RNA, 16 nt, Bordetella pertussis
cgcgcgugcaggccgc

SEQ ID NO: 371582 - RNA, 23 nt, Bordetella pertussis
cgcgcgugcggggcggcaggucg

SEQ ID NO: 371583 - RNA, 15 nt, Bordetella pertussis
cgcgcgugcucgcgc

SEQ ID NO: 371584 - RNA, 16 nt, Bordetella pertussis
cgcgcgugcugggcca

SEQ ID NO: 371585 - RNA, 23 nt, Bordetella pertussis
cgcgcgugcugggccaugcguau

SEQ ID NO: 371586 - RNA, 19 nt, Bordetella pertussis
cgcgcgugagcgaauccag

SEQ ID NO: 371587 - RNA, 15 nt, Bordetella pertussis
cgcgcgugccgcgca

SEQ ID NO: 371588 - RNA, 14 nt, Bordetella pertussis
cgcgcguugaccgc

SEQ ID NO: 371589 - RNA, 12 nt, Bordetella pertussis
cgcgcguugccu

SEQ ID NO: 371590 - RNA, 14 nt, Bordetella pertussis
cgcgcucaggccgc

SEQ ID NO: 371591 - RNA, 16 nt, Bordetella pertussis
cgcgcucaggccgcug

SEQ ID NO: 371592 - RNA, 20 nt, Bordetella pertussis
cgcgcucaggcggugacgcc

SEQ ID NO: 371593 - RNA, 18 nt, Bordetella pertussis
cgcgcucagggggcgccc

SEQ ID NO: 371594 - RNA, 20 nt, Bordetella pertussis
cgcgcucagggggcgcccca

SEQ ID NO: 371595 - RNA, 17 nt, Bordetella pertussis
cgcgcucagcaccaggc

SEQ ID NO: 371596 - RNA, 18 nt, Bordetella pertussis
cgcgcucagcaccaggcc

SEQ ID NO: 371597 - RNA, 17 nt, Bordetella pertussis
cgcgcucagcgccauca

SEQ ID NO: 371598 - RNA, 16 nt, Bordetella pertussis
cgcgcucggacgccgc

SEQ ID NO: 371599 - RNA, 18 nt, Bordetella pertussis
cgcgcucggacgccgcgc

SEQ ID NO: 371600 - RNA, 20 nt, Bordetella pertussis
cgcgcucggacgccgcgcgg

SEQ ID NO: 371601 - RNA, 17 nt, Bordetella pertussis
cgcgcucggccagcaug

SEQ ID NO: 371602 - RNA, 15 nt, Bordetella pertussis
cgcgcucggccagcg

SEQ ID NO: 371603 - RNA, 18 nt, Bordetella pertussis
cgcgcucggccagcgcgc

SEQ ID NO: 371604 - RNA, 20 nt, Bordetella pertussis
cgcgcucggccagcgcgcgg

SEQ ID NO: 371605 - RNA, 22 nt, Bordetella pertussis
cgcgcucggccagcgcgcggcc

SEQ ID NO: 371606 - RNA, 23 nt, Bordetella pertussis
cgcgcucggccagcgcgcggccg

SEQ ID NO: 371607 - RNA, 14 nt, Bordetella pertussis
cgcgcucggcgccg

SEQ ID NO: 371608 - RNA, 16 nt, Bordetella pertussis
cgcgcucggcgccggg

SEQ ID NO: 371609 - RNA, 13 nt, Bordetella pertussis
cgcgcucggcgcu

SEQ ID NO: 371610 - RNA, 15 nt, Bordetella pertussis
cgcgcucggcgcugc

SEQ ID NO: 371611 - RNA, 16 nt, Bordetella pertussis
cgcgcucggcgcugcc

SEQ ID NO: 371612 - RNA, 22 nt, Bordetella pertussis
cgcgcuggcccgcgcgagcggc

SEQ ID NO: 371613 - RNA, 12 nt, Bordetella pertussis
cgcgcuggccga

SEQ ID NO: 371614 - RNA, 16 nt, Bordetella pertussis
cgcgcuggcgcagcag

SEQ ID NO: 371615 - RNA, 19 nt, Bordetella pertussis
cgcgcuggcgcagcaggcg

SEQ ID NO: 371616 - RNA, 22 nt, Bordetella pertussis
cgcgcuggcgcagcaggcgcgc

SEQ ID NO: 371617 - RNA, 12 nt, Bordetella pertussis
cgcgcuggcgcc

SEQ ID NO: 371618 - RNA, 16 nt, Bordetella pertussis
cgcgcuggcgcccggc

SEQ ID NO: 371619 - RNA, 17 nt, Bordetella pertussis
cgcgcuggcgcccggcc

SEQ ID NO: 371620 - RNA, 19 nt, Bordetella pertussis
cgcgcuggcgcgcgacggc

SEQ ID NO: 371621 - RNA, 21 nt, Bordetella pertussis
cgcgcuggcgcgcgacggcgc

SEQ ID NO: 371622 - RNA, 23 nt, Bordetella pertussis
cgcgcuggcgcucgggcgcggca

SEQ ID NO: 371623 - RNA, 13 nt, Bordetella pertussis
cgcgcuggcgcga

SEQ ID NO: 371624 - RNA, 18 nt, Bordetella pertussis
cgcgcuggcggcgcaggc

SEQ ID NO: 371625 - RNA, 21 nt, Bordetella pertussis
cgcgcuggcggcgcaggccgc

SEQ ID NO: 371626 - RNA, 20 nt, Bordetella pertussis
cgcgcuggcgguggccgcgc

SEQ ID NO: 371627 - RNA, 19 nt, Bordetella pertussis
cgcgcuggcugugcccgcc

SEQ ID NO: 371628 - RNA, 20 nt, Bordetella pertussis
cgcgcugggcgcugcugcug

SEQ ID NO: 371629 - RNA, 16 nt, Bordetella pertussis
cgcgcugggucagguc

SEQ ID NO: 371630 - RNA, 17 nt, Bordetella pertussis
cgcgcugggucaggucg

SEQ ID NO: 371631 - RNA, 17 nt, Bordetella pertussis
cgcgcuggugcuggccg

SEQ ID NO: 371632 - RNA, 21 nt, Bordetella pertussis
cgcggaagcugacgaaacgcg

SEQ ID NO: 371633 - RNA, 20 nt, Bordetella pertussis
cgcggaagucgggcaccagc

SEQ ID NO: 371634 - RNA, 22 nt, Bordetella pertussis
cgcggaagucgggcaccagcac

SEQ ID NO: 371635 - RNA, 21 nt, Bordetella pertussis
cgcggacagaugccguccugg

SEQ ID NO: 371636 - RNA, 22 nt, Bordetella pertussis
cgcggacgaagccuaggcugca

SEQ ID NO: 371637 - RNA, 13 nt, Bordetella pertussis
cgcggacgccaug

SEQ ID NO: 371638 - RNA, 16 nt, Bordetella pertussis
cgcggacgccauggcg

SEQ ID NO: 371639 - RNA, 19 nt, Bordetella pertussis
cgcggacgccauggcggcg

SEQ ID NO: 371640 - RNA, 21 nt, Bordetella pertussis
cgcggacgccauggcggcggc

SEQ ID NO: 371641 - RNA, 15 nt, Bordetella pertussis
cgcggacuucgcccg

SEQ ID NO: 371642 - RNA, 22 nt, Bordetella pertussis
cgcggaggugucgccgcccaug

SEQ ID NO: 371643 - RNA, 23 nt, Bordetella pertussis
cgcggaggugucgccgcccaugc

SEQ ID NO: 371644 - RNA, 19 nt, Bordetella pertussis
cgcggauauucgucggccg

SEQ ID NO: 371645 - RNA, 20 nt, Bordetella pertussis
cgcggauauucgucggccgc

SEQ ID NO: 371646 - RNA, 22 nt, Bordetella pertussis
cgcggauauucgucggccgccg

SEQ ID NO: 371647 - RNA, 12 nt, Bordetella pertussis
cgcggaucgacg

SEQ ID NO: 371648 - RNA, 13 nt, Bordetella pertussis
cgcggaucggcca

SEQ ID NO: 371649 - RNA, 16 nt, Bordetella pertussis
cgcggaucgugcgcca

SEQ ID NO: 371650 - RNA, 15 nt, Bordetella pertussis
cgcggaucgugucga

SEQ ID NO: 371651 - RNA, 18 nt, Bordetella pertussis
cgcggaugaccugcgcca

SEQ ID NO: 371652 - RNA, 17 nt, Bordetella pertussis
cgcggaugaccuggugc

SEQ ID NO: 371653 - RNA, 17 nt, Bordetella pertussis
cgcggaugaucgcgcag

SEQ ID NO: 371654 - RNA, 23 nt, Bordetella pertussis
cgcggaugaucgcgcagcaccgc

SEQ ID NO: 371655 - RNA, 15 nt, Bordetella pertussis
cgcggaugcgcgccu

SEQ ID NO: 371656 - RNA, 16 nt, Bordetella pertussis
cgcggaugcgcgccuu

SEQ ID NO: 371657 - RNA, 21 nt, Bordetella pertussis
cgcggauugccguccuggcga

SEQ ID NO: 371658 - RNA, 21 nt, Bordetella pertussis
cgcggauuugcuucaggucgc

SEQ ID NO: 371659 - RNA, 18 nt, Bordetella pertussis
cgcggcaaaaugccgcgu

SEQ ID NO: 371660 - RNA, 19 nt, Bordetella pertussis
cgcggcaaaaugccgcgug

SEQ ID NO: 371661 - RNA, 16 nt, Bordetella pertussis
cgcggcccagcgcggc

SEQ ID NO: 371662 - RNA, 18 nt, Bordetella pertussis
cgcggccccaugcgcggc

SEQ ID NO: 371663 - RNA, 13 nt, Bordetella pertussis
cgcggcccugggc

SEQ ID NO: 371664 - RNA, 22 nt, Bordetella pertussis
cgcggcccugggccagccagcg

SEQ ID NO: 371665 - RNA, 14 nt, Bordetella pertussis
cgcggcccugggcg

SEQ ID NO: 371666 - RNA, 18 nt, Bordetella pertussis
cgcggcccuggucgucgc

SEQ ID NO: 371667 - RNA, 23 nt, Bordetella pertussis
cgcggccgcgcgcuucaggcgcc

SEQ ID NO: 371668 - RNA, 13 nt, Bordetella pertussis
cgcggccgcgcug

SEQ ID NO: 371669 - RNA, 17 nt, Bordetella pertussis
cgcggccgcgcuggcgc

SEQ ID NO: 371670 - RNA, 18 nt, Bordetella pertussis
cgcggccgcggucagcca

SEQ ID NO: 371671 - RNA, 17 nt, Bordetella pertussis
cgcggccgcgucggccu

SEQ ID NO: 371672 - RNA, 14 nt, Bordetella pertussis
cgcggccggcaagg

SEQ ID NO: 371673 - RNA, 12 nt, Bordetella pertussis
cgcggccggcac

SEQ ID NO: 371674 - RNA, 14 nt, Bordetella pertussis
cgcggccggcacca

SEQ ID NO: 371675 - RNA, 19 nt, Bordetella pertussis
cgcggccggcaccaggauc

SEQ ID NO: 371676 - RNA, 18 nt, Bordetella pertussis
cgcggccggcacgcccag

SEQ ID NO: 371677 - RNA, 12 nt, Bordetella pertussis
cgcggccggccg

SEQ ID NO: 371678 - RNA, 15 nt, Bordetella pertussis
cgcggccggccgcgc

SEQ ID NO: 371679 - RNA, 15 nt, Bordetella pertussis
cgcggccggccgggu

SEQ ID NO: 371680 - RNA, 12 nt, Bordetella pertussis
cgcggccggcgc

SEQ ID NO: 371681 - RNA, 17 nt, Bordetella pertussis
cgcggccggcgcgccgg

SEQ ID NO: 371682 - RNA, 23 nt, Bordetella pertussis
cgcggccggcgcgccggccugcg

SEQ ID NO: 371683 - RNA, 16 nt, Bordetella pertussis
cgcggccggcuugcgc

SEQ ID NO: 371684 - RNA, 22 nt, Bordetella pertussis
cgcggccggggguuccugccca

SEQ ID NO: 371685 - RNA, 17 nt, Bordetella pertussis
cgcggccggguggccgc

SEQ ID NO: 371686 - RNA, 20 nt, Bordetella pertussis
cgcggccguaguucggcggg

SEQ ID NO: 371687 - RNA, 18 nt, Bordetella pertussis
cgcggccgucaccgccgc

SEQ ID NO: 371688 - RNA, 21 nt, Bordetella pertussis
cgcggccguguucgagcaggc

SEQ ID NO: 371689 - RNA, 23 nt, Bordetella pertussis
cgcggccuauuuggcggccuggc

SEQ ID NO: 371690 - RNA, 19 nt, Bordetella pertussis
cgcggccucgccggccugg

SEQ ID NO: 371691 - RNA, 15 nt, Bordetella pertussis
cgcggcgagccgcgc

SEQ ID NO: 371692 - RNA, 18 nt, Bordetella pertussis
cgcggcgagccgcgcgca

SEQ ID NO: 371693 - RNA, 20 nt, Bordetella pertussis
cgcggcgagccgcgcgcaug

SEQ ID NO: 371694 - RNA, 14 nt, Bordetella pertussis
cgcggcgagcgccg

SEQ ID NO: 371695 - RNA, 15 nt, Bordetella pertussis
cgcggcgagcgccgc

SEQ ID NO: 371696 - RNA, 17 nt, Bordetella pertussis
cgcggcgauacgcgccg

SEQ ID NO: 371697 - RNA, 18 nt, Bordetella pertussis
cgcggcgaucggcccggg

SEQ ID NO: 371698 - RNA, 15 nt, Bordetella pertussis
cgcggcgaugccggc

SEQ ID NO: 371699 - RNA, 17 nt, Bordetella pertussis
cgcggcgaugccggcca

SEQ ID NO: 371700 - RNA, 20 nt, Bordetella pertussis
cgcggcgaugccggccagca

SEQ ID NO: 371701 - RNA, 17 nt, Bordetella pertussis
cgcggcgauugcggccc

SEQ ID NO: 371702 - RNA, 21 nt, Bordetella pertussis
cgcggcgauugcggcccgcgg

SEQ ID NO: 371703 - RNA, 12 nt, Bordetella pertussis
cgcggcgcagca

SEQ ID NO: 371704 - RNA, 23 nt, Bordetella pertussis
cgcggcgcagcaucuugcgccgc

SEQ ID NO: 371705 - RNA, 14 nt, Bordetella pertussis
cgcggcgcagcaug

SEQ ID NO: 371706 - RNA, 14 nt, Bordetella pertussis
cgcggcgcagccca

SEQ ID NO: 371707 - RNA, 15 nt, Bordetella pertussis
cgcggcgcaggccug

SEQ ID NO: 371708 - RNA, 13 nt, Bordetella pertussis
cgcggcgcaggcg

SEQ ID NO: 371709 - RNA, 16 nt, Bordetella pertussis
cgcggcgccagcgccc

SEQ ID NO: 371710 - RNA, 21 nt, Bordetella pertussis
cgcggcgccguccagcgcggc

SEQ ID NO: 371711 - RNA, 14 nt, Bordetella pertussis
cgcggcgccugccu

SEQ ID NO: 371712 - RNA, 21 nt, Bordetella pertussis
cgcggcgccugcgcgcgcugg

SEQ ID NO: 371713 - RNA, 21 nt, Bordetella pertussis
cgcggcgccuggggcgugccc

SEQ ID NO: 371714 - RNA, 15 nt, Bordetella pertussis
cgcggcgcgccagcg

SEQ ID NO: 371715 - RNA, 16 nt, Bordetella pertussis
cgcggcgcgcgccagg

SEQ ID NO: 371716 - RNA, 14 nt, Bordetella pertussis
cgcggcgcgcgccg

SEQ ID NO: 371717 - RNA, 17 nt, Bordetella pertussis
cgcggcgcgcgccgagg

SEQ ID NO: 371718 - RNA, 20 nt, Bordetella pertussis
cgcggcgcgcgccgagguga

SEQ ID NO: 371719 - RNA, 18 nt, Bordetella pertussis
cgcggcgcgcgccugcag

SEQ ID NO: 371720 - RNA, 14 nt, Bordetella pertussis
cgcggcgcgcgcgc

SEQ ID NO: 371721 - RNA, 21 nt, Bordetella pertussis
cgcggcgcgcgcggcgccugg

SEQ ID NO: 371722 - RNA, 13 nt, Bordetella pertussis
cgcggcgcggcag

SEQ ID NO: 371723 - RNA, 13 nt, Bordetella pertussis
cgcggcgcggcca

SEQ ID NO: 371724 - RNA, 17 nt, Bordetella pertussis
cgcggcgcggccagcag

SEQ ID NO: 371725 - RNA, 13 nt, Bordetella pertussis
cgcggcgcggccc

SEQ ID NO: 371726 - RNA, 16 nt, Bordetella pertussis
cgcggcggcaccagca

SEQ ID NO: 371727 - RNA, 22 nt, Bordetella pertussis
cgcggcggcaccagcaggccgg

SEQ ID NO: 371728 - RNA, 14 nt, Bordetella pertussis
cgcggcggcagcgc

SEQ ID NO: 371729 - RNA, 13 nt, Bordetella pertussis
cgcggcggcccgg

SEQ ID NO: 371730 - RNA, 13 nt, Bordetella pertussis
cgcggcggccagg

SEQ ID NO: 371731 - RNA, 14 nt, Bordetella pertussis
cgcggcggccaggc

SEQ ID NO: 371732 - RNA, 13 nt, Bordetella pertussis
cgcggcggccugg

SEQ ID NO: 371733 - RNA, 23 nt, Bordetella pertussis
cgcggcggccuugugcgccagcg

SEQ ID NO: 371734 - RNA, 16 nt, Bordetella pertussis
cgcggcggcgaccggc

SEQ ID NO: 371735 - RNA, 16 nt, Bordetella pertussis
cgcggcggcgugaacg

SEQ ID NO: 371736 - RNA, 15 nt, Bordetella pertussis
cgcggcggcuugccg

SEQ ID NO: 371737 - RNA, 21 nt, Bordetella pertussis
cgcggcgggaccgugccgccg

SEQ ID NO: 371738 - RNA, 15 nt, Bordetella pertussis
cgcggcgggccccgc

SEQ ID NO: 371739 - RNA, 15 nt, Bordetella pertussis
cgcggcgggcgcugg

SEQ ID NO: 371740 - RNA, 16 nt, Bordetella pertussis
cgcggcgggcgcuggc

SEQ ID NO: 371741 - RNA, 20 nt, Bordetella pertussis
cgcggcgggcgcuggcgcgc

SEQ ID NO: 371742 - RNA, 20 nt, Bordetella pertussis
cgcggcgggcggcgcggcca

SEQ ID NO: 371743 - RNA, 14 nt, Bordetella pertussis
cgcggcgggcucga

SEQ ID NO: 371744 - RNA, 16 nt, Bordetella pertussis
cgcggcgggcucggcg

SEQ ID NO: 371745 - RNA, 13 nt, Bordetella pertussis
cgcggcgggccgg

SEQ ID NO: 371746 - RNA, 23 nt, Bordetella pertussis
cgcggcgggcgauugcucgacau

SEQ ID NO: 371747 - RNA, 17 nt, Bordetella pertussis
cgcggcgggugccgcga

SEQ ID NO: 371748 - RNA, 19 nt, Bordetella pertussis
cgcggcggguucgcagggc

SEQ ID NO: 371749 - RNA, 17 nt, Bordetella pertussis
cgcggcgguccucgccg

SEQ ID NO: 371750 - RNA, 15 nt, Bordetella pertussis
cgcggcgguccugcu

SEQ ID NO: 371751 - RNA, 15 nt, Bordetella pertussis
cgcggcggugccgcc

SEQ ID NO: 371752 - RNA, 18 nt, Bordetella pertussis
cgcggcggugccgcccac

SEQ ID NO: 371753 - RNA, 13 nt, Bordetella pertussis
cgcggcgguggcg

SEQ ID NO: 371754 - RNA, 17 nt, Bordetella pertussis
cgcggcgguuucggccg

SEQ ID NO: 371755 - RNA, 18 nt, Bordetella pertussis
cgcggcguaccgguccag

SEQ ID NO: 371756 - RNA, 20 nt, Bordetella pertussis
cgcggcguacuggcgcggcg

SEQ ID NO: 371757 - RNA, 20 nt, Bordetella pertussis
cgcggcguccgaauacgcca

SEQ ID NO: 371758 - RNA, 21 nt, Bordetella pertussis
cgcggcguccgaauacgccac

SEQ ID NO: 371759 - RNA, 14 nt, Bordetella pertussis
cgcggcguccgcgc

SEQ ID NO: 371760 - RNA, 15 nt, Bordetella pertussis
cgcggcguccgcgcc

SEQ ID NO: 371761 - RNA, 20 nt, Bordetella pertussis
cgcggcgucgaaggccgccg

SEQ ID NO: 371762 - RNA, 15 nt, Bordetella pertussis
cgcggcgucgacgcc

SEQ ID NO: 371763 - RNA, 21 nt, Bordetella pertussis
cgcggcguguagagcugcggc

SEQ ID NO: 371764 - RNA, 20 nt, Bordetella pertussis
cgcggcguugcggcagcggc

SEQ ID NO: 371765 - RNA, 18 nt, Bordetella pertussis
cgcggcguugcggcgcca

SEQ ID NO: 371766 - RNA, 18 nt, Bordetella pertussis
cgcggcuccagcucagca

SEQ ID NO: 371767 - RNA, 22 nt, Bordetella pertussis
cgcggcuccagcucagcagcgc

SEQ ID NO: 371768 - RNA, 23 nt, Bordetella pertussis
cgcggcuccagcucagcagcgcc

SEQ ID NO: 371769 - RNA, 15 nt, Bordetella pertussis
cgcggcucgccgcgc

SEQ ID NO: 371770 - RNA, 21 nt, Bordetella pertussis
cgcggcucgccgcgcacgggc

SEQ ID NO: 371771 - RNA, 16 nt, Bordetella pertussis
cgcggcucgccggccg

SEQ ID NO: 371772 - RNA, 19 nt, Bordetella pertussis
cgcggcucgccggccgcgc

SEQ ID NO: 371773 - RNA, 19 nt, Bordetella pertussis
cgcggcugcgaaaggccga

SEQ ID NO: 371774 - RNA, 20 nt, Bordetella pertussis
cgcggcugcgaaaggccgag

SEQ ID NO: 371775 - RNA, 16 nt, Bordetella pertussis
cgcggcugcgggccgg

SEQ ID NO: 371776 - RNA, 20 nt, Bordetella pertussis
cgcggcugcgggccggcgcc

SEQ ID NO: 371777 - RNA, 17 nt, Bordetella pertussis
cgcggcugggucggcgu

SEQ ID NO: 371778 - RNA, 17 nt, Bordetella pertussis
cgcggcugguggugccg

SEQ ID NO: 371779 - RNA, 20 nt, Bordetella pertussis
cgcggcugguggugccgcgc

SEQ ID NO: 371780 - RNA, 21 nt, Bordetella pertussis
cgcggcugguggugccgcgca

SEQ ID NO: 371781 - RNA, 14 nt, Bordetella pertussis
cgcggcuucgcccg

SEQ ID NO: 371782 - RNA, 20 nt, Bordetella pertussis
cgcggcuuucgccggaggcg

SEQ ID NO: 371783 - RNA, 16 nt, Bordetella pertussis
cgcggcuuuuucucgg

SEQ ID NO: 371784 - RNA, 19 nt, Bordetella pertussis
cgcggcuuuuucucggccu

SEQ ID NO: 371785 - RNA, 16 nt, Bordetella pertussis
cgcgggaagcgcucgc

SEQ ID NO: 371786 - RNA, 22 nt, Bordetella pertussis
cgcgggaagcugucggcgcugg

SEQ ID NO: 371787 - RNA, 16 nt, Bordetella pertussis
cgcgggcacucggcca

SEQ ID NO: 371788 - RNA, 16 nt, Bordetella pertussis
cgcgggcagugcgccg

SEQ ID NO: 371789 - RNA, 20 nt, Bordetella pertussis
cgcgggcagugcgccggacg

SEQ ID NO: 371790 - RNA, 20 nt, Bordetella pertussis
cgcgggcauugggcagcgga

SEQ ID NO: 371791 - RNA, 16 nt, Bordetella pertussis
cgcgggccacgcgccg

SEQ ID NO: 371792 - RNA, 19 nt, Bordetella pertussis
cgcgggccaggccggccca

SEQ ID NO: 371793 - RNA, 18 nt, Bordetella pertussis
cgcgggcccgcucggcca

SEQ ID NO: 371794 - RNA, 21 nt, Bordetella pertussis
cgcgggcccgcucggccagca

SEQ ID NO: 371795 - RNA, 12 nt, Bordetella pertussis
cgcgggccgccg

SEQ ID NO: 371796 - RNA, 17 nt, Bordetella pertussis
cgcgggccgcuggucgu

SEQ ID NO: 371797 - RNA, 21 nt, Bordetella pertussis
cgcgggccuacuugccggcgc

SEQ ID NO: 371798 - RNA, 13 nt, Bordetella pertussis
cgcgggccuggcg

SEQ ID NO: 371799 - RNA, 18 nt, Bordetella pertussis
cgcgggccuuggccagca

SEQ ID NO: 371800 - RNA, 19 nt, Bordetella pertussis
cgcgggccuuggccagcag

SEQ ID NO: 371801 - RNA, 20 nt, Bordetella pertussis
cgcgggccuuggccagcagc

SEQ ID NO: 371802 - RNA, 20 nt, Bordetella pertussis
cgcgggcgauuugccgcagc

SEQ ID NO: 371803 - RNA, 12 nt, Bordetella pertussis
cgcgggcgcagg

SEQ ID NO: 371804 - RNA, 13 nt, Bordetella pertussis
cgcgggcgcccgg

SEQ ID NO: 371805 - RNA, 13 nt, Bordetella pertussis
cgcgggcgccgcg

SEQ ID NO: 371806 - RNA, 13 nt, Bordetella pertussis
cgcgggcgcgccg

SEQ ID NO: 371807 - RNA, 18 nt, Bordetella pertussis
cgcgggcgcgcagcgcga

SEQ ID NO: 371808 - RNA, 15 nt, Bordetella pertussis
cgcgggcgcggcagg

SEQ ID NO: 371809 - RNA, 14 nt, Bordetella pertussis
cgcgggcggccacg

SEQ ID NO: 371810 - RNA, 16 nt, Bordetella pertussis
cgcgggcggccgacgg

SEQ ID NO: 371811 - RNA, 16 nt, Bordetella pertussis
cgcgggcggcuaggcg

SEQ ID NO: 371812 - RNA, 13 nt, Bordetella pertussis
cgcgggcgggccg

SEQ ID NO: 371813 - RNA, 18 nt, Bordetella pertussis
cgcggggcuggccagcug

SEQ ID NO: 371814 - RNA, 23 nt, Bordetella pertussis
cgcggggcuggccagcuggcggc

SEQ ID NO: 371815 - RNA, 24 nt, Bordetella pertussis
cgcggggcuggccagcuggcggcg

SEQ ID NO: 371816 - RNA, 15 nt, Bordetella pertussis
cgcgggugguggccg

SEQ ID NO: 371817 - RNA, 13 nt, Bordetella pertussis
cgcggguucgacg

SEQ ID NO: 371818 - RNA, 15 nt, Bordetella pertussis
cgcggguucgacgcc

SEQ ID NO: 371819 - RNA, 19 nt, Bordetella pertussis
cgcggguucgacgccggca

SEQ ID NO: 371820 - RNA, 16 nt, Bordetella pertussis
cgcggguucggcgguu

SEQ ID NO: 371821 - RNA, 20 nt, Bordetella pertussis
cgcggguuggucgucagcgc

SEQ ID NO: 371822 - RNA, 23 nt, Bordetella pertussis
cgcggguuggucgucagcgccgc

SEQ ID NO: 371823 - RNA, 17 nt, Bordetella pertussis
cgcgguacaggcugccg

SEQ ID NO: 371824 - RNA, 16 nt, Bordetella pertussis
cgcgguacgcaccgcc

SEQ ID NO: 371825 - RNA, 20 nt, Bordetella pertussis
cgcgguacgcaccgccgccg

SEQ ID NO: 371826 - RNA, 21 nt, Bordetella pertussis
cgcgguacgcaccgccgccgg

SEQ ID NO: 371827 - RNA, 22 nt, Bordetella pertussis
cgcgguacgcaccgccgccggc

SEQ ID NO: 371828 - RNA, 19 nt, Bordetella pertussis
cgcgguccugaccggcggc

SEQ ID NO: 371829 - RNA, 20 nt, Bordetella pertussis
cgcgguccugaccggcggcg

SEQ ID NO: 371830 - RNA, 20 nt, Bordetella pertussis
cgcggucgaugcgcacgccc

SEQ ID NO: 371831 - RNA, 19 nt, Bordetella pertussis
cgcggucgcauuggccgcc

SEQ ID NO: 371832 - RNA, 20 nt, Bordetella pertussis
cgcggucgcauuggccgccg

SEQ ID NO: 371833 - RNA, 19 nt, Bordetella pertussis
cgcggucgccaucggccgg

SEQ ID NO: 371834 - RNA, 19 nt, Bordetella pertussis
cgcggucgcccaacccggc

SEQ ID NO: 371835 - RNA, 20 nt, Bordetella pertussis
cgcggucgcccaacccggcg

SEQ ID NO: 371836 - RNA, 19 nt, Bordetella pertussis
cgcggugcaagcggccggc

SEQ ID NO: 371837 - RNA, 14 nt, Bordetella pertussis
cgcggugccgccug

SEQ ID NO: 371838 - RNA, 17 nt, Bordetella pertussis
cgcggugcgcaccaggc

SEQ ID NO: 371839 - RNA, 19 nt, Bordetella pertussis
cgcggugcgcaccaggccc

SEQ ID NO: 371840 - RNA, 12 nt, Bordetella pertussis
cgcggugcgcca

SEQ ID NO: 371841 - RNA, 14 nt, Bordetella pertussis
cgcggugcucggcg

SEQ ID NO: 371842 - RNA, 14 nt, Bordetella pertussis
cgcgguggccagcg

SEQ ID NO: 371843 - RNA, 14 nt, Bordetella pertussis
cgcgguggccgccg

SEQ ID NO: 371844 - RNA, 23 nt, Bordetella pertussis
cgcgguggccgcuucggcggccg

SEQ ID NO: 371845 - RNA, 16 nt, Bordetella pertussis
cgcggugggcagcggc

SEQ ID NO: 371846 - RNA, 14 nt, Bordetella pertussis
cgcggugguccaga

SEQ ID NO: 371847 - RNA, 16 nt, Bordetella pertussis
cgcggugucgccgccg

SEQ ID NO: 371848 - RNA, 24 nt, Bordetella pertussis
cgcggugucgccgccgcgccgaac

SEQ ID NO: 371849 - RNA, 14 nt, Bordetella pertussis
cgcggugucggaca

SEQ ID NO: 371850 - RNA, 21 nt, Bordetella pertussis
cgcggugucggacaacugcgc

SEQ ID NO: 371851 - RNA, 20 nt, Bordetella pertussis
cgcgguucgcauagcgccgg

SEQ ID NO: 371852 - RNA, 21 nt, Bordetella pertussis
cgcgguucgcauagcgccggu

SEQ ID NO: 371853 - RNA, 17 nt, Bordetella pertussis
cgcgguucgccgugcag

SEQ ID NO: 371854 - RNA, 13 nt, Bordetella pertussis
cgcgugcaccagc

SEQ ID NO: 371855 - RNA, 20 nt, Bordetella pertussis
cgcgugcagaucugcacgcu

SEQ ID NO: 371856 - RNA, 23 nt, Bordetella pertussis
cgcgugcagaucugcacgcugua

SEQ ID NO: 371857 - RNA, 14 nt, Bordetella pertussis
cgcgugcagccagc

SEQ ID NO: 371858 - RNA, 15 nt, Bordetella pertussis
cgcgugcagccagcg

SEQ ID NO: 371859 - RNA, 22 nt, Bordetella pertussis
cgcgugcagccagcggccgaua

SEQ ID NO: 371860 - RNA, 13 nt, Bordetella pertussis
cgcgugccagcag

SEQ ID NO: 371861 - RNA, 15 nt, Bordetella pertussis
cgcgugccagcaggu

SEQ ID NO: 371862 - RNA, 14 nt, Bordetella pertussis
cgcgugcgcaggcg

SEQ ID NO: 371863 - RNA, 19 nt, Bordetella pertussis
cgcgugcgcaggcgcgugg

SEQ ID NO: 371864 - RNA, 17 nt, Bordetella pertussis
cgcgugcgcggccgcgc

SEQ ID NO: 371865 - RNA, 15 nt, Bordetella pertussis
cgcgugcggggcggc

SEQ ID NO: 371866 - RNA, 21 nt, Bordetella pertussis
cgcgugcggggcggcaggucg

SEQ ID NO: 371867 - RNA, 19 nt, Bordetella pertussis
cgcgugcucaucggcaggc

SEQ ID NO: 371868 - RNA, 22 nt, Bordetella pertussis
cgcgugcucaucggcaggccgg

SEQ ID NO: 371869 - RNA, 15 nt, Bordetella pertussis
cgcgugcuggcgcag

SEQ ID NO: 371870 - RNA, 17 nt, Bordetella pertussis
cgcgugcuggcgcagca

SEQ ID NO: 371871 - RNA, 24 nt, Bordetella pertussis
cgcgugcuggcgcagcagcgccgg

SEQ ID NO: 371872 - RNA, 14 nt, Bordetella pertussis
cgcgugcugggcca

SEQ ID NO: 371873 - RNA, 16 nt, Bordetella pertussis
cgcguggaaccgccgc

SEQ ID NO: 371874 - RNA, 12 nt, Bordetella pertussis
cgcguggccagc

SEQ ID NO: 371875 - RNA, 16 nt, Bordetella pertussis
cgcguggcccgcgccg

SEQ ID NO: 371876 - RNA, 13 nt, Bordetella pertussis
cgcguggccgcgc

SEQ ID NO: 371877 - RNA, 19 nt, Bordetella pertussis
cgcguggccgcgcugcugc

SEQ ID NO: 371878 - RNA, 14 nt, Bordetella pertussis
cgcguggcgcgcca

SEQ ID NO: 371879 - RNA, 21 nt, Bordetella pertussis
cgcguggcgcgccagcgccac

SEQ ID NO: 371880 - RNA, 15 nt, Bordetella pertussis
cgcguggcggcgcag

SEQ ID NO: 371881 - RNA, 19 nt, Bordetella pertussis
cgcguggcggcgcagcgcc

SEQ ID NO: 371882 - RNA, 17 nt, Bordetella pertussis
cgcguggccgccacgcc

SEQ ID NO: 371883 - RNA, 20 nt, Bordetella pertussis
cgcgugggcacccggccgcu

SEQ ID NO: 371884 - RNA, 22 nt, Bordetella pertussis
cgcgugggcggcggcaugcugg

SEQ ID NO: 371885 - RNA, 13 nt, Bordetella pertussis
cgcguuccggccg

SEQ ID NO: 371886 - RNA, 14 nt, Bordetella pertussis
cgcguuccggccgc

SEQ ID NO: 371887 - RNA, 19 nt, Bordetella pertussis
cgcguuccggccgcgccag

SEQ ID NO: 371888 - RNA, 14 nt, Bordetella pertussis
cgcguucgggcggc

SEQ ID NO: 371889 - RNA, 22 nt, Bordetella pertussis
cgcuaaggagaauccgcaggcg

SEQ ID NO: 371890 - RNA, 19 nt, Bordetella pertussis
cgcuacagggugccgcgcc

SEQ ID NO: 371891 - RNA, 21 nt, Bordetella pertussis
cgcuacagggugccgcgccgg

SEQ ID NO: 371892 - RNA, 15 nt, Bordetella pertussis
cgcuaccaggcgcgc

SEQ ID NO: 371893 - RNA, 17 nt, Bordetella pertussis
cgcuaccaggcgcgcgc

SEQ ID NO: 371894 - RNA, 23 nt, Bordetella pertussis
cgcuacgccgccgauggcgcgcg

SEQ ID NO: 371895 - RNA, 18 nt, Bordetella pertussis
cgcuacgcggcgucagga

SEQ ID NO: 371896 - RNA, 16 nt, Bordetella pertussis
cgcuagggcguggcgc

SEQ ID NO: 371897 - RNA, 18 nt, Bordetella pertussis
cgcuagggcguggcgcga

SEQ ID NO: 371898 - RNA, 15 nt, Bordetella pertussis
cgcuaucauccgcgc

SEQ ID NO: 371899 - RNA, 22 nt, Bordetella pertussis
cgcuaugcagcugcgccagccc

SEQ ID NO: 371900 - RNA, 19 nt, Bordetella pertussis
cgcuaugggggcgagcggg

SEQ ID NO: 371901 - RNA, 21 nt, Bordetella pertussis
cgcuaugggggcgagcgggcc

SEQ ID NO: 371902 - RNA, 22 nt, Bordetella pertussis
cgcuaugggggcgagcgggccg

SEQ ID NO: 371903 - RNA, 23 nt, Bordetella pertussis
cgcuaugggggcgagcgggccgg

SEQ ID NO: 371904 - RNA, 20 nt, Bordetella pertussis
cgcucaacagcuugcccacg

SEQ ID NO: 371905 - RNA, 15 nt, Bordetella pertussis
cgcucaagggccugu

SEQ ID NO: 371906 - RNA, 16 nt, Bordetella pertussis
cgcucaauucggccug

SEQ ID NO: 371907 - RNA, 23 nt, Bordetella pertussis
cgcucaauucggccugacgggcc

SEQ ID NO: 371908 - RNA, 19 nt, Bordetella pertussis
cgcucacagggucaaggcg

SEQ ID NO: 371909 - RNA, 23 nt, Bordetella pertussis
cgcucacagggucaaggcgcggc

SEQ ID NO: 371910 - RNA, 14 nt, Bordetella pertussis
cgcucaccgagggc

SEQ ID NO: 371911 - RNA, 15 nt, Bordetella pertussis
cgcucaccgagggcc

SEQ ID NO: 371912 - RNA, 15 nt, Bordetella pertussis
cgcucagcaccaggc

SEQ ID NO: 371913 - RNA, 20 nt, Bordetella pertussis
cgcucagcaccaggccgccg

SEQ ID NO: 371914 - RNA, 21 nt, Bordetella pertussis
cgcucacggggcugucgcgcg

SEQ ID NO: 371915 - RNA, 14 nt, Bordetella pertussis
cgcucagccgugcc

SEQ ID NO: 371916 - RNA, 13 nt, Bordetella pertussis
cgcucagcgcgcc

SEQ ID NO: 371917 - RNA, 14 nt, Bordetella pertussis
cgcucagcgcgccg

SEQ ID NO: 371918 - RNA, 15 nt, Bordetella pertussis
cgcucagcgcgccga

SEQ ID NO: 371919 - RNA, 23 nt, Bordetella pertussis
cgcucagccuugucgcgggcagu

SEQ ID NO: 371920 - RNA, 13 nt, Bordetella pertussis
cgcucaggccgcc

SEQ ID NO: 371921 - RNA, 14 nt, Bordetella pertussis
cgcucaggccgccg

SEQ ID NO: 371922 - RNA, 16 nt, Bordetella pertussis
cgcucaggccgccggc

SEQ ID NO: 371923 - RNA, 18 nt, Bordetella pertussis
cgcucaggccgccggcgc

SEQ ID NO: 371924 - RNA, 18 nt, Bordetella pertussis
cgcucaggccgcugggca

SEQ ID NO: 371925 - RNA, 21 nt, Bordetella pertussis
cgcucaggccgcugggcacau

SEQ ID NO: 371926 - RNA, 22 nt, Bordetella pertussis
cgcucaggcggugacgcccugc

SEQ ID NO: 371927 - RNA, 16 nt, Bordetella pertussis
cgcucagggggcgccc

SEQ ID NO: 371928 - RNA, 23 nt, Bordetella pertussis
cgcucagguagaccacgcgcugc

SEQ ID NO: 371929 - RNA, 17 nt, Bordetella pertussis
cgcucgcccucgcgcca

SEQ ID NO: 371930 - RNA, 22 nt, Bordetella pertussis
cgcucgcccucgcgccaccaug

SEQ ID NO: 371931 - RNA, 14 nt, Bordetella pertussis
cgcucgcgcaggcg

SEQ ID NO: 371932 - RNA, 14 nt, Bordetella pertussis
cgcucgcgccaggc

SEQ ID NO: 371933 - RNA, 16 nt, Bordetella pertussis
cgcucgcgccaggccc

SEQ ID NO: 371934 - RNA, 11 nt, Bordetella pertussis
cgcucgcgccc

SEQ ID NO: 371935 - RNA, 21 nt, Bordetella pertussis
cgcucgcgcccaucucggccg

SEQ ID NO: 371936 - RNA, 17 nt, Bordetella pertussis
cgcucgcgcucggccag

SEQ ID NO: 371937 - RNA, 18 nt, Bordetella pertussis
cgcucgcgcucggccagc

SEQ ID NO: 371938 - RNA, 15 nt, Bordetella pertussis
cgcucgcgggugcgc

SEQ ID NO: 371939 - RNA, 12 nt, Bordetella pertussis
cgcucgcugccg

SEQ ID NO: 371940 - RNA, 16 nt, Bordetella pertussis
cgcucgcugccggcgu

SEQ ID NO: 371941 - RNA, 19 nt, Bordetella pertussis
cgcucggagggcuccaggc

SEQ ID NO: 371942 - RNA, 15 nt, Bordetella pertussis
cgcucggccacgcgc

SEQ ID NO: 371943 - RNA, 21 nt, Bordetella pertussis
cgcucggccacgcgcugcugc

SEQ ID NO: 371944 - RNA, 16 nt, Bordetella pertussis
cgcucggccagcaugc

SEQ ID NO: 371945 - RNA, 17 nt, Bordetella pertussis
cgcucggccagcgcgcg

SEQ ID NO: 371946 - RNA, 18 nt, Bordetella pertussis
cgcucggcgccgggcugg

SEQ ID NO: 371947 - RNA, 21 nt, Bordetella pertussis
cgcucuacacggccgccaccu

SEQ ID NO: 371948 - RNA, 14 nt, Bordetella pertussis
cgcugaacgaaucg

SEQ ID NO: 371949 - RNA, 23 nt, Bordetella pertussis
cgcugaacguguaggucagcgcc

SEQ ID NO: 371950 - RNA, 20 nt, Bordetella pertussis
cgcugaaggaccucgcgccg

SEQ ID NO: 371951 - RNA, 14 nt, Bordetella pertussis
cgcugaagcgccgc

SEQ ID NO: 371952 - RNA, 16 nt, Bordetella pertussis
cgcugaagcgccgcca

SEQ ID NO: 371953 - RNA, 22 nt, Bordetella pertussis
cgcugaauccggggugccuguc

SEQ ID NO: 371954 - RNA, 15 nt, Bordetella pertussis
cgcugaccagcacga

SEQ ID NO: 371955 - RNA, 18 nt, Bordetella pertussis
cgcugaccagcacgaugg

SEQ ID NO: 371956 - RNA, 17 nt, Bordetella pertussis
cgcugacccuggccgaa

SEQ ID NO: 371957 - RNA, 23 nt, Bordetella pertussis
cgcugacccuggccgaacgccgc

SEQ ID NO: 371958 - RNA, 23 nt, Bordetella pertussis
cgcugacuuccggggagccugcc

SEQ ID NO: 371959 - RNA, 17 nt, Bordetella pertussis
cgcugaucucggccugc

SEQ ID NO: 371960 - RNA, 19 nt, Bordetella pertussis
cgcugaucucggccugccc

SEQ ID NO: 371961 - RNA, 18 nt, Bordetella pertussis
cgcugaugagaucgcccg

SEQ ID NO: 371962 - RNA, 23 nt, Bordetella pertussis
cgcugauucgcgucguugcgccg

SEQ ID NO: 371963 - RNA, 19 nt, Bordetella pertussis
cgcugcaauugcgcggcca

SEQ ID NO: 371964 - RNA, 18 nt, Bordetella pertussis
cgcugcacgcggccgcgc

SEQ ID NO: 371965 - RNA, 22 nt, Bordetella pertussis
cgcugcacgcggccgcgcagga

SEQ ID NO: 371966 - RNA, 16 nt, Bordetella pertussis
cgcugcagcaauccau

SEQ ID NO: 371967 - RNA, 17 nt, Bordetella pertussis
cgcugcagcaauccauc

SEQ ID NO: 371968 - RNA, 20 nt, Bordetella pertussis
cgcugcagcacgcaccaggc

SEQ ID NO: 371969 - RNA, 23 nt, Bordetella pertussis
cgcugcacggccuugucgcgccc

SEQ ID NO: 371970 - RNA, 15 nt, Bordetella pertussis
cgcugcagcgcagga

SEQ ID NO: 371971 - RNA, 19 nt, Bordetella pertussis
cgcugcagcgucugcuggu

SEQ ID NO: 371972 - RNA, 19 nt, Bordetella pertussis
cgcugcaggaucgcggcca

SEQ ID NO: 371973 - RNA, 13 nt, Bordetella pertussis
cgcugcaggcccu

SEQ ID NO: 371974 - RNA, 17 nt, Bordetella pertussis
cgcugcauacgccgcug

SEQ ID NO: 371975 - RNA, 18 nt, Bordetella pertussis
cgcugcauacgccgcuga

SEQ ID NO: 371976 - RNA, 16 nt, Bordetella pertussis
cgcugcaugggcggcc

SEQ ID NO: 371977 - RNA, 18 nt, Bordetella pertussis
cgcugcaugggcggcccg

SEQ ID NO: 371978 - RNA, 18 nt, Bordetella pertussis
cgcugccagccauguucg

SEQ ID NO: 371979 - RNA, 14 nt, Bordetella pertussis
cgcugccagggugc

SEQ ID NO: 371980 - RNA, 19 nt, Bordetella pertussis
cgcugccagggugcaccag

SEQ ID NO: 371981 - RNA, 20 nt, Bordetella pertussis
cgcugcccaccgccguggcc

SEQ ID NO: 371982 - RNA, 19 nt, Bordetella pertussis
cgcugcccaccuuccugcu

SEQ ID NO: 371983 - RNA, 13 nt, Bordetella pertussis
cgcugcccagcau

SEQ ID NO: 371984 - RNA, 14 nt, Bordetella pertussis
cgcugcccagcaug

SEQ ID NO: 371985 - RNA, 13 nt, Bordetella pertussis
cgcugcccagcca

SEQ ID NO: 371986 - RNA, 14 nt, Bordetella pertussis
cgcugccgcgcgcc

SEQ ID NO: 371987 - RNA, 16 nt, Bordetella pertussis
cgcugccgcgcgccgg

SEQ ID NO: 371988 - RNA, 21 nt, Bordetella pertussis
cgcugccgcgcgccggcgccg

SEQ ID NO: 371989 - RNA, 14 nt, Bordetella pertussis
cgcugccggccgac

SEQ ID NO: 371990 - RNA, 18 nt, Bordetella pertussis
cgcugccggccgaccggc

SEQ ID NO: 371991 - RNA, 22 nt, Bordetella pertussis
cgcugccggccgaccggcgcgc

SEQ ID NO: 371992 - RNA, 14 nt, Bordetella pertussis
cgcugccgcugcag

SEQ ID NO: 371993 - RNA, 16 nt, Bordetella pertussis
cgcugccgcugcaggc

SEQ ID NO: 371994 - RNA, 21 nt, Bordetella pertussis
cgcugccgggcucggccacca

SEQ ID NO: 371995 - RNA, 23 nt, Bordetella pertussis
cgcugccgggcucggccaccaug

SEQ ID NO: 371996 - RNA, 13 nt, Bordetella pertussis
cgcugcgcagcag

SEQ ID NO: 371997 - RNA, 16 nt, Bordetella pertussis
cgcugcgcagcagggc

SEQ ID NO: 371998 - RNA, 16 nt, Bordetella pertussis
cgcugcgcaggcgcgc

SEQ ID NO: 371999 - RNA, 14 nt, Bordetella pertussis
cgcugcgcacgcug

SEQ ID NO: 372000 - RNA, 20 nt, Bordetella pertussis
cgcugcgccgaggccugcug

SEQ ID NO: 372001 - RNA, 14 nt, Bordetella pertussis
cgcugcgccggcgg

SEQ ID NO: 372002 - RNA, 19 nt, Bordetella pertussis
cgcugcgccggcggcaccg

SEQ ID NO: 372003 - RNA, 16 nt, Bordetella pertussis
cgcuggcgcagcaggc

SEQ ID NO: 372004 - RNA, 19 nt, Bordetella pertussis
cgcuggcgcagcaggcgcg

SEQ ID NO: 372005 - RNA, 18 nt, Bordetella pertussis
cgcuggcgcccgccugcg

SEQ ID NO: 372006 - RNA, 19 nt, Bordetella pertussis
cgcuggcgcccggccugcg

SEQ ID NO: 372007 - RNA, 17 nt, Bordetella pertussis
cgcuggcgcgagaacca

SEQ ID NO: 372008 - RNA, 24 nt, Bordetella pertussis
cgcuggcgcgagaaccaggccacg

SEQ ID NO: 372009 - RNA, 14 nt, Bordetella pertussis
cgcuggcgcgccgc

SEQ ID NO: 372010 - RNA, 12 nt, Bordetella pertussis
cgcuggcgcgcg

SEQ ID NO: 372011 - RNA, 19 nt, Bordetella pertussis
cgcuggcgcgcgacggcgc

SEQ ID NO: 372012 - RNA, 16 nt, Bordetella pertussis
cgcuggcgcgcggccg

SEQ ID NO: 372013 - RNA, 18 nt, Bordetella pertussis
cgcuggcgcgcggccgcg

SEQ ID NO: 372014 - RNA, 16 nt, Bordetella pertussis
cgcuggcgcgcggcug

SEQ ID NO: 372015 - RNA, 12 nt, Bordetella pertussis
cgcuggcgcgcu

SEQ ID NO: 372016 - RNA, 20 nt, Bordetella pertussis
cgcuggcgcucgggcgcggc

SEQ ID NO: 372017 - RNA, 13 nt, Bordetella pertussis
cgcuggcgccgcg

SEQ ID NO: 372018 - RNA, 13 nt, Bordetella pertussis
cgcuggcgcuggc

SEQ ID NO: 372019 - RNA, 16 nt, Bordetella pertussis
cgcuggcgcuggccgc

SEQ ID NO: 372020 - RNA, 18 nt, Bordetella pertussis
cgcuggcgcuggccgccc

SEQ ID NO: 372021 - RNA, 22 nt, Bordetella pertussis
cgcuggcggaccgaacggccgg

SEQ ID NO: 372022 - RNA, 17 nt, Bordetella pertussis
cgcuggcggcccugccg

SEQ ID NO: 372023 - RNA, 14 nt, Bordetella pertussis
cgcuggcggccgcg

SEQ ID NO: 372024 - RNA, 22 nt, Bordetella pertussis
cgcuggcggccgcgggcgugcu

SEQ ID NO: 372025 - RNA, 23 nt, Bordetella pertussis
cgcuggcggcgcaggccgcgccg

SEQ ID NO: 372026 - RNA, 18 nt, Bordetella pertussis
cgcuggcgguggccgcgc

SEQ ID NO: 372027 - RNA, 19 nt, Bordetella pertussis
cgcuggcgguggccgcgca

SEQ ID NO: 372028 - RNA, 20 nt, Bordetella pertussis
cgcuggcgguggccgcgcau

SEQ ID NO: 372029 - RNA, 21 nt, Bordetella pertussis
cgcuggcgguggccgcgcaug

SEQ ID NO: 372030 - RNA, 14 nt, Bordetella pertussis
cgcuggcguccagc

SEQ ID NO: 372031 - RNA, 21 nt, Bordetella pertussis
cgcuggcguugacguggcuga

SEQ ID NO: 372032 - RNA, 14 nt, Bordetella pertussis
cgcuggcugggccu

SEQ ID NO: 372033 - RNA, 15 nt, Bordetella pertussis
cgcuggcugggccug

SEQ ID NO: 372034 - RNA, 18 nt, Bordetella pertussis
cgcuggcugggccugcug

SEQ ID NO: 372035 - RNA, 20 nt, Bordetella pertussis
cgcuggcugugcccgcccca

SEQ ID NO: 372036 - RNA, 17 nt, Bordetella pertussis
cgcuggcuucgucgccg

SEQ ID NO: 372037 - RNA, 22 nt, Bordetella pertussis
cgcuggggcaggacgccggcgc

SEQ ID NO: 372038 - RNA, 14 nt, Bordetella pertussis
cgcuggggcugccg

SEQ ID NO: 372039 - RNA, 22 nt, Bordetella pertussis
cgcugggucaggucgcugccca

SEQ ID NO: 372040 - RNA, 21 nt, Bordetella pertussis
cgcuggguguagucgcggccg

SEQ ID NO: 372041 - RNA, 14 nt, Bordetella pertussis
cgcuggucaccgcc

SEQ ID NO: 372042 - RNA, 13 nt, Bordetella pertussis
cgcugguccgccg

SEQ ID NO: 372043 - RNA, 16 nt, Bordetella pertussis
cgcugguccgccgccg

SEQ ID NO: 372044 - RNA, 18 nt, Bordetella pertussis
cgcuguccggcgcucgcc

SEQ ID NO: 372045 - RNA, 23 nt, Bordetella pertussis
cgcuguccggcgcucgccccggc

SEQ ID NO: 372046 - RNA, 16 nt, Bordetella pertussis
cgcugucgcaggcgcu

SEQ ID NO: 372047 - RNA, 15 nt, Bordetella pertussis
cgcugucgcgcccgg

SEQ ID NO: 372048 - RNA, 20 nt, Bordetella pertussis
cgcugucggggugccguucg

SEQ ID NO: 372049 - RNA, 16 nt, Bordetella pertussis
cgcugucgugccgcac

SEQ ID NO: 372050 - RNA, 23 nt, Bordetella pertussis
cgcugucggucagcacuugccgg

SEQ ID NO: 372051 - RNA, 22 nt, Bordetella pertussis
cgcugugcgcguuccggccgcg

SEQ ID NO: 372052 - RNA, 14 nt, Bordetella pertussis
cgcuguggacgccg

SEQ ID NO: 372053 - RNA, 19 nt, Bordetella pertussis
cgcuguggacgccgccggc

SEQ ID NO: 372054 - RNA, 14 nt, Bordetella pertussis
cgcuguggcgcgcc

SEQ ID NO: 372055 - RNA, 15 nt, Bordetella pertussis
cgcuguggcgcgcca

SEQ ID NO: 372056 - RNA, 14 nt, Bordetella pertussis
cgcuguucggggca

SEQ ID NO: 372057 - RNA, 20 nt, Bordetella pertussis
cgcuguucggggcagggcgc

SEQ ID NO: 372058 - RNA, 21 nt, Bordetella pertussis
cgcuguucggggcagggcgcc

SEQ ID NO: 372059 - RNA, 22 nt, Bordetella pertussis
cgcuguucuucggcaaccgcgc

SEQ ID NO: 372060 - RNA, 13 nt, Bordetella pertussis
cgcuguugaggau

SEQ ID NO: 372061 - RNA, 21 nt, Bordetella pertussis
cgcuguugcuccaggccggca

SEQ ID NO: 372062 - RNA, 23 nt, Bordetella pertussis
cgcuguugcuccaggccggcaug

SEQ ID NO: 372063 - RNA, 13 nt, Bordetella pertussis
cgcuguugcuggc

SEQ ID NO: 372064 - RNA, 13 nt, Bordetella pertussis
cgcuguuggccgu

SEQ ID NO: 372065 - RNA, 19 nt, Bordetella pertussis
cgcuguuggccggcgcgcc

SEQ ID NO: 372066 - RNA, 23 nt, Bordetella pertussis
cgcuguuggccggcgcgcccuug

SEQ ID NO: 372067 - RNA, 18 nt, Bordetella pertussis
cgcuguuuccgggccugg

SEQ ID NO: 372068 - RNA, 22 nt, Bordetella pertussis
cgcuguuuccgggccuggccug

SEQ ID NO: 372069 - RNA, 14 nt, Bordetella pertussis
cgcuuaccgcgccg

SEQ ID NO: 372070 - RNA, 22 nt, Bordetella pertussis
cgcuuacuggaucuuggccugu

SEQ ID NO: 372071 - RNA, 19 nt, Bordetella pertussis
cgcuuccgccaccgcgccg

SEQ ID NO: 372072 - RNA, 19 nt, Bordetella pertussis
cgcuuccggcaugaccgcg

SEQ ID NO: 372073 - RNA, 23 nt, Bordetella pertussis
cgcuuccggcaugaccgcggacg

SEQ ID NO: 372074 - RNA, 13 nt, Bordetella pertussis
cgcuuccggccgg

SEQ ID NO: 372075 - RNA, 15 nt, Bordetella pertussis
cgcuuccggccgggc

SEQ ID NO: 372076 - RNA, 15 nt, Bordetella pertussis
cgcuuccugcugcgc

SEQ ID NO: 372077 - RNA, 20 nt, Bordetella pertussis
cgcuuccugcugcgccuggc

SEQ ID NO: 372078 - RNA, 23 nt, Bordetella pertussis
cgcuucgagccgguacagccagg

SEQ ID NO: 372079 - RNA, 15 nt, Bordetella pertussis
cgcuucgaugcuggc

SEQ ID NO: 372080 - RNA, 12 nt, Bordetella pertussis
cgcuucggccug

SEQ ID NO: 372081 - RNA, 14 nt, Bordetella pertussis
cgcuucggccugcg

SEQ ID NO: 372082 - RNA, 14 nt, Bordetella pertussis
cgcuucggcggccg

SEQ ID NO: 372083 - RNA, 20 nt, Bordetella pertussis
cgcuucgggcagcucgcgcg

SEQ ID NO: 372084 - RNA, 15 nt, Bordetella pertussis
cgcuucgggccggau

SEQ ID NO: 372085 - RNA, 16 nt, Bordetella pertussis
cgcuucgucggcgucg

SEQ ID NO: 372086 - RNA, 17 nt, Bordetella pertussis
cgcuucgucgggcagcg

SEQ ID NO: 372087 - RNA, 18 nt, Bordetella pertussis
cgcuucgucgggcagcgc

SEQ ID NO: 372088 - RNA, 21 nt, Bordetella pertussis
cgcuucgucgggcagcgcggc

SEQ ID NO: 372089 - RNA, 22 nt, Bordetella pertussis
cgcuucgucgggcagcgcggcg

SEQ ID NO: 372090 - RNA, 13 nt, Bordetella pertussis
cgcuucgucggcc

SEQ ID NO: 372091 - RNA, 19 nt, Bordetella pertussis
cgcuucgucggccgccagc

SEQ ID NO: 372092 - RNA, 15 nt, Bordetella pertussis
cgcuucgugcggccg

SEQ ID NO: 372093 - RNA, 17 nt, Bordetella pertussis
cgcuucgugcggccgca

SEQ ID NO: 372094 - RNA, 23 nt, Bordetella pertussis
cgcuucguucagcuucuggauca

SEQ ID NO: 372095 - RNA, 21 nt, Bordetella pertussis
cgcuucucacugcccgcgccg

SEQ ID NO: 372096 - RNA, 19 nt, Bordetella pertussis
cgcuucugccagacggcca

SEQ ID NO: 372097 - RNA, 20 nt, Bordetella pertussis
cgcuucugccagacggccag

SEQ ID NO: 372098 - RNA, 16 nt, Bordetella pertussis
cgcuucgugcagcgcg

SEQ ID NO: 372099 - RNA, 17 nt, Bordetella pertussis
cgcuucuucgucgcgcc

SEQ ID NO: 372100 - RNA, 23 nt, Bordetella pertussis
cgcuugaaaugcguggcgugccg

SEQ ID NO: 372101 - RNA, 18 nt, Bordetella pertussis
cgcuugaacuccgcggcg

SEQ ID NO: 372102 - RNA, 18 nt, Bordetella pertussis
cgcuugaggcuggugacc

SEQ ID NO: 372103 - RNA, 21 nt, Bordetella pertussis
cgcuugccgaccuccaggccc

SEQ ID NO: 372104 - RNA, 19 nt, Bordetella pertussis
cgcuugccgcaaccgucga

SEQ ID NO: 372105 - RNA, 13 nt, Bordetella pertussis
cgcuugccgccca

SEQ ID NO: 372106 - RNA, 20 nt, Bordetella pertussis
cgcuugcccgugccuugccg

SEQ ID NO: 372107 - RNA, 15 nt, Bordetella pertussis
cgcuuggaccccgug

SEQ ID NO: 372108 - RNA, 22 nt, Bordetella pertussis
cgcuuggaccccguggucgcca

SEQ ID NO: 372109 - RNA, 15 nt, Bordetella pertussis
cgcuuggccagcugg

SEQ ID NO: 372110 - RNA, 23 nt, Bordetella pertussis
cgcuuggcccugcagcggccagu

SEQ ID NO: 372111 - RNA, 13 nt, Bordetella pertussis
cgcuuggccugcg

SEQ ID NO: 372112 - RNA, 20 nt, Bordetella pertussis
cgcuugggccgcgccugcag

SEQ ID NO: 372113 - RNA, 20 nt, Bordetella pertussis
cgcuugucgaugacgcgccg

SEQ ID NO: 372114 - RNA, 15 nt, Bordetella pertussis
cgcuugucgccgcug

SEQ ID NO: 372115 - RNA, 15 nt, Bordetella pertussis
cgcuugugcgucggc

SEQ ID NO: 372116 - RNA, 18 nt, Bordetella pertussis
cgcuugugcgucggcucg

SEQ ID NO: 372117 - RNA, 16 nt, Bordetella pertussis
cgcuuucgaccagcga

SEQ ID NO: 372118 - RNA, 19 nt, Bordetella pertussis
cgcuuucggggcgcaagau

SEQ ID NO: 372119 - RNA, 20 nt, Bordetella pertussis
cgcuuucggggcgcaagauc

SEQ ID NO: 372120 - RNA, 15 nt, Bordetella pertussis
cgcuuugaacgauuc

SEQ ID NO: 372121 - RNA, 17 nt, Bordetella pertussis
cggaaacacguccagcg

SEQ ID NO: 372122 - RNA, 14 nt, Bordetella pertussis
cggaaacgcccagc

SEQ ID NO: 372123 - RNA, 17 nt, Bordetella pertussis
cggaaagcuggcguucg

SEQ ID NO: 372124 - RNA, 23 nt, Bordetella pertussis
cggaaagcuggcguucgucgccu

SEQ ID NO: 372125 - RNA, 15 nt, Bordetella pertussis
cggaaauccgggcgc

SEQ ID NO: 372126 - RNA, 20 nt, Bordetella pertussis
cggaaauccgggcgcugcgc

SEQ ID NO: 372127 - RNA, 18 nt, Bordetella pertussis
cggaacagccuggucagg

SEQ ID NO: 372128 - RNA, 15 nt, Bordetella pertussis
cggaacgugccgucg

SEQ ID NO: 372129 - RNA, 16 nt, Bordetella pertussis
cggaacgugccgucgg

SEQ ID NO: 372130 - RNA, 21 nt, Bordetella pertussis
cggaacgugccgucgggcgcc

SEQ ID NO: 372131 - RNA, 18 nt, Bordetella pertussis
cggaagagggcggggcgu

SEQ ID NO: 372132 - RNA, 19 nt, Bordetella pertussis
cggaaguauucgcgcggcg

SEQ ID NO: 372133 - RNA, 19 nt, Bordetella pertussis
cggaauaccgccagcucgg

SEQ ID NO: 372134 - RNA, 16 nt, Bordetella pertussis
cggaauagauaugggc

SEQ ID NO: 372135 - RNA, 21 nt, Bordetella pertussis
cggaauccacagcuggugccg

SEQ ID NO: 372136 - RNA, 13 nt, Bordetella pertussis
cggaauccuggcg

SEQ ID NO: 372137 - RNA, 17 nt, Bordetella pertussis
cggaauccuggcgacgg

SEQ ID NO: 372138 - RNA, 23 nt, Bordetella pertussis
cggaauccuggcgacggccugcc

SEQ ID NO: 372139 - RNA, 19 nt, Bordetella pertussis
cggaguaguugucgucgcg

SEQ ID NO: 372140 - RNA, 13 nt, Bordetella pertussis
cggagucgccccg

SEQ ID NO: 372141 - RNA, 18 nt, Bordetella pertussis
cggagucgccccgacgcg

SEQ ID NO: 372142 - RNA, 16 nt, Bordetella pertussis
cggagucggcgccgcg

SEQ ID NO: 372143 - RNA, 18 nt, Bordetella pertussis
cggauacgaaaccaggcc

SEQ ID NO: 372144 - RNA, 19 nt, Bordetella pertussis
cggauacgaaaccaggccg

SEQ ID NO: 372145 - RNA, 21 nt, Bordetella pertussis
cggauacgaaaccaggccggg

SEQ ID NO: 372146 - RNA, 19 nt, Bordetella pertussis
cggauagcggugcaggggc

SEQ ID NO: 372147 - RNA, 17 nt, Bordetella pertussis
cggaucaugggccugcc

SEQ ID NO: 372148 - RNA, 20 nt, Bordetella pertussis
cggaucauccgggcccgguu

SEQ ID NO: 372149 - RNA, 15 nt, Bordetella pertussis
cggauccagccaugg

SEQ ID NO: 372150 - RNA, 16 nt, Bordetella pertussis
cggauccagcgaggca

SEQ ID NO: 372151 - RNA, 13 nt, Bordetella pertussis
cggaucccaggcc

SEQ ID NO: 372152 - RNA, 16 nt, Bordetella pertussis
cggaucccaggccggc

SEQ ID NO: 372153 - RNA, 19 nt, Bordetella pertussis
cggaucccaggccggcucg

SEQ ID NO: 372154 - RNA, 12 nt, Bordetella pertussis
cggaucgcggcg

SEQ ID NO: 372155 - RNA, 12 nt, Bordetella pertussis
cggaucggccgg

SEQ ID NO: 372156 - RNA, 16 nt, Bordetella pertussis
cggaugaacgaccagc

SEQ ID NO: 372157 - RNA, 15 nt, Bordetella pertussis
cggaugaagggcugg

SEQ ID NO: 372158 - RNA, 19 nt, Bordetella pertussis
cggaugaagggcuggccgg

SEQ ID NO: 372159 - RNA, 22 nt, Bordetella pertussis
cggaugaagggcuggccggcca

SEQ ID NO: 372160 - RNA, 16 nt, Bordetella pertussis
cggaugaccugcgcca

SEQ ID NO: 372161 - RNA, 16 nt, Bordetella pertussis
cggaugagcaggccgg

SEQ ID NO: 372162 - RNA, 17 nt, Bordetella pertussis
cggaugaugcggcgcca

SEQ ID NO: 372163 - RNA, 19 nt, Bordetella pertussis
cggaugaugcggcgccacg

SEQ ID NO: 372164 - RNA, 16 nt, Bordetella pertussis
cggaugccgcccgugc

SEQ ID NO: 372165 - RNA, 13 nt, Bordetella pertussis
cggaugggcgccg

SEQ ID NO: 372166 - RNA, 14 nt, Bordetella pertussis
cggaugggcgccgu

SEQ ID NO: 372167 - RNA, 16 nt, Bordetella pertussis
cggauggucgagcgcc

SEQ ID NO: 372168 - RNA, 17 nt, Bordetella pertussis
cggauggucgugcggca

SEQ ID NO: 372169 - RNA, 19 nt, Bordetella pertussis
cggauggucgugcggcacg

SEQ ID NO: 372170 - RNA, 15 nt, Bordetella pertussis
cggauguccggcgcg

SEQ ID NO: 372171 - RNA, 22 nt, Bordetella pertussis
cggauguccggcgcgaacggcu

SEQ ID NO: 372172 - RNA, 21 nt, Bordetella pertussis
cggauguggggguuguggcgg

SEQ ID NO: 372173 - RNA, 14 nt, Bordetella pertussis
cggauucaggcgau

SEQ ID NO: 372174 - RNA, 16 nt, Bordetella pertussis
cggauugaccagcgcg

SEQ ID NO: 372175 - RNA, 23 nt, Bordetella pertussis
cggauugaccagcgcggccguca

SEQ ID NO: 372176 - RNA, 13 nt, Bordetella pertussis
cggauuggcgcug

SEQ ID NO: 372177 - RNA, 15 nt, Bordetella pertussis
cggauuggcgcugca

SEQ ID NO: 372178 - RNA, 23 nt, Bordetella pertussis
cggcaaaaaaaaccgcgcgccgg

SEQ ID NO: 372179 - RNA, 15 nt, Bordetella pertussis
cggcaaaacggugcc

SEQ ID NO: 372180 - RNA, 14 nt, Bordetella pertussis
cggcaaacccggcg

SEQ ID NO: 372181 - RNA, 22 nt, Bordetella pertussis
cggcaaagccgcugcgcuggcc

SEQ ID NO: 372182 - RNA, 17 nt, Bordetella pertussis
cggcaacaucuccacca

SEQ ID NO: 372183 - RNA, 21 nt, Bordetella pertussis
cggcaacccgcccacgcggcg

SEQ ID NO: 372184 - RNA, 20 nt, Bordetella pertussis
cggcaaccgucgccagcgcg

SEQ ID NO: 372185 - RNA, 16 nt, Bordetella pertussis
cggcaaccugcacgcg

SEQ ID NO: 372186 - RNA, 18 nt, Bordetella pertussis
cggcaaccugcacgcggg

SEQ ID NO: 372187 - RNA, 15 nt, Bordetella pertussis
cggcaaccgcgccuc

SEQ ID NO: 372188 - RNA, 20 nt, Bordetella pertussis
cggcaacgccggccauggcg

SEQ ID NO: 372189 - RNA, 15 nt, Bordetella pertussis
cggcaacgugcaggc

SEQ ID NO: 372190 - RNA, 18 nt, Bordetella pertussis
cggcaacgugcaggccaa

SEQ ID NO: 372191 - RNA, 14 nt, Bordetella pertussis
cggcacaaccuggc

SEQ ID NO: 372192 - RNA, 17 nt, Bordetella pertussis
cggcacaaccuggcgcg

SEQ ID NO: 372193 - RNA, 17 nt, Bordetella pertussis
cggcacaccccgggcgg

SEQ ID NO: 372194 - RNA, 15 nt, Bordetella pertussis
cggcaccacgaccgg

SEQ ID NO: 372195 - RNA, 20 nt, Bordetella pertussis
cggcacccgcuaccccggca

SEQ ID NO: 372196 - RNA, 20 nt, Bordetella pertussis
cggcaccgaggccgaguggc

SEQ ID NO: 372197 - RNA, 15 nt, Bordetella pertussis
cggcaccguccagca

SEQ ID NO: 372198 - RNA, 15 nt, Bordetella pertussis
cggcaccucggccgg

SEQ ID NO: 372199 - RNA, 18 nt, Bordetella pertussis
cggcaccucggccggggc

SEQ ID NO: 372200 - RNA, 15 nt, Bordetella pertussis
cggcaccucggcgcc

SEQ ID NO: 372201 - RNA, 17 nt, Bordetella pertussis
cggcaccugcugcuuga

SEQ ID NO: 372202 - RNA, 14 nt, Bordetella pertussis
cggcacgccggcgg

SEQ ID NO: 372203 - RNA, 13 nt, Bordetella pertussis
cggcacgccugcc

SEQ ID NO: 372204 - RNA, 13 nt, Bordetella pertussis
cggcacgcgccag

SEQ ID NO: 372205 - RNA, 17 nt, Bordetella pertussis
cggcacgcgccaggcgu

SEQ ID NO: 372206 - RNA, 12 nt, Bordetella pertussis
cggcacgcgcgc

SEQ ID NO: 372207 - RNA, 15 nt, Bordetella pertussis
cggcacgcgcgccgg

SEQ ID NO: 372208 - RNA, 19 nt, Bordetella pertussis
cggcacgcgcgccggcagg

SEQ ID NO: 372209 - RNA, 13 nt, Bordetella pertussis
cggcacgcugacc

SEQ ID NO: 372210 - RNA, 18 nt, Bordetella pertussis
cggcacgcugcgcaggcg

SEQ ID NO: 372211 - RNA, 21 nt, Bordetella pertussis
cggcacgcugcgcaggcgcgc

SEQ ID NO: 372212 - RNA, 22 nt, Bordetella pertussis
cggcacgcugaucgccggcgcc

SEQ ID NO: 372213 - RNA, 17 nt, Bordetella pertussis
cggcacggagggugcgc

SEQ ID NO: 372214 - RNA, 15 nt, Bordetella pertussis
cggcagaaggcgaca

SEQ ID NO: 372215 - RNA, 18 nt, Bordetella pertussis
cggcagaaggcgacaucg

SEQ ID NO: 372216 - RNA, 17 nt, Bordetella pertussis
cggcagaucggcgcugg

SEQ ID NO: 372217 - RNA, 19 nt, Bordetella pertussis
cggcagaucggcgcuggcc

SEQ ID NO: 372218 - RNA, 21 nt, Bordetella pertussis
cggcagaucggcgcuggccug

SEQ ID NO: 372219 - RNA, 22 nt, Bordetella pertussis
cggcagaucggcgcuggccugg

SEQ ID NO: 372220 - RNA, 18 nt, Bordetella pertussis
cggcagaugaucuacgcg

SEQ ID NO: 372221 - RNA, 22 nt, Bordetella pertussis
cggcagaugaucuacgcgcgcg

SEQ ID NO: 372222 - RNA, 21 nt, Bordetella pertussis
cggcagauggugcuccgacgg

SEQ ID NO: 372223 - RNA, 20 nt, Bordetella pertussis
cggcagcaagcugucggacg

SEQ ID NO: 372224 - RNA, 18 nt, Bordetella pertussis
cggcagcauggcgcgcgg

SEQ ID NO: 372225 - RNA, 18 nt, Bordetella pertussis
cggcagccccagcgccca

SEQ ID NO: 372226 - RNA, 20 nt, Bordetella pertussis
cggcagccccagcgcccagg

SEQ ID NO: 372227 - RNA, 15 nt, Bordetella pertussis
cggcagcccggcacg

SEQ ID NO: 372228 - RNA, 21 nt, Bordetella pertussis
cggcagcgcaaaacgcaugac

SEQ ID NO: 372229 - RNA, 19 nt, Bordetella pertussis
cggcagcgcaccgucgcca

SEQ ID NO: 372230 - RNA, 21 nt, Bordetella pertussis
cggcagcgcaccgucgccagg

SEQ ID NO: 372231 - RNA, 13 nt, Bordetella pertussis
cggcagcgccgca

SEQ ID NO: 372232 - RNA, 19 nt, Bordetella pertussis
cggcagcgccgggucaucg

SEQ ID NO: 372233 - RNA, 17 nt, Bordetella pertussis
cggcagcgcgaacggcg

SEQ ID NO: 372234 - RNA, 14 nt, Bordetella pertussis
cggcagcgcgcgcg

SEQ ID NO: 372235 - RNA, 19 nt, Bordetella pertussis
cggcaggagccuguccccg

SEQ ID NO: 372236 - RNA, 21 nt, Bordetella pertussis
cggcaggagccuguccccgcg

SEQ ID NO: 372237 - RNA, 17 nt, Bordetella pertussis
cggcaggcacacgaccg

SEQ ID NO: 372238 - RNA, 20 nt, Bordetella pertussis
cggcaggcacacgaccggcu

SEQ ID NO: 372239 - RNA, 12 nt, Bordetella pertussis
cggcaggcccag

SEQ ID NO: 372240 - RNA, 14 nt, Bordetella pertussis
cggcaggccccggc

SEQ ID NO: 372241 - RNA, 17 nt, Bordetella pertussis
cggcaggccgcagcggg

SEQ ID NO: 372242 - RNA, 19 nt, Bordetella pertussis
cggcaggccgcagcgggcc

SEQ ID NO: 372243 - RNA, 21 nt, Bordetella pertussis
cggcaggccgcagcgggcccg

SEQ ID NO: 372244 - RNA, 13 nt, Bordetella pertussis
cggcaggccgcgc

SEQ ID NO: 372245 - RNA, 16 nt, Bordetella pertussis
cggcaggccgcgcugc

SEQ ID NO: 372246 - RNA, 20 nt, Bordetella pertussis
cggcaggccggccagcaagg

SEQ ID NO: 372247 - RNA, 15 nt, Bordetella pertussis
cggcaggccggcgcg

SEQ ID NO: 372248 - RNA, 17 nt, Bordetella pertussis
cggcaggcgccggcugg

SEQ ID NO: 372249 - RNA, 16 nt, Bordetella pertussis
cggcaggcgcgccagc

SEQ ID NO: 372250 - RNA, 14 nt, Bordetella pertussis
cggcaggcggugcg

SEQ ID NO: 372251 - RNA, 22 nt, Bordetella pertussis
cggcaggcggugcggaggcggc

SEQ ID NO: 372252 - RNA, 15 nt, Bordetella pertussis
cggcaggcgccgccg

SEQ ID NO: 372253 - RNA, 20 nt, Bordetella pertussis
cggcaggcgccgccgcccgg

SEQ ID NO: 372254 - RNA, 14 nt, Bordetella pertussis
cggcaggcuggccg

SEQ ID NO: 372255 - RNA, 19 nt, Bordetella pertussis
cggcaggcuggccggcgug

SEQ ID NO: 372256 - RNA, 16 nt, Bordetella pertussis
cggcagggccagcgcc

SEQ ID NO: 372257 - RNA, 20 nt, Bordetella pertussis
cggcagggccagcgccagca

SEQ ID NO: 372258 - RNA, 22 nt, Bordetella pertussis
cggcagggccagcgccagcacg

SEQ ID NO: 372259 - RNA, 23 nt, Bordetella pertussis
cggcagggccagcgccagcacga

SEQ ID NO: 372260 - RNA, 13 nt, Bordetella pertussis
cggcagggccagc

SEQ ID NO: 372261 - RNA, 20 nt, Bordetella pertussis
cggcaucgcgcugacagcgc

SEQ ID NO: 372262 - RNA, 18 nt, Bordetella pertussis
cggcaucggccacgcugc

SEQ ID NO: 372263 - RNA, 19 nt, Bordetella pertussis
cggcaucggccauggcggu

SEQ ID NO: 372264 - RNA, 13 nt, Bordetella pertussis
cggcaucggcgcc

SEQ ID NO: 372265 - RNA, 17 nt, Bordetella pertussis
cggcaucggcgccgcgc

SEQ ID NO: 372266 - RNA, 14 nt, Bordetella pertussis
cggcaucggcggcu

SEQ ID NO: 372267 - RNA, 22 nt, Bordetella pertussis
cggcaucggcggcuugcggucc

SEQ ID NO: 372268 - RNA, 16 nt, Bordetella pertussis
cggcaucguucaggcg

SEQ ID NO: 372269 - RNA, 18 nt, Bordetella pertussis
cggcaucguucaggcgca

SEQ ID NO: 372270 - RNA, 17 nt, Bordetella pertussis
cggcaucuguccgcgcc

SEQ ID NO: 372271 - RNA, 19 nt, Bordetella pertussis
cggcaucuguccgcgccgg

SEQ ID NO: 372272 - RNA, 22 nt, Bordetella pertussis
cggcaucuguccgcgccgggaa

SEQ ID NO: 372273 - RNA, 18 nt, Bordetella pertussis
cggcaucuugccuuggcg

SEQ ID NO: 372274 - RNA, 17 nt, Bordetella pertussis
cggcaugaccgcggacg

SEQ ID NO: 372275 - RNA, 23 nt, Bordetella pertussis
cggcaugaccgcggacgccaugg

SEQ ID NO: 372276 - RNA, 16 nt, Bordetella pertussis
cggcaugauggcccgg

SEQ ID NO: 372277 - RNA, 16 nt, Bordetella pertussis
cggcauggcgcgcgcg

SEQ ID NO: 372278 - RNA, 17 nt, Bordetella pertussis
cggcauggcggccagcu

SEQ ID NO: 372279 - RNA, 16 nt, Bordetella pertussis
cggcaugggcgugccg

SEQ ID NO: 372280 - RNA, 18 nt, Bordetella pertussis
cggcaugggcgugccgcg

SEQ ID NO: 372281 - RNA, 19 nt, Bordetella pertussis
cggcaugggcgugccgcgc

SEQ ID NO: 372282 - RNA, 20 nt, Bordetella pertussis
cggcauggguaaagcgccgg

SEQ ID NO: 372283 - RNA, 23 nt, Bordetella pertussis
cggcauggguaaagcgccggccc

SEQ ID NO: 372284 - RNA, 19 nt, Bordetella pertussis
cggcaugguagcgguccag

SEQ ID NO: 372285 - RNA, 16 nt, Bordetella pertussis
cggcauggugugccug

SEQ ID NO: 372286 - RNA, 14 nt, Bordetella pertussis
cggcauggucgaug

SEQ ID NO: 372287 - RNA, 14 nt, Bordetella pertussis
cggcauggucggca

SEQ ID NO: 372288 - RNA, 20 nt, Bordetella pertussis
cggcauguaggccucgggcc

SEQ ID NO: 372289 - RNA, 18 nt, Bordetella pertussis
cggcaugucccgaggcgc

SEQ ID NO: 372290 - RNA, 13 nt, Bordetella pertussis
cggcaugucgaug

SEQ ID NO: 372291 - RNA, 15 nt, Bordetella pertussis
cggcaugucgaugcc

SEQ ID NO: 372292 - RNA, 17 nt, Bordetella pertussis
cggcauguugccgcugg

SEQ ID NO: 372293 - RNA, 14 nt, Bordetella pertussis
cggccaaggccggc

SEQ ID NO: 372294 - RNA, 16 nt, Bordetella pertussis
cggccaaggccggcgc

SEQ ID NO: 372295 - RNA, 18 nt, Bordetella pertussis
cggccaaggccggcgcgu

SEQ ID NO: 372296 - RNA, 20 nt, Bordetella pertussis
cggccaaggccggcgcgucg

SEQ ID NO: 372297 - RNA, 16 nt, Bordetella pertussis
cggccaauggccggug

SEQ ID NO: 372298 - RNA, 18 nt, Bordetella pertussis
cggccaccaccaggccca

SEQ ID NO: 372299 - RNA, 19 nt, Bordetella pertussis
cggccaccaccaggcccag

SEQ ID NO: 372300 - RNA, 16 nt, Bordetella pertussis
cggccaccacgauggc

SEQ ID NO: 372301 - RNA, 20 nt, Bordetella pertussis
cggccaccacgauggcgcaa

SEQ ID NO: 372302 - RNA, 15 nt, Bordetella pertussis
cggccaccgcguuga

SEQ ID NO: 372303 - RNA, 19 nt, Bordetella pertussis
cggccaccgcguugagcgc

SEQ ID NO: 372304 - RNA, 21 nt, Bordetella pertussis
cggccaccgcguugagcgccg

SEQ ID NO: 372305 - RNA, 22 nt, Bordetella pertussis
cggccaccgcguugagcgccga

SEQ ID NO: 372306 - RNA, 20 nt, Bordetella pertussis
cggccacgcgcugcagcagc

SEQ ID NO: 372307 - RNA, 17 nt, Bordetella pertussis
cggccacgcugcccugc

SEQ ID NO: 372308 - RNA, 13 nt, Bordetella pertussis
cggccacggccgg

SEQ ID NO: 372309 - RNA, 15 nt, Bordetella pertussis
cggccacggccggca

SEQ ID NO: 372310 - RNA, 14 nt, Bordetella pertussis
cggccacggccggg

SEQ ID NO: 372311 - RNA, 15 nt, Bordetella pertussis
cggccacggccgggc

SEQ ID NO: 372312 - RNA, 14 nt, Bordetella pertussis
cggccacggccugc

SEQ ID NO: 372313 - RNA, 15 nt, Bordetella pertussis
cggccaccgccgugu

SEQ ID NO: 372314 - RNA, 18 nt, Bordetella pertussis
cggccacgcgccgcccgg

SEQ ID NO: 372315 - RNA, 13 nt, Bordetella pertussis
cggccacggcugg

SEQ ID NO: 372316 - RNA, 14 nt, Bordetella pertussis
cggccacggcugga

SEQ ID NO: 372317 - RNA, 12 nt, Bordetella pertussis
cggccacgucgg

SEQ ID NO: 372318 - RNA, 16 nt, Bordetella pertussis
cggccacgucggcggc

SEQ ID NO: 372319 - RNA, 18 nt, Bordetella pertussis
cggccacgucggcggccg

SEQ ID NO: 372320 - RNA, 20 nt, Bordetella pertussis
cggccacgucggcggccgcc

SEQ ID NO: 372321 - RNA, 17 nt, Bordetella pertussis
cggccacgucggucgcu

SEQ ID NO: 372322 - RNA, 18 nt, Bordetella pertussis
cggccacguguggcaggc

SEQ ID NO: 372323 - RNA, 20 nt, Bordetella pertussis
cggccacguguggcaggcca

SEQ ID NO: 372324 - RNA, 24 nt, Bordetella pertussis
cggccacguguggcaggccagcgc

SEQ ID NO: 372325 - RNA, 14 nt, Bordetella pertussis
cggccacuucgcgg

SEQ ID NO: 372326 - RNA, 16 nt, Bordetella pertussis
cggccacuuucgcgcg

SEQ ID NO: 372327 - RNA, 20 nt, Bordetella pertussis
cggccagaccuugcgcgacg

SEQ ID NO: 372328 - RNA, 22 nt, Bordetella pertussis
cggccagaccuugcgcgacggc

SEQ ID NO: 372329 - RNA, 19 nt, Bordetella pertussis
cggccagaucggacgggcc

SEQ ID NO: 372330 - RNA, 21 nt, Bordetella pertussis
cggccagaucggacgggccga

SEQ ID NO: 372331 - RNA, 17 nt, Bordetella pertussis
cggccagcaagcgcgcc

SEQ ID NO: 372332 - RNA, 18 nt, Bordetella pertussis
cggccagcaagcgcgcca

SEQ ID NO: 372333 - RNA, 15 nt, Bordetella pertussis
cggccagcaccaugg

SEQ ID NO: 372334 - RNA, 16 nt, Bordetella pertussis
cggccagcacgccggc

SEQ ID NO: 372335 - RNA, 19 nt, Bordetella pertussis
cggccagcacgccggcggg

SEQ ID NO: 372336 - RNA, 14 nt, Bordetella pertussis
cggccagcaccggc

SEQ ID NO: 372337 - RNA, 17 nt, Bordetella pertussis
cggccagcaccggcccg

SEQ ID NO: 372338 - RNA, 22 nt, Bordetella pertussis
cggccagcacgucauccugggc

SEQ ID NO: 372339 - RNA, 15 nt, Bordetella pertussis
cggccagcagcacga

SEQ ID NO: 372340 - RNA, 22 nt, Bordetella pertussis
cggccagcagcacgaucgcggc

SEQ ID NO: 372341 - RNA, 23 nt, Bordetella pertussis
cggccagcagcacgaucgcggcg

SEQ ID NO: 372342 - RNA, 15 nt, Bordetella pertussis
cggccagcagcgacg

SEQ ID NO: 372343 - RNA, 17 nt, Bordetella pertussis
cggccagcagcgacggc

SEQ ID NO: 372344 - RNA, 19 nt, Bordetella pertussis
cggccagcagcgacggccc

SEQ ID NO: 372345 - RNA, 13 nt, Bordetella pertussis
cggccagcagcgc

SEQ ID NO: 372346 - RNA, 14 nt, Bordetella pertussis
cggccagcagcgcc

SEQ ID NO: 372347 - RNA, 21 nt, Bordetella pertussis
cggccagcagcgcgugcagcc

SEQ ID NO: 372348 - RNA, 21 nt, Bordetella pertussis
cggccagcagcggcaggucgg

SEQ ID NO: 372349 - RNA, 13 nt, Bordetella pertussis
cggccagcagcuu

SEQ ID NO: 372350 - RNA, 15 nt, Bordetella pertussis
cggccagcagcuuga

SEQ ID NO: 372351 - RNA, 22 nt, Bordetella pertussis
cggccagcaucguaucgggcgu

SEQ ID NO: 372352 - RNA, 18 nt, Bordetella pertussis
cggccagccacgccggcg

SEQ ID NO: 372353 - RNA, 19 nt, Bordetella pertussis
cggccagccacgccggcgc

SEQ ID NO: 372354 - RNA, 23 nt, Bordetella pertussis
cggccagccacgccggcgcgccg

SEQ ID NO: 372355 - RNA, 19 nt, Bordetella pertussis
cggccagccauugccgcac

SEQ ID NO: 372356 - RNA, 12 nt, Bordetella pertussis
cggccagccacg

SEQ ID NO: 372357 - RNA, 15 nt, Bordetella pertussis
cggccagccggccga

SEQ ID NO: 372358 - RNA, 12 nt, Bordetella pertussis
cggccagccggg

SEQ ID NO: 372359 - RNA, 15 nt, Bordetella pertussis
cggccagccgggugg

SEQ ID NO: 372360 - RNA, 13 nt, Bordetella pertussis
cggccagccugcc

SEQ ID NO: 372361 - RNA, 14 nt, Bordetella pertussis
cggccagccugccc

SEQ ID NO: 372362 - RNA, 20 nt, Bordetella pertussis
cggccagccugccgcggccg

SEQ ID NO: 372363 - RNA, 14 nt, Bordetella pertussis
cggccagcgaggcc

SEQ ID NO: 372364 - RNA, 16 nt, Bordetella pertussis
cggccagcgaggccgc

SEQ ID NO: 372365 - RNA, 14 nt, Bordetella pertussis
cggccagccggcgc

SEQ ID NO: 372366 - RNA, 15 nt, Bordetella pertussis
cggccagccggcgcg

SEQ ID NO: 372367 - RNA, 12 nt, Bordetella pertussis
cggccagcgcca

SEQ ID NO: 372368 - RNA, 19 nt, Bordetella pertussis
cggccagcgccaccaccgg

SEQ ID NO: 372369 - RNA, 14 nt, Bordetella pertussis
cggccagcgccagc

SEQ ID NO: 372370 - RNA, 17 nt, Bordetella pertussis
cggccagcgccaguccg

SEQ ID NO: 372371 - RNA, 12 nt, Bordetella pertussis
cggccagcgccg

SEQ ID NO: 372372 - RNA, 20 nt, Bordetella pertussis
cggccagcgccgcgaacugg

SEQ ID NO: 372373 - RNA, 16 nt, Bordetella pertussis
cggccagcgccgcgcc

SEQ ID NO: 372374 - RNA, 17 nt, Bordetella pertussis
cggccagcgccgcgccg

SEQ ID NO: 372375 - RNA, 18 nt, Bordetella pertussis
cggccagcgccgcgccgg

SEQ ID NO: 372376 - RNA, 17 nt, Bordetella pertussis
cggccagcgccggcgcg

SEQ ID NO: 372377 - RNA, 23 nt, Bordetella pertussis
cggccagcgcgaaguaccagcgc

SEQ ID NO: 372378 - RNA, 14 nt, Bordetella pertussis
cggccagcgcgacg

SEQ ID NO: 372379 - RNA, 13 nt, Bordetella pertussis
cggccagcgcgca

SEQ ID NO: 372380 - RNA, 14 nt, Bordetella pertussis
cggccagcgcgccg

SEQ ID NO: 372381 - RNA, 19 nt, Bordetella pertussis
cggccagcgcgcggccggc

SEQ ID NO: 372382 - RNA, 21 nt, Bordetella pertussis
cggccagcgcgcggccggccg

SEQ ID NO: 372383 - RNA, 22 nt, Bordetella pertussis
cggccagcgcgcggccggccgc

SEQ ID NO: 372384 - RNA, 16 nt, Bordetella pertussis
cggccagcgcgcggcg

SEQ ID NO: 372385 - RNA, 21 nt, Bordetella pertussis
cggccagcgcgccggccaggg

SEQ ID NO: 372386 - RNA, 13 nt, Bordetella pertussis
cggccagcgcgcg

SEQ ID NO: 372387 - RNA, 15 nt, Bordetella pertussis
cggccagcgcgcgcc

SEQ ID NO: 372388 - RNA, 17 nt, Bordetella pertussis
cggccagcgcgcgccag

SEQ ID NO: 372389 - RNA, 21 nt, Bordetella pertussis
cggccagcgcggcggcagcgc

SEQ ID NO: 372390 - RNA, 15 nt, Bordetella pertussis
cggccagcgcgcggc

SEQ ID NO: 372391 - RNA, 15 nt, Bordetella pertussis
cggccagcgcggcgg

SEQ ID NO: 372392 - RNA, 14 nt, Bordetella pertussis
cggccagcgcgucg

SEQ ID NO: 372393 - RNA, 22 nt, Bordetella pertussis
cggccagcgcgucgagcagcgc

SEQ ID NO: 372394 - RNA, 22 nt, Bordetella pertussis
cggccagcggaugaugcggcgc

SEQ ID NO: 372395 - RNA, 15 nt, Bordetella pertussis
cggccagcggcaggg

SEQ ID NO: 372396 - RNA, 13 nt, Bordetella pertussis
cggccagcggcgc

SEQ ID NO: 372397 - RNA, 23 nt, Bordetella pertussis
cggccagcggcgcuuaccgcgcc

SEQ ID NO: 372398 - RNA, 16 nt, Bordetella pertussis
cggccagcgucagcgc

SEQ ID NO: 372399 - RNA, 21 nt, Bordetella pertussis
cggccagcgugccggugacga

SEQ ID NO: 372400 - RNA, 21 nt, Bordetella pertussis
cggccagcucggcggccgccu

SEQ ID NO: 372401 - RNA, 12 nt, Bordetella pertussis
cggccagcuuga

SEQ ID NO: 372402 - RNA, 17 nt, Bordetella pertussis
cggccagcuugccgcuc

SEQ ID NO: 372403 - RNA, 19 nt, Bordetella pertussis
cggccaggaaagccggcgu

SEQ ID NO: 372404 - RNA, 23 nt, Bordetella pertussis
cggccagcuuguagcggccaucg

SEQ ID NO: 372405 - RNA, 18 nt, Bordetella pertussis
cggccaggacgaucccgg

SEQ ID NO: 372406 - RNA, 13 nt, Bordetella pertussis
cggccaggacggc

SEQ ID NO: 372407 - RNA, 14 nt, Bordetella pertussis
cggccaggacggca

SEQ ID NO: 372408 - RNA, 15 nt, Bordetella pertussis
cggccaggacggcau

SEQ ID NO: 372409 - RNA, 15 nt, Bordetella pertussis
cggccaggacggugu

SEQ ID NO: 372410 - RNA, 17 nt, Bordetella pertussis
cggccaggacggugucg

SEQ ID NO: 372411 - RNA, 20 nt, Bordetella pertussis
cggccaggacggugucgcug

SEQ ID NO: 372412 - RNA, 18 nt, Bordetella pertussis
cggccaggaucgcggcca

SEQ ID NO: 372413 - RNA, 18 nt, Bordetella pertussis
cggccaggcaaucgauga

SEQ ID NO: 372414 - RNA, 15 nt, Bordetella pertussis
cggccaggcccaugc

SEQ ID NO: 372415 - RNA, 21 nt, Bordetella pertussis
cggccaggcccaugccgcccg

SEQ ID NO: 372416 - RNA, 17 nt, Bordetella pertussis
cggccaggcccugcgcg

SEQ ID NO: 372417 - RNA, 12 nt, Bordetella pertussis
cggccaggccga

SEQ ID NO: 372418 - RNA, 13 nt, Bordetella pertussis
cggccaggccggc

SEQ ID NO: 372419 - RNA, 14 nt, Bordetella pertussis
cggccaggccggcc

SEQ ID NO: 372420 - RNA, 15 nt, Bordetella pertussis
cggccaggccggccu

SEQ ID NO: 372421 - RNA, 23 nt, Bordetella pertussis
cggccaggccggcgcgccggccc

SEQ ID NO: 372422 - RNA, 15 nt, Bordetella pertussis
cggccaggccggggc

SEQ ID NO: 372423 - RNA, 23 nt, Bordetella pertussis
cggccaggccggggccguggucg

SEQ ID NO: 372424 - RNA, 13 nt, Bordetella pertussis
cggccaggccggu

SEQ ID NO: 372425 - RNA, 13 nt, Bordetella pertussis
cggccaggcgcca

SEQ ID NO: 372426 - RNA, 13 nt, Bordetella pertussis
cggccaggcgccg

SEQ ID NO: 372427 - RNA, 17 nt, Bordetella pertussis
cggccaggcgccgcuca

SEQ ID NO: 372428 - RNA, 23 nt, Bordetella pertussis
cggccaggcgccgcucagcgcgg

SEQ ID NO: 372429 - RNA, 13 nt, Bordetella pertussis
cggccaggcgcgc

SEQ ID NO: 372430 - RNA, 22 nt, Bordetella pertussis
cggccaggcgcgugcgcaggcg

SEQ ID NO: 372431 - RNA, 16 nt, Bordetella pertussis
cggccaggcgcugcgc

SEQ ID NO: 372432 - RNA, 12 nt, Bordetella pertussis
cggccaggcggg

SEQ ID NO: 372433 - RNA, 22 nt, Bordetella pertussis
cggccaggcgggguggcacagc

SEQ ID NO: 372434 - RNA, 12 nt, Bordetella pertussis
cggccaggcgcc

SEQ ID NO: 372435 - RNA, 23 nt, Bordetella pertussis
cggccaggcguacgcuuaucgcg

SEQ ID NO: 372436 - RNA, 19 nt, Bordetella pertussis
cggccagggaaggggcggc

SEQ ID NO: 372437 - RNA, 12 nt, Bordetella pertussis
cggccagggcca

SEQ ID NO: 372438 - RNA, 16 nt, Bordetella pertussis
cggccagggccugcgg

SEQ ID NO: 372439 - RNA, 18 nt, Bordetella pertussis
cggccagggccugcgggc

SEQ ID NO: 372440 - RNA, 21 nt, Bordetella pertussis
cggccagggccugcgggccgg

SEQ ID NO: 372441 - RNA, 23 nt, Bordetella pertussis
cggccagggccugcgggccgggc

SEQ ID NO: 372442 - RNA, 18 nt, Bordetella pertussis
cggccagggcgaugcggc

SEQ ID NO: 372443 - RNA, 19 nt, Bordetella pertussis
cggccagggcgaugcggcg

SEQ ID NO: 372444 - RNA, 13 nt, Bordetella pertussis
cggccagggcggc

SEQ ID NO: 372445 - RNA, 14 nt, Bordetella pertussis
cggccaucacgccg

SEQ ID NO: 372446 - RNA, 20 nt, Bordetella pertussis
cggccagggcaagcgcgucg

SEQ ID NO: 372447 - RNA, 17 nt, Bordetella pertussis
cggccauccggccacgc

SEQ ID NO: 372448 - RNA, 15 nt, Bordetella pertussis
cggccaucgccaugg

SEQ ID NO: 372449 - RNA, 18 nt, Bordetella pertussis
cggccaucgccauggcca

SEQ ID NO: 372450 - RNA, 17 nt, Bordetella pertussis
cggccauggcggccggc

SEQ ID NO: 372451 - RNA, 18 nt, Bordetella pertussis
cggccauggcggccggcg

SEQ ID NO: 372452 - RNA, 15 nt, Bordetella pertussis
cggccauggccgcca

SEQ ID NO: 372453 - RNA, 19 nt, Bordetella pertussis
cggccauggugccccaugc

SEQ ID NO: 372454 - RNA, 20 nt, Bordetella pertussis
cggccauguagauggccgcc

SEQ ID NO: 372455 - RNA, 21 nt, Bordetella pertussis
cggccauguagauggccgccu

SEQ ID NO: 372456 - RNA, 13 nt, Bordetella pertussis
cggcccacggcca

SEQ ID NO: 372457 - RNA, 16 nt, Bordetella pertussis
cggcccacggccagca

SEQ ID NO: 372458 - RNA, 14 nt, Bordetella pertussis
cggcccagcaugcc

SEQ ID NO: 372459 - RNA, 16 nt, Bordetella pertussis
cggcccagcaugccga

SEQ ID NO: 372460 - RNA, 14 nt, Bordetella pertussis
cggcccagccgcuc

SEQ ID NO: 372461 - RNA, 19 nt, Bordetella pertussis
cggcccagccgcucggcca

SEQ ID NO: 372462 - RNA, 13 nt, Bordetella pertussis
cggcccagcgcca

SEQ ID NO: 372463 - RNA, 17 nt, Bordetella pertussis
cggcccagcgccaucgg

SEQ ID NO: 372464 - RNA, 12 nt, Bordetella pertussis
cggcccagcgcg

SEQ ID NO: 372465 - RNA, 17 nt, Bordetella pertussis
cggcccagcgcggcggc

SEQ ID NO: 372466 - RNA, 18 nt, Bordetella pertussis
cggcccaggauggcgcca

SEQ ID NO: 372467 - RNA, 14 nt, Bordetella pertussis
cggcccaggccggg

SEQ ID NO: 372468 - RNA, 13 nt, Bordetella pertussis
cggccccagcgcc

SEQ ID NO: 372469 - RNA, 19 nt, Bordetella pertussis
cggccccagcgccgcgagc

SEQ ID NO: 372470 - RNA, 23 nt, Bordetella pertussis
cggccccaggaugcgcaccggcc

SEQ ID NO: 372471 - RNA, 13 nt, Bordetella pertussis
cggccccaggccg

SEQ ID NO: 372472 - RNA, 14 nt, Bordetella pertussis
cggccccaggccgg

SEQ ID NO: 372473 - RNA, 16 nt, Bordetella pertussis
cggccccaggccgggu

SEQ ID NO: 372474 - RNA, 19 nt, Bordetella pertussis
cggccccaugcgcggcacg

SEQ ID NO: 372475 - RNA, 14 nt, Bordetella pertussis
cggccccaugucga

SEQ ID NO: 372476 - RNA, 14 nt, Bordetella pertussis
cggcccccagccca

SEQ ID NO: 372477 - RNA, 13 nt, Bordetella pertussis
cggccccgccagg

SEQ ID NO: 372478 - RNA, 14 nt, Bordetella pertussis
cggccccgccaggg

SEQ ID NO: 372479 - RNA, 14 nt, Bordetella pertussis
cggccccggccgcc

SEQ ID NO: 372480 - RNA, 15 nt, Bordetella pertussis
cggccccgcgucggc

SEQ ID NO: 372481 - RNA, 15 nt, Bordetella pertussis
cggccgauggcaucg

SEQ ID NO: 372482 - RNA, 18 nt, Bordetella pertussis
cggccgauggcaucgccc

SEQ ID NO: 372483 - RNA, 20 nt, Bordetella pertussis
cggccgauggcaucgccccg

SEQ ID NO: 372484 - RNA, 14 nt, Bordetella pertussis
cggccgcaagcugg

SEQ ID NO: 372485 - RNA, 13 nt, Bordetella pertussis
cggccgcacgcgg

SEQ ID NO: 372486 - RNA, 15 nt, Bordetella pertussis
cggccgcacgcggcc

SEQ ID NO: 372487 - RNA, 22 nt, Bordetella pertussis
cggccgcaugcgugaagcccau

SEQ ID NO: 372488 - RNA, 21 nt, Bordetella pertussis
cggccgcauugggacgcggcc

SEQ ID NO: 372489 - RNA, 17 nt, Bordetella pertussis
cggccgccaccugggcc

SEQ ID NO: 372490 - RNA, 21 nt, Bordetella pertussis
cggccgccaccugggccgccu

SEQ ID NO: 372491 - RNA, 15 nt, Bordetella pertussis
cggccgccacgcccu

SEQ ID NO: 372492 - RNA, 17 nt, Bordetella pertussis
cggccgccacgcccugg

SEQ ID NO: 372493 - RNA, 16 nt, Bordetella pertussis
cggccgccagcaaggc

SEQ ID NO: 372494 - RNA, 20 nt, Bordetella pertussis
cggccgccagcauggcgucg

SEQ ID NO: 372495 - RNA, 13 nt, Bordetella pertussis
cggccgccagcca

SEQ ID NO: 372496 - RNA, 22 nt, Bordetella pertussis
cggccgccagccaccccgucau

SEQ ID NO: 372497 - RNA, 14 nt, Bordetella pertussis
cggccgccagccgg

SEQ ID NO: 372498 - RNA, 21 nt, Bordetella pertussis
cggccgccagccggcccagca

SEQ ID NO: 372499 - RNA, 15 nt, Bordetella pertussis
cggccgccgaacggc

SEQ ID NO: 372500 - RNA, 18 nt, Bordetella pertussis
cggccgccgaacggcacg

SEQ ID NO: 372501 - RNA, 16 nt, Bordetella pertussis
cggccgccgacgccgc

SEQ ID NO: 372502 - RNA, 19 nt, Bordetella pertussis
cggccgccacccaggcggc

SEQ ID NO: 372503 - RNA, 16 nt, Bordetella pertussis
cggccgccgcaugccg

SEQ ID NO: 372504 - RNA, 17 nt, Bordetella pertussis
cggccgccgcaugccgg

SEQ ID NO: 372505 - RNA, 14 nt, Bordetella pertussis
cggccgccgccggc

SEQ ID NO: 372506 - RNA, 23 nt, Bordetella pertussis
cggccgccggauugacguccaug

SEQ ID NO: 372507 - RNA, 13 nt, Bordetella pertussis
cggccgccggcga

SEQ ID NO: 372508 - RNA, 21 nt, Bordetella pertussis
cggccgccggcgagacgucgg

SEQ ID NO: 372509 - RNA, 15 nt, Bordetella pertussis
cggccgccggcggca

SEQ ID NO: 372510 - RNA, 17 nt, Bordetella pertussis
cggccgcgcaaggcggc

SEQ ID NO: 372511 - RNA, 14 nt, Bordetella pertussis
cggccgcgcaccug

SEQ ID NO: 372512 - RNA, 13 nt, Bordetella pertussis
cggccgcgcagga

SEQ ID NO: 372513 - RNA, 23 nt, Bordetella pertussis
cggccgcgcccgcaacgggccgg

SEQ ID NO: 372514 - RNA, 15 nt, Bordetella pertussis
cggccgcgcccaugc

SEQ ID NO: 372515 - RNA, 14 nt, Bordetella pertussis
cggccgcgggcggc

SEQ ID NO: 372516 - RNA, 14 nt, Bordetella pertussis
cggccgcgggcgug

SEQ ID NO: 372517 - RNA, 21 nt, Bordetella pertussis
cggccgcggggcuggccagcu

SEQ ID NO: 372518 - RNA, 13 nt, Bordetella pertussis
cggccgcgggugg

SEQ ID NO: 372519 - RNA, 18 nt, Bordetella pertussis
cggccgcggucagccaga

SEQ ID NO: 372520 - RNA, 13 nt, Bordetella pertussis
cggccgcguccag

SEQ ID NO: 372521 - RNA, 17 nt, Bordetella pertussis
cggccgcguccagcgcg

SEQ ID NO: 372522 - RNA, 15 nt, Bordetella pertussis
cggccggaggccgcc

SEQ ID NO: 372523 - RNA, 16 nt, Bordetella pertussis
cggccggaggccgccc

SEQ ID NO: 372524 - RNA, 17 nt, Bordetella pertussis
cggccggaugcgcagga

SEQ ID NO: 372525 - RNA, 21 nt, Bordetella pertussis
cggccggaugcgcaggacggc

SEQ ID NO: 372526 - RNA, 17 nt, Bordetella pertussis
cggccggcaaggggcca

SEQ ID NO: 372527 - RNA, 23 nt, Bordetella pertussis
cggccggcaaggggccagccugg

SEQ ID NO: 372528 - RNA, 19 nt, Bordetella pertussis
cggccggcaaggugaucga

SEQ ID NO: 372529 - RNA, 23 nt, Bordetella pertussis
cggccggcaaggugaucgaggcg

SEQ ID NO: 372530 - RNA, 23 nt, Bordetella pertussis
cggccggcaccaggauccccagc

SEQ ID NO: 372531 - RNA, 18 nt, Bordetella pertussis
cggccggcacgcccagcc

SEQ ID NO: 372532 - RNA, 19 nt, Bordetella pertussis
cggccggcacgcccagccg

SEQ ID NO: 372533 - RNA, 14 nt, Bordetella pertussis
cggccggcacgccg

SEQ ID NO: 372534 - RNA, 23 nt, Bordetella pertussis
cggccggcacgccgaugaacgac

SEQ ID NO: 372535 - RNA, 19 nt, Bordetella pertussis
cggccggcccgugcgcaac

SEQ ID NO: 372536 - RNA, 22 nt, Bordetella pertussis
cggccggccgcgcccaugcgcu

SEQ ID NO: 372537 - RNA, 13 nt, Bordetella pertussis
cggccggccugca

SEQ ID NO: 372538 - RNA, 13 nt, Bordetella pertussis
cggccggccugcu

SEQ ID NO: 372539 - RNA, 17 nt, Bordetella pertussis
cggccggcgcacgccgg

SEQ ID NO: 372540 - RNA, 20 nt, Bordetella pertussis
cggccggcgcacgccggacc

SEQ ID NO: 372541 - RNA, 22 nt, Bordetella pertussis
cggccggcgcaguuccggcggg

SEQ ID NO: 372542 - RNA, 14 nt, Bordetella pertussis
cggccggcgccggc

SEQ ID NO: 372543 - RNA, 14 nt, Bordetella pertussis
cggccgggccagcg

SEQ ID NO: 372544 - RNA, 14 nt, Bordetella pertussis
cggccgggccagua

SEQ ID NO: 372545 - RNA, 14 nt, Bordetella pertussis
cggccgggcgccca

SEQ ID NO: 372546 - RNA, 16 nt, Bordetella pertussis
cggccgggcgcccagc

SEQ ID NO: 372547 - RNA, 17 nt, Bordetella pertussis
cggccgggcgcccagcg

SEQ ID NO: 372548 - RNA, 13 nt, Bordetella pertussis
cggccgggcgcgg

SEQ ID NO: 372549 - RNA, 15 nt, Bordetella pertussis
cggccgggcgcggcg

SEQ ID NO: 372550 - RNA, 17 nt, Bordetella pertussis
cggccgggcgcggcgcc

SEQ ID NO: 372551 - RNA, 14 nt, Bordetella pertussis
cggccggggcccgc

SEQ ID NO: 372552 - RNA, 16 nt, Bordetella pertussis
cggccggggcccgcgg

SEQ ID NO: 372553 - RNA, 14 nt, Bordetella pertussis
cggccggggccgcc

SEQ ID NO: 372554 - RNA, 22 nt, Bordetella pertussis
cggccggggcggucaaugcggc

SEQ ID NO: 372555 - RNA, 20 nt, Bordetella pertussis
cggccggggucuugccgcgc

SEQ ID NO: 372556 - RNA, 21 nt, Bordetella pertussis
cggccggggucuugccgcgca

SEQ ID NO: 372557 - RNA, 18 nt, Bordetella pertussis
cggccgggucccuggccc

SEQ ID NO: 372558 - RNA, 15 nt, Bordetella pertussis
cggccgggucggccu

SEQ ID NO: 372559 - RNA, 17 nt, Bordetella pertussis
cggccgggucggccugc

SEQ ID NO: 372560 - RNA, 16 nt, Bordetella pertussis
cggccgguaucgacgc

SEQ ID NO: 372561 - RNA, 17 nt, Bordetella pertussis
cggccgguaucgacgcg

SEQ ID NO: 372562 - RNA, 19 nt, Bordetella pertussis
cggccgguaucgacgcgcg

SEQ ID NO: 372563 - RNA, 14 nt, Bordetella pertussis
cggccgguaucggc

SEQ ID NO: 372564 - RNA, 19 nt, Bordetella pertussis
cggccgguaucggccucga

SEQ ID NO: 372565 - RNA, 17 nt, Bordetella pertussis
cggccggucagcccagg

SEQ ID NO: 372566 - RNA, 18 nt, Bordetella pertussis
cggccggucagcccaggc

SEQ ID NO: 372567 - RNA, 14 nt, Bordetella pertussis
cggccggucaggga

SEQ ID NO: 372568 - RNA, 19 nt, Bordetella pertussis
cggccgguaaggcgcuugc

SEQ ID NO: 372569 - RNA, 20 nt, Bordetella pertussis
cggccggugcaucggccggc

SEQ ID NO: 372570 - RNA, 23 nt, Bordetella pertussis
cggccgguggaaauacagaucgc

SEQ ID NO: 372571 - RNA, 13 nt, Bordetella pertussis
cggccgguggcga

SEQ ID NO: 372572 - RNA, 16 nt, Bordetella pertussis
cggccgguggcgauca

SEQ ID NO: 372573 - RNA, 21 nt, Bordetella pertussis
cggccguaacccgaguccuug

SEQ ID NO: 372574 - RNA, 22 nt, Bordetella pertussis
cggccguauggccguuggccag

SEQ ID NO: 372575 - RNA, 17 nt, Bordetella pertussis
cggccgucaacagcaug

SEQ ID NO: 372576 - RNA, 14 nt, Bordetella pertussis
cggccgucagcagc

SEQ ID NO: 372577 - RNA, 18 nt, Bordetella pertussis
cggccgucagcagcaggc

SEQ ID NO: 372578 - RNA, 17 nt, Bordetella pertussis
cggccgucgaccgacag

SEQ ID NO: 372579 - RNA, 16 nt, Bordetella pertussis
cggccgucgccgccca

SEQ ID NO: 372580 - RNA, 22 nt, Bordetella pertussis
cggccgucgccgcccaugcgca

SEQ ID NO: 372581 - RNA, 23 nt, Bordetella pertussis
cggccgucggcgcuggcgcgcug

SEQ ID NO: 372582 - RNA, 24 nt, Bordetella pertussis
cggccgucggcgcuggcgcgcugu

SEQ ID NO: 372583 - RNA, 13 nt, Bordetella pertussis
cggccgucugggc

SEQ ID NO: 372584 - RNA, 15 nt, Bordetella pertussis
cggccgucugggcgu

SEQ ID NO: 372585 - RNA, 13 nt, Bordetella pertussis
cggccgugccgcc

SEQ ID NO: 372586 - RNA, 16 nt, Bordetella pertussis
cggccucgcugcgggc

SEQ ID NO: 372587 - RNA, 19 nt, Bordetella pertussis
cggccucgcugcgggcggc

SEQ ID NO: 372588 - RNA, 19 nt, Bordetella pertussis
cggccucgcgcagggcggc

SEQ ID NO: 372589 - RNA, 15 nt, Bordetella pertussis
cggccucggccagcu

SEQ ID NO: 372590 - RNA, 15 nt, Bordetella pertussis
cggccucggccagga

SEQ ID NO: 372591 - RNA, 20 nt, Bordetella pertussis
cggccucggccauguagaug

SEQ ID NO: 372592 - RNA, 23 nt, Bordetella pertussis
cggccucggcgaagugcccgcug

SEQ ID NO: 372593 - RNA, 13 nt, Bordetella pertussis
cggccucggcggg

SEQ ID NO: 372594 - RNA, 17 nt, Bordetella pertussis
cggccucggcgggcggc

SEQ ID NO: 372595 - RNA, 18 nt, Bordetella pertussis
cggccucggucucgugcg

SEQ ID NO: 372596 - RNA, 17 nt, Bordetella pertussis
cggccucgguggucagg

SEQ ID NO: 372597 - RNA, 22 nt, Bordetella pertussis
cggccucguaguguucgauggc

SEQ ID NO: 372598 - RNA, 19 nt, Bordetella pertussis
cggccucguccucgucggc

SEQ ID NO: 372599 - RNA, 16 nt, Bordetella pertussis
cggccucguaggccau

SEQ ID NO: 372600 - RNA, 14 nt, Bordetella pertussis
cggccugcgccacc

SEQ ID NO: 372601 - RNA, 19 nt, Bordetella pertussis
cggccugcgccaccagcuu

SEQ ID NO: 372602 - RNA, 21 nt, Bordetella pertussis
cggccugcgccgggcgcggcc

SEQ ID NO: 372603 - RNA, 14 nt, Bordetella pertussis
cggccugcgcgccg

SEQ ID NO: 372604 - RNA, 15 nt, Bordetella pertussis
cggccugcgcgccga

SEQ ID NO: 372605 - RNA, 17 nt, Bordetella pertussis
cggccugcgcgccgacc

SEQ ID NO: 372606 - RNA, 20 nt, Bordetella pertussis
cggccugcgcgccgaccagg

SEQ ID NO: 372607 - RNA, 15 nt, Bordetella pertussis
cggccugcgcgccgg

SEQ ID NO: 372608 - RNA, 13 nt, Bordetella pertussis
cggccugcgggcg

SEQ ID NO: 372609 - RNA, 16 nt, Bordetella pertussis
cggccugcgggcgccg

SEQ ID NO: 372610 - RNA, 17 nt, Bordetella pertussis
cggccugcgggcgccgc

SEQ ID NO: 372611 - RNA, 23 nt, Bordetella pertussis
cggccugcgggcgccgcggggcg

SEQ ID NO: 372612 - RNA, 21 nt, Bordetella pertussis
cggccugcgggcugaugcagg

SEQ ID NO: 372613 - RNA, 19 nt, Bordetella pertussis
cggccugcgucgccaccuc

SEQ ID NO: 372614 - RNA, 20 nt, Bordetella pertussis
cggccugcgugucaggcgga

SEQ ID NO: 372615 - RNA, 16 nt, Bordetella pertussis
cggccugcuccggcgu

SEQ ID NO: 372616 - RNA, 19 nt, Bordetella pertussis
cggccugcucgaaaugcgc

SEQ ID NO: 372617 - RNA, 16 nt, Bordetella pertussis
cggccuggcgggccga

SEQ ID NO: 372618 - RNA, 17 nt, Bordetella pertussis
cggccugggcgcgaugg

SEQ ID NO: 372619 - RNA, 12 nt, Bordetella pertussis
cggccugggcgg

SEQ ID NO: 372620 - RNA, 13 nt, Bordetella pertussis
cggccugggcggc

SEQ ID NO: 372621 - RNA, 19 nt, Bordetella pertussis
cggccuggggacgggcgca

SEQ ID NO: 372622 - RNA, 22 nt, Bordetella pertussis
cggccuggucaugacgggcggc

SEQ ID NO: 372623 - RNA, 19 nt, Bordetella pertussis
cggccugguccgccgcgac

SEQ ID NO: 372624 - RNA, 20 nt, Bordetella pertussis
cggccuguucgcggugucgc

SEQ ID NO: 372625 - RNA, 23 nt, Bordetella pertussis
cggccuucaugaucuggccgacc

SEQ ID NO: 372626 - RNA, 21 nt, Bordetella pertussis
cggccuucauuuccugguuca

SEQ ID NO: 372627 - RNA, 14 nt, Bordetella pertussis
cggccuucugcgcc

SEQ ID NO: 372628 - RNA, 18 nt, Bordetella pertussis
cggccuucugcgccagcg

SEQ ID NO: 372629 - RNA, 15 nt, Bordetella pertussis
cggccuugcaugcgc

SEQ ID NO: 372630 - RNA, 20 nt, Bordetella pertussis
cggccuugccgguggacggc

SEQ ID NO: 372631 - RNA, 17 nt, Bordetella pertussis
cggccuugcgggccggc

SEQ ID NO: 372632 - RNA, 19 nt, Bordetella pertussis
cggccuugcgggccggcug

SEQ ID NO: 372633 - RNA, 13 nt, Bordetella pertussis
cggccuugcgggc

SEQ ID NO: 372634 - RNA, 23 nt, Bordetella pertussis
cggccuuggccauguccuggcag

SEQ ID NO: 372635 - RNA, 14 nt, Bordetella pertussis
cggccuuggccgca

SEQ ID NO: 372636 - RNA, 16 nt, Bordetella pertussis
cggccuuggccgcagc

SEQ ID NO: 372637 - RNA, 20 nt, Bordetella pertussis
cggccuuggccgcagccggc

SEQ ID NO: 372638 - RNA, 21 nt, Bordetella pertussis
cggccuuggccgcagccggcu

SEQ ID NO: 372639 - RNA, 24 nt, Bordetella pertussis
cggccuugcugaaccugcuggccg

SEQ ID NO: 372640 - RNA, 17 nt, Bordetella pertussis
cggcgaaaugucgagcg

SEQ ID NO: 372641 - RNA, 13 nt, Bordetella pertussis
cggcgaacagcgc

SEQ ID NO: 372642 - RNA, 16 nt, Bordetella pertussis
cggcgaaggcgcggcu

SEQ ID NO: 372643 - RNA, 20 nt, Bordetella pertussis
cggcgaagugcccgcuggcc

SEQ ID NO: 372644 - RNA, 16 nt, Bordetella pertussis
cggcgacagggcgucg

SEQ ID NO: 372645 - RNA, 23 nt, Bordetella pertussis
cggcgacauagaucuccggcgcc

SEQ ID NO: 372646 - RNA, 17 nt, Bordetella pertussis
cggcgaccaccgauccg

SEQ ID NO: 372647 - RNA, 18 nt, Bordetella pertussis
cggcgaccaggugcgggc

SEQ ID NO: 372648 - RNA, 13 nt, Bordetella pertussis
cggcgaccaggcc

SEQ ID NO: 372649 - RNA, 17 nt, Bordetella pertussis
cggcgaccaggcccaug

SEQ ID NO: 372650 - RNA, 18 nt, Bordetella pertussis
cggcgacgacuacgcgcu

SEQ ID NO: 372651 - RNA, 22 nt, Bordetella pertussis
cggcgacgaucuccacccccgg

SEQ ID NO: 372652 - RNA, 13 nt, Bordetella pertussis
cggcgacgaugcc

SEQ ID NO: 372653 - RNA, 12 nt, Bordetella pertussis
cggcgacggcau

SEQ ID NO: 372654 - RNA, 14 nt, Bordetella pertussis
cggcgacggcgccu

SEQ ID NO: 372655 - RNA, 16 nt, Bordetella pertussis
cggcgacggcgccugg

SEQ ID NO: 372656 - RNA, 15 nt, Bordetella pertussis
cggcgacggcgucgg

SEQ ID NO: 372657 - RNA, 14 nt, Bordetella pertussis
cggcgacggcgucg

SEQ ID NO: 372658 - RNA, 15 nt, Bordetella pertussis
cggcgacguggcgcu

SEQ ID NO: 372659 - RNA, 19 nt, Bordetella pertussis
cggcgaucaccugcguggc

SEQ ID NO: 372660 - RNA, 20 nt, Bordetella pertussis
cggcgaucaccugcguggcc

SEQ ID NO: 372661 - RNA, 14 nt, Bordetella pertussis
cggcgaucacgccg

SEQ ID NO: 372662 - RNA, 16 nt, Bordetella pertussis
cggcgaucaugccgcc

SEQ ID NO: 372663 - RNA, 18 nt, Bordetella pertussis
cggcgaucauggcguguc

SEQ ID NO: 372664 - RNA, 20 nt, Bordetella pertussis
cggcgaucucgucgaccgcc

SEQ ID NO: 372665 - RNA, 21 nt, Bordetella pertussis
cggcgaucucgucgaccgccu

SEQ ID NO: 372666 - RNA, 16 nt, Bordetella pertussis
cggcgaucugcgcggc

SEQ ID NO: 372667 - RNA, 14 nt, Bordetella pertussis
cggcgaucugggcc

SEQ ID NO: 372668 - RNA, 17 nt, Bordetella pertussis
cggcgaucugggccucg

SEQ ID NO: 372669 - RNA, 23 nt, Bordetella pertussis
cggcgaucuuguaggcgauccag

SEQ ID NO: 372670 - RNA, 16 nt, Bordetella pertussis
cggcgaugaacagcgg

SEQ ID NO: 372671 - RNA, 18 nt, Bordetella pertussis
cggcgaugaacagcggca

SEQ ID NO: 372672 - RNA, 23 nt, Bordetella pertussis
cggcgaugaacagcggcacgccg

SEQ ID NO: 372673 - RNA, 14 nt, Bordetella pertussis
cggcgaugacggcu

SEQ ID NO: 372674 - RNA, 13 nt, Bordetella pertussis
cggcgaugcgggc

SEQ ID NO: 372675 - RNA, 14 nt, Bordetella pertussis
cggcgaugcugccg

SEQ ID NO: 372676 - RNA, 19 nt, Bordetella pertussis
cggcgcaacccggccucgc

SEQ ID NO: 372677 - RNA, 14 nt, Bordetella pertussis
cggcgcaaccggcc

SEQ ID NO: 372678 - RNA, 14 nt, Bordetella pertussis
cggcgcaacgggcc

SEQ ID NO: 372679 - RNA, 19 nt, Bordetella pertussis
cggcgcaauccccgcuucc

SEQ ID NO: 372680 - RNA, 24 nt, Bordetella pertussis
cggcgcacaaucugcgucgccugg

SEQ ID NO: 372681 - RNA, 19 nt, Bordetella pertussis
cggcgcacaccaucagcug

SEQ ID NO: 372682 - RNA, 17 nt, Bordetella pertussis
cggcgcacagggcgucg

SEQ ID NO: 372683 - RNA, 21 nt, Bordetella pertussis
cggcgcaccaaucuugccagg

SEQ ID NO: 372684 - RNA, 20 nt, Bordetella pertussis
cggcgcaccagcgaggcggc

SEQ ID NO: 372685 - RNA, 13 nt, Bordetella pertussis
cggcgcagcacca

SEQ ID NO: 372686 - RNA, 15 nt, Bordetella pertussis
cggcgcagcaccagg

SEQ ID NO: 372687 - RNA, 16 nt, Bordetella pertussis
cggcgcagcaccaggc

SEQ ID NO: 372688 - RNA, 17 nt, Bordetella pertussis
cggcgcagcaccaggcu

SEQ ID NO: 372689 - RNA, 19 nt, Bordetella pertussis
cggcgcagcaccaggcuuu

SEQ ID NO: 372690 - RNA, 22 nt, Bordetella pertussis
cggcgcagcaucuugcgccgcu

SEQ ID NO: 372691 - RNA, 20 nt, Bordetella pertussis
cggcgcagcauuucggcgcc

SEQ ID NO: 372692 - RNA, 15 nt, Bordetella pertussis
cggcgcagcccagcg

SEQ ID NO: 372693 - RNA, 17 nt, Bordetella pertussis
cggcgcagcccagcgcg

SEQ ID NO: 372694 - RNA, 13 nt, Bordetella pertussis
cggcgcagccgcc

SEQ ID NO: 372695 - RNA, 13 nt, Bordetella pertussis
cggcgcagccggc

SEQ ID NO: 372696 - RNA, 15 nt, Bordetella pertussis
cggcgcagccggccg

SEQ ID NO: 372697 - RNA, 14 nt, Bordetella pertussis
cggcgcagcgcacg

SEQ ID NO: 372698 - RNA, 13 nt, Bordetella pertussis
cggcgcagcgccc

SEQ ID NO: 372699 - RNA, 20 nt, Bordetella pertussis
cggcgccacgcagaaggcga

SEQ ID NO: 372700 - RNA, 22 nt, Bordetella pertussis
cggcgccacgcagaaggcgaac

SEQ ID NO: 372701 - RNA, 18 nt, Bordetella pertussis
cggcgccacugccaggcg

SEQ ID NO: 372702 - RNA, 19 nt, Bordetella pertussis
cggcgccacugccaggcgc

SEQ ID NO: 372703 - RNA, 20 nt, Bordetella pertussis
cggcgccacugccaggcgcc

SEQ ID NO: 372704 - RNA, 13 nt, Bordetella pertussis
cggcgccagcauc

SEQ ID NO: 372705 - RNA, 14 nt, Bordetella pertussis
cggcgccagcaugc

SEQ ID NO: 372706 - RNA, 17 nt, Bordetella pertussis
cggcgccagcaugcgcg

SEQ ID NO: 372707 - RNA, 18 nt, Bordetella pertussis
cggcgccagcaugcgcgc

SEQ ID NO: 372708 - RNA, 18 nt, Bordetella pertussis
cggcgccagccgcuccag

SEQ ID NO: 372709 - RNA, 13 nt, Bordetella pertussis
cggcgccagcgcc

SEQ ID NO: 372710 - RNA, 14 nt, Bordetella pertussis
cggcgccaugccgg

SEQ ID NO: 372711 - RNA, 14 nt, Bordetella pertussis
cggcgccaugcgca

SEQ ID NO: 372712 - RNA, 15 nt, Bordetella pertussis
cggcgccaugcgcac

SEQ ID NO: 372713 - RNA, 23 nt, Bordetella pertussis
cggcgccaugcgcaccaccgccg

SEQ ID NO: 372714 - RNA, 14 nt, Bordetella pertussis
cggcgccaugcugg

SEQ ID NO: 372715 - RNA, 23 nt, Bordetella pertussis
cggcgccaugcuggccgccgcgc

SEQ ID NO: 372716 - RNA, 14 nt, Bordetella pertussis
cggcgcccacgccg

SEQ ID NO: 372717 - RNA, 15 nt, Bordetella pertussis
cggcgcccacgccga

SEQ ID NO: 372718 - RNA, 14 nt, Bordetella pertussis
cggcgcccagcugg

SEQ ID NO: 372719 - RNA, 22 nt, Bordetella pertussis
cggcgcccagcuggcgccccuu

SEQ ID NO: 372720 - RNA, 15 nt, Bordetella pertussis
cggcgcccaggccca

SEQ ID NO: 372721 - RNA, 20 nt, Bordetella pertussis
cggcgcccaggcccagcgcg

SEQ ID NO: 372722 - RNA, 21 nt, Bordetella pertussis
cggcgcccaggcccagcgcgc

SEQ ID NO: 372723 - RNA, 12 nt, Bordetella pertussis
cggcgcccagcu

SEQ ID NO: 372724 - RNA, 21 nt, Bordetella pertussis
cggcgcccagcuccaccccgg

SEQ ID NO: 372725 - RNA, 12 nt, Bordetella pertussis
cggcgcccauca

SEQ ID NO: 372726 - RNA, 17 nt, Bordetella pertussis
cggcgcccaucagguga

SEQ ID NO: 372727 - RNA, 23 nt, Bordetella pertussis
cggcgcccaucaggugaaacagc

SEQ ID NO: 372728 - RNA, 16 nt, Bordetella pertussis
cggcgcccccagcagc

SEQ ID NO: 372729 - RNA, 18 nt, Bordetella pertussis
cggcgcccccagcagcga

SEQ ID NO: 372730 - RNA, 18 nt, Bordetella pertussis
cggcgcccccgcggcgcc

SEQ ID NO: 372731 - RNA, 21 nt, Bordetella pertussis
cggcgcccgcauggaccgccg

SEQ ID NO: 372732 - RNA, 17 nt, Bordetella pertussis
cggcgcccgccgccggg

SEQ ID NO: 372733 - RNA, 12 nt, Bordetella pertussis
cggcgcccgccg

SEQ ID NO: 372734 - RNA, 14 nt, Bordetella pertussis
cggcgcccgccugc

SEQ ID NO: 372735 - RNA, 19 nt, Bordetella pertussis
cggcgcccgcggccugcgc

SEQ ID NO: 372736 - RNA, 16 nt, Bordetella pertussis
cggcgcccgccugcgu

SEQ ID NO: 372737 - RNA, 14 nt, Bordetella pertussis
cggcgcccgcugcg

SEQ ID NO: 372738 - RNA, 18 nt, Bordetella pertussis
cggcgcccggcagccgaa

SEQ ID NO: 372739 - RNA, 14 nt, Bordetella pertussis
cggcgcccggcgcc

SEQ ID NO: 372740 - RNA, 15 nt, Bordetella pertussis
cggcgcccggcgccg

SEQ ID NO: 372741 - RNA, 15 nt, Bordetella pertussis
cggcgcccggugcgc

SEQ ID NO: 372742 - RNA, 17 nt, Bordetella pertussis
cggcgcccggugcgcgc

SEQ ID NO: 372743 - RNA, 18 nt, Bordetella pertussis
cggcgcccggugcgcgca

SEQ ID NO: 372744 - RNA, 13 nt, Bordetella pertussis
cggcgcccugcag

SEQ ID NO: 372745 - RNA, 17 nt, Bordetella pertussis
cggcgcccugcagggca

SEQ ID NO: 372746 - RNA, 21 nt, Bordetella pertussis
cggcgcccucuuucgccgcgc

SEQ ID NO: 372747 - RNA, 12 nt, Bordetella pertussis
cggcgccgacaa

SEQ ID NO: 372748 - RNA, 13 nt, Bordetella pertussis
cggcgccgacaac

SEQ ID NO: 372749 - RNA, 14 nt, Bordetella pertussis
cggcgccgacaacg

SEQ ID NO: 372750 - RNA, 17 nt, Bordetella pertussis
cggcgccgacaacggcg

SEQ ID NO: 372751 - RNA, 22 nt, Bordetella pertussis
cggcgccgacaacggcgugcug

SEQ ID NO: 372752 - RNA, 15 nt, Bordetella pertussis
cggcgccgaccaggu

SEQ ID NO: 372753 - RNA, 15 nt, Bordetella pertussis
cggcgccgacgcgcu

SEQ ID NO: 372754 - RNA, 20 nt, Bordetella pertussis
cggcgccgagauggacgcgu

SEQ ID NO: 372755 - RNA, 17 nt, Bordetella pertussis
cggcgccgaggcggucg

SEQ ID NO: 372756 - RNA, 20 nt, Bordetella pertussis
cggcgccgaggcggucgaug

SEQ ID NO: 372757 - RNA, 16 nt, Bordetella pertussis
cggcgccgaucagcag

SEQ ID NO: 372758 - RNA, 20 nt, Bordetella pertussis
cggcgccgauggugcgggcg

SEQ ID NO: 372759 - RNA, 22 nt, Bordetella pertussis
cggcgccgauggugcgggcgau

SEQ ID NO: 372760 - RNA, 20 nt, Bordetella pertussis
cggcgccgccggcggccugg

SEQ ID NO: 372761 - RNA, 18 nt, Bordetella pertussis
cggcgccgccucaggccg

SEQ ID NO: 372762 - RNA, 19 nt, Bordetella pertussis
cggcgccgccucaggccgg

SEQ ID NO: 372763 - RNA, 21 nt, Bordetella pertussis
cggcgccgccucaggccggcg

SEQ ID NO: 372764 - RNA, 14 nt, Bordetella pertussis
cggcgccgcgcgcu

SEQ ID NO: 372765 - RNA, 15 nt, Bordetella pertussis
cggcgccgcgcgcug

SEQ ID NO: 372766 - RNA, 14 nt, Bordetella pertussis
cggcgccgcgcuga

SEQ ID NO: 372767 - RNA, 15 nt, Bordetella pertussis
cggcgccgcgcugau

SEQ ID NO: 372768 - RNA, 17 nt, Bordetella pertussis
cggcgccgccucgggca

SEQ ID NO: 372769 - RNA, 12 nt, Bordetella pertussis
cggcgccgcgca

SEQ ID NO: 372770 - RNA, 19 nt, Bordetella pertussis
cggcgccgcuuccggcaug

SEQ ID NO: 372771 - RNA, 18 nt, Bordetella pertussis
cggcgccggaucggccgg

SEQ ID NO: 372772 - RNA, 13 nt, Bordetella pertussis
cggcgccggcacg

SEQ ID NO: 372773 - RNA, 16 nt, Bordetella pertussis
cggcgccggcacgguu

SEQ ID NO: 372774 - RNA, 12 nt, Bordetella pertussis
cggcgccggccg

SEQ ID NO: 372775 - RNA, 18 nt, Bordetella pertussis
cggcgccggccgcccgcc

SEQ ID NO: 372776 - RNA, 13 nt, Bordetella pertussis
cggcgccggccgc

SEQ ID NO: 372777 - RNA, 14 nt, Bordetella pertussis
cggcgccggccuca

SEQ ID NO: 372778 - RNA, 18 nt, Bordetella pertussis
cggcgccggcgacgccgc

SEQ ID NO: 372779 - RNA, 13 nt, Bordetella pertussis
cggcgccggcguc

SEQ ID NO: 372780 - RNA, 23 nt, Bordetella pertussis
cggcgccggcguccacggcaucg

SEQ ID NO: 372781 - RNA, 16 nt, Bordetella pertussis
cggcgccgggcagccc

SEQ ID NO: 372782 - RNA, 21 nt, Bordetella pertussis
cggcgccgggcagcccgcgca

SEQ ID NO: 372783 - RNA, 23 nt, Bordetella pertussis
cggcgccgggcagcccgcgcacg

SEQ ID NO: 372784 - RNA, 19 nt, Bordetella pertussis
cggcgccgggcgacggcgu

SEQ ID NO: 372785 - RNA, 18 nt, Bordetella pertussis
cggcgccggugaccgcca

SEQ ID NO: 372786 - RNA, 21 nt, Bordetella pertussis
cggcgccggugaccgccagca

SEQ ID NO: 372787 - RNA, 22 nt, Bordetella pertussis
cggcgccggugaccgccagcag

SEQ ID NO: 372788 - RNA, 13 nt, Bordetella pertussis
cggcgccguccag

SEQ ID NO: 372789 - RNA, 19 nt, Bordetella pertussis
cggcgccguccagcgcggc

SEQ ID NO: 372790 - RNA, 11 nt, Bordetella pertussis
cggcgccgucu

SEQ ID NO: 372791 - RNA, 23 nt, Bordetella pertussis
cggcgccguucaugcgucgaacg

SEQ ID NO: 372792 - RNA, 19 nt, Bordetella pertussis
cggcgccguuuucagcgca

SEQ ID NO: 372793 - RNA, 21 nt, Bordetella pertussis
cggcgccuauugcgacgccgc

SEQ ID NO: 372794 - RNA, 16 nt, Bordetella pertussis
cggcgccucgguccag

SEQ ID NO: 372795 - RNA, 12 nt, Bordetella pertussis
cggcgccugcgc

SEQ ID NO: 372796 - RNA, 13 nt, Bordetella pertussis
cggcgccugcgcg

SEQ ID NO: 372797 - RNA, 17 nt, Bordetella pertussis
cggcgccugcgcgcgcu

SEQ ID NO: 372798 - RNA, 16 nt, Bordetella pertussis
cggcgccugcggcaug

SEQ ID NO: 372799 - RNA, 13 nt, Bordetella pertussis
cggcgccuggccg

SEQ ID NO: 372800 - RNA, 15 nt, Bordetella pertussis
cggcgccuggccgcc

SEQ ID NO: 372801 - RNA, 23 nt, Bordetella pertussis
cggcgccuggccgcccagcgccu

SEQ ID NO: 372802 - RNA, 14 nt, Bordetella pertussis
cggcgccuggccgu

SEQ ID NO: 372803 - RNA, 14 nt, Bordetella pertussis
cggcgccuggcgca

SEQ ID NO: 372804 - RNA, 13 nt, Bordetella pertussis
cggcgccugggcc

SEQ ID NO: 372805 - RNA, 16 nt, Bordetella pertussis
cggcgccuggggcgug

SEQ ID NO: 372806 - RNA, 21 nt, Bordetella pertussis
cggcgccuggucgcgcgccug

SEQ ID NO: 372807 - RNA, 19 nt, Bordetella pertussis
cggcgcgaacaccggcagg

SEQ ID NO: 372808 - RNA, 22 nt, Bordetella pertussis
cggcgcgaacaccggcaggccg

SEQ ID NO: 372809 - RNA, 23 nt, Bordetella pertussis
cggcgcgaacaccggcaggccgc

SEQ ID NO: 372810 - RNA, 13 nt, Bordetella pertussis
cggcgcgacgcgc

SEQ ID NO: 372811 - RNA, 14 nt, Bordetella pertussis
cggcgcgacgcgcu

SEQ ID NO: 372812 - RNA, 20 nt, Bordetella pertussis
cggcgcgaacggcagcuugu

SEQ ID NO: 372813 - RNA, 16 nt, Bordetella pertussis
cggcgcgagcgcacag

SEQ ID NO: 372814 - RNA, 17 nt, Bordetella pertussis
cggcgcgagcgcacagg

SEQ ID NO: 372815 - RNA, 23 nt, Bordetella pertussis
cggcgcgagcgcacaggcggcgc

SEQ ID NO: 372816 - RNA, 22 nt, Bordetella pertussis
cggcgcgaguaucccuaccgcc

SEQ ID NO: 372817 - RNA, 19 nt, Bordetella pertussis
cggcgcgcagcagacgcuu

SEQ ID NO: 372818 - RNA, 15 nt, Bordetella pertussis
cggcgcgcagcgccu

SEQ ID NO: 372819 - RNA, 18 nt, Bordetella pertussis
cggcgcgcacgggcgagg

SEQ ID NO: 372820 - RNA, 19 nt, Bordetella pertussis
cggcgcgcacgggcgaggc

SEQ ID NO: 372821 - RNA, 12 nt, Bordetella pertussis
cggcgcgcagcg

SEQ ID NO: 372822 - RNA, 21 nt, Bordetella pertussis
cggcgcgcaucgucaggcagg

SEQ ID NO: 372823 - RNA, 22 nt, Bordetella pertussis
cggcgcgcaucgucaggcaggc

SEQ ID NO: 372824 - RNA, 16 nt, Bordetella pertussis
cggcgcgccagcgcgg

SEQ ID NO: 372825 - RNA, 14 nt, Bordetella pertussis
cggcgcgcccagcg

SEQ ID NO: 372826 - RNA, 23 nt, Bordetella pertussis
cggcgcgcccagcggcaggcugg

SEQ ID NO: 372827 - RNA, 13 nt, Bordetella pertussis
cggcgcgcccagg

SEQ ID NO: 372828 - RNA, 16 nt, Bordetella pertussis
cggcgcgcccaggggc

SEQ ID NO: 372829 - RNA, 18 nt, Bordetella pertussis
cggcgcgcccgcaggcgg

SEQ ID NO: 372830 - RNA, 22 nt, Bordetella pertussis
cggcgcgcccgcaggcggcggc

SEQ ID NO: 372831 - RNA, 13 nt, Bordetella pertussis
cggcgcgcccgcc

SEQ ID NO: 372832 - RNA, 14 nt, Bordetella pertussis
cggcgcgcccgcca

SEQ ID NO: 372833 - RNA, 14 nt, Bordetella pertussis
cggcgcgcccgccg

SEQ ID NO: 372834 - RNA, 20 nt, Bordetella pertussis
cggcgcgcccgccuucggcg

SEQ ID NO: 372835 - RNA, 21 nt, Bordetella pertussis
cggcgcgcccgccuucggcgg

SEQ ID NO: 372836 - RNA, 22 nt, Bordetella pertussis
cggcgcgcccgccuucggcggc

SEQ ID NO: 372837 - RNA, 11 nt, Bordetella pertussis
cggcgcgccgc

SEQ ID NO: 372838 - RNA, 12 nt, Bordetella pertussis
cggcgcgccgcg

SEQ ID NO: 372839 - RNA, 15 nt, Bordetella pertussis
cggcgcgccgcgccg

SEQ ID NO: 372840 - RNA, 18 nt, Bordetella pertussis
cggcgcgccggccugcgc

SEQ ID NO: 372841 - RNA, 20 nt, Bordetella pertussis
cggcgcgccggcccaaggcc

SEQ ID NO: 372842 - RNA, 17 nt, Bordetella pertussis
cggcgcgccggccgcca

SEQ ID NO: 372843 - RNA, 17 nt, Bordetella pertussis
cggcgcgccguccgggc

SEQ ID NO: 372844 - RNA, 20 nt, Bordetella pertussis
cggcgcgccguccgggccgg

SEQ ID NO: 372845 - RNA, 13 nt, Bordetella pertussis
cggcgcgccuuac

SEQ ID NO: 372846 - RNA, 14 nt, Bordetella pertussis
cggcgcgcgaucuc

SEQ ID NO: 372847 - RNA, 19 nt, Bordetella pertussis
cggcgcgcgaucucgggca

SEQ ID NO: 372848 - RNA, 11 nt, Bordetella pertussis
cggcgcgcgca

SEQ ID NO: 372849 - RNA, 15 nt, Bordetella pertussis
cggcgcgcgcaggcg

SEQ ID NO: 372850 - RNA, 16 nt, Bordetella pertussis
cggcgcgcgcaggcgc

SEQ ID NO: 372851 - RNA, 20 nt, Bordetella pertussis
cggcgcgcgcaggcgcucga

SEQ ID NO: 372852 - RNA, 19 nt, Bordetella pertussis
cggcgcgcgcaugcccgac

SEQ ID NO: 372853 - RNA, 11 nt, Bordetella pertussis
cggcgcgcgcc

SEQ ID NO: 372854 - RNA, 12 nt, Bordetella pertussis
cggcgcgcgcca

SEQ ID NO: 372855 - RNA, 13 nt, Bordetella pertussis
cggcgcgcgccgg

SEQ ID NO: 372856 - RNA, 14 nt, Bordetella pertussis
cggcgcgcgccggc

SEQ ID NO: 372857 - RNA, 15 nt, Bordetella pertussis
cggcgcgcgccggcu

SEQ ID NO: 372858 - RNA, 13 nt, Bordetella pertussis
cggcgcgcgccgu

SEQ ID NO: 372859 - RNA, 12 nt, Bordetella pertussis
cggcgcgcgccu

SEQ ID NO: 372860 - RNA, 13 nt, Bordetella pertussis
cggcgcgcgccug

SEQ ID NO: 372861 - RNA, 15 nt, Bordetella pertussis
cggcgcgcgccugcu

SEQ ID NO: 372862 - RNA, 18 nt, Bordetella pertussis
cggcgcgcgccaggccca

SEQ ID NO: 372863 - RNA, 12 nt, Bordetella pertussis
cggcgcgcgccg

SEQ ID NO: 372864 - RNA, 13 nt, Bordetella pertussis
cggcgcgcgccga

SEQ ID NO: 372865 - RNA, 14 nt, Bordetella pertussis
cggcgcgcgcgccg

SEQ ID NO: 372866 - RNA, 15 nt, Bordetella pertussis
cggcgcgcgcgccgc

SEQ ID NO: 372867 - RNA, 20 nt, Bordetella pertussis
cggcgcgcgcguacagccgg

SEQ ID NO: 372868 - RNA, 13 nt, Bordetella pertussis
cggcgcgcgcguu

SEQ ID NO: 372869 - RNA, 15 nt, Bordetella pertussis
cggcgcgcgcguucg

SEQ ID NO: 372870 - RNA, 11 nt, Bordetella pertussis
cggcgcgcgcu

SEQ ID NO: 372871 - RNA, 14 nt, Bordetella pertussis
cggcgcgcgcugca

SEQ ID NO: 372872 - RNA, 17 nt, Bordetella pertussis
cggcgcgcgcugcacgg

SEQ ID NO: 372873 - RNA, 20 nt, Bordetella pertussis
cggcgcgcgcugcacggccu

SEQ ID NO: 372874 - RNA, 14 nt, Bordetella pertussis
cggcgcgcggaucg

SEQ ID NO: 372875 - RNA, 14 nt, Bordetella pertussis
cggcgcgcgcgcgc

SEQ ID NO: 372876 - RNA, 15 nt, Bordetella pertussis
cggcgcgcgcggcca

SEQ ID NO: 372877 - RNA, 21 nt, Bordetella pertussis
cggcgcgcgcggccaguucga

SEQ ID NO: 372878 - RNA, 17 nt, Bordetella pertussis
cggcgcgcgcggcgccg

SEQ ID NO: 372879 - RNA, 23 nt, Bordetella pertussis
cggcgcgcggccguguucgagca

SEQ ID NO: 372880 - RNA, 14 nt, Bordetella pertussis
cggcgcgcggcugg

SEQ ID NO: 372881 - RNA, 20 nt, Bordetella pertussis
cggcgcgcggcugggucggc

SEQ ID NO: 372882 - RNA, 12 nt, Bordetella pertussis
cggcgcgcucgg

SEQ ID NO: 372883 - RNA, 17 nt, Bordetella pertussis
cggcgcgcucggccucg

SEQ ID NO: 372884 - RNA, 16 nt, Bordetella pertussis
cggcgcgcucggcgcc

SEQ ID NO: 372885 - RNA, 12 nt, Bordetella pertussis
cggcgcgcggcc

SEQ ID NO: 372886 - RNA, 17 nt, Bordetella pertussis
cggcgcgcgugccgcgc

SEQ ID NO: 372887 - RNA, 21 nt, Bordetella pertussis
cggcgcgcucuccgaacaggc

SEQ ID NO: 372888 - RNA, 14 nt, Bordetella pertussis
cggcgcgcuggacg

SEQ ID NO: 372889 - RNA, 18 nt, Bordetella pertussis
cggcgcgcuuggucagca

SEQ ID NO: 372890 - RNA, 12 nt, Bordetella pertussis
cggcgcggaucg

SEQ ID NO: 372891 - RNA, 19 nt, Bordetella pertussis
cggcgcggaugccguccac

SEQ ID NO: 372892 - RNA, 11 nt, Bordetella pertussis
cggcgcggccg

SEQ ID NO: 372893 - RNA, 17 nt, Bordetella pertussis
cggcgcggccgacgugg

SEQ ID NO: 372894 - RNA, 18 nt, Bordetella pertussis
cggcgcggccgacgugga

SEQ ID NO: 372895 - RNA, 11 nt, Bordetella pertussis
cggcgcggccu

SEQ ID NO: 372896 - RNA, 19 nt, Bordetella pertussis
cggcgcggccuugcaugcg

SEQ ID NO: 372897 - RNA, 13 nt, Bordetella pertussis
cggcgcggcgagc

SEQ ID NO: 372898 - RNA, 20 nt, Bordetella pertussis
cggcgcggcgagcacggccu

SEQ ID NO: 372899 - RNA, 14 nt, Bordetella pertussis
cggcgcggcgaucg

SEQ ID NO: 372900 - RNA, 22 nt, Bordetella pertussis
cggcgcggcgauugcggcccgc

SEQ ID NO: 372901 - RNA, 18 nt, Bordetella pertussis
cggcgcggccagcagcgc

SEQ ID NO: 372902 - RNA, 23 nt, Bordetella pertussis
cggcgcggccagcagcgcgugca

SEQ ID NO: 372903 - RNA, 14 nt, Bordetella pertussis
cggcgcggcccgcc

SEQ ID NO: 372904 - RNA, 15 nt, Bordetella pertussis
cggcgcggcccgcca

SEQ ID NO: 372905 - RNA, 13 nt, Bordetella pertussis
cggcgcggcgcca

SEQ ID NO: 372906 - RNA, 17 nt, Bordetella pertussis
cggcgcggcgccgucca

SEQ ID NO: 372907 - RNA, 17 nt, Bordetella pertussis
cggcgcggcgcgcgccg

SEQ ID NO: 372908 - RNA, 16 nt, Bordetella pertussis
cggcgcggcgcgcugg

SEQ ID NO: 372909 - RNA, 16 nt, Bordetella pertussis
cggcgcggcgggcgcu

SEQ ID NO: 372910 - RNA, 14 nt, Bordetella pertussis
cggcgcggcgggcu

SEQ ID NO: 372911 - RNA, 17 nt, Bordetella pertussis
cggcggcgacucggcau

SEQ ID NO: 372912 - RNA, 16 nt, Bordetella pertussis
cggcggcgagcgcggc

SEQ ID NO: 372913 - RNA, 22 nt, Bordetella pertussis
cggcggcgagcgcggcgcgcgc

SEQ ID NO: 372914 - RNA, 14 nt, Bordetella pertussis
cggcggcgagcugg

SEQ ID NO: 372915 - RNA, 15 nt, Bordetella pertussis
cggcggcgagggcgu

SEQ ID NO: 372916 - RNA, 15 nt, Bordetella pertussis
cggcggcgaucaacg

SEQ ID NO: 372917 - RNA, 16 nt, Bordetella pertussis
cggcggcgaucacgcc

SEQ ID NO: 372918 - RNA, 18 nt, Bordetella pertussis
cggcggcgaugccgcugg

SEQ ID NO: 372919 - RNA, 18 nt, Bordetella pertussis
cggcggcgaugcgggcca

SEQ ID NO: 372920 - RNA, 14 nt, Bordetella pertussis
cggcggcgaugguc

SEQ ID NO: 372921 - RNA, 13 nt, Bordetella pertussis
cggcggcgcauug

SEQ ID NO: 372922 - RNA, 15 nt, Bordetella pertussis
cggcggcggccaucg

SEQ ID NO: 372923 - RNA, 17 nt, Bordetella pertussis
cggcggcgggcggccgg

SEQ ID NO: 372924 - RNA, 19 nt, Bordetella pertussis
cggcggcgggcggccggcg

SEQ ID NO: 372925 - RNA, 18 nt, Bordetella pertussis
cggcggcuucgcgcagca

SEQ ID NO: 372926 - RNA, 16 nt, Bordetella pertussis
cggcgggaacaggcac

SEQ ID NO: 372927 - RNA, 18 nt, Bordetella pertussis
cggcgggaacaggcaccg

SEQ ID NO: 372928 - RNA, 14 nt, Bordetella pertussis
cggcgggacggcca

SEQ ID NO: 372929 - RNA, 15 nt, Bordetella pertussis
cggcgggacggccau

SEQ ID NO: 372930 - RNA, 13 nt, Bordetella pertussis
cggcgggacgcag

SEQ ID NO: 372931 - RNA, 14 nt, Bordetella pertussis
cggcgggacgcagg

SEQ ID NO: 372932 - RNA, 16 nt, Bordetella pertussis
cggcgggaucgggcag

SEQ ID NO: 372933 - RNA, 21 nt, Bordetella pertussis
cggcgggaucgggcagcuugg

SEQ ID NO: 372934 - RNA, 15 nt, Bordetella pertussis
cggcgggcaggcggg

SEQ ID NO: 372935 - RNA, 16 nt, Bordetella pertussis
cggcgggcaggcgggc

SEQ ID NO: 372936 - RNA, 20 nt, Bordetella pertussis
cggcgggcaggcgggccagg

SEQ ID NO: 372937 - RNA, 16 nt, Bordetella pertussis
cggcgggcaugacgac

SEQ ID NO: 372938 - RNA, 16 nt, Bordetella pertussis
cggcgggccccgcagg

SEQ ID NO: 372939 - RNA, 21 nt, Bordetella pertussis
cggcgggccccgcagggcccg

SEQ ID NO: 372940 - RNA, 17 nt, Bordetella pertussis
cggcgggccgcgccccu

SEQ ID NO: 372941 - RNA, 12 nt, Bordetella pertussis
cggcgggccggc

SEQ ID NO: 372942 - RNA, 14 nt, Bordetella pertussis
cggcgggcgccccg

SEQ ID NO: 372943 - RNA, 16 nt, Bordetella pertussis
cggcggguggccucgc

SEQ ID NO: 372944 - RNA, 18 nt, Bordetella pertussis
cggcggguuucucggccu

SEQ ID NO: 372945 - RNA, 23 nt, Bordetella pertussis
cggcggucaauguauuuggcggc

SEQ ID NO: 372946 - RNA, 14 nt, Bordetella pertussis
cggcggucagcgcg

SEQ ID NO: 372947 - RNA, 19 nt, Bordetella pertussis
cggcggucagcgcggcgcc

SEQ ID NO: 372948 - RNA, 21 nt, Bordetella pertussis
cggcggucagcgcggcgccgg

SEQ ID NO: 372949 - RNA, 12 nt, Bordetella pertussis
cggcgguccaca

SEQ ID NO: 372950 - RNA, 18 nt, Bordetella pertussis
cggcgguccacagcccgg

SEQ ID NO: 372951 - RNA, 15 nt, Bordetella pertussis
cggcggucccgagcg

SEQ ID NO: 372952 - RNA, 21 nt, Bordetella pertussis
cggcggucccgagcgcucccg

SEQ ID NO: 372953 - RNA, 15 nt, Bordetella pertussis
cggcggucgcgcugg

SEQ ID NO: 372954 - RNA, 16 nt, Bordetella pertussis
cggcggugaccaccag

SEQ ID NO: 372955 - RNA, 18 nt, Bordetella pertussis
cggcggugaccaccaggc

SEQ ID NO: 372956 - RNA, 20 nt, Bordetella pertussis
cggcggugaccaccaggccg

SEQ ID NO: 372957 - RNA, 21 nt, Bordetella pertussis
cggcggugaccaccaggccgc

SEQ ID NO: 372958 - RNA, 22 nt, Bordetella pertussis
cggcggugaccaccaggccgcc

SEQ ID NO: 372959 - RNA, 23 nt, Bordetella pertussis
cggcggugaucugcucgccgcgc

SEQ ID NO: 372960 - RNA, 19 nt, Bordetella pertussis
cggcggugccagcgcaagg

SEQ ID NO: 372961 - RNA, 15 nt, Bordetella pertussis
cggcggugccgccca

SEQ ID NO: 372962 - RNA, 21 nt, Bordetella pertussis
cggcggugccgcccaccguga

SEQ ID NO: 372963 - RNA, 13 nt, Bordetella pertussis
cggcggugccgcg

SEQ ID NO: 372964 - RNA, 23 nt, Bordetella pertussis
cggcgguucguccucgucggcca

SEQ ID NO: 372965 - RNA, 18 nt, Bordetella pertussis
cggcgguugcccgccccg

SEQ ID NO: 372966 - RNA, 22 nt, Bordetella pertussis
cggcgguuucuuccagcagggc

SEQ ID NO: 372967 - RNA, 15 nt, Bordetella pertussis
cggcguaaggccgcc

SEQ ID NO: 372968 - RNA, 19 nt, Bordetella pertussis
cggcguaaggccgccggcc

SEQ ID NO: 372969 - RNA, 20 nt, Bordetella pertussis
cggcguaaggccgccggcca

SEQ ID NO: 372970 - RNA, 15 nt, Bordetella pertussis
cggcguaccaggcag

SEQ ID NO: 372971 - RNA, 19 nt, Bordetella pertussis
cggcguaccaggcagccgg

SEQ ID NO: 372972 - RNA, 21 nt, Bordetella pertussis
cggcguaccaggcagccggcc

SEQ ID NO: 372973 - RNA, 14 nt, Bordetella pertussis
cggcguacuggcgc

SEQ ID NO: 372974 - RNA, 16 nt, Bordetella pertussis
cggcguacuggcgcgg

SEQ ID NO: 372975 - RNA, 16 nt, Bordetella pertussis
cggcguagagcgccgc

SEQ ID NO: 372976 - RNA, 17 nt, Bordetella pertussis
cggcguagagcgccgcg

SEQ ID NO: 372977 - RNA, 17 nt, Bordetella pertussis
cggcguagccgaucugg

SEQ ID NO: 372978 - RNA, 14 nt, Bordetella pertussis
cggcguagcugcgc

SEQ ID NO: 372979 - RNA, 15 nt, Bordetella pertussis
cggcguagcugcgcc

SEQ ID NO: 372980 - RNA, 16 nt, Bordetella pertussis
cggcguagcugcgccg

SEQ ID NO: 372981 - RNA, 18 nt, Bordetella pertussis
cggcguaguucagccaca

SEQ ID NO: 372982 - RNA, 22 nt, Bordetella pertussis
cggcguaguucagccacacgau

SEQ ID NO: 372983 - RNA, 22 nt, Bordetella pertussis
cggcguagucguugccggccag

SEQ ID NO: 372984 - RNA, 20 nt, Bordetella pertussis
cggcguauggcccgccacca

SEQ ID NO: 372985 - RNA, 21 nt, Bordetella pertussis
cggcguauggcccgccaccac

SEQ ID NO: 372986 - RNA, 23 nt, Bordetella pertussis
cggcguauggcccgccaccacgg

SEQ ID NO: 372987 - RNA, 15 nt, Bordetella pertussis
cggcgucaaugccag

SEQ ID NO: 372988 - RNA, 21 nt, Bordetella pertussis
cggcgucaaugccagucgccg

SEQ ID NO: 372989 - RNA, 22 nt, Bordetella pertussis
cggcgucaaugccagucgccgc

SEQ ID NO: 372990 - RNA, 14 nt, Bordetella pertussis
cggcgucacgcggc

SEQ ID NO: 372991 - RNA, 16 nt, Bordetella pertussis
cggcgucacgcggccg

SEQ ID NO: 372992 - RNA, 21 nt, Bordetella pertussis
cggcgucaccuugggaucguc

SEQ ID NO: 372993 - RNA, 13 nt, Bordetella pertussis
cggcgucggugcc

SEQ ID NO: 372994 - RNA, 21 nt, Bordetella pertussis
cggcgucguccaucgacgcgg

SEQ ID NO: 372995 - RNA, 21 nt, Bordetella pertussis
cggcgucuggaaacuguuggc

SEQ ID NO: 372996 - RNA, 23 nt, Bordetella pertussis
cggcgucuggagcggccuggccc

SEQ ID NO: 372997 - RNA, 20 nt, Bordetella pertussis
cggcgugccauggacgccgg

SEQ ID NO: 372998 - RNA, 16 nt, Bordetella pertussis
cggcgugcccagggcc

SEQ ID NO: 372999 - RNA, 23 nt, Bordetella pertussis
cggcgugcccugcggcgcggcca

SEQ ID NO: 373000 - RNA, 13 nt, Bordetella pertussis
cggcgugcugccc

SEQ ID NO: 373001 - RNA, 17 nt, Bordetella pertussis
cggcgugcgcuggcugg

SEQ ID NO: 373002 - RNA, 17 nt, Bordetella pertussis
cggcgugcggcccagcc

SEQ ID NO: 373003 - RNA, 15 nt, Bordetella pertussis
cggcguggccgugcu

SEQ ID NO: 373004 - RNA, 23 nt, Bordetella pertussis
cggcguggccugcccgucgggca

SEQ ID NO: 373005 - RNA, 13 nt, Bordetella pertussis
cggcguggcgccg

SEQ ID NO: 373006 - RNA, 21 nt, Bordetella pertussis
cggcguggcgccgaaggcggc

SEQ ID NO: 373007 - RNA, 15 nt, Bordetella pertussis
cggcguggcgcgcac

SEQ ID NO: 373008 - RNA, 15 nt, Bordetella pertussis
cggcguggcgcgccc

SEQ ID NO: 373009 - RNA, 14 nt, Bordetella pertussis
cggcguggcggcca

SEQ ID NO: 373010 - RNA, 16 nt, Bordetella pertussis
cggcguggggccggcc

SEQ ID NO: 373011 - RNA, 17 nt, Bordetella pertussis
cggcguggggccggccg

SEQ ID NO: 373012 - RNA, 20 nt, Bordetella pertussis
cggcguggggccggccgcgc

SEQ ID NO: 373013 - RNA, 23 nt, Bordetella pertussis
cggcguggggccggccgcgcgcg

SEQ ID NO: 373014 - RNA, 15 nt, Bordetella pertussis
cggcgugguaucgcg

SEQ ID NO: 373015 - RNA, 21 nt, Bordetella pertussis
cggcgugguaucgcgccagcg

SEQ ID NO: 373016 - RNA, 23 nt, Bordetella pertussis
cggcgugguaucgcgccagcgcc

SEQ ID NO: 373017 - RNA, 16 nt, Bordetella pertussis
cggcguucaccaggaa

SEQ ID NO: 373018 - RNA, 22 nt, Bordetella pertussis
cggcguucaccaggaagcgcgc

SEQ ID NO: 373019 - RNA, 14 nt, Bordetella pertussis
cggcguuccuggcg

SEQ ID NO: 373020 - RNA, 20 nt, Bordetella pertussis
cggcguuccugggcacgccg

SEQ ID NO: 373021 - RNA, 13 nt, Bordetella pertussis
cggcuaccgcgcc

SEQ ID NO: 373022 - RNA, 13 nt, Bordetella pertussis
cggcuacgaccug

SEQ ID NO: 373023 - RNA, 20 nt, Bordetella pertussis
cggcucagccucgagguggc

SEQ ID NO: 373024 - RNA, 13 nt, Bordetella pertussis
cggcucaggccag

SEQ ID NO: 373025 - RNA, 15 nt, Bordetella pertussis
cggcucaggccagcg

SEQ ID NO: 373026 - RNA, 16 nt, Bordetella pertussis
cggcuccgauagcggc

SEQ ID NO: 373027 - RNA, 20 nt, Bordetella pertussis
cggcuccgcuaucauccgcg

SEQ ID NO: 373028 - RNA, 23 nt, Bordetella pertussis
cggcuccgcuaucauccgcgcau

SEQ ID NO: 373029 - RNA, 15 nt, Bordetella pertussis
cggcucgaacaggcu

SEQ ID NO: 373030 - RNA, 18 nt, Bordetella pertussis
cggcucgaacaggcuggc

SEQ ID NO: 373031 - RNA, 19 nt, Bordetella pertussis
cggcucgagcaagggccag

SEQ ID NO: 373032 - RNA, 14 nt, Bordetella pertussis
cggcucgagcggca

SEQ ID NO: 373033 - RNA, 23 nt, Bordetella pertussis
cggcucgaggaaccagccgucgg

SEQ ID NO: 373034 - RNA, 12 nt, Bordetella pertussis
cggcucgacgcc

SEQ ID NO: 373035 - RNA, 22 nt, Bordetella pertussis
cggcucgaugcaauagcgcccg

SEQ ID NO: 373036 - RNA, 13 nt, Bordetella pertussis
cggcucgccgcgc

SEQ ID NO: 373037 - RNA, 14 nt, Bordetella pertussis
cggcucgccggccg

SEQ ID NO: 373038 - RNA, 16 nt, Bordetella pertussis
cggcucgccggccgcg

SEQ ID NO: 373039 - RNA, 20 nt, Bordetella pertussis
cggcucgccggccgcgccca

SEQ ID NO: 373040 - RNA, 23 nt, Bordetella pertussis
cggcucgccggccgcgcccagcg

SEQ ID NO: 373041 - RNA, 14 nt, Bordetella pertussis
cggcucgccgcaua

SEQ ID NO: 373042 - RNA, 21 nt, Bordetella pertussis
cggcucgccuccccaggccag

SEQ ID NO: 373043 - RNA, 18 nt, Bordetella pertussis
cggcucggaccuggccag

SEQ ID NO: 373044 - RNA, 20 nt, Bordetella pertussis
cggcucggaccuggccagcg

SEQ ID NO: 373045 - RNA, 16 nt, Bordetella pertussis
cggcucgggcucgagc

SEQ ID NO: 373046 - RNA, 17 nt, Bordetella pertussis
cggcugcaagacgccca

SEQ ID NO: 373047 - RNA, 19 nt, Bordetella pertussis
cggcugcaagacgcccagg

SEQ ID NO: 373048 - RNA, 17 nt, Bordetella pertussis
cggcugcaccagcgcgc

SEQ ID NO: 373049 - RNA, 15 nt, Bordetella pertussis
cggcuucgcgcagca

SEQ ID NO: 373050 - RNA, 12 nt, Bordetella pertussis
cggcuugaccac

SEQ ID NO: 373051 - RNA, 22 nt, Bordetella pertussis
cggcuugaccacggccagcagc

SEQ ID NO: 373052 - RNA, 19 nt, Bordetella pertussis
cggcuugcacgccggccac

SEQ ID NO: 373053 - RNA, 18 nt, Bordetella pertussis
cggcuugcagcggacggc

SEQ ID NO: 373054 - RNA, 17 nt, Bordetella pertussis
cggcuugcauggugccg

SEQ ID NO: 373055 - RNA, 16 nt, Bordetella pertussis
cggcuugauggcgaug

SEQ ID NO: 373056 - RNA, 13 nt, Bordetella pertussis
cggcuugcgcgcc

SEQ ID NO: 373057 - RNA, 13 nt, Bordetella pertussis
cggcuugcgcggc

SEQ ID NO: 373058 - RNA, 23 nt, Bordetella pertussis
cggcuugcgcguaggcgcgcgca

SEQ ID NO: 373059 - RNA, 20 nt, Bordetella pertussis
cggcuugcgcaagccggccg

SEQ ID NO: 373060 - RNA, 19 nt, Bordetella pertussis
cggcuuggccucggccggc

SEQ ID NO: 373061 - RNA, 14 nt, Bordetella pertussis
cggcuuggcgugcg

SEQ ID NO: 373062 - RNA, 17 nt, Bordetella pertussis
cggcuugggcacacacc

SEQ ID NO: 373063 - RNA, 19 nt, Bordetella pertussis
cgggaaugaugcgcauuau

SEQ ID NO: 373064 - RNA, 20 nt, Bordetella pertussis
cgggaauugggcgagcccag

SEQ ID NO: 373065 - RNA, 14 nt, Bordetella pertussis
cgggacaggcgcca

SEQ ID NO: 373066 - RNA, 14 nt, Bordetella pertussis
cgggaccggcgcgu

SEQ ID NO: 373067 - RNA, 16 nt, Bordetella pertussis
cgggaccuuggcggcu

SEQ ID NO: 373068 - RNA, 18 nt, Bordetella pertussis
cgggacggaaguccugca

SEQ ID NO: 373069 - RNA, 15 nt, Bordetella pertussis
cgggacuggcgagca

SEQ ID NO: 373070 - RNA, 23 nt, Bordetella pertussis
cgggacuuagaaguccaugccgc

SEQ ID NO: 373071 - RNA, 20 nt, Bordetella pertussis
cgggagaucuguaccgccgg

SEQ ID NO: 373072 - RNA, 19 nt, Bordetella pertussis
cgggagccuguccccgccg

SEQ ID NO: 373073 - RNA, 18 nt, Bordetella pertussis
cgggagccuguccccgcg

SEQ ID NO: 373074 - RNA, 15 nt, Bordetella pertussis
cgggagcggccagca

SEQ ID NO: 373075 - RNA, 18 nt, Bordetella pertussis
cgggaggaagggugcggc

SEQ ID NO: 373076 - RNA, 22 nt, Bordetella pertussis
cgggauaggccucggccaccug

SEQ ID NO: 373077 - RNA, 15 nt, Bordetella pertussis
cgggauaguccagca

SEQ ID NO: 373078 - RNA, 16 nt, Bordetella pertussis
cgggauccacgccgcc

SEQ ID NO: 373079 - RNA, 18 nt, Bordetella pertussis
cgggauccacgccgccgg

SEQ ID NO: 373080 - RNA, 21 nt, Bordetella pertussis
cgggauccacgccgccggcca

SEQ ID NO: 373081 - RNA, 18 nt, Bordetella pertussis
cgggaucccgagcgggca

SEQ ID NO: 373082 - RNA, 20 nt, Bordetella pertussis
cgggauccgugcggcgcgca

SEQ ID NO: 373083 - RNA, 24 nt, Bordetella pertussis
cgggauccgugcggcgcgcacggg

SEQ ID NO: 373084 - RNA, 13 nt, Bordetella pertussis
cgggauccggcag

SEQ ID NO: 373085 - RNA, 13 nt, Bordetella pertussis
cgggaucggcguc

SEQ ID NO: 373086 - RNA, 19 nt, Bordetella pertussis
cgggaucggcgucagcgcc

SEQ ID NO: 373087 - RNA, 16 nt, Bordetella pertussis
cgggaugccccgcccg

SEQ ID NO: 373088 - RNA, 15 nt, Bordetella pertussis
cgggaugcugcucgg

SEQ ID NO: 373089 - RNA, 22 nt, Bordetella pertussis
cgggaugggccacccagcucag

SEQ ID NO: 373090 - RNA, 18 nt, Bordetella pertussis
cgggauguccgcgucggc

SEQ ID NO: 373091 - RNA, 14 nt, Bordetella pertussis
cgggcaaagcccag

SEQ ID NO: 373092 - RNA, 16 nt, Bordetella pertussis
cgggcaaagcccagca

SEQ ID NO: 373093 - RNA, 16 nt, Bordetella pertussis
cgggcaacaaggccac

SEQ ID NO: 373094 - RNA, 23 nt, Bordetella pertussis
cgggcaccaucucccgcaggccc

SEQ ID NO: 373095 - RNA, 18 nt, Bordetella pertussis
cgggcaccaugcgcgagg

SEQ ID NO: 373096 - RNA, 19 nt, Bordetella pertussis
cgggcaccgacacgcuggc

SEQ ID NO: 373097 - RNA, 20 nt, Bordetella pertussis
cgggcaccgacacgcuggcg

SEQ ID NO: 373098 - RNA, 15 nt, Bordetella pertussis
cgggcaccgagccgc

SEQ ID NO: 373099 - RNA, 19 nt, Bordetella pertussis
cgggcacgagaucgccugg

SEQ ID NO: 373100 - RNA, 17 nt, Bordetella pertussis
cgggcacgaucaccgcc

SEQ ID NO: 373101 - RNA, 18 nt, Bordetella pertussis
cgggcacgaucaccgccg

SEQ ID NO: 373102 - RNA, 19 nt, Bordetella pertussis
cgggcacgaucaccgccgc

SEQ ID NO: 373103 - RNA, 13 nt, Bordetella pertussis
cgggcagcaccgc

SEQ ID NO: 373104 - RNA, 16 nt, Bordetella pertussis
cgggcagcaccggggc

SEQ ID NO: 373105 - RNA, 17 nt, Bordetella pertussis
cgggcagcacgcgcacc

SEQ ID NO: 373106 - RNA, 21 nt, Bordetella pertussis
cgggcagcacgcgcaccaggc

SEQ ID NO: 373107 - RNA, 18 nt, Bordetella pertussis
cgggcagcagcagggcca

SEQ ID NO: 373108 - RNA, 20 nt, Bordetella pertussis
cgggcagcaggcgcaucagc

SEQ ID NO: 373109 - RNA, 16 nt, Bordetella pertussis
cgggcagcauggcgcc

SEQ ID NO: 373110 - RNA, 15 nt, Bordetella pertussis
cgggcagcccgcgca

SEQ ID NO: 373111 - RNA, 12 nt, Bordetella pertussis
cgggcagcgccc

SEQ ID NO: 373112 - RNA, 13 nt, Bordetella pertussis
cgggcagcgcccg

SEQ ID NO: 373113 - RNA, 20 nt, Bordetella pertussis
cgggcagggugggcacgcgc

SEQ ID NO: 373114 - RNA, 21 nt, Bordetella pertussis
cgggcagggugggcacgcgcu

SEQ ID NO: 373115 - RNA, 18 nt, Bordetella pertussis
cgggcaggucggccagcg

SEQ ID NO: 373116 - RNA, 23 nt, Bordetella pertussis
cgggcaggucggccagcgugccg

SEQ ID NO: 373117 - RNA, 20 nt, Bordetella pertussis
cgggcaggucggcgcggggc

SEQ ID NO: 373118 - RNA, 16 nt, Bordetella pertussis
cgggcagugcgccgga

SEQ ID NO: 373119 - RNA, 17 nt, Bordetella pertussis
cgggcagugcgccggac

SEQ ID NO: 373120 - RNA, 20 nt, Bordetella pertussis
cgggcaguucgggcacgccg

SEQ ID NO: 373121 - RNA, 22 nt, Bordetella pertussis
cgggcaguucgggcacgccguu

SEQ ID NO: 373122 - RNA, 20 nt, Bordetella pertussis
cgggccacccgccgccggcg

SEQ ID NO: 373123 - RNA, 14 nt, Bordetella pertussis
cgggccacgcgccg

SEQ ID NO: 373124 - RNA, 15 nt, Bordetella pertussis
cgggccacgcgccgu

SEQ ID NO: 373125 - RNA, 12 nt, Bordetella pertussis
cgggccagcaga

SEQ ID NO: 373126 - RNA, 20 nt, Bordetella pertussis
cgggccagcagaaugccgcc

SEQ ID NO: 373127 - RNA, 15 nt, Bordetella pertussis
cgggccagccccggc

SEQ ID NO: 373128 - RNA, 22 nt, Bordetella pertussis
cgggccagccccggcgcgccgg

SEQ ID NO: 373129 - RNA, 20 nt, Bordetella pertussis
cgggccagcuccccgggcgu

SEQ ID NO: 373130 - RNA, 12 nt, Bordetella pertussis
cgggccaggccg

SEQ ID NO: 373131 - RNA, 19 nt, Bordetella pertussis
cgggccagguauucggcgg

SEQ ID NO: 373132 - RNA, 21 nt, Bordetella pertussis
cgggccagguauucggcggug

SEQ ID NO: 373133 - RNA, 14 nt, Bordetella pertussis
cgggccaggccgau

SEQ ID NO: 373134 - RNA, 14 nt, Bordetella pertussis
cgggccaggccggc

SEQ ID NO: 373135 - RNA, 15 nt, Bordetella pertussis
cgggccaggccggcc

SEQ ID NO: 373136 - RNA, 17 nt, Bordetella pertussis
cgggccaggccggugga

SEQ ID NO: 373137 - RNA, 18 nt, Bordetella pertussis
cgggccauggaugcgcgc

SEQ ID NO: 373138 - RNA, 15 nt, Bordetella pertussis
cgggccaugucggcu

SEQ ID NO: 373139 - RNA, 18 nt, Bordetella pertussis
cgggccaugucggcuucg

SEQ ID NO: 373140 - RNA, 19 nt, Bordetella pertussis
cgggcccggaucauccggg

SEQ ID NO: 373141 - RNA, 23 nt, Bordetella pertussis
cgggcccggaucauccgggcccg

SEQ ID NO: 373142 - RNA, 19 nt, Bordetella pertussis
cgggcccggccacggccgg

SEQ ID NO: 373143 - RNA, 14 nt, Bordetella pertussis
cgggcccggcgcgc

SEQ ID NO: 373144 - RNA, 15 nt, Bordetella pertussis
cgggcccgucgcgcc

SEQ ID NO: 373145 - RNA, 22 nt, Bordetella pertussis
cgggcccgucgcgccaggccgg

SEQ ID NO: 373146 - RNA, 13 nt, Bordetella pertussis
cgggccgaacaug

SEQ ID NO: 373147 - RNA, 23 nt, Bordetella pertussis
cgggccgaagaucuccucgcgcg

SEQ ID NO: 373148 - RNA, 16 nt, Bordetella pertussis
cgggccgcgcccacag

SEQ ID NO: 373149 - RNA, 21 nt, Bordetella pertussis
cgggccgcgccccuagcgccg

SEQ ID NO: 373150 - RNA, 12 nt, Bordetella pertussis
cgggccgcgccg

SEQ ID NO: 373151 - RNA, 13 nt, Bordetella pertussis
cgggccgcgcgcg

SEQ ID NO: 373152 - RNA, 19 nt, Bordetella pertussis
cgggccgcgcgcgggcgcc

SEQ ID NO: 373153 - RNA, 15 nt, Bordetella pertussis
cgggccgucgccgcg

SEQ ID NO: 373154 - RNA, 19 nt, Bordetella pertussis
cgggccgucgccgcgcggc

SEQ ID NO: 373155 - RNA, 23 nt, Bordetella pertussis
cgggccgucgugcgccuggcggc

SEQ ID NO: 373156 - RNA, 19 nt, Bordetella pertussis
cgggccgucuacaggccca

SEQ ID NO: 373157 - RNA, 22 nt, Bordetella pertussis
cgggccgucuacaggcccagcg

SEQ ID NO: 373158 - RNA, 19 nt, Bordetella pertussis
cgggccuacugggccagau

SEQ ID NO: 373159 - RNA, 21 nt, Bordetella pertussis
cgggccuacuucggcagcuug

SEQ ID NO: 373160 - RNA, 18 nt, Bordetella pertussis
cgggccuacuugccggcg

SEQ ID NO: 373161 - RNA, 12 nt, Bordetella pertussis
cgggccuagccc

SEQ ID NO: 373162 - RNA, 23 nt, Bordetella pertussis
cgggccguggcgauccagggccg

SEQ ID NO: 373163 - RNA, 21 nt, Bordetella pertussis
cgggccucgaagcccggcagg

SEQ ID NO: 373164 - RNA, 15 nt, Bordetella pertussis
cgggccucgaugacc

SEQ ID NO: 373165 - RNA, 18 nt, Bordetella pertussis
cgggccucgaugaccggg

SEQ ID NO: 373166 - RNA, 18 nt, Bordetella pertussis
cgggccugcagcaugacc

SEQ ID NO: 373167 - RNA, 14 nt, Bordetella pertussis
cgggccugcucggc

SEQ ID NO: 373168 - RNA, 17 nt, Bordetella pertussis
cgggccuggccugcgcc

SEQ ID NO: 373169 - RNA, 12 nt, Bordetella pertussis
cgggccuggcgu

SEQ ID NO: 373170 - RNA, 22 nt, Bordetella pertussis
cgggccuggcguucggcaccgg

SEQ ID NO: 373171 - RNA, 21 nt, Bordetella pertussis
cgggccuggcucaggccugca

SEQ ID NO: 373172 - RNA, 21 nt, Bordetella pertussis
cgggccugggcgucgagcggc

SEQ ID NO: 373173 - RNA, 19 nt, Bordetella pertussis
cgggccuggugcccgacgc

SEQ ID NO: 373174 - RNA, 20 nt, Bordetella pertussis
cgggccuuggccagcagcgc

SEQ ID NO: 373175 - RNA, 23 nt, Bordetella pertussis
cgggccuuggccagcagcgcauc

SEQ ID NO: 373176 - RNA, 23 nt, Bordetella pertussis
cgggcguuuuugcguccggcgcg

SEQ ID NO: 373177 - RNA, 18 nt, Bordetella pertussis
cgggcucgcgcgcgcggg

SEQ ID NO: 373178 - RNA, 15 nt, Bordetella pertussis
cgggcucggccacca

SEQ ID NO: 373179 - RNA, 12 nt, Bordetella pertussis
cgggcucggcgc

SEQ ID NO: 373180 - RNA, 22 nt, Bordetella pertussis
cgggcucguauugugcaugcgc

SEQ ID NO: 373181 - RNA, 22 nt, Bordetella pertussis
cgggcugaacauccugaccggc

SEQ ID NO: 373182 - RNA, 15 nt, Bordetella pertussis
cgggcuggccgccug

SEQ ID NO: 373183 - RNA, 19 nt, Bordetella pertussis
cgggcugggccgaggcgcc

SEQ ID NO: 373184 - RNA, 14 nt, Bordetella pertussis
cgggcuggucgcgc

SEQ ID NO: 373185 - RNA, 17 nt, Bordetella pertussis
cgggcuggucgcgccgg

SEQ ID NO: 373186 - RNA, 20 nt, Bordetella pertussis
cgggcuggugcgccgugccc

SEQ ID NO: 373187 - RNA, 22 nt, Bordetella pertussis
cgggcugguggugggcgugccc

SEQ ID NO: 373188 - RNA, 14 nt, Bordetella pertussis
cgggcuguccgcca

SEQ ID NO: 373189 - RNA, 19 nt, Bordetella pertussis
cgggcuguucgcgcagcag

SEQ ID NO: 373190 - RNA, 21 nt, Bordetella pertussis
cgggcuguucgcgcagcaggc

SEQ ID NO: 373191 - RNA, 14 nt, Bordetella pertussis
cgggcuugcugccc

SEQ ID NO: 373192 - RNA, 19 nt, Bordetella pertussis
cgggcuuucggucucgcgc

SEQ ID NO: 373193 - RNA, 20 nt, Bordetella pertussis
cggggaacaggcgcgccagc

SEQ ID NO: 373194 - RNA, 21 nt, Bordetella pertussis
cggggaacaggcgcgccagcc

SEQ ID NO: 373195 - RNA, 22 nt, Bordetella pertussis
cggggaagauguggucggcgcc

SEQ ID NO: 373196 - RNA, 20 nt, Bordetella pertussis
cggggacaggcaccccagca

SEQ ID NO: 373197 - RNA, 17 nt, Bordetella pertussis
cggggacaggcaccgcc

SEQ ID NO: 373198 - RNA, 20 nt, Bordetella pertussis
cggggacaggcaccgccgca

SEQ ID NO: 373199 - RNA, 17 nt, Bordetella pertussis
cggggacaggcaccuug

SEQ ID NO: 373200 - RNA, 14 nt, Bordetella pertussis
cggggacaggcacg

SEQ ID NO: 373201 - RNA, 21 nt, Bordetella pertussis
cggggacaggcgcccgugcgc

SEQ ID NO: 373202 - RNA, 16 nt, Bordetella pertussis
cggggacuggcaccgg

SEQ ID NO: 373203 - RNA, 20 nt, Bordetella pertussis
cggggacuggcacgcgcuga

SEQ ID NO: 373204 - RNA, 16 nt, Bordetella pertussis
cggggaggccucgacg

SEQ ID NO: 373205 - RNA, 15 nt, Bordetella pertussis
cggggaucaccagcc

SEQ ID NO: 373206 - RNA, 17 nt, Bordetella pertussis
cggggaucaccagcccg

SEQ ID NO: 373207 - RNA, 18 nt, Bordetella pertussis
cggggaucaccagcccgg

SEQ ID NO: 373208 - RNA, 21 nt, Bordetella pertussis
cggggcaacgacgcaggcgcc

SEQ ID NO: 373209 - RNA, 22 nt, Bordetella pertussis
cggggcaacgacgcaggcgccg

SEQ ID NO: 373210 - RNA, 16 nt, Bordetella pertussis
cggggcacccaggcgg

SEQ ID NO: 373211 - RNA, 23 nt, Bordetella pertussis
cggggcagcgaauacggcaagca

SEQ ID NO: 373212 - RNA, 20 nt, Bordetella pertussis
cggggcaggaagccggcccg

SEQ ID NO: 373213 - RNA, 19 nt, Bordetella pertussis
cggggcagggcgccugcag

SEQ ID NO: 373214 - RNA, 22 nt, Bordetella pertussis
cggggcaucaauagcccgugcg

SEQ ID NO: 373215 - RNA, 14 nt, Bordetella pertussis
cggggcaggccgau

SEQ ID NO: 373216 - RNA, 22 nt, Bordetella pertussis
cggggccacauggucgcccagc

SEQ ID NO: 373217 - RNA, 14 nt, Bordetella pertussis
cggggccaggcgca

SEQ ID NO: 373218 - RNA, 13 nt, Bordetella pertussis
cggggccgcagcu

SEQ ID NO: 373219 - RNA, 18 nt, Bordetella pertussis
cggggccgccaacgccaa

SEQ ID NO: 373220 - RNA, 12 nt, Bordetella pertussis
cggggccgccca

SEQ ID NO: 373221 - RNA, 13 nt, Bordetella pertussis
cggggccgcgccg

SEQ ID NO: 373222 - RNA, 16 nt, Bordetella pertussis
cggggccgcgccggcu

SEQ ID NO: 373223 - RNA, 15 nt, Bordetella pertussis
cggggcgcaccggca

SEQ ID NO: 373224 - RNA, 15 nt, Bordetella pertussis
cggggcgcucgagcg

SEQ ID NO: 373225 - RNA, 16 nt, Bordetella pertussis
cggggcggcaggucgc

SEQ ID NO: 373226 - RNA, 15 nt, Bordetella pertussis
cggggcggcgcagca

SEQ ID NO: 373227 - RNA, 17 nt, Bordetella pertussis
cggggcggcggcgcccg

SEQ ID NO: 373228 - RNA, 13 nt, Bordetella pertussis
cggggcugucgag

SEQ ID NO: 373229 - RNA, 23 nt, Bordetella pertussis
cgggggaccuucguucgaagucc

SEQ ID NO: 373230 - RNA, 14 nt, Bordetella pertussis
cgggggcaggcacg

SEQ ID NO: 373231 - RNA, 14 nt, Bordetella pertussis
cgggggcaggccgc

SEQ ID NO: 373232 - RNA, 14 nt, Bordetella pertussis
cgggggcggguuca

SEQ ID NO: 373233 - RNA, 15 nt, Bordetella pertussis
cggggucagcgccgg

SEQ ID NO: 373234 - RNA, 17 nt, Bordetella pertussis
cggggucaauccgcccg

SEQ ID NO: 373235 - RNA, 22 nt, Bordetella pertussis
cgggguccugaggccaggccgg

SEQ ID NO: 373236 - RNA, 14 nt, Bordetella pertussis
cgggguggccggcg

SEQ ID NO: 373237 - RNA, 15 nt, Bordetella pertussis
cgggguggccggcgc

SEQ ID NO: 373238 - RNA, 16 nt, Bordetella pertussis
cgggguggccggcgcg

SEQ ID NO: 373239 - RNA, 13 nt, Bordetella pertussis
cgggguggcgucg

SEQ ID NO: 373240 - RNA, 20 nt, Bordetella pertussis
cgggucagccuugcuccggc

SEQ ID NO: 373241 - RNA, 21 nt, Bordetella pertussis
cgggucagccuugcuccggcg

SEQ ID NO: 373242 - RNA, 16 nt, Bordetella pertussis
cgggucaggcugcggc

SEQ ID NO: 373243 - RNA, 23 nt, Bordetella pertussis
cggguccggccgcgcaaggcggc

SEQ ID NO: 373244 - RNA, 19 nt, Bordetella pertussis
cggguccggcgugccaugg

SEQ ID NO: 373245 - RNA, 23 nt, Bordetella pertussis
cgggucgaucgucuugaccagca

SEQ ID NO: 373246 - RNA, 20 nt, Bordetella pertussis
cgggugaucaguccgacgac

SEQ ID NO: 373247 - RNA, 14 nt, Bordetella pertussis
cgggugccaguccc

SEQ ID NO: 373248 - RNA, 15 nt, Bordetella pertussis
cgggugccagucccc

SEQ ID NO: 373249 - RNA, 20 nt, Bordetella pertussis
cgggugcgccugcagcgccg

SEQ ID NO: 373250 - RNA, 22 nt, Bordetella pertussis
cgggugcgccugcagcgccgcc

SEQ ID NO: 373251 - RNA, 21 nt, Bordetella pertussis
cgggugcgggcaaacggcggc

SEQ ID NO: 373252 - RNA, 14 nt, Bordetella pertussis
cgggugcugcagcg

SEQ ID NO: 373253 - RNA, 12 nt, Bordetella pertussis
cggguggccgcu

SEQ ID NO: 373254 - RNA, 21 nt, Bordetella pertussis
cggguggccgcuccagagcgc

SEQ ID NO: 373255 - RNA, 15 nt, Bordetella pertussis
cggguggccggaucg

SEQ ID NO: 373256 - RNA, 14 nt, Bordetella pertussis
cggguggcggcggg

SEQ ID NO: 373257 - RNA, 22 nt, Bordetella pertussis
cggguguggggggucaggccgu

SEQ ID NO: 373258 - RNA, 22 nt, Bordetella pertussis
cggguuggucgucagcgccgcg

SEQ ID NO: 373259 - RNA, 17 nt, Bordetella pertussis
cggguugugcccgcccg

SEQ ID NO: 373260 - RNA, 22 nt, Bordetella pertussis
cggguuuuccuuuugcgcggcc

SEQ ID NO: 373261 - RNA, 20 nt, Bordetella pertussis
cggguuuuuuuuggcguacg

SEQ ID NO: 373262 - RNA, 16 nt, Bordetella pertussis
cgguaaagaccuuggg

SEQ ID NO: 373263 - RNA, 19 nt, Bordetella pertussis
cgguaagcguccgcgcgcc

SEQ ID NO: 373264 - RNA, 17 nt, Bordetella pertussis
cgguaaggcgcuugcgc

SEQ ID NO: 373265 - RNA, 20 nt, Bordetella pertussis
cgguaaggcgcuugcgcagg

SEQ ID NO: 373266 - RNA, 17 nt, Bordetella pertussis
cgguacagccaggccag

SEQ ID NO: 373267 - RNA, 18 nt, Bordetella pertussis
cgguacagccaggccagc

SEQ ID NO: 373268 - RNA, 14 nt, Bordetella pertussis
cgguacaggcugcc

SEQ ID NO: 373269 - RNA, 22 nt, Bordetella pertussis
cgguaccaggccgagaugugcg

SEQ ID NO: 373270 - RNA, 15 nt, Bordetella pertussis
cgguagccggcgugg

SEQ ID NO: 373271 - RNA, 20 nt, Bordetella pertussis
cgguagccgggucuggccgg

SEQ ID NO: 373272 - RNA, 16 nt, Bordetella pertussis
cgguaggacggcagca

SEQ ID NO: 373273 - RNA, 16 nt, Bordetella pertussis
cgguaggccacgcgcg

SEQ ID NO: 373274 - RNA, 19 nt, Bordetella pertussis
cggucagcacuugccggcc

SEQ ID NO: 373275 - RNA, 13 nt, Bordetella pertussis
cggucagcagggc

SEQ ID NO: 373276 - RNA, 16 nt, Bordetella pertussis
cggucagcagggcgcc

SEQ ID NO: 373277 - RNA, 18 nt, Bordetella pertussis
cggucagcagggcgccga

SEQ ID NO: 373278 - RNA, 17 nt, Bordetella pertussis
cggucagcccaggcggg

SEQ ID NO: 373279 - RNA, 18 nt, Bordetella pertussis
cggucagcccaggcgggc

SEQ ID NO: 373280 - RNA, 15 nt, Bordetella pertussis
cggucagcgccaggg

SEQ ID NO: 373281 - RNA, 14 nt, Bordetella pertussis
cggucagcucaaga

SEQ ID NO: 373282 - RNA, 23 nt, Bordetella pertussis
cggucagcugcuguuggccuucg

SEQ ID NO: 373283 - RNA, 19 nt, Bordetella pertussis
cggucagcuggaacgcgcc

SEQ ID NO: 373284 - RNA, 17 nt, Bordetella pertussis
cggucagcucgucgccg

SEQ ID NO: 373285 - RNA, 16 nt, Bordetella pertussis
cggucagcuugccgcc

SEQ ID NO: 373286 - RNA, 21 nt, Bordetella pertussis
cggucaggaugcgcgccaggc

SEQ ID NO: 373287 - RNA, 19 nt, Bordetella pertussis
cggucaggcgucguuggcc

SEQ ID NO: 373288 - RNA, 13 nt, Bordetella pertussis
cggucagggaggc

SEQ ID NO: 373289 - RNA, 13 nt, Bordetella pertussis
cggucaggggcag

SEQ ID NO: 373290 - RNA, 15 nt, Bordetella pertussis
cggucagucgggacg

SEQ ID NO: 373291 - RNA, 14 nt, Bordetella pertussis
cggucauagacggc

SEQ ID NO: 373292 - RNA, 18 nt, Bordetella pertussis
cggucauagacggcgucg

SEQ ID NO: 373293 - RNA, 13 nt, Bordetella pertussis
cggucaucggcga

SEQ ID NO: 373294 - RNA, 20 nt, Bordetella pertussis
cggucaugccgaacagcaug

SEQ ID NO: 373295 - RNA, 20 nt, Bordetella pertussis
cggucaugcccaugccgcca

SEQ ID NO: 373296 - RNA, 18 nt, Bordetella pertussis
cggucauguccagcgcca

SEQ ID NO: 373297 - RNA, 14 nt, Bordetella pertussis
cgguccacagcccg

SEQ ID NO: 373298 - RNA, 15 nt, Bordetella pertussis
cgguccacagcccgg

SEQ ID NO: 373299 - RNA, 15 nt, Bordetella pertussis
cgguccacgcgggca

SEQ ID NO: 373300 - RNA, 19 nt, Bordetella pertussis
cgguccacgcgggcaucgg

SEQ ID NO: 373301 - RNA, 16 nt, Bordetella pertussis
cgguccagcaccaggg

SEQ ID NO: 373302 - RNA, 20 nt, Bordetella pertussis
cgguccagcaccagggcgcg

SEQ ID NO: 373303 - RNA, 16 nt, Bordetella pertussis
cgguccagcacggcga

SEQ ID NO: 373304 - RNA, 17 nt, Bordetella pertussis
cgguccagcugcgcgcg

SEQ ID NO: 373305 - RNA, 18 nt, Bordetella pertussis
cgguccagcugcgcgcga

SEQ ID NO: 373306 - RNA, 23 nt, Bordetella pertussis
cgguccagcugcgcgcgagcggc

SEQ ID NO: 373307 - RNA, 14 nt, Bordetella pertussis
cgguccaggcggcc

SEQ ID NO: 373308 - RNA, 17 nt, Bordetella pertussis
cgguccaggcggccgcg

SEQ ID NO: 373309 - RNA, 23 nt, Bordetella pertussis
cgguccaugcgaaagcggccagc

SEQ ID NO: 373310 - RNA, 23 nt, Bordetella pertussis
cgguccgcagcgcucgcacggca

SEQ ID NO: 373311 - RNA, 16 nt, Bordetella pertussis
cgguccgcucgaggcc

SEQ ID NO: 373312 - RNA, 19 nt, Bordetella pertussis
cgguccgcucgaggccagg

SEQ ID NO: 373313 - RNA, 13 nt, Bordetella pertussis
cgguccgccucgc

SEQ ID NO: 373314 - RNA, 18 nt, Bordetella pertussis
cgguccggggcgggcgcg

SEQ ID NO: 373315 - RNA, 16 nt, Bordetella pertussis
cgguccguacgccacu

SEQ ID NO: 373316 - RNA, 13 nt, Bordetella pertussis
cgguccugcugau

SEQ ID NO: 373317 - RNA, 22 nt, Bordetella pertussis
cggucgaagaucuucggcaugu

SEQ ID NO: 373318 - RNA, 12 nt, Bordetella pertussis
cggucgacaccg

SEQ ID NO: 373319 - RNA, 16 nt, Bordetella pertussis
cggucgacaccgugaa

SEQ ID NO: 373320 - RNA, 20 nt, Bordetella pertussis
cggucgacauacgcgaugcc

SEQ ID NO: 373321 - RNA, 18 nt, Bordetella pertussis
cggucgacccucagcccg

SEQ ID NO: 373322 - RNA, 22 nt, Bordetella pertussis
cggucgacccucagcccgcacc

SEQ ID NO: 373323 - RNA, 18 nt, Bordetella pertussis
cggucgagacgauggccg

SEQ ID NO: 373324 - RNA, 20 nt, Bordetella pertussis
cggucgagacgauggccgaa

SEQ ID NO: 373325 - RNA, 18 nt, Bordetella pertussis
cggucgaggcgcagucca

SEQ ID NO: 373326 - RNA, 22 nt, Bordetella pertussis
cggucgaguagaaguaggcggc

SEQ ID NO: 373327 - RNA, 15 nt, Bordetella pertussis
cggucgaugaccagc

SEQ ID NO: 373328 - RNA, 16 nt, Bordetella pertussis
cggucgaugaccagcc

SEQ ID NO: 373329 - RNA, 18 nt, Bordetella pertussis
cggucgcauuggccgccg

SEQ ID NO: 373330 - RNA, 18 nt, Bordetella pertussis
cggucgcccaacccggcg

SEQ ID NO: 373331 - RNA, 22 nt, Bordetella pertussis
cggucgcccaacccggcgaggc

SEQ ID NO: 373332 - RNA, 13 nt, Bordetella pertussis
cggucgcccgccg

SEQ ID NO: 373333 - RNA, 22 nt, Bordetella pertussis
cggucgccgcggucgcagacga

SEQ ID NO: 373334 - RNA, 15 nt, Bordetella pertussis
cggucgccggcaugu

SEQ ID NO: 373335 - RNA, 18 nt, Bordetella pertussis
cggucgccguccaggcgc

SEQ ID NO: 373336 - RNA, 20 nt, Bordetella pertussis
cggucgccguccaggcgccg

SEQ ID NO: 373337 - RNA, 19 nt, Bordetella pertussis
cggucgccuguaucagcgc

SEQ ID NO: 373338 - RNA, 21 nt, Bordetella pertussis
cggucgccuguaucagcgccu

SEQ ID NO: 373339 - RNA, 17 nt, Bordetella pertussis
cggucgcgcgugcaggc

SEQ ID NO: 373340 - RNA, 19 nt, Bordetella pertussis
cggucgcgcgugcaggccg

SEQ ID NO: 373341 - RNA, 16 nt, Bordetella pertussis
cggucgcgcuggcccg

SEQ ID NO: 373342 - RNA, 20 nt, Bordetella pertussis
cggucgcgcuggcccgcgcg

SEQ ID NO: 373343 - RNA, 17 nt, Bordetella pertussis
cggucgcuuccagcgca

SEQ ID NO: 373344 - RNA, 18 nt, Bordetella pertussis
cggucggaaacacgucca

SEQ ID NO: 373345 - RNA, 13 nt, Bordetella pertussis
cggucggccggca

SEQ ID NO: 373346 - RNA, 14 nt, Bordetella pertussis
cggucggccggcag

SEQ ID NO: 373347 - RNA, 16 nt, Bordetella pertussis
cggucggccggcagcg

SEQ ID NO: 373348 - RNA, 19 nt, Bordetella pertussis
cggucggccggcagcggcg

SEQ ID NO: 373349 - RNA, 19 nt, Bordetella pertussis
cggucggugcaaugcccag

SEQ ID NO: 373350 - RNA, 21 nt, Bordetella pertussis
cggucggugcaaugcccaguu

SEQ ID NO: 373351 - RNA, 22 nt, Bordetella pertussis
cggucguccucgaugacgacga

SEQ ID NO: 373352 - RNA, 13 nt, Bordetella pertussis
cggucguggccag

SEQ ID NO: 373353 - RNA, 14 nt, Bordetella pertussis
cggucguggccagc

SEQ ID NO: 373354 - RNA, 13 nt, Bordetella pertussis
cggucguggucga

SEQ ID NO: 373355 - RNA, 15 nt, Bordetella pertussis
cggucguggucgaca

SEQ ID NO: 373356 - RNA, 19 nt, Bordetella pertussis
cggucguuccagaacggcg

SEQ ID NO: 373357 - RNA, 19 nt, Bordetella pertussis
cggucuccagcgcgucggc

SEQ ID NO: 373358 - RNA, 23 nt, Bordetella pertussis
cggucuccagcgcgucggccagg

SEQ ID NO: 373359 - RNA, 15 nt, Bordetella pertussis
cggucucgcgcggcc

SEQ ID NO: 373360 - RNA, 14 nt, Bordetella pertussis
cggucucgugcgug

SEQ ID NO: 373361 - RNA, 15 nt, Bordetella pertussis
cggucucgugcgugc

SEQ ID NO: 373362 - RNA, 17 nt, Bordetella pertussis
cggucucgugcgugcgg

SEQ ID NO: 373363 - RNA, 18 nt, Bordetella pertussis
cggucugcaccugcgugg

SEQ ID NO: 373364 - RNA, 15 nt, Bordetella pertussis
cggucugcacgccgg

SEQ ID NO: 373365 - RNA, 17 nt, Bordetella pertussis
cggucugcacgccgggc

SEQ ID NO: 373366 - RNA, 13 nt, Bordetella pertussis
cggucugcgugcg

SEQ ID NO: 373367 - RNA, 14 nt, Bordetella pertussis
cggucugcgugcgc

SEQ ID NO: 373368 - RNA, 18 nt, Bordetella pertussis
cggucugcgugcgcggcg

SEQ ID NO: 373369 - RNA, 21 nt, Bordetella pertussis
cggucugcuucauccaggcgc

SEQ ID NO: 373370 - RNA, 22 nt, Bordetella pertussis
cggucugcuucauccaggcgcu

SEQ ID NO: 373371 - RNA, 20 nt, Bordetella pertussis
cggucuggcccacgcgcacg

SEQ ID NO: 373372 - RNA, 15 nt, Bordetella pertussis
cggucuggcgcgaca

SEQ ID NO: 373373 - RNA, 19 nt, Bordetella pertussis
cggucugggcgucccaggc

SEQ ID NO: 373374 - RNA, 23 nt, Bordetella pertussis
cggucugggcgucccaggccacg

SEQ ID NO: 373375 - RNA, 22 nt, Bordetella pertussis
cggucuucgaugcuggcgcgga

SEQ ID NO: 373376 - RNA, 23 nt, Bordetella pertussis
cggugaacaccaggguggcgccg

SEQ ID NO: 373377 - RNA, 17 nt, Bordetella pertussis
cggugaccaccaggccg

SEQ ID NO: 373378 - RNA, 20 nt, Bordetella pertussis
cggugaccaccaggccgccu

SEQ ID NO: 373379 - RNA, 15 nt, Bordetella pertussis
cggugaccaugcgca

SEQ ID NO: 373380 - RNA, 20 nt, Bordetella pertussis
cggugaccgccagcaggcgc

SEQ ID NO: 373381 - RNA, 18 nt, Bordetella pertussis
cgguggucugccagucca

SEQ ID NO: 373382 - RNA, 19 nt, Bordetella pertussis
cgguggugaccacggcgcg

SEQ ID NO: 373383 - RNA, 13 nt, Bordetella pertussis
cgguguagcugcc

SEQ ID NO: 373384 - RNA, 21 nt, Bordetella pertussis
cgguguaggcgggcagcggcg

SEQ ID NO: 373385 - RNA, 13 nt, Bordetella pertussis
cggugucgccgug

SEQ ID NO: 373386 - RNA, 22 nt, Bordetella pertussis
cggugucggggccgggccggcg

SEQ ID NO: 373387 - RNA, 14 nt, Bordetella pertussis
cgguguucgcgucg

SEQ ID NO: 373388 - RNA, 18 nt, Bordetella pertussis
cgguguucgcgucgucgu

SEQ ID NO: 373389 - RNA, 21 nt, Bordetella pertussis
cgguguucgagccggacgugg

SEQ ID NO: 373390 - RNA, 21 nt, Bordetella pertussis
cgguguugaccaccacgcugg

SEQ ID NO: 373391 - RNA, 13 nt, Bordetella pertussis
cgguguugcucca

SEQ ID NO: 373392 - RNA, 15 nt, Bordetella pertussis
cgguguugcucgugc

SEQ ID NO: 373393 - RNA, 18 nt, Bordetella pertussis
cgguucaggccccggccg

SEQ ID NO: 373394 - RNA, 20 nt, Bordetella pertussis
cgguucaggccccggccggu

SEQ ID NO: 373395 - RNA, 18 nt, Bordetella pertussis
cgguucaggguggccgcg

SEQ ID NO: 373396 - RNA, 12 nt, Bordetella pertussis
cgguucaucgcc

SEQ ID NO: 373397 - RNA, 14 nt, Bordetella pertussis
cgguugagcgccag

SEQ ID NO: 373398 - RNA, 21 nt, Bordetella pertussis
cgguugcagcgcgccaggcgc

SEQ ID NO: 373399 - RNA, 19 nt, Bordetella pertussis
cgguugcccgccccgugca

SEQ ID NO: 373400 - RNA, 15 nt, Bordetella pertussis
cgguugcgaggcggc

SEQ ID NO: 373401 - RNA, 13 nt, Bordetella pertussis
cgguugcgccagc

SEQ ID NO: 373402 - RNA, 22 nt, Bordetella pertussis
cgguugcgccagcuugcgcgcc

SEQ ID NO: 373403 - RNA, 18 nt, Bordetella pertussis
cgguugcgguucugggcc

SEQ ID NO: 373404 - RNA, 19 nt, Bordetella pertussis
cgguugcgucucggccugu

SEQ ID NO: 373405 - RNA, 12 nt, Bordetella pertussis
cgguuggcgccu

SEQ ID NO: 373406 - RNA, 21 nt, Bordetella pertussis
cgguuggcgccuuccggcagc

SEQ ID NO: 373407 - RNA, 22 nt, Bordetella pertussis
cgguuguugcccaccgccagga

SEQ ID NO: 373408 - RNA, 14 nt, Bordetella pertussis
cguaaccggccagu

SEQ ID NO: 373409 - RNA, 23 nt, Bordetella pertussis
cguaagcaggucugcacgaggcg

SEQ ID NO: 373410 - RNA, 19 nt, Bordetella pertussis
cguaagcgcuggacgcccu

SEQ ID NO: 373411 - RNA, 13 nt, Bordetella pertussis
cguaaggccgccg

SEQ ID NO: 373412 - RNA, 17 nt, Bordetella pertussis
cguaaggccgccggcca

SEQ ID NO: 373413 - RNA, 20 nt, Bordetella pertussis
cguaaggccgccggccacca

SEQ ID NO: 373414 - RNA, 24 nt, Bordetella pertussis
cguaaggcugcagcuugcgcgcca

SEQ ID NO: 373415 - RNA, 16 nt, Bordetella pertussis
cguaaguggcggcggg

SEQ ID NO: 373416 - RNA, 13 nt, Bordetella pertussis
cguaagugcccag

SEQ ID NO: 373417 - RNA, 18 nt, Bordetella pertussis
cguaagugcccaggcccg

SEQ ID NO: 373418 - RNA, 22 nt, Bordetella pertussis
cguaauaguggucgccggcgca

SEQ ID NO: 373419 - RNA, 19 nt, Bordetella pertussis
cguaccugcagcaggcgca

SEQ ID NO: 373420 - RNA, 14 nt, Bordetella pertussis
cguacgaccgcagg

SEQ ID NO: 373421 - RNA, 18 nt, Bordetella pertussis
cguacgaggaccuguggc

SEQ ID NO: 373422 - RNA, 21 nt, Bordetella pertussis
cguacgagugcaggcccgaca

SEQ ID NO: 373423 - RNA, 15 nt, Bordetella pertussis
cguacgauagcggau

SEQ ID NO: 373424 - RNA, 15 nt, Bordetella pertussis
cguacgcccggccgc

SEQ ID NO: 373425 - RNA, 17 nt, Bordetella pertussis
cguacgcccggccgccu

SEQ ID NO: 373426 - RNA, 22 nt, Bordetella pertussis
cguacgaagcaaacaggcugcu

SEQ ID NO: 373427 - RNA, 19 nt, Bordetella pertussis
cguacgcggcgcccgcgca

SEQ ID NO: 373428 - RNA, 19 nt, Bordetella pertussis
cguacgcgugggcggcggc

SEQ ID NO: 373429 - RNA, 12 nt, Bordetella pertussis
cguacggcgucg

SEQ ID NO: 373430 - RNA, 19 nt, Bordetella pertussis
cguacguaccaggccgucg

SEQ ID NO: 373431 - RNA, 19 nt, Bordetella pertussis
cguacgucaaggccugccc

SEQ ID NO: 373432 - RNA, 18 nt, Bordetella pertussis
cguacucgaucgccauga

SEQ ID NO: 373433 - RNA, 14 nt, Bordetella pertussis
cguacucgccgucg

SEQ ID NO: 373434 - RNA, 16 nt, Bordetella pertussis
cguacugccauggccc

SEQ ID NO: 373435 - RNA, 19 nt, Bordetella pertussis
cguagagcagugugccugu

SEQ ID NO: 373436 - RNA, 22 nt, Bordetella pertussis
cguagagcgccgcgugguggcg

SEQ ID NO: 373437 - RNA, 22 nt, Bordetella pertussis
cguagagggucuggcggccggu

SEQ ID NO: 373438 - RNA, 15 nt, Bordetella pertussis
cguagaguucgcugc

SEQ ID NO: 373439 - RNA, 20 nt, Bordetella pertussis
cguagauccaggcggccacc

SEQ ID NO: 373440 - RNA, 20 nt, Bordetella pertussis
cguagccgcugcgcgcggcc

SEQ ID NO: 373441 - RNA, 22 nt, Bordetella pertussis
cguagccgcugcgcgcggccug

SEQ ID NO: 373442 - RNA, 23 nt, Bordetella pertussis
cguagccgguaucgcggcgcagg

SEQ ID NO: 373443 - RNA, 14 nt, Bordetella pertussis
cguagccggugcgc

SEQ ID NO: 373444 - RNA, 16 nt, Bordetella pertussis
cguagccggugcgcag

SEQ ID NO: 373445 - RNA, 18 nt, Bordetella pertussis
cguagccggugcgcagca

SEQ ID NO: 373446 - RNA, 14 nt, Bordetella pertussis
cguagccguccucg

SEQ ID NO: 373447 - RNA, 12 nt, Bordetella pertussis
cguagcgcacga

SEQ ID NO: 373448 - RNA, 14 nt, Bordetella pertussis
cguagcgcaggcgc

SEQ ID NO: 373449 - RNA, 11 nt, Bordetella pertussis
cguagcgcugc

SEQ ID NO: 373450 - RNA, 16 nt, Bordetella pertussis
cguagcgcggccgggu

SEQ ID NO: 373451 - RNA, 23 nt, Bordetella pertussis
cguagcguuggcggccggccagc

SEQ ID NO: 373452 - RNA, 17 nt, Bordetella pertussis
cguagcguucgccgucg

SEQ ID NO: 373453 - RNA, 18 nt, Bordetella pertussis
cguagcguucgccgucga

SEQ ID NO: 373454 - RNA, 15 nt, Bordetella pertussis
cguagcugcgccgca

SEQ ID NO: 373455 - RNA, 12 nt, Bordetella pertussis
cguaggcgcgcg

SEQ ID NO: 373456 - RNA, 14 nt, Bordetella pertussis
cguaggcgcgcgca

SEQ ID NO: 373457 - RNA, 15 nt, Bordetella pertussis
cguaggcggcccagg

SEQ ID NO: 373458 - RNA, 18 nt, Bordetella pertussis
cguagggcacaucggcca

SEQ ID NO: 373459 - RNA, 18 nt, Bordetella pertussis
cguaggguucgccgcugu

SEQ ID NO: 373460 - RNA, 15 nt, Bordetella pertussis
cguaggucaggccca

SEQ ID NO: 373461 - RNA, 15 nt, Bordetella pertussis
cguauggcggcgccg

SEQ ID NO: 373462 - RNA, 18 nt, Bordetella pertussis
cguauugcugcugcuggc

SEQ ID NO: 373463 - RNA, 15 nt, Bordetella pertussis
cgucaacgcccaggu

SEQ ID NO: 373464 - RNA, 17 nt, Bordetella pertussis
cgucaccagcaggcggc

SEQ ID NO: 373465 - RNA, 18 nt, Bordetella pertussis
cgucaccagcaggcggcc

SEQ ID NO: 373466 - RNA, 17 nt, Bordetella pertussis
cgucaccaucgccgcgu

SEQ ID NO: 373467 - RNA, 16 nt, Bordetella pertussis
cgucaccccgcccugc

SEQ ID NO: 373468 - RNA, 21 nt, Bordetella pertussis
cgucaccccgcccugcccggc

SEQ ID NO: 373469 - RNA, 22 nt, Bordetella pertussis
cgucaccccgcccugcccggcg

SEQ ID NO: 373470 - RNA, 16 nt, Bordetella pertussis
cgucaccgacgccagc

SEQ ID NO: 373471 - RNA, 19 nt, Bordetella pertussis
cgucaccgccgccgcgccg

SEQ ID NO: 373472 - RNA, 14 nt, Bordetella pertussis
cgucacgcacagca

SEQ ID NO: 373473 - RNA, 18 nt, Bordetella pertussis
cgucacgcacagcaccug

SEQ ID NO: 373474 - RNA, 14 nt, Bordetella pertussis
cgucacgcugaacu

SEQ ID NO: 373475 - RNA, 15 nt, Bordetella pertussis
cgucacgcgcaaggc

SEQ ID NO: 373476 - RNA, 13 nt, Bordetella pertussis
cgucagacgcgcu

SEQ ID NO: 373477 - RNA, 16 nt, Bordetella pertussis
cgucagcacaucgccc

SEQ ID NO: 373478 - RNA, 20 nt, Bordetella pertussis
cgucagagcccuucgacgcg

SEQ ID NO: 373479 - RNA, 14 nt, Bordetella pertussis
cgucagcacggucg

SEQ ID NO: 373480 - RNA, 14 nt, Bordetella pertussis
cgucagcagcgcgg

SEQ ID NO: 373481 - RNA, 22 nt, Bordetella pertussis
cgucagcaugccguuggagccg

SEQ ID NO: 373482 - RNA, 18 nt, Bordetella pertussis
cgucaggcgagcgcggcg

SEQ ID NO: 373483 - RNA, 13 nt, Bordetella pertussis
cgucagggccgca

SEQ ID NO: 373484 - RNA, 14 nt, Bordetella pertussis
cgucagggccgcag

SEQ ID NO: 373485 - RNA, 16 nt, Bordetella pertussis
cgucagggccgcagca

SEQ ID NO: 373486 - RNA, 19 nt, Bordetella pertussis
cgucagggccgcagcaccu

SEQ ID NO: 373487 - RNA, 23 nt, Bordetella pertussis
cgucaggcugggagagccggcca

SEQ ID NO: 373488 - RNA, 18 nt, Bordetella pertussis
cgucaggggcaugccggc

SEQ ID NO: 373489 - RNA, 13 nt, Bordetella pertussis
cgucaggguacgc

SEQ ID NO: 373490 - RNA, 19 nt, Bordetella pertussis
cgucaggguacgcucgacg

SEQ ID NO: 373491 - RNA, 21 nt, Bordetella pertussis
cgucauccugggcgcgcgcca

SEQ ID NO: 373492 - RNA, 16 nt, Bordetella pertussis
cgucaucggcgcgcag

SEQ ID NO: 373493 - RNA, 19 nt, Bordetella pertussis
cgucaucgggugcggcgcc

SEQ ID NO: 373494 - RNA, 19 nt, Bordetella pertussis
cgucaucguggccgcgcaa

SEQ ID NO: 373495 - RNA, 21 nt, Bordetella pertussis
cgucaugaacgucaccccgcc

SEQ ID NO: 373496 - RNA, 21 nt, Bordetella pertussis
cgucaugcgcaccuugucgcg

SEQ ID NO: 373497 - RNA, 18 nt, Bordetella pertussis
cgucaugcgccaugaacg

SEQ ID NO: 373498 - RNA, 14 nt, Bordetella pertussis
cgucaugcgccgca

SEQ ID NO: 373499 - RNA, 15 nt, Bordetella pertussis
cgucaugcgccgcag

SEQ ID NO: 373500 - RNA, 20 nt, Bordetella pertussis
cgucaugcgccgcagcaccu

SEQ ID NO: 373501 - RNA, 23 nt, Bordetella pertussis
cgucaugcgcuugucgccgcugc

SEQ ID NO: 373502 - RNA, 13 nt, Bordetella pertussis
cgucauggccgau

SEQ ID NO: 373503 - RNA, 14 nt, Bordetella pertussis
cgucauggcgccgu

SEQ ID NO: 373504 - RNA, 22 nt, Bordetella pertussis
cgucaugggcggggccacaugg

SEQ ID NO: 373505 - RNA, 17 nt, Bordetella pertussis
cgucauggucgaccagc

SEQ ID NO: 373506 - RNA, 21 nt, Bordetella pertussis
cgucaugugcugcggcagcca

SEQ ID NO: 373507 - RNA, 14 nt, Bordetella pertussis
cguccaaaacagac

SEQ ID NO: 373508 - RNA, 20 nt, Bordetella pertussis
cguccaagcagacccgcgcc

SEQ ID NO: 373509 - RNA, 22 nt, Bordetella pertussis
cguccaagcagacccgcgccca

SEQ ID NO: 373510 - RNA, 14 nt, Bordetella pertussis
cguccaaugccagg

SEQ ID NO: 373511 - RNA, 14 nt, Bordetella pertussis
cguccaccaccagg

SEQ ID NO: 373512 - RNA, 17 nt, Bordetella pertussis
cguccaccaccaggccg

SEQ ID NO: 373513 - RNA, 21 nt, Bordetella pertussis
cguccaccuugacgcgcaggc

SEQ ID NO: 373514 - RNA, 14 nt, Bordetella pertussis
cguccacgcccagc

SEQ ID NO: 373515 - RNA, 22 nt, Bordetella pertussis
cguccacgcccagcgccggcac

SEQ ID NO: 373516 - RNA, 14 nt, Bordetella pertussis
cguccacggcaucg

SEQ ID NO: 373517 - RNA, 15 nt, Bordetella pertussis
cguccacggcaucgg

SEQ ID NO: 373518 - RNA, 20 nt, Bordetella pertussis
cguccacggcaucggccagc

SEQ ID NO: 373519 - RNA, 21 nt, Bordetella pertussis
cguccacggcaucggccagca

SEQ ID NO: 373520 - RNA, 15 nt, Bordetella pertussis
cguccacggccugcg

SEQ ID NO: 373521 - RNA, 24 nt, Bordetella pertussis
cguccacggccugcgcgccgacca

SEQ ID NO: 373522 - RNA, 17 nt, Bordetella pertussis
cguccacgccgcgcgcg

SEQ ID NO: 373523 - RNA, 16 nt, Bordetella pertussis
cguccagcacgcggcg

SEQ ID NO: 373524 - RNA, 21 nt, Bordetella pertussis
cguccagcacgcggcgcagca

SEQ ID NO: 373525 - RNA, 17 nt, Bordetella pertussis
cguccagcacggccgcg

SEQ ID NO: 373526 - RNA, 20 nt, Bordetella pertussis
cguccagccccugcgggccg

SEQ ID NO: 373527 - RNA, 19 nt, Bordetella pertussis
cguccagcccgugggcggc

SEQ ID NO: 373528 - RNA, 16 nt, Bordetella pertussis
cguccagccugcccgg

SEQ ID NO: 373529 - RNA, 21 nt, Bordetella pertussis
cguccagcgacuccggccggg

SEQ ID NO: 373530 - RNA, 22 nt, Bordetella pertussis
cguccagcgacuccggccgggc

SEQ ID NO: 373531 - RNA, 18 nt, Bordetella pertussis
cguccagcgacucgguca

SEQ ID NO: 373532 - RNA, 21 nt, Bordetella pertussis
cguccagcgacucggucagca

SEQ ID NO: 373533 - RNA, 12 nt, Bordetella pertussis
cguccagcgccg

SEQ ID NO: 373534 - RNA, 14 nt, Bordetella pertussis
cguccagcgcgcgg

SEQ ID NO: 373535 - RNA, 15 nt, Bordetella pertussis
cguccagcgcgcggc

SEQ ID NO: 373536 - RNA, 19 nt, Bordetella pertussis
cguccagcgcgcggccucg

SEQ ID NO: 373537 - RNA, 21 nt, Bordetella pertussis
cguccagcgucaugcgcaccu

SEQ ID NO: 373538 - RNA, 17 nt, Bordetella pertussis
cguccagcguggcgcag

SEQ ID NO: 373539 - RNA, 17 nt, Bordetella pertussis
cguccaggaagcagccc

SEQ ID NO: 373540 - RNA, 18 nt, Bordetella pertussis
cguccaggaagcagccca

SEQ ID NO: 373541 - RNA, 21 nt, Bordetella pertussis
cguccaggaagcagcccagca

SEQ ID NO: 373542 - RNA, 16 nt, Bordetella pertussis
cguccaggcccuggcg

SEQ ID NO: 373543 - RNA, 17 nt, Bordetella pertussis
cguccaggcccuggcgg

SEQ ID NO: 373544 - RNA, 21 nt, Bordetella pertussis
cguccaggcccuggcggcgca

SEQ ID NO: 373545 - RNA, 23 nt, Bordetella pertussis
cguccaggccuuucucaaggccg

SEQ ID NO: 373546 - RNA, 15 nt, Bordetella pertussis
cguccaggcgcgcca

SEQ ID NO: 373547 - RNA, 17 nt, Bordetella pertussis
cguccaggcgcgccagc

SEQ ID NO: 373548 - RNA, 12 nt, Bordetella pertussis
cguccaggcggc

SEQ ID NO: 373549 - RNA, 12 nt, Bordetella pertussis
cguccaggcggu

SEQ ID NO: 373550 - RNA, 20 nt, Bordetella pertussis
cguccaggcugccggcguug

SEQ ID NO: 373551 - RNA, 17 nt, Bordetella pertussis
cguccaggugcggcggc

SEQ ID NO: 373552 - RNA, 17 nt, Bordetella pertussis
cguccagguugcccgag

SEQ ID NO: 373553 - RNA, 17 nt, Bordetella pertussis
cguccagucccguggcg

SEQ ID NO: 373554 - RNA, 16 nt, Bordetella pertussis
cguccaucgacgcggc

SEQ ID NO: 373555 - RNA, 17 nt, Bordetella pertussis
cguccccacggggacug

SEQ ID NO: 373556 - RNA, 19 nt, Bordetella pertussis
cgucccgacccccggcccg

SEQ ID NO: 373557 - RNA, 22 nt, Bordetella pertussis
cgucccgacccccggcccgcgc

SEQ ID NO: 373558 - RNA, 20 nt, Bordetella pertussis
cguccgagcccgacgcgagg

SEQ ID NO: 373559 - RNA, 22 nt, Bordetella pertussis
cguccgccccauccacggcgcc

SEQ ID NO: 373560 - RNA, 15 nt, Bordetella pertussis
cguccgcgacgcugu

SEQ ID NO: 373561 - RNA, 21 nt, Bordetella pertussis
cguccgcgacgguccugcgcg

SEQ ID NO: 373562 - RNA, 16 nt, Bordetella pertussis
cguccgcgcgccgcug

SEQ ID NO: 373563 - RNA, 17 nt, Bordetella pertussis
cguccgcggcccgcccg

SEQ ID NO: 373564 - RNA, 14 nt, Bordetella pertussis
cguccgcgucgccg

SEQ ID NO: 373565 - RNA, 18 nt, Bordetella pertussis
cguccgcgucgccgccgu

SEQ ID NO: 373566 - RNA, 19 nt, Bordetella pertussis
cguccggguuggcgaugcu

SEQ ID NO: 373567 - RNA, 15 nt, Bordetella pertussis
cguccguccuggcca

SEQ ID NO: 373568 - RNA, 18 nt, Bordetella pertussis
cguccguccuggccacug

SEQ ID NO: 373569 - RNA, 17 nt, Bordetella pertussis
cguccgucucgcccagg

SEQ ID NO: 373570 - RNA, 22 nt, Bordetella pertussis
cguccgucucgcccaggcccag

SEQ ID NO: 373571 - RNA, 14 nt, Bordetella pertussis
cguccgucgggcaa

SEQ ID NO: 373572 - RNA, 21 nt, Bordetella pertussis
cguccgucggguugccgcugc

SEQ ID NO: 373573 - RNA, 17 nt, Bordetella pertussis
cguccguggccggcgcg

SEQ ID NO: 373574 - RNA, 21 nt, Bordetella pertussis
cguccucaggcccgcggcgcc

SEQ ID NO: 373575 - RNA, 20 nt, Bordetella pertussis
cgucgaacagcuucuccaug

SEQ ID NO: 373576 - RNA, 15 nt, Bordetella pertussis
cgucgaacggccggg

SEQ ID NO: 373577 - RNA, 21 nt, Bordetella pertussis
cgucgaacuccugcagcacgc

SEQ ID NO: 373578 - RNA, 13 nt, Bordetella pertussis
cgucgaccacgcc

SEQ ID NO: 373579 - RNA, 23 nt, Bordetella pertussis
cgucgaccacgccggcggccaug

SEQ ID NO: 373580 - RNA, 20 nt, Bordetella pertussis
cgucgaccaccagcaucgcg

SEQ ID NO: 373581 - RNA, 14 nt, Bordetella pertussis
cgucgagcaccgug

SEQ ID NO: 373582 - RNA, 12 nt, Bordetella pertussis
cgucgagcacgc

SEQ ID NO: 373583 - RNA, 15 nt, Bordetella pertussis
cgucgagcacgcggc

SEQ ID NO: 373584 - RNA, 14 nt, Bordetella pertussis
cgucgagcagcgca

SEQ ID NO: 373585 - RNA, 15 nt, Bordetella pertussis
cgucgagcagcgcau

SEQ ID NO: 373586 - RNA, 18 nt, Bordetella pertussis
cgucgagcaggccggcgu

SEQ ID NO: 373587 - RNA, 17 nt, Bordetella pertussis
cgucgagcucgauggcu

SEQ ID NO: 373588 - RNA, 22 nt, Bordetella pertussis
cgucgaggaucaaggcccggau

SEQ ID NO: 373589 - RNA, 23 nt, Bordetella pertussis
cgucgaggaugcgagcaaaggac

SEQ ID NO: 373590 - RNA, 18 nt, Bordetella pertussis
cgucgaguucgagcacgg

SEQ ID NO: 373591 - RNA, 15 nt, Bordetella pertussis
cgucgaucagccacg

SEQ ID NO: 373592 - RNA, 16 nt, Bordetella pertussis
cgucgaucaggcccag

SEQ ID NO: 373593 - RNA, 17 nt, Bordetella pertussis
cgucgaucauggcgccg

SEQ ID NO: 373594 - RNA, 19 nt, Bordetella pertussis
cgucgaugcgcgcgcggau

SEQ ID NO: 373595 - RNA, 20 nt, Bordetella pertussis
cgucgauguagagggucugg

SEQ ID NO: 373596 - RNA, 21 nt, Bordetella pertussis
cgucgauuucgucgagcucga

SEQ ID NO: 373597 - RNA, 21 nt, Bordetella pertussis
cgucgcccacauagaccggcu

SEQ ID NO: 373598 - RNA, 22 nt, Bordetella pertussis
cgucgcccacauagaccggcug

SEQ ID NO: 373599 - RNA, 20 nt, Bordetella pertussis
cgucgcccuugauggccucg

SEQ ID NO: 373600 - RNA, 13 nt, Bordetella pertussis
cgucgccgcgccg

SEQ ID NO: 373601 - RNA, 12 nt, Bordetella pertussis
cgucgccgcgcg

SEQ ID NO: 373602 - RNA, 15 nt, Bordetella pertussis
cgucgccgcgcggcg

SEQ ID NO: 373603 - RNA, 16 nt, Bordetella pertussis
cgucgccgcuggccag

SEQ ID NO: 373604 - RNA, 14 nt, Bordetella pertussis
cgucgccggcgaug

SEQ ID NO: 373605 - RNA, 14 nt, Bordetella pertussis
cgucgccggcgcug

SEQ ID NO: 373606 - RNA, 16 nt, Bordetella pertussis
cgucgccggcgcugcu

SEQ ID NO: 373607 - RNA, 15 nt, Bordetella pertussis
cgucgcgaugcgcca

SEQ ID NO: 373608 - RNA, 18 nt, Bordetella pertussis
cgucgcgaugcgccaggc

SEQ ID NO: 373609 - RNA, 21 nt, Bordetella pertussis
cgucgcgaugcgccaggcgcu

SEQ ID NO: 373610 - RNA, 18 nt, Bordetella pertussis
cgucgcgcaauacgccgc

SEQ ID NO: 373611 - RNA, 18 nt, Bordetella pertussis
cgucgcgcacccgcaggc

SEQ ID NO: 373612 - RNA, 23 nt, Bordetella pertussis
cgucgcgcacccgcaggccguug

SEQ ID NO: 373613 - RNA, 21 nt, Bordetella pertussis
cgucgcgcagcaggguggcca

SEQ ID NO: 373614 - RNA, 23 nt, Bordetella pertussis
cgucgcgcagcaggguggccacg

SEQ ID NO: 373615 - RNA, 14 nt, Bordetella pertussis
cgucgcgccaggcc

SEQ ID NO: 373616 - RNA, 20 nt, Bordetella pertussis
cgucgcgcgaucaggcggug

SEQ ID NO: 373617 - RNA, 14 nt, Bordetella pertussis
cgucgcgcgcacgc

SEQ ID NO: 373618 - RNA, 15 nt, Bordetella pertussis
cgucgcgcgccaggc

SEQ ID NO: 373619 - RNA, 18 nt, Bordetella pertussis
cgucgcgcgccaggcggu

SEQ ID NO: 373620 - RNA, 13 nt, Bordetella pertussis
cgucgcggcgucg

SEQ ID NO: 373621 - RNA, 14 nt, Bordetella pertussis
cgucgcggcugggc

SEQ ID NO: 373622 - RNA, 18 nt, Bordetella pertussis
cgucgcgguacaggcugc

SEQ ID NO: 373623 - RNA, 15 nt, Bordetella pertussis
cgucgcgguccagca

SEQ ID NO: 373624 - RNA, 18 nt, Bordetella pertussis
cgucgcgguccagcacca

SEQ ID NO: 373625 - RNA, 21 nt, Bordetella pertussis
cgucgcgguccagcaccaggg

SEQ ID NO: 373626 - RNA, 15 nt, Bordetella pertussis
cgucggcguaaggcc

SEQ ID NO: 373627 - RNA, 19 nt, Bordetella pertussis
cgucggcguaaggccgccg

SEQ ID NO: 373628 - RNA, 23 nt, Bordetella pertussis
cgucggcguaaggccgccggcca

SEQ ID NO: 373629 - RNA, 18 nt, Bordetella pertussis
cgucggcguugugccggc

SEQ ID NO: 373630 - RNA, 20 nt, Bordetella pertussis
cgucggcguugugccggcgc

SEQ ID NO: 373631 - RNA, 21 nt, Bordetella pertussis
cgucggcguugugccggcgca

SEQ ID NO: 373632 - RNA, 23 nt, Bordetella pertussis
cgucggcguugugccggcgcagg

SEQ ID NO: 373633 - RNA, 21 nt, Bordetella pertussis
cgucgggcuugccguucaugc

SEQ ID NO: 373634 - RNA, 15 nt, Bordetella pertussis
cgucguagccgccga

SEQ ID NO: 373635 - RNA, 15 nt, Bordetella pertussis
cgucguagcgccagc

SEQ ID NO: 373636 - RNA, 20 nt, Bordetella pertussis
cgucguagcgccagcguucg

SEQ ID NO: 373637 - RNA, 16 nt, Bordetella pertussis
cgucguagugcgcgcc

SEQ ID NO: 373638 - RNA, 15 nt, Bordetella pertussis
cgucgucgaugccga

SEQ ID NO: 373639 - RNA, 17 nt, Bordetella pertussis
cgucgucgaugccgacc

SEQ ID NO: 373640 - RNA, 20 nt, Bordetella pertussis
cgucgucgaugccgaccagg

SEQ ID NO: 373641 - RNA, 21 nt, Bordetella pertussis
cgucgucgguggggcaggucg

SEQ ID NO: 373642 - RNA, 23 nt, Bordetella pertussis
cgucgucguucugcguggcggcg

SEQ ID NO: 373643 - RNA, 21 nt, Bordetella pertussis
cgucgugcagcgugggcucga

SEQ ID NO: 373644 - RNA, 17 nt, Bordetella pertussis
cgucgugcgccuggcgg

SEQ ID NO: 373645 - RNA, 16 nt, Bordetella pertussis
cgucguuucccagcaa

SEQ ID NO: 373646 - RNA, 19 nt, Bordetella pertussis
cgucuacaggcccagcgcc

SEQ ID NO: 373647 - RNA, 23 nt, Bordetella pertussis
cgucuacaggcccagcgccagca

SEQ ID NO: 373648 - RNA, 14 nt, Bordetella pertussis
cgucucgcccaggc

SEQ ID NO: 373649 - RNA, 13 nt, Bordetella pertussis
cgucucgcccaug

SEQ ID NO: 373650 - RNA, 13 nt, Bordetella pertussis
cgucucgcgcgcc

SEQ ID NO: 373651 - RNA, 19 nt, Bordetella pertussis
cgucucggaaaacuggcgg

SEQ ID NO: 373652 - RNA, 23 nt, Bordetella pertussis
cgucuguaucguugucgcgccgc

SEQ ID NO: 373653 - RNA, 18 nt, Bordetella pertussis
cgucuucaguugacgccg

SEQ ID NO: 373654 - RNA, 19 nt, Bordetella pertussis
cgugaccagcugcaccagg

SEQ ID NO: 373655 - RNA, 17 nt, Bordetella pertussis
cgugaccggacugucca

SEQ ID NO: 373656 - RNA, 14 nt, Bordetella pertussis
cgugaccgcgacgc

SEQ ID NO: 373657 - RNA, 18 nt, Bordetella pertussis
cgugaccgcgacgcgccu

SEQ ID NO: 373658 - RNA, 20 nt, Bordetella pertussis
cgugaccugcgucugcgugc

SEQ ID NO: 373659 - RNA, 16 nt, Bordetella pertussis
cgugacguugccgcgc

SEQ ID NO: 373660 - RNA, 18 nt, Bordetella pertussis
cgugacguugccgcgcgc

SEQ ID NO: 373661 - RNA, 17 nt, Bordetella pertussis
cgugacuucggccgcca

SEQ ID NO: 373662 - RNA, 19 nt, Bordetella pertussis
cgugacuucggccgccagc

SEQ ID NO: 373663 - RNA, 13 nt, Bordetella pertussis
cgugagcgccgcc

SEQ ID NO: 373664 - RNA, 14 nt, Bordetella pertussis
cgugagcgccgccg

SEQ ID NO: 373665 - RNA, 14 nt, Bordetella pertussis
cgugagcgccucga

SEQ ID NO: 373666 - RNA, 16 nt, Bordetella pertussis
cgugaugggcgcaucc

SEQ ID NO: 373667 - RNA, 22 nt, Bordetella pertussis
cgugaugggcgcauccagcucg

SEQ ID NO: 373668 - RNA, 13 nt, Bordetella pertussis
cgugauggggccg

SEQ ID NO: 373669 - RNA, 17 nt, Bordetella pertussis
cgugauggggccgggcg

SEQ ID NO: 373670 - RNA, 14 nt, Bordetella pertussis
cgugauggacgccg

SEQ ID NO: 373671 - RNA, 13 nt, Bordetella pertussis
cgugaugucgccg

SEQ ID NO: 373672 - RNA, 17 nt, Bordetella pertussis
cgugcaccagccauucg

SEQ ID NO: 373673 - RNA, 14 nt, Bordetella pertussis
cgugcaccagcccg

SEQ ID NO: 373674 - RNA, 12 nt, Bordetella pertussis
cgugcaccaugc

SEQ ID NO: 373675 - RNA, 15 nt, Bordetella pertussis
cgugcacgcccgcgg

SEQ ID NO: 373676 - RNA, 18 nt, Bordetella pertussis
cgugcacgcccgcggcgc

SEQ ID NO: 373677 - RNA, 20 nt, Bordetella pertussis
cgugcacgcccgcggcgccc

SEQ ID NO: 373678 - RNA, 22 nt, Bordetella pertussis
cgugcacgcccgcggcgcccag

SEQ ID NO: 373679 - RNA, 17 nt, Bordetella pertussis
cgugccagccgaacugg

SEQ ID NO: 373680 - RNA, 16 nt, Bordetella pertussis
cgugccauggaccggc

SEQ ID NO: 373681 - RNA, 14 nt, Bordetella pertussis
cgugcccagcgaga

SEQ ID NO: 373682 - RNA, 23 nt, Bordetella pertussis
cgugcccagcgagaucagcaccg

SEQ ID NO: 373683 - RNA, 15 nt, Bordetella pertussis
cgugcccagcuggca

SEQ ID NO: 373684 - RNA, 21 nt, Bordetella pertussis
cgugcccagcuggcaccgcga

SEQ ID NO: 373685 - RNA, 14 nt, Bordetella pertussis
cgugcccaguuucg

SEQ ID NO: 373686 - RNA, 20 nt, Bordetella pertussis
cgugcccaguuucgcgacca

SEQ ID NO: 373687 - RNA, 22 nt, Bordetella pertussis
cgugcccgccacccagggcuug

SEQ ID NO: 373688 - RNA, 15 nt, Bordetella pertussis
cgugcccggcgggcc

SEQ ID NO: 373689 - RNA, 18 nt, Bordetella pertussis
cgugcccgguucugcggc

SEQ ID NO: 373690 - RNA, 18 nt, Bordetella pertussis
cgugcccguugccgcgcg

SEQ ID NO: 373691 - RNA, 21 nt, Bordetella pertussis
cgugcccguugccgcgcgcga

SEQ ID NO: 373692 - RNA, 18 nt, Bordetella pertussis
cgugcccugcggcgcggc

SEQ ID NO: 373693 - RNA, 22 nt, Bordetella pertussis
cgugcccugcggcgcggccagc

SEQ ID NO: 373694 - RNA, 19 nt, Bordetella pertussis
cgugcccuugagcgugggc

SEQ ID NO: 373695 - RNA, 19 nt, Bordetella pertussis
cgugcgcaggcgcguggcc

SEQ ID NO: 373696 - RNA, 24 nt, Bordetella pertussis
cgugcgcaggcgcguggccacggc

SEQ ID NO: 373697 - RNA, 20 nt, Bordetella pertussis
cgugcgcagguauuccgccg

SEQ ID NO: 373698 - RNA, 17 nt, Bordetella pertussis
cgugcgccacagcauga

SEQ ID NO: 373699 - RNA, 12 nt, Bordetella pertussis
cgugcgcccaug

SEQ ID NO: 373700 - RNA, 13 nt, Bordetella pertussis
cgugcgcccaugg

SEQ ID NO: 373701 - RNA, 15 nt, Bordetella pertussis
cgugcgcccauggcg

SEQ ID NO: 373702 - RNA, 12 nt, Bordetella pertussis
cgugcgccccgc

SEQ ID NO: 373703 - RNA, 13 nt, Bordetella pertussis
cgugcgcccgacg

SEQ ID NO: 373704 - RNA, 14 nt, Bordetella pertussis
cgugcgcccgacgc

SEQ ID NO: 373705 - RNA, 13 nt, Bordetella pertussis
cgugcgccagcgc

SEQ ID NO: 373706 - RNA, 14 nt, Bordetella pertussis
cgugcgccagcgcc

SEQ ID NO: 373707 - RNA, 15 nt, Bordetella pertussis
cgugcgccagcgcca

SEQ ID NO: 373708 - RNA, 23 nt, Bordetella pertussis
cgugcgccacuucgccucggcgg

SEQ ID NO: 373709 - RNA, 13 nt, Bordetella pertussis
cgugcgccgggcg

SEQ ID NO: 373710 - RNA, 14 nt, Bordetella pertussis
cgugcgccgggcgu

SEQ ID NO: 373711 - RNA, 13 nt, Bordetella pertussis
cgugcgccgggcu

SEQ ID NO: 373712 - RNA, 17 nt, Bordetella pertussis
cgugcgcgaccgcgcgg

SEQ ID NO: 373713 - RNA, 18 nt, Bordetella pertussis
cgugcgcgaccgcgcggc

SEQ ID NO: 373714 - RNA, 16 nt, Bordetella pertussis
cgugcgcgaccuccgg

SEQ ID NO: 373715 - RNA, 16 nt, Bordetella pertussis
cgugcgcgcgccaugg

SEQ ID NO: 373716 - RNA, 19 nt, Bordetella pertussis
cgugcgcggccgcgcgcuu

SEQ ID NO: 373717 - RNA, 18 nt, Bordetella pertussis
cgugcgcgggcgccaucg

SEQ ID NO: 373718 - RNA, 17 nt, Bordetella pertussis
cgugcgcgggcgcggca

SEQ ID NO: 373719 - RNA, 21 nt, Bordetella pertussis
cgugcgcgguucaggcuugca

SEQ ID NO: 373720 - RNA, 21 nt, Bordetella pertussis
cgugcgcuugcgcauggccgg

SEQ ID NO: 373721 - RNA, 21 nt, Bordetella pertussis
cgugcgcuggcugggccugcu

SEQ ID NO: 373722 - RNA, 20 nt, Bordetella pertussis
cgugcggauggucgagcgcc

SEQ ID NO: 373723 - RNA, 21 nt, Bordetella pertussis
cgugcggauggucgagcgccu

SEQ ID NO: 373724 - RNA, 14 nt, Bordetella pertussis
cgugcggcacgcac

SEQ ID NO: 373725 - RNA, 16 nt, Bordetella pertussis
cgugcggcacgcacag

SEQ ID NO: 373726 - RNA, 15 nt, Bordetella pertussis
cgugcggccgcagca

SEQ ID NO: 373727 - RNA, 12 nt, Bordetella pertussis
cgugcggccgca

SEQ ID NO: 373728 - RNA, 13 nt, Bordetella pertussis
cgugcugcagggc

SEQ ID NO: 373729 - RNA, 14 nt, Bordetella pertussis
cgugcugcccgcgu

SEQ ID NO: 373730 - RNA, 20 nt, Bordetella pertussis
cgugcugcgcguggccauca

SEQ ID NO: 373731 - RNA, 23 nt, Bordetella pertussis
cgugcugcggcugaucaccgccg

SEQ ID NO: 373732 - RNA, 14 nt, Bordetella pertussis
cgugcuggacccgc

SEQ ID NO: 373733 - RNA, 21 nt, Bordetella pertussis
cgugcuggacccgcugcgacc

SEQ ID NO: 373734 - RNA, 20 nt, Bordetella pertussis
cgugcuggcugagcaggccg

SEQ ID NO: 373735 - RNA, 12 nt, Bordetella pertussis
cgugcugggcgg

SEQ ID NO: 373736 - RNA, 22 nt, Bordetella pertussis
cguggaagguccacggcauggc

SEQ ID NO: 373737 - RNA, 13 nt, Bordetella pertussis
cguggacaggcac

SEQ ID NO: 373738 - RNA, 18 nt, Bordetella pertussis
cguggacaggcaccugcg

SEQ ID NO: 373739 - RNA, 21 nt, Bordetella pertussis
cguggacgaauacgcuggcgc

SEQ ID NO: 373740 - RNA, 19 nt, Bordetella pertussis
cguggacgugcgcgaccgc

SEQ ID NO: 373741 - RNA, 15 nt, Bordetella pertussis
cguggacucgauggc

SEQ ID NO: 373742 - RNA, 16 nt, Bordetella pertussis
cguggacucgauggcg

SEQ ID NO: 373743 - RNA, 20 nt, Bordetella pertussis
cguggacucgauggcgcagg

SEQ ID NO: 373744 - RNA, 15 nt, Bordetella pertussis
cguggaggcggcggc

SEQ ID NO: 373745 - RNA, 22 nt, Bordetella pertussis
cguggaugggcuuugacgccgg

SEQ ID NO: 373746 - RNA, 13 nt, Bordetella pertussis
cguggcaggugcg

SEQ ID NO: 373747 - RNA, 15 nt, Bordetella pertussis
cguggcaggugcggc

SEQ ID NO: 373748 - RNA, 19 nt, Bordetella pertussis
cguggcaggugcggccgca

SEQ ID NO: 373749 - RNA, 22 nt, Bordetella pertussis
cguggcaggugcggccgcagcg

SEQ ID NO: 373750 - RNA, 14 nt, Bordetella pertussis
cguggccaagggcg

SEQ ID NO: 373751 - RNA, 16 nt, Bordetella pertussis
cguggccaagggcgcc

SEQ ID NO: 373752 - RNA, 23 nt, Bordetella pertussis
cguggccaagggcgccgcgccgg

SEQ ID NO: 373753 - RNA, 14 nt, Bordetella pertussis
cguggccaccaggc

SEQ ID NO: 373754 - RNA, 16 nt, Bordetella pertussis
cguggccaccaggcgc

SEQ ID NO: 373755 - RNA, 22 nt, Bordetella pertussis
cguggccaccaggcgcgcgcca

SEQ ID NO: 373756 - RNA, 22 nt, Bordetella pertussis
cguggccacggccgcgaucgag

SEQ ID NO: 373757 - RNA, 18 nt, Bordetella pertussis
cguggccagcacggcgca

SEQ ID NO: 373758 - RNA, 22 nt, Bordetella pertussis
cguggccagcacggcgcacacc

SEQ ID NO: 373759 - RNA, 12 nt, Bordetella pertussis
cguggcccagca

SEQ ID NO: 373760 - RNA, 17 nt, Bordetella pertussis
cguggcccagcaccgcc

SEQ ID NO: 373761 - RNA, 12 nt, Bordetella pertussis
cguggcccagcc

SEQ ID NO: 373762 - RNA, 17 nt, Bordetella pertussis
cguggcccagccgcaug

SEQ ID NO: 373763 - RNA, 20 nt, Bordetella pertussis
cguggcccagccgcaugccg

SEQ ID NO: 373764 - RNA, 13 nt, Bordetella pertussis
cguggccaucaac

SEQ ID NO: 373765 - RNA, 15 nt, Bordetella pertussis
cguggcccgcgccgc

SEQ ID NO: 373766 - RNA, 23 nt, Bordetella pertussis
cguggccgcgcaaggccugcucg

SEQ ID NO: 373767 - RNA, 22 nt, Bordetella pertussis
cguggccgggcccggcgcgccu

SEQ ID NO: 373768 - RNA, 18 nt, Bordetella pertussis
cguggccgugcgaggcga

SEQ ID NO: 373769 - RNA, 18 nt, Bordetella pertussis
cguggcgacgcgcugccg

SEQ ID NO: 373770 - RNA, 13 nt, Bordetella pertussis
cguggcgacgucg

SEQ ID NO: 373771 - RNA, 17 nt, Bordetella pertussis
cguggcgauagcgcucc

SEQ ID NO: 373772 - RNA, 21 nt, Bordetella pertussis
cguggcgauagcgcuccagcg

SEQ ID NO: 373773 - RNA, 18 nt, Bordetella pertussis
cguggcgauccagggccg

SEQ ID NO: 373774 - RNA, 12 nt, Bordetella pertussis
cguggcgcagcu

SEQ ID NO: 373775 - RNA, 18 nt, Bordetella pertussis
cguggcgcagucgagcac

SEQ ID NO: 373776 - RNA, 21 nt, Bordetella pertussis
cguggcgcagucgagcaccgc

SEQ ID NO: 373777 - RNA, 17 nt, Bordetella pertussis
cguggcgcagugggcca

SEQ ID NO: 373778 - RNA, 13 nt, Bordetella pertussis
cguggcgcccagc

SEQ ID NO: 373779 - RNA, 22 nt, Bordetella pertussis
cguggcgccgaaggcggcgccg

SEQ ID NO: 373780 - RNA, 22 nt, Bordetella pertussis
cguggcgccgacccugcccggc

SEQ ID NO: 373781 - RNA, 17 nt, Bordetella pertussis
cguggcgcgcaccuggg

SEQ ID NO: 373782 - RNA, 15 nt, Bordetella pertussis
cguggcgcgccagcg

SEQ ID NO: 373783 - RNA, 18 nt, Bordetella pertussis
cguggcgcuccaugcggc

SEQ ID NO: 373784 - RNA, 12 nt, Bordetella pertussis
cguggcggccac

SEQ ID NO: 373785 - RNA, 14 nt, Bordetella pertussis
cguggcggccaggc

SEQ ID NO: 373786 - RNA, 14 nt, Bordetella pertussis
cguggcggccgcgg

SEQ ID NO: 373787 - RNA, 20 nt, Bordetella pertussis
cguggcggccgcgggcagca

SEQ ID NO: 373788 - RNA, 14 nt, Bordetella pertussis
cguggcggccugcg

SEQ ID NO: 373789 - RNA, 17 nt, Bordetella pertussis
cguggcggccugcgccg

SEQ ID NO: 373790 - RNA, 19 nt, Bordetella pertussis
cguggcggccugcgccggc

SEQ ID NO: 373791 - RNA, 18 nt, Bordetella pertussis
cguggcggcgauguggcg

SEQ ID NO: 373792 - RNA, 14 nt, Bordetella pertussis
cguggcgggccgcg

SEQ ID NO: 373793 - RNA, 16 nt, Bordetella pertussis
cguggcgggccgcgcc

SEQ ID NO: 373794 - RNA, 16 nt, Bordetella pertussis
cguggcggggcguucg

SEQ ID NO: 373795 - RNA, 21 nt, Bordetella pertussis
cguggcguaauagcuggcggc

SEQ ID NO: 373796 - RNA, 13 nt, Bordetella pertussis
cguggcguccaug

SEQ ID NO: 373797 - RNA, 15 nt, Bordetella pertussis
cguggcguccaugca

SEQ ID NO: 373798 - RNA, 16 nt, Bordetella pertussis
cguggcgucguggggc

SEQ ID NO: 373799 - RNA, 21 nt, Bordetella pertussis
cguggcgucguggggcgcggc

SEQ ID NO: 373800 - RNA, 16 nt, Bordetella pertussis
cguggcgugcaggccg

SEQ ID NO: 373801 - RNA, 21 nt, Bordetella pertussis
cguggcgugcaggccggcggc

SEQ ID NO: 373802 - RNA, 20 nt, Bordetella pertussis
cguggcggguccacguggcg

SEQ ID NO: 373803 - RNA, 21 nt, Bordetella pertussis
cguggcugaccagcagcaccg

SEQ ID NO: 373804 - RNA, 23 nt, Bordetella pertussis
cguggcugaccagcagcaccgug

SEQ ID NO: 373805 - RNA, 21 nt, Bordetella pertussis
cguggcuggugauguccugca

SEQ ID NO: 373806 - RNA, 16 nt, Bordetella pertussis
cgugggacaggcaccc

SEQ ID NO: 373807 - RNA, 17 nt, Bordetella pertussis
cgugggcaggugcuugg

SEQ ID NO: 373808 - RNA, 21 nt, Bordetella pertussis
cgugggcucgaugcguccguc

SEQ ID NO: 373809 - RNA, 24 nt, Bordetella pertussis
cgugggcuguucguagucgagcca

SEQ ID NO: 373810 - RNA, 15 nt, Bordetella pertussis
cguggggacaggcac

SEQ ID NO: 373811 - RNA, 20 nt, Bordetella pertussis
cguggggacaggcaccugcg

SEQ ID NO: 373812 - RNA, 17 nt, Bordetella pertussis
cguggggagcgcggccc

SEQ ID NO: 373813 - RNA, 14 nt, Bordetella pertussis
cguggggccggccg

SEQ ID NO: 373814 - RNA, 15 nt, Bordetella pertussis
cguggggccggccgc

SEQ ID NO: 373815 - RNA, 13 nt, Bordetella pertussis
cguggggacgcgg

SEQ ID NO: 373816 - RNA, 13 nt, Bordetella pertussis
cgugguacgugga

SEQ ID NO: 373817 - RNA, 18 nt, Bordetella pertussis
cgugguccacgaagcagg

SEQ ID NO: 373818 - RNA, 22 nt, Bordetella pertussis
cguggucgcagucccaguccgg

SEQ ID NO: 373819 - RNA, 14 nt, Bordetella pertussis
cguggucgccagca

SEQ ID NO: 373820 - RNA, 18 nt, Bordetella pertussis
cguggugcccugcuccca

SEQ ID NO: 373821 - RNA, 22 nt, Bordetella pertussis
cgugguggccuugcugcccgac

SEQ ID NO: 373822 - RNA, 15 nt, Bordetella pertussis
cguggugggcaccgu

SEQ ID NO: 373823 - RNA, 19 nt, Bordetella pertussis
cguguagagcaggccgccc

SEQ ID NO: 373824 - RNA, 14 nt, Bordetella pertussis
cguguagagcugcg

SEQ ID NO: 373825 - RNA, 17 nt, Bordetella pertussis
cguguagagcugcggcg

SEQ ID NO: 373826 - RNA, 13 nt, Bordetella pertussis
cgugucaggcgga

SEQ ID NO: 373827 - RNA, 20 nt, Bordetella pertussis
cgugucaggcggagucgccc

SEQ ID NO: 373828 - RNA, 19 nt, Bordetella pertussis
cgugucccagccggcggca

SEQ ID NO: 373829 - RNA, 13 nt, Bordetella pertussis
cguguccagcggc

SEQ ID NO: 373830 - RNA, 13 nt, Bordetella pertussis
cgugucgcccuuc

SEQ ID NO: 373831 - RNA, 19 nt, Bordetella pertussis
cgugucgcccuucaggcca

SEQ ID NO: 373832 - RNA, 20 nt, Bordetella pertussis
cgugucgcccuucaggccag

SEQ ID NO: 373833 - RNA, 21 nt, Bordetella pertussis
cgugucgcccuucaggccagu

SEQ ID NO: 373834 - RNA, 17 nt, Bordetella pertussis
cgugugaucgccgacga

SEQ ID NO: 373835 - RNA, 15 nt, Bordetella pertussis
cgugugcccagcacc

SEQ ID NO: 373836 - RNA, 15 nt, Bordetella pertussis
cgugugccgccagcg

SEQ ID NO: 373837 - RNA, 17 nt, Bordetella pertussis
cguguggcaggccagcg

SEQ ID NO: 373838 - RNA, 23 nt, Bordetella pertussis
cguguggugaaagccgccggcgc

SEQ ID NO: 373839 - RNA, 14 nt, Bordetella pertussis
cguguuccagcgcc

SEQ ID NO: 373840 - RNA, 15 nt, Bordetella pertussis
cguguuccagcgccu

SEQ ID NO: 373841 - RNA, 18 nt, Bordetella pertussis
cguguucgcggccggaca

SEQ ID NO: 373842 - RNA, 19 nt, Bordetella pertussis
cguguucgcggccggacag

SEQ ID NO: 373843 - RNA, 14 nt, Bordetella pertussis
cguguucgagcagg

SEQ ID NO: 373844 - RNA, 22 nt, Bordetella pertussis
cguguucgagcaggcgcgcggu

SEQ ID NO: 373845 - RNA, 16 nt, Bordetella pertussis
cguguuucucgcucuu

SEQ ID NO: 373846 - RNA, 14 nt, Bordetella pertussis
cguucaagucgccc

SEQ ID NO: 373847 - RNA, 16 nt, Bordetella pertussis
cguucaagucgcccug

SEQ ID NO: 373848 - RNA, 21 nt, Bordetella pertussis
cguucaccaggaagcgcgccu

SEQ ID NO: 373849 - RNA, 19 nt, Bordetella pertussis
cguucacgcccgagauggc

SEQ ID NO: 373850 - RNA, 18 nt, Bordetella pertussis
cguucacgccggcgcgcc

SEQ ID NO: 373851 - RNA, 20 nt, Bordetella pertussis
cguucacgccggcgcgccgg

SEQ ID NO: 373852 - RNA, 13 nt, Bordetella pertussis
cguucacguagaa

SEQ ID NO: 373853 - RNA, 22 nt, Bordetella pertussis
cguucacguagaaauacgcgcg

SEQ ID NO: 373854 - RNA, 23 nt, Bordetella pertussis
cguucacguagaaauacgcgcgc

SEQ ID NO: 373855 - RNA, 14 nt, Bordetella pertussis
cguucagcgccggc

SEQ ID NO: 373856 - RNA, 18 nt, Bordetella pertussis
cguucagcgggcgcgccc

SEQ ID NO: 373857 - RNA, 16 nt, Bordetella pertussis
cguucagggacgggcc

SEQ ID NO: 373858 - RNA, 19 nt, Bordetella pertussis
cguucagggacgggccagc

SEQ ID NO: 373859 - RNA, 16 nt, Bordetella pertussis
cguucagggcgccgcg

SEQ ID NO: 373860 - RNA, 17 nt, Bordetella pertussis
cguucagggcgccgcgg

SEQ ID NO: 373861 - RNA, 19 nt, Bordetella pertussis
cguucagggcgccgcggcg

SEQ ID NO: 373862 - RNA, 22 nt, Bordetella pertussis
cguucagguucaucagccggau

SEQ ID NO: 373863 - RNA, 15 nt, Bordetella pertussis
cguucaucagcgcgc

SEQ ID NO: 373864 - RNA, 17 nt, Bordetella pertussis
cguucaugccgaccacg

SEQ ID NO: 373865 - RNA, 18 nt, Bordetella pertussis
cguucauggcgcaugacg

SEQ ID NO: 373866 - RNA, 20 nt, Bordetella pertussis
cguuccagcagaucgcggcg

SEQ ID NO: 373867 - RNA, 20 nt, Bordetella pertussis
cguuccaugacguccagcgc

SEQ ID NO: 373868 - RNA, 21 nt, Bordetella pertussis
cguuccaugacguccagcgcc

SEQ ID NO: 373869 - RNA, 22 nt, Bordetella pertussis
cguuccaugacguccagcgcca

SEQ ID NO: 373870 - RNA, 19 nt, Bordetella pertussis
cguuccaugcgauccaggg

SEQ ID NO: 373871 - RNA, 20 nt, Bordetella pertussis
cguucgacgggcaggcccag

SEQ ID NO: 373872 - RNA, 22 nt, Bordetella pertussis
cguucgacgggcaggcccagcc

SEQ ID NO: 373873 - RNA, 24 nt, Bordetella pertussis
cguucgacuucguccggcgcgucg

SEQ ID NO: 373874 - RNA, 13 nt, Bordetella pertussis
cguucgccgucga

SEQ ID NO: 373875 - RNA, 13 nt, Bordetella pertussis
cguucgcgcugcc

SEQ ID NO: 373876 - RNA, 15 nt, Bordetella pertussis
cguucgcgcugccca

SEQ ID NO: 373877 - RNA, 18 nt, Bordetella pertussis
cguucgcgcuugcggccg

SEQ ID NO: 373878 - RNA, 21 nt, Bordetella pertussis
cguucgcgcuugcggccgucg

SEQ ID NO: 373879 - RNA, 12 nt, Bordetella pertussis
cguucggccagc

SEQ ID NO: 373880 - RNA, 15 nt, Bordetella pertussis
cguucggccagcgcg

SEQ ID NO: 373881 - RNA, 23 nt, Bordetella pertussis
cguucggccagcgcgcggcgcag

SEQ ID NO: 373882 - RNA, 16 nt, Bordetella pertussis
cguucggccagcccca

SEQ ID NO: 373883 - RNA, 22 nt, Bordetella pertussis
cguucgggcggcaggugcgcca

SEQ ID NO: 373884 - RNA, 16 nt, Bordetella pertussis
cguucugcgcgcccgu

SEQ ID NO: 373885 - RNA, 22 nt, Bordetella pertussis
cguucuggcgcagcaaggcgcg

SEQ ID NO: 373886 - RNA, 18 nt, Bordetella pertussis
cguucuggcugcgcgccu

SEQ ID NO: 373887 - RNA, 15 nt, Bordetella pertussis
cguucugggagcgcg

SEQ ID NO: 373888 - RNA, 20 nt, Bordetella pertussis
cguucugggagcgcgggccg

SEQ ID NO: 373889 - RNA, 23 nt, Bordetella pertussis
cguucugggagcgcgggccgccg

SEQ ID NO: 373890 - RNA, 20 nt, Bordetella pertussis
cguucugcagcgcggugcgg

SEQ ID NO: 373891 - RNA, 21 nt, Bordetella pertussis
cguucuugagaauggcgcggu

SEQ ID NO: 373892 - RNA, 15 nt, Bordetella pertussis
cguugaagcgcagcc

SEQ ID NO: 373893 - RNA, 17 nt, Bordetella pertussis
cguugagcagcaugugc

SEQ ID NO: 373894 - RNA, 17 nt, Bordetella pertussis
cguugaggguuucgacg

SEQ ID NO: 373895 - RNA, 19 nt, Bordetella pertussis
cguugaggguuucgacgcc

SEQ ID NO: 373896 - RNA, 16 nt, Bordetella pertussis
cuacacggccgccacc

SEQ ID NO: 373897 - RNA, 13 nt, Bordetella pertussis
cuacacgguggcg

SEQ ID NO: 373898 - RNA, 19 nt, Bordetella pertussis
cuacacggugggcgacgcg

SEQ ID NO: 373899 - RNA, 21 nt, Bordetella pertussis
cuacacggugggcgacgcggc

SEQ ID NO: 373900 - RNA, 13 nt, Bordetella pertussis
cuacagcucgccg

SEQ ID NO: 373901 - RNA, 14 nt, Bordetella pertussis
cuacaggcccagcg

SEQ ID NO: 373902 - RNA, 17 nt, Bordetella pertussis
cuacaggcccagcgcca

SEQ ID NO: 373903 - RNA, 15 nt, Bordetella pertussis
cuaccggcgccgacg

SEQ ID NO: 373904 - RNA, 18 nt, Bordetella pertussis
cuacgugcuggacccgcu

SEQ ID NO: 373905 - RNA, 15 nt, Bordetella pertussis
cuacugcccucgccu

SEQ ID NO: 373906 - RNA, 17 nt, Bordetella pertussis
cuacugcccucgccucg

SEQ ID NO: 373907 - RNA, 14 nt, Bordetella pertussis
cuacuggcgcgcgc

SEQ ID NO: 373908 - RNA, 17 nt, Bordetella pertussis
cuagagcaugcggcguc

SEQ ID NO: 373909 - RNA, 17 nt, Bordetella pertussis
cuagcccggcgccaccc

SEQ ID NO: 373910 - RNA, 13 nt, Bordetella pertussis
cuaugacgaccgc

SEQ ID NO: 373911 - RNA, 18 nt, Bordetella pertussis
cuaugcagcugcgccagc

SEQ ID NO: 373912 - RNA, 22 nt, Bordetella pertussis
cuaugcgguguugcucgugcug

SEQ ID NO: 373913 - RNA, 23 nt, Bordetella pertussis
cuaugcgguguugcucgugcugg

SEQ ID NO: 373914 - RNA, 18 nt, Bordetella pertussis
cucaaccacgaacacgau

SEQ ID NO: 373915 - RNA, 16 nt, Bordetella pertussis
cucaaccucgacgcgc

SEQ ID NO: 373916 - RNA, 22 nt, Bordetella pertussis
cucaacgaagaacagccgcugc

SEQ ID NO: 373917 - RNA, 18 nt, Bordetella pertussis
cucaacuggccggccugg

SEQ ID NO: 373918 - RNA, 19 nt, Bordetella pertussis
cucacagggucaaggcgcg

SEQ ID NO: 373919 - RNA, 21 nt, Bordetella pertussis
cucacagggucaaggcgcggc

SEQ ID NO: 373920 - RNA, 21 nt, Bordetella pertussis
cucacgcccagucccaggccg

SEQ ID NO: 373921 - RNA, 23 nt, Bordetella pertussis
cucacgcccgugucgccgucggu

SEQ ID NO: 373922 - RNA, 23 nt, Bordetella pertussis
cucacgggcgaagcggaccuggu

SEQ ID NO: 373923 - RNA, 15 nt, Bordetella pertussis
cucacggggcugucg

SEQ ID NO: 373924 - RNA, 19 nt, Bordetella pertussis
cucacggggcugucgcgcg

SEQ ID NO: 373925 - RNA, 22 nt, Bordetella pertussis
cucacggggcugucgcgcgcau

SEQ ID NO: 373926 - RNA, 13 nt, Bordetella pertussis
cucagcgacgcgc

SEQ ID NO: 373927 - RNA, 13 nt, Bordetella pertussis
cucagcgcgccgc

SEQ ID NO: 373928 - RNA, 21 nt, Bordetella pertussis
cucagcgcggcgcggccagca

SEQ ID NO: 373929 - RNA, 22 nt, Bordetella pertussis
cucagcgcggcgcggccagcag

SEQ ID NO: 373930 - RNA, 15 nt, Bordetella pertussis
cucaggcggccaggg

SEQ ID NO: 373931 - RNA, 20 nt, Bordetella pertussis
cucagggcggggugccugca

SEQ ID NO: 373932 - RNA, 15 nt, Bordetella pertussis
cucaggguacggcga

SEQ ID NO: 373933 - RNA, 22 nt, Bordetella pertussis
cucaguccagcuggcccuggca

SEQ ID NO: 373934 - RNA, 13 nt, Bordetella pertussis
cucaucaucgcgc

SEQ ID NO: 373935 - RNA, 13 nt, Bordetella pertussis
cucaucgagcgcc

SEQ ID NO: 373936 - RNA, 23 nt, Bordetella pertussis
cucaucggcaggccggcgcgcgc

SEQ ID NO: 373937 - RNA, 21 nt, Bordetella pertussis
cucauggccgcgcccagcgcg

SEQ ID NO: 373938 - RNA, 17 nt, Bordetella pertussis
cucauggcggcacgaau

SEQ ID NO: 373939 - RNA, 21 nt, Bordetella pertussis
cucauguugggggcgaagacg

SEQ ID NO: 373940 - RNA, 17 nt, Bordetella pertussis
cucauucggcgcgcucg

SEQ ID NO: 373941 - RNA, 14 nt, Bordetella pertussis
cuccagcaucgccg

SEQ ID NO: 373942 - RNA, 19 nt, Bordetella pertussis
cuccagcaucgccgccagc

SEQ ID NO: 373943 - RNA, 23 nt, Bordetella pertussis
cuccagcccgauaugcagccgca

SEQ ID NO: 373944 - RNA, 13 nt, Bordetella pertussis
cuccagcgcggcg

SEQ ID NO: 373945 - RNA, 24 nt, Bordetella pertussis
cuccagcgcgucggccaggcgcca

SEQ ID NO: 373946 - RNA, 14 nt, Bordetella pertussis
cuccagcucagcag

SEQ ID NO: 373947 - RNA, 21 nt, Bordetella pertussis
cuccagcucagcagcgccagg

SEQ ID NO: 373948 - RNA, 16 nt, Bordetella pertussis
cuccagcuccagcgcg

SEQ ID NO: 373949 - RNA, 20 nt, Bordetella pertussis
cuccagcgugucgaacacca

SEQ ID NO: 373950 - RNA, 18 nt, Bordetella pertussis
cuccagcuggcgcaccag

SEQ ID NO: 373951 - RNA, 20 nt, Bordetella pertussis
cuccaggaaagcgccgccgc

SEQ ID NO: 373952 - RNA, 21 nt, Bordetella pertussis
cuccaggaugcgcgacaccgu

SEQ ID NO: 373953 - RNA, 12 nt, Bordetella pertussis
cuccaggccggc

SEQ ID NO: 373954 - RNA, 14 nt, Bordetella pertussis
cuccaggccggcau

SEQ ID NO: 373955 - RNA, 18 nt, Bordetella pertussis
cuccaggccggcaugcgc

SEQ ID NO: 373956 - RNA, 18 nt, Bordetella pertussis
cuccaggcggcggugcca

SEQ ID NO: 373957 - RNA, 14 nt, Bordetella pertussis
cuccaggcucaggc

SEQ ID NO: 373958 - RNA, 17 nt, Bordetella pertussis
cuccaggcucaggcggc

SEQ ID NO: 373959 - RNA, 15 nt, Bordetella pertussis
cuccaugcggcggcg

SEQ ID NO: 373960 - RNA, 15 nt, Bordetella pertussis
cucccacgaacgcca

SEQ ID NO: 373961 - RNA, 18 nt, Bordetella pertussis
cucccagaccugcgcgcc

SEQ ID NO: 373962 - RNA, 20 nt, Bordetella pertussis
cucccagaccugcgcgccgg

SEQ ID NO: 373963 - RNA, 21 nt, Bordetella pertussis
cucccgcugacuuccggggag

SEQ ID NO: 373964 - RNA, 14 nt, Bordetella pertussis
cucccgcuggcggc

SEQ ID NO: 373965 - RNA, 17 nt, Bordetella pertussis
cucccagaaacuggcgc

SEQ ID NO: 373966 - RNA, 18 nt, Bordetella pertussis
cucccugugggggacagg

SEQ ID NO: 373967 - RNA, 21 nt, Bordetella pertussis
cucccugugggggacaggcac

SEQ ID NO: 373968 - RNA, 14 nt, Bordetella pertussis
cuccgaacgcgaca

SEQ ID NO: 373969 - RNA, 14 nt, Bordetella pertussis
cuccgaagggcugc

SEQ ID NO: 373970 - RNA, 19 nt, Bordetella pertussis
cuccgagggacaccgcagg

SEQ ID NO: 373971 - RNA, 17 nt, Bordetella pertussis
cuccgauagcggcgccg

SEQ ID NO: 373972 - RNA, 18 nt, Bordetella pertussis
cuccgccauggaggcgca

SEQ ID NO: 373973 - RNA, 14 nt, Bordetella pertussis
cuccgcgccgacca

SEQ ID NO: 373974 - RNA, 16 nt, Bordetella pertussis
cuccgcguugcgcugc

SEQ ID NO: 373975 - RNA, 19 nt, Bordetella pertussis
cuccggauaccgccgccgc

SEQ ID NO: 373976 - RNA, 14 nt, Bordetella pertussis
cuccggcaacagca

SEQ ID NO: 373977 - RNA, 17 nt, Bordetella pertussis
cuccggccgggccagcg

SEQ ID NO: 373978 - RNA, 20 nt, Bordetella pertussis
cuccggccgggccagcgcga

SEQ ID NO: 373979 - RNA, 19 nt, Bordetella pertussis
cuccggcgccagcaugcgc

SEQ ID NO: 373980 - RNA, 11 nt, Bordetella pertussis
cuccggcgcca

SEQ ID NO: 373981 - RNA, 17 nt, Bordetella pertussis
cuccggcggcagcgcga

SEQ ID NO: 373982 - RNA, 17 nt, Bordetella pertussis
cuccggcgugauggacg

SEQ ID NO: 373983 - RNA, 17 nt, Bordetella pertussis
cuccggcugcgcgcgca

SEQ ID NO: 373984 - RNA, 15 nt, Bordetella pertussis
cuccgggagccuguc

SEQ ID NO: 373985 - RNA, 18 nt, Bordetella pertussis
cuccucgacgucgcccaa

SEQ ID NO: 373986 - RNA, 23 nt, Bordetella pertussis
cuccucgcccgaccugcuggcgc

SEQ ID NO: 373987 - RNA, 13 nt, Bordetella pertussis
cuccucgcgcgcg

SEQ ID NO: 373988 - RNA, 21 nt, Bordetella pertussis
cuccucggccugccggcgcgc

SEQ ID NO: 373989 - RNA, 19 nt, Bordetella pertussis
cuccugugggggcgcggcg

SEQ ID NO: 373990 - RNA, 15 nt, Bordetella pertussis
cuccuugacgcgcgc

SEQ ID NO: 373991 - RNA, 16 nt, Bordetella pertussis
cuccuugacgcgcgcg

SEQ ID NO: 373992 - RNA, 16 nt, Bordetella pertussis
cucgaacaggccaucg

SEQ ID NO: 373993 - RNA, 14 nt, Bordetella pertussis
cucgaacacgccga

SEQ ID NO: 373994 - RNA, 16 nt, Bordetella pertussis
cucgaacgccgcgucg

SEQ ID NO: 373995 - RNA, 16 nt, Bordetella pertussis
cucgaagcccggcagg

SEQ ID NO: 373996 - RNA, 17 nt, Bordetella pertussis
cucgaagcggcucaggc

SEQ ID NO: 373997 - RNA, 18 nt, Bordetella pertussis
cucgacgaacacgcgcgc

SEQ ID NO: 373998 - RNA, 20 nt, Bordetella pertussis
cucgacgaacacgcgcgccg

SEQ ID NO: 373999 - RNA, 19 nt, Bordetella pertussis
cucgacgaagcccgugucg

SEQ ID NO: 374000 - RNA, 20 nt, Bordetella pertussis
cucgaccgcuucggucagcu

SEQ ID NO: 374001 - RNA, 19 nt, Bordetella pertussis
cucgacgaugcccugcgcc

SEQ ID NO: 374002 - RNA, 17 nt, Bordetella pertussis
cucgacgcaaucggcga

SEQ ID NO: 374003 - RNA, 19 nt, Bordetella pertussis
cucgacguaagugcccagg

SEQ ID NO: 374004 - RNA, 12 nt, Bordetella pertussis
cucgagccggcu

SEQ ID NO: 374005 - RNA, 20 nt, Bordetella pertussis
cucgagcggcagcagcgaga

SEQ ID NO: 374006 - RNA, 13 nt, Bordetella pertussis
cucgagcggcgga

SEQ ID NO: 374007 - RNA, 19 nt, Bordetella pertussis
cucgagcgcggcgcgcgcg

SEQ ID NO: 374008 - RNA, 16 nt, Bordetella pertussis
cucgcacacgcgcugg

SEQ ID NO: 374009 - RNA, 18 nt, Bordetella pertussis
cucgcacacgcgcugggc

SEQ ID NO: 374010 - RNA, 21 nt, Bordetella pertussis
cucgcacggccgucaacagca

SEQ ID NO: 374011 - RNA, 17 nt, Bordetella pertussis
cucgcacgugacgccgg

SEQ ID NO: 374012 - RNA, 23 nt, Bordetella pertussis
cucgcaggccugcugcagcguga

SEQ ID NO: 374013 - RNA, 23 nt, Bordetella pertussis
cucgcaucggccugcaccggcgc

SEQ ID NO: 374014 - RNA, 14 nt, Bordetella pertussis
cucgccacacgcca

SEQ ID NO: 374015 - RNA, 13 nt, Bordetella pertussis
cucgccagcggca

SEQ ID NO: 374016 - RNA, 19 nt, Bordetella pertussis
cucgccagcggcagcgcgc

SEQ ID NO: 374017 - RNA, 12 nt, Bordetella pertussis
cucgcccagcac

SEQ ID NO: 374018 - RNA, 20 nt, Bordetella pertussis
cucgcccagcgagccggcca

SEQ ID NO: 374019 - RNA, 22 nt, Bordetella pertussis
cucgcccagcgagccggccagc

SEQ ID NO: 374020 - RNA, 16 nt, Bordetella pertussis
cucgcccagcggcgcc

SEQ ID NO: 374021 - RNA, 23 nt, Bordetella pertussis
cucgcccagcggcgccgaccagg

SEQ ID NO: 374022 - RNA, 14 nt, Bordetella pertussis
cucgcccaggccca

SEQ ID NO: 374023 - RNA, 17 nt, Bordetella pertussis
cucgcccaggcccagca

SEQ ID NO: 374024 - RNA, 19 nt, Bordetella pertussis
cucgcccccgaaggccgcg

SEQ ID NO: 374025 - RNA, 20 nt, Bordetella pertussis
cucgcccccgaaggccgcgc

SEQ ID NO: 374026 - RNA, 21 nt, Bordetella pertussis
cucgcccccgaaggccgcgcc

SEQ ID NO: 374027 - RNA, 13 nt, Bordetella pertussis
cucgccccgacca

SEQ ID NO: 374028 - RNA, 20 nt, Bordetella pertussis
cucgccccggcgcgcagcgc

SEQ ID NO: 374029 - RNA, 12 nt, Bordetella pertussis
cucgcccgaccu

SEQ ID NO: 374030 - RNA, 14 nt, Bordetella pertussis
cucgcccgaccugc

SEQ ID NO: 374031 - RNA, 17 nt, Bordetella pertussis
cucgcccgaccugcugg

SEQ ID NO: 374032 - RNA, 15 nt, Bordetella pertussis
cucgcccucgcgcca

SEQ ID NO: 374033 - RNA, 18 nt, Bordetella pertussis
cucgcccucgcgccacca

SEQ ID NO: 374034 - RNA, 15 nt, Bordetella pertussis
cucgcccugcucgcg

SEQ ID NO: 374035 - RNA, 14 nt, Bordetella pertussis
cucgcccuggcgca

SEQ ID NO: 374036 - RNA, 19 nt, Bordetella pertussis
cucgccgaacugccggcgc

SEQ ID NO: 374037 - RNA, 15 nt, Bordetella pertussis
cucgccgagccgggc

SEQ ID NO: 374038 - RNA, 16 nt, Bordetella pertussis
cucgccgagccgggcc

SEQ ID NO: 374039 - RNA, 13 nt, Bordetella pertussis
cucgccgcccagc

SEQ ID NO: 374040 - RNA, 19 nt, Bordetella pertussis
cucgccgcccagccggccg

SEQ ID NO: 374041 - RNA, 12 nt, Bordetella pertussis
cucgccgcgcac

SEQ ID NO: 374042 - RNA, 22 nt, Bordetella pertussis
cucgccgcgcgacagccgcgcc

SEQ ID NO: 374043 - RNA, 22 nt, Bordetella pertussis
cucgccggcccugccgcccugg

SEQ ID NO: 374044 - RNA, 15 nt, Bordetella pertussis
cucgccggccgcgcc

SEQ ID NO: 374045 - RNA, 17 nt, Bordetella pertussis
cucgccggccgcgccca

SEQ ID NO: 374046 - RNA, 16 nt, Bordetella pertussis
cucgccggccuggcgc

SEQ ID NO: 374047 - RNA, 14 nt, Bordetella pertussis
cucgccggcgcugc

SEQ ID NO: 374048 - RNA, 15 nt, Bordetella pertussis
cucgccuccccaggc

SEQ ID NO: 374049 - RNA, 17 nt, Bordetella pertussis
cucgcgcacagcgcgca

SEQ ID NO: 374050 - RNA, 14 nt, Bordetella pertussis
cucgcggcuggugg

SEQ ID NO: 374051 - RNA, 16 nt, Bordetella pertussis
cucgcgggccuuggcc

SEQ ID NO: 374052 - RNA, 20 nt, Bordetella pertussis
cucgcgggccuuggccagca

SEQ ID NO: 374053 - RNA, 15 nt, Bordetella pertussis
cucgcugaccggcgu

SEQ ID NO: 374054 - RNA, 14 nt, Bordetella pertussis
cucgcugccggcgc

SEQ ID NO: 374055 - RNA, 14 nt, Bordetella pertussis
cucgcugccggcgu

SEQ ID NO: 374056 - RNA, 16 nt, Bordetella pertussis
cucgcugccggcgucc

SEQ ID NO: 374057 - RNA, 15 nt, Bordetella pertussis
cucggcacggccagc

SEQ ID NO: 374058 - RNA, 13 nt, Bordetella pertussis
cucggccaggcca

SEQ ID NO: 374059 - RNA, 18 nt, Bordetella pertussis
cucggccaggccauggcg

SEQ ID NO: 374060 - RNA, 14 nt, Bordetella pertussis
cucggcaucggcca

SEQ ID NO: 374061 - RNA, 15 nt, Bordetella pertussis
cucggccaggucgcg

SEQ ID NO: 374062 - RNA, 20 nt, Bordetella pertussis
cucggccaggugcgccaugc

SEQ ID NO: 374063 - RNA, 20 nt, Bordetella pertussis
cucggccauguagauggccg

SEQ ID NO: 374064 - RNA, 20 nt, Bordetella pertussis
cucggcccuagagcaugcgg

SEQ ID NO: 374065 - RNA, 17 nt, Bordetella pertussis
cucggccucgcggcgca

SEQ ID NO: 374066 - RNA, 23 nt, Bordetella pertussis
cucggccugcccguucacgcgca

SEQ ID NO: 374067 - RNA, 16 nt, Bordetella pertussis
cucggccugccggcgc

SEQ ID NO: 374068 - RNA, 16 nt, Bordetella pertussis
cucggccucggucagg

SEQ ID NO: 374069 - RNA, 19 nt, Bordetella pertussis
cucggccucgguggucagg

SEQ ID NO: 374070 - RNA, 17 nt, Bordetella pertussis
cucggccuugggcgcgg

SEQ ID NO: 374071 - RNA, 18 nt, Bordetella pertussis
cucggugcgggccggcgc

SEQ ID NO: 374072 - RNA, 18 nt, Bordetella pertussis
cucgguggaggacgccga

SEQ ID NO: 374073 - RNA, 19 nt, Bordetella pertussis
cucguacggcgucgggcag

SEQ ID NO: 374074 - RNA, 13 nt, Bordetella pertussis
cucguccaucgcc

SEQ ID NO: 374075 - RNA, 15 nt, Bordetella pertussis
cucguccaucgccug

SEQ ID NO: 374076 - RNA, 14 nt, Bordetella pertussis
cucguccgauggcg

SEQ ID NO: 374077 - RNA, 19 nt, Bordetella pertussis
cucguccgucucgcccagg

SEQ ID NO: 374078 - RNA, 12 nt, Bordetella pertussis
cucgucgacgcg

SEQ ID NO: 374079 - RNA, 20 nt, Bordetella pertussis
cucgucggucaugcccaugc

SEQ ID NO: 374080 - RNA, 20 nt, Bordetella pertussis
cucguuccagaugcgcagca

SEQ ID NO: 374081 - RNA, 14 nt, Bordetella pertussis
cucguugcccgcgg

SEQ ID NO: 374082 - RNA, 13 nt, Bordetella pertussis
cucguugcgcaag

SEQ ID NO: 374083 - RNA, 16 nt, Bordetella pertussis
cucguuggccagcgcg

SEQ ID NO: 374084 - RNA, 19 nt, Bordetella pertussis
cucuacaccaucaacgggc

SEQ ID NO: 374085 - RNA, 19 nt, Bordetella pertussis
cucugcccgaagcggcccg

SEQ ID NO: 374086 - RNA, 19 nt, Bordetella pertussis
cucuugaccugggccagca

SEQ ID NO: 374087 - RNA, 21 nt, Bordetella pertussis
cucuuggcaaccucgccgcgc

SEQ ID NO: 374088 - RNA, 18 nt, Bordetella pertussis
cugaacgaauaaucgccg

SEQ ID NO: 374089 - RNA, 14 nt, Bordetella pertussis
cugaacgccgggcc

SEQ ID NO: 374090 - RNA, 19 nt, Bordetella pertussis
cugaacgccgggccgugcg

SEQ ID NO: 374091 - RNA, 13 nt, Bordetella pertussis
cugaacgcgcgug

SEQ ID NO: 374092 - RNA, 21 nt, Bordetella pertussis
cugaacgcgcgugaacggcuc

SEQ ID NO: 374093 - RNA, 15 nt, Bordetella pertussis
cugaacgcguccagg

SEQ ID NO: 374094 - RNA, 22 nt, Bordetella pertussis
cugaacgcguccaggcccuggc

SEQ ID NO: 374095 - RNA, 18 nt, Bordetella pertussis
cugaaguaguacucgccg

SEQ ID NO: 374096 - RNA, 16 nt, Bordetella pertussis
cugaaucgcccgggcg

SEQ ID NO: 374097 - RNA, 17 nt, Bordetella pertussis
cugaaucgcccgggcgc

SEQ ID NO: 374098 - RNA, 14 nt, Bordetella pertussis
cugaaugccgccgu

SEQ ID NO: 374099 - RNA, 17 nt, Bordetella pertussis
cugaaugccgccgugau

SEQ ID NO: 374100 - RNA, 20 nt, Bordetella pertussis
cugacaccguuuuggcaggc

SEQ ID NO: 374101 - RNA, 12 nt, Bordetella pertussis
cugaccaccggg

SEQ ID NO: 374102 - RNA, 18 nt, Bordetella pertussis
cugaccagcacgaugguc

SEQ ID NO: 374103 - RNA, 23 nt, Bordetella pertussis
cugaccagcagcaccgugccggc

SEQ ID NO: 374104 - RNA, 13 nt, Bordetella pertussis
cugaccgacggcc

SEQ ID NO: 374105 - RNA, 19 nt, Bordetella pertussis
cugaccgacgugcgccgca

SEQ ID NO: 374106 - RNA, 13 nt, Bordetella pertussis
cugaccgaagcgc

SEQ ID NO: 374107 - RNA, 17 nt, Bordetella pertussis
cugaccggcggcacggc

SEQ ID NO: 374108 - RNA, 21 nt, Bordetella pertussis
cugacggccccguugucgccg

SEQ ID NO: 374109 - RNA, 13 nt, Bordetella pertussis
cugacgggccucg

SEQ ID NO: 374110 - RNA, 14 nt, Bordetella pertussis
cugacgggccucga

SEQ ID NO: 374111 - RNA, 19 nt, Bordetella pertussis
cugacgggucacccgccgc

SEQ ID NO: 374112 - RNA, 13 nt, Bordetella pertussis
cugagccaggcgc

SEQ ID NO: 374113 - RNA, 21 nt, Bordetella pertussis
cugagccaggcgcccggcgug

SEQ ID NO: 374114 - RNA, 18 nt, Bordetella pertussis
cugagccauuccggcugg

SEQ ID NO: 374115 - RNA, 19 nt, Bordetella pertussis
cugagccgauacaggcgcu

SEQ ID NO: 374116 - RNA, 21 nt, Bordetella pertussis
cugagcgacaugucgccgcgg

SEQ ID NO: 374117 - RNA, 16 nt, Bordetella pertussis
cugagcgugacguagc

SEQ ID NO: 374118 - RNA, 19 nt, Bordetella pertussis
cugaucccggcgcuggccg

SEQ ID NO: 374119 - RNA, 18 nt, Bordetella pertussis
cugauccucgccagcggc

SEQ ID NO: 374120 - RNA, 23 nt, Bordetella pertussis
cugaucgaggagcugcugugcgc

SEQ ID NO: 374121 - RNA, 24 nt, Bordetella pertussis
cugaucgaggagcugcugugcgcc

SEQ ID NO: 374122 - RNA, 19 nt, Bordetella pertussis
cugaucgacaugcuggccc

SEQ ID NO: 374123 - RNA, 17 nt, Bordetella pertussis
cugaucgcgcagcgccu

SEQ ID NO: 374124 - RNA, 14 nt, Bordetella pertussis
cugaucggccgacu

SEQ ID NO: 374125 - RNA, 13 nt, Bordetella pertussis
cugaucggggcca

SEQ ID NO: 374126 - RNA, 17 nt, Bordetella pertussis
cugaugagaucgcccgc

SEQ ID NO: 374127 - RNA, 19 nt, Bordetella pertussis
cugaugagaucgcccgcgu

SEQ ID NO: 374128 - RNA, 14 nt, Bordetella pertussis
cugaugcccagccc

SEQ ID NO: 374129 - RNA, 15 nt, Bordetella pertussis
cugaugcccagcccg

SEQ ID NO: 374130 - RNA, 17 nt, Bordetella pertussis
cugaugcccagcccggc

SEQ ID NO: 374131 - RNA, 22 nt, Bordetella pertussis
cugcaccagcgcgccgcgcgcg

SEQ ID NO: 374132 - RNA, 23 nt, Bordetella pertussis
cugcacccacacuuggccggcga

SEQ ID NO: 374133 - RNA, 23 nt, Bordetella pertussis
cugcacgcgcgcgggcgcgccgu

SEQ ID NO: 374134 - RNA, 17 nt, Bordetella pertussis
cugcacgcgcgcgugca

SEQ ID NO: 374135 - RNA, 19 nt, Bordetella pertussis
cugcacgcggccgcgcagg

SEQ ID NO: 374136 - RNA, 14 nt, Bordetella pertussis
cugcacgcgggcgc

SEQ ID NO: 374137 - RNA, 22 nt, Bordetella pertussis
cugcacgcucuugagcgcggcc

SEQ ID NO: 374138 - RNA, 23 nt, Bordetella pertussis
cugcacggcggaaugcggcgaca

SEQ ID NO: 374139 - RNA, 20 nt, Bordetella pertussis
cugcacggugggcagcagca

SEQ ID NO: 374140 - RNA, 22 nt, Bordetella pertussis
cugcacgucccagucgccgcgc

SEQ ID NO: 374141 - RNA, 20 nt, Bordetella pertussis
cugcacgugaugcaggcggu

SEQ ID NO: 374142 - RNA, 17 nt, Bordetella pertussis
cugcacuugcgaacggc

SEQ ID NO: 374143 - RNA, 17 nt, Bordetella pertussis
cugcagcacgcaccagg

SEQ ID NO: 374144 - RNA, 14 nt, Bordetella pertussis
cugcagcagcggca

SEQ ID NO: 374145 - RNA, 17 nt, Bordetella pertussis
cugcagcagcguggccg

SEQ ID NO: 374146 - RNA, 23 nt, Bordetella pertussis
cugcagcagcguggccgccacca

SEQ ID NO: 374147 - RNA, 17 nt, Bordetella pertussis
cugcagcaggcgcacca

SEQ ID NO: 374148 - RNA, 21 nt, Bordetella pertussis
cugcagccaguugggccaggg

SEQ ID NO: 374149 - RNA, 13 nt, Bordetella pertussis
cugcagcgccgcc

SEQ ID NO: 374150 - RNA, 16 nt, Bordetella pertussis
cugcagcgccgccugg

SEQ ID NO: 374151 - RNA, 14 nt, Bordetella pertussis
cugcagcgcgcgcg

SEQ ID NO: 374152 - RNA, 21 nt, Bordetella pertussis
cugcagcgcugguucgaccug

SEQ ID NO: 374153 - RNA, 17 nt, Bordetella pertussis
cugcagcuugcgcgcca

SEQ ID NO: 374154 - RNA, 17 nt, Bordetella pertussis
cugcaggaagccugcgc

SEQ ID NO: 374155 - RNA, 20 nt, Bordetella pertussis
cugcaggccaucgcggucga

SEQ ID NO: 374156 - RNA, 17 nt, Bordetella pertussis
cugcaggcccagcacgc

SEQ ID NO: 374157 - RNA, 22 nt, Bordetella pertussis
cugcaggcccagcacgcgcgcc

SEQ ID NO: 374158 - RNA, 13 nt, Bordetella pertussis
cugcaggcccggc

SEQ ID NO: 374159 - RNA, 14 nt, Bordetella pertussis
cugcaggcccggcg

SEQ ID NO: 374160 - RNA, 19 nt, Bordetella pertussis
cugcaggaucgcggccagc

SEQ ID NO: 374161 - RNA, 23 nt, Bordetella pertussis
cugcaggaucgcggccagcggca

SEQ ID NO: 374162 - RNA, 16 nt, Bordetella pertussis
cugcaggaugaggcgc

SEQ ID NO: 374163 - RNA, 12 nt, Bordetella pertussis
cugcaggauggg

SEQ ID NO: 374164 - RNA, 12 nt, Bordetella pertussis
cugcaggccggc

SEQ ID NO: 374165 - RNA, 16 nt, Bordetella pertussis
cugcaggccgggcagu

SEQ ID NO: 374166 - RNA, 16 nt, Bordetella pertussis
cugcaggcgcugcgca

SEQ ID NO: 374167 - RNA, 22 nt, Bordetella pertussis
cugcaggcgucccggaugcgau

SEQ ID NO: 374168 - RNA, 20 nt, Bordetella pertussis
cugcaggcucuggcugacga

SEQ ID NO: 374169 - RNA, 21 nt, Bordetella pertussis
cugcagggcaugggcccgggc

SEQ ID NO: 374170 - RNA, 23 nt, Bordetella pertussis
cugcagggcaugggcccgggcgc

SEQ ID NO: 374171 - RNA, 15 nt, Bordetella pertussis
cugcagggcgucugc

SEQ ID NO: 374172 - RNA, 21 nt, Bordetella pertussis
cugcagggcgucugcucgccg

SEQ ID NO: 374173 - RNA, 18 nt, Bordetella pertussis
cugcagggucagcccgcc

SEQ ID NO: 374174 - RNA, 23 nt, Bordetella pertussis
cugcagguccugguagaucagcg

SEQ ID NO: 374175 - RNA, 21 nt, Bordetella pertussis
cugcaggugccugucccagcg

SEQ ID NO: 374176 - RNA, 19 nt, Bordetella pertussis
cugcaguucggccgccagg

SEQ ID NO: 374177 - RNA, 14 nt, Bordetella pertussis
cugcaguugcgcca

SEQ ID NO: 374178 - RNA, 16 nt, Bordetella pertussis
cugcaguugcgccacg

SEQ ID NO: 374179 - RNA, 14 nt, Bordetella pertussis
cugcauccggccca

SEQ ID NO: 374180 - RNA, 18 nt, Bordetella pertussis
cugcauccggcccagcgc

SEQ ID NO: 374181 - RNA, 14 nt, Bordetella pertussis
cugcaucggcauga

SEQ ID NO: 374182 - RNA, 21 nt, Bordetella pertussis
cugcaugccauggacgagggc

SEQ ID NO: 374183 - RNA, 20 nt, Bordetella pertussis
cugcauguacucggccaggc

SEQ ID NO: 374184 - RNA, 22 nt, Bordetella pertussis
cugcauguacucggccaggcca

SEQ ID NO: 374185 - RNA, 15 nt, Bordetella pertussis
cugccaccagcgcgc

SEQ ID NO: 374186 - RNA, 20 nt, Bordetella pertussis
cugccaccagcgcgccagca

SEQ ID NO: 374187 - RNA, 16 nt, Bordetella pertussis
cugccagaacagccgc

SEQ ID NO: 374188 - RNA, 16 nt, Bordetella pertussis
cugccagacggccagc

SEQ ID NO: 374189 - RNA, 19 nt, Bordetella pertussis
cugccagacggccagcgcg

SEQ ID NO: 374190 - RNA, 21 nt, Bordetella pertussis
cugccagacggccagcgcgcg

SEQ ID NO: 374191 - RNA, 22 nt, Bordetella pertussis
cugccagccauguucgaccagg

SEQ ID NO: 374192 - RNA, 23 nt, Bordetella pertussis
cugccagccauguucgaccagga

SEQ ID NO: 374193 - RNA, 17 nt, Bordetella pertussis
cugccagcccaccagcg

SEQ ID NO: 374194 - RNA, 13 nt, Bordetella pertussis
cugccaggcgagc

SEQ ID NO: 374195 - RNA, 20 nt, Bordetella pertussis
cugccaggcgagcgccgcgc

SEQ ID NO: 374196 - RNA, 21 nt, Bordetella pertussis
cugccaggcgagcgccgcgcu

SEQ ID NO: 374197 - RNA, 18 nt, Bordetella pertussis
cugccaggcgccgcgucc

SEQ ID NO: 374198 - RNA, 19 nt, Bordetella pertussis
cugccagggaaucacccga

SEQ ID NO: 374199 - RNA, 17 nt, Bordetella pertussis
cugccaguccauccagc

SEQ ID NO: 374200 - RNA, 23 nt, Bordetella pertussis
cugccaguugaaccgcaacgcca

SEQ ID NO: 374201 - RNA, 13 nt, Bordetella pertussis
cugccauccggcc

SEQ ID NO: 374202 - RNA, 16 nt, Bordetella pertussis
cugccauccggccgca

SEQ ID NO: 374203 - RNA, 19 nt, Bordetella pertussis
cugccaugccccauccagc

SEQ ID NO: 374204 - RNA, 13 nt, Bordetella pertussis
cugccaugccgcg

SEQ ID NO: 374205 - RNA, 17 nt, Bordetella pertussis
cugccaugccgcgcgcc

SEQ ID NO: 374206 - RNA, 19 nt, Bordetella pertussis
cugccauggccccgggcgg

SEQ ID NO: 374207 - RNA, 13 nt, Bordetella pertussis
cugccauucgucg

SEQ ID NO: 374208 - RNA, 19 nt, Bordetella pertussis
cugcccaccgccgcccgcc

SEQ ID NO: 374209 - RNA, 22 nt, Bordetella pertussis
cugcccaccgccgcccgccagg

SEQ ID NO: 374210 - RNA, 19 nt, Bordetella pertussis
cugcccaccuuccugcugg

SEQ ID NO: 374211 - RNA, 14 nt, Bordetella pertussis
cugcccaccuugcg

SEQ ID NO: 374212 - RNA, 18 nt, Bordetella pertussis
cugcccagccacaccagg

SEQ ID NO: 374213 - RNA, 19 nt, Bordetella pertussis
cugcccagccacaccaggu

SEQ ID NO: 374214 - RNA, 22 nt, Bordetella pertussis
cugcccagcgucagcugggcau

SEQ ID NO: 374215 - RNA, 12 nt, Bordetella pertussis
cugcccaggcca

SEQ ID NO: 374216 - RNA, 17 nt, Bordetella pertussis
cugccccccgagggggc

SEQ ID NO: 374217 - RNA, 18 nt, Bordetella pertussis
cugccccccgagggggcu

SEQ ID NO: 374218 - RNA, 15 nt, Bordetella pertussis
cugccccgccugcgc

SEQ ID NO: 374219 - RNA, 17 nt, Bordetella pertussis
cugccccggcagagaca

SEQ ID NO: 374220 - RNA, 13 nt, Bordetella pertussis
cugccccagcggc

SEQ ID NO: 374221 - RNA, 21 nt, Bordetella pertussis
cugccccagcggcuggcgcac

SEQ ID NO: 374222 - RNA, 22 nt, Bordetella pertussis
cugccccaucccauccgcgcca

SEQ ID NO: 374223 - RNA, 14 nt, Bordetella pertussis
cugccccauggcau

SEQ ID NO: 374224 - RNA, 20 nt, Bordetella pertussis
cugcccgaagcgcagcacca

SEQ ID NO: 374225 - RNA, 19 nt, Bordetella pertussis
cugccccugcggggacagg

SEQ ID NO: 374226 - RNA, 16 nt, Bordetella pertussis
cugcccgacggcgccg

SEQ ID NO: 374227 - RNA, 21 nt, Bordetella pertussis
cugcccgagaccgcccgcugc

SEQ ID NO: 374228 - RNA, 12 nt, Bordetella pertussis
cugcccgcaacg

SEQ ID NO: 374229 - RNA, 14 nt, Bordetella pertussis
cugcccgcacgggc

SEQ ID NO: 374230 - RNA, 16 nt, Bordetella pertussis
cugcccgcacgggccg

SEQ ID NO: 374231 - RNA, 22 nt, Bordetella pertussis
cugcccgcacgggccgacggcc

SEQ ID NO: 374232 - RNA, 14 nt, Bordetella pertussis
cugcccgccugguc

SEQ ID NO: 374233 - RNA, 22 nt, Bordetella pertussis
cugcccgcgguccagcacggcg

SEQ ID NO: 374234 - RNA, 23 nt, Bordetella pertussis
cugcccgcgguccagcacggcga

SEQ ID NO: 374235 - RNA, 20 nt, Bordetella pertussis
cugcccgggcaccagguccu

SEQ ID NO: 374236 - RNA, 16 nt, Bordetella pertussis
cugcccgggcagcacc

SEQ ID NO: 374237 - RNA, 19 nt, Bordetella pertussis
cugcccgggcagcaccgcu

SEQ ID NO: 374238 - RNA, 17 nt, Bordetella pertussis
cugcccgucgcuggcgc

SEQ ID NO: 374239 - RNA, 22 nt, Bordetella pertussis
cugcccguacgucaaggccugc

SEQ ID NO: 374240 - RNA, 16 nt, Bordetella pertussis
cugcccgucuuggcgu

SEQ ID NO: 374241 - RNA, 21 nt, Bordetella pertussis
cugcccucgggcgacaggcgc

SEQ ID NO: 374242 - RNA, 19 nt, Bordetella pertussis
cugcccucggucagcgcca

SEQ ID NO: 374243 - RNA, 21 nt, Bordetella pertussis
cugcccucggucagcgccagg

SEQ ID NO: 374244 - RNA, 22 nt, Bordetella pertussis
cugcccugcaugaccgccgcca

SEQ ID NO: 374245 - RNA, 13 nt, Bordetella pertussis
cugcccuggcgcu

SEQ ID NO: 374246 - RNA, 20 nt, Bordetella pertussis
cugcccugguggcagagggc

SEQ ID NO: 374247 - RNA, 15 nt, Bordetella pertussis
cugccgaaacgcugg

SEQ ID NO: 374248 - RNA, 16 nt, Bordetella pertussis
cugccgaaacgcuggc

SEQ ID NO: 374249 - RNA, 19 nt, Bordetella pertussis
cugccgaaacgcuggcgua

SEQ ID NO: 374250 - RNA, 22 nt, Bordetella pertussis
cugccgaauucguuggugccca

SEQ ID NO: 374251 - RNA, 16 nt, Bordetella pertussis
cugccgaccagcacgg

SEQ ID NO: 374252 - RNA, 18 nt, Bordetella pertussis
cugccgagcgcugcgcca

SEQ ID NO: 374253 - RNA, 20 nt, Bordetella pertussis
cugccgaucgugcacgcccg

SEQ ID NO: 374254 - RNA, 21 nt, Bordetella pertussis
cugccgcaucccgcccccgcc

SEQ ID NO: 374255 - RNA, 13 nt, Bordetella pertussis
cugccgcccgagc

SEQ ID NO: 374256 - RNA, 21 nt, Bordetella pertussis
cugccgcccgagcuggccggc

SEQ ID NO: 374257 - RNA, 23 nt, Bordetella pertussis
cugccgcccgagcuggccggcga

SEQ ID NO: 374258 - RNA, 16 nt, Bordetella pertussis
cugccgccgaugugcg

SEQ ID NO: 374259 - RNA, 13 nt, Bordetella pertussis
cugccgccggcga

SEQ ID NO: 374260 - RNA, 12 nt, Bordetella pertussis
cugccgcgcgau

SEQ ID NO: 374261 - RNA, 20 nt, Bordetella pertussis
cugccgcgcgauccggcgug

SEQ ID NO: 374262 - RNA, 12 nt, Bordetella pertussis
cugccgcgcgcc

SEQ ID NO: 374263 - RNA, 15 nt, Bordetella pertussis
cugccgcgcgccggc

SEQ ID NO: 374264 - RNA, 21 nt, Bordetella pertussis
cugccgcgcgccggcgccggc

SEQ ID NO: 374265 - RNA, 19 nt, Bordetella pertussis
cugccgcggauugccgucc

SEQ ID NO: 374266 - RNA, 17 nt, Bordetella pertussis
cugccgcgcccggcggc

SEQ ID NO: 374267 - RNA, 12 nt, Bordetella pertussis
cugccgcugacc

SEQ ID NO: 374268 - RNA, 19 nt, Bordetella pertussis
cugccgcugaccggcggca

SEQ ID NO: 374269 - RNA, 20 nt, Bordetella pertussis
cugccggaaacccgggcuuu

SEQ ID NO: 374270 - RNA, 22 nt, Bordetella pertussis
cugccggccgaccggcgcgcgc

SEQ ID NO: 374271 - RNA, 17 nt, Bordetella pertussis
cugccggccggccagua

SEQ ID NO: 374272 - RNA, 13 nt, Bordetella pertussis
cugccggccuggc

SEQ ID NO: 374273 - RNA, 13 nt, Bordetella pertussis
cugccggcgcgcc

SEQ ID NO: 374274 - RNA, 17 nt, Bordetella pertussis
cugccggcgcgcccagg

SEQ ID NO: 374275 - RNA, 23 nt, Bordetella pertussis
cugccggcgcgccucggcgcgcg

SEQ ID NO: 374276 - RNA, 16 nt, Bordetella pertussis
cugccggcgcgggcgc

SEQ ID NO: 374277 - RNA, 14 nt, Bordetella pertussis
cugccggcgcccuu

SEQ ID NO: 374278 - RNA, 21 nt, Bordetella pertussis
cugccggcguccugcggcggc

SEQ ID NO: 374279 - RNA, 20 nt, Bordetella pertussis
cugccggcguuggccggguc

SEQ ID NO: 374280 - RNA, 14 nt, Bordetella pertussis
cugccgggcaugaa

SEQ ID NO: 374281 - RNA, 16 nt, Bordetella pertussis
cugccgggcucggcca

SEQ ID NO: 374282 - RNA, 18 nt, Bordetella pertussis
cugccggggcacccaggc

SEQ ID NO: 374283 - RNA, 22 nt, Bordetella pertussis
cugccggggcacccaggcgggc

SEQ ID NO: 374284 - RNA, 21 nt, Bordetella pertussis
cugccgguaaccgacgcagcg

SEQ ID NO: 374285 - RNA, 22 nt, Bordetella pertussis
cugccgguaaccgacgcagcgc

SEQ ID NO: 374286 - RNA, 15 nt, Bordetella pertussis
cugccguagcccagg

SEQ ID NO: 374287 - RNA, 16 nt, Bordetella pertussis
cugccguagcccaggu

SEQ ID NO: 374288 - RNA, 18 nt, Bordetella pertussis
cugccguagcccaggucc

SEQ ID NO: 374289 - RNA, 22 nt, Bordetella pertussis
cugccguagcccagguccagcg

SEQ ID NO: 374290 - RNA, 15 nt, Bordetella pertussis
cugccgucggccagc

SEQ ID NO: 374291 - RNA, 16 nt, Bordetella pertussis
cugccgucggccagcu

SEQ ID NO: 374292 - RNA, 15 nt, Bordetella pertussis
cugccgucggcguug

SEQ ID NO: 374293 - RNA, 18 nt, Bordetella pertussis
cugccgucgucguccagg

SEQ ID NO: 374294 - RNA, 19 nt, Bordetella pertussis
cugccgucgucguccaggc

SEQ ID NO: 374295 - RNA, 20 nt, Bordetella pertussis
cugccgugcagauggcggau

SEQ ID NO: 374296 - RNA, 23 nt, Bordetella pertussis
cugccgugggacaggcacccugc

SEQ ID NO: 374297 - RNA, 17 nt, Bordetella pertussis
cugccguucgcgcugcc

SEQ ID NO: 374298 - RNA, 21 nt, Bordetella pertussis
cugccguuucucaacccgccg

SEQ ID NO: 374299 - RNA, 22 nt, Bordetella pertussis
cugccguuucucaacccgccgg

SEQ ID NO: 374300 - RNA, 19 nt, Bordetella pertussis
cugccguuuucgaucaggg

SEQ ID NO: 374301 - RNA, 22 nt, Bordetella pertussis
cugccguuuucgaucagggcga

SEQ ID NO: 374302 - RNA, 21 nt, Bordetella pertussis
cugccuacuugcgggacugga

SEQ ID NO: 374303 - RNA, 23 nt, Bordetella pertussis
cugccuacuugcgggacuggacg

SEQ ID NO: 374304 - RNA, 15 nt, Bordetella pertussis
cugccuccaggcgca

SEQ ID NO: 374305 - RNA, 13 nt, Bordetella pertussis
cugccugcagcgc

SEQ ID NO: 374306 - RNA, 14 nt, Bordetella pertussis
cugccugccgccug

SEQ ID NO: 374307 - RNA, 16 nt, Bordetella pertussis
cugccugccggccggc

SEQ ID NO: 374308 - RNA, 15 nt, Bordetella pertussis
cugccuggcgaacag

SEQ ID NO: 374309 - RNA, 20 nt, Bordetella pertussis
cugcgaaagcgcgucgagca

SEQ ID NO: 374310 - RNA, 15 nt, Bordetella pertussis
cugcgaacgcccggc

SEQ ID NO: 374311 - RNA, 16 nt, Bordetella pertussis
cugcgacagcaccggg

SEQ ID NO: 374312 - RNA, 14 nt, Bordetella pertussis
cugcgacagcagca

SEQ ID NO: 374313 - RNA, 20 nt, Bordetella pertussis
cugcgacagcagcaugcggc

SEQ ID NO: 374314 - RNA, 13 nt, Bordetella pertussis
cugcgacagcagg

SEQ ID NO: 374315 - RNA, 17 nt, Bordetella pertussis
cugcgacaggcgcagcu

SEQ ID NO: 374316 - RNA, 20 nt, Bordetella pertussis
cugcgagacgcgcucgcgcg

SEQ ID NO: 374317 - RNA, 18 nt, Bordetella pertussis
cugcgagagauagcccag

SEQ ID NO: 374318 - RNA, 17 nt, Bordetella pertussis
cuggacgagggccgcgg

SEQ ID NO: 374319 - RNA, 20 nt, Bordetella pertussis
cuggacgagggccgcggcga

SEQ ID NO: 374320 - RNA, 22 nt, Bordetella pertussis
cuggacgagggccgcggcgagc

SEQ ID NO: 374321 - RNA, 13 nt, Bordetella pertussis
cugcgaggacagg

SEQ ID NO: 374322 - RNA, 11 nt, Bordetella pertussis
cuggacgcgcg

SEQ ID NO: 374323 - RNA, 18 nt, Bordetella pertussis
cuggacgcgcgcggcgac

SEQ ID NO: 374324 - RNA, 16 nt, Bordetella pertussis
cuggacgucugagcgc

SEQ ID NO: 374325 - RNA, 18 nt, Bordetella pertussis
cuggacgucugagcgccg

SEQ ID NO: 374326 - RNA, 19 nt, Bordetella pertussis
cuggacgucugagcgccgg

SEQ ID NO: 374327 - RNA, 21 nt, Bordetella pertussis
cuggacuguccggcaacacca

SEQ ID NO: 374328 - RNA, 18 nt, Bordetella pertussis
cuggagaagcgccgcgcc

SEQ ID NO: 374329 - RNA, 19 nt, Bordetella pertussis
cuggagacuggcaccggcc

SEQ ID NO: 374330 - RNA, 14 nt, Bordetella pertussis
cuggagauggcgcc

SEQ ID NO: 374331 - RNA, 17 nt, Bordetella pertussis
cuggagcgccacgccgu

SEQ ID NO: 374332 - RNA, 18 nt, Bordetella pertussis
cuggagcgcggcggcgug

SEQ ID NO: 374333 - RNA, 17 nt, Bordetella pertussis
cuggagcggccuggccc

SEQ ID NO: 374334 - RNA, 20 nt, Bordetella pertussis
cuggagcggccuggccccgc

SEQ ID NO: 374335 - RNA, 21 nt, Bordetella pertussis
cuggagcucgggugggccggc

SEQ ID NO: 374336 - RNA, 20 nt, Bordetella pertussis
cuggagcuuggccggugcca

SEQ ID NO: 374337 - RNA, 15 nt, Bordetella pertussis
cuggauauccacgcc

SEQ ID NO: 374338 - RNA, 22 nt, Bordetella pertussis
cuggauauccacgccuucggcg

SEQ ID NO: 374339 - RNA, 17 nt, Bordetella pertussis
cuggaucaccgccggcg

SEQ ID NO: 374340 - RNA, 19 nt, Bordetella pertussis
cuggaucaggaugggcgcg

SEQ ID NO: 374341 - RNA, 13 nt, Bordetella pertussis
cuggaucgcgccc

SEQ ID NO: 374342 - RNA, 23 nt, Bordetella pertussis
cuggaucgugcccagcuggcacc

SEQ ID NO: 374343 - RNA, 16 nt, Bordetella pertussis
cuggaucuuggccugu

SEQ ID NO: 374344 - RNA, 17 nt, Bordetella pertussis
cuggaucuuggccuguu

SEQ ID NO: 374345 - RNA, 23 nt, Bordetella pertussis
cuggaucuggugaaacagcauca

SEQ ID NO: 374346 - RNA, 18 nt, Bordetella pertussis
cuggauggccuggguggc

SEQ ID NO: 374347 - RNA, 20 nt, Bordetella pertussis
cuggauggccuggguggccu

SEQ ID NO: 374348 - RNA, 21 nt, Bordetella pertussis
cuggauggccuggguggccug

SEQ ID NO: 374349 - RNA, 18 nt, Bordetella pertussis
cuggauggugccgccgcc

SEQ ID NO: 374350 - RNA, 19 nt, Bordetella pertussis
cuggauguacgucagcaug

SEQ ID NO: 374351 - RNA, 17 nt, Bordetella pertussis
cuggcagaugcgcgcca

SEQ ID NO: 374352 - RNA, 20 nt, Bordetella pertussis
cuggcagaugcgcgccaggc

SEQ ID NO: 374353 - RNA, 21 nt, Bordetella pertussis
cuggcagaccgagcgcgcccg

SEQ ID NO: 374354 - RNA, 21 nt, Bordetella pertussis
cuggcagacguacuugaucug

SEQ ID NO: 374355 - RNA, 12 nt, Bordetella pertussis
cuggcagcuggc

SEQ ID NO: 374356 - RNA, 12 nt, Bordetella pertussis
cuggcaggccgc

SEQ ID NO: 374357 - RNA, 22 nt, Bordetella pertussis
cuggccaccgaagcggcguucu

SEQ ID NO: 374358 - RNA, 12 nt, Bordetella pertussis
cuggccacgcug

SEQ ID NO: 374359 - RNA, 17 nt, Bordetella pertussis
cuggccacguugucgcg

SEQ ID NO: 374360 - RNA, 18 nt, Bordetella pertussis
cuggccacuggccgcgcu

SEQ ID NO: 374361 - RNA, 19 nt, Bordetella pertussis
cuggccagauagcccaggc

SEQ ID NO: 374362 - RNA, 18 nt, Bordetella pertussis
cuggccagccgcucgcgc

SEQ ID NO: 374363 - RNA, 22 nt, Bordetella pertussis
cuggccagccgcucgcgcgacc

SEQ ID NO: 374364 - RNA, 23 nt, Bordetella pertussis
cuggccagccgcucgcgcgacca

SEQ ID NO: 374365 - RNA, 23 nt, Bordetella pertussis
cuggcccgaacggcccauccauc

SEQ ID NO: 374366 - RNA, 14 nt, Bordetella pertussis
cuggcccgccagca

SEQ ID NO: 374367 - RNA, 19 nt, Bordetella pertussis
cuggcccgccagcaaggcg

SEQ ID NO: 374368 - RNA, 14 nt, Bordetella pertussis
cuggcccgcgcgag

SEQ ID NO: 374369 - RNA, 22 nt, Bordetella pertussis
cuggcccgcgcgagcggcgugc

SEQ ID NO: 374370 - RNA, 20 nt, Bordetella pertussis
cuggcccggcaccguccagc

SEQ ID NO: 374371 - RNA, 14 nt, Bordetella pertussis
cuggcccgucaugg

SEQ ID NO: 374372 - RNA, 16 nt, Bordetella pertussis
cuggcccgucaugggc

SEQ ID NO: 374373 - RNA, 14 nt, Bordetella pertussis
cuggcccuggcggg

SEQ ID NO: 374374 - RNA, 13 nt, Bordetella pertussis
cuggccgacaagg

SEQ ID NO: 374375 - RNA, 15 nt, Bordetella pertussis
cuggccgacaaggag

SEQ ID NO: 374376 - RNA, 20 nt, Bordetella pertussis
cuggcccuuggucugcaggc

SEQ ID NO: 374377 - RNA, 14 nt, Bordetella pertussis
cuggccugccgcgc

SEQ ID NO: 374378 - RNA, 15 nt, Bordetella pertussis
cuggccugccgcgcc

SEQ ID NO: 374379 - RNA, 21 nt, Bordetella pertussis
cuggccugccgcgccgaccgg

SEQ ID NO: 374380 - RNA, 22 nt, Bordetella pertussis
cuggccugcgccgccgcgcgcu

SEQ ID NO: 374381 - RNA, 15 nt, Bordetella pertussis
cuggccuggccgccg

SEQ ID NO: 374382 - RNA, 16 nt, Bordetella pertussis
cuggccugucuggugg

SEQ ID NO: 374383 - RNA, 17 nt, Bordetella pertussis
cuggccugucugguggc

SEQ ID NO: 374384 - RNA, 20 nt, Bordetella pertussis
cuggccugucugguggcgau

SEQ ID NO: 374385 - RNA, 23 nt, Bordetella pertussis
cuggccuugugcgccgucgcacu

SEQ ID NO: 374386 - RNA, 22 nt, Bordetella pertussis
cuggccuugauguauggcugca

SEQ ID NO: 374387 - RNA, 19 nt, Bordetella pertussis
cuggcgaagaacaccgccg

SEQ ID NO: 374388 - RNA, 15 nt, Bordetella pertussis
cuggcgaccggcggc

SEQ ID NO: 374389 - RNA, 14 nt, Bordetella pertussis
cuggcgagcauggc

SEQ ID NO: 374390 - RNA, 21 nt, Bordetella pertussis
cuggcgaucaccgacagcgcc

SEQ ID NO: 374391 - RNA, 18 nt, Bordetella pertussis
cuggcgaucacggccaac

SEQ ID NO: 374392 - RNA, 17 nt, Bordetella pertussis
cuggcgaucaggccgcc

SEQ ID NO: 374393 - RNA, 22 nt, Bordetella pertussis
cuggcgaucgucaccaucgccg

SEQ ID NO: 374394 - RNA, 19 nt, Bordetella pertussis
cuggcgaugcccaccagcc

SEQ ID NO: 374395 - RNA, 21 nt, Bordetella pertussis
cuggcgaugcccaccagccgc

SEQ ID NO: 374396 - RNA, 22 nt, Bordetella pertussis
cuggcgaugcccaccagccgcc

SEQ ID NO: 374397 - RNA, 15 nt, Bordetella pertussis
cuggcgauggccuga

SEQ ID NO: 374398 - RNA, 23 nt, Bordetella pertussis
cuggcgaugguggauccgccggu

SEQ ID NO: 374399 - RNA, 16 nt, Bordetella pertussis
cuggcgcaaggcgucg

SEQ ID NO: 374400 - RNA, 21 nt, Bordetella pertussis
cuggcgcaaggcgucgggcac

SEQ ID NO: 374401 - RNA, 16 nt, Bordetella pertussis
cuggcgcagcacgccg

SEQ ID NO: 374402 - RNA, 17 nt, Bordetella pertussis
cuggcgcagcacgccgc

SEQ ID NO: 374403 - RNA, 19 nt, Bordetella pertussis
cuggcgcagcacgccgcgc

SEQ ID NO: 374404 - RNA, 23 nt, Bordetella pertussis
cuggcgcagcacgccgcgccagg

SEQ ID NO: 374405 - RNA, 15 nt, Bordetella pertussis
cuggcgcagcagcgc

SEQ ID NO: 374406 - RNA, 17 nt, Bordetella pertussis
cuggcgcagcagcgccg

SEQ ID NO: 374407 - RNA, 18 nt, Bordetella pertussis
cuggcgcagcagcgccgg

SEQ ID NO: 374408 - RNA, 19 nt, Bordetella pertussis
cuggcgcagcagcgccggc

SEQ ID NO: 374409 - RNA, 14 nt, Bordetella pertussis
cuggcgcagcaggc

SEQ ID NO: 374410 - RNA, 21 nt, Bordetella pertussis
cuggcgcagcaggcgcgcggc

SEQ ID NO: 374411 - RNA, 12 nt, Bordetella pertussis
cuggcgcagggc

SEQ ID NO: 374412 - RNA, 16 nt, Bordetella pertussis
cuggcgcagggcauac

SEQ ID NO: 374413 - RNA, 17 nt, Bordetella pertussis
cuggcgcaguaucccgg

SEQ ID NO: 374414 - RNA, 22 nt, Bordetella pertussis
cuggcgcaguaucccggccagg

SEQ ID NO: 374415 - RNA, 23 nt, Bordetella pertussis
cuggcgcaguaucccggccaggc

SEQ ID NO: 374416 - RNA, 13 nt, Bordetella pertussis
cuggcgcauggcc

SEQ ID NO: 374417 - RNA, 16 nt, Bordetella pertussis
cuggcgcauggccggc

SEQ ID NO: 374418 - RNA, 18 nt, Bordetella pertussis
cuggcgcauggccggcgu

SEQ ID NO: 374419 - RNA, 13 nt, Bordetella pertussis
cuggcgcauggcu

SEQ ID NO: 374420 - RNA, 18 nt, Bordetella pertussis
cuggcgccaacccgccau

SEQ ID NO: 374421 - RNA, 22 nt, Bordetella pertussis
cuggcgccaacccgccauccug

SEQ ID NO: 374422 - RNA, 13 nt, Bordetella pertussis
cuggcgccccuuc

SEQ ID NO: 374423 - RNA, 21 nt, Bordetella pertussis
cuggcgccccuuccacccgca

SEQ ID NO: 374424 - RNA, 15 nt, Bordetella pertussis
cuggcgcccgccugc

SEQ ID NO: 374425 - RNA, 14 nt, Bordetella pertussis
cuggcgcccggcgg

SEQ ID NO: 374426 - RNA, 15 nt, Bordetella pertussis
cuggcgcaggccggc

SEQ ID NO: 374427 - RNA, 15 nt, Bordetella pertussis
cuggcgccgcgcgcc

SEQ ID NO: 374428 - RNA, 21 nt, Bordetella pertussis
cuggcgccgcggccggguggc

SEQ ID NO: 374429 - RNA, 18 nt, Bordetella pertussis
cuggcgccguucgucgcg

SEQ ID NO: 374430 - RNA, 20 nt, Bordetella pertussis
cuggcgccguucgucgcgca

SEQ ID NO: 374431 - RNA, 19 nt, Bordetella pertussis
cuggcgcgacgccugcgcc

SEQ ID NO: 374432 - RNA, 10 nt, Bordetella pertussis
cuggcgcgcg

SEQ ID NO: 374433 - RNA, 14 nt, Bordetella pertussis
cuggcgcgcgaacg

SEQ ID NO: 374434 - RNA, 13 nt, Bordetella pertussis
cuggcgcgcgacc

SEQ ID NO: 374435 - RNA, 14 nt, Bordetella pertussis
cuggcgcgcgacca

SEQ ID NO: 374436 - RNA, 16 nt, Bordetella pertussis
cuggcgcgcgaccagg

SEQ ID NO: 374437 - RNA, 17 nt, Bordetella pertussis
cuggcgcgcgaccaggc

SEQ ID NO: 374438 - RNA, 15 nt, Bordetella pertussis
cuggcgcgcgacggc

SEQ ID NO: 374439 - RNA, 15 nt, Bordetella pertussis
cuggcgcgcgcaagc

SEQ ID NO: 374440 - RNA, 14 nt, Bordetella pertussis
cuggcgcgcggccg

SEQ ID NO: 374441 - RNA, 15 nt, Bordetella pertussis
cuggcgcgcggcugg

SEQ ID NO: 374442 - RNA, 16 nt, Bordetella pertussis
cuggcgcgcggcuggc

SEQ ID NO: 374443 - RNA, 22 nt, Bordetella pertussis
cuggcgcgcguugaccgccucg

SEQ ID NO: 374444 - RNA, 19 nt, Bordetella pertussis
cuggcgcgcaccaucgccg

SEQ ID NO: 374445 - RNA, 16 nt, Bordetella pertussis
cuggcgcgcaccaugg

SEQ ID NO: 374446 - RNA, 15 nt, Bordetella pertussis
cuggcgcgcaucggc

SEQ ID NO: 374447 - RNA, 19 nt, Bordetella pertussis
cuggcgcgcaucggcgccg

SEQ ID NO: 374448 - RNA, 16 nt, Bordetella pertussis
cuggcgcgccgccucg

SEQ ID NO: 374449 - RNA, 15 nt, Bordetella pertussis
cuggcgggccgaggc

SEQ ID NO: 374450 - RNA, 19 nt, Bordetella pertussis
cuggcgggccggaaacgcg

SEQ ID NO: 374451 - RNA, 17 nt, Bordetella pertussis
cuggcgggccugggcgu

SEQ ID NO: 374452 - RNA, 20 nt, Bordetella pertussis
cuggcgggccugggcgucga

SEQ ID NO: 374453 - RNA, 17 nt, Bordetella pertussis
cuggcgguaugcggcgc

SEQ ID NO: 374454 - RNA, 20 nt, Bordetella pertussis
cuggcggucuuucaccgaca

SEQ ID NO: 374455 - RNA, 16 nt, Bordetella pertussis
cuggcgguggccgcgc

SEQ ID NO: 374456 - RNA, 17 nt, Bordetella pertussis
cuggcgguggccgcgca

SEQ ID NO: 374457 - RNA, 24 nt, Bordetella pertussis
cuggcgguggccgcgcaugccagc

SEQ ID NO: 374458 - RNA, 22 nt, Bordetella pertussis
cuggcggugcgccgcaugcggc

SEQ ID NO: 374459 - RNA, 21 nt, Bordetella pertussis
cuggcgguuguugcccaccgc

SEQ ID NO: 374460 - RNA, 14 nt, Bordetella pertussis
cuggcguacgcugc

SEQ ID NO: 374461 - RNA, 12 nt, Bordetella pertussis
cuggcuucgucg

SEQ ID NO: 374462 - RNA, 21 nt, Bordetella pertussis
cuggcuucgucgccggcguug

SEQ ID NO: 374463 - RNA, 23 nt, Bordetella pertussis
cuggcuuucgccgcgggccugcu

SEQ ID NO: 374464 - RNA, 22 nt, Bordetella pertussis
cugggacaggcacaccgugccg

SEQ ID NO: 374465 - RNA, 16 nt, Bordetella pertussis
cugggacaggcccagc

SEQ ID NO: 374466 - RNA, 19 nt, Bordetella pertussis
cugggcacauccagcgcca

SEQ ID NO: 374467 - RNA, 22 nt, Bordetella pertussis
cugggcacauccagcgccagca

SEQ ID NO: 374468 - RNA, 13 nt, Bordetella pertussis
cugggccacaggg

SEQ ID NO: 374469 - RNA, 23 nt, Bordetella pertussis
cugggccacagggcgaaggccag

SEQ ID NO: 374470 - RNA, 23 nt, Bordetella pertussis
cugggccagcaucggcacccagc

SEQ ID NO: 374471 - RNA, 24 nt, Bordetella pertussis
cugggccagcaucggcacccagcc

SEQ ID NO: 374472 - RNA, 14 nt, Bordetella pertussis
cugggccagccagc

SEQ ID NO: 374473 - RNA, 16 nt, Bordetella pertussis
cugggccagccagcgc

SEQ ID NO: 374474 - RNA, 15 nt, Bordetella pertussis
cugggccaggccggc

SEQ ID NO: 374475 - RNA, 15 nt, Bordetella pertussis
cugggccaugcguau

SEQ ID NO: 374476 - RNA, 16 nt, Bordetella pertussis
cugggccagaccgcgc

SEQ ID NO: 374477 - RNA, 19 nt, Bordetella pertussis
cugggccagaccgcgcgca

SEQ ID NO: 374478 - RNA, 17 nt, Bordetella pertussis
cugggccgagcgcgcca

SEQ ID NO: 374479 - RNA, 23 nt, Bordetella pertussis
cugggcggcggcgaugccgcugg

SEQ ID NO: 374480 - RNA, 14 nt, Bordetella pertussis
cugggcggcgugac

SEQ ID NO: 374481 - RNA, 19 nt, Bordetella pertussis
cugggcggcgugaccgcga

SEQ ID NO: 374482 - RNA, 17 nt, Bordetella pertussis
cugggcgguugcgcugc

SEQ ID NO: 374483 - RNA, 13 nt, Bordetella pertussis
cugggcguggcgc

SEQ ID NO: 374484 - RNA, 15 nt, Bordetella pertussis
cugggcguggcgcgc

SEQ ID NO: 374485 - RNA, 21 nt, Bordetella pertussis
cugggcuuuggcuuggcgaau

SEQ ID NO: 374486 - RNA, 18 nt, Bordetella pertussis
cuggggaagcgcucgucg

SEQ ID NO: 374487 - RNA, 19 nt, Bordetella pertussis
cuggggaagcgcucgucgg

SEQ ID NO: 374488 - RNA, 13 nt, Bordetella pertussis
cugggugacgcug

SEQ ID NO: 374489 - RNA, 19 nt, Bordetella pertussis
cugggugacgcuggagcgc

SEQ ID NO: 374490 - RNA, 13 nt, Bordetella pertussis
cuggggcagcagg

SEQ ID NO: 374491 - RNA, 14 nt, Bordetella pertussis
cugggugcuggugc

SEQ ID NO: 374492 - RNA, 16 nt, Bordetella pertussis
cugggugcuggugcgc

SEQ ID NO: 374493 - RNA, 19 nt, Bordetella pertussis
cuggguggccagcgccgcc

SEQ ID NO: 374494 - RNA, 19 nt, Bordetella pertussis
cuggguguagucgcggccg

SEQ ID NO: 374495 - RNA, 20 nt, Bordetella pertussis
cuggguguagucgcggccgu

SEQ ID NO: 374496 - RNA, 14 nt, Bordetella pertussis
cuggguucaggccu

SEQ ID NO: 374497 - RNA, 20 nt, Bordetella pertussis
cugguacagccccagcgcca

SEQ ID NO: 374498 - RNA, 22 nt, Bordetella pertussis
cugguacagccccagcgccagc

SEQ ID NO: 374499 - RNA, 16 nt, Bordetella pertussis
cugguacgacagcucg

SEQ ID NO: 374500 - RNA, 20 nt, Bordetella pertussis
cugguagaguacugcguucg

SEQ ID NO: 374501 - RNA, 19 nt, Bordetella pertussis
cugguagaucagcgcgucg

SEQ ID NO: 374502 - RNA, 20 nt, Bordetella pertussis
cugguagaucagcgcgucgg

SEQ ID NO: 374503 - RNA, 13 nt, Bordetella pertussis
cuggucgacgccg

SEQ ID NO: 374504 - RNA, 14 nt, Bordetella pertussis
cuggucgacgccgg

SEQ ID NO: 374505 - RNA, 16 nt, Bordetella pertussis
cuggucgacgccggcg

SEQ ID NO: 374506 - RNA, 17 nt, Bordetella pertussis
cuggucgacgccggcga

SEQ ID NO: 374507 - RNA, 22 nt, Bordetella pertussis
cuggucgagagccugggcgcgc

SEQ ID NO: 374508 - RNA, 17 nt, Bordetella pertussis
cuggucgagcgggcgcc

SEQ ID NO: 374509 - RNA, 19 nt, Bordetella pertussis
cuggucgagcgggcgccag

SEQ ID NO: 374510 - RNA, 20 nt, Bordetella pertussis
cuggucgcacaucaggucga

SEQ ID NO: 374511 - RNA, 13 nt, Bordetella pertussis
cuggucgcgcacc

SEQ ID NO: 374512 - RNA, 17 nt, Bordetella pertussis
cuggucgcgcaccuguu

SEQ ID NO: 374513 - RNA, 23 nt, Bordetella pertussis
cuggucgcgcaccuguucggcgg

SEQ ID NO: 374514 - RNA, 14 nt, Bordetella pertussis
cuggucgcgcagca

SEQ ID NO: 374515 - RNA, 13 nt, Bordetella pertussis
cuggucgcgcgcc

SEQ ID NO: 374516 - RNA, 14 nt, Bordetella pertussis
cuggucgcuggcgc

SEQ ID NO: 374517 - RNA, 15 nt, Bordetella pertussis
cuggucgcuggcgcc

SEQ ID NO: 374518 - RNA, 14 nt, Bordetella pertussis
cuggucggccuuca

SEQ ID NO: 374519 - RNA, 22 nt, Bordetella pertussis
cuggucgggcgugagcgccucg

SEQ ID NO: 374520 - RNA, 23 nt, Bordetella pertussis
cuggucggggucggccaccacca

SEQ ID NO: 374521 - RNA, 15 nt, Bordetella pertussis
cuggucgucgcggcc

SEQ ID NO: 374522 - RNA, 22 nt, Bordetella pertussis
cuggucgucgcggcccugggcc

SEQ ID NO: 374523 - RNA, 19 nt, Bordetella pertussis
cuggucuucgagcgcgagc

SEQ ID NO: 374524 - RNA, 19 nt, Bordetella pertussis
cuggugaaacagcaucagc

SEQ ID NO: 374525 - RNA, 16 nt, Bordetella pertussis
cuggugaucugcugcg

SEQ ID NO: 374526 - RNA, 15 nt, Bordetella pertussis
cuggugcaccacgcg

SEQ ID NO: 374527 - RNA, 19 nt, Bordetella pertussis
cuggugcaccacgcgcucc

SEQ ID NO: 374528 - RNA, 14 nt, Bordetella pertussis
cuggugcacgccga

SEQ ID NO: 374529 - RNA, 23 nt, Bordetella pertussis
cuggugcagcggcucgacgccgu

SEQ ID NO: 374530 - RNA, 16 nt, Bordetella pertussis
cuggugcccgacgccg

SEQ ID NO: 374531 - RNA, 17 nt, Bordetella pertussis
cuggugcccgacgccgc

SEQ ID NO: 374532 - RNA, 19 nt, Bordetella pertussis
cuggugcccgacgccgcgc

SEQ ID NO: 374533 - RNA, 19 nt, Bordetella pertussis
cuggugccgguugcgcgcc

SEQ ID NO: 374534 - RNA, 19 nt, Bordetella pertussis
cuggugcgccgugcccggc

SEQ ID NO: 374535 - RNA, 23 nt, Bordetella pertussis
cuggugcgcguccugggccgagc

SEQ ID NO: 374536 - RNA, 13 nt, Bordetella pertussis
cuggugcuggugc

SEQ ID NO: 374537 - RNA, 14 nt, Bordetella pertussis
cuggugcuggugcc

SEQ ID NO: 374538 - RNA, 14 nt, Bordetella pertussis
cuggugcuggugcu

SEQ ID NO: 374539 - RNA, 19 nt, Bordetella pertussis
cugguggaccugccguucg

SEQ ID NO: 374540 - RNA, 23 nt, Bordetella pertussis
cugguggaccugccguucgcgcu

SEQ ID NO: 374541 - RNA, 16 nt, Bordetella pertussis
cugguggcgauccaug

SEQ ID NO: 374542 - RNA, 22 nt, Bordetella pertussis
cugguggugggcgugcccucgc

SEQ ID NO: 374543 - RNA, 16 nt, Bordetella pertussis
cuggugugccuguccc

SEQ ID NO: 374544 - RNA, 21 nt, Bordetella pertussis
cugguuguccaccacccaggc

SEQ ID NO: 374545 - RNA, 22 nt, Bordetella pertussis
cuguaacaacacguacgaccgc

SEQ ID NO: 374546 - RNA, 13 nt, Bordetella pertussis
cuguaccagcaug

SEQ ID NO: 374547 - RNA, 13 nt, Bordetella pertussis
cuguaccgcgcga

SEQ ID NO: 374548 - RNA, 19 nt, Bordetella pertussis
cuguaccgguagcccgcgu

SEQ ID NO: 374549 - RNA, 13 nt, Bordetella pertussis
cuguacggccggc

SEQ ID NO: 374550 - RNA, 21 nt, Bordetella pertussis
cuguagcgguagccggcgugg

SEQ ID NO: 374551 - RNA, 18 nt, Bordetella pertussis
cuguccaagcgcguggcc

SEQ ID NO: 374552 - RNA, 19 nt, Bordetella pertussis
cuguccaagcgcguggcca

SEQ ID NO: 374553 - RNA, 16 nt, Bordetella pertussis
cuguagucgccgcugc

SEQ ID NO: 374554 - RNA, 13 nt, Bordetella pertussis
cuguccacgccga

SEQ ID NO: 374555 - RNA, 13 nt, Bordetella pertussis
cuguccaggccgg

SEQ ID NO: 374556 - RNA, 18 nt, Bordetella pertussis
cuguccagucuggauggc

SEQ ID NO: 374557 - RNA, 19 nt, Bordetella pertussis
cuguccccacggggacagg

SEQ ID NO: 374558 - RNA, 21 nt, Bordetella pertussis
cuguccccgcacggggacagg

SEQ ID NO: 374559 - RNA, 19 nt, Bordetella pertussis
cuguccccgcagggacagg

SEQ ID NO: 374560 - RNA, 14 nt, Bordetella pertussis
cuguccccgcaugg

SEQ ID NO: 374561 - RNA, 16 nt, Bordetella pertussis
cuguccccgccgggac

SEQ ID NO: 374562 - RNA, 19 nt, Bordetella pertussis
cuguccccgccgggacagg

SEQ ID NO: 374563 - RNA, 21 nt, Bordetella pertussis
cuguccccgcgcggggggcug

SEQ ID NO: 374564 - RNA, 17 nt, Bordetella pertussis
cuguccccgcggggaca

SEQ ID NO: 374565 - RNA, 23 nt, Bordetella pertussis
cuguccccgcggggacuggcucc

SEQ ID NO: 374566 - RNA, 16 nt, Bordetella pertussis
cuguccccgcugcggc

SEQ ID NO: 374567 - RNA, 20 nt, Bordetella pertussis
cuguccccgcugcggcaagg

SEQ ID NO: 374568 - RNA, 19 nt, Bordetella pertussis
cuguccccgucgggacagg

SEQ ID NO: 374569 - RNA, 19 nt, Bordetella pertussis
cugucccaaccgggacagg

SEQ ID NO: 374570 - RNA, 18 nt, Bordetella pertussis
cugucccaauccgcgaag

SEQ ID NO: 374571 - RNA, 19 nt, Bordetella pertussis
cugucccagcggggacagg

SEQ ID NO: 374572 - RNA, 18 nt, Bordetella pertussis
cugucccggcggggacag

SEQ ID NO: 374573 - RNA, 19 nt, Bordetella pertussis
cugucccggcggggacagg

SEQ ID NO: 374574 - RNA, 23 nt, Bordetella pertussis
cuguccgaugcgcugcuggaggc

SEQ ID NO: 374575 - RNA, 18 nt, Bordetella pertussis
cugucgccacgggcguca

SEQ ID NO: 374576 - RNA, 22 nt, Bordetella pertussis
cugucggccgaaccgcgcagcc

SEQ ID NO: 374577 - RNA, 22 nt, Bordetella pertussis
cugucggugaugauccugcugg

SEQ ID NO: 374578 - RNA, 18 nt, Bordetella pertussis
cugugcgauggcacggca

SEQ ID NO: 374579 - RNA, 21 nt, Bordetella pertussis
cugugcgcguuccggccgcgc

SEQ ID NO: 374580 - RNA, 21 nt, Bordetella pertussis
cuguucagaaaccugaccucg

SEQ ID NO: 374581 - RNA, 19 nt, Bordetella pertussis
cuguucaggcgcucgaucg

SEQ ID NO: 374582 - RNA, 17 nt, Bordetella pertussis
cuguucccgccgggcca

SEQ ID NO: 374583 - RNA, 17 nt, Bordetella pertussis
cuguucgccgcaccagg

SEQ ID NO: 374584 - RNA, 22 nt, Bordetella pertussis
cuguucgccgcaccaggccgcg

SEQ ID NO: 374585 - RNA, 21 nt, Bordetella pertussis
cuguucgcgcagcaggccgcg

SEQ ID NO: 374586 - RNA, 21 nt, Bordetella pertussis
cuguucggcgaccgccggccg

SEQ ID NO: 374587 - RNA, 21 nt, Bordetella pertussis
cuguucggcgaugcgggcggc

SEQ ID NO: 374588 - RNA, 19 nt, Bordetella pertussis
cuguugcuccaggccggca

SEQ ID NO: 374589 - RNA, 18 nt, Bordetella pertussis
cuuagcgcagcagcgaca

SEQ ID NO: 374590 - RNA, 17 nt, Bordetella pertussis
cuucagcacgcucagca

SEQ ID NO: 374591 - RNA, 14 nt, Bordetella pertussis
cuucagccagcgau

SEQ ID NO: 374592 - RNA, 20 nt, Bordetella pertussis
cuucagcccggcgacguugc

SEQ ID NO: 374593 - RNA, 17 nt, Bordetella pertussis
cuucagcccggcgcgcc

SEQ ID NO: 374594 - RNA, 19 nt, Bordetella pertussis
cuucagcccgggcaugcga

SEQ ID NO: 374595 - RNA, 19 nt, Bordetella pertussis
cuucagcgggccggcacca

SEQ ID NO: 374596 - RNA, 16 nt, Bordetella pertussis
cuucaggcgccgcaga

SEQ ID NO: 374597 - RNA, 17 nt, Bordetella pertussis
cuucaggcgcgcggcag

SEQ ID NO: 374598 - RNA, 17 nt, Bordetella pertussis
cuucagggcgccggcgu

SEQ ID NO: 374599 - RNA, 15 nt, Bordetella pertussis
cuucaguuccaggcg

SEQ ID NO: 374600 - RNA, 16 nt, Bordetella pertussis
cuucaugccggcguug

SEQ ID NO: 374601 - RNA, 20 nt, Bordetella pertussis
cuuccaggcgcccgccacca

SEQ ID NO: 374602 - RNA, 14 nt, Bordetella pertussis
cuuccaggcgcagg

SEQ ID NO: 374603 - RNA, 15 nt, Bordetella pertussis
cuuccaggcgcaggc

SEQ ID NO: 374604 - RNA, 22 nt, Bordetella pertussis
cuuccagguacaggggcaaggc

SEQ ID NO: 374605 - RNA, 20 nt, Bordetella pertussis
cuuccaucuacgugcuggac

SEQ ID NO: 374606 - RNA, 23 nt, Bordetella pertussis
cuuccucccagaccugcgcgccg

SEQ ID NO: 374607 - RNA, 16 nt, Bordetella pertussis
cuuccucgacccgcgc

SEQ ID NO: 374608 - RNA, 14 nt, Bordetella pertussis
cuuccugaacgacg

SEQ ID NO: 374609 - RNA, 21 nt, Bordetella pertussis
cuuccugggcgccggcggcga

SEQ ID NO: 374610 - RNA, 12 nt, Bordetella pertussis
cuucgaggccgg

SEQ ID NO: 374611 - RNA, 15 nt, Bordetella pertussis
cuucgaggccggcgu

SEQ ID NO: 374612 - RNA, 18 nt, Bordetella pertussis
cuucgaucaugcccgcca

SEQ ID NO: 374613 - RNA, 19 nt, Bordetella pertussis
cuucgaugaugagcgcgcc

SEQ ID NO: 374614 - RNA, 20 nt, Bordetella pertussis
cuucgaugaugagcgcgccg

SEQ ID NO: 374615 - RNA, 13 nt, Bordetella pertussis
cuucgaugcuggc

SEQ ID NO: 374616 - RNA, 19 nt, Bordetella pertussis
cuucgaugcuggcgcggac

SEQ ID NO: 374617 - RNA, 14 nt, Bordetella pertussis
cuucgccgucgacg

SEQ ID NO: 374618 - RNA, 15 nt, Bordetella pertussis
cuucgccgucgacgu

SEQ ID NO: 374619 - RNA, 15 nt, Bordetella pertussis
cuucgccuggccggc

SEQ ID NO: 374620 - RNA, 19 nt, Bordetella pertussis
cuucgcgauccagcagcgu

SEQ ID NO: 374621 - RNA, 13 nt, Bordetella pertussis
cuucggccgacau

SEQ ID NO: 374622 - RNA, 21 nt, Bordetella pertussis
cuucggccggcugcgcgccga

SEQ ID NO: 374623 - RNA, 21 nt, Bordetella pertussis
cuucggccugcgccaccagcu

SEQ ID NO: 374624 - RNA, 20 nt, Bordetella pertussis
cuucggcggccaugccgacg

SEQ ID NO: 374625 - RNA, 23 nt, Bordetella pertussis
cuucggcguacugcugcaaggac

SEQ ID NO: 374626 - RNA, 15 nt, Bordetella pertussis
cuucgucgccggcgu

SEQ ID NO: 374627 - RNA, 14 nt, Bordetella pertussis
cuucgucuucgacc

SEQ ID NO: 374628 - RNA, 21 nt, Bordetella pertussis
cuucgugcagcgcgugggcca

SEQ ID NO: 374629 - RNA, 13 nt, Bordetella pertussis
cuucguggcgcag

SEQ ID NO: 374630 - RNA, 20 nt, Bordetella pertussis
cuugcccaggccggcgcgcu

SEQ ID NO: 374631 - RNA, 17 nt, Bordetella pertussis
cuugcccaggcugggcc

SEQ ID NO: 374632 - RNA, 14 nt, Bordetella pertussis
cuugcccgagaugc

SEQ ID NO: 374633 - RNA, 21 nt, Bordetella pertussis
cuugcccgagaugcccgacgc

SEQ ID NO: 374634 - RNA, 15 nt, Bordetella pertussis
cuugcccgccagcgc

SEQ ID NO: 374635 - RNA, 14 nt, Bordetella pertussis
cuugcccgcgcgca

SEQ ID NO: 374636 - RNA, 17 nt, Bordetella pertussis
cuugcccgggcuggccg

SEQ ID NO: 374637 - RNA, 16 nt, Bordetella pertussis
cuugcccgucagcggc

SEQ ID NO: 374638 - RNA, 17 nt, Bordetella pertussis
cuugcccuugaauucca

SEQ ID NO: 374639 - RNA, 15 nt, Bordetella pertussis
cuugccgaccuccag

SEQ ID NO: 374640 - RNA, 23 nt, Bordetella pertussis
cuugccgaccuccaggcccaggc

SEQ ID NO: 374641 - RNA, 20 nt, Bordetella pertussis
cuugccgaagauucccgcgc

SEQ ID NO: 374642 - RNA, 22 nt, Bordetella pertussis
cuugccgauccagcgccugggg

SEQ ID NO: 374643 - RNA, 16 nt, Bordetella pertussis
cuugccgaugcggcgc

SEQ ID NO: 374644 - RNA, 21 nt, Bordetella pertussis
cuugccgaugcggcgcaugcu

SEQ ID NO: 374645 - RNA, 16 nt, Bordetella pertussis
cuugccugacgugcgc

SEQ ID NO: 374646 - RNA, 20 nt, Bordetella pertussis
cuugcgauaggugcgcagcc

SEQ ID NO: 374647 - RNA, 20 nt, Bordetella pertussis
cuugcgcaagccggccgcgc

SEQ ID NO: 374648 - RNA, 22 nt, Bordetella pertussis
cuugcgcaagccggccgcgccg

SEQ ID NO: 374649 - RNA, 15 nt, Bordetella pertussis
cuugcgcagcgcggc

SEQ ID NO: 374650 - RNA, 23 nt, Bordetella pertussis
cuugcgcagggcgggcggugcgg

SEQ ID NO: 374651 - RNA, 14 nt, Bordetella pertussis
cuugcgccgcugcg

SEQ ID NO: 374652 - RNA, 18 nt, Bordetella pertussis
cuugcgcgaaggccgccc

SEQ ID NO: 374653 - RNA, 14 nt, Bordetella pertussis
cuugcgcgacagca

SEQ ID NO: 374654 - RNA, 15 nt, Bordetella pertussis
cuugcgcgacagcag

SEQ ID NO: 374655 - RNA, 20 nt, Bordetella pertussis
cuugcgcgacagcaggccgg

SEQ ID NO: 374656 - RNA, 16 nt, Bordetella pertussis
cuugcgcgacggcgau

SEQ ID NO: 374657 - RNA, 16 nt, Bordetella pertussis
cuugcgcgcgccggac

SEQ ID NO: 374658 - RNA, 14 nt, Bordetella pertussis
cuugcgcggccacc

SEQ ID NO: 374659 - RNA, 22 nt, Bordetella pertussis
cuugcgcggccagcaccggccc

SEQ ID NO: 374660 - RNA, 21 nt, Bordetella pertussis
cuugcgcggcgagcgccgcca

SEQ ID NO: 374661 - RNA, 15 nt, Bordetella pertussis
cuugcgcguccaggc

SEQ ID NO: 374662 - RNA, 17 nt, Bordetella pertussis
cuugcgcguccaggcca

SEQ ID NO: 374663 - RNA, 15 nt, Bordetella pertussis
cuugcgcucgcccag

SEQ ID NO: 374664 - RNA, 17 nt, Bordetella pertussis
cuugcgcucgcccagca

SEQ ID NO: 374665 - RNA, 20 nt, Bordetella pertussis
cuugcgcucgcccagcaccu

SEQ ID NO: 374666 - RNA, 13 nt, Bordetella pertussis
cuugcgcuggcgc

SEQ ID NO: 374667 - RNA, 15 nt, Bordetella pertussis
cuugcgcuggcgcgc

SEQ ID NO: 374668 - RNA, 20 nt, Bordetella pertussis
cuugcgcuuuuuucuccagc

SEQ ID NO: 374669 - RNA, 15 nt, Bordetella pertussis
cuugcucagucgggc

SEQ ID NO: 374670 - RNA, 14 nt, Bordetella pertussis
cuugcucaucacca

SEQ ID NO: 374671 - RNA, 22 nt, Bordetella pertussis
cuugcugaaccugcuggccgcc

SEQ ID NO: 374672 - RNA, 14 nt, Bordetella pertussis
cuugcugcccgacg

SEQ ID NO: 374673 - RNA, 15 nt, Bordetella pertussis
cuugcugcuguuggc

SEQ ID NO: 374674 - RNA, 16 nt, Bordetella pertussis
cuuggccacuucgccg

SEQ ID NO: 374675 - RNA, 14 nt, Bordetella pertussis
cuuggccagcuggc

SEQ ID NO: 374676 - RNA, 15 nt, Bordetella pertussis
cuuggccagcuggcg

SEQ ID NO: 374677 - RNA, 19 nt, Bordetella pertussis
cuuggcccggcgggaacag

SEQ ID NO: 374678 - RNA, 16 nt, Bordetella pertussis
cuuggccgcagccggc

SEQ ID NO: 374679 - RNA, 20 nt, Bordetella pertussis
cuuggugaaaucccccgcca

SEQ ID NO: 374680 - RNA, 20 nt, Bordetella pertussis
cuuggugccguaauccgugg

SEQ ID NO: 374681 - RNA, 16 nt, Bordetella pertussis
cuugugcgccagcgcg

SEQ ID NO: 374682 - RNA, 18 nt, Bordetella pertussis
cuugugcgccagcgcgaa

SEQ ID NO: 374683 - RNA, 15 nt, Bordetella pertussis
cuugugcgucggcuc

SEQ ID NO: 374684 - RNA, 17 nt, Bordetella pertussis
cuugugcaucucgaagc

SEQ ID NO: 374685 - RNA, 16 nt, Bordetella pertussis
cuuguucgcgcgcggu

SEQ ID NO: 374686 - RNA, 21 nt, Bordetella pertussis
cuuguugcgugccgcccagga

SEQ ID NO: 374687 - RNA, 18 nt, Bordetella pertussis
cuuguugcucuugaccug

SEQ ID NO: 374688 - RNA, 20 nt, Bordetella pertussis
cuuguuggaaaucgugccgu

SEQ ID NO: 374689 - RNA, 23 nt, Bordetella pertussis
cuuguuggcgccggccgcgcgcg

SEQ ID NO: 374690 - RNA, 16 nt, Bordetella pertussis
cuuuugcggcgcggcg

SEQ ID NO: 374691 - RNA, 16 nt, Bordetella pertussis
cuuuuucucggccucg

SEQ ID NO: 374692 - RNA, 15 nt, Bordetella pertussis
gaaaagccgcggccg

SEQ ID NO: 374693 - RNA, 14 nt, Bordetella pertussis
gaaacacguccagc

SEQ ID NO: 374694 - RNA, 18 nt, Bordetella pertussis
gaaacagcaucagcggca

SEQ ID NO: 374695 - RNA, 22 nt, Bordetella pertussis
gaaacgguucuggaucgcgccc

SEQ ID NO: 374696 - RNA, 18 nt, Bordetella pertussis
gaaacguugcggaucacg

SEQ ID NO: 374697 - RNA, 14 nt, Bordetella pertussis
gaaacucaccgccg

SEQ ID NO: 374698 - RNA, 23 nt, Bordetella pertussis
gaaacucaccgccgcccgcaggc

SEQ ID NO: 374699 - RNA, 14 nt, Bordetella pertussis
gaaacucgcgcagc

SEQ ID NO: 374700 - RNA, 15 nt, Bordetella pertussis
gaaacucgcgcagcg

SEQ ID NO: 374701 - RNA, 13 nt, Bordetella pertussis
gaaagcacgccau

SEQ ID NO: 374702 - RNA, 18 nt, Bordetella pertussis
gaaagcccggccccaggc

SEQ ID NO: 374703 - RNA, 19 nt, Bordetella pertussis
gaaagccgccggcgcgcgg

SEQ ID NO: 374704 - RNA, 24 nt, Bordetella pertussis
gaaagccggcgucaaaccaagcag

SEQ ID NO: 374705 - RNA, 15 nt, Bordetella pertussis
gaaagcgcggccggg

SEQ ID NO: 374706 - RNA, 13 nt, Bordetella pertussis
gaaagcgucggcu

SEQ ID NO: 374707 - RNA, 21 nt, Bordetella pertussis
gaaauacaccuuguuggcgcc

SEQ ID NO: 374708 - RNA, 15 nt, Bordetella pertussis
gaaauagcccgcggc

SEQ ID NO: 374709 - RNA, 23 nt, Bordetella pertussis
gaaauaggaucccggcgccagcc

SEQ ID NO: 374710 - RNA, 17 nt, Bordetella pertussis
gaaaucaggcgcaucga

SEQ ID NO: 374711 - RNA, 15 nt, Bordetella pertussis
gaaauccagcgcgcc

SEQ ID NO: 374712 - RNA, 16 nt, Bordetella pertussis
gaaaucccccgcgucg

SEQ ID NO: 374713 - RNA, 16 nt, Bordetella pertussis
gaaaucgcggcgcugu

SEQ ID NO: 374714 - RNA, 18 nt, Bordetella pertussis
gaaaugauaguccugcca

SEQ ID NO: 374715 - RNA, 18 nt, Bordetella pertussis
gaaaugccgaagcgcgcg

SEQ ID NO: 374716 - RNA, 20 nt, Bordetella pertussis
gaaaugccgcgcgcagggcg

SEQ ID NO: 374717 - RNA, 12 nt, Bordetella pertussis
gaaaugccggcg

SEQ ID NO: 374718 - RNA, 15 nt, Bordetella pertussis
gaaaugccggcggcg

SEQ ID NO: 374719 - RNA, 20 nt, Bordetella pertussis
gaaaugcuggucgcgcaccu

SEQ ID NO: 374720 - RNA, 17 nt, Bordetella pertussis
gaaauggaugcgcgccc

SEQ ID NO: 374721 - RNA, 13 nt, Bordetella pertussis
gaaauggcggcgg

SEQ ID NO: 374722 - RNA, 21 nt, Bordetella pertussis
gaaauggcggcgguagcgcuc

SEQ ID NO: 374723 - RNA, 19 nt, Bordetella pertussis
gaaauuggggccgccugga

SEQ ID NO: 374724 - RNA, 17 nt, Bordetella pertussis
gaacaacagcgccugca

SEQ ID NO: 374725 - RNA, 19 nt, Bordetella pertussis
gaacaagguacccgcgccg

SEQ ID NO: 374726 - RNA, 21 nt, Bordetella pertussis
gaacaccggcaggccgcgcug

SEQ ID NO: 374727 - RNA, 14 nt, Bordetella pertussis
gaacaccggcgcgc

SEQ ID NO: 374728 - RNA, 22 nt, Bordetella pertussis
gaacaccggcgcgccuggcgcg

SEQ ID NO: 374729 - RNA, 19 nt, Bordetella pertussis
gaacaccguuuccaagcgc

SEQ ID NO: 374730 - RNA, 13 nt, Bordetella pertussis
gaacacgccgacc

SEQ ID NO: 374731 - RNA, 16 nt, Bordetella pertussis
gaacacgccgaccgga

SEQ ID NO: 374732 - RNA, 16 nt, Bordetella pertussis
gaacacgcgcgccgcg

SEQ ID NO: 374733 - RNA, 13 nt, Bordetella pertussis
gaacagcagaugg

SEQ ID NO: 374734 - RNA, 14 nt, Bordetella pertussis
gaacagcagauggc

SEQ ID NO: 374735 - RNA, 16 nt, Bordetella pertussis
gaacagcauggcggcg

SEQ ID NO: 374736 - RNA, 18 nt, Bordetella pertussis
gaacagccagggcagggc

SEQ ID NO: 374737 - RNA, 14 nt, Bordetella pertussis
gaacagccgcccca

SEQ ID NO: 374738 - RNA, 18 nt, Bordetella pertussis
gaacagccgccccagcag

SEQ ID NO: 374739 - RNA, 17 nt, Bordetella pertussis
gaacagccuggucaggu

SEQ ID NO: 374740 - RNA, 18 nt, Bordetella pertussis
gaacagcggaucgccggu

SEQ ID NO: 374741 - RNA, 16 nt, Bordetella pertussis
gaacagcggcacgccg

SEQ ID NO: 374742 - RNA, 14 nt, Bordetella pertussis
gaacagcguccagc

SEQ ID NO: 374743 - RNA, 19 nt, Bordetella pertussis
gaacagcuggaagcgcgcc

SEQ ID NO: 374744 - RNA, 16 nt, Bordetella pertussis
gaacaggcgcgccagc

SEQ ID NO: 374745 - RNA, 14 nt, Bordetella pertussis
gaacaggcgcuugc

SEQ ID NO: 374746 - RNA, 22 nt, Bordetella pertussis
gaacagguacccccagcggcgc

SEQ ID NO: 374747 - RNA, 17 nt, Bordetella pertussis
gaacauauccacgccac

SEQ ID NO: 374748 - RNA, 18 nt, Bordetella pertussis
gaacaugacuucggucag

SEQ ID NO: 374749 - RNA, 18 nt, Bordetella pertussis
gaacaugagccaugccgu

SEQ ID NO: 374750 - RNA, 17 nt, Bordetella pertussis
gaacauguccaccagcc

SEQ ID NO: 374751 - RNA, 18 nt, Bordetella pertussis
gaacauguccaccagccg

SEQ ID NO: 374752 - RNA, 17 nt, Bordetella pertussis
gaacauguucacgccca

SEQ ID NO: 374753 - RNA, 21 nt, Bordetella pertussis
gaaccacaggguggcgcccag

SEQ ID NO: 374754 - RNA, 19 nt, Bordetella pertussis
gaaccagcgcaccaccagc

SEQ ID NO: 374755 - RNA, 19 nt, Bordetella pertussis
gaaccaggccaccgcggug

SEQ ID NO: 374756 - RNA, 17 nt, Bordetella pertussis
gaaccaggccgccaggg

SEQ ID NO: 374757 - RNA, 13 nt, Bordetella pertussis
gaaccaggccugc

SEQ ID NO: 374758 - RNA, 22 nt, Bordetella pertussis
gaaccagugcaggggguggcgg

SEQ ID NO: 374759 - RNA, 17 nt, Bordetella pertussis
gaaccaguugcgggccu

SEQ ID NO: 374760 - RNA, 20 nt, Bordetella pertussis
gaaccauugcagggugucgg

SEQ ID NO: 374761 - RNA, 19 nt, Bordetella pertussis
gaaccauuggggaucgaac

SEQ ID NO: 374762 - RNA, 18 nt, Bordetella pertussis
gaacccgaacgcgugcac

SEQ ID NO: 374763 - RNA, 11 nt, Bordetella pertussis
gaaccccuccg

SEQ ID NO: 374764 - RNA, 17 nt, Bordetella pertussis
gaacccggccggcgccg

SEQ ID NO: 374765 - RNA, 20 nt, Bordetella pertussis
gaacccggccggcgccggca

SEQ ID NO: 374766 - RNA, 18 nt, Bordetella pertussis
gaaccgaaaugccgcagc

SEQ ID NO: 374767 - RNA, 16 nt, Bordetella pertussis
gaaccgcaacgccagc

SEQ ID NO: 374768 - RNA, 23 nt, Bordetella pertussis
gaaccgcagaagcagccgcgcgg

SEQ ID NO: 374769 - RNA, 18 nt, Bordetella pertussis
gaaccgccgcaagacggc

SEQ ID NO: 374770 - RNA, 19 nt, Bordetella pertussis
gaaccgccgcuuucgaccu

SEQ ID NO: 374771 - RNA, 17 nt, Bordetella pertussis
gaaccgccuucgggcgg

SEQ ID NO: 374772 - RNA, 16 nt, Bordetella pertussis
gaaccgcgcagccgcu

SEQ ID NO: 374773 - RNA, 17 nt, Bordetella pertussis
gaaccgcggcgcagguc

SEQ ID NO: 374774 - RNA, 14 nt, Bordetella pertussis
gaaccugcuggccg

SEQ ID NO: 374775 - RNA, 17 nt, Bordetella pertussis
gaaccugcuggccgccg

SEQ ID NO: 374776 - RNA, 19 nt, Bordetella pertussis
gaacgaauaaucgccggug

SEQ ID NO: 374777 - RNA, 23 nt, Bordetella pertussis
gaacgacacccggucggcccagg

SEQ ID NO: 374778 - RNA, 18 nt, Bordetella pertussis
gaacgacaggguccaggu

SEQ ID NO: 374779 - RNA, 18 nt, Bordetella pertussis
gaacgcccggcccaggcc

SEQ ID NO: 374780 - RNA, 13 nt, Bordetella pertussis
gaacgccgcgccc

SEQ ID NO: 374781 - RNA, 13 nt, Bordetella pertussis
gaacgccgcgcuc

SEQ ID NO: 374782 - RNA, 16 nt, Bordetella pertussis
gaacgccgcgcugccu

SEQ ID NO: 374783 - RNA, 18 nt, Bordetella pertussis
gaacgccgcgcugccuga

SEQ ID NO: 374784 - RNA, 23 nt, Bordetella pertussis
gaacgccgucgggguggcgucgu

SEQ ID NO: 374785 - RNA, 11 nt, Bordetella pertussis
gaacgccucgg

SEQ ID NO: 374786 - RNA, 14 nt, Bordetella pertussis
gaacgccuugcccg

SEQ ID NO: 374787 - RNA, 21 nt, Bordetella pertussis
gaacgccuugcccgggcuggc

SEQ ID NO: 374788 - RNA, 20 nt, Bordetella pertussis
gaacgcgcauucgucgcugc

SEQ ID NO: 374789 - RNA, 17 nt, Bordetella pertussis
gaacgcgccgcuggcgu

SEQ ID NO: 374790 - RNA, 22 nt, Bordetella pertussis
gaacgcgccgcuggcgucgcgc

SEQ ID NO: 374791 - RNA, 17 nt, Bordetella pertussis
gaacggaaacgcccagc

SEQ ID NO: 374792 - RNA, 14 nt, Bordetella pertussis
gaacggcaccagcc

SEQ ID NO: 374793 - RNA, 16 nt, Bordetella pertussis
gaacggcaccagccgg

SEQ ID NO: 374794 - RNA, 17 nt, Bordetella pertussis
gaacggcaccagccggg

SEQ ID NO: 374795 - RNA, 16 nt, Bordetella pertussis
gaacggcagcgcgcgc

SEQ ID NO: 374796 - RNA, 21 nt, Bordetella pertussis
gaacggcccacgcugucgggg

SEQ ID NO: 374797 - RNA, 16 nt, Bordetella pertussis
gaacggccccgccagg

SEQ ID NO: 374798 - RNA, 18 nt, Bordetella pertussis
gaacggccgggcgcccag

SEQ ID NO: 374799 - RNA, 20 nt, Bordetella pertussis
gaacggccggucagcccagg

SEQ ID NO: 374800 - RNA, 13 nt, Bordetella pertussis
gaacggccgcccg

SEQ ID NO: 374801 - RNA, 14 nt, Bordetella pertussis
gaacggcgcgaagg

SEQ ID NO: 374802 - RNA, 20 nt, Bordetella pertussis
gaacuauggcgcgcgcacgc

SEQ ID NO: 374803 - RNA, 21 nt, Bordetella pertussis
gaacuccaggaaagcgccgcc

SEQ ID NO: 374804 - RNA, 16 nt, Bordetella pertussis
gaacuccgcggcgucg

SEQ ID NO: 374805 - RNA, 14 nt, Bordetella pertussis
gaacuccggcggcg

SEQ ID NO: 374806 - RNA, 21 nt, Bordetella pertussis
gaacuccugcagcacgcuggc

SEQ ID NO: 374807 - RNA, 20 nt, Bordetella pertussis
gaacucgauccgggccuggc

SEQ ID NO: 374808 - RNA, 18 nt, Bordetella pertussis
gaacucgauggccucggc

SEQ ID NO: 374809 - RNA, 15 nt, Bordetella pertussis
gaacucggccgcaug

SEQ ID NO: 374810 - RNA, 19 nt, Bordetella pertussis
gaacucguuggccagcgcg

SEQ ID NO: 374811 - RNA, 21 nt, Bordetella pertussis
gaacucguuggccagcgcgcc

SEQ ID NO: 374812 - RNA, 14 nt, Bordetella pertussis
gaacugcaggccgc

SEQ ID NO: 374813 - RNA, 20 nt, Bordetella pertussis
gaacugcuugcgcgugcgca

SEQ ID NO: 374814 - RNA, 19 nt, Bordetella pertussis
gaauccacagcuggugccg

SEQ ID NO: 374815 - RNA, 21 nt, Bordetella pertussis
gaauccccgcucaggucgaac

SEQ ID NO: 374816 - RNA, 13 nt, Bordetella pertussis
gaauccggccagc

SEQ ID NO: 374817 - RNA, 17 nt, Bordetella pertussis
gaauccggggugccugu

SEQ ID NO: 374818 - RNA, 20 nt, Bordetella pertussis
gaauccuggcgacggccugc

SEQ ID NO: 374819 - RNA, 12 nt, Bordetella pertussis
gaaucugcuugc

SEQ ID NO: 374820 - RNA, 23 nt, Bordetella pertussis
gaaugaacagcuugcuguccagu

SEQ ID NO: 374821 - RNA, 16 nt, Bordetella pertussis
gaaucuucgaugcgcg

SEQ ID NO: 374822 - RNA, 23 nt, Bordetella pertussis
gaaugcguguuccagcgccuggc

SEQ ID NO: 374823 - RNA, 17 nt, Bordetella pertussis
gaauggccacggcuugc

SEQ ID NO: 374824 - RNA, 17 nt, Bordetella pertussis
gaauggcgcgauccagu

SEQ ID NO: 374825 - RNA, 17 nt, Bordetella pertussis
gaauguauuggcccagu

SEQ ID NO: 374826 - RNA, 20 nt, Bordetella pertussis
gaaugucaccccugcgcugc

SEQ ID NO: 374827 - RNA, 22 nt, Bordetella pertussis
gaaugucccacaggcgcgcggc

SEQ ID NO: 374828 - RNA, 16 nt, Bordetella pertussis
gacaacugcgcgaaug

SEQ ID NO: 374829 - RNA, 12 nt, Bordetella pertussis
gacaaggcgcgc

SEQ ID NO: 374830 - RNA, 20 nt, Bordetella pertussis
gacaauccuggcugauccag

SEQ ID NO: 374831 - RNA, 17 nt, Bordetella pertussis
gacacagcggcgcgagc

SEQ ID NO: 374832 - RNA, 20 nt, Bordetella pertussis
gacaccaaggggcggaucgu

SEQ ID NO: 374833 - RNA, 15 nt, Bordetella pertussis
gacaccaugauggcc

SEQ ID NO: 374834 - RNA, 19 nt, Bordetella pertussis
gacaccaugauggccgcgc

SEQ ID NO: 374835 - RNA, 14 nt, Bordetella pertussis
gacacccgcggcca

SEQ ID NO: 374836 - RNA, 16 nt, Bordetella pertussis
gacacccggucggccc

SEQ ID NO: 374837 - RNA, 18 nt, Bordetella pertussis
gacacccggucggcccag

SEQ ID NO: 374838 - RNA, 15 nt, Bordetella pertussis
gacagcacauggcgc

SEQ ID NO: 374839 - RNA, 19 nt, Bordetella pertussis
gacagcacgcccgccagca

SEQ ID NO: 374840 - RNA, 16 nt, Bordetella pertussis
gacagcagcaugcggc

SEQ ID NO: 374841 - RNA, 19 nt, Bordetella pertussis
gacagcagcccgcuggccg

SEQ ID NO: 374842 - RNA, 18 nt, Bordetella pertussis
gacagcaguucggccggc

SEQ ID NO: 374843 - RNA, 19 nt, Bordetella pertussis
gacagcaguucggccggcg

SEQ ID NO: 374844 - RNA, 19 nt, Bordetella pertussis
gacagcagggucggcccca

SEQ ID NO: 374845 - RNA, 17 nt, Bordetella pertussis
gacagcaugaacggcag

SEQ ID NO: 374846 - RNA, 22 nt, Bordetella pertussis
gacagccuuuccuccugccggc

SEQ ID NO: 374847 - RNA, 20 nt, Bordetella pertussis
gacagcgacagccaggccag

SEQ ID NO: 374848 - RNA, 16 nt, Bordetella pertussis
gacagcggcgagcgcg

SEQ ID NO: 374849 - RNA, 18 nt, Bordetella pertussis
gacagcggcgagcgcggc

SEQ ID NO: 374850 - RNA, 19 nt, Bordetella pertussis
gacagcggcgagcgcggcg

SEQ ID NO: 374851 - RNA, 21 nt, Bordetella pertussis
gacaggcacccuugccgcagg

SEQ ID NO: 374852 - RNA, 20 nt, Bordetella pertussis
gacaggcacccuugccgcgg

SEQ ID NO: 374853 - RNA, 23 nt, Bordetella pertussis
gacaggcacccuuuugccgcagg

SEQ ID NO: 374854 - RNA, 18 nt, Bordetella pertussis
gacaggcaccucguucac

SEQ ID NO: 374855 - RNA, 20 nt, Bordetella pertussis
gacaggcaccugcggugucc

SEQ ID NO: 374856 - RNA, 15 nt, Bordetella pertussis
gacaggcacgcgccg

SEQ ID NO: 374857 - RNA, 17 nt, Bordetella pertussis
gacaggcagacgaugcc

SEQ ID NO: 374858 - RNA, 22 nt, Bordetella pertussis
gacaggcagacgaugcccaggc

SEQ ID NO: 374859 - RNA, 22 nt, Bordetella pertussis
gacagcgcucuauucggccaac

SEQ ID NO: 374860 - RNA, 15 nt, Bordetella pertussis
gacagcgcugguggc

SEQ ID NO: 374861 - RNA, 12 nt, Bordetella pertussis
gacaggcgcccg

SEQ ID NO: 374862 - RNA, 21 nt, Bordetella pertussis
gacaggcgccucgcgacggcc

SEQ ID NO: 374863 - RNA, 14 nt, Bordetella pertussis
gacaggcgcgccau

SEQ ID NO: 374864 - RNA, 11 nt, Bordetella pertussis
gacaggcgccc

SEQ ID NO: 374865 - RNA, 14 nt, Bordetella pertussis
gacaggcggugcgc

SEQ ID NO: 374866 - RNA, 17 nt, Bordetella pertussis
gacaggcgugcgcagcu

SEQ ID NO: 374867 - RNA, 20 nt, Bordetella pertussis
gacaggcucuuuucauuugg

SEQ ID NO: 374868 - RNA, 13 nt, Bordetella pertussis
gacagggccgcga

SEQ ID NO: 374869 - RNA, 16 nt, Bordetella pertussis
gacagggcgucgucgg

SEQ ID NO: 374870 - RNA, 19 nt, Bordetella pertussis
gacaggggccucaugacgg

SEQ ID NO: 374871 - RNA, 19 nt, Bordetella pertussis
gacagguagcggucgccgc

SEQ ID NO: 374872 - RNA, 18 nt, Bordetella pertussis
gacagguaggcgccgguc

SEQ ID NO: 374873 - RNA, 16 nt, Bordetella pertussis
gacaggucggcgccca

SEQ ID NO: 374874 - RNA, 17 nt, Bordetella pertussis
gacaucgccgcugcgca

SEQ ID NO: 374875 - RNA, 20 nt, Bordetella pertussis
gacaucgccgcugcgcagca

SEQ ID NO: 374876 - RNA, 22 nt, Bordetella pertussis
gaccaccacgcuggcuucgucg

SEQ ID NO: 374877 - RNA, 13 nt, Bordetella pertussis
gaccaccagcagg

SEQ ID NO: 374878 - RNA, 18 nt, Bordetella pertussis
gaccaccagcaucgcgcc

SEQ ID NO: 374879 - RNA, 22 nt, Bordetella pertussis
gaccaccagcaucgcgccuucg

SEQ ID NO: 374880 - RNA, 14 nt, Bordetella pertussis
gaccaccggcuugg

SEQ ID NO: 374881 - RNA, 17 nt, Bordetella pertussis
gaccaccgucuugcccg

SEQ ID NO: 374882 - RNA, 19 nt, Bordetella pertussis
gaccaccugcaccgccgcg

SEQ ID NO: 374883 - RNA, 14 nt, Bordetella pertussis
gaccaccuugcccc

SEQ ID NO: 374884 - RNA, 13 nt, Bordetella pertussis
gaccacgauggcc

SEQ ID NO: 374885 - RNA, 18 nt, Bordetella pertussis
gaccacgauggccggcgc

SEQ ID NO: 374886 - RNA, 19 nt, Bordetella pertussis
gaccacgauggccggcgcg

SEQ ID NO: 374887 - RNA, 16 nt, Bordetella pertussis
gaccacgaccuuggcg

SEQ ID NO: 374888 - RNA, 22 nt, Bordetella pertussis
gaccacgaccuuggcggccgac

SEQ ID NO: 374889 - RNA, 12 nt, Bordetella pertussis
gaccacgcgcug

SEQ ID NO: 374890 - RNA, 13 nt, Bordetella pertussis
gaccacgcgcugc

SEQ ID NO: 374891 - RNA, 15 nt, Bordetella pertussis
gaccacgcgcugcgc

SEQ ID NO: 374892 - RNA, 21 nt, Bordetella pertussis
gaccacgcgcgcgccgccggc

SEQ ID NO: 374893 - RNA, 14 nt, Bordetella pertussis
gaccacggccagca

SEQ ID NO: 374894 - RNA, 13 nt, Bordetella pertussis
gaccacggcgcgc

SEQ ID NO: 374895 - RNA, 21 nt, Bordetella pertussis
gaccacggcggcuucggccgu

SEQ ID NO: 374896 - RNA, 17 nt, Bordetella pertussis
gaccacggucuggcgcg

SEQ ID NO: 374897 - RNA, 13 nt, Bordetella pertussis
gaccacgucgacc

SEQ ID NO: 374898 - RNA, 14 nt, Bordetella pertussis
gaccacgucgacca

SEQ ID NO: 374899 - RNA, 18 nt, Bordetella pertussis
gaccacuaucagcgcguc

SEQ ID NO: 374900 - RNA, 17 nt, Bordetella pertussis
gaccagcaccagcgccu

SEQ ID NO: 374901 - RNA, 16 nt, Bordetella pertussis
gaccagcaccggcacg

SEQ ID NO: 374902 - RNA, 19 nt, Bordetella pertussis
gaccagcacgauccagccg

SEQ ID NO: 374903 - RNA, 20 nt, Bordetella pertussis
gaccagcacgauccagccgu

SEQ ID NO: 374904 - RNA, 19 nt, Bordetella pertussis
gaccagcagcaccgugccg

SEQ ID NO: 374905 - RNA, 14 nt, Bordetella pertussis
gaccagcagccggu

SEQ ID NO: 374906 - RNA, 20 nt, Bordetella pertussis
gaccagcagccgguuggcgc

SEQ ID NO: 374907 - RNA, 17 nt, Bordetella pertussis
gaccagcagcgaaucgc

SEQ ID NO: 374908 - RNA, 14 nt, Bordetella pertussis
gaccagcagcgccg

SEQ ID NO: 374909 - RNA, 17 nt, Bordetella pertussis
gaccagcagcgccgggg

SEQ ID NO: 374910 - RNA, 23 nt, Bordetella pertussis
gaccagcagcggguugcgcgcca

SEQ ID NO: 374911 - RNA, 12 nt, Bordetella pertussis
gaccagcagcuc

SEQ ID NO: 374912 - RNA, 14 nt, Bordetella pertussis
gaccagcaggccga

SEQ ID NO: 374913 - RNA, 14 nt, Bordetella pertussis
gaccagccagccgc

SEQ ID NO: 374914 - RNA, 16 nt, Bordetella pertussis
gaccagccagccgccg

SEQ ID NO: 374915 - RNA, 22 nt, Bordetella pertussis
gaccagccagccgccgcgcggc

SEQ ID NO: 374916 - RNA, 17 nt, Bordetella pertussis
gaccagcccggccgcca

SEQ ID NO: 374917 - RNA, 20 nt, Bordetella pertussis
gaccagcccggccgccagca

SEQ ID NO: 374918 - RNA, 15 nt, Bordetella pertussis
gaccagcccggccgc

SEQ ID NO: 374919 - RNA, 13 nt, Bordetella pertussis
gaccagcgccggc

SEQ ID NO: 374920 - RNA, 15 nt, Bordetella pertussis
gaccagcgccggcgc

SEQ ID NO: 374921 - RNA, 12 nt, Bordetella pertussis
gaccagcgcgcg

SEQ ID NO: 374922 - RNA, 13 nt, Bordetella pertussis
gaccagcgcgcgc

SEQ ID NO: 374923 - RNA, 15 nt, Bordetella pertussis
gaccagcgcgcgccg

SEQ ID NO: 374924 - RNA, 17 nt, Bordetella pertussis
gaccagcgcgcgccggc

SEQ ID NO: 374925 - RNA, 18 nt, Bordetella pertussis
gaccagcgcgcggugccg

SEQ ID NO: 374926 - RNA, 22 nt, Bordetella pertussis
gaccagcgcgcggugccgccug

SEQ ID NO: 374927 - RNA, 23 nt, Bordetella pertussis
gaccagcgcgcggugccgccugg

SEQ ID NO: 374928 - RNA, 14 nt, Bordetella pertussis
gaccagcgcggccg

SEQ ID NO: 374929 - RNA, 20 nt, Bordetella pertussis
gaccagcgcgucgcacuggg

SEQ ID NO: 374930 - RNA, 19 nt, Bordetella pertussis
gaccagcggaucgccgggc

SEQ ID NO: 374931 - RNA, 20 nt, Bordetella pertussis
gaccagcggaucgccgggca

SEQ ID NO: 374932 - RNA, 13 nt, Bordetella pertussis
gaccagcggcgug

SEQ ID NO: 374933 - RNA, 23 nt, Bordetella pertussis
gaccagcggcgugaugcccaggc

SEQ ID NO: 374934 - RNA, 23 nt, Bordetella pertussis
gaccaggaaguugcccaccgaca

SEQ ID NO: 374935 - RNA, 23 nt, Bordetella pertussis
gaccagcuugucgaccaccggcu

SEQ ID NO: 374936 - RNA, 20 nt, Bordetella pertussis
gaccaggaugaugcagcaca

SEQ ID NO: 374937 - RNA, 14 nt, Bordetella pertussis
gaccaggcccacga

SEQ ID NO: 374938 - RNA, 12 nt, Bordetella pertussis
gaccaggcccau

SEQ ID NO: 374939 - RNA, 14 nt, Bordetella pertussis
gaccaggcccgcca

SEQ ID NO: 374940 - RNA, 16 nt, Bordetella pertussis
gaccaggcccgccacg

SEQ ID NO: 374941 - RNA, 14 nt, Bordetella pertussis
gaccaggccggcgg

SEQ ID NO: 374942 - RNA, 22 nt, Bordetella pertussis
gaccaggcgggcaucgcccacc

SEQ ID NO: 374943 - RNA, 19 nt, Bordetella pertussis
gaccaggcugcgcgccggc

SEQ ID NO: 374944 - RNA, 21 nt, Bordetella pertussis
gaccaggcuggagucgggcug

SEQ ID NO: 374945 - RNA, 22 nt, Bordetella pertussis
gaccaggcuggagucgggcugc

SEQ ID NO: 374946 - RNA, 16 nt, Bordetella pertussis
gaccagggcgccgacc

SEQ ID NO: 374947 - RNA, 18 nt, Bordetella pertussis
gaccagggcgccgaccgg

SEQ ID NO: 374948 - RNA, 21 nt, Bordetella pertussis
gaccagggcggugggcagcgc

SEQ ID NO: 374949 - RNA, 23 nt, Bordetella pertussis
gaccagggcggugggcagcgcgu

SEQ ID NO: 374950 - RNA, 19 nt, Bordetella pertussis
gaccaggucgccguacucg

SEQ ID NO: 374951 - RNA, 23 nt, Bordetella pertussis
gaccaggucgccguacucgccgg

SEQ ID NO: 374952 - RNA, 15 nt, Bordetella pertussis
gaccaguucggccag

SEQ ID NO: 374953 - RNA, 17 nt, Bordetella pertussis
gaccaguucggccagca

SEQ ID NO: 374954 - RNA, 18 nt, Bordetella pertussis
gaccaguucggccagcag

SEQ ID NO: 374955 - RNA, 22 nt, Bordetella pertussis
gaccaugacgucgacguugcgc

SEQ ID NO: 374956 - RNA, 14 nt, Bordetella pertussis
gaccaugccggccu

SEQ ID NO: 374957 - RNA, 22 nt, Bordetella pertussis
gaccaugcgcugggcaugggcg

SEQ ID NO: 374958 - RNA, 17 nt, Bordetella pertussis
gaccccgucgaccgcgg

SEQ ID NO: 374959 - RNA, 16 nt, Bordetella pertussis
gaccccguggucgcca

SEQ ID NO: 374960 - RNA, 23 nt, Bordetella pertussis
gaccccguggucgccagcacgcg

SEQ ID NO: 374961 - RNA, 14 nt, Bordetella pertussis
gacccgaaggcgcg

SEQ ID NO: 374962 - RNA, 22 nt, Bordetella pertussis
gacccgaaucucccggcgcccu

SEQ ID NO: 374963 - RNA, 22 nt, Bordetella pertussis
gacccgauagccgcgcgccugc

SEQ ID NO: 374964 - RNA, 15 nt, Bordetella pertussis
gacccgagcccuggc

SEQ ID NO: 374965 - RNA, 12 nt, Bordetella pertussis
gacccgaugcgc

SEQ ID NO: 374966 - RNA, 16 nt, Bordetella pertussis
gacccgcaaaaccggg

SEQ ID NO: 374967 - RNA, 20 nt, Bordetella pertussis
gacccgcaaaaccgggcccg

SEQ ID NO: 374968 - RNA, 16 nt, Bordetella pertussis
gacccgggccgcuggc

SEQ ID NO: 374969 - RNA, 20 nt, Bordetella pertussis
gacccgggccgcuggcccgg

SEQ ID NO: 374970 - RNA, 23 nt, Bordetella pertussis
gacccggggcaggaagccggccc

SEQ ID NO: 374971 - RNA, 14 nt, Bordetella pertussis
gaccgaacggccgg

SEQ ID NO: 374972 - RNA, 15 nt, Bordetella pertussis
gaccgaacggccggu

SEQ ID NO: 374973 - RNA, 13 nt, Bordetella pertussis
gaccgaagcgcgg

SEQ ID NO: 374974 - RNA, 16 nt, Bordetella pertussis
gaccgaagcgcgggcg

SEQ ID NO: 374975 - RNA, 13 nt, Bordetella pertussis
gaccgacagcaca

SEQ ID NO: 374976 - RNA, 21 nt, Bordetella pertussis
gaccgaagaggagcugcacaa

SEQ ID NO: 374977 - RNA, 16 nt, Bordetella pertussis
gaccgacaggccuggc

SEQ ID NO: 374978 - RNA, 14 nt, Bordetella pertussis
gaccgacaggcggc

SEQ ID NO: 374979 - RNA, 15 nt, Bordetella pertussis
gaccgacaggcggcu

SEQ ID NO: 374980 - RNA, 15 nt, Bordetella pertussis
gaccgacggccugga

SEQ ID NO: 374981 - RNA, 18 nt, Bordetella pertussis
gaccgacgugcgccgcau

SEQ ID NO: 374982 - RNA, 12 nt, Bordetella pertussis
gaccgacgccgu

SEQ ID NO: 374983 - RNA, 14 nt, Bordetella pertussis
gaccgagccggcca

SEQ ID NO: 374984 - RNA, 21 nt, Bordetella pertussis
gaccgagccggccagcgccug

SEQ ID NO: 374985 - RNA, 13 nt, Bordetella pertussis
gaccgagcgcgcc

SEQ ID NO: 374986 - RNA, 21 nt, Bordetella pertussis
gaccgagcccggcaccaugcg

SEQ ID NO: 374987 - RNA, 22 nt, Bordetella pertussis
gaccgauucgaacucgccgaac

SEQ ID NO: 374988 - RNA, 18 nt, Bordetella pertussis
gaccgcacgauggcgcgc

SEQ ID NO: 374989 - RNA, 20 nt, Bordetella pertussis
gaccgcacgauggcgcgcga

SEQ ID NO: 374990 - RNA, 20 nt, Bordetella pertussis
gaccgcaggggauugccgcg

SEQ ID NO: 374991 - RNA, 13 nt, Bordetella pertussis
gaccgcaugcggc

SEQ ID NO: 374992 - RNA, 21 nt, Bordetella pertussis
gaccgcgcgguggccgccgcg

SEQ ID NO: 374993 - RNA, 22 nt, Bordetella pertussis
gaccgcgcugcggucagcugug

SEQ ID NO: 374994 - RNA, 15 nt, Bordetella pertussis
gaccgcggacgccau

SEQ ID NO: 374995 - RNA, 14 nt, Bordetella pertussis
gaccgcggccgcgc

SEQ ID NO: 374996 - RNA, 18 nt, Bordetella pertussis
gaccgcggccgcgcuggc

SEQ ID NO: 374997 - RNA, 20 nt, Bordetella pertussis
gaccgcggccgcgcuggcgc

SEQ ID NO: 374998 - RNA, 20 nt, Bordetella pertussis
gaccgcggcgguccugcuga

SEQ ID NO: 374999 - RNA, 15 nt, Bordetella pertussis
gaccgcgggcgcgcg

SEQ ID NO: 375000 - RNA, 20 nt, Bordetella pertussis
gaccggccuggucaugacgg

SEQ ID NO: 375001 - RNA, 12 nt, Bordetella pertussis
gaccggcgccgg

SEQ ID NO: 375002 - RNA, 13 nt, Bordetella pertussis
gaccggcgccggc

SEQ ID NO: 375003 - RNA, 13 nt, Bordetella pertussis
gaccggcgccugc

SEQ ID NO: 375004 - RNA, 13 nt, Bordetella pertussis
gaccggcgcgcgc

SEQ ID NO: 375005 - RNA, 14 nt, Bordetella pertussis
gaccggcgcggccu

SEQ ID NO: 375006 - RNA, 19 nt, Bordetella pertussis
gaccggcgcggccugcaau

SEQ ID NO: 375007 - RNA, 19 nt, Bordetella pertussis
gaccggcggcacggccggc

SEQ ID NO: 375008 - RNA, 21 nt, Bordetella pertussis
gaccggcggcacggccggccu

SEQ ID NO: 375009 - RNA, 14 nt, Bordetella pertussis
gaccggcgccggcu

SEQ ID NO: 375010 - RNA, 20 nt, Bordetella pertussis
gaccggcguauggcccgcca

SEQ ID NO: 375011 - RNA, 16 nt, Bordetella pertussis
gaccggcgugacgcgc

SEQ ID NO: 375012 - RNA, 18 nt, Bordetella pertussis
gaccggcguguccagcgg

SEQ ID NO: 375013 - RNA, 22 nt, Bordetella pertussis
gaccggcguguccagcggcgcc

SEQ ID NO: 375014 - RNA, 19 nt, Bordetella pertussis
gaccggcucgaucgccgcc

SEQ ID NO: 375015 - RNA, 20 nt, Bordetella pertussis
gaccggcucgaucgccgccg

SEQ ID NO: 375016 - RNA, 21 nt, Bordetella pertussis
gaccggcucgaucgccgccgg

SEQ ID NO: 375017 - RNA, 15 nt, Bordetella pertussis
gaccggcuggcgcac

SEQ ID NO: 375018 - RNA, 16 nt, Bordetella pertussis
gaccggcuggcgcacg

SEQ ID NO: 375019 - RNA, 17 nt, Bordetella pertussis
gaccggcuggcgcacgu

SEQ ID NO: 375020 - RNA, 13 nt, Bordetella pertussis
gaccggggcgucc

SEQ ID NO: 375021 - RNA, 19 nt, Bordetella pertussis
gaccggggcguccaccgcc

SEQ ID NO: 375022 - RNA, 14 nt, Bordetella pertussis
gaccgggucgggcg

SEQ ID NO: 375023 - RNA, 21 nt, Bordetella pertussis
gaccgggucgggcgucugccc

SEQ ID NO: 375024 - RNA, 17 nt, Bordetella pertussis
gaccgggucgucgggcg

SEQ ID NO: 375025 - RNA, 18 nt, Bordetella pertussis
gaccgggucgucgggcgg

SEQ ID NO: 375026 - RNA, 17 nt, Bordetella pertussis
gaccguagcgcaggcgc

SEQ ID NO: 375027 - RNA, 15 nt, Bordetella pertussis
gaccgugaucggcgc

SEQ ID NO: 375028 - RNA, 22 nt, Bordetella pertussis
gaccguuccagacgauggugcc

SEQ ID NO: 375029 - RNA, 14 nt, Bordetella pertussis
gaccucggcggcgu

SEQ ID NO: 375030 - RNA, 15 nt, Bordetella pertussis
gaccucggcggcguc

SEQ ID NO: 375031 - RNA, 16 nt, Bordetella pertussis
gaccucuccacuggcc

SEQ ID NO: 375032 - RNA, 19 nt, Bordetella pertussis
gaccugacccccgaacugg

SEQ ID NO: 375033 - RNA, 22 nt, Bordetella pertussis
gaccugcucgucgccaugcggc

SEQ ID NO: 375034 - RNA, 11 nt, Bordetella pertussis
gaccugcuugc

SEQ ID NO: 375035 - RNA, 14 nt, Bordetella pertussis
gaccugcuugccca

SEQ ID NO: 375036 - RNA, 17 nt, Bordetella pertussis
gaccugcuugcccagca

SEQ ID NO: 375037 - RNA, 15 nt, Bordetella pertussis
gaccuggacgagggc

SEQ ID NO: 375038 - RNA, 19 nt, Bordetella pertussis
gaccuggacgagggccgcg

SEQ ID NO: 375039 - RNA, 18 nt, Bordetella pertussis
gaccuggaucacgugcca

SEQ ID NO: 375040 - RNA, 20 nt, Bordetella pertussis
gaccuggcgcccgacggcgc

SEQ ID NO: 375041 - RNA, 14 nt, Bordetella pertussis
gaccuggcgcgcga

SEQ ID NO: 375042 - RNA, 14 nt, Bordetella pertussis
gaccugggccuggu

SEQ ID NO: 375043 - RNA, 22 nt, Bordetella pertussis
gaccugggccugguacaggccg

SEQ ID NO: 375044 - RNA, 17 nt, Bordetella pertussis
gaccuggggguucgugg

SEQ ID NO: 375045 - RNA, 22 nt, Bordetella pertussis
gaccuugagaugccagcggcgc

SEQ ID NO: 375046 - RNA, 20 nt, Bordetella pertussis
gaccuugagcacgcuggcgu

SEQ ID NO: 375047 - RNA, 21 nt, Bordetella pertussis
gaccuugccgauccagcgccu

SEQ ID NO: 375048 - RNA, 15 nt, Bordetella pertussis
gaccuugcuggaccg

SEQ ID NO: 375049 - RNA, 13 nt, Bordetella pertussis
gaccuuggcggcu

SEQ ID NO: 375050 - RNA, 14 nt, Bordetella pertussis
gaccuuggcggcug

SEQ ID NO: 375051 - RNA, 19 nt, Bordetella pertussis
gaccuuggcggcuggcgcg

SEQ ID NO: 375052 - RNA, 21 nt, Bordetella pertussis
gaccuuggcggcuggcgcggc

SEQ ID NO: 375053 - RNA, 17 nt, Bordetella pertussis
gacgaaacccgggccgu

SEQ ID NO: 375054 - RNA, 13 nt, Bordetella pertussis
gacgaacaacacg

SEQ ID NO: 375055 - RNA, 16 nt, Bordetella pertussis
gacgaacaaggccgga

SEQ ID NO: 375056 - RNA, 14 nt, Bordetella pertussis
gacgaacaggccgc

SEQ ID NO: 375057 - RNA, 15 nt, Bordetella pertussis
gacgaacaggccgcc

SEQ ID NO: 375058 - RNA, 17 nt, Bordetella pertussis
gacgaauacgcuggcgc

SEQ ID NO: 375059 - RNA, 18 nt, Bordetella pertussis
gacgaauggguccgcgug

SEQ ID NO: 375060 - RNA, 17 nt, Bordetella pertussis
gacgaauuucucggcca

SEQ ID NO: 375061 - RNA, 18 nt, Bordetella pertussis
gacgaauuucucggccag

SEQ ID NO: 375062 - RNA, 20 nt, Bordetella pertussis
gacgaauuucucggccagcg

SEQ ID NO: 375063 - RNA, 19 nt, Bordetella pertussis
gacgcagcacggcuugcgc

SEQ ID NO: 375064 - RNA, 22 nt, Bordetella pertussis
gacgcagcacggcuugcgcgcc

SEQ ID NO: 375065 - RNA, 13 nt, Bordetella pertussis
gacgcagccgccc

SEQ ID NO: 375066 - RNA, 15 nt, Bordetella pertussis
gacgcagccgcccgg

SEQ ID NO: 375067 - RNA, 16 nt, Bordetella pertussis
gacgcagccuucgucc

SEQ ID NO: 375068 - RNA, 16 nt, Bordetella pertussis
gacgcagcgugcgacg

SEQ ID NO: 375069 - RNA, 14 nt, Bordetella pertussis
gacgcaggcccagc

SEQ ID NO: 375070 - RNA, 17 nt, Bordetella pertussis
gacgcaggcccagccag

SEQ ID NO: 375071 - RNA, 13 nt, Bordetella pertussis
gacgcaggcccau

SEQ ID NO: 375072 - RNA, 14 nt, Bordetella pertussis
gacgcaggcgccgc

SEQ ID NO: 375073 - RNA, 15 nt, Bordetella pertussis
gacgcaggcgccgca

SEQ ID NO: 375074 - RNA, 17 nt, Bordetella pertussis
gacgcaggcgccgcacc

SEQ ID NO: 375075 - RNA, 20 nt, Bordetella pertussis
gacgcaugucagcgccuggc

SEQ ID NO: 375076 - RNA, 20 nt, Bordetella pertussis
gacgccagcgcgccauggcc

SEQ ID NO: 375077 - RNA, 17 nt, Bordetella pertussis
gacgccauggcggcggc

SEQ ID NO: 375078 - RNA, 19 nt, Bordetella pertussis
gacgccauggcggcggcca

SEQ ID NO: 375079 - RNA, 16 nt, Bordetella pertussis
gacgcccagccugccg

SEQ ID NO: 375080 - RNA, 23 nt, Bordetella pertussis
gacgcccaggcccaccgcaucgc

SEQ ID NO: 375081 - RNA, 15 nt, Bordetella pertussis
gacgcccagguccga

SEQ ID NO: 375082 - RNA, 21 nt, Bordetella pertussis
gacgcccagguccgaaccgac

SEQ ID NO: 375083 - RNA, 17 nt, Bordetella pertussis
gacgcccgcccgcugac

SEQ ID NO: 375084 - RNA, 16 nt, Bordetella pertussis
gacgcccgcgcccagu

SEQ ID NO: 375085 - RNA, 14 nt, Bordetella pertussis
gacgcccgggcggc

SEQ ID NO: 375086 - RNA, 15 nt, Bordetella pertussis
gacgcccgggcggcu

SEQ ID NO: 375087 - RNA, 13 nt, Bordetella pertussis
gacgcccuggcgc

SEQ ID NO: 375088 - RNA, 14 nt, Bordetella pertussis
gacgcccuggcgca

SEQ ID NO: 375089 - RNA, 15 nt, Bordetella pertussis
gacgcccuggcgcag

SEQ ID NO: 375090 - RNA, 17 nt, Bordetella pertussis
gacgccgaacacaucga

SEQ ID NO: 375091 - RNA, 15 nt, Bordetella pertussis
gacgccgaccucggc

SEQ ID NO: 375092 - RNA, 19 nt, Bordetella pertussis
gacgccgaccucggcaccg

SEQ ID NO: 375093 - RNA, 15 nt, Bordetella pertussis
gacgccgacgaugcc

SEQ ID NO: 375094 - RNA, 16 nt, Bordetella pertussis
gacgccggcagcgacu

SEQ ID NO: 375095 - RNA, 21 nt, Bordetella pertussis
gacgccggcgaaugccggccg

SEQ ID NO: 375096 - RNA, 13 nt, Bordetella pertussis
gacgccggcgacg

SEQ ID NO: 375097 - RNA, 13 nt, Bordetella pertussis
gacgccggcgccg

SEQ ID NO: 375098 - RNA, 22 nt, Bordetella pertussis
gacgccggcgccggcgacgccg

SEQ ID NO: 375099 - RNA, 20 nt, Bordetella pertussis
gacgccggcggcgugcgccu

SEQ ID NO: 375100 - RNA, 20 nt, Bordetella pertussis
gacgccggcuucagccgcaa

SEQ ID NO: 375101 - RNA, 20 nt, Bordetella pertussis
gacgccgguguagcugcccg

SEQ ID NO: 375102 - RNA, 18 nt, Bordetella pertussis
gacgcgcaagcggcccca

SEQ ID NO: 375103 - RNA, 16 nt, Bordetella pertussis
gacgcgcagcggcagg

SEQ ID NO: 375104 - RNA, 17 nt, Bordetella pertussis
gacgcgcagcggcaggc

SEQ ID NO: 375105 - RNA, 22 nt, Bordetella pertussis
gacgcgcagcggcaggcccugc

SEQ ID NO: 375106 - RNA, 13 nt, Bordetella pertussis
gacgcgcagcggc

SEQ ID NO: 375107 - RNA, 13 nt, Bordetella pertussis
gacgcgcaggcca

SEQ ID NO: 375108 - RNA, 17 nt, Bordetella pertussis
gacgcgcaggccauugc

SEQ ID NO: 375109 - RNA, 20 nt, Bordetella pertussis
gacgcgcauuucgaccugcg

SEQ ID NO: 375110 - RNA, 22 nt, Bordetella pertussis
gacgcgcauuucgaccugcgca

SEQ ID NO: 375111 - RNA, 12 nt, Bordetella pertussis
gacgcgggcggc

SEQ ID NO: 375112 - RNA, 15 nt, Bordetella pertussis
gacgcgggcggccga

SEQ ID NO: 375113 - RNA, 12 nt, Bordetella pertussis
gacgcggggaca

SEQ ID NO: 375114 - RNA, 17 nt, Bordetella pertussis
gacgcggggacaggcac

SEQ ID NO: 375115 - RNA, 21 nt, Bordetella pertussis
gacgcggggacaggcacacca

SEQ ID NO: 375116 - RNA, 22 nt, Bordetella pertussis
gacgcggggauggcuuccugcg

SEQ ID NO: 375117 - RNA, 14 nt, Bordetella pertussis
gacgcguagccgau

SEQ ID NO: 375118 - RNA, 17 nt, Bordetella pertussis
gacgcugacccuggccg

SEQ ID NO: 375119 - RNA, 18 nt, Bordetella pertussis
gacgcugacccuggccga

SEQ ID NO: 375120 - RNA, 18 nt, Bordetella pertussis
gacgcugaccgagggcgc

SEQ ID NO: 375121 - RNA, 12 nt, Bordetella pertussis
gacgcugaucgg

SEQ ID NO: 375122 - RNA, 16 nt, Bordetella pertussis
gacgcugaucggccga

SEQ ID NO: 375123 - RNA, 21 nt, Bordetella pertussis
gacgcugaucggccgacugcu

SEQ ID NO: 375124 - RNA, 22 nt, Bordetella pertussis
gacgcugaucucggccugcccg

SEQ ID NO: 375125 - RNA, 16 nt, Bordetella pertussis
gacgcugauggccgcc

SEQ ID NO: 375126 - RNA, 23 nt, Bordetella pertussis
gacgcugauggccgccagcggcu

SEQ ID NO: 375127 - RNA, 17 nt, Bordetella pertussis
gacgcuggagauggcgc

SEQ ID NO: 375128 - RNA, 18 nt, Bordetella pertussis
gacgcuggagauggcgcc

SEQ ID NO: 375129 - RNA, 19 nt, Bordetella pertussis
gacgcuggagauggcgccg

SEQ ID NO: 375130 - RNA, 20 nt, Bordetella pertussis
gacgcuggagcgcggcggcg

SEQ ID NO: 375131 - RNA, 17 nt, Bordetella pertussis
gacgcuguagaggcgcg

SEQ ID NO: 375132 - RNA, 20 nt, Bordetella pertussis
gacgcuguagaggcgcggcu

SEQ ID NO: 375133 - RNA, 23 nt, Bordetella pertussis
gacgcuguagaggcgcggcucgc

SEQ ID NO: 375134 - RNA, 16 nt, Bordetella pertussis
gacgcugucgcgcccg

SEQ ID NO: 375135 - RNA, 17 nt, Bordetella pertussis
gacgcuguuggucaggu

SEQ ID NO: 375136 - RNA, 15 nt, Bordetella pertussis
gacgcuucaggccgu

SEQ ID NO: 375137 - RNA, 16 nt, Bordetella pertussis
gacgcuuucggggcgc

SEQ ID NO: 375138 - RNA, 15 nt, Bordetella pertussis
gacggacuggcuggu

SEQ ID NO: 375139 - RNA, 16 nt, Bordetella pertussis
gacggauacaccaggu

SEQ ID NO: 375140 - RNA, 15 nt, Bordetella pertussis
gacggauucgcccag

SEQ ID NO: 375141 - RNA, 17 nt, Bordetella pertussis
gacggcaagaucgccgg

SEQ ID NO: 375142 - RNA, 21 nt, Bordetella pertussis
gacggcaaugccugcgcgaug

SEQ ID NO: 375143 - RNA, 22 nt, Bordetella pertussis
gacggcaaugccugcgcgaugc

SEQ ID NO: 375144 - RNA, 11 nt, Bordetella pertussis
gacggcggcgc

SEQ ID NO: 375145 - RNA, 14 nt, Bordetella pertussis
gacggcggcgcgcg

SEQ ID NO: 375146 - RNA, 14 nt, Bordetella pertussis
gacggcggcgcggc

SEQ ID NO: 375147 - RNA, 14 nt, Bordetella pertussis
gacggcggcgugga

SEQ ID NO: 375148 - RNA, 18 nt, Bordetella pertussis
gacggcgggaccggcgau

SEQ ID NO: 375149 - RNA, 13 nt, Bordetella pertussis
gacggcgggcgcc

SEQ ID NO: 375150 - RNA, 14 nt, Bordetella pertussis
gacggcgggcgccc

SEQ ID NO: 375151 - RNA, 17 nt, Bordetella pertussis
gacggcguagccgaucu

SEQ ID NO: 375152 - RNA, 22 nt, Bordetella pertussis
gacggcguagccgaucuggccc

SEQ ID NO: 375153 - RNA, 23 nt, Bordetella pertussis
gacggcguagccgaucuggcccu

SEQ ID NO: 375154 - RNA, 13 nt, Bordetella pertussis
gacggcgucggcc

SEQ ID NO: 375155 - RNA, 17 nt, Bordetella pertussis
gacggcgucggccuggu

SEQ ID NO: 375156 - RNA, 18 nt, Bordetella pertussis
gacggcgucgagcacgcg

SEQ ID NO: 375157 - RNA, 20 nt, Bordetella pertussis
gacggcgucgagcacgcggc

SEQ ID NO: 375158 - RNA, 22 nt, Bordetella pertussis
gacggcgucgggcagcaggcgc

SEQ ID NO: 375159 - RNA, 22 nt, Bordetella pertussis
gacggcucgcgcucgcccggcc

SEQ ID NO: 375160 - RNA, 23 nt, Bordetella pertussis
gacggggucggggcaggccuggu

SEQ ID NO: 375161 - RNA, 19 nt, Bordetella pertussis
gacggggugccuguccccg

SEQ ID NO: 375162 - RNA, 19 nt, Bordetella pertussis
gacggggugccugucccug

SEQ ID NO: 375163 - RNA, 17 nt, Bordetella pertussis
gacggguaucgucgacc

SEQ ID NO: 375164 - RNA, 21 nt, Bordetella pertussis
gacggguaucgucgaccugga

SEQ ID NO: 375165 - RNA, 23 nt, Bordetella pertussis
gacgguagccgggucuggccggc

SEQ ID NO: 375166 - RNA, 14 nt, Bordetella pertussis
gacgguagcgcacg

SEQ ID NO: 375167 - RNA, 18 nt, Bordetella pertussis
gacgguagcgcacgcacc

SEQ ID NO: 375168 - RNA, 22 nt, Bordetella pertussis
gacgguagcgcacgcaccgcgc

SEQ ID NO: 375169 - RNA, 20 nt, Bordetella pertussis
gacgguaucucagcgcgccg

SEQ ID NO: 375170 - RNA, 16 nt, Bordetella pertussis
gacgguaucugucccg

SEQ ID NO: 375171 - RNA, 15 nt, Bordetella pertussis
gacgguaauccaguu

SEQ ID NO: 375172 - RNA, 16 nt, Bordetella pertussis
gacgguacaccugacg

SEQ ID NO: 375173 - RNA, 18 nt, Bordetella pertussis
gacgguacaccugacgcg

SEQ ID NO: 375174 - RNA, 16 nt, Bordetella pertussis
gacggucaccgcgccc

SEQ ID NO: 375175 - RNA, 17 nt, Bordetella pertussis
gacggucacggucuggc

SEQ ID NO: 375176 - RNA, 21 nt, Bordetella pertussis
gacggucacggucuggcccac

SEQ ID NO: 375177 - RNA, 19 nt, Bordetella pertussis
gacggucaggggcaggcgc

SEQ ID NO: 375178 - RNA, 22 nt, Bordetella pertussis
gacggucaggggcaggcgcacg

SEQ ID NO: 375179 - RNA, 17 nt, Bordetella pertussis
gacgguccugcgcgccg

SEQ ID NO: 375180 - RNA, 15 nt, Bordetella pertussis
gacgguggccgcggc

SEQ ID NO: 375181 - RNA, 17 nt, Bordetella pertussis
gacgguggccgcggcgu

SEQ ID NO: 375182 - RNA, 15 nt, Bordetella pertussis
gacgguggcuggggc

SEQ ID NO: 375183 - RNA, 18 nt, Bordetella pertussis
gacgguggugucggcggc

SEQ ID NO: 375184 - RNA, 19 nt, Bordetella pertussis
gacgguggugucggcggcc

SEQ ID NO: 375185 - RNA, 15 nt, Bordetella pertussis
gacggugucgcugac

SEQ ID NO: 375186 - RNA, 18 nt, Bordetella pertussis
gacguaagugcccaggcc

SEQ ID NO: 375187 - RNA, 20 nt, Bordetella pertussis
gacguaaucgagcuggccca

SEQ ID NO: 375188 - RNA, 18 nt, Bordetella pertussis
gacguacuucucgucgcg

SEQ ID NO: 375189 - RNA, 22 nt, Bordetella pertussis
gacguacuucucgucgcgcaug

SEQ ID NO: 375190 - RNA, 13 nt, Bordetella pertussis
gacgucgcccaac

SEQ ID NO: 375191 - RNA, 19 nt, Bordetella pertussis
gacgucgcccuggauggcg

SEQ ID NO: 375192 - RNA, 21 nt, Bordetella pertussis
gacgucgcccuggauggcggc

SEQ ID NO: 375193 - RNA, 23 nt, Bordetella pertussis
gacgucgcccuggauggcggccg

SEQ ID NO: 375194 - RNA, 19 nt, Bordetella pertussis
gacgucggccucgcgcagg

SEQ ID NO: 375195 - RNA, 21 nt, Bordetella pertussis
gacgucggccucgcgcagggc

SEQ ID NO: 375196 - RNA, 16 nt, Bordetella pertussis
gacgugcgcgaccgcg

SEQ ID NO: 375197 - RNA, 18 nt, Bordetella pertussis
gacgugcgcgaccgcgcg

SEQ ID NO: 375198 - RNA, 15 nt, Bordetella pertussis
gacguggaccgcgcg

SEQ ID NO: 375199 - RNA, 20 nt, Bordetella pertussis
gacguggcgcuccaugcggc

SEQ ID NO: 375200 - RNA, 22 nt, Bordetella pertussis
gacguggcgcuccaugcggcgg

SEQ ID NO: 375201 - RNA, 22 nt, Bordetella pertussis
gacgugggcgccuacggcggcg

SEQ ID NO: 375202 - RNA, 23 nt, Bordetella pertussis
gacgugggcgccuacggcggcgg

SEQ ID NO: 375203 - RNA, 23 nt, Bordetella pertussis
gacgugucccccggugccgaaga

SEQ ID NO: 375204 - RNA, 21 nt, Bordetella pertussis
gacguucggggcgucgcugcu

SEQ ID NO: 375205 - RNA, 17 nt, Bordetella pertussis
gacguugccgcgcgcgu

SEQ ID NO: 375206 - RNA, 20 nt, Bordetella pertussis
gacguugcgcgacaggcccg

SEQ ID NO: 375207 - RNA, 13 nt, Bordetella pertussis
gacguuggcgaau

SEQ ID NO: 375208 - RNA, 23 nt, Bordetella pertussis
gacguuguccaggccgaucagcg

SEQ ID NO: 375209 - RNA, 22 nt, Bordetella pertussis
gacguuguucaggaaggcccgg

SEQ ID NO: 375210 - RNA, 18 nt, Bordetella pertussis
gacuacgcgcuggcgcag

SEQ ID NO: 375211 - RNA, 22 nt, Bordetella pertussis
gacucauaggcaucgaccagcg

SEQ ID NO: 375212 - RNA, 17 nt, Bordetella pertussis
gacuccaccggcgucac

SEQ ID NO: 375213 - RNA, 14 nt, Bordetella pertussis
gacuccggccgggc

SEQ ID NO: 375214 - RNA, 17 nt, Bordetella pertussis
gacuccggccgggccag

SEQ ID NO: 375215 - RNA, 18 nt, Bordetella pertussis
gacucgaaacgggcggcg

SEQ ID NO: 375216 - RNA, 22 nt, Bordetella pertussis
gacucgaaacgggcggcgucgc

SEQ ID NO: 375217 - RNA, 20 nt, Bordetella pertussis
gacucgacgaacacgcgcgc

SEQ ID NO: 375218 - RNA, 22 nt, Bordetella pertussis
gacucgacgaacacgcgcgccg

SEQ ID NO: 375219 - RNA, 16 nt, Bordetella pertussis
gacucgauggcgcagg

SEQ ID NO: 375220 - RNA, 13 nt, Bordetella pertussis
gacucgggcaugc

SEQ ID NO: 375221 - RNA, 19 nt, Bordetella pertussis
gacucgggcaugcgccugc

SEQ ID NO: 375222 - RNA, 16 nt, Bordetella pertussis
gacucgucgaccacca

SEQ ID NO: 375223 - RNA, 18 nt, Bordetella pertussis
gacugaacgcguccaggc

SEQ ID NO: 375224 - RNA, 15 nt, Bordetella pertussis
gacugcaggcgcugc

SEQ ID NO: 375225 - RNA, 20 nt, Bordetella pertussis
gacugcugccggauuggcgc

SEQ ID NO: 375226 - RNA, 18 nt, Bordetella pertussis
gacuggauauggcgccgc

SEQ ID NO: 375227 - RNA, 17 nt, Bordetella pertussis
gacuggcaccggccaag

SEQ ID NO: 375228 - RNA, 17 nt, Bordetella pertussis
gacuggcaccggccgac

SEQ ID NO: 375229 - RNA, 14 nt, Bordetella pertussis
gacuggacgaugag

SEQ ID NO: 375230 - RNA, 15 nt, Bordetella pertussis
gacuggcagugcgcg

SEQ ID NO: 375231 - RNA, 19 nt, Bordetella pertussis
gacuggcccaggcgggcca

SEQ ID NO: 375232 - RNA, 22 nt, Bordetella pertussis
gacuggcccaggcgggccaggu

SEQ ID NO: 375233 - RNA, 16 nt, Bordetella pertussis
gacuggccgcgccgcu

SEQ ID NO: 375234 - RNA, 21 nt, Bordetella pertussis
gacuggcgagcacccgcaggc

SEQ ID NO: 375235 - RNA, 11 nt, Bordetella pertussis
gacuggcgcgc

SEQ ID NO: 375236 - RNA, 15 nt, Bordetella pertussis
gacuggcgcgcacca

SEQ ID NO: 375237 - RNA, 19 nt, Bordetella pertussis
gacuggcggcugcgggcgc

SEQ ID NO: 375238 - RNA, 18 nt, Bordetella pertussis
gacuggcucccgcugacu

SEQ ID NO: 375239 - RNA, 18 nt, Bordetella pertussis
gacugggcgucgcucugc

SEQ ID NO: 375240 - RNA, 20 nt, Bordetella pertussis
gacuggugcaacuccacgcc

SEQ ID NO: 375241 - RNA, 18 nt, Bordetella pertussis
gacugugcagccacgccu

SEQ ID NO: 375242 - RNA, 20 nt, Bordetella pertussis
gacuuagaaguccaugccgc

SEQ ID NO: 375243 - RNA, 20 nt, Bordetella pertussis
gacuuccucgacccgcgccu

SEQ ID NO: 375244 - RNA, 20 nt, Bordetella pertussis
gacuucgacccggacaacgc

SEQ ID NO: 375245 - RNA, 14 nt, Bordetella pertussis
gacuucgacggcag

SEQ ID NO: 375246 - RNA, 19 nt, Bordetella pertussis
gacuucagguagguggaca

SEQ ID NO: 375247 - RNA, 19 nt, Bordetella pertussis
gacuucggccgccagccgg

SEQ ID NO: 375248 - RNA, 15 nt, Bordetella pertussis
gacuucggcggccau

SEQ ID NO: 375249 - RNA, 19 nt, Bordetella pertussis
gacuucggcggccaugccg

SEQ ID NO: 375250 - RNA, 20 nt, Bordetella pertussis
gacuucgcgaaagcgcugcg

SEQ ID NO: 375251 - RNA, 20 nt, Bordetella pertussis
gacuucggucagcuugccgc

SEQ ID NO: 375252 - RNA, 21 nt, Bordetella pertussis
gacuucucuuucucgggcguc

SEQ ID NO: 375253 - RNA, 18 nt, Bordetella pertussis
gacuugcggcacgugccg

SEQ ID NO: 375254 - RNA, 21 nt, Bordetella pertussis
gagaaaccgauggugccgggc

SEQ ID NO: 375255 - RNA, 16 nt, Bordetella pertussis
gagaacgagccggccg

SEQ ID NO: 375256 - RNA, 17 nt, Bordetella pertussis
gagaacgcggccgcgac

SEQ ID NO: 375257 - RNA, 16 nt, Bordetella pertussis
gagaacgcgucgcuca

SEQ ID NO: 375258 - RNA, 13 nt, Bordetella pertussis
gagaagcgccgcg

SEQ ID NO: 375259 - RNA, 17 nt, Bordetella pertussis
gagaagcgccgcgccga

SEQ ID NO: 375260 - RNA, 24 nt, Bordetella pertussis
gagaaggcgguguagaccaccagc

SEQ ID NO: 375261 - RNA, 22 nt, Bordetella pertussis
gagaagggcuugaccagggcgg

SEQ ID NO: 375262 - RNA, 17 nt, Bordetella pertussis
gagaagucaucgauggc

SEQ ID NO: 375263 - RNA, 14 nt, Bordetella pertussis
gagacaggcgcgcc

SEQ ID NO: 375264 - RNA, 22 nt, Bordetella pertussis
gagaccaagcugcgcgaggacc

SEQ ID NO: 375265 - RNA, 18 nt, Bordetella pertussis
gagaccacgauggccggc

SEQ ID NO: 375266 - RNA, 12 nt, Bordetella pertussis
gagaccggcaug

SEQ ID NO: 375267 - RNA, 19 nt, Bordetella pertussis
gagaccggcgccugcggca

SEQ ID NO: 375268 - RNA, 22 nt, Bordetella pertussis
gagaccguggaaaccgcgucgu

SEQ ID NO: 375269 - RNA, 23 nt, Bordetella pertussis
gagacgaaggcgccggccaggcc

SEQ ID NO: 375270 - RNA, 19 nt, Bordetella pertussis
gagacgcgcucgcgcgcgu

SEQ ID NO: 375271 - RNA, 19 nt, Bordetella pertussis
gagacggucaccgcgccca

SEQ ID NO: 375272 - RNA, 16 nt, Bordetella pertussis
gagacuggcaccggcc

SEQ ID NO: 375273 - RNA, 15 nt, Bordetella pertussis
gagacuggcagugcg

SEQ ID NO: 375274 - RNA, 15 nt, Bordetella pertussis
gagagccggccacgc

SEQ ID NO: 375275 - RNA, 15 nt, Bordetella pertussis
gagauacuggccgau

SEQ ID NO: 375276 - RNA, 22 nt, Bordetella pertussis
gagauacuugcgcagcgcggcg

SEQ ID NO: 375277 - RNA, 16 nt, Bordetella pertussis
gagauaggcggccagg

SEQ ID NO: 375278 - RNA, 16 nt, Bordetella pertussis
gagaucaugaccacgu

SEQ ID NO: 375279 - RNA, 14 nt, Bordetella pertussis
gagauccgccggcg

SEQ ID NO: 375280 - RNA, 14 nt, Bordetella pertussis
gagaucgccgccga

SEQ ID NO: 375281 - RNA, 16 nt, Bordetella pertussis
gagaucgccgagcggc

SEQ ID NO: 375282 - RNA, 19 nt, Bordetella pertussis
gagauggguacagcgcgcc

SEQ ID NO: 375283 - RNA, 17 nt, Bordetella pertussis
gagauguuccugcgcga

SEQ ID NO: 375284 - RNA, 15 nt, Bordetella pertussis
gagcaacgugcgcac

SEQ ID NO: 375285 - RNA, 16 nt, Bordetella pertussis
gagcaauccgucaggc

SEQ ID NO: 375286 - RNA, 13 nt, Bordetella pertussis
gagcaccacggcg

SEQ ID NO: 375287 - RNA, 15 nt, Bordetella pertussis
gagcaccacggcgcg

SEQ ID NO: 375288 - RNA, 13 nt, Bordetella pertussis
gagcaccagcagc

SEQ ID NO: 375289 - RNA, 17 nt, Bordetella pertussis
gagcaccagcagcccca

SEQ ID NO: 375290 - RNA, 19 nt, Bordetella pertussis
gagcaccagcagccccagc

SEQ ID NO: 375291 - RNA, 14 nt, Bordetella pertussis
gagcacccgcaggc

SEQ ID NO: 375292 - RNA, 15 nt, Bordetella pertussis
gagcacccgcaggcg

SEQ ID NO: 375293 - RNA, 17 nt, Bordetella pertussis
gagcaccgagaccgggc

SEQ ID NO: 375294 - RNA, 15 nt, Bordetella pertussis
gagcacgcggcgcgg

SEQ ID NO: 375295 - RNA, 15 nt, Bordetella pertussis
gagcacggcguggcg

SEQ ID NO: 375296 - RNA, 20 nt, Bordetella pertussis
gagcacggcguggcgcgcac

SEQ ID NO: 375297 - RNA, 14 nt, Bordetella pertussis
gagcacguccagcg

SEQ ID NO: 375298 - RNA, 17 nt, Bordetella pertussis
gagcacguccagcggcg

SEQ ID NO: 375299 - RNA, 22 nt, Bordetella pertussis
gagcacgguuucgccgugcugg

SEQ ID NO: 375300 - RNA, 16 nt, Bordetella pertussis
gagcagaugcgacugg

SEQ ID NO: 375301 - RNA, 21 nt, Bordetella pertussis
gaggcaucgaaggcgaccggc

SEQ ID NO: 375302 - RNA, 17 nt, Bordetella pertussis
gaggcauuggcggcggc

SEQ ID NO: 375303 - RNA, 14 nt, Bordetella pertussis
gaggccagcacgcc

SEQ ID NO: 375304 - RNA, 16 nt, Bordetella pertussis
gaggccagcacgccgg

SEQ ID NO: 375305 - RNA, 13 nt, Bordetella pertussis
gaggccaggcccu

SEQ ID NO: 375306 - RNA, 23 nt, Bordetella pertussis
gaggccaggcccucgcggccguc

SEQ ID NO: 375307 - RNA, 12 nt, Bordetella pertussis
gaggccaggccg

SEQ ID NO: 375308 - RNA, 13 nt, Bordetella pertussis
gaggccaggccgg

SEQ ID NO: 375309 - RNA, 15 nt, Bordetella pertussis
gaggccagggagugc

SEQ ID NO: 375310 - RNA, 16 nt, Bordetella pertussis
gaggcccagccgcucg

SEQ ID NO: 375311 - RNA, 16 nt, Bordetella pertussis
gaggccgagcgcgagc

SEQ ID NO: 375312 - RNA, 14 nt, Bordetella pertussis
gaggccgcgcgccu

SEQ ID NO: 375313 - RNA, 14 nt, Bordetella pertussis
gaggccggcgugcu

SEQ ID NO: 375314 - RNA, 12 nt, Bordetella pertussis
gaggcgcgggca

SEQ ID NO: 375315 - RNA, 13 nt, Bordetella pertussis
gaggcgcgggcga

SEQ ID NO: 375316 - RNA, 14 nt, Bordetella pertussis
gaggcgcuggccgg

SEQ ID NO: 375317 - RNA, 23 nt, Bordetella pertussis
gaggcgcuggcguccagccugcc

SEQ ID NO: 375318 - RNA, 13 nt, Bordetella pertussis
gaggcggccgcgg

SEQ ID NO: 375319 - RNA, 22 nt, Bordetella pertussis
gaggcggccgcgggcggcgcgc

SEQ ID NO: 375320 - RNA, 12 nt, Bordetella pertussis
gaggcggccggg

SEQ ID NO: 375321 - RNA, 13 nt, Bordetella pertussis
gaggcggccgggc

SEQ ID NO: 375322 - RNA, 20 nt, Bordetella pertussis
gaggcggcgacgcagcacgg

SEQ ID NO: 375323 - RNA, 15 nt, Bordetella pertussis
gaggcggcgcggguc

SEQ ID NO: 375324 - RNA, 17 nt, Bordetella pertussis
gaggcggugggcagggc

SEQ ID NO: 375325 - RNA, 18 nt, Bordetella pertussis
gaggcggugggcagggcg

SEQ ID NO: 375326 - RNA, 15 nt, Bordetella pertussis
gagggccggacuggc

SEQ ID NO: 375327 - RNA, 20 nt, Bordetella pertussis
gagggccggacuggcgcgca

SEQ ID NO: 375328 - RNA, 21 nt, Bordetella pertussis
gagggccggacuggcgcgcac

SEQ ID NO: 375329 - RNA, 15 nt, Bordetella pertussis
gagggccggcgccag

SEQ ID NO: 375330 - RNA, 13 nt, Bordetella pertussis
gagggccgcggcg

SEQ ID NO: 375331 - RNA, 14 nt, Bordetella pertussis
gagggccgcggcga

SEQ ID NO: 375332 - RNA, 14 nt, Bordetella pertussis
gagggcgaucaugc

SEQ ID NO: 375333 - RNA, 17 nt, Bordetella pertussis
gagggcgcgggccagcu

SEQ ID NO: 375334 - RNA, 12 nt, Bordetella pertussis
gagggcgcggcg

SEQ ID NO: 375335 - RNA, 13 nt, Bordetella pertussis
gagguagggcgcg

SEQ ID NO: 375336 - RNA, 20 nt, Bordetella pertussis
gaggucagcccggcggccau

SEQ ID NO: 375337 - RNA, 13 nt, Bordetella pertussis
gaggucagcggcu

SEQ ID NO: 375338 - RNA, 14 nt, Bordetella pertussis
gagguccugcucgg

SEQ ID NO: 375339 - RNA, 22 nt, Bordetella pertussis
gaggugcacgugggcacgccgg

SEQ ID NO: 375340 - RNA, 14 nt, Bordetella pertussis
gagguggcgggcga

SEQ ID NO: 375341 - RNA, 13 nt, Bordetella pertussis
gagguggcgcauu

SEQ ID NO: 375342 - RNA, 22 nt, Bordetella pertussis
gagguguagaacucggccgcau

SEQ ID NO: 375343 - RNA, 13 nt, Bordetella pertussis
gagucgccccgac

SEQ ID NO: 375344 - RNA, 14 nt, Bordetella pertussis
gagucggcgccgcg

SEQ ID NO: 375345 - RNA, 19 nt, Bordetella pertussis
gagucggcgccgcgcagca

SEQ ID NO: 375346 - RNA, 15 nt, Bordetella pertussis
gagucgggcugcugc

SEQ ID NO: 375347 - RNA, 22 nt, Bordetella pertussis
gagucguauucggaccagggcu

SEQ ID NO: 375348 - RNA, 18 nt, Bordetella pertussis
gagugauuguccugcacg

SEQ ID NO: 375349 - RNA, 17 nt, Bordetella pertussis
gagugcgaggacgaccu

SEQ ID NO: 375350 - RNA, 14 nt, Bordetella pertussis
gaguuccgcgacgc

SEQ ID NO: 375351 - RNA, 16 nt, Bordetella pertussis
gaguuccgcgacgcgg

SEQ ID NO: 375352 - RNA, 22 nt, Bordetella pertussis
gauaaaccgguggugcugcugg

SEQ ID NO: 375353 - RNA, 13 nt, Bordetella pertussis
gauaaaggccgca

SEQ ID NO: 375354 - RNA, 16 nt, Bordetella pertussis
gauacaaggugccugu

SEQ ID NO: 375355 - RNA, 20 nt, Bordetella pertussis
gauacaaggugccugucccc

SEQ ID NO: 375356 - RNA, 17 nt, Bordetella pertussis
gauacagcuuggcgcgc

SEQ ID NO: 375357 - RNA, 13 nt, Bordetella pertussis
gauacaggcgcuc

SEQ ID NO: 375358 - RNA, 15 nt, Bordetella pertussis
gauacaggcgcucgc

SEQ ID NO: 375359 - RNA, 16 nt, Bordetella pertussis
gauaccacgcgcggcg

SEQ ID NO: 375360 - RNA, 17 nt, Bordetella pertussis
gauaccacgcgcggcgg

SEQ ID NO: 375361 - RNA, 19 nt, Bordetella pertussis
gauaccacgcgcggcggcg

SEQ ID NO: 375362 - RNA, 20 nt, Bordetella pertussis
gauaccacgcgcggcggcgg

SEQ ID NO: 375363 - RNA, 16 nt, Bordetella pertussis
gauaccgccuuggccg

SEQ ID NO: 375364 - RNA, 12 nt, Bordetella pertussis
gauaccgucgcg

SEQ ID NO: 375365 - RNA, 14 nt, Bordetella pertussis
gauaccgucgcgcu

SEQ ID NO: 375366 - RNA, 17 nt, Bordetella pertussis
gauaccgucgcgcucga

SEQ ID NO: 375367 - RNA, 18 nt, Bordetella pertussis
gauaccgucuuggcaguc

SEQ ID NO: 375368 - RNA, 18 nt, Bordetella pertussis
gauacgaaaccaggccgg

SEQ ID NO: 375369 - RNA, 16 nt, Bordetella pertussis
gauacgacacgccgcg

SEQ ID NO: 375370 - RNA, 15 nt, Bordetella pertussis
gauacgccgggcgcg

SEQ ID NO: 375371 - RNA, 17 nt, Bordetella pertussis
gauacuguucgccgcac

SEQ ID NO: 375372 - RNA, 21 nt, Bordetella pertussis
gauagacauugcccagcacca

SEQ ID NO: 375373 - RNA, 15 nt, Bordetella pertussis
gauagauggccaggu

SEQ ID NO: 375374 - RNA, 23 nt, Bordetella pertussis
gauagauggccagguggcggcgg

SEQ ID NO: 375375 - RNA, 22 nt, Bordetella pertussis
gauagcccuugaucagcggcgg

SEQ ID NO: 375376 - RNA, 16 nt, Bordetella pertussis
gauagccgcggcgccg

SEQ ID NO: 375377 - RNA, 18 nt, Bordetella pertussis
gauagccgcggcgccgca

SEQ ID NO: 375378 - RNA, 18 nt, Bordetella pertussis
gauagcgccgcgcaucga

SEQ ID NO: 375379 - RNA, 17 nt, Bordetella pertussis
gauagcgccguaccagc

SEQ ID NO: 375380 - RNA, 14 nt, Bordetella pertussis
gauaugcagccgca

SEQ ID NO: 375381 - RNA, 22 nt, Bordetella pertussis
gaucagcaagggccccagcauc

SEQ ID NO: 375382 - RNA, 23 nt, Bordetella pertussis
gaucagcaagggccccagcaucu

SEQ ID NO: 375383 - RNA, 20 nt, Bordetella pertussis
gaucagcaccacggcggcca

SEQ ID NO: 375384 - RNA, 14 nt, Bordetella pertussis
gaucagcaccgcgg

SEQ ID NO: 375385 - RNA, 15 nt, Bordetella pertussis
gaucagcacgauggu

SEQ ID NO: 375386 - RNA, 14 nt, Bordetella pertussis
gaucagcaggccca

SEQ ID NO: 375387 - RNA, 19 nt, Bordetella pertussis
gaucagcaggcccaccagg

SEQ ID NO: 375388 - RNA, 20 nt, Bordetella pertussis
gaucagcaggucggcgcggc

SEQ ID NO: 375389 - RNA, 20 nt, Bordetella pertussis
gaucagcauaucgucgcugc

SEQ ID NO: 375390 - RNA, 21 nt, Bordetella pertussis
gaucagccacgugaagcgccg

SEQ ID NO: 375391 - RNA, 14 nt, Bordetella pertussis
gaucagccagccgg

SEQ ID NO: 375392 - RNA, 23 nt, Bordetella pertussis
gaucagccagccggcggccagcu

SEQ ID NO: 375393 - RNA, 15 nt, Bordetella pertussis
gaucagccccugcca

SEQ ID NO: 375394 - RNA, 17 nt, Bordetella pertussis
gaucagccccugccaug

SEQ ID NO: 375395 - RNA, 12 nt, Bordetella pertussis
gaucagccggcc

SEQ ID NO: 375396 - RNA, 17 nt, Bordetella pertussis
gaucagcgacagcaggg

SEQ ID NO: 375397 - RNA, 12 nt, Bordetella pertussis
gaucagcgccca

SEQ ID NO: 375398 - RNA, 12 nt, Bordetella pertussis
gaucagcgcgcc

SEQ ID NO: 375399 - RNA, 23 nt, Bordetella pertussis
gaucagcggauugaccagcgcgg

SEQ ID NO: 375400 - RNA, 14 nt, Bordetella pertussis
gaucagcgcggccg

SEQ ID NO: 375401 - RNA, 19 nt, Bordetella pertussis
gaucagcggcggcacgcgc

SEQ ID NO: 375402 - RNA, 20 nt, Bordetella pertussis
gaucagcggcggcacgcgcg

SEQ ID NO: 375403 - RNA, 21 nt, Bordetella pertussis
gaucagcggcggcacgcgcgc

SEQ ID NO: 375404 - RNA, 20 nt, Bordetella pertussis
gaucagcgggcuggccagcg

SEQ ID NO: 375405 - RNA, 14 nt, Bordetella pertussis
gaucagcugcggcc

SEQ ID NO: 375406 - RNA, 22 nt, Bordetella pertussis
gaucagcugcggccccggcacc

SEQ ID NO: 375407 - RNA, 23 nt, Bordetella pertussis
gaucagcugcggccccggcacca

SEQ ID NO: 375408 - RNA, 21 nt, Bordetella pertussis
gaucaggaagacuuccgugcc

SEQ ID NO: 375409 - RNA, 13 nt, Bordetella pertussis
gaucaggcccagc

SEQ ID NO: 375410 - RNA, 14 nt, Bordetella pertussis
gaucaggcccagca

SEQ ID NO: 375411 - RNA, 21 nt, Bordetella pertussis
gaucaggcccuggggccgcgg

SEQ ID NO: 375412 - RNA, 22 nt, Bordetella pertussis
gaucaggcccuggggccgcggc

SEQ ID NO: 375413 - RNA, 17 nt, Bordetella pertussis
gaucaggccgaacuggg

SEQ ID NO: 375414 - RNA, 15 nt, Bordetella pertussis
gaucaggccgcccca

SEQ ID NO: 375415 - RNA, 13 nt, Bordetella pertussis
gaucaggccggcg

SEQ ID NO: 375416 - RNA, 16 nt, Bordetella pertussis
gaucaggccggcgaug

SEQ ID NO: 375417 - RNA, 20 nt, Bordetella pertussis
gaucaggcgcuccauggcgc

SEQ ID NO: 375418 - RNA, 14 nt, Bordetella pertussis
gaucaggcggcgcg

SEQ ID NO: 375419 - RNA, 13 nt, Bordetella pertussis
gaucaggcggcug

SEQ ID NO: 375420 - RNA, 15 nt, Bordetella pertussis
gaucagggccgugcc

SEQ ID NO: 375421 - RNA, 21 nt, Bordetella pertussis
gaucaggcggugccccggccu

SEQ ID NO: 375422 - RNA, 19 nt, Bordetella pertussis
gaucaguaucucggcgccc

SEQ ID NO: 375423 - RNA, 16 nt, Bordetella pertussis
gaucaguccgacgaca

SEQ ID NO: 375424 - RNA, 15 nt, Bordetella pertussis
gaucaguucggcaug

SEQ ID NO: 375425 - RNA, 17 nt, Bordetella pertussis
gaucauccagguggcgg

SEQ ID NO: 375426 - RNA, 17 nt, Bordetella pertussis
gaucauccgggcccggu

SEQ ID NO: 375427 - RNA, 16 nt, Bordetella pertussis
gaucauccuguucgug

SEQ ID NO: 375428 - RNA, 23 nt, Bordetella pertussis
gaucaucgaggcaaucagcccca

SEQ ID NO: 375429 - RNA, 15 nt, Bordetella pertussis
gaucaucggcgccau

SEQ ID NO: 375430 - RNA, 13 nt, Bordetella pertussis
gaucaucgugccg

SEQ ID NO: 375431 - RNA, 14 nt, Bordetella pertussis
gaucaugaugcgcu

SEQ ID NO: 375432 - RNA, 22 nt, Bordetella pertussis
gaucaugccgcugaccagcacg

SEQ ID NO: 375433 - RNA, 18 nt, Bordetella pertussis
gaucauugggucugcgcg

SEQ ID NO: 375434 - RNA, 14 nt, Bordetella pertussis
gauccacgccgccg

SEQ ID NO: 375435 - RNA, 21 nt, Bordetella pertussis
gauccacgccgccggccagcu

SEQ ID NO: 375436 - RNA, 17 nt, Bordetella pertussis
gauccacucggccagcg

SEQ ID NO: 375437 - RNA, 14 nt, Bordetella pertussis
gauccagcagcgug

SEQ ID NO: 375438 - RNA, 16 nt, Bordetella pertussis
gauccagcccaccgcg

SEQ ID NO: 375439 - RNA, 21 nt, Bordetella pertussis
gauccagccguuggcgcccag

SEQ ID NO: 375440 - RNA, 22 nt, Bordetella pertussis
gauccagccguuggcgcccagc

SEQ ID NO: 375441 - RNA, 14 nt, Bordetella pertussis
gauccagcgcggcc

SEQ ID NO: 375442 - RNA, 17 nt, Bordetella pertussis
gauccagcgcggccacg

SEQ ID NO: 375443 - RNA, 22 nt, Bordetella pertussis
gauccagcgcucgggcucgcgc

SEQ ID NO: 375444 - RNA, 22 nt, Bordetella pertussis
gauccaggcggccaccaccagg

SEQ ID NO: 375445 - RNA, 17 nt, Bordetella pertussis
gaucccuugugcgcgcc

SEQ ID NO: 375446 - RNA, 19 nt, Bordetella pertussis
gauccgccauaugcgcgaa

SEQ ID NO: 375447 - RNA, 15 nt, Bordetella pertussis
gauccgccgcggcca

SEQ ID NO: 375448 - RNA, 18 nt, Bordetella pertussis
gauccgccgcggccagcg

SEQ ID NO: 375449 - RNA, 20 nt, Bordetella pertussis
gauccgcgacgcccuggccu

SEQ ID NO: 375450 - RNA, 16 nt, Bordetella pertussis
gauccgcgccaggcgg

SEQ ID NO: 375451 - RNA, 12 nt, Bordetella pertussis
gauccgcgggcg

SEQ ID NO: 375452 - RNA, 14 nt, Bordetella pertussis
gauccgcgggcggg

SEQ ID NO: 375453 - RNA, 20 nt, Bordetella pertussis
gauccgcgggcgggccgcgg

SEQ ID NO: 375454 - RNA, 24 nt, Bordetella pertussis
gauccggacugaacgcguccaggc

SEQ ID NO: 375455 - RNA, 22 nt, Bordetella pertussis
gauccggcagcagcagcgugcg

SEQ ID NO: 375456 - RNA, 13 nt, Bordetella pertussis
gauccggcgaccg

SEQ ID NO: 375457 - RNA, 19 nt, Bordetella pertussis
gauccggcgaccgacggca

SEQ ID NO: 375458 - RNA, 16 nt, Bordetella pertussis
gauccggcgcuggcgc

SEQ ID NO: 375459 - RNA, 17 nt, Bordetella pertussis
gauccggcgcuggcgca

SEQ ID NO: 375460 - RNA, 15 nt, Bordetella pertussis
gauccugcugguggc

SEQ ID NO: 375461 - RNA, 18 nt, Bordetella pertussis
gauccugcugguggcgau

SEQ ID NO: 375462 - RNA, 17 nt, Bordetella pertussis
gauccuucgcggccgua

SEQ ID NO: 375463 - RNA, 15 nt, Bordetella pertussis
gauccuuggugccgu

SEQ ID NO: 375464 - RNA, 21 nt, Bordetella pertussis
gaucgaacgccucgggcgcaa

SEQ ID NO: 375465 - RNA, 22 nt, Bordetella pertussis
gaucgaacgccucgggcgcaac

SEQ ID NO: 375466 - RNA, 21 nt, Bordetella pertussis
gaucgaacgggaauggcggac

SEQ ID NO: 375467 - RNA, 20 nt, Bordetella pertussis
gaucgacaacaagccgggcg

SEQ ID NO: 375468 - RNA, 22 nt, Bordetella pertussis
gaucgacaacaagccgggcgcc

SEQ ID NO: 375469 - RNA, 21 nt, Bordetella pertussis
gaucgaucagccagccggcgg

SEQ ID NO: 375470 - RNA, 20 nt, Bordetella pertussis
gaucgcacacaccgcgucau

SEQ ID NO: 375471 - RNA, 13 nt, Bordetella pertussis
gaucgccagcagg

SEQ ID NO: 375472 - RNA, 16 nt, Bordetella pertussis
gaucgccagcaggcgc

SEQ ID NO: 375473 - RNA, 14 nt, Bordetella pertussis
gaucgccagcgccg

SEQ ID NO: 375474 - RNA, 15 nt, Bordetella pertussis
gaucgccagcgccgg

SEQ ID NO: 375475 - RNA, 18 nt, Bordetella pertussis
gaucgccaugacgcuggu

SEQ ID NO: 375476 - RNA, 20 nt, Bordetella pertussis
gaucgccaggucggccagcc

SEQ ID NO: 375477 - RNA, 22 nt, Bordetella pertussis
gaucgccaggucggccagccgg

SEQ ID NO: 375478 - RNA, 16 nt, Bordetella pertussis
gaucgccgagcggcau

SEQ ID NO: 375479 - RNA, 15 nt, Bordetella pertussis
gaucgccgcaugggc

SEQ ID NO: 375480 - RNA, 16 nt, Bordetella pertussis
gaucgccgccggcacg

SEQ ID NO: 375481 - RNA, 13 nt, Bordetella pertussis
gaucgccgccggc

SEQ ID NO: 375482 - RNA, 13 nt, Bordetella pertussis
gaucgcggcgcgg

SEQ ID NO: 375483 - RNA, 14 nt, Bordetella pertussis
gaucgcggcgcugg

SEQ ID NO: 375484 - RNA, 13 nt, Bordetella pertussis
gaucggcgcuggc

SEQ ID NO: 375485 - RNA, 14 nt, Bordetella pertussis
gaucggcgcuggcc

SEQ ID NO: 375486 - RNA, 16 nt, Bordetella pertussis
gaucggcgcuggccug

SEQ ID NO: 375487 - RNA, 23 nt, Bordetella pertussis
gaucggcguauugcuccacaggc

SEQ ID NO: 375488 - RNA, 17 nt, Bordetella pertussis
gaucggcuugccgcgcg

SEQ ID NO: 375489 - RNA, 18 nt, Bordetella pertussis
gaucgggcagcuuggcgc

SEQ ID NO: 375490 - RNA, 21 nt, Bordetella pertussis
gaucgggcagcuuggcgcgcc

SEQ ID NO: 375491 - RNA, 18 nt, Bordetella pertussis
gaucguccugaaucgccc

SEQ ID NO: 375492 - RNA, 16 nt, Bordetella pertussis
gaucgucgcugcgcgg

SEQ ID NO: 375493 - RNA, 17 nt, Bordetella pertussis
gaucuccacgaaggcga

SEQ ID NO: 375494 - RNA, 17 nt, Bordetella pertussis
gaucuccggcgccuggc

SEQ ID NO: 375495 - RNA, 21 nt, Bordetella pertussis
gaucuccgggagccugucccc

SEQ ID NO: 375496 - RNA, 19 nt, Bordetella pertussis
gaucucuccgaacgcgaca

SEQ ID NO: 375497 - RNA, 23 nt, Bordetella pertussis
gaucugcgagccuucggccggcu

SEQ ID NO: 375498 - RNA, 19 nt, Bordetella pertussis
gaucugguccacggcggcg

SEQ ID NO: 375499 - RNA, 20 nt, Bordetella pertussis
gaucugguccacggcggcgg

SEQ ID NO: 375500 - RNA, 16 nt, Bordetella pertussis
gaucugguccugggcc

SEQ ID NO: 375501 - RNA, 18 nt, Bordetella pertussis
gaucuggugaaacagcau

SEQ ID NO: 375502 - RNA, 15 nt, Bordetella pertussis
gaucuguaccgccgg

SEQ ID NO: 375503 - RNA, 18 nt, Bordetella pertussis
gaucuuccuugaagccgu

SEQ ID NO: 375504 - RNA, 21 nt, Bordetella pertussis
gaugaacaagguacccgcgcc

SEQ ID NO: 375505 - RNA, 24 nt, Bordetella pertussis
gaugaacagcggcacgccggcggc

SEQ ID NO: 375506 - RNA, 20 nt, Bordetella pertussis
gaugaacaucggcagcgagg

SEQ ID NO: 375507 - RNA, 14 nt, Bordetella pertussis
gaugaacgaccagc

SEQ ID NO: 375508 - RNA, 17 nt, Bordetella pertussis
gaugaagaugccgaacc

SEQ ID NO: 375509 - RNA, 20 nt, Bordetella pertussis
gaugaagcccgagcggcgcc

SEQ ID NO: 375510 - RNA, 22 nt, Bordetella pertussis
gaugaagucgcggcccgccagg

SEQ ID NO: 375511 - RNA, 16 nt, Bordetella pertussis
gaugaccagcagcgcc

SEQ ID NO: 375512 - RNA, 12 nt, Bordetella pertussis
gaugaccagcca

SEQ ID NO: 375513 - RNA, 17 nt, Bordetella pertussis
gaugaccagccagccgc

SEQ ID NO: 375514 - RNA, 21 nt, Bordetella pertussis
gaugaccagcgccggcgcaug

SEQ ID NO: 375515 - RNA, 14 nt, Bordetella pertussis
gaugccgcgcaccu

SEQ ID NO: 375516 - RNA, 15 nt, Bordetella pertussis
gaugccgccggcggg

SEQ ID NO: 375517 - RNA, 14 nt, Bordetella pertussis
gaugccggccagca

SEQ ID NO: 375518 - RNA, 17 nt, Bordetella pertussis
gaugccggccucggcca

SEQ ID NO: 375519 - RNA, 18 nt, Bordetella pertussis
gaugccuugguggggucg

SEQ ID NO: 375520 - RNA, 20 nt, Bordetella pertussis
gaugcgacuggcggcugcgg

SEQ ID NO: 375521 - RNA, 23 nt, Bordetella pertussis
gaugcgagcaaaggacacgcgcg

SEQ ID NO: 375522 - RNA, 19 nt, Bordetella pertussis
gaugcgccaguccagcgcg

SEQ ID NO: 375523 - RNA, 21 nt, Bordetella pertussis
gaugcgccaguccagcgcgcc

SEQ ID NO: 375524 - RNA, 13 nt, Bordetella pertussis
gaugcgccgcacc

SEQ ID NO: 375525 - RNA, 14 nt, Bordetella pertussis
gaugcgccgcacca

SEQ ID NO: 375526 - RNA, 12 nt, Bordetella pertussis
gaugcgccggcc

SEQ ID NO: 375527 - RNA, 17 nt, Bordetella pertussis
gaugcgccggccuggcg

SEQ ID NO: 375528 - RNA, 22 nt, Bordetella pertussis
gaugcgccggccuggcgcgacg

SEQ ID NO: 375529 - RNA, 12 nt, Bordetella pertussis
gaugcgccgcgc

SEQ ID NO: 375530 - RNA, 14 nt, Bordetella pertussis
gaugcgcgaagcgc

SEQ ID NO: 375531 - RNA, 11 nt, Bordetella pertussis
gaugcgcgcca

SEQ ID NO: 375532 - RNA, 12 nt, Bordetella pertussis
gaugcgcgccag

SEQ ID NO: 375533 - RNA, 13 nt, Bordetella pertussis
gaugcgcgccagg

SEQ ID NO: 375534 - RNA, 14 nt, Bordetella pertussis
gaugcgcgccaggc

SEQ ID NO: 375535 - RNA, 17 nt, Bordetella pertussis
gaugcgcgccaggcgcg

SEQ ID NO: 375536 - RNA, 16 nt, Bordetella pertussis
gaugcgcgagcgcgug

SEQ ID NO: 375537 - RNA, 20 nt, Bordetella pertussis
gaugcgcgccccgucggccg

SEQ ID NO: 375538 - RNA, 23 nt, Bordetella pertussis
gaugcgcgccguacagccgcggc

SEQ ID NO: 375539 - RNA, 17 nt, Bordetella pertussis
gaugcgcgcgcgggcca

SEQ ID NO: 375540 - RNA, 14 nt, Bordetella pertussis
gaugcgcggcccgg

SEQ ID NO: 375541 - RNA, 11 nt, Bordetella pertussis
gaugcgcggcg

SEQ ID NO: 375542 - RNA, 13 nt, Bordetella pertussis
gaugcgcggcggg

SEQ ID NO: 375543 - RNA, 15 nt, Bordetella pertussis
gaugcgcgucaggcg

SEQ ID NO: 375544 - RNA, 21 nt, Bordetella pertussis
gaugcggccguugcuccagcc

SEQ ID NO: 375545 - RNA, 15 nt, Bordetella pertussis
gaugcggccuucgcc

SEQ ID NO: 375546 - RNA, 13 nt, Bordetella pertussis
gaugcggcgcaug

SEQ ID NO: 375547 - RNA, 12 nt, Bordetella pertussis
gaugcggcgcgc

SEQ ID NO: 375548 - RNA, 13 nt, Bordetella pertussis
gaugcggcgcgcc

SEQ ID NO: 375549 - RNA, 16 nt, Bordetella pertussis
gaugcggcgcgccgcg

SEQ ID NO: 375550 - RNA, 22 nt, Bordetella pertussis
gaugcgggcaucgcccugcucg

SEQ ID NO: 375551 - RNA, 16 nt, Bordetella pertussis
gaugcgggccacgccg

SEQ ID NO: 375552 - RNA, 13 nt, Bordetella pertussis
gaugcgggcggcg

SEQ ID NO: 375553 - RNA, 20 nt, Bordetella pertussis
gaugcgggucaaggcggggc

SEQ ID NO: 375554 - RNA, 19 nt, Bordetella pertussis
gaugcgggucggcgccaug

SEQ ID NO: 375555 - RNA, 14 nt, Bordetella pertussis
gaugcucgccggcg

SEQ ID NO: 375556 - RNA, 16 nt, Bordetella pertussis
gaugcucgccggcgcc

SEQ ID NO: 375557 - RNA, 15 nt, Bordetella pertussis
gaugcugaccaccgg

SEQ ID NO: 375558 - RNA, 18 nt, Bordetella pertussis
gaugcugcagggccugga

SEQ ID NO: 375559 - RNA, 15 nt, Bordetella pertussis
gaugcugccgggcau

SEQ ID NO: 375560 - RNA, 15 nt, Bordetella pertussis
gaugcugccgucgcc

SEQ ID NO: 375561 - RNA, 21 nt, Bordetella pertussis
gauggaucccuggucgaccca

SEQ ID NO: 375562 - RNA, 18 nt, Bordetella pertussis
gauggaugccgucggccu

SEQ ID NO: 375563 - RNA, 14 nt, Bordetella pertussis
gauggaggccagga

SEQ ID NO: 375564 - RNA, 17 nt, Bordetella pertussis
gauggauuucgaccgca

SEQ ID NO: 375565 - RNA, 14 nt, Bordetella pertussis
gauggccgcgccca

SEQ ID NO: 375566 - RNA, 20 nt, Bordetella pertussis
gauggccacgaccaccagcg

SEQ ID NO: 375567 - RNA, 15 nt, Bordetella pertussis
gauggccacgcgcug

SEQ ID NO: 375568 - RNA, 15 nt, Bordetella pertussis
gauggccgcgcgcag

SEQ ID NO: 375569 - RNA, 20 nt, Bordetella pertussis
gauggccgcgcgcagcgagg

SEQ ID NO: 375570 - RNA, 17 nt, Bordetella pertussis
gauggccggccugccgg

SEQ ID NO: 375571 - RNA, 14 nt, Bordetella pertussis
gauggccggcgcga

SEQ ID NO: 375572 - RNA, 17 nt, Bordetella pertussis
gauggccgggccguggc

SEQ ID NO: 375573 - RNA, 14 nt, Bordetella pertussis
gauggccggguggu

SEQ ID NO: 375574 - RNA, 18 nt, Bordetella pertussis
gauggccugugcggccca

SEQ ID NO: 375575 - RNA, 18 nt, Bordetella pertussis
gauggccuuuuccaggcg

SEQ ID NO: 375576 - RNA, 19 nt, Bordetella pertussis
gauggccuuuuccaggcgu

SEQ ID NO: 375577 - RNA, 16 nt, Bordetella pertussis
gauggcgauggcuugg

SEQ ID NO: 375578 - RNA, 19 nt, Bordetella pertussis
gauggcgauggcuuggcgc

SEQ ID NO: 375579 - RNA, 19 nt, Bordetella pertussis
gauggcgauguccagcgag

SEQ ID NO: 375580 - RNA, 12 nt, Bordetella pertussis
gauggcgcagcg

SEQ ID NO: 375581 - RNA, 14 nt, Bordetella pertussis
gauggcgcagcggg

SEQ ID NO: 375582 - RNA, 18 nt, Bordetella pertussis
gauggcgcaggcgcgcca

SEQ ID NO: 375583 - RNA, 23 nt, Bordetella pertussis
gauggcgccaccuucgccgcgca

SEQ ID NO: 375584 - RNA, 14 nt, Bordetella pertussis
gauggcgccagccc

SEQ ID NO: 375585 - RNA, 22 nt, Bordetella pertussis
gauggcgccgauuucgccgccg

SEQ ID NO: 375586 - RNA, 17 nt, Bordetella pertussis
gauggcgccgcugucgc

SEQ ID NO: 375587 - RNA, 19 nt, Bordetella pertussis
gauggcgccggccagcgcg

SEQ ID NO: 375588 - RNA, 23 nt, Bordetella pertussis
gauggcgccggccagcgcgccgg

SEQ ID NO: 375589 - RNA, 12 nt, Bordetella pertussis
gauggcgcgcgc

SEQ ID NO: 375590 - RNA, 14 nt, Bordetella pertussis
gauggcgcgcggcu

SEQ ID NO: 375591 - RNA, 15 nt, Bordetella pertussis
gauggcgcgucgccg

SEQ ID NO: 375592 - RNA, 19 nt, Bordetella pertussis
gauggcgcgucgccgcgcc

SEQ ID NO: 375593 - RNA, 16 nt, Bordetella pertussis
gauggcuucgcgcaca

SEQ ID NO: 375594 - RNA, 20 nt, Bordetella pertussis
gaugggcaggcccaugacgc

SEQ ID NO: 375595 - RNA, 14 nt, Bordetella pertussis
gaugggcgcaucca

SEQ ID NO: 375596 - RNA, 14 nt, Bordetella pertussis
gaugggcgcgcgca

SEQ ID NO: 375597 - RNA, 21 nt, Bordetella pertussis
gaugggcgcggcgcgcgccga

SEQ ID NO: 375598 - RNA, 20 nt, Bordetella pertussis
gauggggcagccauccucgc

SEQ ID NO: 375599 - RNA, 15 nt, Bordetella pertussis
gauggggccauggca

SEQ ID NO: 375600 - RNA, 13 nt, Bordetella pertussis
gauggggccgcgc

SEQ ID NO: 375601 - RNA, 14 nt, Bordetella pertussis
gauggggccgcgcc

SEQ ID NO: 375602 - RNA, 22 nt, Bordetella pertussis
gauggggguggaaaugccggcg

SEQ ID NO: 375603 - RNA, 19 nt, Bordetella pertussis
gauggggucgggccgcgcg

SEQ ID NO: 375604 - RNA, 18 nt, Bordetella pertussis
gauggguacagcgcgccc

SEQ ID NO: 375605 - RNA, 19 nt, Bordetella pertussis
gauggguacagcgcgcccg

SEQ ID NO: 375606 - RNA, 15 nt, Bordetella pertussis
gauggguacgccggc

SEQ ID NO: 375607 - RNA, 18 nt, Bordetella pertussis
gaugguagaugcgcgcga

SEQ ID NO: 375608 - RNA, 16 nt, Bordetella pertussis
gaugguaucggccggg

SEQ ID NO: 375609 - RNA, 14 nt, Bordetella pertussis
gauggucgcggccg

SEQ ID NO: 375610 - RNA, 18 nt, Bordetella pertussis
gauggucgugcggcacgc

SEQ ID NO: 375611 - RNA, 19 nt, Bordetella pertussis
gauggucgugcggcacgca

SEQ ID NO: 375612 - RNA, 22 nt, Bordetella pertussis
gauggugaacgccaccaggccg

SEQ ID NO: 375613 - RNA, 20 nt, Bordetella pertussis
gauggugcauucguccaggu

SEQ ID NO: 375614 - RNA, 20 nt, Bordetella pertussis
gaugguggggcuggccgccg

SEQ ID NO: 375615 - RNA, 20 nt, Bordetella pertussis
gaugugcgcgggcgcgggcu

SEQ ID NO: 375616 - RNA, 16 nt, Bordetella pertussis
gauguggcgcuggcgg

SEQ ID NO: 375617 - RNA, 18 nt, Bordetella pertussis
gauguucaugaccgccgc

SEQ ID NO: 375618 - RNA, 17 nt, Bordetella pertussis
gauguuccugcgcgaca

SEQ ID NO: 375619 - RNA, 15 nt, Bordetella pertussis
gauucgcgcaccgag

SEQ ID NO: 375620 - RNA, 19 nt, Bordetella pertussis
gauucgcgccggccgacgg

SEQ ID NO: 375621 - RNA, 22 nt, Bordetella pertussis
gauucgcggugcaagcggccgg

SEQ ID NO: 375622 - RNA, 15 nt, Bordetella pertussis
gauugaacugcugga

SEQ ID NO: 375623 - RNA, 19 nt, Bordetella pertussis
gauuguccagcggcagcgg

SEQ ID NO: 375624 - RNA, 21 nt, Bordetella pertussis
gauugugcaugacggccagga

SEQ ID NO: 375625 - RNA, 22 nt, Bordetella pertussis
gauugugcaugacggccaggau

SEQ ID NO: 375626 - RNA, 17 nt, Bordetella pertussis
gauuucauggcgucugc

SEQ ID NO: 375627 - RNA, 17 nt, Bordetella pertussis
gauuuccucgcgcacca

SEQ ID NO: 375628 - RNA, 17 nt, Bordetella pertussis
gauuuccuugcgccgcc

SEQ ID NO: 375629 - RNA, 21 nt, Bordetella pertussis
gauuucgaucacggcgcgcgc

SEQ ID NO: 375630 - RNA, 16 nt, Bordetella pertussis
gauuucgcuggccauc

SEQ ID NO: 375631 - RNA, 15 nt, Bordetella pertussis
gauuucggagcggcu

SEQ ID NO: 375632 - RNA, 14 nt, Bordetella pertussis
gauuugagcagcgu

SEQ ID NO: 375633 - RNA, 13 nt, Bordetella pertussis
gcaaaccacgucg

SEQ ID NO: 375634 - RNA, 21 nt, Bordetella pertussis
gcaaacccggcgaagccggca

SEQ ID NO: 375635 - RNA, 17 nt, Bordetella pertussis
gcaaaccgacgcggcca

SEQ ID NO: 375636 - RNA, 18 nt, Bordetella pertussis
gcaaacuuccccgcgugc

SEQ ID NO: 375637 - RNA, 22 nt, Bordetella pertussis
gcaaacuuccccgcgugccugu

SEQ ID NO: 375638 - RNA, 21 nt, Bordetella pertussis
gcaaagaaauugggcguggcg

SEQ ID NO: 375639 - RNA, 13 nt, Bordetella pertussis
gcaaagccgcugc

SEQ ID NO: 375640 - RNA, 17 nt, Bordetella pertussis
gcaaagccugacggcua

SEQ ID NO: 375641 - RNA, 18 nt, Bordetella pertussis
gcaaagcgcgcguccugc

SEQ ID NO: 375642 - RNA, 22 nt, Bordetella pertussis
gcaaagcgcgcguccugcgcca

SEQ ID NO: 375643 - RNA, 15 nt, Bordetella pertussis
gcaaagcgcggcugc

SEQ ID NO: 375644 - RNA, 15 nt, Bordetella pertussis
gcaaaggcccaggca

SEQ ID NO: 375645 - RNA, 20 nt, Bordetella pertussis
gcaacaaaggaaaucgcggc

SEQ ID NO: 375646 - RNA, 21 nt, Bordetella pertussis
gcaacaaaggaaaucgcggcg

SEQ ID NO: 375647 - RNA, 13 nt, Bordetella pertussis
gcaacacgaccag

SEQ ID NO: 375648 - RNA, 17 nt, Bordetella pertussis
gcaacacgaccagcagg

SEQ ID NO: 375649 - RNA, 18 nt, Bordetella pertussis
gcaacacgaccagcaggc

SEQ ID NO: 375650 - RNA, 15 nt, Bordetella pertussis
gcaacagacccgggc

SEQ ID NO: 375651 - RNA, 16 nt, Bordetella pertussis
gcaacagacccgggcc

SEQ ID NO: 375652 - RNA, 17 nt, Bordetella pertussis
gcaacaggcagcugcgc

SEQ ID NO: 375653 - RNA, 21 nt, Bordetella pertussis
gcaacaggcagcugcgcgucg

SEQ ID NO: 375654 - RNA, 23 nt, Bordetella pertussis
gcaacaggucguuguggcaggcg

SEQ ID NO: 375655 - RNA, 21 nt, Bordetella pertussis
gcaaccagggagccguucugg

SEQ ID NO: 375656 - RNA, 18 nt, Bordetella pertussis
gcaaccaggggcggcgcg

SEQ ID NO: 375657 - RNA, 19 nt, Bordetella pertussis
gcaaccaggggcggcgcgg

SEQ ID NO: 375658 - RNA, 21 nt, Bordetella pertussis
gcaaccaggggcggcgcggcg

SEQ ID NO: 375659 - RNA, 19 nt, Bordetella pertussis
gcaacccacccccagcagc

SEQ ID NO: 375660 - RNA, 13 nt, Bordetella pertussis
gcaacccacggcg

SEQ ID NO: 375661 - RNA, 14 nt, Bordetella pertussis
gcaacccacggcgu

SEQ ID NO: 375662 - RNA, 13 nt, Bordetella pertussis
gcaaccccaccgg

SEQ ID NO: 375663 - RNA, 15 nt, Bordetella pertussis
gcaaccccaccggca

SEQ ID NO: 375664 - RNA, 13 nt, Bordetella pertussis
gcaaccccagcag

SEQ ID NO: 375665 - RNA, 16 nt, Bordetella pertussis
gcaaccccagcagcgc

SEQ ID NO: 375666 - RNA, 17 nt, Bordetella pertussis
gcaaccccagcagcgcc

SEQ ID NO: 375667 - RNA, 23 nt, Bordetella pertussis
gcaacccgcccacgcggcgcugc

SEQ ID NO: 375668 - RNA, 18 nt, Bordetella pertussis
gcaacccggccucgcugc

SEQ ID NO: 375669 - RNA, 18 nt, Bordetella pertussis
gcaaccgccacgugcugc

SEQ ID NO: 375670 - RNA, 19 nt, Bordetella pertussis
gcaaccggaacaccagcaa

SEQ ID NO: 375671 - RNA, 19 nt, Bordetella pertussis
gcaaccggucggccggcag

SEQ ID NO: 375672 - RNA, 17 nt, Bordetella pertussis
gcaaccgucgaccggcc

SEQ ID NO: 375673 - RNA, 13 nt, Bordetella pertussis
gcaaccgucgcca

SEQ ID NO: 375674 - RNA, 16 nt, Bordetella pertussis
gcaaccgucgccagcg

SEQ ID NO: 375675 - RNA, 24 nt, Bordetella pertussis
gcaaccucgccgcgccagcugcgc

SEQ ID NO: 375676 - RNA, 22 nt, Bordetella pertussis
gcaaccuggucaagggcggcca

SEQ ID NO: 375677 - RNA, 13 nt, Bordetella pertussis
gcaacgccagcag

SEQ ID NO: 375678 - RNA, 16 nt, Bordetella pertussis
gcaacgccagcaggcg

SEQ ID NO: 375679 - RNA, 22 nt, Bordetella pertussis
gcaacgccagcaggcgaaacgc

SEQ ID NO: 375680 - RNA, 17 nt, Bordetella pertussis
gcaacgccgccaccagg

SEQ ID NO: 375681 - RNA, 18 nt, Bordetella pertussis
gcaacgccgcccguccgg

SEQ ID NO: 375682 - RNA, 20 nt, Bordetella pertussis
gcaacgccgcccguccgggc

SEQ ID NO: 375683 - RNA, 15 nt, Bordetella pertussis
gcaacgccgccggca

SEQ ID NO: 375684 - RNA, 22 nt, Bordetella pertussis
gcaacgccgccggcagggccag

SEQ ID NO: 375685 - RNA, 17 nt, Bordetella pertussis
gcaacgccggccgccau

SEQ ID NO: 375686 - RNA, 17 nt, Bordetella pertussis
gcaacgccgggccgcgc

SEQ ID NO: 375687 - RNA, 20 nt, Bordetella pertussis
gcaacgccgggccgcgccgc

SEQ ID NO: 375688 - RNA, 15 nt, Bordetella pertussis
gcaacgcgccgcugu

SEQ ID NO: 375689 - RNA, 13 nt, Bordetella pertussis
gcaacgggccggc

SEQ ID NO: 375690 - RNA, 21 nt, Bordetella pertussis
gcaacgggccggccgccggcg

SEQ ID NO: 375691 - RNA, 14 nt, Bordetella pertussis
gcaacgggucgcgc

SEQ ID NO: 375692 - RNA, 17 nt, Bordetella pertussis
gcaacgggucgcgcagc

SEQ ID NO: 375693 - RNA, 15 nt, Bordetella pertussis
gcaacgugcaggcca

SEQ ID NO: 375694 - RNA, 23 nt, Bordetella pertussis
gcaacuccacgcccugcaccguc

SEQ ID NO: 375695 - RNA, 14 nt, Bordetella pertussis
gcaacuccagcaua

SEQ ID NO: 375696 - RNA, 14 nt, Bordetella pertussis
gcaagacgcccagg

SEQ ID NO: 375697 - RNA, 16 nt, Bordetella pertussis
gcaagacgcccaggcc

SEQ ID NO: 375698 - RNA, 18 nt, Bordetella pertussis
gcaagacgcccaggccca

SEQ ID NO: 375699 - RNA, 17 nt, Bordetella pertussis
gcaagacgcggcagggc

SEQ ID NO: 375700 - RNA, 15 nt, Bordetella pertussis
gcaagaucgccggcu

SEQ ID NO: 375701 - RNA, 14 nt, Bordetella pertussis
gcaagaugccggcc

SEQ ID NO: 375702 - RNA, 15 nt, Bordetella pertussis
gcaagcaccgccugc

SEQ ID NO: 375703 - RNA, 16 nt, Bordetella pertussis
gcaagcaagccccagg

SEQ ID NO: 375704 - RNA, 18 nt, Bordetella pertussis
gcaagcagggaugccggu

SEQ ID NO: 375705 - RNA, 14 nt, Bordetella pertussis
gcaagcagccggaa

SEQ ID NO: 375706 - RNA, 17 nt, Bordetella pertussis
gcaagcagcgagagcgc

SEQ ID NO: 375707 - RNA, 13 nt, Bordetella pertussis
gcaagccagggca

SEQ ID NO: 375708 - RNA, 18 nt, Bordetella pertussis
gcaagcccaccgggccgg

SEQ ID NO: 375709 - RNA, 21 nt, Bordetella pertussis
gcaagcccaccgggccggccu

SEQ ID NO: 375710 - RNA, 13 nt, Bordetella pertussis
gcaagcccaggcg

SEQ ID NO: 375711 - RNA, 15 nt, Bordetella pertussis
gcaagccccaggcag

SEQ ID NO: 375712 - RNA, 15 nt, Bordetella pertussis
gcaagccggccgcgc

SEQ ID NO: 375713 - RNA, 19 nt, Bordetella pertussis
gcaagccggccgcgcggcc

SEQ ID NO: 375714 - RNA, 22 nt, Bordetella pertussis
gcaagccggcggucccgagcgc

SEQ ID NO: 375715 - RNA, 13 nt, Bordetella pertussis
gcaagccuugcgg

SEQ ID NO: 375716 - RNA, 14 nt, Bordetella pertussis
gcaagcgcgccgac

SEQ ID NO: 375717 - RNA, 15 nt, Bordetella pertussis
gcaagcgcgccgaca

SEQ ID NO: 375718 - RNA, 17 nt, Bordetella pertussis
gcaagcgcucgccggcg

SEQ ID NO: 375719 - RNA, 15 nt, Bordetella pertussis
gcaagcgcucggcca

SEQ ID NO: 375720 - RNA, 15 nt, Bordetella pertussis
gcaagcgcuggaugg

SEQ ID NO: 375721 - RNA, 13 nt, Bordetella pertussis
gcaagcggccggc

SEQ ID NO: 375722 - RNA, 17 nt, Bordetella pertussis
gcaagcugcuggcgcgc

SEQ ID NO: 375723 - RNA, 23 nt, Bordetella pertussis
gcaaggacgcguccucggccagc

SEQ ID NO: 375724 - RNA, 21 nt, Bordetella pertussis
gcaaggcccgccgcggcaggc

SEQ ID NO: 375725 - RNA, 16 nt, Bordetella pertussis
gcaaggccgcgaacgc

SEQ ID NO: 375726 - RNA, 20 nt, Bordetella pertussis
gcaaggccgcgaacgcgccg

SEQ ID NO: 375727 - RNA, 21 nt, Bordetella pertussis
gcaaggccggcggcacgcugc

SEQ ID NO: 375728 - RNA, 18 nt, Bordetella pertussis
gcaaggcggcaaacccgg

SEQ ID NO: 375729 - RNA, 14 nt, Bordetella pertussis
gcaaggcggcccgg

SEQ ID NO: 375730 - RNA, 16 nt, Bordetella pertussis
gcaaggcggcccggcc

SEQ ID NO: 375731 - RNA, 22 nt, Bordetella pertussis
gcaaggcgggcuggucgcgccg

SEQ ID NO: 375732 - RNA, 20 nt, Bordetella pertussis
gcaaggcgucggccaggccg

SEQ ID NO: 375733 - RNA, 22 nt, Bordetella pertussis
gcaaggcgucgggcacguccgg

SEQ ID NO: 375734 - RNA, 22 nt, Bordetella pertussis
gcaagggccccccggcgcggcc

SEQ ID NO: 375735 - RNA, 23 nt, Bordetella pertussis
gcaagggccccccggcgcggccg

SEQ ID NO: 375736 - RNA, 14 nt, Bordetella pertussis
gcaaggggccagcc

SEQ ID NO: 375737 - RNA, 19 nt, Bordetella pertussis
gcaaggggccagccuggcg

SEQ ID NO: 375738 - RNA, 22 nt, Bordetella pertussis
gcaagggggacuggcaccggca

SEQ ID NO: 375739 - RNA, 19 nt, Bordetella pertussis
gcaagguccaggcgcgcaa

SEQ ID NO: 375740 - RNA, 17 nt, Bordetella pertussis
gcaagucagcccgcguc

SEQ ID NO: 375741 - RNA, 15 nt, Bordetella pertussis
gcaaguguggcgcac

SEQ ID NO: 375742 - RNA, 16 nt, Bordetella pertussis
gcaaguguggcgcacc

SEQ ID NO: 375743 - RNA, 17 nt, Bordetella pertussis
gcaaguguggcgcaccg

SEQ ID NO: 375744 - RNA, 19 nt, Bordetella pertussis
gcaaguucaucaucgccga

SEQ ID NO: 375745 - RNA, 19 nt, Bordetella pertussis
gcaaucuugccgccgggca

SEQ ID NO: 375746 - RNA, 17 nt, Bordetella pertussis
gcaaugacgacgccggc

SEQ ID NO: 375747 - RNA, 21 nt, Bordetella pertussis
gcaauucgaccggcagggugc

SEQ ID NO: 375748 - RNA, 23 nt, Bordetella pertussis
gcacaagcgcguggccggcgacg

SEQ ID NO: 375749 - RNA, 15 nt, Bordetella pertussis
gcacaaucugcgucg

SEQ ID NO: 375750 - RNA, 20 nt, Bordetella pertussis
gcacaaucugcgucgccugg

SEQ ID NO: 375751 - RNA, 15 nt, Bordetella pertussis
gcacacaccgcguca

SEQ ID NO: 375752 - RNA, 16 nt, Bordetella pertussis
gcacacaccgcgucau

SEQ ID NO: 375753 - RNA, 15 nt, Bordetella pertussis
gcacaccagcgccag

SEQ ID NO: 375754 - RNA, 16 nt, Bordetella pertussis
gcacaccaucagcugg

SEQ ID NO: 375755 - RNA, 13 nt, Bordetella pertussis
gcacaccggucua

SEQ ID NO: 375756 - RNA, 20 nt, Bordetella pertussis
gcacccgguauccgcgcaug

SEQ ID NO: 375757 - RNA, 20 nt, Bordetella pertussis
gcacccgucccugguccagc

SEQ ID NO: 375758 - RNA, 16 nt, Bordetella pertussis
gcacccugcaggccgg

SEQ ID NO: 375759 - RNA, 17 nt, Bordetella pertussis
gcacccugcaggccggg

SEQ ID NO: 375760 - RNA, 18 nt, Bordetella pertussis
gcacccugcaggccgggc

SEQ ID NO: 375761 - RNA, 14 nt, Bordetella pertussis
gcaccgaggugccg

SEQ ID NO: 375762 - RNA, 17 nt, Bordetella pertussis
gcaccgaggugccggcg

SEQ ID NO: 375763 - RNA, 22 nt, Bordetella pertussis
gcaccgaggugccggcggugau

SEQ ID NO: 375764 - RNA, 18 nt, Bordetella pertussis
gcaccgaugcgccggccu

SEQ ID NO: 375765 - RNA, 22 nt, Bordetella pertussis
gcaccgaugcgccggccuggcg

SEQ ID NO: 375766 - RNA, 20 nt, Bordetella pertussis
gcaccgcaugggccaggcgc

SEQ ID NO: 375767 - RNA, 12 nt, Bordetella pertussis
gcaccgccaccg

SEQ ID NO: 375768 - RNA, 18 nt, Bordetella pertussis
gcaccgccaccguggcgu

SEQ ID NO: 375769 - RNA, 15 nt, Bordetella pertussis
gcaccgccgcgcggu

SEQ ID NO: 375770 - RNA, 21 nt, Bordetella pertussis
gcaccgccgcgcggugcucgg

SEQ ID NO: 375771 - RNA, 13 nt, Bordetella pertussis
gcaccgccgcguc

SEQ ID NO: 375772 - RNA, 24 nt, Bordetella pertussis
gcaccgccgcguccucggccuggc

SEQ ID NO: 375773 - RNA, 15 nt, Bordetella pertussis
gcaccgccgcguugc

SEQ ID NO: 375774 - RNA, 21 nt, Bordetella pertussis
gcaccgccgcguugcgcgacu

SEQ ID NO: 375775 - RNA, 16 nt, Bordetella pertussis
gcaccgcgaccaugcg

SEQ ID NO: 375776 - RNA, 14 nt, Bordetella pertussis
gcaccgcgacgacc

SEQ ID NO: 375777 - RNA, 18 nt, Bordetella pertussis
gcaccgcgccagcgccgg

SEQ ID NO: 375778 - RNA, 19 nt, Bordetella pertussis
gcaccgcgccagcgccggc

SEQ ID NO: 375779 - RNA, 16 nt, Bordetella pertussis
gcaccgcgcagcccgg

SEQ ID NO: 375780 - RNA, 13 nt, Bordetella pertussis
gcaccgcgcuggg

SEQ ID NO: 375781 - RNA, 12 nt, Bordetella pertussis
gcaccgcgcgca

SEQ ID NO: 375782 - RNA, 21 nt, Bordetella pertussis
gcaccgcuucuucgucgcgcc

SEQ ID NO: 375783 - RNA, 18 nt, Bordetella pertussis
gcaccggaggcgccgcgg

SEQ ID NO: 375784 - RNA, 20 nt, Bordetella pertussis
gcaccggcacgacggccucc

SEQ ID NO: 375785 - RNA, 19 nt, Bordetella pertussis
gcaccggcacgcgccagcu

SEQ ID NO: 375786 - RNA, 20 nt, Bordetella pertussis
gcaccggcacgcgccagcug

SEQ ID NO: 375787 - RNA, 15 nt, Bordetella pertussis
gcaccggcagccauc

SEQ ID NO: 375788 - RNA, 18 nt, Bordetella pertussis
gcaccggcagccauccca

SEQ ID NO: 375789 - RNA, 14 nt, Bordetella pertussis
gcaccggcagcgua

SEQ ID NO: 375790 - RNA, 20 nt, Bordetella pertussis
gcaccggcagcguaucgccc

SEQ ID NO: 375791 - RNA, 17 nt, Bordetella pertussis
gcaccggccgacccgcg

SEQ ID NO: 375792 - RNA, 15 nt, Bordetella pertussis
gcaccggccgccgca

SEQ ID NO: 375793 - RNA, 12 nt, Bordetella pertussis
gcaccggccagu

SEQ ID NO: 375794 - RNA, 15 nt, Bordetella pertussis
gcaccgugaugcgcg

SEQ ID NO: 375795 - RNA, 18 nt, Bordetella pertussis
gcaccgugaugcgcgccg

SEQ ID NO: 375796 - RNA, 19 nt, Bordetella pertussis
gcaccgugaugcgcgccgc

SEQ ID NO: 375797 - RNA, 20 nt, Bordetella pertussis
gcaccgugaugucgccgucg

SEQ ID NO: 375798 - RNA, 20 nt, Bordetella pertussis
gcaccucacggugaccgggu

SEQ ID NO: 375799 - RNA, 16 nt, Bordetella pertussis
gcaccucgacgcagcc

SEQ ID NO: 375800 - RNA, 21 nt, Bordetella pertussis
gcaccucggacgagacaggcg

SEQ ID NO: 375801 - RNA, 22 nt, Bordetella pertussis
gcaccucggacgagacaggcgc

SEQ ID NO: 375802 - RNA, 20 nt, Bordetella pertussis
gcaccugcaggccgccggcc

SEQ ID NO: 375803 - RNA, 14 nt, Bordetella pertussis
gcaccugcaggguc

SEQ ID NO: 375804 - RNA, 21 nt, Bordetella pertussis
gcaccugcagggucagcccgc

SEQ ID NO: 375805 - RNA, 23 nt, Bordetella pertussis
gcaccugcagggucagcccgcca

SEQ ID NO: 375806 - RNA, 13 nt, Bordetella pertussis
gcaccugccgacu

SEQ ID NO: 375807 - RNA, 22 nt, Bordetella pertussis
gcaccugccugccgccugccag

SEQ ID NO: 375808 - RNA, 15 nt, Bordetella pertussis
gcaccugcguggccu

SEQ ID NO: 375809 - RNA, 15 nt, Bordetella pertussis
gcaccugcuccagcg

SEQ ID NO: 375810 - RNA, 15 nt, Bordetella pertussis
gcaccugcugcggca

SEQ ID NO: 375811 - RNA, 18 nt, Bordetella pertussis
gcaccugcugcggcacgg

SEQ ID NO: 375812 - RNA, 20 nt, Bordetella pertussis
gcaccugcugcggcacggcc

SEQ ID NO: 375813 - RNA, 23 nt, Bordetella pertussis
gcaccugcugcuugaccuuggcu

SEQ ID NO: 375814 - RNA, 15 nt, Bordetella pertussis
gcaccugcuugagca

SEQ ID NO: 375815 - RNA, 15 nt, Bordetella pertussis
gcaccuuggcccggc

SEQ ID NO: 375816 - RNA, 15 nt, Bordetella pertussis
gcaccuugggcgccu

SEQ ID NO: 375817 - RNA, 17 nt, Bordetella pertussis
gcaccuugggcgccugc

SEQ ID NO: 375818 - RNA, 21 nt, Bordetella pertussis
gcaccuuguacuggucgcgca

SEQ ID NO: 375819 - RNA, 19 nt, Bordetella pertussis
gcaccuugucgcgcagcgc

SEQ ID NO: 375820 - RNA, 20 nt, Bordetella pertussis
gcaccuugucgcgcagcgcc

SEQ ID NO: 375821 - RNA, 18 nt, Bordetella pertussis
gcaccuuucugcugcucg

SEQ ID NO: 375822 - RNA, 18 nt, Bordetella pertussis
gcaccuuuuuccuugcgg

SEQ ID NO: 375823 - RNA, 20 nt, Bordetella pertussis
gcacgaaaagccgcggccgc

SEQ ID NO: 375824 - RNA, 20 nt, Bordetella pertussis
gcacgaagccgaugcgccgc

SEQ ID NO: 375825 - RNA, 23 nt, Bordetella pertussis
gcacgaagccgaugcgccgcgcu

SEQ ID NO: 375826 - RNA, 16 nt, Bordetella pertussis
gcacgaagcggcaucg

SEQ ID NO: 375827 - RNA, 20 nt, Bordetella pertussis
gcacgaaguacucgccggcg

SEQ ID NO: 375828 - RNA, 22 nt, Bordetella pertussis
gcacgaaguacucgccggcgcu

SEQ ID NO: 375829 - RNA, 13 nt, Bordetella pertussis
gcacgaccaggcc

SEQ ID NO: 375830 - RNA, 14 nt, Bordetella pertussis
gcacgaccaggccg

SEQ ID NO: 375831 - RNA, 15 nt, Bordetella pertussis
gcacgaccaggccgu

SEQ ID NO: 375832 - RNA, 18 nt, Bordetella pertussis
gcacgaccaggccguggc

SEQ ID NO: 375833 - RNA, 20 nt, Bordetella pertussis
gcacgaccaggccguggccc

SEQ ID NO: 375834 - RNA, 22 nt, Bordetella pertussis
gcacgaccaggccguggcccag

SEQ ID NO: 375835 - RNA, 14 nt, Bordetella pertussis
gcacgaccugcgca

SEQ ID NO: 375836 - RNA, 16 nt, Bordetella pertussis
gcacgacgacggccgg

SEQ ID NO: 375837 - RNA, 17 nt, Bordetella pertussis
gcacgacgacggccggc

SEQ ID NO: 375838 - RNA, 15 nt, Bordetella pertussis
gcacgacgaucggcc

SEQ ID NO: 375839 - RNA, 18 nt, Bordetella pertussis
gcacgacgaagaacacca

SEQ ID NO: 375840 - RNA, 16 nt, Bordetella pertussis
gcacgcccagccgcag

SEQ ID NO: 375841 - RNA, 22 nt, Bordetella pertussis
gcacgcccagccgcagcaggcg

SEQ ID NO: 375842 - RNA, 23 nt, Bordetella pertussis
gcacgcccauggucaggacgacg

SEQ ID NO: 375843 - RNA, 17 nt, Bordetella pertussis
gcacgcccgacgguauc

SEQ ID NO: 375844 - RNA, 13 nt, Bordetella pertussis
gcacgcccgccag

SEQ ID NO: 375845 - RNA, 14 nt, Bordetella pertussis
gcacgcccgccugc

SEQ ID NO: 375846 - RNA, 18 nt, Bordetella pertussis
gcacgcccgcggcgccca

SEQ ID NO: 375847 - RNA, 18 nt, Bordetella pertussis
gcacgccugccgcgcccg

SEQ ID NO: 375848 - RNA, 20 nt, Bordetella pertussis
gcacgccugccgcgcccggc

SEQ ID NO: 375849 - RNA, 21 nt, Bordetella pertussis
gcacgccugccgcgcccggcg

SEQ ID NO: 375850 - RNA, 15 nt, Bordetella pertussis
gcacgccucgccggc

SEQ ID NO: 375851 - RNA, 17 nt, Bordetella pertussis
gcacgccuucgagcugc

SEQ ID NO: 375852 - RNA, 14 nt, Bordetella pertussis
gcacgcgcaccagg

SEQ ID NO: 375853 - RNA, 15 nt, Bordetella pertussis
gcacgcgcaccaggc

SEQ ID NO: 375854 - RNA, 17 nt, Bordetella pertussis
gcacgcgcaccaggccu

SEQ ID NO: 375855 - RNA, 18 nt, Bordetella pertussis
gcacgcgcaccaggccug

SEQ ID NO: 375856 - RNA, 19 nt, Bordetella pertussis
gcacgcgcaccaggccugc

SEQ ID NO: 375857 - RNA, 18 nt, Bordetella pertussis
gcacgcgcagcacgcugc

SEQ ID NO: 375858 - RNA, 20 nt, Bordetella pertussis
gcacgcgcagcacgcugcgc

SEQ ID NO: 375859 - RNA, 18 nt, Bordetella pertussis
gcacgcgcagcuugcccg

SEQ ID NO: 375860 - RNA, 14 nt, Bordetella pertussis
gcacgcgcgccagc

SEQ ID NO: 375861 - RNA, 15 nt, Bordetella pertussis
gcacgcgcgccagcu

SEQ ID NO: 375862 - RNA, 18 nt, Bordetella pertussis
gcacgcgcgccagcuggg

SEQ ID NO: 375863 - RNA, 13 nt, Bordetella pertussis
gcacgcgccaggc

SEQ ID NO: 375864 - RNA, 14 nt, Bordetella pertussis
gcacgcgccaggcg

SEQ ID NO: 375865 - RNA, 17 nt, Bordetella pertussis
gcacgcucuacacggcc

SEQ ID NO: 375866 - RNA, 18 nt, Bordetella pertussis
gcacgcucuacacggccg

SEQ ID NO: 375867 - RNA, 19 nt, Bordetella pertussis
gcacgcucuacacggccgc

SEQ ID NO: 375868 - RNA, 14 nt, Bordetella pertussis
gcacgcucuugagc

SEQ ID NO: 375869 - RNA, 21 nt, Bordetella pertussis
gcacgcucuugagcgcggccu

SEQ ID NO: 375870 - RNA, 20 nt, Bordetella pertussis
gcacgcugaccgaagcgggc

SEQ ID NO: 375871 - RNA, 13 nt, Bordetella pertussis
gcacgcugaucgc

SEQ ID NO: 375872 - RNA, 19 nt, Bordetella pertussis
gcacgcugaucgccggcgc

SEQ ID NO: 375873 - RNA, 21 nt, Bordetella pertussis
gcacgcugaucgccggcgccc

SEQ ID NO: 375874 - RNA, 19 nt, Bordetella pertussis
gcacgcugcgcaggcgcgc

SEQ ID NO: 375875 - RNA, 18 nt, Bordetella pertussis
gcacggcaauguccgggg

SEQ ID NO: 375876 - RNA, 12 nt, Bordetella pertussis
gcacggccacga

SEQ ID NO: 375877 - RNA, 15 nt, Bordetella pertussis
gcacggccacggccg

SEQ ID NO: 375878 - RNA, 17 nt, Bordetella pertussis
gcacggccacggccggc

SEQ ID NO: 375879 - RNA, 12 nt, Bordetella pertussis
gcacggccagcg

SEQ ID NO: 375880 - RNA, 13 nt, Bordetella pertussis
gcacggccggcca

SEQ ID NO: 375881 - RNA, 15 nt, Bordetella pertussis
gcacggccggccagg

SEQ ID NO: 375882 - RNA, 16 nt, Bordetella pertussis
gcacggccggccaggc

SEQ ID NO: 375883 - RNA, 21 nt, Bordetella pertussis
gcacggccgucaacagcaugg

SEQ ID NO: 375884 - RNA, 19 nt, Bordetella pertussis
gcacggccuugucgcgccc

SEQ ID NO: 375885 - RNA, 17 nt, Bordetella pertussis
gcacggcgaugcugccg

SEQ ID NO: 375886 - RNA, 14 nt, Bordetella pertussis
gcacggcgcacacc

SEQ ID NO: 375887 - RNA, 19 nt, Bordetella pertussis
gcacggcgcacaccaucag

SEQ ID NO: 375888 - RNA, 21 nt, Bordetella pertussis
gcacggcgcacaccaucagcu

SEQ ID NO: 375889 - RNA, 12 nt, Bordetella pertussis
gcacggcgcccu

SEQ ID NO: 375890 - RNA, 14 nt, Bordetella pertussis
gcacggcgcccugc

SEQ ID NO: 375891 - RNA, 16 nt, Bordetella pertussis
gcacggcgcccugcgc

SEQ ID NO: 375892 - RNA, 19 nt, Bordetella pertussis
gcacgggcgcugcccagga

SEQ ID NO: 375893 - RNA, 21 nt, Bordetella pertussis
gcacggggacuggcaccggcc

SEQ ID NO: 375894 - RNA, 22 nt, Bordetella pertussis
gcacggggacuggcacgcgcug

SEQ ID NO: 375895 - RNA, 16 nt, Bordetella pertussis
gcacgguacgccgaac

SEQ ID NO: 375896 - RNA, 15 nt, Bordetella pertussis
gcacgguccaggcgg

SEQ ID NO: 375897 - RNA, 21 nt, Bordetella pertussis
gcacgguccaggcggccgcgg

SEQ ID NO: 375898 - RNA, 14 nt, Bordetella pertussis
gcacggucggcgcg

SEQ ID NO: 375899 - RNA, 16 nt, Bordetella pertussis
gcacgugaugcaggcg

SEQ ID NO: 375900 - RNA, 17 nt, Bordetella pertussis
gcacgugaugcaggcgg

SEQ ID NO: 375901 - RNA, 18 nt, Bordetella pertussis
gcacgugaugcaggcggu

SEQ ID NO: 375902 - RNA, 17 nt, Bordetella pertussis
gcacgugccggauggcg

SEQ ID NO: 375903 - RNA, 22 nt, Bordetella pertussis
gcacgugccggauggcgcggau

SEQ ID NO: 375904 - RNA, 21 nt, Bordetella pertussis
gcacguggaugaugcgcgagc

SEQ ID NO: 375905 - RNA, 19 nt, Bordetella pertussis
gcacgugggcacgccggcc

SEQ ID NO: 375906 - RNA, 21 nt, Bordetella pertussis
gcacguggucgugcaggaccu

SEQ ID NO: 375907 - RNA, 20 nt, Bordetella pertussis
gcacguugucgagcaggccg

SEQ ID NO: 375908 - RNA, 22 nt, Bordetella pertussis
gcacuaccugcgcuaugggggc

SEQ ID NO: 375909 - RNA, 16 nt, Bordetella pertussis
gcacucuugccgcugc

SEQ ID NO: 375910 - RNA, 14 nt, Bordetella pertussis
gcacugaucgccgc

SEQ ID NO: 375911 - RNA, 23 nt, Bordetella pertussis
gcacugaucuuucagcgcgacga

SEQ ID NO: 375912 - RNA, 14 nt, Bordetella pertussis
gcacugcaggccau

SEQ ID NO: 375913 - RNA, 15 nt, Bordetella pertussis
gcacugcaggccauc

SEQ ID NO: 375914 - RNA, 15 nt, Bordetella pertussis
gcacuggcgcggcgc

SEQ ID NO: 375915 - RNA, 17 nt, Bordetella pertussis
gcacuggguggccagcg

SEQ ID NO: 375916 - RNA, 22 nt, Bordetella pertussis
gcacugucggcguuccuggcgc

SEQ ID NO: 375917 - RNA, 15 nt, Bordetella pertussis
gcacuugcgaacggc

SEQ ID NO: 375918 - RNA, 17 nt, Bordetella pertussis
gcacuugcgaacggccg

SEQ ID NO: 375919 - RNA, 21 nt, Bordetella pertussis
gcacuugcgaacggccgcccg

SEQ ID NO: 375920 - RNA, 14 nt, Bordetella pertussis
gcacuuguggaccg

SEQ ID NO: 375921 - RNA, 16 nt, Bordetella pertussis
gcagaaauggaugcgc

SEQ ID NO: 375922 - RNA, 15 nt, Bordetella pertussis
gcagaacagcagcgu

SEQ ID NO: 375923 - RNA, 16 nt, Bordetella pertussis
gcagaacagcagcgug

SEQ ID NO: 375924 - RNA, 18 nt, Bordetella pertussis
gcagaacagcggaucgcc

SEQ ID NO: 375925 - RNA, 15 nt, Bordetella pertussis
gcagaacagggugcc

SEQ ID NO: 375926 - RNA, 20 nt, Bordetella pertussis
gcagaacagggugccgcccu

SEQ ID NO: 375927 - RNA, 19 nt, Bordetella pertussis
gcagaacggaaacgcccag

SEQ ID NO: 375928 - RNA, 21 nt, Bordetella pertussis
gcagaacggaaacgcccagcc

SEQ ID NO: 375929 - RNA, 22 nt, Bordetella pertussis
gcagaagcagccgcgcggccgg

SEQ ID NO: 375930 - RNA, 15 nt, Bordetella pertussis
gcagaaggucugggc

SEQ ID NO: 375931 - RNA, 16 nt, Bordetella pertussis
gcagaaguggucgcgc

SEQ ID NO: 375932 - RNA, 23 nt, Bordetella pertussis
gcagaaugccgcccacgaucacc

SEQ ID NO: 375933 - RNA, 19 nt, Bordetella pertussis
gcagaauguauuggcccag

SEQ ID NO: 375934 - RNA, 14 nt, Bordetella pertussis
gcagaccacgccgg

SEQ ID NO: 375935 - RNA, 16 nt, Bordetella pertussis
gcagaccagcaccggc

SEQ ID NO: 375936 - RNA, 17 nt, Bordetella pertussis
gcagaccagcaccggca

SEQ ID NO: 375937 - RNA, 18 nt, Bordetella pertussis
gcagacccuggcgcgcgu

SEQ ID NO: 375938 - RNA, 13 nt, Bordetella pertussis
gcagaccgagcgc

SEQ ID NO: 375939 - RNA, 16 nt, Bordetella pertussis
gcagaccuaccaggcc

SEQ ID NO: 375940 - RNA, 20 nt, Bordetella pertussis
gcagacgaucauccaggccg

SEQ ID NO: 375941 - RNA, 21 nt, Bordetella pertussis
gcagacgaucauccaggccgu

SEQ ID NO: 375942 - RNA, 18 nt, Bordetella pertussis
gcagacgaugcccaggcc

SEQ ID NO: 375943 - RNA, 20 nt, Bordetella pertussis
gcagacgccaucuugcaggc

SEQ ID NO: 375944 - RNA, 22 nt, Bordetella pertussis
gcagacgccaucuugcaggcgc

SEQ ID NO: 375945 - RNA, 15 nt, Bordetella pertussis
gcagacggcggcugg

SEQ ID NO: 375946 - RNA, 16 nt, Bordetella pertussis
gcagagcaccacggcg

SEQ ID NO: 375947 - RNA, 18 nt, Bordetella pertussis
gcagaugcgcgccaggcg

SEQ ID NO: 375948 - RNA, 15 nt, Bordetella pertussis
gcagauggccagcag

SEQ ID NO: 375949 - RNA, 18 nt, Bordetella pertussis
gcagauggccagcagcgc

SEQ ID NO: 375950 - RNA, 19 nt, Bordetella pertussis
gcagauggcccuugcccag

SEQ ID NO: 375951 - RNA, 14 nt, Bordetella pertussis
gcagauggcggcga

SEQ ID NO: 375952 - RNA, 17 nt, Bordetella pertussis
gcagauggugcuccgac

SEQ ID NO: 375953 - RNA, 23 nt, Bordetella pertussis
gcagauugaugcccaugcgcugc

SEQ ID NO: 375954 - RNA, 12 nt, Bordetella pertussis
gcagauugccgc

SEQ ID NO: 375955 - RNA, 17 nt, Bordetella pertussis
gcagauugccgcgcggc

SEQ ID NO: 375956 - RNA, 18 nt, Bordetella pertussis
gcagcaaccggaacacca

SEQ ID NO: 375957 - RNA, 19 nt, Bordetella pertussis
gcagcaaccggaacaccag

SEQ ID NO: 375958 - RNA, 21 nt, Bordetella pertussis
gcagcaaccggaacaccagca

SEQ ID NO: 375959 - RNA, 16 nt, Bordetella pertussis
gcagcaacccgcccgg

SEQ ID NO: 375960 - RNA, 13 nt, Bordetella pertussis
gcagcaacgccgg

SEQ ID NO: 375961 - RNA, 15 nt, Bordetella pertussis
gcagcaacgccggcg

SEQ ID NO: 375962 - RNA, 13 nt, Bordetella pertussis
gcagcaacgcggc

SEQ ID NO: 375963 - RNA, 23 nt, Bordetella pertussis
gcagcaacggugagccggccacc

SEQ ID NO: 375964 - RNA, 19 nt, Bordetella pertussis
gcagcaccucggcguggcg

SEQ ID NO: 375965 - RNA, 22 nt, Bordetella pertussis
gcagcaccucggcguggcgggg

SEQ ID NO: 375966 - RNA, 19 nt, Bordetella pertussis
gcagcaccuugaccugguc

SEQ ID NO: 375967 - RNA, 16 nt, Bordetella pertussis
gcagcacgaucgcggc

SEQ ID NO: 375968 - RNA, 19 nt, Bordetella pertussis
gcagcacgaucgcggcgcu

SEQ ID NO: 375969 - RNA, 13 nt, Bordetella pertussis
gcagcacgauggc

SEQ ID NO: 375970 - RNA, 15 nt, Bordetella pertussis
gcagcacgauggggc

SEQ ID NO: 375971 - RNA, 14 nt, Bordetella pertussis
gcagcacgcaccag

SEQ ID NO: 375972 - RNA, 18 nt, Bordetella pertussis
gcagcacgcaccaggcgc

SEQ ID NO: 375973 - RNA, 12 nt, Bordetella pertussis
gcagcacgccca

SEQ ID NO: 375974 - RNA, 19 nt, Bordetella pertussis
gcagcacgcccagauggcc

SEQ ID NO: 375975 - RNA, 13 nt, Bordetella pertussis
gcagcacgccgau

SEQ ID NO: 375976 - RNA, 13 nt, Bordetella pertussis
gcagcacgcgcac

SEQ ID NO: 375977 - RNA, 15 nt, Bordetella pertussis
gcagcacgcugcgcg

SEQ ID NO: 375978 - RNA, 18 nt, Bordetella pertussis
gcagcacgcugcgcggcg

SEQ ID NO: 375979 - RNA, 14 nt, Bordetella pertussis
gcagcacgcuggcc

SEQ ID NO: 375980 - RNA, 14 nt, Bordetella pertussis
gcagcacgcccaga

SEQ ID NO: 375981 - RNA, 19 nt, Bordetella pertussis
gcagcacggcuugcgcgcc

SEQ ID NO: 375982 - RNA, 13 nt, Bordetella pertussis
gcagcagcacgcc

SEQ ID NO: 375983 - RNA, 14 nt, Bordetella pertussis
gcagcagcacggcc

SEQ ID NO: 375984 - RNA, 15 nt, Bordetella pertussis
gcagcagcgcaucga

SEQ ID NO: 375985 - RNA, 21 nt, Bordetella pertussis
gcagcagcgccggcaggcgcg

SEQ ID NO: 375986 - RNA, 13 nt, Bordetella pertussis
gcagcagcgcgcc

SEQ ID NO: 375987 - RNA, 14 nt, Bordetella pertussis
gcagcagcgcgccg

SEQ ID NO: 375988 - RNA, 16 nt, Bordetella pertussis
gcagcagcuugccgac

SEQ ID NO: 375989 - RNA, 12 nt, Bordetella pertussis
gcagcaggccca

SEQ ID NO: 375990 - RNA, 13 nt, Bordetella pertussis
gcagcaggcccau

SEQ ID NO: 375991 - RNA, 21 nt, Bordetella pertussis
gcagcaggcccuccggcgcca

SEQ ID NO: 375992 - RNA, 16 nt, Bordetella pertussis
gcagccauucggccac

SEQ ID NO: 375993 - RNA, 17 nt, Bordetella pertussis
gcagccauucggccacu

SEQ ID NO: 375994 - RNA, 17 nt, Bordetella pertussis
gcagccauucggccagg

SEQ ID NO: 375995 - RNA, 14 nt, Bordetella pertussis
gcagcccacucagg

SEQ ID NO: 375996 - RNA, 17 nt, Bordetella pertussis
gcagcccagcaccacgg

SEQ ID NO: 375997 - RNA, 14 nt, Bordetella pertussis
gcagcccagcacga

SEQ ID NO: 375998 - RNA, 15 nt, Bordetella pertussis
gcagcccagcgcgau

SEQ ID NO: 375999 - RNA, 14 nt, Bordetella pertussis
gcagccccagcgcc

SEQ ID NO: 376000 - RNA, 17 nt, Bordetella pertussis
gcagccccagcgcccag

SEQ ID NO: 376001 - RNA, 20 nt, Bordetella pertussis
gcagccccagcgcccaggcg

SEQ ID NO: 376002 - RNA, 21 nt, Bordetella pertussis
gcagccccagcgcccaggcga

SEQ ID NO: 376003 - RNA, 20 nt, Bordetella pertussis
gcagccccagcguccaggcg

SEQ ID NO: 376004 - RNA, 13 nt, Bordetella pertussis
gcagcccggcacg

SEQ ID NO: 376005 - RNA, 21 nt, Bordetella pertussis
gcagcccggcgugcccagggc

SEQ ID NO: 376006 - RNA, 15 nt, Bordetella pertussis
gcagccgacaggcgc

SEQ ID NO: 376007 - RNA, 22 nt, Bordetella pertussis
gcagccgacaggcgcgcaggcg

SEQ ID NO: 376008 - RNA, 16 nt, Bordetella pertussis
gcagccgcaccagcgc

SEQ ID NO: 376009 - RNA, 17 nt, Bordetella pertussis
gcagccgcaccagcgca

SEQ ID NO: 376010 - RNA, 12 nt, Bordetella pertussis
gcagccgccaua

SEQ ID NO: 376011 - RNA, 14 nt, Bordetella pertussis
gcagccgcgccaag

SEQ ID NO: 376012 - RNA, 14 nt, Bordetella pertussis
gcagccgcgcgccu

SEQ ID NO: 376013 - RNA, 14 nt, Bordetella pertussis
gcagccgcgcggcc

SEQ ID NO: 376014 - RNA, 15 nt, Bordetella pertussis
gcagccgcgcggccg

SEQ ID NO: 376015 - RNA, 18 nt, Bordetella pertussis
gcagccgcgcggccgggc

SEQ ID NO: 376016 - RNA, 15 nt, Bordetella pertussis
gcagccgcuccagcc

SEQ ID NO: 376017 - RNA, 16 nt, Bordetella pertussis
gcagccgcuccagcca

SEQ ID NO: 376018 - RNA, 20 nt, Bordetella pertussis
gcagccgcuccagccaccac

SEQ ID NO: 376019 - RNA, 20 nt, Bordetella pertussis
gcagccggccaaggcaagca

SEQ ID NO: 376020 - RNA, 13 nt, Bordetella pertussis
gcagccggccaug

SEQ ID NO: 376021 - RNA, 12 nt, Bordetella pertussis
gcagccggccgg

SEQ ID NO: 376022 - RNA, 18 nt, Bordetella pertussis
gcagccgggcugccggca

SEQ ID NO: 376023 - RNA, 19 nt, Bordetella pertussis
gcagcgaauacggcaagca

SEQ ID NO: 376024 - RNA, 15 nt, Bordetella pertussis
gcagcgaccgcggcg

SEQ ID NO: 376025 - RNA, 13 nt, Bordetella pertussis
gcagcgcaccgac

SEQ ID NO: 376026 - RNA, 12 nt, Bordetella pertussis
gcagcgcaccac

SEQ ID NO: 376027 - RNA, 14 nt, Bordetella pertussis
gcagcgcagcgcca

SEQ ID NO: 376028 - RNA, 16 nt, Bordetella pertussis
gcagcgcaggaugggc

SEQ ID NO: 376029 - RNA, 14 nt, Bordetella pertussis
gcagcgcaucgagc

SEQ ID NO: 376030 - RNA, 22 nt, Bordetella pertussis
gcagcgcaucgagcuccugcag

SEQ ID NO: 376031 - RNA, 20 nt, Bordetella pertussis
gcagcgcaucgccgcaggcg

SEQ ID NO: 376032 - RNA, 14 nt, Bordetella pertussis
gcagcgccaccggc

SEQ ID NO: 376033 - RNA, 16 nt, Bordetella pertussis
gcagcgccaccggcug

SEQ ID NO: 376034 - RNA, 15 nt, Bordetella pertussis
gcagcgccugccgcg

SEQ ID NO: 376035 - RNA, 21 nt, Bordetella pertussis
gcagcgccugccgcgugcccg

SEQ ID NO: 376036 - RNA, 15 nt, Bordetella pertussis
gcagcgccuggccga

SEQ ID NO: 376037 - RNA, 23 nt, Bordetella pertussis
gcagcgccuggccgagcgcggca

SEQ ID NO: 376038 - RNA, 22 nt, Bordetella pertussis
gcagcgcgaacggcgggcggau

SEQ ID NO: 376039 - RNA, 23 nt, Bordetella pertussis
gcagcgccuugcggcgcuuggcg

SEQ ID NO: 376040 - RNA, 14 nt, Bordetella pertussis
gcagcgcggccggc

SEQ ID NO: 376041 - RNA, 15 nt, Bordetella pertussis
gcagcgcggccggca

SEQ ID NO: 376042 - RNA, 18 nt, Bordetella pertussis
gcagcgcggccggcacca

SEQ ID NO: 376043 - RNA, 15 nt, Bordetella pertussis
gcagcgcggcggcga

SEQ ID NO: 376044 - RNA, 18 nt, Bordetella pertussis
gcagcgcggcggcgaccg

SEQ ID NO: 376045 - RNA, 13 nt, Bordetella pertussis
gcagcgcggucau

SEQ ID NO: 376046 - RNA, 18 nt, Bordetella pertussis
gcagcgcggucaugccga

SEQ ID NO: 376047 - RNA, 21 nt, Bordetella pertussis
gcagcgcggucaugccgaaca

SEQ ID NO: 376048 - RNA, 16 nt, Bordetella pertussis
gcagcgcguccugcca

SEQ ID NO: 376049 - RNA, 17 nt, Bordetella pertussis
gcagcgcguccugccag

SEQ ID NO: 376050 - RNA, 22 nt, Bordetella pertussis
gcagcgcgugcagccagcggcc

SEQ ID NO: 376051 - RNA, 20 nt, Bordetella pertussis
gcagcgcgugugguuggcgc

SEQ ID NO: 376052 - RNA, 23 nt, Bordetella pertussis
gcagcgcgugugguuggcgcugc

SEQ ID NO: 376053 - RNA, 13 nt, Bordetella pertussis
gcagcggcgacgg

SEQ ID NO: 376054 - RNA, 22 nt, Bordetella pertussis
gcagcggcgccaugcgcaccac

SEQ ID NO: 376055 - RNA, 17 nt, Bordetella pertussis
gcagcggcgcgcgcagg

SEQ ID NO: 376056 - RNA, 18 nt, Bordetella pertussis
gcagcggcgcgcgcaggu

SEQ ID NO: 376057 - RNA, 13 nt, Bordetella pertussis
gcagcggcggcac

SEQ ID NO: 376058 - RNA, 19 nt, Bordetella pertussis
gcagcggcggcacgguggc

SEQ ID NO: 376059 - RNA, 15 nt, Bordetella pertussis
gcagcggcggcgcgg

SEQ ID NO: 376060 - RNA, 13 nt, Bordetella pertussis
gcagcggcggcgc

SEQ ID NO: 376061 - RNA, 16 nt, Bordetella pertussis
gcagcggcucgacgcc

SEQ ID NO: 376062 - RNA, 17 nt, Bordetella pertussis
gcagcggcucgagcggc

SEQ ID NO: 376063 - RNA, 21 nt, Bordetella pertussis
gcagcggcucgagcggcagca

SEQ ID NO: 376064 - RNA, 18 nt, Bordetella pertussis
gcagcggcuucaugccgg

SEQ ID NO: 376065 - RNA, 15 nt, Bordetella pertussis
gcagcgggcuggggc

SEQ ID NO: 376066 - RNA, 22 nt, Bordetella pertussis
gcagcgggcuggggcaggcacu

SEQ ID NO: 376067 - RNA, 18 nt, Bordetella pertussis
gcagcgggcccgucgcgc

SEQ ID NO: 376068 - RNA, 17 nt, Bordetella pertussis
gcagcgucgcggcgucg

SEQ ID NO: 376069 - RNA, 20 nt, Bordetella pertussis
gcagcgugaccgacaggccu

SEQ ID NO: 376070 - RNA, 15 nt, Bordetella pertussis
gcagcgugaccggac

SEQ ID NO: 376071 - RNA, 21 nt, Bordetella pertussis
gcagcgugaugccgucgagcg

SEQ ID NO: 376072 - RNA, 15 nt, Bordetella pertussis
gcagcgugauggggc

SEQ ID NO: 376073 - RNA, 16 nt, Bordetella pertussis
gcagcgugauggggcc

SEQ ID NO: 376074 - RNA, 19 nt, Bordetella pertussis
gcagcgugauggggccggg

SEQ ID NO: 376075 - RNA, 20 nt, Bordetella pertussis
gcagcgugauggggccgggc

SEQ ID NO: 376076 - RNA, 13 nt, Bordetella pertussis
gcagcguggccac

SEQ ID NO: 376077 - RNA, 15 nt, Bordetella pertussis
gcagcguggccacca

SEQ ID NO: 376078 - RNA, 16 nt, Bordetella pertussis
gcagcguggccaccag

SEQ ID NO: 376079 - RNA, 21 nt, Bordetella pertussis
gcagcguggccaccaggcgcg

SEQ ID NO: 376080 - RNA, 22 nt, Bordetella pertussis
gcagcguggccaccaggcgcgc

SEQ ID NO: 376081 - RNA, 17 nt, Bordetella pertussis
gcagcguggccgccacc

SEQ ID NO: 376082 - RNA, 21 nt, Bordetella pertussis
gcagcguggccgccaccagcg

SEQ ID NO: 376083 - RNA, 22 nt, Bordetella pertussis
gcagcguggccgccaccagcgc

SEQ ID NO: 376084 - RNA, 23 nt, Bordetella pertussis
gcagcguggccgccaccagcgcg

SEQ ID NO: 376085 - RNA, 12 nt, Bordetella pertussis
gcagcguggcgc

SEQ ID NO: 376086 - RNA, 14 nt, Bordetella pertussis
gcaggcacuggcgc

SEQ ID NO: 376087 - RNA, 23 nt, Bordetella pertussis
gcaggcaguuggcggcgcagccg

SEQ ID NO: 376088 - RNA, 22 nt, Bordetella pertussis
gcaggcauucgaacaacagcgc

SEQ ID NO: 376089 - RNA, 21 nt, Bordetella pertussis
gcaggccaccgacggcgcggc

SEQ ID NO: 376090 - RNA, 22 nt, Bordetella pertussis
gcaggccaccgacggcgcggcg

SEQ ID NO: 376091 - RNA, 14 nt, Bordetella pertussis
gcaggccagcaugg

SEQ ID NO: 376092 - RNA, 20 nt, Bordetella pertussis
gcaggccagcauggccgugg

SEQ ID NO: 376093 - RNA, 21 nt, Bordetella pertussis
gcaggccagcauggccguggc

SEQ ID NO: 376094 - RNA, 18 nt, Bordetella pertussis
gcaggccagcccgcgcgc

SEQ ID NO: 376095 - RNA, 19 nt, Bordetella pertussis
gcaggcccuggagaucgcc

SEQ ID NO: 376096 - RNA, 13 nt, Bordetella pertussis
gcaggcccugggc

SEQ ID NO: 376097 - RNA, 14 nt, Bordetella pertussis
gcaggcccugggcg

SEQ ID NO: 376098 - RNA, 16 nt, Bordetella pertussis
gcaggcccugggcgag

SEQ ID NO: 376099 - RNA, 13 nt, Bordetella pertussis
gcaggccgaaacc

SEQ ID NO: 376100 - RNA, 14 nt, Bordetella pertussis
gcaggccgaaaccg

SEQ ID NO: 376101 - RNA, 17 nt, Bordetella pertussis
gcaggccgacgcgcugu

SEQ ID NO: 376102 - RNA, 15 nt, Bordetella pertussis
gcaggccgcagcggg

SEQ ID NO: 376103 - RNA, 17 nt, Bordetella pertussis
gcaggccgcccagcgca

SEQ ID NO: 376104 - RNA, 14 nt, Bordetella pertussis
gcaggccgccgccg

SEQ ID NO: 376105 - RNA, 15 nt, Bordetella pertussis
gcaggccgccgccgg

SEQ ID NO: 376106 - RNA, 19 nt, Bordetella pertussis
gcaggccgccgccggugau

SEQ ID NO: 376107 - RNA, 15 nt, Bordetella pertussis
gcaggccgcgcagca

SEQ ID NO: 376108 - RNA, 16 nt, Bordetella pertussis
gcaggccgcgcagcac

SEQ ID NO: 376109 - RNA, 18 nt, Bordetella pertussis
gcaggccgcgcagcacgc

SEQ ID NO: 376110 - RNA, 20 nt, Bordetella pertussis
gcaggccgcgccacaggcgc

SEQ ID NO: 376111 - RNA, 15 nt, Bordetella pertussis
gcaggccgcgccggc

SEQ ID NO: 376112 - RNA, 18 nt, Bordetella pertussis
gcaggccgcgcgcaucca

SEQ ID NO: 376113 - RNA, 15 nt, Bordetella pertussis
gcaggccgcgcgugc

SEQ ID NO: 376114 - RNA, 14 nt, Bordetella pertussis
gcaggccgccggcc

SEQ ID NO: 376115 - RNA, 17 nt, Bordetella pertussis
gcaggccgccggccagc

SEQ ID NO: 376116 - RNA, 14 nt, Bordetella pertussis
gcaggccgcgcugc

SEQ ID NO: 376117 - RNA, 15 nt, Bordetella pertussis
gcaggccgcgcugcc

SEQ ID NO: 376118 - RNA, 16 nt, Bordetella pertussis
gcaggccgcgcugcca

SEQ ID NO: 376119 - RNA, 16 nt, Bordetella pertussis
gcaggccgcgcuggug

SEQ ID NO: 376120 - RNA, 14 nt, Bordetella pertussis
gcaggccgcggcca

SEQ ID NO: 376121 - RNA, 18 nt, Bordetella pertussis
gcaggccgcggccaggcc

SEQ ID NO: 376122 - RNA, 13 nt, Bordetella pertussis
gcaggccggcgcg

SEQ ID NO: 376123 - RNA, 20 nt, Bordetella pertussis
gcaggccggcggccagcgcg

SEQ ID NO: 376124 - RNA, 14 nt, Bordetella pertussis
gcaggccggcggcg

SEQ ID NO: 376125 - RNA, 12 nt, Bordetella pertussis
gcaggccgcgua

SEQ ID NO: 376126 - RNA, 17 nt, Bordetella pertussis
gcaggccguaaccggcc

SEQ ID NO: 376127 - RNA, 14 nt, Bordetella pertussis
gcaggcgcacgccg

SEQ ID NO: 376128 - RNA, 12 nt, Bordetella pertussis
gcaggcgcagcg

SEQ ID NO: 376129 - RNA, 15 nt, Bordetella pertussis
gcaggcgcaggccgc

SEQ ID NO: 376130 - RNA, 16 nt, Bordetella pertussis
gcaggcgcaggccgcg

SEQ ID NO: 376131 - RNA, 13 nt, Bordetella pertussis
gcaggcgccuucg

SEQ ID NO: 376132 - RNA, 20 nt, Bordetella pertussis
gcaggcgccuucggcgcggc

SEQ ID NO: 376133 - RNA, 21 nt, Bordetella pertussis
gcaggcgccuucggcgcggcg

SEQ ID NO: 376134 - RNA, 21 nt, Bordetella pertussis
gcaggcgccuuucccgcgccg

SEQ ID NO: 376135 - RNA, 13 nt, Bordetella pertussis
gcaggcgccggcu

SEQ ID NO: 376136 - RNA, 12 nt, Bordetella pertussis
gcaggcgcgagc

SEQ ID NO: 376137 - RNA, 19 nt, Bordetella pertussis
gcaggcgcgagcgccgggc

SEQ ID NO: 376138 - RNA, 23 nt, Bordetella pertussis
gcaggcgcgagcgccgggcgccg

SEQ ID NO: 376139 - RNA, 15 nt, Bordetella pertussis
gcaggcgcgaggugg

SEQ ID NO: 376140 - RNA, 13 nt, Bordetella pertussis
gcaggcgcgccag

SEQ ID NO: 376141 - RNA, 15 nt, Bordetella pertussis
gcaggcgcgccagcc

SEQ ID NO: 376142 - RNA, 16 nt, Bordetella pertussis
gcaggcgcgccagccc

SEQ ID NO: 376143 - RNA, 15 nt, Bordetella pertussis
gcaggcgcgccgggc

SEQ ID NO: 376144 - RNA, 14 nt, Bordetella pertussis
gcaggcgcgcgccu

SEQ ID NO: 376145 - RNA, 17 nt, Bordetella pertussis
gcaggcgcgcucaggcc

SEQ ID NO: 376146 - RNA, 23 nt, Bordetella pertussis
gcaggcgcgcucaggccgccggc

SEQ ID NO: 376147 - RNA, 20 nt, Bordetella pertussis
gcaggcgcgugaggucgcgc

SEQ ID NO: 376148 - RNA, 12 nt, Bordetella pertussis
gcaggcgcugcg

SEQ ID NO: 376149 - RNA, 13 nt, Bordetella pertussis
gcaggcgcugcgc

SEQ ID NO: 376150 - RNA, 21 nt, Bordetella pertussis
gcaggcgcucgaggcgcuggc

SEQ ID NO: 376151 - RNA, 18 nt, Bordetella pertussis
gcaggcgcucggccagcg

SEQ ID NO: 376152 - RNA, 16 nt, Bordetella pertussis
gcaggcggugcggagg

SEQ ID NO: 376153 - RNA, 22 nt, Bordetella pertussis
gcaggcggugcggaggcggccg

SEQ ID NO: 376154 - RNA, 19 nt, Bordetella pertussis
gcaggcgucggccagcgcg

SEQ ID NO: 376155 - RNA, 14 nt, Bordetella pertussis
gcaggcguuucgcc

SEQ ID NO: 376156 - RNA, 15 nt, Bordetella pertussis
gcaggcuccacagcc

SEQ ID NO: 376157 - RNA, 16 nt, Bordetella pertussis
gcaggcugccgccggc

SEQ ID NO: 376158 - RNA, 17 nt, Bordetella pertussis
gcaggcugccgccggcg

SEQ ID NO: 376159 - RNA, 18 nt, Bordetella pertussis
gcaggcugccgccggcga

SEQ ID NO: 376160 - RNA, 12 nt, Bordetella pertussis
gcagggccuccu

SEQ ID NO: 376161 - RNA, 16 nt, Bordetella pertussis
gcagggccuggcagau

SEQ ID NO: 376162 - RNA, 21 nt, Bordetella pertussis
gcagggcgccgacgaugccgc

SEQ ID NO: 376163 - RNA, 16 nt, Bordetella pertussis
gcagggcggccaggcc

SEQ ID NO: 376164 - RNA, 14 nt, Bordetella pertussis
gcagggcggccggc

SEQ ID NO: 376165 - RNA, 16 nt, Bordetella pertussis
gcagggcggccggcac

SEQ ID NO: 376166 - RNA, 20 nt, Bordetella pertussis
gcagggcggccucgacggcc

SEQ ID NO: 376167 - RNA, 12 nt, Bordetella pertussis
gcagggcggcgg

SEQ ID NO: 376168 - RNA, 12 nt, Bordetella pertussis
gcagggcggcgu

SEQ ID NO: 376169 - RNA, 21 nt, Bordetella pertussis
gcagggcggcgucgaucggcg

SEQ ID NO: 376170 - RNA, 17 nt, Bordetella pertussis
gcagggcgggggacgcc

SEQ ID NO: 376171 - RNA, 16 nt, Bordetella pertussis
gcagggcgucggccgc

SEQ ID NO: 376172 - RNA, 20 nt, Bordetella pertussis
gcagggcgugcgggacggcc

SEQ ID NO: 376173 - RNA, 20 nt, Bordetella pertussis
gcagggugucggccagggcg

SEQ ID NO: 376174 - RNA, 12 nt, Bordetella pertussis
gcagggugugcc

SEQ ID NO: 376175 - RNA, 21 nt, Bordetella pertussis
gcaggguucggugccuguccc

SEQ ID NO: 376176 - RNA, 15 nt, Bordetella pertussis
gcaggguuggcgcgc

SEQ ID NO: 376177 - RNA, 17 nt, Bordetella pertussis
gcaggguuggcgcgccg

SEQ ID NO: 376178 - RNA, 13 nt, Bordetella pertussis
gcagguacgccau

SEQ ID NO: 376179 - RNA, 24 nt, Bordetella pertussis
gcagguagucgaugaaggcgccga

SEQ ID NO: 376180 - RNA, 17 nt, Bordetella pertussis
gcaggucacgggcgaug

SEQ ID NO: 376181 - RNA, 18 nt, Bordetella pertussis
gcaggucaucgcgcuggc

SEQ ID NO: 376182 - RNA, 14 nt, Bordetella pertussis
gcagguccaccgcc

SEQ ID NO: 376183 - RNA, 15 nt, Bordetella pertussis
gcagguccggucgcg

SEQ ID NO: 376184 - RNA, 20 nt, Bordetella pertussis
gcagguccugcacgcgggcc

SEQ ID NO: 376185 - RNA, 21 nt, Bordetella pertussis
gcagguccugcacgcgggcca

SEQ ID NO: 376186 - RNA, 22 nt, Bordetella pertussis
gcagguccugcacgcgggccag

SEQ ID NO: 376187 - RNA, 23 nt, Bordetella pertussis
gcagguccugguaucccucgccc

SEQ ID NO: 376188 - RNA, 20 nt, Bordetella pertussis
gcaggucgauggggucgggc

SEQ ID NO: 376189 - RNA, 22 nt, Bordetella pertussis
gcaggucgauggggucgggccg

SEQ ID NO: 376190 - RNA, 14 nt, Bordetella pertussis
gcaggucgccagca

SEQ ID NO: 376191 - RNA, 15 nt, Bordetella pertussis
gcaggucggccagcg

SEQ ID NO: 376192 - RNA, 17 nt, Bordetella pertussis
gcaggucggcgaugcgc

SEQ ID NO: 376193 - RNA, 12 nt, Bordetella pertussis
gcaggucggcgc

SEQ ID NO: 376194 - RNA, 13 nt, Bordetella pertussis
gcaggucggggcg

SEQ ID NO: 376195 - RNA, 20 nt, Bordetella pertussis
gcaggucggggcgcucgagc

SEQ ID NO: 376196 - RNA, 12 nt, Bordetella pertussis
gcaggucggucg

SEQ ID NO: 376197 - RNA, 14 nt, Bordetella pertussis
gcaggucggucgcc

SEQ ID NO: 376198 - RNA, 21 nt, Bordetella pertussis
gcaggucgggauaguccagca

SEQ ID NO: 376199 - RNA, 19 nt, Bordetella pertussis
gcaggucgucgagccgggc

SEQ ID NO: 376200 - RNA, 19 nt, Bordetella pertussis
gcaggugaugcgcgcggcc

SEQ ID NO: 376201 - RNA, 14 nt, Bordetella pertussis
gcaggugcacgcac

SEQ ID NO: 376202 - RNA, 22 nt, Bordetella pertussis
gcaggugcacgcacgguacgcc

SEQ ID NO: 376203 - RNA, 16 nt, Bordetella pertussis
gcaggugccgccggcg

SEQ ID NO: 376204 - RNA, 21 nt, Bordetella pertussis
gcaggugccgccggcgcggcu

SEQ ID NO: 376205 - RNA, 23 nt, Bordetella pertussis
gcaggugccgccggcgcggcugc

SEQ ID NO: 376206 - RNA, 13 nt, Bordetella pertussis
gcaggugcggccg

SEQ ID NO: 376207 - RNA, 20 nt, Bordetella pertussis
gcaggugcgucacgcacagc

SEQ ID NO: 376208 - RNA, 17 nt, Bordetella pertussis
gcagguggccagcccgg

SEQ ID NO: 376209 - RNA, 23 nt, Bordetella pertussis
gcagguggggcagcaggccggcg

SEQ ID NO: 376210 - RNA, 14 nt, Bordetella pertussis
gcagguucugcgcg

SEQ ID NO: 376211 - RNA, 23 nt, Bordetella pertussis
gcagugcgcgcgcccccagcgcc

SEQ ID NO: 376212 - RNA, 15 nt, Bordetella pertussis
gcaguucggccgcca

SEQ ID NO: 376213 - RNA, 16 nt, Bordetella pertussis
gcaguucggccggcgg

SEQ ID NO: 376214 - RNA, 15 nt, Bordetella pertussis
gcaguucggcgucgg

SEQ ID NO: 376215 - RNA, 16 nt, Bordetella pertussis
gcaguucgggcacgcc

SEQ ID NO: 376216 - RNA, 18 nt, Bordetella pertussis
gcaguucgggcacgccgu

SEQ ID NO: 376217 - RNA, 18 nt, Bordetella pertussis
gcaguucggucagcgcgg

SEQ ID NO: 376218 - RNA, 19 nt, Bordetella pertussis
gcaguucggucagcgcggc

SEQ ID NO: 376219 - RNA, 20 nt, Bordetella pertussis
gcaguucggucagcgcggcg

SEQ ID NO: 376220 - RNA, 13 nt, Bordetella pertussis
gcaguucggugcg

SEQ ID NO: 376221 - RNA, 19 nt, Bordetella pertussis
gcaguugaacacgcggugc

SEQ ID NO: 376222 - RNA, 20 nt, Bordetella pertussis
gcaguugaacacgcggugca

SEQ ID NO: 376223 - RNA, 14 nt, Bordetella pertussis
gcaguugcagcaug

SEQ ID NO: 376224 - RNA, 15 nt, Bordetella pertussis
gcaguugcagcauga

SEQ ID NO: 376225 - RNA, 12 nt, Bordetella pertussis
gcaguugccgaa

SEQ ID NO: 376226 - RNA, 13 nt, Bordetella pertussis
gcaguugcgccag

SEQ ID NO: 376227 - RNA, 16 nt, Bordetella pertussis
gcaguugcuggcggcc

SEQ ID NO: 376228 - RNA, 18 nt, Bordetella pertussis
gcaguugcuggcggccgu

SEQ ID NO: 376229 - RNA, 20 nt, Bordetella pertussis
gcaguuggcggcgcagccgc

SEQ ID NO: 376230 - RNA, 15 nt, Bordetella pertussis
gcaguuuccagggcu

SEQ ID NO: 376231 - RNA, 18 nt, Bordetella pertussis
gcaguuucugcaccggcg

SEQ ID NO: 376232 - RNA, 15 nt, Bordetella pertussis
gcauagcccaggccg

SEQ ID NO: 376233 - RNA, 20 nt, Bordetella pertussis
gcauagcccaggccgccggc

SEQ ID NO: 376234 - RNA, 15 nt, Bordetella pertussis
gcauagacccacagg

SEQ ID NO: 376235 - RNA, 14 nt, Bordetella pertussis
gcauagcgcgccac

SEQ ID NO: 376236 - RNA, 18 nt, Bordetella pertussis
gcauaggacgccaccagu

SEQ ID NO: 376237 - RNA, 21 nt, Bordetella pertussis
gcauaggacgccaccagugcg

SEQ ID NO: 376238 - RNA, 13 nt, Bordetella pertussis
gcauaggcggcgc

SEQ ID NO: 376239 - RNA, 17 nt, Bordetella pertussis
gcauaggcggcgcaggc

SEQ ID NO: 376240 - RNA, 24 nt, Bordetella pertussis
gcauagguaucggcccgcgccagc

SEQ ID NO: 376241 - RNA, 23 nt, Bordetella pertussis
gcaucaccagcucgcggcccugg

SEQ ID NO: 376242 - RNA, 22 nt, Bordetella pertussis
gcaucacgcuggccgcgcccgc

SEQ ID NO: 376243 - RNA, 15 nt, Bordetella pertussis
gcaucccggcgcuca

SEQ ID NO: 376244 - RNA, 22 nt, Bordetella pertussis
gcaucccggcgcucagcgcgcc

SEQ ID NO: 376245 - RNA, 22 nt, Bordetella pertussis
gcaucccugcuugcgcggaccu

SEQ ID NO: 376246 - RNA, 13 nt, Bordetella pertussis
gcauccgcgccag

SEQ ID NO: 376247 - RNA, 14 nt, Bordetella pertussis
gcauccgcgccagg

SEQ ID NO: 376248 - RNA, 16 nt, Bordetella pertussis
gcaucgacagcgcgcc

SEQ ID NO: 376249 - RNA, 19 nt, Bordetella pertussis
gcaucgacagcgcgcccgc

SEQ ID NO: 376250 - RNA, 16 nt, Bordetella pertussis
gcaucgacaugcccgc

SEQ ID NO: 376251 - RNA, 18 nt, Bordetella pertussis
gcaucgaccacgcgcgcg

SEQ ID NO: 376252 - RNA, 20 nt, Bordetella pertussis
gcaucgaccacgcgcgcgcc

SEQ ID NO: 376253 - RNA, 21 nt, Bordetella pertussis
gcaucgaccacgcgcgcgccg

SEQ ID NO: 376254 - RNA, 18 nt, Bordetella pertussis
gcaucgagcuccugcagg

SEQ ID NO: 376255 - RNA, 22 nt, Bordetella pertussis
gcaucgagcuccugcaggaugg

SEQ ID NO: 376256 - RNA, 17 nt, Bordetella pertussis
gcaucgaucagcgcgcc

SEQ ID NO: 376257 - RNA, 15 nt, Bordetella pertussis
gcaucgaucucggcc

SEQ ID NO: 376258 - RNA, 16 nt, Bordetella pertussis
gcaucgaucucggccu

SEQ ID NO: 376259 - RNA, 22 nt, Bordetella pertussis
gcaucgauuucucgcugcugac

SEQ ID NO: 376260 - RNA, 22 nt, Bordetella pertussis
gcaucgcccugcucgaucuggu

SEQ ID NO: 376261 - RNA, 16 nt, Bordetella pertussis
gcaucgccgcaggcgu

SEQ ID NO: 376262 - RNA, 12 nt, Bordetella pertussis
gcaucgccgcca

SEQ ID NO: 376263 - RNA, 15 nt, Bordetella pertussis
gcaucgccgccagcu

SEQ ID NO: 376264 - RNA, 14 nt, Bordetella pertussis
gcaucgccgcgggc

SEQ ID NO: 376265 - RNA, 18 nt, Bordetella pertussis
gcaucgcgaugcgcagca

SEQ ID NO: 376266 - RNA, 21 nt, Bordetella pertussis
gcaucgcgcacccguuccagc

SEQ ID NO: 376267 - RNA, 16 nt, Bordetella pertussis
gcaucgcgccuucggc

SEQ ID NO: 376268 - RNA, 19 nt, Bordetella pertussis
gcaucgcgccuucggcgcg

SEQ ID NO: 376269 - RNA, 15 nt, Bordetella pertussis
gcaucgcgcgcgccg

SEQ ID NO: 376270 - RNA, 17 nt, Bordetella pertussis
gcaucgcgcgcgccggc

SEQ ID NO: 376271 - RNA, 16 nt, Bordetella pertussis
gcaucgcgcggcaugg

SEQ ID NO: 376272 - RNA, 12 nt, Bordetella pertussis
gcaucgcgcuga

SEQ ID NO: 376273 - RNA, 21 nt, Bordetella pertussis
gcaucgcgcugacagcgcucu

SEQ ID NO: 376274 - RNA, 17 nt, Bordetella pertussis
gcaucgcgcagcgugcg

SEQ ID NO: 376275 - RNA, 15 nt, Bordetella pertussis
gcaucgcggcagccc

SEQ ID NO: 376276 - RNA, 16 nt, Bordetella pertussis
gcaucgcggcagcccg

SEQ ID NO: 376277 - RNA, 16 nt, Bordetella pertussis
gcaucggcacccagcc

SEQ ID NO: 376278 - RNA, 16 nt, Bordetella pertussis
gcaucggccacgcugc

SEQ ID NO: 376279 - RNA, 22 nt, Bordetella pertussis
gcaucggccacgcugcccugcu

SEQ ID NO: 376280 - RNA, 15 nt, Bordetella pertussis
gcaucggcgccgagc

SEQ ID NO: 376281 - RNA, 16 nt, Bordetella pertussis
gcaucggcgccgagca

SEQ ID NO: 376282 - RNA, 17 nt, Bordetella pertussis
gcaucggcgccgcgcgc

SEQ ID NO: 376283 - RNA, 19 nt, Bordetella pertussis
gcaucggcgccgcgcgcuu

SEQ ID NO: 376284 - RNA, 14 nt, Bordetella pertussis
gcaucggcgccggc

SEQ ID NO: 376285 - RNA, 15 nt, Bordetella pertussis
gcaucggcgccggcg

SEQ ID NO: 376286 - RNA, 16 nt, Bordetella pertussis
gcaucggcgccggcgu

SEQ ID NO: 376287 - RNA, 18 nt, Bordetella pertussis
gcaucggcggcaggucgg

SEQ ID NO: 376288 - RNA, 17 nt, Bordetella pertussis
gcaucggcguaccaggc

SEQ ID NO: 376289 - RNA, 17 nt, Bordetella pertussis
gcaucggucaacgccug

SEQ ID NO: 376290 - RNA, 18 nt, Bordetella pertussis
gcaucggucaacgccugc

SEQ ID NO: 376291 - RNA, 22 nt, Bordetella pertussis
gcaucggucaacgccugcgggc

SEQ ID NO: 376292 - RNA, 20 nt, Bordetella pertussis
gcaucgggguuccacagcgc

SEQ ID NO: 376293 - RNA, 21 nt, Bordetella pertussis
gcaucguaguugggcgccuug

SEQ ID NO: 376294 - RNA, 15 nt, Bordetella pertussis
gcaucguaucgggcg

SEQ ID NO: 376295 - RNA, 15 nt, Bordetella pertussis
gcaucgucaggcagg

SEQ ID NO: 376296 - RNA, 20 nt, Bordetella pertussis
gcaucgucaggcaggcgcgc

SEQ ID NO: 376297 - RNA, 16 nt, Bordetella pertussis
gcaucgucgcgcugcg

SEQ ID NO: 376298 - RNA, 19 nt, Bordetella pertussis
gcaucguuacacuggcccu

SEQ ID NO: 376299 - RNA, 22 nt, Bordetella pertussis
gcaucguuacacuggcccuggc

SEQ ID NO: 376300 - RNA, 17 nt, Bordetella pertussis
gcaucguucaggcgcau

SEQ ID NO: 376301 - RNA, 15 nt, Bordetella pertussis
gcaucucgcggcggu

SEQ ID NO: 376302 - RNA, 21 nt, Bordetella pertussis
gcaucuggcgcauggccggcg

SEQ ID NO: 376303 - RNA, 16 nt, Bordetella pertussis
gcaucuguccgcgccg

SEQ ID NO: 376304 - RNA, 17 nt, Bordetella pertussis
gcaucuugcgccgcugc

SEQ ID NO: 376305 - RNA, 20 nt, Bordetella pertussis
gcaugaaaaagggcgcacca

SEQ ID NO: 376306 - RNA, 19 nt, Bordetella pertussis
gcaugaacggcagcgcgcg

SEQ ID NO: 376307 - RNA, 16 nt, Bordetella pertussis
gcaugaagcgguggcg

SEQ ID NO: 376308 - RNA, 18 nt, Bordetella pertussis
gcaugaagcugcccagca

SEQ ID NO: 376309 - RNA, 19 nt, Bordetella pertussis
gcaugaagcugcccagcaa

SEQ ID NO: 376310 - RNA, 17 nt, Bordetella pertussis
gcaugaccgacaggcgg

SEQ ID NO: 376311 - RNA, 17 nt, Bordetella pertussis
gcaugaccgccgccagc

SEQ ID NO: 376312 - RNA, 18 nt, Bordetella pertussis
gcaugaccgccgccagca

SEQ ID NO: 376313 - RNA, 21 nt, Bordetella pertussis
gcaugaccgccgccagcagcg

SEQ ID NO: 376314 - RNA, 15 nt, Bordetella pertussis
gcaugaccgccggca

SEQ ID NO: 376315 - RNA, 23 nt, Bordetella pertussis
gcaugaccgcggacgccauggcg

SEQ ID NO: 376316 - RNA, 14 nt, Bordetella pertussis
gcaugaccucggcc

SEQ ID NO: 376317 - RNA, 14 nt, Bordetella pertussis
gcaugacggccagg

SEQ ID NO: 376318 - RNA, 17 nt, Bordetella pertussis
gcaugacggccaggaug

SEQ ID NO: 376319 - RNA, 19 nt, Bordetella pertussis
gcaugacggccaggauggc

SEQ ID NO: 376320 - RNA, 17 nt, Bordetella pertussis
gcaugacggcgucgagc

SEQ ID NO: 376321 - RNA, 19 nt, Bordetella pertussis
gcaugacggggucggggca

SEQ ID NO: 376322 - RNA, 21 nt, Bordetella pertussis
gcaugaucaugccgcugccca

SEQ ID NO: 376323 - RNA, 17 nt, Bordetella pertussis
gcaugaugcugccgggc

SEQ ID NO: 376324 - RNA, 18 nt, Bordetella pertussis
gcaugaugcugccgggca

SEQ ID NO: 376325 - RNA, 13 nt, Bordetella pertussis
gcaugauggccgg

SEQ ID NO: 376326 - RNA, 14 nt, Bordetella pertussis
gcaugaugucgcgg

SEQ ID NO: 376327 - RNA, 22 nt, Bordetella pertussis
gcaugauuccugucgcgcugcu

SEQ ID NO: 376328 - RNA, 14 nt, Bordetella pertussis
gcaugcaccgcgug

SEQ ID NO: 376329 - RNA, 20 nt, Bordetella pertussis
gcaugccagcuugcaggcgc

SEQ ID NO: 376330 - RNA, 18 nt, Bordetella pertussis
gcaugccauagucgcgca

SEQ ID NO: 376331 - RNA, 21 nt, Bordetella pertussis
gcaugccauggccgcgcggcg

SEQ ID NO: 376332 - RNA, 17 nt, Bordetella pertussis
gcaugcccgaccgcaug

SEQ ID NO: 376333 - RNA, 23 nt, Bordetella pertussis
gcaugccccaacggcgcaccguc

SEQ ID NO: 376334 - RNA, 21 nt, Bordetella pertussis
gcaugcccuuugcagccagau

SEQ ID NO: 376335 - RNA, 18 nt, Bordetella pertussis
gcaugccgaccaccagca

SEQ ID NO: 376336 - RNA, 23 nt, Bordetella pertussis
gcaugccgaccaccagcaccgau

SEQ ID NO: 376337 - RNA, 12 nt, Bordetella pertussis
gcaugccgcugc

SEQ ID NO: 376338 - RNA, 20 nt, Bordetella pertussis
gcaugccgcugcaggucggg

SEQ ID NO: 376339 - RNA, 19 nt, Bordetella pertussis
gcaugccggcauaggcggc

SEQ ID NO: 376340 - RNA, 22 nt, Bordetella pertussis
gcaugccggcauaggcggcgca

SEQ ID NO: 376341 - RNA, 23 nt, Bordetella pertussis
gcaugccggcauaggcggcgcag

SEQ ID NO: 376342 - RNA, 23 nt, Bordetella pertussis
gcaugccguccacgcccagcgcc

SEQ ID NO: 376343 - RNA, 18 nt, Bordetella pertussis
gcaugccgucgagcgcga

SEQ ID NO: 376344 - RNA, 14 nt, Bordetella pertussis
gcaugccgggcugc

SEQ ID NO: 376345 - RNA, 19 nt, Bordetella pertussis
gcaugcgaaagccggccuc

SEQ ID NO: 376346 - RNA, 21 nt, Bordetella pertussis
gcaugcgaggaaugcggcggg

SEQ ID NO: 376347 - RNA, 15 nt, Bordetella pertussis
gcaugcgcacgcgcg

SEQ ID NO: 376348 - RNA, 20 nt, Bordetella pertussis
gcaugcgcagcgcgucggcg

SEQ ID NO: 376349 - RNA, 12 nt, Bordetella pertussis
gcaugcgccagc

SEQ ID NO: 376350 - RNA, 14 nt, Bordetella pertussis
gcaugcgccagcca

SEQ ID NO: 376351 - RNA, 15 nt, Bordetella pertussis
gcaugcgccagccag

SEQ ID NO: 376352 - RNA, 17 nt, Bordetella pertussis
gcaugcgccagccagcg

SEQ ID NO: 376353 - RNA, 18 nt, Bordetella pertussis
gcaugcgccgcaccagcg

SEQ ID NO: 376354 - RNA, 12 nt, Bordetella pertussis
gcaugcgccugc

SEQ ID NO: 376355 - RNA, 17 nt, Bordetella pertussis
gcaugcgccugcgccau

SEQ ID NO: 376356 - RNA, 20 nt, Bordetella pertussis
gcaugcgccugucccaggcg

SEQ ID NO: 376357 - RNA, 17 nt, Bordetella pertussis
gcaugcgcgaacgcgcg

SEQ ID NO: 376358 - RNA, 20 nt, Bordetella pertussis
gcaugcgcgaacgcgcgccg

SEQ ID NO: 376359 - RNA, 11 nt, Bordetella pertussis
gcaugcgcgcg

SEQ ID NO: 376360 - RNA, 12 nt, Bordetella pertussis
gcaugcgcgcgg

SEQ ID NO: 376361 - RNA, 13 nt, Bordetella pertussis
gcaugcgcgcggc

SEQ ID NO: 376362 - RNA, 21 nt, Bordetella pertussis
gcaugcgcggcgggacggcca

SEQ ID NO: 376363 - RNA, 22 nt, Bordetella pertussis
gcaugcgcggcgggacggccau

SEQ ID NO: 376364 - RNA, 17 nt, Bordetella pertussis
gcaugcgcgucuccagc

SEQ ID NO: 376365 - RNA, 20 nt, Bordetella pertussis
gcaugcgcgucuccagcgcc

SEQ ID NO: 376366 - RNA, 22 nt, Bordetella pertussis
gcaugcgcgucuccagcgccgg

SEQ ID NO: 376367 - RNA, 12 nt, Bordetella pertussis
gcaugcgcgcca

SEQ ID NO: 376368 - RNA, 19 nt, Bordetella pertussis
gcaugcggcacaaccuggc

SEQ ID NO: 376369 - RNA, 21 nt, Bordetella pertussis
gcaugcggcacaaccuggcgc

SEQ ID NO: 376370 - RNA, 22 nt, Bordetella pertussis
gcaugcggcacaaccuggcgcg

SEQ ID NO: 376371 - RNA, 22 nt, Bordetella pertussis
gcaugcgguuucucagcgcgcu

SEQ ID NO: 376372 - RNA, 19 nt, Bordetella pertussis
gcaugcucuggcacaccag

SEQ ID NO: 376373 - RNA, 22 nt, Bordetella pertussis
gcaugcucuggcacaccagcgc

SEQ ID NO: 376374 - RNA, 23 nt, Bordetella pertussis
gcaugcucuggcacaccagcgcc

SEQ ID NO: 376375 - RNA, 19 nt, Bordetella pertussis
gcaugcugcgcgagguggg

SEQ ID NO: 376376 - RNA, 20 nt, Bordetella pertussis
gcaugcugcgcgaggugggc

SEQ ID NO: 376377 - RNA, 21 nt, Bordetella pertussis
gcauggacugcaggcgcugcg

SEQ ID NO: 376378 - RNA, 15 nt, Bordetella pertussis
gcauggagaccggcg

SEQ ID NO: 376379 - RNA, 20 nt, Bordetella pertussis
gcauggagaccggcgccugc

SEQ ID NO: 376380 - RNA, 13 nt, Bordetella pertussis
gcauggcagcaga

SEQ ID NO: 376381 - RNA, 21 nt, Bordetella pertussis
gcauggcagcagaucggcggc

SEQ ID NO: 376382 - RNA, 19 nt, Bordetella pertussis
gcauggccaaugccauugg

SEQ ID NO: 376383 - RNA, 14 nt, Bordetella pertussis
gcauggccaccagg

SEQ ID NO: 376384 - RNA, 16 nt, Bordetella pertussis
gcauggccaccaggua

SEQ ID NO: 376385 - RNA, 15 nt, Bordetella pertussis
gcauggccagcgcgc

SEQ ID NO: 376386 - RNA, 17 nt, Bordetella pertussis
gcauggccagcgcgcag

SEQ ID NO: 376387 - RNA, 13 nt, Bordetella pertussis
gcauggccaggaa

SEQ ID NO: 376388 - RNA, 13 nt, Bordetella pertussis
gcauggccggcag

SEQ ID NO: 376389 - RNA, 19 nt, Bordetella pertussis
gcauggccggcaggucgau

SEQ ID NO: 376390 - RNA, 23 nt, Bordetella pertussis
gcauggccgguucgaugaccugg

SEQ ID NO: 376391 - RNA, 13 nt, Bordetella pertussis
gcauggccggcgu

SEQ ID NO: 376392 - RNA, 14 nt, Bordetella pertussis
gcauggcgaucgaa

SEQ ID NO: 376393 - RNA, 19 nt, Bordetella pertussis
gcauggcgaucgaacgcgg

SEQ ID NO: 376394 - RNA, 22 nt, Bordetella pertussis
gcauggcgaucgaacgcggcca

SEQ ID NO: 376395 - RNA, 20 nt, Bordetella pertussis
gcauggcgaugaccucggcg

SEQ ID NO: 376396 - RNA, 18 nt, Bordetella pertussis
gcauggcgccagcuggac

SEQ ID NO: 376397 - RNA, 21 nt, Bordetella pertussis
gcauggcgccaugcgacagcc

SEQ ID NO: 376398 - RNA, 11 nt, Bordetella pertussis
gcauggcgccg

SEQ ID NO: 376399 - RNA, 13 nt, Bordetella pertussis
gcauggcgccgcg

SEQ ID NO: 376400 - RNA, 13 nt, Bordetella pertussis
gcauggcgcgcgg

SEQ ID NO: 376401 - RNA, 18 nt, Bordetella pertussis
gcauggcgcgugcgcgcg

SEQ ID NO: 376402 - RNA, 20 nt, Bordetella pertussis
gcauggcggccaggcgcgcc

SEQ ID NO: 376403 - RNA, 23 nt, Bordetella pertussis
gcauggcggccaggcgcgccgcg

SEQ ID NO: 376404 - RNA, 20 nt, Bordetella pertussis
gcauggcggcgcccgcugcg

SEQ ID NO: 376405 - RNA, 22 nt, Bordetella pertussis
gcauggcgguggccagcgccug

SEQ ID NO: 376406 - RNA, 14 nt, Bordetella pertussis
gcauggcgucaagc

SEQ ID NO: 376407 - RNA, 22 nt, Bordetella pertussis
gcauggcgucgaaacgcugcgc

SEQ ID NO: 376408 - RNA, 17 nt, Bordetella pertussis
gcaugggcacauacagc

SEQ ID NO: 376409 - RNA, 15 nt, Bordetella pertussis
gcaugggcgcaggcc

SEQ ID NO: 376410 - RNA, 17 nt, Bordetella pertussis
gcaugggcgcaggccgc

SEQ ID NO: 376411 - RNA, 19 nt, Bordetella pertussis
gcaugggcgcaggccgcca

SEQ ID NO: 376412 - RNA, 22 nt, Bordetella pertussis
gcaugggcgccgagggccgcgc

SEQ ID NO: 376413 - RNA, 18 nt, Bordetella pertussis
gcaugggcgcgcccggcg

SEQ ID NO: 376414 - RNA, 16 nt, Bordetella pertussis
gcaugggcggcccggc

SEQ ID NO: 376415 - RNA, 17 nt, Bordetella pertussis
gcaugggcggcccggcc

SEQ ID NO: 376416 - RNA, 20 nt, Bordetella pertussis
gcaugggcgugccgcgcugg

SEQ ID NO: 376417 - RNA, 17 nt, Bordetella pertussis
gcaugggcccgggcgcg

SEQ ID NO: 376418 - RNA, 19 nt, Bordetella pertussis
gcaugggcccgggcgcgcu

SEQ ID NO: 376419 - RNA, 17 nt, Bordetella pertussis
gcaugggggcuggcgcu

SEQ ID NO: 376420 - RNA, 19 nt, Bordetella pertussis
gcauggguaaagcgccggc

SEQ ID NO: 376421 - RNA, 15 nt, Bordetella pertussis
gcauggucgcgaugc

SEQ ID NO: 376422 - RNA, 16 nt, Bordetella pertussis
gcauggucggcauggc

SEQ ID NO: 376423 - RNA, 17 nt, Bordetella pertussis
gcaugguggcgcaggca

SEQ ID NO: 376424 - RNA, 14 nt, Bordetella pertussis
gcauguacucggcc

SEQ ID NO: 376425 - RNA, 15 nt, Bordetella pertussis
gcauguacucggcca

SEQ ID NO: 376426 - RNA, 18 nt, Bordetella pertussis
gcauguacucggccaggc

SEQ ID NO: 376427 - RNA, 19 nt, Bordetella pertussis
gcauguacucggccaggcc

SEQ ID NO: 376428 - RNA, 21 nt, Bordetella pertussis
gcauguacucggccaggccau

SEQ ID NO: 376429 - RNA, 16 nt, Bordetella pertussis
gcauguccagcggcgu

SEQ ID NO: 376430 - RNA, 15 nt, Bordetella pertussis
gcaugucccagcgcu

SEQ ID NO: 376431 - RNA, 16 nt, Bordetella pertussis
gcaugucccagcgcuc

SEQ ID NO: 376432 - RNA, 22 nt, Bordetella pertussis
gcaugucccagcgcucguccac

SEQ ID NO: 376433 - RNA, 20 nt, Bordetella pertussis
gcaugucccgaggcgcccca

SEQ ID NO: 376434 - RNA, 21 nt, Bordetella pertussis
gcauguccgccacgccggcca

SEQ ID NO: 376435 - RNA, 20 nt, Bordetella pertussis
gcauguccguaucgcggccg

SEQ ID NO: 376436 - RNA, 14 nt, Bordetella pertussis
gcaugucgcggccc

SEQ ID NO: 376437 - RNA, 17 nt, Bordetella pertussis
gcaugucguacaggccg

SEQ ID NO: 376438 - RNA, 19 nt, Bordetella pertussis
gcaugucguacaggccguu

SEQ ID NO: 376439 - RNA, 20 nt, Bordetella pertussis
gcaugucguggcgauagcgc

SEQ ID NO: 376440 - RNA, 21 nt, Bordetella pertussis
gcaugugccaccgcccaggcg

SEQ ID NO: 376441 - RNA, 23 nt, Bordetella pertussis
gcaugugccaccgcccaggcgca

SEQ ID NO: 376442 - RNA, 21 nt, Bordetella pertussis
gcaugugcucgggacgcaggc

SEQ ID NO: 376443 - RNA, 18 nt, Bordetella pertussis
gcauuaccagcaacgcgc

SEQ ID NO: 376444 - RNA, 20 nt, Bordetella pertussis
gcauucccggaccgcgcugc

SEQ ID NO: 376445 - RNA, 21 nt, Bordetella pertussis
gcauucccggaccgcgcugcg

SEQ ID NO: 376446 - RNA, 20 nt, Bordetella pertussis
gcauucgaacaacagcgccu

SEQ ID NO: 376447 - RNA, 22 nt, Bordetella pertussis
gcauucgucgcugccgcgcgau

SEQ ID NO: 376448 - RNA, 19 nt, Bordetella pertussis
gcauucuggugcagcggcu

SEQ ID NO: 376449 - RNA, 15 nt, Bordetella pertussis
gcauugaagcuggcg

SEQ ID NO: 376450 - RNA, 22 nt, Bordetella pertussis
gcauugaagcuggcgccggucu

SEQ ID NO: 376451 - RNA, 21 nt, Bordetella pertussis
gcauugaucgaucagccagcc

SEQ ID NO: 376452 - RNA, 18 nt, Bordetella pertussis
gcauugcacaacgggcag

SEQ ID NO: 376453 - RNA, 18 nt, Bordetella pertussis
gcauugcccaccacggcg

SEQ ID NO: 376454 - RNA, 18 nt, Bordetella pertussis
gcauugccgccgcccugc

SEQ ID NO: 376455 - RNA, 11 nt, Bordetella pertussis
gcauugcggcu

SEQ ID NO: 376456 - RNA, 19 nt, Bordetella pertussis
gcauuggcgccgcgcucgc

SEQ ID NO: 376457 - RNA, 23 nt, Bordetella pertussis
gcauuggcgccgcgcucgcgcca

SEQ ID NO: 376458 - RNA, 16 nt, Bordetella pertussis
gcauuggccgccgcca

SEQ ID NO: 376459 - RNA, 21 nt, Bordetella pertussis
gcauuucggcgccgccggcca

SEQ ID NO: 376460 - RNA, 14 nt, Bordetella pertussis
gcauuucucgggcg

SEQ ID NO: 376461 - RNA, 14 nt, Bordetella pertussis
gcauuugccgcggc

SEQ ID NO: 376462 - RNA, 21 nt, Bordetella pertussis
gccaaagaucaaaaaggcccu

SEQ ID NO: 376463 - RNA, 14 nt, Bordetella pertussis
gccaaagcgcagcg

SEQ ID NO: 376464 - RNA, 21 nt, Bordetella pertussis
gccaaccccgagggcgcggcg

SEQ ID NO: 376465 - RNA, 14 nt, Bordetella pertussis
gccaacccgccauc

SEQ ID NO: 376466 - RNA, 20 nt, Bordetella pertussis
gccaacccggccucagcggc

SEQ ID NO: 376467 - RNA, 23 nt, Bordetella pertussis
gccaacccucgcacggccgucaa

SEQ ID NO: 376468 - RNA, 23 nt, Bordetella pertussis
gccaacgccaagcugcuggccgg

SEQ ID NO: 376469 - RNA, 17 nt, Bordetella pertussis
gccaacgccacgcccau

SEQ ID NO: 376470 - RNA, 19 nt, Bordetella pertussis
gccaacgcacaagggcccc

SEQ ID NO: 376471 - RNA, 14 nt, Bordetella pertussis
gccaacgcggcgcg

SEQ ID NO: 376472 - RNA, 20 nt, Bordetella pertussis
gccaacgggauccggcagca

SEQ ID NO: 376473 - RNA, 15 nt, Bordetella pertussis
gccaacggugccagu

SEQ ID NO: 376474 - RNA, 16 nt, Bordetella pertussis
gccaacgucggcagcc

SEQ ID NO: 376475 - RNA, 12 nt, Bordetella pertussis
gccacgaccggc

SEQ ID NO: 376476 - RNA, 13 nt, Bordetella pertussis
gccacgaccggcu

SEQ ID NO: 376477 - RNA, 16 nt, Bordetella pertussis
gccacgaccggcucga

SEQ ID NO: 376478 - RNA, 21 nt, Bordetella pertussis
gccacgaccggcucgaucgcc

SEQ ID NO: 376479 - RNA, 18 nt, Bordetella pertussis
gccacgacguagucggcg

SEQ ID NO: 376480 - RNA, 22 nt, Bordetella pertussis
gccacgaucccgucauggcggc

SEQ ID NO: 376481 - RNA, 20 nt, Bordetella pertussis
gccacgaugauggaggccag

SEQ ID NO: 376482 - RNA, 21 nt, Bordetella pertussis
gccacgaugauggaggccagg

SEQ ID NO: 376483 - RNA, 16 nt, Bordetella pertussis
gccacgauguugcgca

SEQ ID NO: 376484 - RNA, 18 nt, Bordetella pertussis
gccacgauguugcgcagg

SEQ ID NO: 376485 - RNA, 14 nt, Bordetella pertussis
gccacgcaggcggg

SEQ ID NO: 376486 - RNA, 12 nt, Bordetella pertussis
gccacgccggcc

SEQ ID NO: 376487 - RNA, 13 nt, Bordetella pertussis
gccacgccggcca

SEQ ID NO: 376488 - RNA, 16 nt, Bordetella pertussis
gccacgccggccacga

SEQ ID NO: 376489 - RNA, 15 nt, Bordetella pertussis
gccacgccggccagc

SEQ ID NO: 376490 - RNA, 16 nt, Bordetella pertussis
gccacgccggccagcu

SEQ ID NO: 376491 - RNA, 14 nt, Bordetella pertussis
gccacgccggccgg

SEQ ID NO: 376492 - RNA, 15 nt, Bordetella pertussis
gccacgccggccggg

SEQ ID NO: 376493 - RNA, 16 nt, Bordetella pertussis
gccacgccggccgggg

SEQ ID NO: 376494 - RNA, 22 nt, Bordetella pertussis
gccacgccggcgcgccggccgc

SEQ ID NO: 376495 - RNA, 21 nt, Bordetella pertussis
gccacgccgucagcgacaucg

SEQ ID NO: 376496 - RNA, 18 nt, Bordetella pertussis
gccacgccuuguucgcgc

SEQ ID NO: 376497 - RNA, 20 nt, Bordetella pertussis
gccacgccuuguucgcgcgc

SEQ ID NO: 376498 - RNA, 15 nt, Bordetella pertussis
gccacgcgagcccgc

SEQ ID NO: 376499 - RNA, 18 nt, Bordetella pertussis
gccacgcgcaacgccgcc

SEQ ID NO: 376500 - RNA, 17 nt, Bordetella pertussis
gccacgcgcacggccag

SEQ ID NO: 376501 - RNA, 20 nt, Bordetella pertussis
gccacgcgccgugcagacgg

SEQ ID NO: 376502 - RNA, 16 nt, Bordetella pertussis
gccacgcgcgauccgc

SEQ ID NO: 376503 - RNA, 20 nt, Bordetella pertussis
gccacgcgcgauccgcgcca

SEQ ID NO: 376504 - RNA, 18 nt, Bordetella pertussis
gccacgcgcgcuggcgcc

SEQ ID NO: 376505 - RNA, 19 nt, Bordetella pertussis
gccacgcgcgcuggcgccc

SEQ ID NO: 376506 - RNA, 20 nt, Bordetella pertussis
gccacgcgcgcuggcgcccg

SEQ ID NO: 376507 - RNA, 17 nt, Bordetella pertussis
gccacgcgcggaucggc

SEQ ID NO: 376508 - RNA, 12 nt, Bordetella pertussis
gccacgcgcugc

SEQ ID NO: 376509 - RNA, 13 nt, Bordetella pertussis
gccacgcgcuugc

SEQ ID NO: 376510 - RNA, 19 nt, Bordetella pertussis
gccacgcgcuugcgcgcca

SEQ ID NO: 376511 - RNA, 20 nt, Bordetella pertussis
gccacgcgcuugcgcgccac

SEQ ID NO: 376512 - RNA, 19 nt, Bordetella pertussis
gccacgcgggcguggucau

SEQ ID NO: 376513 - RNA, 16 nt, Bordetella pertussis
gccacgcgguccagcc

SEQ ID NO: 376514 - RNA, 12 nt, Bordetella pertussis
gccacggccgcg

SEQ ID NO: 376515 - RNA, 16 nt, Bordetella pertussis
gccacggccgcgaucg

SEQ ID NO: 376516 - RNA, 14 nt, Bordetella pertussis
gccacggccggcag

SEQ ID NO: 376517 - RNA, 16 nt, Bordetella pertussis
gccacggccggcagcg

SEQ ID NO: 376518 - RNA, 22 nt, Bordetella pertussis
gccacggccggcagcgccuugc

SEQ ID NO: 376519 - RNA, 16 nt, Bordetella pertussis
gccacgcucacgcccg

SEQ ID NO: 376520 - RNA, 15 nt, Bordetella pertussis
gccacggcgggccgg

SEQ ID NO: 376521 - RNA, 23 nt, Bordetella pertussis
gccacggcgggccggcucggcgg

SEQ ID NO: 376522 - RNA, 18 nt, Bordetella pertussis
gccacggcggugaccacc

SEQ ID NO: 376523 - RNA, 16 nt, Bordetella pertussis
gccacggcggugcuga

SEQ ID NO: 376524 - RNA, 18 nt, Bordetella pertussis
gccacggcgucgaugcgc

SEQ ID NO: 376525 - RNA, 15 nt, Bordetella pertussis
gccacggcgucgccg

SEQ ID NO: 376526 - RNA, 23 nt, Bordetella pertussis
gccacggcgucgccggccaggca

SEQ ID NO: 376527 - RNA, 24 nt, Bordetella pertussis
gccacggcgucgccggccaggcaa

SEQ ID NO: 376528 - RNA, 18 nt, Bordetella pertussis
gccacggcuucgcccagc

SEQ ID NO: 376529 - RNA, 19 nt, Bordetella pertussis
gccacgucacggaucagcc

SEQ ID NO: 376530 - RNA, 23 nt, Bordetella pertussis
gccacgucauaggcuucgcccgc

SEQ ID NO: 376531 - RNA, 13 nt, Bordetella pertussis
gccacguccagca

SEQ ID NO: 376532 - RNA, 16 nt, Bordetella pertussis
gccacguccagcacgg

SEQ ID NO: 376533 - RNA, 18 nt, Bordetella pertussis
gccacguccagcacggcc

SEQ ID NO: 376534 - RNA, 21 nt, Bordetella pertussis
gccacgucgaccucgagcacc

SEQ ID NO: 376535 - RNA, 13 nt, Bordetella pertussis
gccacgucgccca

SEQ ID NO: 376536 - RNA, 15 nt, Bordetella pertussis
gccacgucgcccaca

SEQ ID NO: 376537 - RNA, 13 nt, Bordetella pertussis
gccacgucgccgg

SEQ ID NO: 376538 - RNA, 16 nt, Bordetella pertussis
gccacgucgcucggcc

SEQ ID NO: 376539 - RNA, 18 nt, Bordetella pertussis
gccacgucgcucggccuc

SEQ ID NO: 376540 - RNA, 13 nt, Bordetella pertussis
gccacgucggcgg

SEQ ID NO: 376541 - RNA, 18 nt, Bordetella pertussis
gccacgucggucgcuucc

SEQ ID NO: 376542 - RNA, 18 nt, Bordetella pertussis
gccacgugaagcgccgcg

SEQ ID NO: 376543 - RNA, 14 nt, Bordetella pertussis
gccacgugcugcug

SEQ ID NO: 376544 - RNA, 21 nt, Bordetella pertussis
gccacguguggcaggccagcg

SEQ ID NO: 376545 - RNA, 19 nt, Bordetella pertussis
gccacguugaagcgcagcc

SEQ ID NO: 376546 - RNA, 20 nt, Bordetella pertussis
gccacguugaagcgcagcca

SEQ ID NO: 376547 - RNA, 18 nt, Bordetella pertussis
gccacuauguggcguucg

SEQ ID NO: 376548 - RNA, 20 nt, Bordetella pertussis
gccacuauguggcguucgcg

SEQ ID NO: 376549 - RNA, 15 nt, Bordetella pertussis
gccacguugucgcgc

SEQ ID NO: 376550 - RNA, 22 nt, Bordetella pertussis
gccacuccugguugaccgagcc

SEQ ID NO: 376551 - RNA, 14 nt, Bordetella pertussis
gccacucgaugggc

SEQ ID NO: 376552 - RNA, 16 nt, Bordetella pertussis
gccacuugcaggccgc

SEQ ID NO: 376553 - RNA, 15 nt, Bordetella pertussis
gccacuuucgcgcgc

SEQ ID NO: 376554 - RNA, 19 nt, Bordetella pertussis
gccacuuucgcgcgcgccu

SEQ ID NO: 376555 - RNA, 17 nt, Bordetella pertussis
gccagaacaugagccau

SEQ ID NO: 376556 - RNA, 20 nt, Bordetella pertussis
gccagaacgacagcgacaac

SEQ ID NO: 376557 - RNA, 18 nt, Bordetella pertussis
gccagaacgcugaugcgc

SEQ ID NO: 376558 - RNA, 22 nt, Bordetella pertussis
gccagaacgcugaugcgcguca

SEQ ID NO: 376559 - RNA, 18 nt, Bordetella pertussis
gccagaccgcgcgcacca

SEQ ID NO: 376560 - RNA, 15 nt, Bordetella pertussis
gccagaccgcgcgca

SEQ ID NO: 376561 - RNA, 14 nt, Bordetella pertussis
gccagaccugguga

SEQ ID NO: 376562 - RNA, 20 nt, Bordetella pertussis
gccagaccuggugaucgcgc

SEQ ID NO: 376563 - RNA, 14 nt, Bordetella pertussis
gccagaccuugcgc

SEQ ID NO: 376564 - RNA, 14 nt, Bordetella pertussis
gccagacggccagc

SEQ ID NO: 376565 - RNA, 15 nt, Bordetella pertussis
gccagacggccagcg

SEQ ID NO: 376566 - RNA, 22 nt, Bordetella pertussis
gccagauccgguaugccugcca

SEQ ID NO: 376567 - RNA, 18 nt, Bordetella pertussis
gccagaucggacgggccg

SEQ ID NO: 376568 - RNA, 22 nt, Bordetella pertussis
gccagaucggacgggccgauga

SEQ ID NO: 376569 - RNA, 20 nt, Bordetella pertussis
gccagaucguugaucucgcc

SEQ ID NO: 376570 - RNA, 15 nt, Bordetella pertussis
gccagaugcgccgca

SEQ ID NO: 376571 - RNA, 15 nt, Bordetella pertussis
gccagcaagcgcgcc

SEQ ID NO: 376572 - RNA, 17 nt, Bordetella pertussis
gccagcaagcgcgccau

SEQ ID NO: 376573 - RNA, 19 nt, Bordetella pertussis
gccagcaagcgcgccauga

SEQ ID NO: 376574 - RNA, 16 nt, Bordetella pertussis
gccagcaagcgcucgg

SEQ ID NO: 376575 - RNA, 17 nt, Bordetella pertussis
gccagcaagcgcucggc

SEQ ID NO: 376576 - RNA, 20 nt, Bordetella pertussis
gccagcaagcgcucggccac

SEQ ID NO: 376577 - RNA, 21 nt, Bordetella pertussis
gccagcaagcgcucggccacg

SEQ ID NO: 376578 - RNA, 22 nt, Bordetella pertussis
gccagcaagcgcucggccacgc

SEQ ID NO: 376579 - RNA, 21 nt, Bordetella pertussis
gccagcaaggcggcaaacccg

SEQ ID NO: 376580 - RNA, 13 nt, Bordetella pertussis
gccagcaaggcgu

SEQ ID NO: 376581 - RNA, 16 nt, Bordetella pertussis
gccagcaaggcgucgg

SEQ ID NO: 376582 - RNA, 19 nt, Bordetella pertussis
gccagcaaggcgucggcca

SEQ ID NO: 376583 - RNA, 20 nt, Bordetella pertussis
gccagcaaggcgucggccag

SEQ ID NO: 376584 - RNA, 23 nt, Bordetella pertussis
gccagcaagggguccguggcggc

SEQ ID NO: 376585 - RNA, 24 nt, Bordetella pertussis
gccagcacagugucuaucauggcc

SEQ ID NO: 376586 - RNA, 20 nt, Bordetella pertussis
gccagcacauacgccgccga

SEQ ID NO: 376587 - RNA, 16 nt, Bordetella pertussis
gccagcaggcgcuggu

SEQ ID NO: 376588 - RNA, 17 nt, Bordetella pertussis
gccagcaggcgcugguc

SEQ ID NO: 376589 - RNA, 16 nt, Bordetella pertussis
gccagcaggcgcucgg

SEQ ID NO: 376590 - RNA, 16 nt, Bordetella pertussis
gccagcaggucgcgca

SEQ ID NO: 376591 - RNA, 19 nt, Bordetella pertussis
gccagcaggucgcgcacgc

SEQ ID NO: 376592 - RNA, 22 nt, Bordetella pertussis
gccagcaggucgcgcacgcugg

SEQ ID NO: 376593 - RNA, 18 nt, Bordetella pertussis
gccagcaguguuucggcc

SEQ ID NO: 376594 - RNA, 21 nt, Bordetella pertussis
gccagcaguguuucggccugc

SEQ ID NO: 376595 - RNA, 12 nt, Bordetella pertussis
gccagcaggucg

SEQ ID NO: 376596 - RNA, 22 nt, Bordetella pertussis
gccagcauacccugcgcgccgc

SEQ ID NO: 376597 - RNA, 14 nt, Bordetella pertussis
gccagcauccagcc

SEQ ID NO: 376598 - RNA, 16 nt, Bordetella pertussis
gccagcauccagccga

SEQ ID NO: 376599 - RNA, 15 nt, Bordetella pertussis
gccagcaucggcacc

SEQ ID NO: 376600 - RNA, 19 nt, Bordetella pertussis
gccagcaucggcacccagc

SEQ ID NO: 376601 - RNA, 20 nt, Bordetella pertussis
gccagcaucggcacccagcc

SEQ ID NO: 376602 - RNA, 17 nt, Bordetella pertussis
gccagcaugaucaugcc

SEQ ID NO: 376603 - RNA, 21 nt, Bordetella pertussis
gccagcaugaucaugccgcug

SEQ ID NO: 376604 - RNA, 21 nt, Bordetella pertussis
gccagcaugcgcgcggccucg

SEQ ID NO: 376605 - RNA, 15 nt, Bordetella pertussis
gccagcaugcugggu

SEQ ID NO: 376606 - RNA, 18 nt, Bordetella pertussis
gccagcauggcggccagg

SEQ ID NO: 376607 - RNA, 22 nt, Bordetella pertussis
gccagcauggcggccaggcgcg

SEQ ID NO: 376608 - RNA, 13 nt, Bordetella pertussis
gccagcauggcgu

SEQ ID NO: 376609 - RNA, 15 nt, Bordetella pertussis
gccagcauggcgucg

SEQ ID NO: 376610 - RNA, 18 nt, Bordetella pertussis
gccagcauuaccagcaac

SEQ ID NO: 376611 - RNA, 23 nt, Bordetella pertussis
gccagcauuaccagcaacgcgcc

SEQ ID NO: 376612 - RNA, 13 nt, Bordetella pertussis
gccagccacgccg

SEQ ID NO: 376613 - RNA, 23 nt, Bordetella pertussis
gccagccacgccggcgcgccggc

SEQ ID NO: 376614 - RNA, 14 nt, Bordetella pertussis
gccagccacgcgcg

SEQ ID NO: 376615 - RNA, 18 nt, Bordetella pertussis
gccagccacgcgcgcugg

SEQ ID NO: 376616 - RNA, 19 nt, Bordetella pertussis
gccagccacgcgcgcuggc

SEQ ID NO: 376617 - RNA, 22 nt, Bordetella pertussis
gccagccacgcgcgcuggcgcc

SEQ ID NO: 376618 - RNA, 16 nt, Bordetella pertussis
gccagccagcgcaugc

SEQ ID NO: 376619 - RNA, 14 nt, Bordetella pertussis
gccagccagcgccg

SEQ ID NO: 376620 - RNA, 16 nt, Bordetella pertussis
gccagccagcgccgca

SEQ ID NO: 376621 - RNA, 15 nt, Bordetella pertussis
gccagccaggugcua

SEQ ID NO: 376622 - RNA, 21 nt, Bordetella pertussis
gccagccaggcgguggccucg

SEQ ID NO: 376623 - RNA, 15 nt, Bordetella pertussis
gccagccauugccgc

SEQ ID NO: 376624 - RNA, 17 nt, Bordetella pertussis
gccagccauugccgcac

SEQ ID NO: 376625 - RNA, 18 nt, Bordetella pertussis
gccagccauugccgcacg

SEQ ID NO: 376626 - RNA, 19 nt, Bordetella pertussis
gccagccauugccgcacga

SEQ ID NO: 376627 - RNA, 21 nt, Bordetella pertussis
gccagcccacaagccguacag

SEQ ID NO: 376628 - RNA, 15 nt, Bordetella pertussis
gccagcccaccagcg

SEQ ID NO: 376629 - RNA, 18 nt, Bordetella pertussis
gccagcccaccagcgcca

SEQ ID NO: 376630 - RNA, 21 nt, Bordetella pertussis
gccagcccaccagcgccacgc

SEQ ID NO: 376631 - RNA, 21 nt, Bordetella pertussis
gccagccccaccuugcccagc

SEQ ID NO: 376632 - RNA, 22 nt, Bordetella pertussis
gccagccccaccuugcccagca

SEQ ID NO: 376633 - RNA, 13 nt, Bordetella pertussis
gccagccgccgcg

SEQ ID NO: 376634 - RNA, 14 nt, Bordetella pertussis
gccagccccggcgc

SEQ ID NO: 376635 - RNA, 18 nt, Bordetella pertussis
gccagccgcuggcgauca

SEQ ID NO: 376636 - RNA, 24 nt, Bordetella pertussis
gccagccgcuggcgaucaggccgc

SEQ ID NO: 376637 - RNA, 16 nt, Bordetella pertussis
gccagccgcuggcgcg

SEQ ID NO: 376638 - RNA, 17 nt, Bordetella pertussis
gccagccgcuggcgcgc

SEQ ID NO: 376639 - RNA, 22 nt, Bordetella pertussis
gccagccgcuggcgcgccgccu

SEQ ID NO: 376640 - RNA, 18 nt, Bordetella pertussis
gccagccgcuugcggcca

SEQ ID NO: 376641 - RNA, 20 nt, Bordetella pertussis
gccagccgcuugcggccagg

SEQ ID NO: 376642 - RNA, 14 nt, Bordetella pertussis
gccagccggcccag

SEQ ID NO: 376643 - RNA, 16 nt, Bordetella pertussis
gccagccggcccagca

SEQ ID NO: 376644 - RNA, 13 nt, Bordetella pertussis
gccagccggcccg

SEQ ID NO: 376645 - RNA, 16 nt, Bordetella pertussis
gccagccggcccgaca

SEQ ID NO: 376646 - RNA, 18 nt, Bordetella pertussis
gccagccggcccgacacc

SEQ ID NO: 376647 - RNA, 22 nt, Bordetella pertussis
gccagccggcccgacaccugga

SEQ ID NO: 376648 - RNA, 13 nt, Bordetella pertussis
gccagccgcucca

SEQ ID NO: 376649 - RNA, 13 nt, Bordetella pertussis
gccagccugcccg

SEQ ID NO: 376650 - RNA, 14 nt, Bordetella pertussis
gccagccugcccgu

SEQ ID NO: 376651 - RNA, 15 nt, Bordetella pertussis
gccagccuggcgcca

SEQ ID NO: 376652 - RNA, 17 nt, Bordetella pertussis
gccagccuggcgccaac

SEQ ID NO: 376653 - RNA, 16 nt, Bordetella pertussis
gccagccugugcgcca

SEQ ID NO: 376654 - RNA, 18 nt, Bordetella pertussis
gccagcgccgcgcgcgug

SEQ ID NO: 376655 - RNA, 17 nt, Bordetella pertussis
gccagcgccgcggccgg

SEQ ID NO: 376656 - RNA, 23 nt, Bordetella pertussis
gccagcgccgcggccggcggcgc

SEQ ID NO: 376657 - RNA, 14 nt, Bordetella pertussis
gccagcgccgcggu

SEQ ID NO: 376658 - RNA, 17 nt, Bordetella pertussis
gccagcgccgcggugau

SEQ ID NO: 376659 - RNA, 16 nt, Bordetella pertussis
gccagcgccgcgcgcg

SEQ ID NO: 376660 - RNA, 13 nt, Bordetella pertussis
gccagcgccgggg

SEQ ID NO: 376661 - RNA, 22 nt, Bordetella pertussis
gccagcgccggcgcgcgcugau

SEQ ID NO: 376662 - RNA, 22 nt, Bordetella pertussis
gccagcgccggcgcguccacgc

SEQ ID NO: 376663 - RNA, 23 nt, Bordetella pertussis
gccagcgccuccaucagcagcac

SEQ ID NO: 376664 - RNA, 14 nt, Bordetella pertussis
gccagcgccugcgc

SEQ ID NO: 376665 - RNA, 19 nt, Bordetella pertussis
gccagcgccugcgcggccu

SEQ ID NO: 376666 - RNA, 13 nt, Bordetella pertussis
gccagcgccugga

SEQ ID NO: 376667 - RNA, 18 nt, Bordetella pertussis
gccagcgccuggaccugg

SEQ ID NO: 376668 - RNA, 13 nt, Bordetella pertussis
gccagcgccuggg

SEQ ID NO: 376669 - RNA, 15 nt, Bordetella pertussis
gccagcgccugggcg

SEQ ID NO: 376670 - RNA, 20 nt, Bordetella pertussis
gccagcgccugggcgcggau

SEQ ID NO: 376671 - RNA, 22 nt, Bordetella pertussis
gccagcgccugggucaggucgg

SEQ ID NO: 376672 - RNA, 23 nt, Bordetella pertussis
gccagcgcgaaaacccgcggcag

SEQ ID NO: 376673 - RNA, 13 nt, Bordetella pertussis
gccagcgcgacgg

SEQ ID NO: 376674 - RNA, 19 nt, Bordetella pertussis
gccagcgcggcggcagcgc

SEQ ID NO: 376675 - RNA, 19 nt, Bordetella pertussis
gccagcgccucgucgcgca

SEQ ID NO: 376676 - RNA, 22 nt, Bordetella pertussis
gccagcgcgucgcguagcgcgg

SEQ ID NO: 376677 - RNA, 22 nt, Bordetella pertussis
gccagcgcgguugacugcagcc

SEQ ID NO: 376678 - RNA, 18 nt, Bordetella pertussis
gccagcgcuguccaggcc

SEQ ID NO: 376679 - RNA, 20 nt, Bordetella pertussis
gccagcgcuguccaggccgg

SEQ ID NO: 376680 - RNA, 22 nt, Bordetella pertussis
gccagcggaugaugcggcgcca

SEQ ID NO: 376681 - RNA, 15 nt, Bordetella pertussis
gccagcggauggugc

SEQ ID NO: 376682 - RNA, 14 nt, Bordetella pertussis
gccagcggcagcgc

SEQ ID NO: 376683 - RNA, 18 nt, Bordetella pertussis
gccagcggcagcgcgcag

SEQ ID NO: 376684 - RNA, 22 nt, Bordetella pertussis
gccagcggcagcgcgcaggaca

SEQ ID NO: 376685 - RNA, 15 nt, Bordetella pertussis
gccagcggcaggccc

SEQ ID NO: 376686 - RNA, 17 nt, Bordetella pertussis
gccagcggcaggcccag

SEQ ID NO: 376687 - RNA, 21 nt, Bordetella pertussis
gccagcggcgacugccccagc

SEQ ID NO: 376688 - RNA, 22 nt, Bordetella pertussis
gccagcggcgacugccccagcg

SEQ ID NO: 376689 - RNA, 14 nt, Bordetella pertussis
gccagcggcgagca

SEQ ID NO: 376690 - RNA, 14 nt, Bordetella pertussis
gccagcggcgcagc

SEQ ID NO: 376691 - RNA, 15 nt, Bordetella pertussis
gccagcggcgcagcc

SEQ ID NO: 376692 - RNA, 16 nt, Bordetella pertussis
gccagcggcgcagccg

SEQ ID NO: 376693 - RNA, 17 nt, Bordetella pertussis
gccagcggcgcagccgg

SEQ ID NO: 376694 - RNA, 12 nt, Bordetella pertussis
gccagcggcgca

SEQ ID NO: 376695 - RNA, 13 nt, Bordetella pertussis
gccagcgucaggc

SEQ ID NO: 376696 - RNA, 17 nt, Bordetella pertussis
gccagcguaucgccgcc

SEQ ID NO: 376697 - RNA, 22 nt, Bordetella pertussis
gccagcguaucgccgccgccgg

SEQ ID NO: 376698 - RNA, 16 nt, Bordetella pertussis
gccagcgugcccagcg

SEQ ID NO: 376699 - RNA, 14 nt, Bordetella pertussis
gccagcgugccggu

SEQ ID NO: 376700 - RNA, 15 nt, Bordetella pertussis
gccagcgugccggug

SEQ ID NO: 376701 - RNA, 23 nt, Bordetella pertussis
gccagcgugccggugacgacgcg

SEQ ID NO: 376702 - RNA, 15 nt, Bordetella pertussis
gccagcucgcgcagc

SEQ ID NO: 376703 - RNA, 21 nt, Bordetella pertussis
gccagcucgcgcagcaggccg

SEQ ID NO: 376704 - RNA, 21 nt, Bordetella pertussis
gccagcucgcguugcaccgcg

SEQ ID NO: 376705 - RNA, 19 nt, Bordetella pertussis
gccagcucggccaaggcau

SEQ ID NO: 376706 - RNA, 20 nt, Bordetella pertussis
gccagcucggcggccgccug

SEQ ID NO: 376707 - RNA, 16 nt, Bordetella pertussis
gccagcucggccugcg

SEQ ID NO: 376708 - RNA, 21 nt, Bordetella pertussis
gccagcucggccugcggcucg

SEQ ID NO: 376709 - RNA, 21 nt, Bordetella pertussis
gccagcucuuccgagauggcc

SEQ ID NO: 376710 - RNA, 13 nt, Bordetella pertussis
gccaggaucgcgg

SEQ ID NO: 376711 - RNA, 19 nt, Bordetella pertussis
gccaggaucgcggccagcc

SEQ ID NO: 376712 - RNA, 12 nt, Bordetella pertussis
gccaggauggcc

SEQ ID NO: 376713 - RNA, 14 nt, Bordetella pertussis
gccaggauggccac

SEQ ID NO: 376714 - RNA, 18 nt, Bordetella pertussis
gccaggauggccacgacc

SEQ ID NO: 376715 - RNA, 19 nt, Bordetella pertussis
gccaggauggccacgacca

SEQ ID NO: 376716 - RNA, 16 nt, Bordetella pertussis
gccaggcaaaggccca

SEQ ID NO: 376717 - RNA, 19 nt, Bordetella pertussis
gccaggcaaaggcccaggc

SEQ ID NO: 376718 - RNA, 20 nt, Bordetella pertussis
gccaggcaaaggcccaggca

SEQ ID NO: 376719 - RNA, 17 nt, Bordetella pertussis
gccaggauuucauggca

SEQ ID NO: 376720 - RNA, 21 nt, Bordetella pertussis
gccaggcaaucgaugaucacg

SEQ ID NO: 376721 - RNA, 22 nt, Bordetella pertussis
gccaggcauugaagcuggcgcc

SEQ ID NO: 376722 - RNA, 12 nt, Bordetella pertussis
gccaggccagca

SEQ ID NO: 376723 - RNA, 13 nt, Bordetella pertussis
gccaggccagcgc

SEQ ID NO: 376724 - RNA, 15 nt, Bordetella pertussis
gccaggccagcgcca

SEQ ID NO: 376725 - RNA, 14 nt, Bordetella pertussis
gccaggccauggcg

SEQ ID NO: 376726 - RNA, 15 nt, Bordetella pertussis
gccaggccauggcgc

SEQ ID NO: 376727 - RNA, 17 nt, Bordetella pertussis
gccaggccauggcgcga

SEQ ID NO: 376728 - RNA, 18 nt, Bordetella pertussis
gccaggccauggcgcgau

SEQ ID NO: 376729 - RNA, 15 nt, Bordetella pertussis
gccaggcccagggcc

SEQ ID NO: 376730 - RNA, 12 nt, Bordetella pertussis
gccaggccccgc

SEQ ID NO: 376731 - RNA, 18 nt, Bordetella pertussis
gccaggccccgccgggcc

SEQ ID NO: 376732 - RNA, 15 nt, Bordetella pertussis
gccaggcccggcgcg

SEQ ID NO: 376733 - RNA, 17 nt, Bordetella pertussis
gccaggcccggcgcgca

SEQ ID NO: 376734 - RNA, 13 nt, Bordetella pertussis
gccaggcccucgc

SEQ ID NO: 376735 - RNA, 22 nt, Bordetella pertussis
gccaggcccucgcggccgucgg

SEQ ID NO: 376736 - RNA, 16 nt, Bordetella pertussis
gccaggcccugcgcgu

SEQ ID NO: 376737 - RNA, 12 nt, Bordetella pertussis
gccaggcccugu

SEQ ID NO: 376738 - RNA, 18 nt, Bordetella pertussis
gccaggcccuugauggcc

SEQ ID NO: 376739 - RNA, 19 nt, Bordetella pertussis
gccaggccgaacgcggucg

SEQ ID NO: 376740 - RNA, 20 nt, Bordetella pertussis
gccaggccgaacgcggucgc

SEQ ID NO: 376741 - RNA, 23 nt, Bordetella pertussis
gccaggccgauuucggccgccgg

SEQ ID NO: 376742 - RNA, 15 nt, Bordetella pertussis
gccaggccgcauacg

SEQ ID NO: 376743 - RNA, 24 nt, Bordetella pertussis
gccaggccgcauacgacacgucau

SEQ ID NO: 376744 - RNA, 16 nt, Bordetella pertussis
gccaggccgccgccgg

SEQ ID NO: 376745 - RNA, 18 nt, Bordetella pertussis
gccaggccgaucagcacc

SEQ ID NO: 376746 - RNA, 15 nt, Bordetella pertussis
gccaggccgcgcagg

SEQ ID NO: 376747 - RNA, 19 nt, Bordetella pertussis
gccaggccgcgcagggcau

SEQ ID NO: 376748 - RNA, 15 nt, Bordetella pertussis
gccaggccggcccag

SEQ ID NO: 376749 - RNA, 19 nt, Bordetella pertussis
gccaggccggccugcaggc

SEQ ID NO: 376750 - RNA, 22 nt, Bordetella pertussis
gccaggccggccugcaggcucu

SEQ ID NO: 376751 - RNA, 16 nt, Bordetella pertussis
gccaggccggcgcgcc

SEQ ID NO: 376752 - RNA, 16 nt, Bordetella pertussis
gccaggccggcggcga

SEQ ID NO: 376753 - RNA, 15 nt, Bordetella pertussis
gccaggccggggccg

SEQ ID NO: 376754 - RNA, 18 nt, Bordetella pertussis
gccaggccggggccgugg

SEQ ID NO: 376755 - RNA, 17 nt, Bordetella pertussis
gccaggccucggcuccg

SEQ ID NO: 376756 - RNA, 17 nt, Bordetella pertussis
gccaggccucggucgcc

SEQ ID NO: 376757 - RNA, 12 nt, Bordetella pertussis
gccaggccucgg

SEQ ID NO: 376758 - RNA, 18 nt, Bordetella pertussis
gccaggccuucgacgucc

SEQ ID NO: 376759 - RNA, 16 nt, Bordetella pertussis
gccaggcgaaccuggc

SEQ ID NO: 376760 - RNA, 20 nt, Bordetella pertussis
gccaggcgaaccuggcgggg

SEQ ID NO: 376761 - RNA, 18 nt, Bordetella pertussis
gccaggcgccagaugcgc

SEQ ID NO: 376762 - RNA, 14 nt, Bordetella pertussis
gccaggcgccagcg

SEQ ID NO: 376763 - RNA, 15 nt, Bordetella pertussis
gccaggcgccagcgg

SEQ ID NO: 376764 - RNA, 13 nt, Bordetella pertussis
gccaggcgcccca

SEQ ID NO: 376765 - RNA, 15 nt, Bordetella pertussis
gccaggcgcccggcg

SEQ ID NO: 376766 - RNA, 12 nt, Bordetella pertussis
gccaggcgccgc

SEQ ID NO: 376767 - RNA, 13 nt, Bordetella pertussis
gccaggcgccgcg

SEQ ID NO: 376768 - RNA, 17 nt, Bordetella pertussis
gccaggcgccgcguccg

SEQ ID NO: 376769 - RNA, 15 nt, Bordetella pertussis
gccaggcgccgggcc

SEQ ID NO: 376770 - RNA, 14 nt, Bordetella pertussis
gccaggcgcgaucg

SEQ ID NO: 376771 - RNA, 12 nt, Bordetella pertussis
gccaggcgcgca

SEQ ID NO: 376772 - RNA, 15 nt, Bordetella pertussis
gccaggcgcgccgcg

SEQ ID NO: 376773 - RNA, 14 nt, Bordetella pertussis
gccaggcgcucagc

SEQ ID NO: 376774 - RNA, 16 nt, Bordetella pertussis
gccaggcgcuccagca

SEQ ID NO: 376775 - RNA, 18 nt, Bordetella pertussis
gccaggcgcuccagcacc

SEQ ID NO: 376776 - RNA, 12 nt, Bordetella pertussis
gccaggcgcugc

SEQ ID NO: 376777 - RNA, 17 nt, Bordetella pertussis
gccaggcgguggccucg

SEQ ID NO: 376778 - RNA, 17 nt, Bordetella pertussis
gccaggcguugaccugg

SEQ ID NO: 376779 - RNA, 14 nt, Bordetella pertussis
gccaggcucagcag

SEQ ID NO: 376780 - RNA, 15 nt, Bordetella pertussis
gccaggcucagcagg

SEQ ID NO: 376781 - RNA, 23 nt, Bordetella pertussis
gccaggcucuuuuucgagccgca

SEQ ID NO: 376782 - RNA, 18 nt, Bordetella pertussis
gccaggcugaccagcgcg

SEQ ID NO: 376783 - RNA, 22 nt, Bordetella pertussis
gccaggcugaccagcgcgucgc

SEQ ID NO: 376784 - RNA, 22 nt, Bordetella pertussis
gccagggaaucacccgauacga

SEQ ID NO: 376785 - RNA, 17 nt, Bordetella pertussis
gccagggaggaacuggg

SEQ ID NO: 376786 - RNA, 15 nt, Bordetella pertussis
gccagggcagggcgc

SEQ ID NO: 376787 - RNA, 13 nt, Bordetella pertussis
gccagggccacgc

SEQ ID NO: 376788 - RNA, 17 nt, Bordetella pertussis
gccagggccacgccggc

SEQ ID NO: 376789 - RNA, 19 nt, Bordetella pertussis
gccagggccacgccggccg

SEQ ID NO: 376790 - RNA, 18 nt, Bordetella pertussis
gccagggccauguggcgc

SEQ ID NO: 376791 - RNA, 20 nt, Bordetella pertussis
gccagggccauguggcgcag

SEQ ID NO: 376792 - RNA, 17 nt, Bordetella pertussis
gccagggccgccgcgcc

SEQ ID NO: 376793 - RNA, 18 nt, Bordetella pertussis
gccagggccgccgcgccc

SEQ ID NO: 376794 - RNA, 19 nt, Bordetella pertussis
gccagggccgccgcgccca

SEQ ID NO: 376795 - RNA, 12 nt, Bordetella pertussis
gccagggccucg

SEQ ID NO: 376796 - RNA, 13 nt, Bordetella pertussis
gccagggccucgc

SEQ ID NO: 376797 - RNA, 18 nt, Bordetella pertussis
gccagggccugcgggccg

SEQ ID NO: 376798 - RNA, 22 nt, Bordetella pertussis
gccagggcgaugaccggcaagc

SEQ ID NO: 376799 - RNA, 23 nt, Bordetella pertussis
gccagggcgaugaccggcaagcg

SEQ ID NO: 376800 - RNA, 21 nt, Bordetella pertussis
gccagggcgaugcggcggccg

SEQ ID NO: 376801 - RNA, 15 nt, Bordetella pertussis
gccagggcgccgcgg

SEQ ID NO: 376802 - RNA, 13 nt, Bordetella pertussis
gccagggcggcga

SEQ ID NO: 376803 - RNA, 17 nt, Bordetella pertussis
gccaggggaugacgggc

SEQ ID NO: 376804 - RNA, 20 nt, Bordetella pertussis
gccaggggaugacgggcgag

SEQ ID NO: 376805 - RNA, 19 nt, Bordetella pertussis
gccaggggcgcuggucgau

SEQ ID NO: 376806 - RNA, 17 nt, Bordetella pertussis
gccagggugaccuggcg

SEQ ID NO: 376807 - RNA, 18 nt, Bordetella pertussis
gccagggugaccuggcgc

SEQ ID NO: 376808 - RNA, 19 nt, Bordetella pertussis
gccagggugaccuggcgcg

SEQ ID NO: 376809 - RNA, 20 nt, Bordetella pertussis
gccagggugaccuggcgcgc

SEQ ID NO: 376810 - RNA, 16 nt, Bordetella pertussis
gccagggugcaccagg

SEQ ID NO: 376811 - RNA, 18 nt, Bordetella pertussis
gccagggugcaccaggug

SEQ ID NO: 376812 - RNA, 15 nt, Bordetella pertussis
gccagggugccccgc

SEQ ID NO: 376813 - RNA, 22 nt, Bordetella pertussis
gccaggguuugcuggcgcagca

SEQ ID NO: 376814 - RNA, 15 nt, Bordetella pertussis
gccagguaagcuggc

SEQ ID NO: 376815 - RNA, 17 nt, Bordetella pertussis
gccagguaagcuggcgc

SEQ ID NO: 376816 - RNA, 14 nt, Bordetella pertussis
gccagguacaggcc

SEQ ID NO: 376817 - RNA, 19 nt, Bordetella pertussis
gccagguacaggccgccgg

SEQ ID NO: 376818 - RNA, 20 nt, Bordetella pertussis
gccagguacaggccgccggu

SEQ ID NO: 376819 - RNA, 16 nt, Bordetella pertussis
gccagguagcgggugg

SEQ ID NO: 376820 - RNA, 14 nt, Bordetella pertussis
gccagguaggccgg

SEQ ID NO: 376821 - RNA, 18 nt, Bordetella pertussis
gccagguaggccggcgcg

SEQ ID NO: 376822 - RNA, 21 nt, Bordetella pertussis
gccagguaggccggcgcgacc

SEQ ID NO: 376823 - RNA, 22 nt, Bordetella pertussis
gccagguagucgucgaaggcgc

SEQ ID NO: 376824 - RNA, 21 nt, Bordetella pertussis
gccagguauugcucggcgguc

SEQ ID NO: 376825 - RNA, 22 nt, Bordetella pertussis
gccagguccacauccgcgcugc

SEQ ID NO: 376826 - RNA, 15 nt, Bordetella pertussis
gccaggucgcgcacc

SEQ ID NO: 376827 - RNA, 21 nt, Bordetella pertussis
gccaggucgcgcaccaggucg

SEQ ID NO: 376828 - RNA, 14 nt, Bordetella pertussis
gccaggucgcgcau

SEQ ID NO: 376829 - RNA, 16 nt, Bordetella pertussis
gccaggucgcgcauca

SEQ ID NO: 376830 - RNA, 15 nt, Bordetella pertussis
gccaggucggccacc

SEQ ID NO: 376831 - RNA, 20 nt, Bordetella pertussis
gccaggucggccagccggcc

SEQ ID NO: 376832 - RNA, 16 nt, Bordetella pertussis
gccaggucggcggcca

SEQ ID NO: 376833 - RNA, 21 nt, Bordetella pertussis
gccaggucggcggccagcgcg

SEQ ID NO: 376834 - RNA, 13 nt, Bordetella pertussis
gccaggucggcgu

SEQ ID NO: 376835 - RNA, 15 nt, Bordetella pertussis
gccaggugcacagcg

SEQ ID NO: 376836 - RNA, 12 nt, Bordetella pertussis
gccaggugcgcc

SEQ ID NO: 376837 - RNA, 23 nt, Bordetella pertussis
gccagguggcgaugccgggcacg

SEQ ID NO: 376838 - RNA, 17 nt, Bordetella pertussis
gccagguggcggcggca

SEQ ID NO: 376839 - RNA, 16 nt, Bordetella pertussis
gccagguguaggccag

SEQ ID NO: 376840 - RNA, 12 nt, Bordetella pertussis
gccagguucgcc

SEQ ID NO: 376841 - RNA, 17 nt, Bordetella pertussis
gccagguucgccuggcg

SEQ ID NO: 376842 - RNA, 16 nt, Bordetella pertussis
gccaguagcgccggcu

SEQ ID NO: 376843 - RNA, 16 nt, Bordetella pertussis
gccaguaggcgcccca

SEQ ID NO: 376844 - RNA, 16 nt, Bordetella pertussis
gccaguccauccagcg

SEQ ID NO: 376845 - RNA, 15 nt, Bordetella pertussis
gccagucccccgcgg

SEQ ID NO: 376846 - RNA, 21 nt, Bordetella pertussis
gccagucccccgcggggacag

SEQ ID NO: 376847 - RNA, 16 nt, Bordetella pertussis
gccaguccccgcaggg

SEQ ID NO: 376848 - RNA, 22 nt, Bordetella pertussis
gccaguccccgcagggacaggc

SEQ ID NO: 376849 - RNA, 14 nt, Bordetella pertussis
gccaguccccgcgg

SEQ ID NO: 376850 - RNA, 19 nt, Bordetella pertussis
gccaguccccgcggggaca

SEQ ID NO: 376851 - RNA, 22 nt, Bordetella pertussis
gccaguccccgcggggacaggc

SEQ ID NO: 376852 - RNA, 22 nt, Bordetella pertussis
gccaguccccguucggggacag

SEQ ID NO: 376853 - RNA, 16 nt, Bordetella pertussis
gccaguccccugcggg

SEQ ID NO: 376854 - RNA, 17 nt, Bordetella pertussis
gccaguccccugcgggg

SEQ ID NO: 376855 - RNA, 21 nt, Bordetella pertussis
gccaguccccugcggggacag

SEQ ID NO: 376856 - RNA, 17 nt, Bordetella pertussis
gccaguccagcgcgccg

SEQ ID NO: 376857 - RNA, 18 nt, Bordetella pertussis
gccaguccagcgcgccgc

SEQ ID NO: 376858 - RNA, 19 nt, Bordetella pertussis
gccaguccgcagcgcagcg

SEQ ID NO: 376859 - RNA, 18 nt, Bordetella pertussis
gccauagcguucgguggc

SEQ ID NO: 376860 - RNA, 14 nt, Bordetella pertussis
gccauaggcgcgca

SEQ ID NO: 376861 - RNA, 16 nt, Bordetella pertussis
gccauaggcgcgcacc

SEQ ID NO: 376862 - RNA, 17 nt, Bordetella pertussis
gccauaggcgcgcacca

SEQ ID NO: 376863 - RNA, 19 nt, Bordetella pertussis
gccauaggcgcgcaccagc

SEQ ID NO: 376864 - RNA, 14 nt, Bordetella pertussis
gccauagucgcgca

SEQ ID NO: 376865 - RNA, 15 nt, Bordetella pertussis
gccauagcugcgcca

SEQ ID NO: 376866 - RNA, 18 nt, Bordetella pertussis
gccaucacaucgcuaugc

SEQ ID NO: 376867 - RNA, 19 nt, Bordetella pertussis
gccaucaggugcaggguug

SEQ ID NO: 376868 - RNA, 20 nt, Bordetella pertussis
gccaucauccuggucgacgc

SEQ ID NO: 376869 - RNA, 21 nt, Bordetella pertussis
gccaucauccuggucgacgcg

SEQ ID NO: 376870 - RNA, 21 nt, Bordetella pertussis
gccaucauggcgucggccacg

SEQ ID NO: 376871 - RNA, 14 nt, Bordetella pertussis
gccauccagccagg

SEQ ID NO: 376872 - RNA, 16 nt, Bordetella pertussis
gccauccagccaggcc

SEQ ID NO: 376873 - RNA, 15 nt, Bordetella pertussis
gccaucgccauggcc

SEQ ID NO: 376874 - RNA, 17 nt, Bordetella pertussis
gccaucgccauggccac

SEQ ID NO: 376875 - RNA, 19 nt, Bordetella pertussis
gccaucgccgccgccgggc

SEQ ID NO: 376876 - RNA, 13 nt, Bordetella pertussis
gccaucgccgcca

SEQ ID NO: 376877 - RNA, 15 nt, Bordetella pertussis
gccaucgccgccacg

SEQ ID NO: 376878 - RNA, 12 nt, Bordetella pertussis
gccaucgcgcau

SEQ ID NO: 376879 - RNA, 21 nt, Bordetella pertussis
gccaucgcgguccugaccggc

SEQ ID NO: 376880 - RNA, 19 nt, Bordetella pertussis
gccaucgcggucgaugacc

SEQ ID NO: 376881 - RNA, 16 nt, Bordetella pertussis
gccaucgcugguaugc

SEQ ID NO: 376882 - RNA, 13 nt, Bordetella pertussis
gccaucggcgcca

SEQ ID NO: 376883 - RNA, 21 nt, Bordetella pertussis
gccaucggcgccaagcggcag

SEQ ID NO: 376884 - RNA, 12 nt, Bordetella pertussis
gccaucggccgg

SEQ ID NO: 376885 - RNA, 18 nt, Bordetella pertussis
gccaucuugcaggcgcca

SEQ ID NO: 376886 - RNA, 21 nt, Bordetella pertussis
gccaucuuggugcgcgccagg

SEQ ID NO: 376887 - RNA, 19 nt, Bordetella pertussis
gccaugaacgcuugacggc

SEQ ID NO: 376888 - RNA, 21 nt, Bordetella pertussis
gccaugaacgcuugacggcca

SEQ ID NO: 376889 - RNA, 20 nt, Bordetella pertussis
gccaugagcgcuugacggcc

SEQ ID NO: 376890 - RNA, 23 nt, Bordetella pertussis
gccaugagcgcuugacggccaag

SEQ ID NO: 376891 - RNA, 14 nt, Bordetella pertussis
gccaugacgcuggu

SEQ ID NO: 376892 - RNA, 16 nt, Bordetella pertussis
gccaugaucaggccga

SEQ ID NO: 376893 - RNA, 19 nt, Bordetella pertussis
gccaugaucaggccgaacu

SEQ ID NO: 376894 - RNA, 22 nt, Bordetella pertussis
gccaugaucaggccgaacuggg

SEQ ID NO: 376895 - RNA, 13 nt, Bordetella pertussis
gccauggcggccg

SEQ ID NO: 376896 - RNA, 13 nt, Bordetella pertussis
gccauggcggcgc

SEQ ID NO: 376897 - RNA, 16 nt, Bordetella pertussis
gccauggcggcggcca

SEQ ID NO: 376898 - RNA, 18 nt, Bordetella pertussis
gccauggcggcggccacg

SEQ ID NO: 376899 - RNA, 19 nt, Bordetella pertussis
gccauggcggcggccacga

SEQ ID NO: 376900 - RNA, 21 nt, Bordetella pertussis
gccauggcggcggccacgacc

SEQ ID NO: 376901 - RNA, 14 nt, Bordetella pertussis
gccauggcggcgcc

SEQ ID NO: 376902 - RNA, 15 nt, Bordetella pertussis
gccauggcggcgccc

SEQ ID NO: 376903 - RNA, 15 nt, Bordetella pertussis
gccauggucgcgacc

SEQ ID NO: 376904 - RNA, 22 nt, Bordetella pertussis
gccauggucucccccucggccu

SEQ ID NO: 376905 - RNA, 13 nt, Bordetella pertussis
gccauggugccgc

SEQ ID NO: 376906 - RNA, 13 nt, Bordetella pertussis
gccauguccuggc

SEQ ID NO: 376907 - RNA, 21 nt, Bordetella pertussis
gccauguccuggcaggccgcu

SEQ ID NO: 376908 - RNA, 20 nt, Bordetella pertussis
gccaugucgacgaucucgcg

SEQ ID NO: 376909 - RNA, 13 nt, Bordetella pertussis
gccaugugcgcca

SEQ ID NO: 376910 - RNA, 14 nt, Bordetella pertussis
gccaugugcgccgc

SEQ ID NO: 376911 - RNA, 18 nt, Bordetella pertussis
gccaugugcgccgcgccg

SEQ ID NO: 376912 - RNA, 19 nt, Bordetella pertussis
gccaugugcgccgcgccgu

SEQ ID NO: 376913 - RNA, 17 nt, Bordetella pertussis
gccauguggcgacgccc

SEQ ID NO: 376914 - RNA, 18 nt, Bordetella pertussis
gccauguggcgacgccca

SEQ ID NO: 376915 - RNA, 21 nt, Bordetella pertussis
gccauguggcgacgcccagcc

SEQ ID NO: 376916 - RNA, 16 nt, Bordetella pertussis
gccauguggcgcagcg

SEQ ID NO: 376917 - RNA, 16 nt, Bordetella pertussis
gccauguucgaccagg

SEQ ID NO: 376918 - RNA, 21 nt, Bordetella pertussis
gccauguucuucaggcuccag

SEQ ID NO: 376919 - RNA, 22 nt, Bordetella pertussis
gccauguucuucaggcuccagu

SEQ ID NO: 376920 - RNA, 20 nt, Bordetella pertussis
gccauucauccagcgcgcga

SEQ ID NO: 376921 - RNA, 23 nt, Bordetella pertussis
gccauuccggcuggucggggugg

SEQ ID NO: 376922 - RNA, 21 nt, Bordetella pertussis
gccauucgauggcggcgcugg

SEQ ID NO: 376923 - RNA, 22 nt, Bordetella pertussis
gccauucgauggcggcgcuggc

SEQ ID NO: 376924 - RNA, 20 nt, Bordetella pertussis
gccauucuucgccgaugcgc

SEQ ID NO: 376925 - RNA, 17 nt, Bordetella pertussis
gccauugcacgcgcagg

SEQ ID NO: 376926 - RNA, 17 nt, Bordetella pertussis
gccauugcccacagcac

SEQ ID NO: 376927 - RNA, 23 nt, Bordetella pertussis
gccauugcgccguugcgggcugc

SEQ ID NO: 376928 - RNA, 14 nt, Bordetella pertussis
gccauugcgcggcc

SEQ ID NO: 376929 - RNA, 23 nt, Bordetella pertussis
gccauugcgcggccugcuccggc

SEQ ID NO: 376930 - RNA, 15 nt, Bordetella pertussis
gccauugccacggcg

SEQ ID NO: 376931 - RNA, 23 nt, Bordetella pertussis
gccauuggugcgcacaucgcccg

SEQ ID NO: 376932 - RNA, 12 nt, Bordetella pertussis
gcccaacgcggc

SEQ ID NO: 376933 - RNA, 13 nt, Bordetella pertussis
gcccaacgcggcg

SEQ ID NO: 376934 - RNA, 11 nt, Bordetella pertussis
gcccaagcccg

SEQ ID NO: 376935 - RNA, 22 nt, Bordetella pertussis
gcccaaugucaccgacgccagc

SEQ ID NO: 376936 - RNA, 16 nt, Bordetella pertussis
gcccaccaccagcggc

SEQ ID NO: 376937 - RNA, 17 nt, Bordetella pertussis
gcccaccaccagcggcg

SEQ ID NO: 376938 - RNA, 17 nt, Bordetella pertussis
gcccaccagcgccacgc

SEQ ID NO: 376939 - RNA, 20 nt, Bordetella pertussis
gcccaccagcgccacgccgg

SEQ ID NO: 376940 - RNA, 14 nt, Bordetella pertussis
gcccaccagccggg

SEQ ID NO: 376941 - RNA, 15 nt, Bordetella pertussis
gcccaccagccgggc

SEQ ID NO: 376942 - RNA, 16 nt, Bordetella pertussis
gcccaccagccgggcg

SEQ ID NO: 376943 - RNA, 22 nt, Bordetella pertussis
gcccaccagccgggcggccacg

SEQ ID NO: 376944 - RNA, 22 nt, Bordetella pertussis
gcccaccagggaccaauacgcc

SEQ ID NO: 376945 - RNA, 16 nt, Bordetella pertussis
gcccaccagggugccg

SEQ ID NO: 376946 - RNA, 18 nt, Bordetella pertussis
gcccaccaugagcacgcc

SEQ ID NO: 376947 - RNA, 15 nt, Bordetella pertussis
gcccagcgagcuggu

SEQ ID NO: 376948 - RNA, 14 nt, Bordetella pertussis
gcccagcgccagca

SEQ ID NO: 376949 - RNA, 17 nt, Bordetella pertussis
gcccagcgccagcagca

SEQ ID NO: 376950 - RNA, 14 nt, Bordetella pertussis
gcccagcgccaggg

SEQ ID NO: 376951 - RNA, 16 nt, Bordetella pertussis
gcccagcgccagggcc

SEQ ID NO: 376952 - RNA, 22 nt, Bordetella pertussis
gcccagcgccaucaagagcacc

SEQ ID NO: 376953 - RNA, 14 nt, Bordetella pertussis
gcccagcgccgccg

SEQ ID NO: 376954 - RNA, 16 nt, Bordetella pertussis
gcccagcgccggcacg

SEQ ID NO: 376955 - RNA, 23 nt, Bordetella pertussis
gcccagcgccggcacgcugaucg

SEQ ID NO: 376956 - RNA, 13 nt, Bordetella pertussis
gcccagcgcgccg

SEQ ID NO: 376957 - RNA, 17 nt, Bordetella pertussis
gcccagcgcgaugucgc

SEQ ID NO: 376958 - RNA, 20 nt, Bordetella pertussis
gcccagcgcgaugucgccca

SEQ ID NO: 376959 - RNA, 23 nt, Bordetella pertussis
gcccagcgcgaugucgcccaugc

SEQ ID NO: 376960 - RNA, 13 nt, Bordetella pertussis
gcccagcgcggcc

SEQ ID NO: 376961 - RNA, 14 nt, Bordetella pertussis
gcccagcgcgucgg

SEQ ID NO: 376962 - RNA, 19 nt, Bordetella pertussis
gcccagcgcgugggccagc

SEQ ID NO: 376963 - RNA, 19 nt, Bordetella pertussis
gcccagcgcuugcacgcca

SEQ ID NO: 376964 - RNA, 17 nt, Bordetella pertussis
gcccagcggaauggggc

SEQ ID NO: 376965 - RNA, 20 nt, Bordetella pertussis
gcccagcggcaggcuggccg

SEQ ID NO: 376966 - RNA, 15 nt, Bordetella pertussis
gcccagcggcgccga

SEQ ID NO: 376967 - RNA, 18 nt, Bordetella pertussis
gcccagcggcgccgacca

SEQ ID NO: 376968 - RNA, 21 nt, Bordetella pertussis
gcccagcuggcaccgcgacga

SEQ ID NO: 376969 - RNA, 17 nt, Bordetella pertussis
gcccagcuggcgccccu

SEQ ID NO: 376970 - RNA, 17 nt, Bordetella pertussis
gcccagcugggcggcgu

SEQ ID NO: 376971 - RNA, 18 nt, Bordetella pertussis
gcccagcugggcggcgug

SEQ ID NO: 376972 - RNA, 21 nt, Bordetella pertussis
gcccagcuguccaagcgcgug

SEQ ID NO: 376973 - RNA, 17 nt, Bordetella pertussis
gcccagcuugaugccgc

SEQ ID NO: 376974 - RNA, 15 nt, Bordetella pertussis
gcccaggaaaccggc

SEQ ID NO: 376975 - RNA, 14 nt, Bordetella pertussis
gcccaggaugcccu

SEQ ID NO: 376976 - RNA, 14 nt, Bordetella pertussis
gcccaggauggcgc

SEQ ID NO: 376977 - RNA, 12 nt, Bordetella pertussis
gcccaggccagc

SEQ ID NO: 376978 - RNA, 14 nt, Bordetella pertussis
gcccaggccagcca

SEQ ID NO: 376979 - RNA, 17 nt, Bordetella pertussis
gcccaggccagcgccgc

SEQ ID NO: 376980 - RNA, 21 nt, Bordetella pertussis
gcccaggccagcgccgcggcc

SEQ ID NO: 376981 - RNA, 16 nt, Bordetella pertussis
gcccaggcccaccgca

SEQ ID NO: 376982 - RNA, 17 nt, Bordetella pertussis
gcccaggcccaccgcau

SEQ ID NO: 376983 - RNA, 16 nt, Bordetella pertussis
gcccaggcccacgccg

SEQ ID NO: 376984 - RNA, 18 nt, Bordetella pertussis
gcccaggcccacgccgcg

SEQ ID NO: 376985 - RNA, 12 nt, Bordetella pertussis
gcccaggcccag

SEQ ID NO: 376986 - RNA, 13 nt, Bordetella pertussis
gcccaggcccagc

SEQ ID NO: 376987 - RNA, 14 nt, Bordetella pertussis
gcccaggcccagca

SEQ ID NO: 376988 - RNA, 15 nt, Bordetella pertussis
gcccaggcgcgcugg

SEQ ID NO: 376989 - RNA, 16 nt, Bordetella pertussis
gcccaggcgcgcuggc

SEQ ID NO: 376990 - RNA, 21 nt, Bordetella pertussis
gcccaggcgcgcuggcgcucg

SEQ ID NO: 376991 - RNA, 14 nt, Bordetella pertussis
gcccaggcugggcc

SEQ ID NO: 376992 - RNA, 17 nt, Bordetella pertussis
gcccaggcugggccaga

SEQ ID NO: 376993 - RNA, 16 nt, Bordetella pertussis
gcccagggcagcggcc

SEQ ID NO: 376994 - RNA, 18 nt, Bordetella pertussis
gcccagggcagcggccag

SEQ ID NO: 376995 - RNA, 19 nt, Bordetella pertussis
gcccagggcagcggccaga

SEQ ID NO: 376996 - RNA, 14 nt, Bordetella pertussis
gcccaggcgcuggu

SEQ ID NO: 376997 - RNA, 19 nt, Bordetella pertussis
gcccaggcggcccagcgug

SEQ ID NO: 376998 - RNA, 14 nt, Bordetella pertussis
gcccaggcgggcca

SEQ ID NO: 376999 - RNA, 16 nt, Bordetella pertussis
gcccagggccgcgccg

SEQ ID NO: 377000 - RNA, 13 nt, Bordetella pertussis
gcccagggcgaug

SEQ ID NO: 377001 - RNA, 16 nt, Bordetella pertussis
gcccaggcguccaggc

SEQ ID NO: 377002 - RNA, 15 nt, Bordetella pertussis
gcccaguacggccug

SEQ ID NO: 377003 - RNA, 17 nt, Bordetella pertussis
gcccaguacggccugca

SEQ ID NO: 377004 - RNA, 19 nt, Bordetella pertussis
gcccaguacggccugcaug

SEQ ID NO: 377005 - RNA, 18 nt, Bordetella pertussis
gcccaguauggugaccgg

SEQ ID NO: 377006 - RNA, 21 nt, Bordetella pertussis
gcccaguauggugaccggcgu

SEQ ID NO: 377007 - RNA, 22 nt, Bordetella pertussis
gcccaguauggugaccggcgug

SEQ ID NO: 377008 - RNA, 16 nt, Bordetella pertussis
gcccaguccagggugu

SEQ ID NO: 377009 - RNA, 20 nt, Bordetella pertussis
gcccagucccaggccgacca

SEQ ID NO: 377010 - RNA, 17 nt, Bordetella pertussis
gcccagugucucgacca

SEQ ID NO: 377011 - RNA, 17 nt, Bordetella pertussis
gcccaguuccacgcggc

SEQ ID NO: 377012 - RNA, 19 nt, Bordetella pertussis
gcccaguuccacgcggccg

SEQ ID NO: 377013 - RNA, 22 nt, Bordetella pertussis
gcccaguuccacgcggccgugg

SEQ ID NO: 377014 - RNA, 17 nt, Bordetella pertussis
gcccaguucgcgcagca

SEQ ID NO: 377015 - RNA, 21 nt, Bordetella pertussis
gcccaguucgcgcagcagcuu

SEQ ID NO: 377016 - RNA, 15 nt, Bordetella pertussis
gcccaguucgcggcc

SEQ ID NO: 377017 - RNA, 16 nt, Bordetella pertussis
gcccaguucgcggccg

SEQ ID NO: 377018 - RNA, 19 nt, Bordetella pertussis
gcccaguucgcggccggcc

SEQ ID NO: 377019 - RNA, 20 nt, Bordetella pertussis
gcccaguucgcggccggccg

SEQ ID NO: 377020 - RNA, 21 nt, Bordetella pertussis
gcccauggggugcuccugcca

SEQ ID NO: 377021 - RNA, 14 nt, Bordetella pertussis
gcccauucccgccc

SEQ ID NO: 377022 - RNA, 17 nt, Bordetella pertussis
gcccauucgcgcaccga

SEQ ID NO: 377023 - RNA, 19 nt, Bordetella pertussis
gcccauugcggcaccugcu

SEQ ID NO: 377024 - RNA, 14 nt, Bordetella pertussis
gcccauuuccgcuu

SEQ ID NO: 377025 - RNA, 16 nt, Bordetella pertussis
gcccauuucgauggcc

SEQ ID NO: 377026 - RNA, 15 nt, Bordetella pertussis
gccccaacgcggcca

SEQ ID NO: 377027 - RNA, 19 nt, Bordetella pertussis
gccccaacggccuucggcg

SEQ ID NO: 377028 - RNA, 21 nt, Bordetella pertussis
gccccaacggccuucggcggc

SEQ ID NO: 377029 - RNA, 23 nt, Bordetella pertussis
gccccaacggccuucggcggcgc

SEQ ID NO: 377030 - RNA, 14 nt, Bordetella pertussis
gccccacacgcgcg

SEQ ID NO: 377031 - RNA, 15 nt, Bordetella pertussis
gccccacacgcgcgc

SEQ ID NO: 377032 - RNA, 20 nt, Bordetella pertussis
gccccacccggguacguggc

SEQ ID NO: 377033 - RNA, 12 nt, Bordetella pertussis
gccccagcaucu

SEQ ID NO: 377034 - RNA, 14 nt, Bordetella pertussis
gccccagcgccagc

SEQ ID NO: 377035 - RNA, 15 nt, Bordetella pertussis
gccccagcgccagcg

SEQ ID NO: 377036 - RNA, 14 nt, Bordetella pertussis
gccccagcgcccag

SEQ ID NO: 377037 - RNA, 17 nt, Bordetella pertussis
gccccagcggcuggcgc

SEQ ID NO: 377038 - RNA, 14 nt, Bordetella pertussis
gccccagcguccag

SEQ ID NO: 377039 - RNA, 16 nt, Bordetella pertussis
gccccagcguccaggc

SEQ ID NO: 377040 - RNA, 20 nt, Bordetella pertussis
gccccagcguccaggcggcc

SEQ ID NO: 377041 - RNA, 21 nt, Bordetella pertussis
gccccagcguccaggcggcca

SEQ ID NO: 377042 - RNA, 17 nt, Bordetella pertussis
gccccagcuugucggcc

SEQ ID NO: 377043 - RNA, 19 nt, Bordetella pertussis
gccccagcuugucggccgc

SEQ ID NO: 377044 - RNA, 21 nt, Bordetella pertussis
gccccagcuugucggccgcgc

SEQ ID NO: 377045 - RNA, 20 nt, Bordetella pertussis
gccccaggaaaccgaccuga

SEQ ID NO: 377046 - RNA, 18 nt, Bordetella pertussis
gccccaggaugcgcaccg

SEQ ID NO: 377047 - RNA, 18 nt, Bordetella pertussis
gccccauccacggcgcca

SEQ ID NO: 377048 - RNA, 19 nt, Bordetella pertussis
gccccauccacggcgccau

SEQ ID NO: 377049 - RNA, 24 nt, Bordetella pertussis
gccccauccacggcgccaugccgg

SEQ ID NO: 377050 - RNA, 14 nt, Bordetella pertussis
gccccauccagcgg

SEQ ID NO: 377051 - RNA, 21 nt, Bordetella pertussis
gccccaucccauccgcgccac

SEQ ID NO: 377052 - RNA, 14 nt, Bordetella pertussis
gccccauugccucg

SEQ ID NO: 377053 - RNA, 17 nt, Bordetella pertussis
gccccauugccucgcgg

SEQ ID NO: 377054 - RNA, 20 nt, Bordetella pertussis
gccccauugggacgccagcc

SEQ ID NO: 377055 - RNA, 22 nt, Bordetella pertussis
gcccccacgcugcgcccgcuau

SEQ ID NO: 377056 - RNA, 16 nt, Bordetella pertussis
gcccccagcagcgagg

SEQ ID NO: 377057 - RNA, 17 nt, Bordetella pertussis
gcccccagcgccgucag

SEQ ID NO: 377058 - RNA, 23 nt, Bordetella pertussis
gcccccagcgcgccugcccaggc

SEQ ID NO: 377059 - RNA, 14 nt, Bordetella pertussis
gccccccaugccgg

SEQ ID NO: 377060 - RNA, 13 nt, Bordetella pertussis
gcccccugcgggg

SEQ ID NO: 377061 - RNA, 22 nt, Bordetella pertussis
gcccccuuguagggaaucguca

SEQ ID NO: 377062 - RNA, 14 nt, Bordetella pertussis
gccccgccucgacg

SEQ ID NO: 377063 - RNA, 15 nt, Bordetella pertussis
gccccgccugcgcca

SEQ ID NO: 377064 - RNA, 17 nt, Bordetella pertussis
gccccgccugcgccagg

SEQ ID NO: 377065 - RNA, 14 nt, Bordetella pertussis
gccccgccgggccg

SEQ ID NO: 377066 - RNA, 19 nt, Bordetella pertussis
gccccgcgaggggcccuug

SEQ ID NO: 377067 - RNA, 17 nt, Bordetella pertussis
gccccgcgucggcgaag

SEQ ID NO: 377068 - RNA, 13 nt, Bordetella pertussis
gccccgcggccgc

SEQ ID NO: 377069 - RNA, 16 nt, Bordetella pertussis
gccccgcuggccgucg

SEQ ID NO: 377070 - RNA, 22 nt, Bordetella pertussis
gccccgcuacguguccugccgg

SEQ ID NO: 377071 - RNA, 17 nt, Bordetella pertussis
gccccgcuucgggccgg

SEQ ID NO: 377072 - RNA, 18 nt, Bordetella pertussis
gccccggcaccaucgccg

SEQ ID NO: 377073 - RNA, 16 nt, Bordetella pertussis
gccccggccgcccccg

SEQ ID NO: 377074 - RNA, 16 nt, Bordetella pertussis
gccccggcgcgcagcg

SEQ ID NO: 377075 - RNA, 18 nt, Bordetella pertussis
gccccggcgcgcagcgcc

SEQ ID NO: 377076 - RNA, 21 nt, Bordetella pertussis
gccccggcgcgcagcgccugc

SEQ ID NO: 377077 - RNA, 16 nt, Bordetella pertussis
gccccggcgcgccggc

SEQ ID NO: 377078 - RNA, 14 nt, Bordetella pertussis
gccccggcgcggcg

SEQ ID NO: 377079 - RNA, 15 nt, Bordetella pertussis
gccccggcgcggcgc

SEQ ID NO: 377080 - RNA, 22 nt, Bordetella pertussis
gccccggcgcggcgcgcgccgu

SEQ ID NO: 377081 - RNA, 22 nt, Bordetella pertussis
gccccggccucccggaccagca

SEQ ID NO: 377082 - RNA, 18 nt, Bordetella pertussis
gccccggccucgcggcgc

SEQ ID NO: 377083 - RNA, 18 nt, Bordetella pertussis
gccccggcucccgcgcca

SEQ ID NO: 377084 - RNA, 19 nt, Bordetella pertussis
gccccggcucccgcgccau

SEQ ID NO: 377085 - RNA, 21 nt, Bordetella pertussis
gccccggcucccgcgccauug

SEQ ID NO: 377086 - RNA, 19 nt, Bordetella pertussis
gccccgggugcagguccgg

SEQ ID NO: 377087 - RNA, 22 nt, Bordetella pertussis
gccccgggcggguugugcccgc

SEQ ID NO: 377088 - RNA, 15 nt, Bordetella pertussis
gccccuccggcgccg

SEQ ID NO: 377089 - RNA, 16 nt, Bordetella pertussis
gccccuccggcgccgc

SEQ ID NO: 377090 - RNA, 13 nt, Bordetella pertussis
gccccuccggguc

SEQ ID NO: 377091 - RNA, 17 nt, Bordetella pertussis
gccccuguccucgcagg

SEQ ID NO: 377092 - RNA, 12 nt, Bordetella pertussis
gccccuugccca

SEQ ID NO: 377093 - RNA, 13 nt, Bordetella pertussis
gcccgaaacgcgc

SEQ ID NO: 377094 - RNA, 15 nt, Bordetella pertussis
gcccgaaacgcgcag

SEQ ID NO: 377095 - RNA, 17 nt, Bordetella pertussis
gcccgaaacgcgcagca

SEQ ID NO: 377096 - RNA, 21 nt, Bordetella pertussis
gcccgaaacgcgcagcaccgg

SEQ ID NO: 377097 - RNA, 23 nt, Bordetella pertussis
gcccgaaacgcgcagcaccggcg

SEQ ID NO: 377098 - RNA, 21 nt, Bordetella pertussis
gcccgaaagguccuggagacg

SEQ ID NO: 377099 - RNA, 20 nt, Bordetella pertussis
gcccgaagauuuccucgcgc

SEQ ID NO: 377100 - RNA, 23 nt, Bordetella pertussis
gcccgaagauuuccucgcgcacc

SEQ ID NO: 377101 - RNA, 13 nt, Bordetella pertussis
gcccgaagcgcag

SEQ ID NO: 377102 - RNA, 14 nt, Bordetella pertussis
gcccgaaggcagcg

SEQ ID NO: 377103 - RNA, 16 nt, Bordetella pertussis
gcccgaaggcagcggc

SEQ ID NO: 377104 - RNA, 18 nt, Bordetella pertussis
gcccgaaggcagcggcac

SEQ ID NO: 377105 - RNA, 14 nt, Bordetella pertussis
gcccgaagcgcagc

SEQ ID NO: 377106 - RNA, 20 nt, Bordetella pertussis
gcccgaagcgcagcaccagg

SEQ ID NO: 377107 - RNA, 16 nt, Bordetella pertussis
gcccgacagcacgccc

SEQ ID NO: 377108 - RNA, 15 nt, Bordetella pertussis
gcccgagcggcgcca

SEQ ID NO: 377109 - RNA, 17 nt, Bordetella pertussis
gcccgagcggcgccagu

SEQ ID NO: 377110 - RNA, 19 nt, Bordetella pertussis
gcccgagcggcgccagucg

SEQ ID NO: 377111 - RNA, 22 nt, Bordetella pertussis
gcccgagcggcgccagucgcgc

SEQ ID NO: 377112 - RNA, 23 nt, Bordetella pertussis
gcccgagcggcgccagucgcgca

SEQ ID NO: 377113 - RNA, 24 nt, Bordetella pertussis
gcccgagcggcgccagucgcgcag

SEQ ID NO: 377114 - RNA, 13 nt, Bordetella pertussis
gcccgagcuggcc

SEQ ID NO: 377115 - RNA, 15 nt, Bordetella pertussis
gcccgagcuggccgg

SEQ ID NO: 377116 - RNA, 18 nt, Bordetella pertussis
gcccgagcuggccggcga

SEQ ID NO: 377117 - RNA, 16 nt, Bordetella pertussis
gcccgaggcgcgcagc

SEQ ID NO: 377118 - RNA, 16 nt, Bordetella pertussis
gcccgaucggccggcc

SEQ ID NO: 377119 - RNA, 17 nt, Bordetella pertussis
gcccgaucggccggccg

SEQ ID NO: 377120 - RNA, 13 nt, Bordetella pertussis
gcccgaugccgcc

SEQ ID NO: 377121 - RNA, 15 nt, Bordetella pertussis
gcccgaugccgccau

SEQ ID NO: 377122 - RNA, 16 nt, Bordetella pertussis
gcccgaugccgccaug

SEQ ID NO: 377123 - RNA, 17 nt, Bordetella pertussis
gcccgaugccgccaugc

SEQ ID NO: 377124 - RNA, 16 nt, Bordetella pertussis
gcccgaugccuuggug

SEQ ID NO: 377125 - RNA, 22 nt, Bordetella pertussis
gcccgaugccgauacgucgcag

SEQ ID NO: 377126 - RNA, 16 nt, Bordetella pertussis
gcccgaugcgccaggc

SEQ ID NO: 377127 - RNA, 17 nt, Bordetella pertussis
gcccgaugcgccaggcc

SEQ ID NO: 377128 - RNA, 18 nt, Bordetella pertussis
gcccgaugcgccaggccu

SEQ ID NO: 377129 - RNA, 17 nt, Bordetella pertussis
gcccgaugcucgccggc

SEQ ID NO: 377130 - RNA, 19 nt, Bordetella pertussis
gcccgaugcucgccggcgc

SEQ ID NO: 377131 - RNA, 22 nt, Bordetella pertussis
gcccgaugcucgccggcgccgc

SEQ ID NO: 377132 - RNA, 18 nt, Bordetella pertussis
gcccgcaccgcccgcaag

SEQ ID NO: 377133 - RNA, 22 nt, Bordetella pertussis
gcccgcaccgggcggcccggcg

SEQ ID NO: 377134 - RNA, 14 nt, Bordetella pertussis
gcccgcaccuugcc

SEQ ID NO: 377135 - RNA, 18 nt, Bordetella pertussis
gcccgcacgggccgacgg

SEQ ID NO: 377136 - RNA, 23 nt, Bordetella pertussis
gcccgcacgggccgacggccucg

SEQ ID NO: 377137 - RNA, 16 nt, Bordetella pertussis
gcccgcagagggagcg

SEQ ID NO: 377138 - RNA, 17 nt, Bordetella pertussis
gcccgcauggaccgccg

SEQ ID NO: 377139 - RNA, 18 nt, Bordetella pertussis
gcccgcauggaccgccgc

SEQ ID NO: 377140 - RNA, 20 nt, Bordetella pertussis
gcccgcauggaccgccgccg

SEQ ID NO: 377141 - RNA, 23 nt, Bordetella pertussis
gcccgcauggaccgccgccgucg

SEQ ID NO: 377142 - RNA, 20 nt, Bordetella pertussis
gcccgcaugucccagcgcuc

SEQ ID NO: 377143 - RNA, 22 nt, Bordetella pertussis
gcccgcaugucccagcgcucgu

SEQ ID NO: 377144 - RNA, 15 nt, Bordetella pertussis
gcccgcauguccgag

SEQ ID NO: 377145 - RNA, 15 nt, Bordetella pertussis
gcccgccaccacgcg

SEQ ID NO: 377146 - RNA, 15 nt, Bordetella pertussis
gcccgccaccacggc

SEQ ID NO: 377147 - RNA, 13 nt, Bordetella pertussis
gcccgccaccagg

SEQ ID NO: 377148 - RNA, 21 nt, Bordetella pertussis
gcccgccaccaggaacgccag

SEQ ID NO: 377149 - RNA, 23 nt, Bordetella pertussis
gcccgccaccaggaacgccagca

SEQ ID NO: 377150 - RNA, 20 nt, Bordetella pertussis
gcccgccacccagggcuuga

SEQ ID NO: 377151 - RNA, 15 nt, Bordetella pertussis
gcccgccacgcgggc

SEQ ID NO: 377152 - RNA, 19 nt, Bordetella pertussis
gcccgccacgcgggccggc

SEQ ID NO: 377153 - RNA, 19 nt, Bordetella pertussis
gcccgccacggucgcgagc

SEQ ID NO: 377154 - RNA, 18 nt, Bordetella pertussis
gcccgccagcaaggcggc

SEQ ID NO: 377155 - RNA, 19 nt, Bordetella pertussis
gcccgccagcaaggcggca

SEQ ID NO: 377156 - RNA, 15 nt, Bordetella pertussis
gcccgccagcagcuc

SEQ ID NO: 377157 - RNA, 13 nt, Bordetella pertussis
gcccgccccggcg

SEQ ID NO: 377158 - RNA, 15 nt, Bordetella pertussis
gcccgccccggcgca

SEQ ID NO: 377159 - RNA, 18 nt, Bordetella pertussis
gcccgcccgccgccugcg

SEQ ID NO: 377160 - RNA, 14 nt, Bordetella pertussis
gcccgcccgcgagc

SEQ ID NO: 377161 - RNA, 17 nt, Bordetella pertussis
gcccgcccgcgcccagc

SEQ ID NO: 377162 - RNA, 14 nt, Bordetella pertussis
gcccgcccgcugac

SEQ ID NO: 377163 - RNA, 23 nt, Bordetella pertussis
gcccgcccgcugaccggccuggu

SEQ ID NO: 377164 - RNA, 14 nt, Bordetella pertussis
gcccgcccugggca

SEQ ID NO: 377165 - RNA, 15 nt, Bordetella pertussis
gcccgcccugggcag

SEQ ID NO: 377166 - RNA, 15 nt, Bordetella pertussis
gcccgccgagucggc

SEQ ID NO: 377167 - RNA, 19 nt, Bordetella pertussis
gcccgccugccggccuggc

SEQ ID NO: 377168 - RNA, 21 nt, Bordetella pertussis
gcccgccugccggccuggcuc

SEQ ID NO: 377169 - RNA, 16 nt, Bordetella pertussis
gcccgccugcgccagc

SEQ ID NO: 377170 - RNA, 12 nt, Bordetella pertussis
gcccgccuucgc

SEQ ID NO: 377171 - RNA, 18 nt, Bordetella pertussis
gcccgccuucgcugacgc

SEQ ID NO: 377172 - RNA, 19 nt, Bordetella pertussis
gcccgccuucgcugacgcg

SEQ ID NO: 377173 - RNA, 14 nt, Bordetella pertussis
gcccgccuucggcg

SEQ ID NO: 377174 - RNA, 16 nt, Bordetella pertussis
gcccgccuucggcggc

SEQ ID NO: 377175 - RNA, 21 nt, Bordetella pertussis
gcccgccuucggcggcgggcu

SEQ ID NO: 377176 - RNA, 17 nt, Bordetella pertussis
gcccgccuggucgcugg

SEQ ID NO: 377177 - RNA, 19 nt, Bordetella pertussis
gcccgccuggucgcuggcg

SEQ ID NO: 377178 - RNA, 16 nt, Bordetella pertussis
gcccgccuucagcggg

SEQ ID NO: 377179 - RNA, 19 nt, Bordetella pertussis
gcccgccuucagcgggccg

SEQ ID NO: 377180 - RNA, 22 nt, Bordetella pertussis
gcccgccuucagcgggccggca

SEQ ID NO: 377181 - RNA, 17 nt, Bordetella pertussis
gcccgccuuugccgcug

SEQ ID NO: 377182 - RNA, 14 nt, Bordetella pertussis
gcccgcgacgcugg

SEQ ID NO: 377183 - RNA, 15 nt, Bordetella pertussis
gcccgcgacgcuggc

SEQ ID NO: 377184 - RNA, 17 nt, Bordetella pertussis
gcccgcgacgcuggcga

SEQ ID NO: 377185 - RNA, 19 nt, Bordetella pertussis
gcccgcgagcggccagccu

SEQ ID NO: 377186 - RNA, 20 nt, Bordetella pertussis
gcccgcgagcggccagccug

SEQ ID NO: 377187 - RNA, 13 nt, Bordetella pertussis
gcccgcgauaugc

SEQ ID NO: 377188 - RNA, 17 nt, Bordetella pertussis
gcccgcgcaccaggcgc

SEQ ID NO: 377189 - RNA, 19 nt, Bordetella pertussis
gcccgcgcaccaggcgcgg

SEQ ID NO: 377190 - RNA, 15 nt, Bordetella pertussis
gcccgcgcacgcccg

SEQ ID NO: 377191 - RNA, 17 nt, Bordetella pertussis
gcccgcgcacgcccgcg

SEQ ID NO: 377192 - RNA, 13 nt, Bordetella pertussis
gcccgcgccagcg

SEQ ID NO: 377193 - RNA, 21 nt, Bordetella pertussis
gcccgcgccaucgcgucgacg

SEQ ID NO: 377194 - RNA, 13 nt, Bordetella pertussis
gcccgcgccgaag

SEQ ID NO: 377195 - RNA, 13 nt, Bordetella pertussis
gcccgcgccgacg

SEQ ID NO: 377196 - RNA, 20 nt, Bordetella pertussis
gcccgcgccgacggcggcgc

SEQ ID NO: 377197 - RNA, 14 nt, Bordetella pertussis
gcccgcgccgcguc

SEQ ID NO: 377198 - RNA, 16 nt, Bordetella pertussis
gcccgcgccgcgucau

SEQ ID NO: 377199 - RNA, 15 nt, Bordetella pertussis
gcccgcgccgggguu

SEQ ID NO: 377200 - RNA, 22 nt, Bordetella pertussis
gcccgcgcgagcggcgugcgcg

SEQ ID NO: 377201 - RNA, 13 nt, Bordetella pertussis
gcccgcgccgggg

SEQ ID NO: 377202 - RNA, 13 nt, Bordetella pertussis
gcccgcgcgcacg

SEQ ID NO: 377203 - RNA, 19 nt, Bordetella pertussis
gcccgcgcgcgagcugcgc

SEQ ID NO: 377204 - RNA, 13 nt, Bordetella pertussis
gcccgcgcggcca

SEQ ID NO: 377205 - RNA, 14 nt, Bordetella pertussis
gcccgcgcggccag

SEQ ID NO: 377206 - RNA, 19 nt, Bordetella pertussis
gcccgcgcggccagcgccg

SEQ ID NO: 377207 - RNA, 21 nt, Bordetella pertussis
gcccgcgcggccagcgccggc

SEQ ID NO: 377208 - RNA, 15 nt, Bordetella pertussis
gcccgcgcuggcgca

SEQ ID NO: 377209 - RNA, 16 nt, Bordetella pertussis
gcccgcgcuggcgcag

SEQ ID NO: 377210 - RNA, 14 nt, Bordetella pertussis
gcccgcgcuguugc

SEQ ID NO: 377211 - RNA, 21 nt, Bordetella pertussis
gcccgcgcuguugcuccaggc

SEQ ID NO: 377212 - RNA, 24 nt, Bordetella pertussis
gcccgcgcuguugcuccaggccgg

SEQ ID NO: 377213 - RNA, 19 nt, Bordetella pertussis
gcccgcggaaagcuggcgu

SEQ ID NO: 377214 - RNA, 15 nt, Bordetella pertussis
gcccgcggccagcca

SEQ ID NO: 377215 - RNA, 21 nt, Bordetella pertussis
gcccgcggccagccacgccgg

SEQ ID NO: 377216 - RNA, 16 nt, Bordetella pertussis
gcccgcggcgccagcg

SEQ ID NO: 377217 - RNA, 17 nt, Bordetella pertussis
gcccgcggcgccagcgc

SEQ ID NO: 377218 - RNA, 18 nt, Bordetella pertussis
gcccgcggcgccagcgcu

SEQ ID NO: 377219 - RNA, 22 nt, Bordetella pertussis
gcccgcggcgccagcgcuucgg

SEQ ID NO: 377220 - RNA, 16 nt, Bordetella pertussis
gcccgcggcgcccagc

SEQ ID NO: 377221 - RNA, 22 nt, Bordetella pertussis
gcccgcggccugcagaccagca

SEQ ID NO: 377222 - RNA, 18 nt, Bordetella pertussis
gcccgcgggcgcccggcc

SEQ ID NO: 377223 - RNA, 20 nt, Bordetella pertussis
gcccgcgggcgcccggccgg

SEQ ID NO: 377224 - RNA, 23 nt, Bordetella pertussis
gcccgcgggugauauuggcgaac

SEQ ID NO: 377225 - RNA, 17 nt, Bordetella pertussis
gcccgcguacagcccga

SEQ ID NO: 377226 - RNA, 22 nt, Bordetella pertussis
gcccgcguacagcccgaacaga

SEQ ID NO: 377227 - RNA, 22 nt, Bordetella pertussis
gcccgcgucacgauuucggcca

SEQ ID NO: 377228 - RNA, 17 nt, Bordetella pertussis
gcccgcgucagacgcgc

SEQ ID NO: 377229 - RNA, 16 nt, Bordetella pertussis
gcccgcguccaccaag

SEQ ID NO: 377230 - RNA, 17 nt, Bordetella pertussis
gcccgcgucgcugucgg

SEQ ID NO: 377231 - RNA, 16 nt, Bordetella pertussis
gcccgcgucggcgcgg

SEQ ID NO: 377232 - RNA, 19 nt, Bordetella pertussis
gcccgcgugacggccgcca

SEQ ID NO: 377233 - RNA, 17 nt, Bordetella pertussis
gcccgcguucaggcgcg

SEQ ID NO: 377234 - RNA, 18 nt, Bordetella pertussis
gcccgcguucaggcgcgg

SEQ ID NO: 377235 - RNA, 15 nt, Bordetella pertussis
gcccgcuacgcgggc

SEQ ID NO: 377236 - RNA, 16 nt, Bordetella pertussis
gcccgcuaugcgggcu

SEQ ID NO: 377237 - RNA, 23 nt, Bordetella pertussis
gcccgcuaugcgggcuugcugcc

SEQ ID NO: 377238 - RNA, 15 nt, Bordetella pertussis
gcccgcuccaggcgg

SEQ ID NO: 377239 - RNA, 14 nt, Bordetella pertussis
gcccgcucggccag

SEQ ID NO: 377240 - RNA, 15 nt, Bordetella pertussis
gcccgcucggccagc

SEQ ID NO: 377241 - RNA, 16 nt, Bordetella pertussis
gcccgcucggccagca

SEQ ID NO: 377242 - RNA, 17 nt, Bordetella pertussis
gcccgcucggccagcag

SEQ ID NO: 377243 - RNA, 15 nt, Bordetella pertussis
gcccgcugaccggcc

SEQ ID NO: 377244 - RNA, 16 nt, Bordetella pertussis
gcccgcugaccggccu

SEQ ID NO: 377245 - RNA, 18 nt, Bordetella pertussis
gcccgcugaccggccugg

SEQ ID NO: 377246 - RNA, 19 nt, Bordetella pertussis
gcccgcugaccggccuggu

SEQ ID NO: 377247 - RNA, 14 nt, Bordetella pertussis
gcccgcugccgaga

SEQ ID NO: 377248 - RNA, 19 nt, Bordetella pertussis
gcccgcuggccgaucugcu

SEQ ID NO: 377249 - RNA, 22 nt, Bordetella pertussis
gcccgcuucucacugcccgcgc

SEQ ID NO: 377250 - RNA, 18 nt, Bordetella pertussis
gcccgcuucuuccuugcg

SEQ ID NO: 377251 - RNA, 14 nt, Bordetella pertussis
gcccgcuuccuugg

SEQ ID NO: 377252 - RNA, 23 nt, Bordetella pertussis
gcccgcuugcggccggcgcugau

SEQ ID NO: 377253 - RNA, 19 nt, Bordetella pertussis
gcccgcuugggccgcgccu

SEQ ID NO: 377254 - RNA, 21 nt, Bordetella pertussis
gcccgcuugggccgcgccugc

SEQ ID NO: 377255 - RNA, 17 nt, Bordetella pertussis
gcccggaauaccgccag

SEQ ID NO: 377256 - RNA, 20 nt, Bordetella pertussis
gcccggaauaccgccagcuc

SEQ ID NO: 377257 - RNA, 20 nt, Bordetella pertussis
gcccggauacugcacgcggu

SEQ ID NO: 377258 - RNA, 20 nt, Bordetella pertussis
gcccggauauggccggcgcg

SEQ ID NO: 377259 - RNA, 20 nt, Bordetella pertussis
gcccggaucaguccgggcgc

SEQ ID NO: 377260 - RNA, 21 nt, Bordetella pertussis
gcccggaucauccgggcccgg

SEQ ID NO: 377261 - RNA, 19 nt, Bordetella pertussis
gcccggcaacaucuccacc

SEQ ID NO: 377262 - RNA, 23 nt, Bordetella pertussis
gcccggcaacaucuccaccagcg

SEQ ID NO: 377263 - RNA, 19 nt, Bordetella pertussis
gcccggcaacccgcccacg

SEQ ID NO: 377264 - RNA, 16 nt, Bordetella pertussis
gcccggcaccaugcgc

SEQ ID NO: 377265 - RNA, 17 nt, Bordetella pertussis
gcccggcaccaugcgca

SEQ ID NO: 377266 - RNA, 19 nt, Bordetella pertussis
gcccggcaccaugcgcacc

SEQ ID NO: 377267 - RNA, 20 nt, Bordetella pertussis
gcccggcaccaugcgcacca

SEQ ID NO: 377268 - RNA, 22 nt, Bordetella pertussis
gcccggcaccaugcgcaccagg

SEQ ID NO: 377269 - RNA, 19 nt, Bordetella pertussis
gcccggcaccguccagcau

SEQ ID NO: 377270 - RNA, 15 nt, Bordetella pertussis
gcccggcacgucggu

SEQ ID NO: 377271 - RNA, 22 nt, Bordetella pertussis
gcccggcagggucucggccacg

SEQ ID NO: 377272 - RNA, 14 nt, Bordetella pertussis
gcccggcaggguga

SEQ ID NO: 377273 - RNA, 21 nt, Bordetella pertussis
gcccggcagggugacgggcug

SEQ ID NO: 377274 - RNA, 16 nt, Bordetella pertussis
gcccggcagaacagcg

SEQ ID NO: 377275 - RNA, 22 nt, Bordetella pertussis
gcccggcagaacagcggaucgc

SEQ ID NO: 377276 - RNA, 14 nt, Bordetella pertussis
gcccggcaugggcg

SEQ ID NO: 377277 - RNA, 20 nt, Bordetella pertussis
gcccggccacggccgggccu

SEQ ID NO: 377278 - RNA, 23 nt, Bordetella pertussis
gcccggcccaggccgggcguugu

SEQ ID NO: 377279 - RNA, 16 nt, Bordetella pertussis
gcccggccccaggccg

SEQ ID NO: 377280 - RNA, 19 nt, Bordetella pertussis
gcccggccccaggccgggu

SEQ ID NO: 377281 - RNA, 14 nt, Bordetella pertussis
gcccggcccccagc

SEQ ID NO: 377282 - RNA, 16 nt, Bordetella pertussis
gcccggccgcagggcg

SEQ ID NO: 377283 - RNA, 16 nt, Bordetella pertussis
gcccggccgccagcau

SEQ ID NO: 377284 - RNA, 19 nt, Bordetella pertussis
gcccggccgccagcauggc

SEQ ID NO: 377285 - RNA, 16 nt, Bordetella pertussis
gcccggccgccgccgg

SEQ ID NO: 377286 - RNA, 17 nt, Bordetella pertussis
gcccggccgccgccggc

SEQ ID NO: 377287 - RNA, 19 nt, Bordetella pertussis
gcccggccgccgccggcaa

SEQ ID NO: 377288 - RNA, 14 nt, Bordetella pertussis
gcccggccggcacg

SEQ ID NO: 377289 - RNA, 22 nt, Bordetella pertussis
gcccggccggcacggccggcca

SEQ ID NO: 377290 - RNA, 13 nt, Bordetella pertussis
gcccggccggccc

SEQ ID NO: 377291 - RNA, 17 nt, Bordetella pertussis
gcccggccggcccgcgc

SEQ ID NO: 377292 - RNA, 21 nt, Bordetella pertussis
gcccggccugcgggcgccgcg

SEQ ID NO: 377293 - RNA, 20 nt, Bordetella pertussis
gcccggcgagaacgcggccg

SEQ ID NO: 377294 - RNA, 22 nt, Bordetella pertussis
gcccggcgagaacgcggccgcg

SEQ ID NO: 377295 - RNA, 14 nt, Bordetella pertussis
gcccggcgagcaug

SEQ ID NO: 377296 - RNA, 21 nt, Bordetella pertussis
gcccggcgagguugcaggcca

SEQ ID NO: 377297 - RNA, 12 nt, Bordetella pertussis
gcccggcgccac

SEQ ID NO: 377298 - RNA, 16 nt, Bordetella pertussis
gcccggcgccgcgcgc

SEQ ID NO: 377299 - RNA, 19 nt, Bordetella pertussis
gcccggcgccgcgcgcugg

SEQ ID NO: 377300 - RNA, 13 nt, Bordetella pertussis
gcccggcgccauc

SEQ ID NO: 377301 - RNA, 14 nt, Bordetella pertussis
gcccggcgccaucu

SEQ ID NO: 377302 - RNA, 16 nt, Bordetella pertussis
gcccggcgcgacaggc

SEQ ID NO: 377303 - RNA, 18 nt, Bordetella pertussis
gcccggcgcgacaggcgg

SEQ ID NO: 377304 - RNA, 14 nt, Bordetella pertussis
gcccggcgcgacga

SEQ ID NO: 377305 - RNA, 12 nt, Bordetella pertussis
gcccggcgcgca

SEQ ID NO: 377306 - RNA, 15 nt, Bordetella pertussis
gcccggcgcgcaucg

SEQ ID NO: 377307 - RNA, 16 nt, Bordetella pertussis
gcccggcgcgcaucgu

SEQ ID NO: 377308 - RNA, 12 nt, Bordetella pertussis
gcccggcgcgcc

SEQ ID NO: 377309 - RNA, 13 nt, Bordetella pertussis
gcccggcgcgcca

SEQ ID NO: 377310 - RNA, 14 nt, Bordetella pertussis
gcccggcgcgccac

SEQ ID NO: 377311 - RNA, 13 nt, Bordetella pertussis
gcccggcgcgccu

SEQ ID NO: 377312 - RNA, 21 nt, Bordetella pertussis
gcccggcgcgccuuacgcggc

SEQ ID NO: 377313 - RNA, 16 nt, Bordetella pertussis
gcccggcgcgccuucg

SEQ ID NO: 377314 - RNA, 21 nt, Bordetella pertussis
gcccggcgcgccuucggcagg

SEQ ID NO: 377315 - RNA, 21 nt, Bordetella pertussis
gcccggcggaucacccagcgg

SEQ ID NO: 377316 - RNA, 13 nt, Bordetella pertussis
gcccggcggccau

SEQ ID NO: 377317 - RNA, 15 nt, Bordetella pertussis
gcccggcggcgcgcc

SEQ ID NO: 377318 - RNA, 17 nt, Bordetella pertussis
gcccggcggcgcgccgc

SEQ ID NO: 377319 - RNA, 18 nt, Bordetella pertussis
gcccggcggcgcgccgcc

SEQ ID NO: 377320 - RNA, 20 nt, Bordetella pertussis
gcccggcggcgcgccgccgg

SEQ ID NO: 377321 - RNA, 22 nt, Bordetella pertussis
gcccggcggcgcgccgccgggc

SEQ ID NO: 377322 - RNA, 22 nt, Bordetella pertussis
gcccggcggcgcggcgagcacg

SEQ ID NO: 377323 - RNA, 23 nt, Bordetella pertussis
gcccggcggcgcggcgagcacgg

SEQ ID NO: 377324 - RNA, 14 nt, Bordetella pertussis
gcccggcgggaaca

SEQ ID NO: 377325 - RNA, 17 nt, Bordetella pertussis
gcccggcgggaacaggc

SEQ ID NO: 377326 - RNA, 13 nt, Bordetella pertussis
gcccggcgggccg

SEQ ID NO: 377327 - RNA, 17 nt, Bordetella pertussis
gcccggcguagcugcgc

SEQ ID NO: 377328 - RNA, 19 nt, Bordetella pertussis
gcccggcguagcugcgccg

SEQ ID NO: 377329 - RNA, 18 nt, Bordetella pertussis
gcccggcggugaccuggg

SEQ ID NO: 377330 - RNA, 18 nt, Bordetella pertussis
gcccggcgugacgcugac

SEQ ID NO: 377331 - RNA, 20 nt, Bordetella pertussis
gcccggcgugcccagggcca

SEQ ID NO: 377332 - RNA, 22 nt, Bordetella pertussis
gcccggcgugcccagggccacg

SEQ ID NO: 377333 - RNA, 22 nt, Bordetella pertussis
gcccggcuccaggccgcccagc

SEQ ID NO: 377334 - RNA, 13 nt, Bordetella pertussis
gcccggcugcucg

SEQ ID NO: 377335 - RNA, 14 nt, Bordetella pertussis
gcccgggcaccagg

SEQ ID NO: 377336 - RNA, 18 nt, Bordetella pertussis
gcccgggcaccagguccu

SEQ ID NO: 377337 - RNA, 15 nt, Bordetella pertussis
gcccgggcaggcuca

SEQ ID NO: 377338 - RNA, 21 nt, Bordetella pertussis
gcccgggcaggcucagcccgg

SEQ ID NO: 377339 - RNA, 19 nt, Bordetella pertussis
gcccgggcgagauggcgug

SEQ ID NO: 377340 - RNA, 23 nt, Bordetella pertussis
gcccgggcgagauggcgugcacg

SEQ ID NO: 377341 - RNA, 14 nt, Bordetella pertussis
gcccgggcgccugc

SEQ ID NO: 377342 - RNA, 15 nt, Bordetella pertussis
gcccgggcgccugcg

SEQ ID NO: 377343 - RNA, 16 nt, Bordetella pertussis
gcccgggcgccugcgc

SEQ ID NO: 377344 - RNA, 19 nt, Bordetella pertussis
gcccgggcgccugcgccac

SEQ ID NO: 377345 - RNA, 13 nt, Bordetella pertussis
gcccgggcgcgcu

SEQ ID NO: 377346 - RNA, 13 nt, Bordetella pertussis
gcccgggcgugcc

SEQ ID NO: 377347 - RNA, 13 nt, Bordetella pertussis
gcccgggcuggcc

SEQ ID NO: 377348 - RNA, 17 nt, Bordetella pertussis
gcccgggcuggccgccu

SEQ ID NO: 377349 - RNA, 19 nt, Bordetella pertussis
gcccgggcuggccgccugc

SEQ ID NO: 377350 - RNA, 16 nt, Bordetella pertussis
gcccggggccauggca

SEQ ID NO: 377351 - RNA, 17 nt, Bordetella pertussis
gcccgggcugauccgca

SEQ ID NO: 377352 - RNA, 15 nt, Bordetella pertussis
gcccggguacggcag

SEQ ID NO: 377353 - RNA, 17 nt, Bordetella pertussis
gcccgggugaucagucc

SEQ ID NO: 377354 - RNA, 14 nt, Bordetella pertussis
gcccggggcggcgu

SEQ ID NO: 377355 - RNA, 19 nt, Bordetella pertussis
gcccgggugggcggcaucg

SEQ ID NO: 377356 - RNA, 22 nt, Bordetella pertussis
gcccggguuggcguccaggcgc

SEQ ID NO: 377357 - RNA, 22 nt, Bordetella pertussis
gcccgguaggccacgcgcgggc

SEQ ID NO: 377358 - RNA, 18 nt, Bordetella pertussis
gcccgguauuccucgacg

SEQ ID NO: 377359 - RNA, 16 nt, Bordetella pertussis
gcccgucaugcgccgc

SEQ ID NO: 377360 - RNA, 14 nt, Bordetella pertussis
gcccgucaugggcg

SEQ ID NO: 377361 - RNA, 20 nt, Bordetella pertussis
gcccgucaugggcggggcca

SEQ ID NO: 377362 - RNA, 22 nt, Bordetella pertussis
gcccgucaugggcggggccaca

SEQ ID NO: 377363 - RNA, 17 nt, Bordetella pertussis
gcccguccacggccugc

SEQ ID NO: 377364 - RNA, 19 nt, Bordetella pertussis
gcccguccacggccugcgc

SEQ ID NO: 377365 - RNA, 22 nt, Bordetella pertussis
gcccgucccgacccccggcccg

SEQ ID NO: 377366 - RNA, 14 nt, Bordetella pertussis
gcccgucagcggcg

SEQ ID NO: 377367 - RNA, 15 nt, Bordetella pertussis
gcccgucagcggcgc

SEQ ID NO: 377368 - RNA, 15 nt, Bordetella pertussis
gcccguccuggugca

SEQ ID NO: 377369 - RNA, 14 nt, Bordetella pertussis
gcccgucgcgccag

SEQ ID NO: 377370 - RNA, 16 nt, Bordetella pertussis
gcccgucgcgccaggc

SEQ ID NO: 377371 - RNA, 17 nt, Bordetella pertussis
gcccgucgcgccaggcc

SEQ ID NO: 377372 - RNA, 16 nt, Bordetella pertussis
gcccgucgcuggcgcg

SEQ ID NO: 377373 - RNA, 18 nt, Bordetella pertussis
gcccuacgacacgcucaa

SEQ ID NO: 377374 - RNA, 17 nt, Bordetella pertussis
gccgaauccggccagca

SEQ ID NO: 377375 - RNA, 21 nt, Bordetella pertussis
gccgaauccggccagcacgcc

SEQ ID NO: 377376 - RNA, 15 nt, Bordetella pertussis
gccgaaucggccccu

SEQ ID NO: 377377 - RNA, 18 nt, Bordetella pertussis
gccgaaucguucacgccc

SEQ ID NO: 377378 - RNA, 21 nt, Bordetella pertussis
gccgaauugccgccgcugccg

SEQ ID NO: 377379 - RNA, 23 nt, Bordetella pertussis
gccgaauugccgccgcugccggc

SEQ ID NO: 377380 - RNA, 20 nt, Bordetella pertussis
gccgacagcuugcgcuggcg

SEQ ID NO: 377381 - RNA, 21 nt, Bordetella pertussis
gccgacagcuugcgcuggcgc

SEQ ID NO: 377382 - RNA, 19 nt, Bordetella pertussis
gccgacaggaaggcgagcg

SEQ ID NO: 377383 - RNA, 23 nt, Bordetella pertussis
gccgacaggaaggcgagcgcggc

SEQ ID NO: 377384 - RNA, 18 nt, Bordetella pertussis
gccgacaggaugaagacc

SEQ ID NO: 377385 - RNA, 21 nt, Bordetella pertussis
gccgacaggaugaagaccacg

SEQ ID NO: 377386 - RNA, 12 nt, Bordetella pertussis
gccgacaggcgc

SEQ ID NO: 377387 - RNA, 20 nt, Bordetella pertussis
gccgacaggcgcgcaggcgg

SEQ ID NO: 377388 - RNA, 19 nt, Bordetella pertussis
gccgacagguaggcgccgg

SEQ ID NO: 377389 - RNA, 18 nt, Bordetella pertussis
gccgaccagcacgaucca

SEQ ID NO: 377390 - RNA, 13 nt, Bordetella pertussis
gccgaccaggccc

SEQ ID NO: 377391 - RNA, 19 nt, Bordetella pertussis
gccgaccaggcccgccacg

SEQ ID NO: 377392 - RNA, 14 nt, Bordetella pertussis
gccgaccaggccgg

SEQ ID NO: 377393 - RNA, 15 nt, Bordetella pertussis
gccgaccaggccggc

SEQ ID NO: 377394 - RNA, 20 nt, Bordetella pertussis
gccgaccaggccggcggcgg

SEQ ID NO: 377395 - RNA, 15 nt, Bordetella pertussis
gccgaccaggcugcg

SEQ ID NO: 377396 - RNA, 14 nt, Bordetella pertussis
gccgaccagguauc

SEQ ID NO: 377397 - RNA, 17 nt, Bordetella pertussis
gccgaccgagccgaagu

SEQ ID NO: 377398 - RNA, 18 nt, Bordetella pertussis
gccgaccgcacgauggcg

SEQ ID NO: 377399 - RNA, 19 nt, Bordetella pertussis
gccgaccgcacgauggcgc

SEQ ID NO: 377400 - RNA, 20 nt, Bordetella pertussis
gccgaccgcacgauggcgcg

SEQ ID NO: 377401 - RNA, 22 nt, Bordetella pertussis
gccgaccgcacgauggcgcgcg

SEQ ID NO: 377402 - RNA, 23 nt, Bordetella pertussis
gccgaccgcacgauggcgcgcga

SEQ ID NO: 377403 - RNA, 12 nt, Bordetella pertussis
gccgaccgcgcg

SEQ ID NO: 377404 - RNA, 14 nt, Bordetella pertussis
gccgaccuggcgcc

SEQ ID NO: 377405 - RNA, 19 nt, Bordetella pertussis
gccgaccuggcgcccgacg

SEQ ID NO: 377406 - RNA, 21 nt, Bordetella pertussis
gccgacgccggcucaggccag

SEQ ID NO: 377407 - RNA, 16 nt, Bordetella pertussis
gccgacgcgcccgggc

SEQ ID NO: 377408 - RNA, 17 nt, Bordetella pertussis
gccgacgcgcccgggcu

SEQ ID NO: 377409 - RNA, 17 nt, Bordetella pertussis
gccgacgcgccgggcca

SEQ ID NO: 377410 - RNA, 19 nt, Bordetella pertussis
gccgacgcgccgggccacg

SEQ ID NO: 377411 - RNA, 20 nt, Bordetella pertussis
gccgacgcgccgggccacga

SEQ ID NO: 377412 - RNA, 14 nt, Bordetella pertussis
gccgacgcgcuggc

SEQ ID NO: 377413 - RNA, 15 nt, Bordetella pertussis
gccgacgcgcugucc

SEQ ID NO: 377414 - RNA, 14 nt, Bordetella pertussis
gccgacgcuccaga

SEQ ID NO: 377415 - RNA, 18 nt, Bordetella pertussis
gccgacggcaagaucgcc

SEQ ID NO: 377416 - RNA, 17 nt, Bordetella pertussis
gccgacggcauggccgg

SEQ ID NO: 377417 - RNA, 21 nt, Bordetella pertussis
gccgacggcauggccggcagg

SEQ ID NO: 377418 - RNA, 19 nt, Bordetella pertussis
gccgacggcauggcggcca

SEQ ID NO: 377419 - RNA, 20 nt, Bordetella pertussis
gccgacggcauggcggccag

SEQ ID NO: 377420 - RNA, 22 nt, Bordetella pertussis
gccgacggcauggcggccagcu

SEQ ID NO: 377421 - RNA, 17 nt, Bordetella pertussis
gccgacguagucgcgcc

SEQ ID NO: 377422 - RNA, 21 nt, Bordetella pertussis
gccgacguagucgcgccagcg

SEQ ID NO: 377423 - RNA, 22 nt, Bordetella pertussis
gccgacguagucgcgccagcgg

SEQ ID NO: 377424 - RNA, 19 nt, Bordetella pertussis
gccgacguggaccgcgcgg

SEQ ID NO: 377425 - RNA, 19 nt, Bordetella pertussis
gccgagacggccgccgacg

SEQ ID NO: 377426 - RNA, 15 nt, Bordetella pertussis
gccgagcagaucgcc

SEQ ID NO: 377427 - RNA, 20 nt, Bordetella pertussis
gccgagcagaucgccaacgu

SEQ ID NO: 377428 - RNA, 12 nt, Bordetella pertussis
gccgagccauug

SEQ ID NO: 377429 - RNA, 18 nt, Bordetella pertussis
gccgagcgcaccccggcc

SEQ ID NO: 377430 - RNA, 17 nt, Bordetella pertussis
gccgagcgcgccagcac

SEQ ID NO: 377431 - RNA, 13 nt, Bordetella pertussis
gccgagcgcugcg

SEQ ID NO: 377432 - RNA, 16 nt, Bordetella pertussis
gccgagcgggccagcg

SEQ ID NO: 377433 - RNA, 19 nt, Bordetella pertussis
gccgagcgggccagcgcgg

SEQ ID NO: 377434 - RNA, 22 nt, Bordetella pertussis
gccgagcgggccagcgcggcca

SEQ ID NO: 377435 - RNA, 17 nt, Bordetella pertussis
gccgaggaccugcuggc

SEQ ID NO: 377436 - RNA, 19 nt, Bordetella pertussis
gccgaggaccugcuggcgu

SEQ ID NO: 377437 - RNA, 13 nt, Bordetella pertussis
gccgaggaucagc

SEQ ID NO: 377438 - RNA, 21 nt, Bordetella pertussis
gccgaggaucuggccggcgcu

SEQ ID NO: 377439 - RNA, 23 nt, Bordetella pertussis
gccgaggaucuggccggcgcugg

SEQ ID NO: 377440 - RNA, 18 nt, Bordetella pertussis
gccgaggucgcccuuggg

SEQ ID NO: 377441 - RNA, 14 nt, Bordetella pertussis
gccgaggucggcgg

SEQ ID NO: 377442 - RNA, 15 nt, Bordetella pertussis
gccgaguggaugcgc

SEQ ID NO: 377443 - RNA, 16 nt, Bordetella pertussis
gccgaguggaugcgcu

SEQ ID NO: 377444 - RNA, 13 nt, Bordetella pertussis
gccgaguggccgc

SEQ ID NO: 377445 - RNA, 16 nt, Bordetella pertussis
gccgaguggcgggcca

SEQ ID NO: 377446 - RNA, 16 nt, Bordetella pertussis
gccgaguuuccgcacc

SEQ ID NO: 377447 - RNA, 16 nt, Bordetella pertussis
gccgauaccacgcgcg

SEQ ID NO: 377448 - RNA, 19 nt, Bordetella pertussis
gccgauacgcgugcgcggc

SEQ ID NO: 377449 - RNA, 17 nt, Bordetella pertussis
gccgauacgggcgcggc

SEQ ID NO: 377450 - RNA, 19 nt, Bordetella pertussis
gccgauacaggcgcucgcg

SEQ ID NO: 377451 - RNA, 21 nt, Bordetella pertussis
gccgaucaccugcaggcccac

SEQ ID NO: 377452 - RNA, 23 nt, Bordetella pertussis
gccgaucaccugcaggcccaccg

SEQ ID NO: 377453 - RNA, 17 nt, Bordetella pertussis
gccgaucagcaccacgg

SEQ ID NO: 377454 - RNA, 23 nt, Bordetella pertussis
gccgaucagcaggucggcgcggc

SEQ ID NO: 377455 - RNA, 13 nt, Bordetella pertussis
gccgaucagccgg

SEQ ID NO: 377456 - RNA, 15 nt, Bordetella pertussis
gccgaucagccggcc

SEQ ID NO: 377457 - RNA, 18 nt, Bordetella pertussis
gccgaucagccggccaug

SEQ ID NO: 377458 - RNA, 23 nt, Bordetella pertussis
gccgaucagcggauugaccagcg

SEQ ID NO: 377459 - RNA, 17 nt, Bordetella pertussis
gccgaucagcgggcugg

SEQ ID NO: 377460 - RNA, 19 nt, Bordetella pertussis
gccgaucgcggcuccagcu

SEQ ID NO: 377461 - RNA, 23 nt, Bordetella pertussis
gccgaucggcuugccgcgcggcg

SEQ ID NO: 377462 - RNA, 15 nt, Bordetella pertussis
gccgaucucacgggc

SEQ ID NO: 377463 - RNA, 16 nt, Bordetella pertussis
gccgaucgugcacgcc

SEQ ID NO: 377464 - RNA, 17 nt, Bordetella pertussis
gccgaucgugcacgccc

SEQ ID NO: 377465 - RNA, 13 nt, Bordetella pertussis
gccgaucugcugg

SEQ ID NO: 377466 - RNA, 20 nt, Bordetella pertussis
gccgaucugcugggccgggu

SEQ ID NO: 377467 - RNA, 19 nt, Bordetella pertussis
gccgaugauggugaacgcc

SEQ ID NO: 377468 - RNA, 22 nt, Bordetella pertussis
gccgaugauggugaacgccacc

SEQ ID NO: 377469 - RNA, 22 nt, Bordetella pertussis
gccgaugcacagguagaucagc

SEQ ID NO: 377470 - RNA, 12 nt, Bordetella pertussis
gccgaugccgca

SEQ ID NO: 377471 - RNA, 16 nt, Bordetella pertussis
gccgaugccgccauca

SEQ ID NO: 377472 - RNA, 12 nt, Bordetella pertussis
gccgaugccgcg

SEQ ID NO: 377473 - RNA, 12 nt, Bordetella pertussis
gccgaugccgcu

SEQ ID NO: 377474 - RNA, 17 nt, Bordetella pertussis
gccgaugugcggcguga

SEQ ID NO: 377475 - RNA, 20 nt, Bordetella pertussis
gccgauguuguuggccgcca

SEQ ID NO: 377476 - RNA, 14 nt, Bordetella pertussis
gccgauucgaccug

SEQ ID NO: 377477 - RNA, 18 nt, Bordetella pertussis
gccgauucgaccugcuug

SEQ ID NO: 377478 - RNA, 14 nt, Bordetella pertussis
gccgauugaggcca

SEQ ID NO: 377479 - RNA, 17 nt, Bordetella pertussis
gccgauugaggccagca

SEQ ID NO: 377480 - RNA, 21 nt, Bordetella pertussis
gccgauugaggccagcacgcc

SEQ ID NO: 377481 - RNA, 21 nt, Bordetella pertussis
gccgauugugcaugacggcca

SEQ ID NO: 377482 - RNA, 23 nt, Bordetella pertussis
gccgauugugcaugacggccagg

SEQ ID NO: 377483 - RNA, 19 nt, Bordetella pertussis
gccgauuucgccgccgcca

SEQ ID NO: 377484 - RNA, 23 nt, Bordetella pertussis
gccgauuucgccgccgccaucgu

SEQ ID NO: 377485 - RNA, 17 nt, Bordetella pertussis
gccgauuucgcgcgcca

SEQ ID NO: 377486 - RNA, 20 nt, Bordetella pertussis
gccgauuucggccgccggcg

SEQ ID NO: 377487 - RNA, 21 nt, Bordetella pertussis
gccgauuucggccgccggcga

SEQ ID NO: 377488 - RNA, 17 nt, Bordetella pertussis
gccgcaaccagggagcc

SEQ ID NO: 377489 - RNA, 15 nt, Bordetella pertussis
gccgcaacccacccc

SEQ ID NO: 377490 - RNA, 23 nt, Bordetella pertussis
gccgcaacccacccccagcagca

SEQ ID NO: 377491 - RNA, 22 nt, Bordetella pertussis
gccgcaaaucaaugaaaaagcc

SEQ ID NO: 377492 - RNA, 22 nt, Bordetella pertussis
gccgcaaccgucgaccggcccg

SEQ ID NO: 377493 - RNA, 16 nt, Bordetella pertussis
gccgcaacgccgccgg

SEQ ID NO: 377494 - RNA, 15 nt, Bordetella pertussis
gccgcaacgccgggc

SEQ ID NO: 377495 - RNA, 13 nt, Bordetella pertussis
gccgcaagacggc

SEQ ID NO: 377496 - RNA, 20 nt, Bordetella pertussis
gccgcaagcaagccccaggc

SEQ ID NO: 377497 - RNA, 17 nt, Bordetella pertussis
gccgcacagcguggcga

SEQ ID NO: 377498 - RNA, 15 nt, Bordetella pertussis
gccgcacaucgucga

SEQ ID NO: 377499 - RNA, 13 nt, Bordetella pertussis
gccgcaccaggcc

SEQ ID NO: 377500 - RNA, 14 nt, Bordetella pertussis
gccgcaccaggccg

SEQ ID NO: 377501 - RNA, 15 nt, Bordetella pertussis
gccgcaccaggccgc

SEQ ID NO: 377502 - RNA, 17 nt, Bordetella pertussis
gccgcaccaggccgcgg

SEQ ID NO: 377503 - RNA, 18 nt, Bordetella pertussis
gccgcaccaggccgcggc

SEQ ID NO: 377504 - RNA, 19 nt, Bordetella pertussis
gccgcaccaggccgcggcg

SEQ ID NO: 377505 - RNA, 18 nt, Bordetella pertussis
gccgcaccagcgcauugc

SEQ ID NO: 377506 - RNA, 16 nt, Bordetella pertussis
gccgcaccagcggcga

SEQ ID NO: 377507 - RNA, 16 nt, Bordetella pertussis
gccgcacccgaugacg

SEQ ID NO: 377508 - RNA, 14 nt, Bordetella pertussis
gccgcacgguggcg

SEQ ID NO: 377509 - RNA, 15 nt, Bordetella pertussis
gccgcacgguggcgc

SEQ ID NO: 377510 - RNA, 17 nt, Bordetella pertussis
gccgcacgguggcgccg

SEQ ID NO: 377511 - RNA, 21 nt, Bordetella pertussis
gccgcacgguggcgccgucgc

SEQ ID NO: 377512 - RNA, 20 nt, Bordetella pertussis
gccgcacugggugacgcugg

SEQ ID NO: 377513 - RNA, 16 nt, Bordetella pertussis
gccgcacuucgggcca

SEQ ID NO: 377514 - RNA, 16 nt, Bordetella pertussis
gccgcagaacagcagc

SEQ ID NO: 377515 - RNA, 21 nt, Bordetella pertussis
gccgcagaacagcagcgugau

SEQ ID NO: 377516 - RNA, 12 nt, Bordetella pertussis
gccgcagcacca

SEQ ID NO: 377517 - RNA, 20 nt, Bordetella pertussis
gccgcagcaccacaucgccg

SEQ ID NO: 377518 - RNA, 12 nt, Bordetella pertussis
gccgcagauggc

SEQ ID NO: 377519 - RNA, 16 nt, Bordetella pertussis
gccgcagauggccagc

SEQ ID NO: 377520 - RNA, 17 nt, Bordetella pertussis
gccgcagauggccagca

SEQ ID NO: 377521 - RNA, 20 nt, Bordetella pertussis
gccgcagauggccagcagcg

SEQ ID NO: 377522 - RNA, 22 nt, Bordetella pertussis
gccgcagauggcguaggcggcc

SEQ ID NO: 377523 - RNA, 23 nt, Bordetella pertussis
gccgcagauggcguaggcggccu

SEQ ID NO: 377524 - RNA, 20 nt, Bordetella pertussis
gccgcagaugucaguccuca

SEQ ID NO: 377525 - RNA, 17 nt, Bordetella pertussis
gccgcagauuuccagcg

SEQ ID NO: 377526 - RNA, 18 nt, Bordetella pertussis
gccgcagcggacguuggc

SEQ ID NO: 377527 - RNA, 15 nt, Bordetella pertussis
gccgcagcggccaug

SEQ ID NO: 377528 - RNA, 17 nt, Bordetella pertussis
gccgcagcgggcccguc

SEQ ID NO: 377529 - RNA, 20 nt, Bordetella pertussis
gccgcagcgggcccgucgcg

SEQ ID NO: 377530 - RNA, 22 nt, Bordetella pertussis
gccgcagcgggcccgucgcgcc

SEQ ID NO: 377531 - RNA, 16 nt, Bordetella pertussis
gccgcagcggggacag

SEQ ID NO: 377532 - RNA, 13 nt, Bordetella pertussis
gccgcagcgucgc

SEQ ID NO: 377533 - RNA, 20 nt, Bordetella pertussis
gccgcagcgucgcggcgucg

SEQ ID NO: 377534 - RNA, 15 nt, Bordetella pertussis
gccgcagcguggcgu

SEQ ID NO: 377535 - RNA, 12 nt, Bordetella pertussis
gccgcagcugga

SEQ ID NO: 377536 - RNA, 14 nt, Bordetella pertussis
gccgcaggagucgc

SEQ ID NO: 377537 - RNA, 17 nt, Bordetella pertussis
gccgcaggagucgcucc

SEQ ID NO: 377538 - RNA, 17 nt, Bordetella pertussis
gccgcaguauuccugcu

SEQ ID NO: 377539 - RNA, 13 nt, Bordetella pertussis
gccgcagugcgcg

SEQ ID NO: 377540 - RNA, 17 nt, Bordetella pertussis
gccgcagugcgcgcgcc

SEQ ID NO: 377541 - RNA, 16 nt, Bordetella pertussis
gccgcaguuccaggca

SEQ ID NO: 377542 - RNA, 23 nt, Bordetella pertussis
gccgcauaccuuggcgcccagcu

SEQ ID NO: 377543 - RNA, 19 nt, Bordetella pertussis
gccgcaugaaaaaagcccc

SEQ ID NO: 377544 - RNA, 17 nt, Bordetella pertussis
gccgcaugccggcgaug

SEQ ID NO: 377545 - RNA, 14 nt, Bordetella pertussis
gccgcaugccgggc

SEQ ID NO: 377546 - RNA, 15 nt, Bordetella pertussis
gccgcaugggcgcgc

SEQ ID NO: 377547 - RNA, 17 nt, Bordetella pertussis
gccgcaugggcgcgccc

SEQ ID NO: 377548 - RNA, 20 nt, Bordetella pertussis
gccgcaugggcgcgcccggc

SEQ ID NO: 377549 - RNA, 19 nt, Bordetella pertussis
gccgcauugggacgcggcc

SEQ ID NO: 377550 - RNA, 20 nt, Bordetella pertussis
gccgcauuuccucgaccagc

SEQ ID NO: 377551 - RNA, 22 nt, Bordetella pertussis
gccgcauuucguaaagccgcac

SEQ ID NO: 377552 - RNA, 23 nt, Bordetella pertussis
gccgcauuucguaaagccgcacg

SEQ ID NO: 377553 - RNA, 16 nt, Bordetella pertussis
gccgccaacgccaagc

SEQ ID NO: 377554 - RNA, 22 nt, Bordetella pertussis
gccgccaacgccaagcugcugg

SEQ ID NO: 377555 - RNA, 17 nt, Bordetella pertussis
gccgccaacgcggcgcg

SEQ ID NO: 377556 - RNA, 18 nt, Bordetella pertussis
gccgccaacgcggcgcgu

SEQ ID NO: 377557 - RNA, 20 nt, Bordetella pertussis
gccgccacacgaggaccgcg

SEQ ID NO: 377558 - RNA, 17 nt, Bordetella pertussis
gccgccacaggcugacg

SEQ ID NO: 377559 - RNA, 17 nt, Bordetella pertussis
gccgccaccaccucggc

SEQ ID NO: 377560 - RNA, 16 nt, Bordetella pertussis
gccgccaccagcgcgu

SEQ ID NO: 377561 - RNA, 20 nt, Bordetella pertussis
gccgccaccagcggcguggc

SEQ ID NO: 377562 - RNA, 14 nt, Bordetella pertussis
gccgccacccaggc

SEQ ID NO: 377563 - RNA, 15 nt, Bordetella pertussis
gccgccacccaggcg

SEQ ID NO: 377564 - RNA, 14 nt, Bordetella pertussis
gccgccaccugggc

SEQ ID NO: 377565 - RNA, 21 nt, Bordetella pertussis
gccgccaccugggccgccugc

SEQ ID NO: 377566 - RNA, 23 nt, Bordetella pertussis
gccgccacgcccuggcagcuggc

SEQ ID NO: 377567 - RNA, 15 nt, Bordetella pertussis
gccgccacgcgcacg

SEQ ID NO: 377568 - RNA, 18 nt, Bordetella pertussis
gccgccacgcgcacggcc

SEQ ID NO: 377569 - RNA, 20 nt, Bordetella pertussis
gccgccacgcgcacggccag

SEQ ID NO: 377570 - RNA, 22 nt, Bordetella pertussis
gccgccacgcgcacggccagca

SEQ ID NO: 377571 - RNA, 14 nt, Bordetella pertussis
gccgccacgcuggc

SEQ ID NO: 377572 - RNA, 17 nt, Bordetella pertussis
gccgccacgcuggccgc

SEQ ID NO: 377573 - RNA, 15 nt, Bordetella pertussis
gccgccacgggcccg

SEQ ID NO: 377574 - RNA, 21 nt, Bordetella pertussis
gccgccacgggcccgcgcaga

SEQ ID NO: 377575 - RNA, 13 nt, Bordetella pertussis
gccgccacgugca

SEQ ID NO: 377576 - RNA, 18 nt, Bordetella pertussis
gccgccagcaccugcuug

SEQ ID NO: 377577 - RNA, 13 nt, Bordetella pertussis
gccgccagcacgc

SEQ ID NO: 377578 - RNA, 15 nt, Bordetella pertussis
gccgccagcacgcca

SEQ ID NO: 377579 - RNA, 15 nt, Bordetella pertussis
gccgccagcagcgcc

SEQ ID NO: 377580 - RNA, 17 nt, Bordetella pertussis
gccgccagcagcgccgg

SEQ ID NO: 377581 - RNA, 18 nt, Bordetella pertussis
gccgccagcauggcggcc

SEQ ID NO: 377582 - RNA, 22 nt, Bordetella pertussis
gccgccagcauggcggccaggc

SEQ ID NO: 377583 - RNA, 16 nt, Bordetella pertussis
gccgccagcauggcgu

SEQ ID NO: 377584 - RNA, 15 nt, Bordetella pertussis
gccgccaggcauuga

SEQ ID NO: 377585 - RNA, 20 nt, Bordetella pertussis
gccgccagggcggcugccga

SEQ ID NO: 377586 - RNA, 13 nt, Bordetella pertussis
gccgccagguagc

SEQ ID NO: 377587 - RNA, 22 nt, Bordetella pertussis
gccgccaggucggccaccgccg

SEQ ID NO: 377588 - RNA, 15 nt, Bordetella pertussis
gccgccauaggcgcg

SEQ ID NO: 377589 - RNA, 13 nt, Bordetella pertussis
gccgccauggcgc

SEQ ID NO: 377590 - RNA, 17 nt, Bordetella pertussis
gccgccauggcgcuggc

SEQ ID NO: 377591 - RNA, 16 nt, Bordetella pertussis
gccgccauggcggcgc

SEQ ID NO: 377592 - RNA, 18 nt, Bordetella pertussis
gccgccauggcggcgccc

SEQ ID NO: 377593 - RNA, 19 nt, Bordetella pertussis
gccgccauggcggcgccca

SEQ ID NO: 377594 - RNA, 22 nt, Bordetella pertussis
gccgccauggucgcgaccaccg

SEQ ID NO: 377595 - RNA, 23 nt, Bordetella pertussis
gccgccauguauaacguggcgcg

SEQ ID NO: 377596 - RNA, 16 nt, Bordetella pertussis
gccgcccaccaccagc

SEQ ID NO: 377597 - RNA, 20 nt, Bordetella pertussis
gccgcccaccaccagcgcgg

SEQ ID NO: 377598 - RNA, 20 nt, Bordetella pertussis
gccgcccaugcgcauggcca

SEQ ID NO: 377599 - RNA, 23 nt, Bordetella pertussis
gccgcccaugcggguuggcaguc

SEQ ID NO: 377600 - RNA, 24 nt, Bordetella pertussis
gccgcccaugcggguuggcagucg

SEQ ID NO: 377601 - RNA, 16 nt, Bordetella pertussis
gccgccccaacggccu

SEQ ID NO: 377602 - RNA, 15 nt, Bordetella pertussis
gccgcccaugccgcc

SEQ ID NO: 377603 - RNA, 17 nt, Bordetella pertussis
gccgcccaugccgccgg

SEQ ID NO: 377604 - RNA, 20 nt, Bordetella pertussis
gccgcccaugccgccgggca

SEQ ID NO: 377605 - RNA, 16 nt, Bordetella pertussis
gccgccccagcagcag

SEQ ID NO: 377606 - RNA, 17 nt, Bordetella pertussis
gccgccccagcagcagc

SEQ ID NO: 377607 - RNA, 18 nt, Bordetella pertussis
gccgccccagcagcagcg

SEQ ID NO: 377608 - RNA, 19 nt, Bordetella pertussis
gccgccccagcagcagcga

SEQ ID NO: 377609 - RNA, 19 nt, Bordetella pertussis
gccgccccaggcguacgag

SEQ ID NO: 377610 - RNA, 23 nt, Bordetella pertussis
gccgccccaggcguacgaggacc

SEQ ID NO: 377611 - RNA, 21 nt, Bordetella pertussis
gccgccccaguugcgcgucca

SEQ ID NO: 377612 - RNA, 24 nt, Bordetella pertussis
gccgccccaguugcgcguccaggc

SEQ ID NO: 377613 - RNA, 17 nt, Bordetella pertussis
gccgcccccagcgcgcc

SEQ ID NO: 377614 - RNA, 15 nt, Bordetella pertussis
gccgcccccgcccag

SEQ ID NO: 377615 - RNA, 19 nt, Bordetella pertussis
gccgcccccgcccagcauc

SEQ ID NO: 377616 - RNA, 17 nt, Bordetella pertussis
gccgccccggcgcggcg

SEQ ID NO: 377617 - RNA, 23 nt, Bordetella pertussis
gccgcccgaauccagggccacgc

SEQ ID NO: 377618 - RNA, 17 nt, Bordetella pertussis
gccgcccgagcuggccg

SEQ ID NO: 377619 - RNA, 18 nt, Bordetella pertussis
gccgcccgcacgaagcgg

SEQ ID NO: 377620 - RNA, 14 nt, Bordetella pertussis
gccgcccgcaggca

SEQ ID NO: 377621 - RNA, 20 nt, Bordetella pertussis
gccgcccgcaggcauugcgc

SEQ ID NO: 377622 - RNA, 15 nt, Bordetella pertussis
gccgcccgccaggcc

SEQ ID NO: 377623 - RNA, 13 nt, Bordetella pertussis
gccgcccgcccgc

SEQ ID NO: 377624 - RNA, 14 nt, Bordetella pertussis
gccgcccgccgggc

SEQ ID NO: 377625 - RNA, 15 nt, Bordetella pertussis
gccgcccgccgggcc

SEQ ID NO: 377626 - RNA, 16 nt, Bordetella pertussis
gccgcccgccugccgg

SEQ ID NO: 377627 - RNA, 18 nt, Bordetella pertussis
gccgcccgccugccggcc

SEQ ID NO: 377628 - RNA, 17 nt, Bordetella pertussis
gccgcccgcggccagcc

SEQ ID NO: 377629 - RNA, 19 nt, Bordetella pertussis
gccgcccgcggccagccac

SEQ ID NO: 377630 - RNA, 16 nt, Bordetella pertussis
gccgcccgcggccugc

SEQ ID NO: 377631 - RNA, 17 nt, Bordetella pertussis
gccgcccgcggccugca

SEQ ID NO: 377632 - RNA, 15 nt, Bordetella pertussis
gccgcccgugccagu

SEQ ID NO: 377633 - RNA, 21 nt, Bordetella pertussis
gccgcccucgcccccgaaggc

SEQ ID NO: 377634 - RNA, 22 nt, Bordetella pertussis
gccgcccugccaauagcggugg

SEQ ID NO: 377635 - RNA, 13 nt, Bordetella pertussis
gccgcccuggcgc

SEQ ID NO: 377636 - RNA, 14 nt, Bordetella pertussis
gccgcccuggcgca

SEQ ID NO: 377637 - RNA, 18 nt, Bordetella pertussis
gccgcccuggcgcagggc

SEQ ID NO: 377638 - RNA, 14 nt, Bordetella pertussis
gccgcccuggcgcg

SEQ ID NO: 377639 - RNA, 18 nt, Bordetella pertussis
gccgcccuggcgcgaggc

SEQ ID NO: 377640 - RNA, 14 nt, Bordetella pertussis
gccgcccuggucau

SEQ ID NO: 377641 - RNA, 22 nt, Bordetella pertussis
gccgcccuggucaucgccaugc

SEQ ID NO: 377642 - RNA, 14 nt, Bordetella pertussis
gccgccgauggcgc

SEQ ID NO: 377643 - RNA, 16 nt, Bordetella pertussis
gccgccgauggcgcca

SEQ ID NO: 377644 - RNA, 15 nt, Bordetella pertussis
gccgccgauggcgcg

SEQ ID NO: 377645 - RNA, 17 nt, Bordetella pertussis
gccgccgauggcgcgcg

SEQ ID NO: 377646 - RNA, 20 nt, Bordetella pertussis
gccgccgauggcgcgcggcu

SEQ ID NO: 377647 - RNA, 12 nt, Bordetella pertussis
gccgccgcacag

SEQ ID NO: 377648 - RNA, 18 nt, Bordetella pertussis
gccgccgcagccgccagc

SEQ ID NO: 377649 - RNA, 19 nt, Bordetella pertussis
gccgccgcagccgccagcg

SEQ ID NO: 377650 - RNA, 14 nt, Bordetella pertussis
gccgccgcaggcua

SEQ ID NO: 377651 - RNA, 22 nt, Bordetella pertussis
gccgccgccaccaccucggccu

SEQ ID NO: 377652 - RNA, 15 nt, Bordetella pertussis
gccgccgccaccagc

SEQ ID NO: 377653 - RNA, 16 nt, Bordetella pertussis
gccgccgccaccagcg

SEQ ID NO: 377654 - RNA, 12 nt, Bordetella pertussis
gccgccgccagc

SEQ ID NO: 377655 - RNA, 13 nt, Bordetella pertussis
gccgccgccagcg

SEQ ID NO: 377656 - RNA, 15 nt, Bordetella pertussis
gccgccgccagcgcg

SEQ ID NO: 377657 - RNA, 16 nt, Bordetella pertussis
gccgccgccagcgcgc

SEQ ID NO: 377658 - RNA, 21 nt, Bordetella pertussis
gccgccgccauagcugcgcca

SEQ ID NO: 377659 - RNA, 13 nt, Bordetella pertussis
gccgccgccuggc

SEQ ID NO: 377660 - RNA, 21 nt, Bordetella pertussis
gccgccgcgauugcagguggc

SEQ ID NO: 377661 - RNA, 14 nt, Bordetella pertussis
gccgccgcgcacca

SEQ ID NO: 377662 - RNA, 16 nt, Bordetella pertussis
gccgccgcgcccagca

SEQ ID NO: 377663 - RNA, 22 nt, Bordetella pertussis
gccgccgcgcccagcagcgcca

SEQ ID NO: 377664 - RNA, 16 nt, Bordetella pertussis
gccgccgcgcccagcc

SEQ ID NO: 377665 - RNA, 17 nt, Bordetella pertussis
gccgccgcgcccagccg

SEQ ID NO: 377666 - RNA, 19 nt, Bordetella pertussis
gccgccgcgcccagccgcg

SEQ ID NO: 377667 - RNA, 15 nt, Bordetella pertussis
gccgccgcgcagccg

SEQ ID NO: 377668 - RNA, 20 nt, Bordetella pertussis
gccgccgcgcagccgacagg

SEQ ID NO: 377669 - RNA, 19 nt, Bordetella pertussis
gccgccgcgcccuggcgcg

SEQ ID NO: 377670 - RNA, 17 nt, Bordetella pertussis
gccgccgcgccgcuggc

SEQ ID NO: 377671 - RNA, 21 nt, Bordetella pertussis
gccgccgcgccgcuggcgucc

SEQ ID NO: 377672 - RNA, 14 nt, Bordetella pertussis
gccgccgcgcgcgg

SEQ ID NO: 377673 - RNA, 16 nt, Bordetella pertussis
gccgccgcgcgcuggc

SEQ ID NO: 377674 - RNA, 14 nt, Bordetella pertussis
gccgccgcugucgg

SEQ ID NO: 377675 - RNA, 16 nt, Bordetella pertussis
gccgccggacgcaggu

SEQ ID NO: 377676 - RNA, 22 nt, Bordetella pertussis
gccgccggacgcaggucgucgu

SEQ ID NO: 377677 - RNA, 15 nt, Bordetella pertussis
gccgccggacggcgc

SEQ ID NO: 377678 - RNA, 12 nt, Bordetella pertussis
gccgccggcacg

SEQ ID NO: 377679 - RNA, 19 nt, Bordetella pertussis
gccgccggcacguaccagg

SEQ ID NO: 377680 - RNA, 19 nt, Bordetella pertussis
gccgccggcagggccagcg

SEQ ID NO: 377681 - RNA, 22 nt, Bordetella pertussis
gccgccggcagggccagcgcca

SEQ ID NO: 377682 - RNA, 15 nt, Bordetella pertussis
gccgccggccaccag

SEQ ID NO: 377683 - RNA, 17 nt, Bordetella pertussis
gccgccggccaccagcg

SEQ ID NO: 377684 - RNA, 13 nt, Bordetella pertussis
gccgccggccacc

SEQ ID NO: 377685 - RNA, 22 nt, Bordetella pertussis
gccgccggcgcgguauggccgc

SEQ ID NO: 377686 - RNA, 20 nt, Bordetella pertussis
gccgccggcgcguugcggau

SEQ ID NO: 377687 - RNA, 13 nt, Bordetella pertussis
gccgccggcggca

SEQ ID NO: 377688 - RNA, 24 nt, Bordetella pertussis
gccgccggcggcauucagcgcugc

SEQ ID NO: 377689 - RNA, 13 nt, Bordetella pertussis
gccgccggcggcc

SEQ ID NO: 377690 - RNA, 14 nt, Bordetella pertussis
gccgccggcggccu

SEQ ID NO: 377691 - RNA, 16 nt, Bordetella pertussis
gccgccggcggcgccg

SEQ ID NO: 377692 - RNA, 18 nt, Bordetella pertussis
gccgccggcggcgccggc

SEQ ID NO: 377693 - RNA, 20 nt, Bordetella pertussis
gccgccggcggcgucggcgc

SEQ ID NO: 377694 - RNA, 22 nt, Bordetella pertussis
gccgccggcggcgucggcgccc

SEQ ID NO: 377695 - RNA, 14 nt, Bordetella pertussis
gccgccggcgucgc

SEQ ID NO: 377696 - RNA, 13 nt, Bordetella pertussis
gccgccggcgugc

SEQ ID NO: 377697 - RNA, 19 nt, Bordetella pertussis
gccgccgggucgcugugcg

SEQ ID NO: 377698 - RNA, 21 nt, Bordetella pertussis
gccgccgggucgcugugcgcg

SEQ ID NO: 377699 - RNA, 17 nt, Bordetella pertussis
gccgccggucaccgccg

SEQ ID NO: 377700 - RNA, 23 nt, Bordetella pertussis
gccgccggucaccgccgccgcca

SEQ ID NO: 377701 - RNA, 22 nt, Bordetella pertussis
gccgccggugauaugcgccagg

SEQ ID NO: 377702 - RNA, 22 nt, Bordetella pertussis
gccgccguaaucggcgucggca

SEQ ID NO: 377703 - RNA, 20 nt, Bordetella pertussis
gccgccguacgaguggccgu

SEQ ID NO: 377704 - RNA, 20 nt, Bordetella pertussis
gccgccguagccgcugcgcg

SEQ ID NO: 377705 - RNA, 21 nt, Bordetella pertussis
gccgccguagccgcugcgcgc

SEQ ID NO: 377706 - RNA, 16 nt, Bordetella pertussis
gccgccguaggacagc

SEQ ID NO: 377707 - RNA, 21 nt, Bordetella pertussis
gccgccguaggacagccccag

SEQ ID NO: 377708 - RNA, 22 nt, Bordetella pertussis
gccgccguaggacagccccagc

SEQ ID NO: 377709 - RNA, 18 nt, Bordetella pertussis
gccgccgugcgcgggcgc

SEQ ID NO: 377710 - RNA, 24 nt, Bordetella pertussis
gccgccgugcgagcacggcguggc

SEQ ID NO: 377711 - RNA, 16 nt, Bordetella pertussis
gccgccuaccaggugg

SEQ ID NO: 377712 - RNA, 19 nt, Bordetella pertussis
gccgccuauguaggcgccg

SEQ ID NO: 377713 - RNA, 22 nt, Bordetella pertussis
gccgccuauguaggcgccgcgc

SEQ ID NO: 377714 - RNA, 23 nt, Bordetella pertussis
gccgccuauguaggcgccgcgcc

SEQ ID NO: 377715 - RNA, 23 nt, Bordetella pertussis
gccgccucgauugaccagcacca

SEQ ID NO: 377716 - RNA, 15 nt, Bordetella pertussis
gccgccucaggccgg

SEQ ID NO: 377717 - RNA, 16 nt, Bordetella pertussis
gccgccucgcgcucca

SEQ ID NO: 377718 - RNA, 15 nt, Bordetella pertussis
gccgccucggcggcc

SEQ ID NO: 377719 - RNA, 19 nt, Bordetella pertussis
gccgccucggcggccagcg

SEQ ID NO: 377720 - RNA, 22 nt, Bordetella pertussis
gccgccucggcggccagcgcgc

SEQ ID NO: 377721 - RNA, 15 nt, Bordetella pertussis
gccgccucgggcacg

SEQ ID NO: 377722 - RNA, 19 nt, Bordetella pertussis
gccgccucgggcacggcca

SEQ ID NO: 377723 - RNA, 20 nt, Bordetella pertussis
gccgcgacgcuacagcguca

SEQ ID NO: 377724 - RNA, 13 nt, Bordetella pertussis
gccgcgagcaugc

SEQ ID NO: 377725 - RNA, 14 nt, Bordetella pertussis
gccgcgaggcgcag

SEQ ID NO: 377726 - RNA, 15 nt, Bordetella pertussis
gccgcgaggcgcagg

SEQ ID NO: 377727 - RNA, 14 nt, Bordetella pertussis
gccgcgaucagcgc

SEQ ID NO: 377728 - RNA, 17 nt, Bordetella pertussis
gccgcgaucagcgcggc

SEQ ID NO: 377729 - RNA, 15 nt, Bordetella pertussis
gccgcgcgccuuacu

SEQ ID NO: 377730 - RNA, 23 nt, Bordetella pertussis
gccgcgcgcgacuucgccgaucg

SEQ ID NO: 377731 - RNA, 13 nt, Bordetella pertussis
gccgcgcgcgcag

SEQ ID NO: 377732 - RNA, 13 nt, Bordetella pertussis
gccgcgcgcgcca

SEQ ID NO: 377733 - RNA, 14 nt, Bordetella pertussis
gccgcgcgcgccag

SEQ ID NO: 377734 - RNA, 16 nt, Bordetella pertussis
gccgcgcgcgccaggc

SEQ ID NO: 377735 - RNA, 15 nt, Bordetella pertussis
gccgcgcgcgccaug

SEQ ID NO: 377736 - RNA, 20 nt, Bordetella pertussis
gccgcgcgcggccccggcuc

SEQ ID NO: 377737 - RNA, 14 nt, Bordetella pertussis
gccgcgcgcggccg

SEQ ID NO: 377738 - RNA, 15 nt, Bordetella pertussis
gccgcgcgcggccgg

SEQ ID NO: 377739 - RNA, 18 nt, Bordetella pertussis
gccgcgcgcggccggcac

SEQ ID NO: 377740 - RNA, 18 nt, Bordetella pertussis
gccgcgcgcggccggcgc

SEQ ID NO: 377741 - RNA, 19 nt, Bordetella pertussis
gccgcgcgcggccggcgcg

SEQ ID NO: 377742 - RNA, 13 nt, Bordetella pertussis
gccgcgcgcggcc

SEQ ID NO: 377743 - RNA, 15 nt, Bordetella pertussis
gccgcgcgcggcggc

SEQ ID NO: 377744 - RNA, 16 nt, Bordetella pertussis
gccgcgcgcggcggcc

SEQ ID NO: 377745 - RNA, 15 nt, Bordetella pertussis
gccgcgcgcgggcgc

SEQ ID NO: 377746 - RNA, 16 nt, Bordetella pertussis
gccgcgcgcgggcgcc

SEQ ID NO: 377747 - RNA, 21 nt, Bordetella pertussis
gccgcgcgcguauggcggcgc

SEQ ID NO: 377748 - RNA, 14 nt, Bordetella pertussis
gccgcgcgcgucgc

SEQ ID NO: 377749 - RNA, 22 nt, Bordetella pertussis
gccgcgcgcgucgccgcuggcc

SEQ ID NO: 377750 - RNA, 23 nt, Bordetella pertussis
gccgcgcgcgugccgcaggccag

SEQ ID NO: 377751 - RNA, 14 nt, Bordetella pertussis
gccgcgcgcucaac

SEQ ID NO: 377752 - RNA, 13 nt, Bordetella pertussis
gccgcgcgcucgg

SEQ ID NO: 377753 - RNA, 13 nt, Bordetella pertussis
gccgcgcgcuggc

SEQ ID NO: 377754 - RNA, 14 nt, Bordetella pertussis
gccgcgcgcuggcu

SEQ ID NO: 377755 - RNA, 21 nt, Bordetella pertussis
gccgcgcgcuggcugugcccg

SEQ ID NO: 377756 - RNA, 13 nt, Bordetella pertussis
gccgcgcgcuggu

SEQ ID NO: 377757 - RNA, 15 nt, Bordetella pertussis
gccgcgcgcuggucg

SEQ ID NO: 377758 - RNA, 19 nt, Bordetella pertussis
gccgcgcgcuggucgggau

SEQ ID NO: 377759 - RNA, 20 nt, Bordetella pertussis
gccgcgcggccggcuugcgc

SEQ ID NO: 377760 - RNA, 14 nt, Bordetella pertussis
gccgcgcggccggg

SEQ ID NO: 377761 - RNA, 13 nt, Bordetella pertussis
gccgcgcggcgag

SEQ ID NO: 377762 - RNA, 12 nt, Bordetella pertussis
gccgcgcggcgc

SEQ ID NO: 377763 - RNA, 14 nt, Bordetella pertussis
gccgcgcggcgccu

SEQ ID NO: 377764 - RNA, 13 nt, Bordetella pertussis
gccgcgcggcgcg

SEQ ID NO: 377765 - RNA, 18 nt, Bordetella pertussis
gccgcgcggcggaucggc

SEQ ID NO: 377766 - RNA, 18 nt, Bordetella pertussis
gccgcgcgguacgcaccg

SEQ ID NO: 377767 - RNA, 20 nt, Bordetella pertussis
gccgcgcgguacgcaccgcc

SEQ ID NO: 377768 - RNA, 21 nt, Bordetella pertussis
gccgcgcgguacgcaccgccg

SEQ ID NO: 377769 - RNA, 22 nt, Bordetella pertussis
gccgcgcgguacgcaccgccgc

SEQ ID NO: 377770 - RNA, 18 nt, Bordetella pertussis
gccgcgcggucgccaucg

SEQ ID NO: 377771 - RNA, 16 nt, Bordetella pertussis
gccgcgcguacgcggc

SEQ ID NO: 377772 - RNA, 19 nt, Bordetella pertussis
gccgcgcguacgcggcgcg

SEQ ID NO: 377773 - RNA, 13 nt, Bordetella pertussis
gccgcgcucagca

SEQ ID NO: 377774 - RNA, 18 nt, Bordetella pertussis
gccgcgcucagcaccagg

SEQ ID NO: 377775 - RNA, 21 nt, Bordetella pertussis
gccgcgcucagcaccaggccg

SEQ ID NO: 377776 - RNA, 23 nt, Bordetella pertussis
gccgcgcucagcaccaggccgcc

SEQ ID NO: 377777 - RNA, 17 nt, Bordetella pertussis
gccgcgcucaggccgcu

SEQ ID NO: 377778 - RNA, 23 nt, Bordetella pertussis
gccgcgcucaggccgcugggcac

SEQ ID NO: 377779 - RNA, 15 nt, Bordetella pertussis
gccgcgcucgcgcca

SEQ ID NO: 377780 - RNA, 16 nt, Bordetella pertussis
gccgcgcucgcgccag

SEQ ID NO: 377781 - RNA, 17 nt, Bordetella pertussis
gccgcgcucgcgccagg

SEQ ID NO: 377782 - RNA, 18 nt, Bordetella pertussis
gccgcgcucgcgccaggc

SEQ ID NO: 377783 - RNA, 19 nt, Bordetella pertussis
gccgcgcucgcgccaggcc

SEQ ID NO: 377784 - RNA, 20 nt, Bordetella pertussis
gccgcgcucgcgccaggccc

SEQ ID NO: 377785 - RNA, 21 nt, Bordetella pertussis
gccgcgcucgcgccaggcccc

SEQ ID NO: 377786 - RNA, 14 nt, Bordetella pertussis
gccgcgcucggcgc

SEQ ID NO: 377787 - RNA, 17 nt, Bordetella pertussis
gccgcggaagucgggca

SEQ ID NO: 377788 - RNA, 23 nt, Bordetella pertussis
gccgcggaagucgggcaccagca

SEQ ID NO: 377789 - RNA, 15 nt, Bordetella pertussis
gccgcggacccaggc

SEQ ID NO: 377790 - RNA, 16 nt, Bordetella pertussis
gccgcggacccaggcc

SEQ ID NO: 377791 - RNA, 23 nt, Bordetella pertussis
gccgcggacccaggccucggcuu

SEQ ID NO: 377792 - RNA, 15 nt, Bordetella pertussis
gccgcggccuggccg

SEQ ID NO: 377793 - RNA, 18 nt, Bordetella pertussis
gccgcggccuggccgggg

SEQ ID NO: 377794 - RNA, 17 nt, Bordetella pertussis
gccgcggcgagcucggc

SEQ ID NO: 377795 - RNA, 12 nt, Bordetella pertussis
gccgcggcgcgc

SEQ ID NO: 377796 - RNA, 13 nt, Bordetella pertussis
gccgcggcgcgcg

SEQ ID NO: 377797 - RNA, 14 nt, Bordetella pertussis
gccgcggcgcgcgc

SEQ ID NO: 377798 - RNA, 19 nt, Bordetella pertussis
gccgcggcgcgcgcggcgc

SEQ ID NO: 377799 - RNA, 15 nt, Bordetella pertussis
gccgcggcgcggccc

SEQ ID NO: 377800 - RNA, 21 nt, Bordetella pertussis
gccgcggcgcggcccgccacg

SEQ ID NO: 377801 - RNA, 14 nt, Bordetella pertussis
gccgcggcggcgag

SEQ ID NO: 377802 - RNA, 13 nt, Bordetella pertussis
gccgcggcgggcu

SEQ ID NO: 377803 - RNA, 18 nt, Bordetella pertussis
gccgcggcgguuucggcc

SEQ ID NO: 377804 - RNA, 20 nt, Bordetella pertussis
gccgcggcgguuucggccgg

SEQ ID NO: 377805 - RNA, 12 nt, Bordetella pertussis
gccgcggcgugc

SEQ ID NO: 377806 - RNA, 18 nt, Bordetella pertussis
gccgcggcgugcugcccg

SEQ ID NO: 377807 - RNA, 20 nt, Bordetella pertussis
gccgcggcguugcggcagcg

SEQ ID NO: 377808 - RNA, 19 nt, Bordetella pertussis
gccgcggcuugccgcggcg

SEQ ID NO: 377809 - RNA, 15 nt, Bordetella pertussis
gccgcggucagccag

SEQ ID NO: 377810 - RNA, 17 nt, Bordetella pertussis
gccgcgguccgggccau

SEQ ID NO: 377811 - RNA, 23 nt, Bordetella pertussis
gccgcguaggcggucagcuggaa

SEQ ID NO: 377812 - RNA, 18 nt, Bordetella pertussis
gccgcguaugcggcagca

SEQ ID NO: 377813 - RNA, 19 nt, Bordetella pertussis
gccgcguaugcggcagcag

SEQ ID NO: 377814 - RNA, 24 nt, Bordetella pertussis
gccgcguaugcggcagcagggcca

SEQ ID NO: 377815 - RNA, 18 nt, Bordetella pertussis
gccgcgucauacgacgcg

SEQ ID NO: 377816 - RNA, 22 nt, Bordetella pertussis
gccgcguccgcccgcuccacca

SEQ ID NO: 377817 - RNA, 12 nt, Bordetella pertussis
gccgcguccggc

SEQ ID NO: 377818 - RNA, 16 nt, Bordetella pertussis
gccgcguccggcgccc

SEQ ID NO: 377819 - RNA, 17 nt, Bordetella pertussis
gccgcguccggcgcccg

SEQ ID NO: 377820 - RNA, 19 nt, Bordetella pertussis
gccgcguccggcgcccgcc

SEQ ID NO: 377821 - RNA, 20 nt, Bordetella pertussis
gccgcguccggcgcccgccg

SEQ ID NO: 377822 - RNA, 12 nt, Bordetella pertussis
gccgcguccagc

SEQ ID NO: 377823 - RNA, 15 nt, Bordetella pertussis
gccgcguccagcgcg

SEQ ID NO: 377824 - RNA, 19 nt, Bordetella pertussis
gccgcgucccgugccggcc

SEQ ID NO: 377825 - RNA, 20 nt, Bordetella pertussis
gccgcgucccgugccggccg

SEQ ID NO: 377826 - RNA, 21 nt, Bordetella pertussis
gccgcgucccgugccggccgg

SEQ ID NO: 377827 - RNA, 15 nt, Bordetella pertussis
gccgcguccucggcc

SEQ ID NO: 377828 - RNA, 14 nt, Bordetella pertussis
gccgcgucgagcgc

SEQ ID NO: 377829 - RNA, 14 nt, Bordetella pertussis
gccgcgucgaucag

SEQ ID NO: 377830 - RNA, 16 nt, Bordetella pertussis
gccgcgucgaucagcg

SEQ ID NO: 377831 - RNA, 23 nt, Bordetella pertussis
gccgcgucgaucagcgcgggcca

SEQ ID NO: 377832 - RNA, 23 nt, Bordetella pertussis
gccgcguuucccucggugcugcu

SEQ ID NO: 377833 - RNA, 14 nt, Bordetella pertussis
gccgcuacgcggcg

SEQ ID NO: 377834 - RNA, 15 nt, Bordetella pertussis
gccgcuccagagcgc

SEQ ID NO: 377835 - RNA, 16 nt, Bordetella pertussis
gccgcuccagagcgcg

SEQ ID NO: 377836 - RNA, 19 nt, Bordetella pertussis
gccgcuccagagcgcgcac

SEQ ID NO: 377837 - RNA, 18 nt, Bordetella pertussis
gccgcuccagccaccacu

SEQ ID NO: 377838 - RNA, 16 nt, Bordetella pertussis
gccgcucgacgucgcc

SEQ ID NO: 377839 - RNA, 20 nt, Bordetella pertussis
gccgcucgacgucgcccugg

SEQ ID NO: 377840 - RNA, 15 nt, Bordetella pertussis
gccgcucuuggcgug

SEQ ID NO: 377841 - RNA, 15 nt, Bordetella pertussis
gccgcugaccggcgg

SEQ ID NO: 377842 - RNA, 19 nt, Bordetella pertussis
gccgcugaccggcggcacg

SEQ ID NO: 377843 - RNA, 14 nt, Bordetella pertussis
gccgcugaccagca

SEQ ID NO: 377844 - RNA, 15 nt, Bordetella pertussis
gccgcugaccagcac

SEQ ID NO: 377845 - RNA, 17 nt, Bordetella pertussis
gccgcugaccagcacga

SEQ ID NO: 377846 - RNA, 15 nt, Bordetella pertussis
gccgcugacugggcg

SEQ ID NO: 377847 - RNA, 14 nt, Bordetella pertussis
gccgcugcgcagca

SEQ ID NO: 377848 - RNA, 15 nt, Bordetella pertussis
gccgcugcgcgcggc

SEQ ID NO: 377849 - RNA, 16 nt, Bordetella pertussis
gccgcugcgcgcggcc

SEQ ID NO: 377850 - RNA, 18 nt, Bordetella pertussis
gccgcugcgcuggccgcg

SEQ ID NO: 377851 - RNA, 14 nt, Bordetella pertussis
gccgcuguggacgc

SEQ ID NO: 377852 - RNA, 17 nt, Bordetella pertussis
gccgcuguggacgccgc

SEQ ID NO: 377853 - RNA, 18 nt, Bordetella pertussis
gccgcuguggacgccgcc

SEQ ID NO: 377854 - RNA, 21 nt, Bordetella pertussis
gccgcuguggacgccgccggc

SEQ ID NO: 377855 - RNA, 22 nt, Bordetella pertussis
gccgcuguggacgccgccggcc

SEQ ID NO: 377856 - RNA, 13 nt, Bordetella pertussis
gccgcuguggcgc

SEQ ID NO: 377857 - RNA, 16 nt, Bordetella pertussis
gccgcuguucggcgag

SEQ ID NO: 377858 - RNA, 20 nt, Bordetella pertussis
gccgcuguugaggaugugca

SEQ ID NO: 377859 - RNA, 19 nt, Bordetella pertussis
gccgcuguugcccaccagc

SEQ ID NO: 377860 - RNA, 21 nt, Bordetella pertussis
gccgcuguugcccaccagccg

SEQ ID NO: 377861 - RNA, 21 nt, Bordetella pertussis
gccgcuucaggaacaugucca

SEQ ID NO: 377862 - RNA, 22 nt, Bordetella pertussis
gccgcuuccggcaugaccgcgg

SEQ ID NO: 377863 - RNA, 17 nt, Bordetella pertussis
gccgcuucgaugcuggc

SEQ ID NO: 377864 - RNA, 18 nt, Bordetella pertussis
gccgcuucgaugcuggcg

SEQ ID NO: 377865 - RNA, 21 nt, Bordetella pertussis
gccgcuucgaugcuggcggca

SEQ ID NO: 377866 - RNA, 20 nt, Bordetella pertussis
gccgcuucggccugcgccac

SEQ ID NO: 377867 - RNA, 21 nt, Bordetella pertussis
gccgcuucggccugcgccacc

SEQ ID NO: 377868 - RNA, 22 nt, Bordetella pertussis
gccgcuucggccugcgccacca

SEQ ID NO: 377869 - RNA, 15 nt, Bordetella pertussis
gccgcuucggcggcc

SEQ ID NO: 377870 - RNA, 16 nt, Bordetella pertussis
gccgcuucggcggccg

SEQ ID NO: 377871 - RNA, 18 nt, Bordetella pertussis
gccgcuucggcggccgcg

SEQ ID NO: 377872 - RNA, 14 nt, Bordetella pertussis
gccgcuuucgaccu

SEQ ID NO: 377873 - RNA, 23 nt, Bordetella pertussis
gccgcuuucgaccuugcugacgc

SEQ ID NO: 377874 - RNA, 23 nt, Bordetella pertussis
gccggaaacgcggucaccgagcu

SEQ ID NO: 377875 - RNA, 18 nt, Bordetella pertussis
gccggaaagcuguccacg

SEQ ID NO: 377876 - RNA, 19 nt, Bordetella pertussis
gccggaaagcuguccacgc

SEQ ID NO: 377877 - RNA, 20 nt, Bordetella pertussis
gccggaaagcuguccacgcc

SEQ ID NO: 377878 - RNA, 17 nt, Bordetella pertussis
gccggaaaucacgaucu

SEQ ID NO: 377879 - RNA, 19 nt, Bordetella pertussis
gccggaaaucacgaucugg

SEQ ID NO: 377880 - RNA, 19 nt, Bordetella pertussis
gccggaaaugccgcgcgca

SEQ ID NO: 377881 - RNA, 20 nt, Bordetella pertussis
gccggaaaugccgcgcgcag

SEQ ID NO: 377882 - RNA, 21 nt, Bordetella pertussis
gccggaaaugccgcgcgcagg

SEQ ID NO: 377883 - RNA, 19 nt, Bordetella pertussis
gccggaacagcguccagcc

SEQ ID NO: 377884 - RNA, 16 nt, Bordetella pertussis
gccggaacaggcgccu

SEQ ID NO: 377885 - RNA, 16 nt, Bordetella pertussis
gccggaauccuggcga

SEQ ID NO: 377886 - RNA, 14 nt, Bordetella pertussis
gccggagcagucgc

SEQ ID NO: 377887 - RNA, 18 nt, Bordetella pertussis
gccggagcagucgcgcag

SEQ ID NO: 377888 - RNA, 19 nt, Bordetella pertussis
gccggagcagucgcgcagc

SEQ ID NO: 377889 - RNA, 20 nt, Bordetella pertussis
gccggagcagucgcgcagcc

SEQ ID NO: 377890 - RNA, 21 nt, Bordetella pertussis
gccggagcagucgcgcagcca

SEQ ID NO: 377891 - RNA, 17 nt, Bordetella pertussis
gccggagcccgucaggc

SEQ ID NO: 377892 - RNA, 13 nt, Bordetella pertussis
gccggagcagcag

SEQ ID NO: 377893 - RNA, 14 nt, Bordetella pertussis
gccggaucagcgcc

SEQ ID NO: 377894 - RNA, 15 nt, Bordetella pertussis
gccggauccagcugc

SEQ ID NO: 377895 - RNA, 23 nt, Bordetella pertussis
gccggauccagcugcgaaagcgc

SEQ ID NO: 377896 - RNA, 15 nt, Bordetella pertussis
gccggauggccgggu

SEQ ID NO: 377897 - RNA, 12 nt, Bordetella pertussis
gccggauggcgc

SEQ ID NO: 377898 - RNA, 18 nt, Bordetella pertussis
gccggaugguagaugcgc

SEQ ID NO: 377899 - RNA, 20 nt, Bordetella pertussis
gccggaugguagaugcgcgc

SEQ ID NO: 377900 - RNA, 14 nt, Bordetella pertussis
gccggcaaacccgg

SEQ ID NO: 377901 - RNA, 19 nt, Bordetella pertussis
gccggcacgacgaucggcc

SEQ ID NO: 377902 - RNA, 22 nt, Bordetella pertussis
gccggcacgcccagccgcagca

SEQ ID NO: 377903 - RNA, 23 nt, Bordetella pertussis
gccggcacgccgaugaacgacag

SEQ ID NO: 377904 - RNA, 17 nt, Bordetella pertussis
gccggcacgccugccgc

SEQ ID NO: 377905 - RNA, 21 nt, Bordetella pertussis
gccggcacgccugccgcgccc

SEQ ID NO: 377906 - RNA, 13 nt, Bordetella pertussis
gccggcacgcgcg

SEQ ID NO: 377907 - RNA, 14 nt, Bordetella pertussis
gccggcacgcugac

SEQ ID NO: 377908 - RNA, 17 nt, Bordetella pertussis
gccggcacgcugaccga

SEQ ID NO: 377909 - RNA, 17 nt, Bordetella pertussis
gccggcacgcugaucgc

SEQ ID NO: 377910 - RNA, 18 nt, Bordetella pertussis
gccggcacgcugaucgcc

SEQ ID NO: 377911 - RNA, 21 nt, Bordetella pertussis
gccggcacgcugaucgccggc

SEQ ID NO: 377912 - RNA, 14 nt, Bordetella pertussis
gccggcacggccgg

SEQ ID NO: 377913 - RNA, 15 nt, Bordetella pertussis
gccggcacggccggc

SEQ ID NO: 377914 - RNA, 16 nt, Bordetella pertussis
gccggcacggccggcc

SEQ ID NO: 377915 - RNA, 17 nt, Bordetella pertussis
gccggcacggccggcca

SEQ ID NO: 377916 - RNA, 18 nt, Bordetella pertussis
gccggcacggccggccag

SEQ ID NO: 377917 - RNA, 20 nt, Bordetella pertussis
gccggcacggccggccaggc

SEQ ID NO: 377918 - RNA, 22 nt, Bordetella pertussis
gccggcacggccggccaggcgc

SEQ ID NO: 377919 - RNA, 15 nt, Bordetella pertussis
gccggcagcggcgcc

SEQ ID NO: 377920 - RNA, 17 nt, Bordetella pertussis
gccggcagcggcgccau

SEQ ID NO: 377921 - RNA, 13 nt, Bordetella pertussis
gccggcaggccgg

SEQ ID NO: 377922 - RNA, 15 nt, Bordetella pertussis
gccggcaggccggcc

SEQ ID NO: 377923 - RNA, 13 nt, Bordetella pertussis
gccggcaggcgcg

SEQ ID NO: 377924 - RNA, 17 nt, Bordetella pertussis
gccggcaggcgcgccag

SEQ ID NO: 377925 - RNA, 17 nt, Bordetella pertussis
gccggcagggccagcgc

SEQ ID NO: 377926 - RNA, 19 nt, Bordetella pertussis
gccggcagggccagcgcca

SEQ ID NO: 377927 - RNA, 15 nt, Bordetella pertussis
gccggcagggcggcc

SEQ ID NO: 377928 - RNA, 17 nt, Bordetella pertussis
gccggcagggcggccag

SEQ ID NO: 377929 - RNA, 18 nt, Bordetella pertussis
gccggcagggcggccagg

SEQ ID NO: 377930 - RNA, 21 nt, Bordetella pertussis
gccggcagggcggccaggccg

SEQ ID NO: 377931 - RNA, 22 nt, Bordetella pertussis
gccggcagggcggccaggccgg

SEQ ID NO: 377932 - RNA, 19 nt, Bordetella pertussis
gccggcagggugcuguuca

SEQ ID NO: 377933 - RNA, 17 nt, Bordetella pertussis
gccggcauaggcggcgc

SEQ ID NO: 377934 - RNA, 18 nt, Bordetella pertussis
gccggcauaggcggcgca

SEQ ID NO: 377935 - RNA, 19 nt, Bordetella pertussis
gccggcauaggcggcgcag

SEQ ID NO: 377936 - RNA, 20 nt, Bordetella pertussis
gccggcauaggcggcgcagg

SEQ ID NO: 377937 - RNA, 23 nt, Bordetella pertussis
gccggcauaggcggcgcaggcca

SEQ ID NO: 377938 - RNA, 15 nt, Bordetella pertussis
gccggcagugccugc

SEQ ID NO: 377939 - RNA, 23 nt, Bordetella pertussis
gccggcagugccugcgaacgccc

SEQ ID NO: 377940 - RNA, 16 nt, Bordetella pertussis
gccggccaccagcggc

SEQ ID NO: 377941 - RNA, 17 nt, Bordetella pertussis
gccggccaccagcggcg

SEQ ID NO: 377942 - RNA, 18 nt, Bordetella pertussis
gccggccaccagcggcgc

SEQ ID NO: 377943 - RNA, 19 nt, Bordetella pertussis
gccggccaccagcggcgcc

SEQ ID NO: 377944 - RNA, 20 nt, Bordetella pertussis
gccggccaccagcggcgccg

SEQ ID NO: 377945 - RNA, 21 nt, Bordetella pertussis
gccggccaccagcggcgccgg

SEQ ID NO: 377946 - RNA, 15 nt, Bordetella pertussis
gccggccaccgccug

SEQ ID NO: 377947 - RNA, 13 nt, Bordetella pertussis
gccggccacgcgc

SEQ ID NO: 377948 - RNA, 12 nt, Bordetella pertussis
gccggccagcug

SEQ ID NO: 377949 - RNA, 16 nt, Bordetella pertussis
gccggccagcugcaug

SEQ ID NO: 377950 - RNA, 20 nt, Bordetella pertussis
gccggccagcugcaugcgca

SEQ ID NO: 377951 - RNA, 22 nt, Bordetella pertussis
gccggccagcugcaugcgcacg

SEQ ID NO: 377952 - RNA, 22 nt, Bordetella pertussis
gccggccagcuugagcaggcgc

SEQ ID NO: 377953 - RNA, 22 nt, Bordetella pertussis
gccggccaggacgaucccggcc

SEQ ID NO: 377954 - RNA, 23 nt, Bordetella pertussis
gccggccaggacgaucccggcca

SEQ ID NO: 377955 - RNA, 18 nt, Bordetella pertussis
gccggccaggaugagggc

SEQ ID NO: 377956 - RNA, 14 nt, Bordetella pertussis
gccggccaggcccu

SEQ ID NO: 377957 - RNA, 15 nt, Bordetella pertussis
gccggccagggccac

SEQ ID NO: 377958 - RNA, 20 nt, Bordetella pertussis
gccggccagggccacgccgg

SEQ ID NO: 377959 - RNA, 21 nt, Bordetella pertussis
gccggccagggccacgccggc

SEQ ID NO: 377960 - RNA, 13 nt, Bordetella pertussis
gccggccagggcg

SEQ ID NO: 377961 - RNA, 13 nt, Bordetella pertussis
gccggccaggccc

SEQ ID NO: 377962 - RNA, 15 nt, Bordetella pertussis
gccggccaggcgccg

SEQ ID NO: 377963 - RNA, 16 nt, Bordetella pertussis
gccggccaggcgccgc

SEQ ID NO: 377964 - RNA, 15 nt, Bordetella pertussis
gccggccaggucggc

SEQ ID NO: 377965 - RNA, 22 nt, Bordetella pertussis
gccggccaguggcgcggcgucg

SEQ ID NO: 377966 - RNA, 11 nt, Bordetella pertussis
gccggccauca

SEQ ID NO: 377967 - RNA, 12 nt, Bordetella pertussis
gccggccaucac

SEQ ID NO: 377968 - RNA, 18 nt, Bordetella pertussis
gccggccaucaggugcag

SEQ ID NO: 377969 - RNA, 22 nt, Bordetella pertussis
gccggccaugcucagcagcacc

SEQ ID NO: 377970 - RNA, 14 nt, Bordetella pertussis
gccggccauggccc

SEQ ID NO: 377971 - RNA, 13 nt, Bordetella pertussis
gccggcccgccac

SEQ ID NO: 377972 - RNA, 14 nt, Bordetella pertussis
gccggcccgccacg

SEQ ID NO: 377973 - RNA, 19 nt, Bordetella pertussis
gccggcccgccacgcgggc

SEQ ID NO: 377974 - RNA, 21 nt, Bordetella pertussis
gccggcccggaauaccgccag

SEQ ID NO: 377975 - RNA, 11 nt, Bordetella pertussis
gccggcccggu

SEQ ID NO: 377976 - RNA, 18 nt, Bordetella pertussis
gccggcccguuggcaggc

SEQ ID NO: 377977 - RNA, 22 nt, Bordetella pertussis
gccggcccugccgcccuggcgc

SEQ ID NO: 377978 - RNA, 16 nt, Bordetella pertussis
gccggccgaccggcgc

SEQ ID NO: 377979 - RNA, 17 nt, Bordetella pertussis
gccggccgaccggcgcg

SEQ ID NO: 377980 - RNA, 19 nt, Bordetella pertussis
gccggccgaccggcgcgcg

SEQ ID NO: 377981 - RNA, 15 nt, Bordetella pertussis
gccggccgacggcgc

SEQ ID NO: 377982 - RNA, 16 nt, Bordetella pertussis
gccggccgauagccgc

SEQ ID NO: 377983 - RNA, 23 nt, Bordetella pertussis
gccggccgauagccgcggcgccg

SEQ ID NO: 377984 - RNA, 14 nt, Bordetella pertussis
gccggccgccagca

SEQ ID NO: 377985 - RNA, 15 nt, Bordetella pertussis
gccggccgcccaggc

SEQ ID NO: 377986 - RNA, 18 nt, Bordetella pertussis
gccggccgcccaggcgca

SEQ ID NO: 377987 - RNA, 19 nt, Bordetella pertussis
gccggccgcccaggcgcag

SEQ ID NO: 377988 - RNA, 22 nt, Bordetella pertussis
gccggccgcccaggcgcagccg

SEQ ID NO: 377989 - RNA, 15 nt, Bordetella pertussis
gccggccgccgaacg

SEQ ID NO: 377990 - RNA, 13 nt, Bordetella pertussis
gccggccgccggc

SEQ ID NO: 377991 - RNA, 17 nt, Bordetella pertussis
gccggccgccgggccgc

SEQ ID NO: 377992 - RNA, 14 nt, Bordetella pertussis
gccggccgccucca

SEQ ID NO: 377993 - RNA, 18 nt, Bordetella pertussis
gccggccgccuccaggcg

SEQ ID NO: 377994 - RNA, 15 nt, Bordetella pertussis
gccggccgcgcccag

SEQ ID NO: 377995 - RNA, 17 nt, Bordetella pertussis
gccggccgcgcccagcg

SEQ ID NO: 377996 - RNA, 22 nt, Bordetella pertussis
gccggccgcgcccaugcgcugg

SEQ ID NO: 377997 - RNA, 13 nt, Bordetella pertussis
gccggccgcgccg

SEQ ID NO: 377998 - RNA, 15 nt, Bordetella pertussis
gccggccgcgccgcg

SEQ ID NO: 377999 - RNA, 14 nt, Bordetella pertussis
gccggccgccuggc

SEQ ID NO: 378000 - RNA, 14 nt, Bordetella pertussis
gccggccgcgcgcg

SEQ ID NO: 378001 - RNA, 15 nt, Bordetella pertussis
gccggccgcgcgcgc

SEQ ID NO: 378002 - RNA, 17 nt, Bordetella pertussis
gccggccgcgcgcgcca

SEQ ID NO: 378003 - RNA, 19 nt, Bordetella pertussis
gccggccgcgcgcgccagg

SEQ ID NO: 378004 - RNA, 18 nt, Bordetella pertussis
gccggccgcgcgcgccau

SEQ ID NO: 378005 - RNA, 19 nt, Bordetella pertussis
gccggccgcgcggccguca

SEQ ID NO: 378006 - RNA, 20 nt, Bordetella pertussis
gccggccgcgcggccgucag

SEQ ID NO: 378007 - RNA, 13 nt, Bordetella pertussis
gccggccgcgcgc

SEQ ID NO: 378008 - RNA, 12 nt, Bordetella pertussis
gccggccgcguu

SEQ ID NO: 378009 - RNA, 18 nt, Bordetella pertussis
gccggccgcguucagcau

SEQ ID NO: 378010 - RNA, 18 nt, Bordetella pertussis
gccggccgcggggcuggc

SEQ ID NO: 378011 - RNA, 20 nt, Bordetella pertussis
gccggccgcggggcuggcca

SEQ ID NO: 378012 - RNA, 14 nt, Bordetella pertussis
gccggccgggccgc

SEQ ID NO: 378013 - RNA, 22 nt, Bordetella pertussis
gccggccgggccgcgcgaugcg

SEQ ID NO: 378014 - RNA, 23 nt, Bordetella pertussis
gccggccggguugucgcccacca

SEQ ID NO: 378015 - RNA, 20 nt, Bordetella pertussis
gccggccguauggccguugg

SEQ ID NO: 378016 - RNA, 18 nt, Bordetella pertussis
gccggccguuucaggccu

SEQ ID NO: 378017 - RNA, 22 nt, Bordetella pertussis
gccggccguuucaggccugcgg

SEQ ID NO: 378018 - RNA, 14 nt, Bordetella pertussis
gccggccuccagca

SEQ ID NO: 378019 - RNA, 16 nt, Bordetella pertussis
gccggccuccagcauc

SEQ ID NO: 378020 - RNA, 24 nt, Bordetella pertussis
gccggccuccagcaucgccgccag

SEQ ID NO: 378021 - RNA, 17 nt, Bordetella pertussis
gccggccuccggggugc

SEQ ID NO: 378022 - RNA, 14 nt, Bordetella pertussis
gccggccucggcca

SEQ ID NO: 378023 - RNA, 19 nt, Bordetella pertussis
gccggccugcaaugcggcc

SEQ ID NO: 378024 - RNA, 21 nt, Bordetella pertussis
gccggccugcaaugcggccag

SEQ ID NO: 378025 - RNA, 17 nt, Bordetella pertussis
gccggccugcaggugcc

SEQ ID NO: 378026 - RNA, 22 nt, Bordetella pertussis
gccggccugcaggugccgccgg

SEQ ID NO: 378027 - RNA, 15 nt, Bordetella pertussis
gccggccugccggcg

SEQ ID NO: 378028 - RNA, 17 nt, Bordetella pertussis
gccggccugccggcgca

SEQ ID NO: 378029 - RNA, 18 nt, Bordetella pertussis
gccggccugccggcgcac

SEQ ID NO: 378030 - RNA, 21 nt, Bordetella pertussis
gccggccugcgauucgcgcuu

SEQ ID NO: 378031 - RNA, 13 nt, Bordetella pertussis
gccggccugcgcc

SEQ ID NO: 378032 - RNA, 15 nt, Bordetella pertussis
gccggccugcgccag

SEQ ID NO: 378033 - RNA, 17 nt, Bordetella pertussis
gccggccugcgccagcu

SEQ ID NO: 378034 - RNA, 14 nt, Bordetella pertussis
gccggccugcgucg

SEQ ID NO: 378035 - RNA, 15 nt, Bordetella pertussis
gccggccugcgucgc

SEQ ID NO: 378036 - RNA, 17 nt, Bordetella pertussis
gccggccugcgucgcca

SEQ ID NO: 378037 - RNA, 18 nt, Bordetella pertussis
gccggccugcucgccggc

SEQ ID NO: 378038 - RNA, 19 nt, Bordetella pertussis
gccggccugcucgccggcc

SEQ ID NO: 378039 - RNA, 15 nt, Bordetella pertussis
gccggccuggcgcga

SEQ ID NO: 378040 - RNA, 23 nt, Bordetella pertussis
gccggccuggcgcgacgccugcg

SEQ ID NO: 378041 - RNA, 15 nt, Bordetella pertussis
gccggccuggcgcgc

SEQ ID NO: 378042 - RNA, 16 nt, Bordetella pertussis
gccggccuggcgcgca

SEQ ID NO: 378043 - RNA, 17 nt, Bordetella pertussis
gccggccuggcgcgcau

SEQ ID NO: 378044 - RNA, 20 nt, Bordetella pertussis
gccggccuggcgcgcaucgg

SEQ ID NO: 378045 - RNA, 13 nt, Bordetella pertussis
gccggccuggcuc

SEQ ID NO: 378046 - RNA, 18 nt, Bordetella pertussis
gccggccugggcggcggc

SEQ ID NO: 378047 - RNA, 19 nt, Bordetella pertussis
gccggccugggcggcggcg

SEQ ID NO: 378048 - RNA, 22 nt, Bordetella pertussis
gccggccugggcggcggcgaug

SEQ ID NO: 378049 - RNA, 22 nt, Bordetella pertussis
gccggccuggggacgggcgcac

SEQ ID NO: 378050 - RNA, 19 nt, Bordetella pertussis
gccggccucuucgucgccg

SEQ ID NO: 378051 - RNA, 23 nt, Bordetella pertussis
gccggccucuucgucgccggcgc

SEQ ID NO: 378052 - RNA, 13 nt, Bordetella pertussis
gccggccugacgc

SEQ ID NO: 378053 - RNA, 17 nt, Bordetella pertussis
gccggccugaggcccga

SEQ ID NO: 378054 - RNA, 21 nt, Bordetella pertussis
gccggccugcuuggccgcgua

SEQ ID NO: 378055 - RNA, 14 nt, Bordetella pertussis
gccggccuugcuga

SEQ ID NO: 378056 - RNA, 16 nt, Bordetella pertussis
gccggcgaaugccggc

SEQ ID NO: 378057 - RNA, 17 nt, Bordetella pertussis
gccggcgaaugccggcc

SEQ ID NO: 378058 - RNA, 14 nt, Bordetella pertussis
gccggcgacguggc

SEQ ID NO: 378059 - RNA, 16 nt, Bordetella pertussis
gccggcgacguggcgc

SEQ ID NO: 378060 - RNA, 18 nt, Bordetella pertussis
gccggcgacguggcgcuc

SEQ ID NO: 378061 - RNA, 15 nt, Bordetella pertussis
gccggcgauauggcc

SEQ ID NO: 378062 - RNA, 19 nt, Bordetella pertussis
gccggcgauauggccaggg

SEQ ID NO: 378063 - RNA, 22 nt, Bordetella pertussis
gccggcgauauggccagggucg

SEQ ID NO: 378064 - RNA, 20 nt, Bordetella pertussis
gccggcgaugaagucgcggc

SEQ ID NO: 378065 - RNA, 23 nt, Bordetella pertussis
gccggcgaugaagucgcggcccg

SEQ ID NO: 378066 - RNA, 14 nt, Bordetella pertussis
gccggcgauggcgu

SEQ ID NO: 378067 - RNA, 21 nt, Bordetella pertussis
gccggcgauggcguugcgcac

SEQ ID NO: 378068 - RNA, 17 nt, Bordetella pertussis
gccggcgauugcgccag

SEQ ID NO: 378069 - RNA, 18 nt, Bordetella pertussis
gccggcgauugcgccagc

SEQ ID NO: 378070 - RNA, 19 nt, Bordetella pertussis
gccggcgauugcgccagcg

SEQ ID NO: 378071 - RNA, 16 nt, Bordetella pertussis
gccggcgcaacgggcc

SEQ ID NO: 378072 - RNA, 22 nt, Bordetella pertussis
gccggcgcacaaucugcgucgc

SEQ ID NO: 378073 - RNA, 15 nt, Bordetella pertussis
gccggcgcacccggu

SEQ ID NO: 378074 - RNA, 18 nt, Bordetella pertussis
gccggcgcaugagccggc

SEQ ID NO: 378075 - RNA, 20 nt, Bordetella pertussis
gccggcgcaugagccggcag

SEQ ID NO: 378076 - RNA, 13 nt, Bordetella pertussis
gccggcgccagcc

SEQ ID NO: 378077 - RNA, 14 nt, Bordetella pertussis
gccggcgccagccg

SEQ ID NO: 378078 - RNA, 16 nt, Bordetella pertussis
gccggcgccagccgcu

SEQ ID NO: 378079 - RNA, 13 nt, Bordetella pertussis
gccggcgccccca

SEQ ID NO: 378080 - RNA, 17 nt, Bordetella pertussis
gccggcgcccccagcag

SEQ ID NO: 378081 - RNA, 18 nt, Bordetella pertussis
gccggcgcccccagcagc

SEQ ID NO: 378082 - RNA, 22 nt, Bordetella pertussis
gccggcgcccccagcagcgagg

SEQ ID NO: 378083 - RNA, 11 nt, Bordetella pertussis
gccggcgcccg

SEQ ID NO: 378084 - RNA, 11 nt, Bordetella pertussis
gccggcgcccu

SEQ ID NO: 378085 - RNA, 12 nt, Bordetella pertussis
gccggcgccggc

SEQ ID NO: 378086 - RNA, 13 nt, Bordetella pertussis
gccggcgccggca

SEQ ID NO: 378087 - RNA, 16 nt, Bordetella pertussis
gccggcgccggcgacg

SEQ ID NO: 378088 - RNA, 19 nt, Bordetella pertussis
gccggcgccggcgacgccg

SEQ ID NO: 378089 - RNA, 15 nt, Bordetella pertussis
gccggcgccggcgcg

SEQ ID NO: 378090 - RNA, 18 nt, Bordetella pertussis
gccggcgccggcgcgccg

SEQ ID NO: 378091 - RNA, 14 nt, Bordetella pertussis
gccggcgccguuca

SEQ ID NO: 378092 - RNA, 21 nt, Bordetella pertussis
gccggcgccguuuucagcgca

SEQ ID NO: 378093 - RNA, 20 nt, Bordetella pertussis
gccggcgccuuggccugggc

SEQ ID NO: 378094 - RNA, 15 nt, Bordetella pertussis
gccggcgcgaacccc

SEQ ID NO: 378095 - RNA, 22 nt, Bordetella pertussis
gccggcgcgaaccccuccggcg

SEQ ID NO: 378096 - RNA, 19 nt, Bordetella pertussis
gccggcgcgaccgccucca

SEQ ID NO: 378097 - RNA, 14 nt, Bordetella pertussis
gccggcgcgcaaac

SEQ ID NO: 378098 - RNA, 13 nt, Bordetella pertussis
gccggcgcgcagg

SEQ ID NO: 378099 - RNA, 15 nt, Bordetella pertussis
gccggcgcgcaggca

SEQ ID NO: 378100 - RNA, 12 nt, Bordetella pertussis
gccggcgcgccc

SEQ ID NO: 378101 - RNA, 13 nt, Bordetella pertussis
gccggcgcgccca

SEQ ID NO: 378102 - RNA, 20 nt, Bordetella pertussis
gccggcgcgccggcccaagg

SEQ ID NO: 378103 - RNA, 19 nt, Bordetella pertussis
gccggcgcgccggccgcgg

SEQ ID NO: 378104 - RNA, 15 nt, Bordetella pertussis
gccggcgcgccgggc

SEQ ID NO: 378105 - RNA, 14 nt, Bordetella pertussis
gccggcgcgcgcag

SEQ ID NO: 378106 - RNA, 15 nt, Bordetella pertussis
gccggcgcgcgcagg

SEQ ID NO: 378107 - RNA, 16 nt, Bordetella pertussis
gccggcgcgcgcaggc

SEQ ID NO: 378108 - RNA, 13 nt, Bordetella pertussis
gccggcgcgcgcg

SEQ ID NO: 378109 - RNA, 17 nt, Bordetella pertussis
gccggcgcgcgcgacca

SEQ ID NO: 378110 - RNA, 18 nt, Bordetella pertussis
gccggcgcgcgcgcgccg

SEQ ID NO: 378111 - RNA, 17 nt, Bordetella pertussis
gccggcgcgcgcguaca

SEQ ID NO: 378112 - RNA, 19 nt, Bordetella pertussis
gccggcgcgcgcguacagc

SEQ ID NO: 378113 - RNA, 15 nt, Bordetella pertussis
gccggcgcgcgcuga

SEQ ID NO: 378114 - RNA, 14 nt, Bordetella pertussis
gccggcgcgcggcc

SEQ ID NO: 378115 - RNA, 16 nt, Bordetella pertussis
gccggcgcgcucggcc

SEQ ID NO: 378116 - RNA, 17 nt, Bordetella pertussis
gccggcgcgcucggccu

SEQ ID NO: 378117 - RNA, 12 nt, Bordetella pertussis
gccggcgcgccu

SEQ ID NO: 378118 - RNA, 21 nt, Bordetella pertussis
gccggcgcggcugcugggcau

SEQ ID NO: 378119 - RNA, 13 nt, Bordetella pertussis
gccggcgcgggcg

SEQ ID NO: 378120 - RNA, 14 nt, Bordetella pertussis
gccggcgcgguggc

SEQ ID NO: 378121 - RNA, 13 nt, Bordetella pertussis
gccggcgcgucgc

SEQ ID NO: 378122 - RNA, 14 nt, Bordetella pertussis
gccggcgcgucgcc

SEQ ID NO: 378123 - RNA, 20 nt, Bordetella pertussis
gccggcgcgucgccggcgau

SEQ ID NO: 378124 - RNA, 23 nt, Bordetella pertussis
gccggcgcgucgcgcggcggcac

SEQ ID NO: 378125 - RNA, 15 nt, Bordetella pertussis
gccggcgcgugcugg

SEQ ID NO: 378126 - RNA, 22 nt, Bordetella pertussis
gccggcgcgugcuggcgcagca

SEQ ID NO: 378127 - RNA, 14 nt, Bordetella pertussis
gccggcgcucagcg

SEQ ID NO: 378128 - RNA, 16 nt, Bordetella pertussis
gccggcgcucgcgcac

SEQ ID NO: 378129 - RNA, 18 nt, Bordetella pertussis
gccggcgcucgcgcaccg

SEQ ID NO: 378130 - RNA, 13 nt, Bordetella pertussis
gccggcgcugcgc

SEQ ID NO: 378131 - RNA, 17 nt, Bordetella pertussis
gccggcgcugcgcagca

SEQ ID NO: 378132 - RNA, 23 nt, Bordetella pertussis
gccggcgcugcgcagcagggcgg

SEQ ID NO: 378133 - RNA, 14 nt, Bordetella pertussis
gccggcgcugcugu

SEQ ID NO: 378134 - RNA, 17 nt, Bordetella pertussis
gccggcgcugcugucgc

SEQ ID NO: 378135 - RNA, 17 nt, Bordetella pertussis
gccggcgcugggcaggc

SEQ ID NO: 378136 - RNA, 21 nt, Bordetella pertussis
gccggcgcugggcaggcuggc

SEQ ID NO: 378137 - RNA, 23 nt, Bordetella pertussis
gccggcgcugggcaggcuggcgc

SEQ ID NO: 378138 - RNA, 21 nt, Bordetella pertussis
gccggcggcaauaucggcacc

SEQ ID NO: 378139 - RNA, 12 nt, Bordetella pertussis
gccggcggcacc

SEQ ID NO: 378140 - RNA, 13 nt, Bordetella pertussis
gccggcggcaccg

SEQ ID NO: 378141 - RNA, 15 nt, Bordetella pertussis
gccggcggcaccgcg

SEQ ID NO: 378142 - RNA, 18 nt, Bordetella pertussis
gccggcggcaccgcgcag

SEQ ID NO: 378143 - RNA, 20 nt, Bordetella pertussis
gccggcggcaccgcgcagcc

SEQ ID NO: 378144 - RNA, 18 nt, Bordetella pertussis
gccggcggcacgcugcgc

SEQ ID NO: 378145 - RNA, 21 nt, Bordetella pertussis
gccggcggcacgcugcgcagg

SEQ ID NO: 378146 - RNA, 13 nt, Bordetella pertussis
gccggcggcagcc

SEQ ID NO: 378147 - RNA, 15 nt, Bordetella pertussis
gccggcggcagccgg

SEQ ID NO: 378148 - RNA, 16 nt, Bordetella pertussis
gccggcggcagccggc

SEQ ID NO: 378149 - RNA, 18 nt, Bordetella pertussis
gccggcggcagccggcca

SEQ ID NO: 378150 - RNA, 19 nt, Bordetella pertussis
gccggcggcagccggccau

SEQ ID NO: 378151 - RNA, 23 nt, Bordetella pertussis
gccggcggcaugcgccagccagc

SEQ ID NO: 378152 - RNA, 16 nt, Bordetella pertussis
gccggcggcauucagc

SEQ ID NO: 378153 - RNA, 21 nt, Bordetella pertussis
gccggcggccagcgcgccgcc

SEQ ID NO: 378154 - RNA, 21 nt, Bordetella pertussis
gccggcggcccauucgcgcac

SEQ ID NO: 378155 - RNA, 23 nt, Bordetella pertussis
gccggcggcccauucgcgcaccg

SEQ ID NO: 378156 - RNA, 13 nt, Bordetella pertussis
gccggcggccggu

SEQ ID NO: 378157 - RNA, 23 nt, Bordetella pertussis
gccggcggccuaugugcaggcca

SEQ ID NO: 378158 - RNA, 14 nt, Bordetella pertussis
gccggcggccugca

SEQ ID NO: 378159 - RNA, 15 nt, Bordetella pertussis
gccggcggccugcag

SEQ ID NO: 378160 - RNA, 15 nt, Bordetella pertussis
gccggcggccuggac

SEQ ID NO: 378161 - RNA, 15 nt, Bordetella pertussis
gccggcggcgaugcg

SEQ ID NO: 378162 - RNA, 11 nt, Bordetella pertussis
gccggcggcgc

SEQ ID NO: 378163 - RNA, 13 nt, Bordetella pertussis
gccggcggcgcac

SEQ ID NO: 378164 - RNA, 15 nt, Bordetella pertussis
gccggcggcgcacca

SEQ ID NO: 378165 - RNA, 14 nt, Bordetella pertussis
gccggcggcgccgg

SEQ ID NO: 378166 - RNA, 17 nt, Bordetella pertussis
gccggcggcgccggccu

SEQ ID NO: 378167 - RNA, 15 nt, Bordetella pertussis
gccggcggcgcuggc

SEQ ID NO: 378168 - RNA, 13 nt, Bordetella pertussis
gccggcggcgggc

SEQ ID NO: 378169 - RNA, 14 nt, Bordetella pertussis
gccggcggcgguca

SEQ ID NO: 378170 - RNA, 17 nt, Bordetella pertussis
gccggcggcggucagcg

SEQ ID NO: 378171 - RNA, 21 nt, Bordetella pertussis
gccggcggcgugcgccugcug

SEQ ID NO: 378172 - RNA, 22 nt, Bordetella pertussis
gccggcggcgugcgccugcugg

SEQ ID NO: 378173 - RNA, 14 nt, Bordetella pertussis
gccggcgggcaggc

SEQ ID NO: 378174 - RNA, 20 nt, Bordetella pertussis
gccggcgggcaggcgggcca

SEQ ID NO: 378175 - RNA, 23 nt, Bordetella pertussis
gccggcgggcaggcgggccaggc

SEQ ID NO: 378176 - RNA, 14 nt, Bordetella pertussis
gccggcgggcgcug

SEQ ID NO: 378177 - RNA, 15 nt, Bordetella pertussis
gccggcgggcgcugc

SEQ ID NO: 378178 - RNA, 23 nt, Bordetella pertussis
gccggcgggcgcugccugccggc

SEQ ID NO: 378179 - RNA, 16 nt, Bordetella pertussis
gccggcgggcggcugc

SEQ ID NO: 378180 - RNA, 14 nt, Bordetella pertussis
gccggcggucacgc

SEQ ID NO: 378181 - RNA, 17 nt, Bordetella pertussis
gccggcggucacgccga

SEQ ID NO: 378182 - RNA, 21 nt, Bordetella pertussis
gccggcggucccgagcgcucc

SEQ ID NO: 378183 - RNA, 20 nt, Bordetella pertussis
gccggcggucgcgcuggccc

SEQ ID NO: 378184 - RNA, 24 nt, Bordetella pertussis
gccggcggugaugacgucgucgau

SEQ ID NO: 378185 - RNA, 14 nt, Bordetella pertussis
gccggcgucacgcg

SEQ ID NO: 378186 - RNA, 18 nt, Bordetella pertussis
gccggcgucacgcggccg

SEQ ID NO: 378187 - RNA, 20 nt, Bordetella pertussis
gccggcgucacgcggccggg

SEQ ID NO: 378188 - RNA, 15 nt, Bordetella pertussis
gccggcguccacggc

SEQ ID NO: 378189 - RNA, 22 nt, Bordetella pertussis
gccggcguccacggcaucggcc

SEQ ID NO: 378190 - RNA, 22 nt, Bordetella pertussis
gccggcguagucguugccggcc

SEQ ID NO: 378191 - RNA, 18 nt, Bordetella pertussis
gccggcgucaaaccaagc

SEQ ID NO: 378192 - RNA, 23 nt, Bordetella pertussis
gccggcguccugcggcggcagcu

SEQ ID NO: 378193 - RNA, 23 nt, Bordetella pertussis
gccggcgucuggagcggccuggc

SEQ ID NO: 378194 - RNA, 19 nt, Bordetella pertussis
gccggcguggccugcccgu

SEQ ID NO: 378195 - RNA, 13 nt, Bordetella pertussis
gccggcguggcgc

SEQ ID NO: 378196 - RNA, 14 nt, Bordetella pertussis
gccggcguggcgcg

SEQ ID NO: 378197 - RNA, 20 nt, Bordetella pertussis
gccggcguguucagcgcgcg

SEQ ID NO: 378198 - RNA, 21 nt, Bordetella pertussis
gccggcguucaccaggaagcg

SEQ ID NO: 378199 - RNA, 22 nt, Bordetella pertussis
gccggcguucaccaggaagcgc

SEQ ID NO: 378200 - RNA, 20 nt, Bordetella pertussis
gccggcguucuggucagccg

SEQ ID NO: 378201 - RNA, 22 nt, Bordetella pertussis
gccggcguucuucagcgcgcuc

SEQ ID NO: 378202 - RNA, 17 nt, Bordetella pertussis
gccggcguugaaggcga

SEQ ID NO: 378203 - RNA, 17 nt, Bordetella pertussis
gccggcguugccguuuc

SEQ ID NO: 378204 - RNA, 15 nt, Bordetella pertussis
gccggcguuggccgg

SEQ ID NO: 378205 - RNA, 17 nt, Bordetella pertussis
gccggcguuggccgggu

SEQ ID NO: 378206 - RNA, 22 nt, Bordetella pertussis
gccggcguuggccgggucgcgc

SEQ ID NO: 378207 - RNA, 23 nt, Bordetella pertussis
gccggcguuggccgggucgcgca

SEQ ID NO: 378208 - RNA, 23 nt, Bordetella pertussis
gccggcguuggugacgauggugc

SEQ ID NO: 378209 - RNA, 19 nt, Bordetella pertussis
gccggcuaccgcgccaucu

SEQ ID NO: 378210 - RNA, 20 nt, Bordetella pertussis
gccggcuacagcucgccggc

SEQ ID NO: 378211 - RNA, 15 nt, Bordetella pertussis
gccggcucaggccag

SEQ ID NO: 378212 - RNA, 17 nt, Bordetella pertussis
gccggcucaggccagcg

SEQ ID NO: 378213 - RNA, 19 nt, Bordetella pertussis
gccggcucaggccagcgac

SEQ ID NO: 378214 - RNA, 19 nt, Bordetella pertussis
gccggcucauucggcgcgc

SEQ ID NO: 378215 - RNA, 15 nt, Bordetella pertussis
gccggcuccgauagc

SEQ ID NO: 378216 - RNA, 19 nt, Bordetella pertussis
gccggcuccgauagcggcg

SEQ ID NO: 378217 - RNA, 20 nt, Bordetella pertussis
gccggcuccgauagcggcgc

SEQ ID NO: 378218 - RNA, 20 nt, Bordetella pertussis
gccggcucgaacaggcuggc

SEQ ID NO: 378219 - RNA, 18 nt, Bordetella pertussis
gccggcugaauuggcgcc

SEQ ID NO: 378220 - RNA, 24 nt, Bordetella pertussis
gccggcugaauuggcgcccaucgc

SEQ ID NO: 378221 - RNA, 15 nt, Bordetella pertussis
gccggcucccgcgcu

SEQ ID NO: 378222 - RNA, 19 nt, Bordetella pertussis
gccggcucccgcgcugccg

SEQ ID NO: 378223 - RNA, 19 nt, Bordetella pertussis
gccggcucguacggcgucg

SEQ ID NO: 378224 - RNA, 21 nt, Bordetella pertussis
gccggcucguaggcgaggucc

SEQ ID NO: 378225 - RNA, 16 nt, Bordetella pertussis
gccggcugcaccagcg

SEQ ID NO: 378226 - RNA, 18 nt, Bordetella pertussis
gccggcugcaccagcgcg

SEQ ID NO: 378227 - RNA, 21 nt, Bordetella pertussis
gccggcugcaccagcgcgccg

SEQ ID NO: 378228 - RNA, 23 nt, Bordetella pertussis
gccggcugcaccagcgcgccgcg

SEQ ID NO: 378229 - RNA, 13 nt, Bordetella pertussis
gccggcugcgcgc

SEQ ID NO: 378230 - RNA, 14 nt, Bordetella pertussis
gccggcugcgcgcc

SEQ ID NO: 378231 - RNA, 18 nt, Bordetella pertussis
gccggcugcgcgccgacc

SEQ ID NO: 378232 - RNA, 12 nt, Bordetella pertussis
gccggcuggcau

SEQ ID NO: 378233 - RNA, 15 nt, Bordetella pertussis
gccggcugggcggcc

SEQ ID NO: 378234 - RNA, 22 nt, Bordetella pertussis
gccggcuuccagcagcaugccg

SEQ ID NO: 378235 - RNA, 18 nt, Bordetella pertussis
gccggcuucgucaugguc

SEQ ID NO: 378236 - RNA, 20 nt, Bordetella pertussis
gccggcuugcauggugccgg

SEQ ID NO: 378237 - RNA, 15 nt, Bordetella pertussis
gccggcuugcgcaag

SEQ ID NO: 378238 - RNA, 22 nt, Bordetella pertussis
gccggcuugcgcaagccggccg

SEQ ID NO: 378239 - RNA, 15 nt, Bordetella pertussis
gccggcuugcgccag

SEQ ID NO: 378240 - RNA, 18 nt, Bordetella pertussis
gccggcuugcgccagcca

SEQ ID NO: 378241 - RNA, 20 nt, Bordetella pertussis
gccggcuugcgccagccacg

SEQ ID NO: 378242 - RNA, 18 nt, Bordetella pertussis
gccggcuuucagcgccga

SEQ ID NO: 378243 - RNA, 22 nt, Bordetella pertussis
gccggcuuucagcgccgagcgc

SEQ ID NO: 378244 - RNA, 12 nt, Bordetella pertussis
gccgggacaggc

SEQ ID NO: 378245 - RNA, 13 nt, Bordetella pertussis
gccgggacaggca

SEQ ID NO: 378246 - RNA, 14 nt, Bordetella pertussis
gccgggacaggcac

SEQ ID NO: 378247 - RNA, 17 nt, Bordetella pertussis
gccgggacaaucgaaga

SEQ ID NO: 378248 - RNA, 14 nt, Bordetella pertussis
gccgggagccuguc

SEQ ID NO: 378249 - RNA, 16 nt, Bordetella pertussis
gccgggagcggccagc

SEQ ID NO: 378250 - RNA, 17 nt, Bordetella pertussis
gccgggagcggccagca

SEQ ID NO: 378251 - RNA, 19 nt, Bordetella pertussis
gccgggagcggccagcaag

SEQ ID NO: 378252 - RNA, 23 nt, Bordetella pertussis
gccgggaccuuggcggcuggcgc

SEQ ID NO: 378253 - RNA, 20 nt, Bordetella pertussis
gccgggauccacgccgccgg

SEQ ID NO: 378254 - RNA, 20 nt, Bordetella pertussis
gccgguucgaugaccugggc

SEQ ID NO: 378255 - RNA, 21 nt, Bordetella pertussis
gccgguucggucgacgacggc

SEQ ID NO: 378256 - RNA, 23 nt, Bordetella pertussis
gccgguucggucgacgacggcaa

SEQ ID NO: 378257 - RNA, 18 nt, Bordetella pertussis
gccgguugcgcgccgaca

SEQ ID NO: 378258 - RNA, 19 nt, Bordetella pertussis
gccgguugcgcgccgacag

SEQ ID NO: 378259 - RNA, 13 nt, Bordetella pertussis
gccgguuggcgcc

SEQ ID NO: 378260 - RNA, 14 nt, Bordetella pertussis
gccgguuggcgccu

SEQ ID NO: 378261 - RNA, 14 nt, Bordetella pertussis
gccguaaccggcca

SEQ ID NO: 378262 - RNA, 16 nt, Bordetella pertussis
gccguaaccggccagu

SEQ ID NO: 378263 - RNA, 19 nt, Bordetella pertussis
gccguaacaggacagccgc

SEQ ID NO: 378264 - RNA, 23 nt, Bordetella pertussis
gccguacacguuggggaaccgca

SEQ ID NO: 378265 - RNA, 22 nt, Bordetella pertussis
gccguacagcgaaggggcgcau

SEQ ID NO: 378266 - RNA, 16 nt, Bordetella pertussis
gccguacagggccgcg

SEQ ID NO: 378267 - RNA, 23 nt, Bordetella pertussis
gccguacauggccagguacaggc

SEQ ID NO: 378268 - RNA, 13 nt, Bordetella pertussis
gccguaccagcgc

SEQ ID NO: 378269 - RNA, 16 nt, Bordetella pertussis
gccguaccaggugcgc

SEQ ID NO: 378270 - RNA, 18 nt, Bordetella pertussis
gccguaccaggugcgcau

SEQ ID NO: 378271 - RNA, 20 nt, Bordetella pertussis
gccguaccaguacaccggcg

SEQ ID NO: 378272 - RNA, 13 nt, Bordetella pertussis
gccguaccugcag

SEQ ID NO: 378273 - RNA, 21 nt, Bordetella pertussis
gccguaccugcagcaggcgca

SEQ ID NO: 378274 - RNA, 22 nt, Bordetella pertussis
gccguaccugcagcaggcgcac

SEQ ID NO: 378275 - RNA, 23 nt, Bordetella pertussis
gccguaccugcagcaggcgcacc

SEQ ID NO: 378276 - RNA, 17 nt, Bordetella pertussis
gccguacgagugcaggc

SEQ ID NO: 378277 - RNA, 20 nt, Bordetella pertussis
gccguacgagugcaggcccg

SEQ ID NO: 378278 - RNA, 17 nt, Bordetella pertussis
gccguaccgggcggucc

SEQ ID NO: 378279 - RNA, 22 nt, Bordetella pertussis
gccguacgcggcgcccgcgcau

SEQ ID NO: 378280 - RNA, 17 nt, Bordetella pertussis
gccguacugggcaccac

SEQ ID NO: 378281 - RNA, 22 nt, Bordetella pertussis
gccguacuuggcgauggccgcc

SEQ ID NO: 378282 - RNA, 19 nt, Bordetella pertussis
gccguagagggucuggcgg

SEQ ID NO: 378283 - RNA, 21 nt, Bordetella pertussis
gccguagagggucuggcggcc

SEQ ID NO: 378284 - RNA, 19 nt, Bordetella pertussis
gccguagcccagguccagc

SEQ ID NO: 378285 - RNA, 17 nt, Bordetella pertussis
gccguagcgcgccagcc

SEQ ID NO: 378286 - RNA, 18 nt, Bordetella pertussis
gccguagcgcgccagccg

SEQ ID NO: 378287 - RNA, 17 nt, Bordetella pertussis
gccguagcgcguggcca

SEQ ID NO: 378288 - RNA, 17 nt, Bordetella pertussis
gccguagcguuggcggc

SEQ ID NO: 378289 - RNA, 19 nt, Bordetella pertussis
gccguagcguuggcggccg

SEQ ID NO: 378290 - RNA, 21 nt, Bordetella pertussis
gccguaggacagccccagcag

SEQ ID NO: 378291 - RNA, 15 nt, Bordetella pertussis
gccguaggcgccggc

SEQ ID NO: 378292 - RNA, 16 nt, Bordetella pertussis
gccguaggcgccggcc

SEQ ID NO: 378293 - RNA, 17 nt, Bordetella pertussis
gccguaggcgccggccu

SEQ ID NO: 378294 - RNA, 16 nt, Bordetella pertussis
gccguaguaggucaug

SEQ ID NO: 378295 - RNA, 17 nt, Bordetella pertussis
gccgucagcucgaucag

SEQ ID NO: 378296 - RNA, 20 nt, Bordetella pertussis
gccgucagcucgaucaggcg

SEQ ID NO: 378297 - RNA, 23 nt, Bordetella pertussis
gccgucaggaucaggccggcgau

SEQ ID NO: 378298 - RNA, 19 nt, Bordetella pertussis
gccgucaggcguugcgccg

SEQ ID NO: 378299 - RNA, 14 nt, Bordetella pertussis
gccgucaugcgccg

SEQ ID NO: 378300 - RNA, 17 nt, Bordetella pertussis
gccgucaugcgccgucc

SEQ ID NO: 378301 - RNA, 23 nt, Bordetella pertussis
gccguccaaaacagacaggccgg

SEQ ID NO: 378302 - RNA, 23 nt, Bordetella pertussis
gccguccaggcgccgcacgccgg

SEQ ID NO: 378303 - RNA, 20 nt, Bordetella pertussis
gccguccagucccguggcgc

SEQ ID NO: 378304 - RNA, 16 nt, Bordetella pertussis
gccguccgagcccgac

SEQ ID NO: 378305 - RNA, 18 nt, Bordetella pertussis
gccgucgaccgcgaagcg

SEQ ID NO: 378306 - RNA, 19 nt, Bordetella pertussis
gccgucgaccgcgaagcgc

SEQ ID NO: 378307 - RNA, 23 nt, Bordetella pertussis
gccgucgaccgcgaagcgcgcca

SEQ ID NO: 378308 - RNA, 20 nt, Bordetella pertussis
gccgucgagcaucccggcgc

SEQ ID NO: 378309 - RNA, 21 nt, Bordetella pertussis
gccgucgagcaucccggcgcu

SEQ ID NO: 378310 - RNA, 15 nt, Bordetella pertussis
gccgucgagccgggc

SEQ ID NO: 378311 - RNA, 16 nt, Bordetella pertussis
gccgucgagccgggcg

SEQ ID NO: 378312 - RNA, 17 nt, Bordetella pertussis
gccgucgagccgggcgc

SEQ ID NO: 378313 - RNA, 18 nt, Bordetella pertussis
gccgucgagccgggcgcc

SEQ ID NO: 378314 - RNA, 22 nt, Bordetella pertussis
gccgucgagccgggcgccgauc

SEQ ID NO: 378315 - RNA, 16 nt, Bordetella pertussis
gccgucgagcgcggcc

SEQ ID NO: 378316 - RNA, 17 nt, Bordetella pertussis
gccgucgagcgcggcca

SEQ ID NO: 378317 - RNA, 23 nt, Bordetella pertussis
gccgucgagcugcucgagcaugc

SEQ ID NO: 378318 - RNA, 16 nt, Bordetella pertussis
gccgucgagaaugacg

SEQ ID NO: 378319 - RNA, 22 nt, Bordetella pertussis
gccgucgcccuggcggcgguca

SEQ ID NO: 378320 - RNA, 13 nt, Bordetella pertussis
gccgucgccgccc

SEQ ID NO: 378321 - RNA, 14 nt, Bordetella pertussis
gccgucgccgccca

SEQ ID NO: 378322 - RNA, 15 nt, Bordetella pertussis
gccgucgccgcccau

SEQ ID NO: 378323 - RNA, 17 nt, Bordetella pertussis
gccgucgccgcccaugc

SEQ ID NO: 378324 - RNA, 16 nt, Bordetella pertussis
gccgucgccgaucggc

SEQ ID NO: 378325 - RNA, 20 nt, Bordetella pertussis
gccgucgccuucggcggcga

SEQ ID NO: 378326 - RNA, 14 nt, Bordetella pertussis
gccgucgcgcacca

SEQ ID NO: 378327 - RNA, 16 nt, Bordetella pertussis
gccgucggccagcuug

SEQ ID NO: 378328 - RNA, 14 nt, Bordetella pertussis
gccgucggccgcgc

SEQ ID NO: 378329 - RNA, 18 nt, Bordetella pertussis
gccgucggccgcgcccau

SEQ ID NO: 378330 - RNA, 14 nt, Bordetella pertussis
gccgucggccugga

SEQ ID NO: 378331 - RNA, 16 nt, Bordetella pertussis
gccgucggcgcuggcg

SEQ ID NO: 378332 - RNA, 18 nt, Bordetella pertussis
gccgucggcgcuggcgcg

SEQ ID NO: 378333 - RNA, 15 nt, Bordetella pertussis
gccgucggcgucgaa

SEQ ID NO: 378334 - RNA, 17 nt, Bordetella pertussis
gccgucgggggccggcu

SEQ ID NO: 378335 - RNA, 20 nt, Bordetella pertussis
gccgucgggggccggcucgc

SEQ ID NO: 378336 - RNA, 23 nt, Bordetella pertussis
gccgucgggggccggcucgcccc

SEQ ID NO: 378337 - RNA, 16 nt, Bordetella pertussis
gccgucgguaucgggc

SEQ ID NO: 378338 - RNA, 17 nt, Bordetella pertussis
gccgugcaggcccgggc

SEQ ID NO: 378339 - RNA, 23 nt, Bordetella pertussis
gccgugccagauacccacuucga

SEQ ID NO: 378340 - RNA, 23 nt, Bordetella pertussis
gccgugcccgacggacuggcugg

SEQ ID NO: 378341 - RNA, 17 nt, Bordetella pertussis
gccgugcccgagggcgc

SEQ ID NO: 378342 - RNA, 20 nt, Bordetella pertussis
gccgugccgcccgguucgcc

SEQ ID NO: 378343 - RNA, 22 nt, Bordetella pertussis
gccgugccgcgcgcaccggcuu

SEQ ID NO: 378344 - RNA, 22 nt, Bordetella pertussis
gccgugccgggccuggugcccg

SEQ ID NO: 378345 - RNA, 17 nt, Bordetella pertussis
gccgugcugggcggcca

SEQ ID NO: 378346 - RNA, 22 nt, Bordetella pertussis
gccgugcuguaccucagccugc

SEQ ID NO: 378347 - RNA, 23 nt, Bordetella pertussis
gccgugcuucucguagaacgcau

SEQ ID NO: 378348 - RNA, 14 nt, Bordetella pertussis
gccguggacgugcg

SEQ ID NO: 378349 - RNA, 16 nt, Bordetella pertussis
gccguggaggcggcgg

SEQ ID NO: 378350 - RNA, 18 nt, Bordetella pertussis
gccguggaggcggcggcc

SEQ ID NO: 378351 - RNA, 14 nt, Bordetella pertussis
gccguggcccagcc

SEQ ID NO: 378352 - RNA, 21 nt, Bordetella pertussis
gccguggccggcaucgcgcug

SEQ ID NO: 378353 - RNA, 22 nt, Bordetella pertussis
gccguggcgcaccagguuggcg

SEQ ID NO: 378354 - RNA, 13 nt, Bordetella pertussis
gccguggcggcca

SEQ ID NO: 378355 - RNA, 14 nt, Bordetella pertussis
gccguggcgggucc

SEQ ID NO: 378356 - RNA, 19 nt, Bordetella pertussis
gccguggcgugcaggccgg

SEQ ID NO: 378357 - RNA, 23 nt, Bordetella pertussis
gccguggcgugcaggccggcggc

SEQ ID NO: 378358 - RNA, 13 nt, Bordetella pertussis
gccguggcguuga

SEQ ID NO: 378359 - RNA, 21 nt, Bordetella pertussis
gccguggcguugacggcccag

SEQ ID NO: 378360 - RNA, 20 nt, Bordetella pertussis
gccguggcuggucacgucca

SEQ ID NO: 378361 - RNA, 20 nt, Bordetella pertussis
gccguggugcugaccggcuu

SEQ ID NO: 378362 - RNA, 22 nt, Bordetella pertussis
gccgugucgcccuucaggccag

SEQ ID NO: 378363 - RNA, 19 nt, Bordetella pertussis
gccguguucgagcaggcgc

SEQ ID NO: 378364 - RNA, 23 nt, Bordetella pertussis
gccguuaugguucggccucgccc

SEQ ID NO: 378365 - RNA, 20 nt, Bordetella pertussis
gccguucagggacgggccag

SEQ ID NO: 378366 - RNA, 23 nt, Bordetella pertussis
gccguucagggacgggccagccc

SEQ ID NO: 378367 - RNA, 22 nt, Bordetella pertussis
gccguucagguucaucagccgg

SEQ ID NO: 378368 - RNA, 17 nt, Bordetella pertussis
gccguucaucagcgcgc

SEQ ID NO: 378369 - RNA, 21 nt, Bordetella pertussis
gccguucaucagcgcgcgcag

SEQ ID NO: 378370 - RNA, 22 nt, Bordetella pertussis
gccguucaucagcgcgcgcagc

SEQ ID NO: 378371 - RNA, 14 nt, Bordetella pertussis
gccguuccagucca

SEQ ID NO: 378372 - RNA, 17 nt, Bordetella pertussis
gccguuccaguccagcg

SEQ ID NO: 378373 - RNA, 22 nt, Bordetella pertussis
gccguuccaguccagcgucggc

SEQ ID NO: 378374 - RNA, 16 nt, Bordetella pertussis
gccguucccgccgggc

SEQ ID NO: 378375 - RNA, 17 nt, Bordetella pertussis
gccguucccgccgggcu

SEQ ID NO: 378376 - RNA, 22 nt, Bordetella pertussis
gccguuccugcagcgugcugcg

SEQ ID NO: 378377 - RNA, 23 nt, Bordetella pertussis
gccguucggaguaguugucgucg

SEQ ID NO: 378378 - RNA, 14 nt, Bordetella pertussis
gccguucggccagc

SEQ ID NO: 378379 - RNA, 13 nt, Bordetella pertussis
gccguucgcgcug

SEQ ID NO: 378380 - RNA, 18 nt, Bordetella pertussis
gccguucggugcgcagcg

SEQ ID NO: 378381 - RNA, 21 nt, Bordetella pertussis
gccguucggugcgcagcggca

SEQ ID NO: 378382 - RNA, 15 nt, Bordetella pertussis
gccguucgucgcgca

SEQ ID NO: 378383 - RNA, 16 nt, Bordetella pertussis
gccguucucaggccga

SEQ ID NO: 378384 - RNA, 20 nt, Bordetella pertussis
gccguuucaggccugcggcg

SEQ ID NO: 378385 - RNA, 16 nt, Bordetella pertussis
gccguuuucagcgcag

SEQ ID NO: 378386 - RNA, 19 nt, Bordetella pertussis
gccguuuucagcgcaggcu

SEQ ID NO: 378387 - RNA, 23 nt, Bordetella pertussis
gccguuuuuuuguucaucgagca

SEQ ID NO: 378388 - RNA, 23 nt, Bordetella pertussis
gccuacacgguggcggugcucga

SEQ ID NO: 378389 - RNA, 13 nt, Bordetella pertussis
gccuaccggcgcc

SEQ ID NO: 378390 - RNA, 14 nt, Bordetella pertussis
gccuaccggcgccg

SEQ ID NO: 378391 - RNA, 14 nt, Bordetella pertussis
gccuacggcggcgg

SEQ ID NO: 378392 - RNA, 15 nt, Bordetella pertussis
gccuacuggcgcgcg

SEQ ID NO: 378393 - RNA, 17 nt, Bordetella pertussis
gccuacuggcgcgcgca

SEQ ID NO: 378394 - RNA, 20 nt, Bordetella pertussis
gccucagcccgcguucaggc

SEQ ID NO: 378395 - RNA, 15 nt, Bordetella pertussis
gccucagcggccgcu

SEQ ID NO: 378396 - RNA, 12 nt, Bordetella pertussis
gccucaggccgg

SEQ ID NO: 378397 - RNA, 21 nt, Bordetella pertussis
gccucauccccgcgugccugu

SEQ ID NO: 378398 - RNA, 17 nt, Bordetella pertussis
gccucaucguucugcgu

SEQ ID NO: 378399 - RNA, 17 nt, Bordetella pertussis
gccuccagcaucgccgc

SEQ ID NO: 378400 - RNA, 18 nt, Bordetella pertussis
gccuccagcaucgccgcc

SEQ ID NO: 378401 - RNA, 19 nt, Bordetella pertussis
gccuccagcaucgccgcca

SEQ ID NO: 378402 - RNA, 22 nt, Bordetella pertussis
gccuccagcaucgccgccagcu

SEQ ID NO: 378403 - RNA, 19 nt, Bordetella pertussis
gccuccaggaugagcgccu

SEQ ID NO: 378404 - RNA, 20 nt, Bordetella pertussis
gccuccagcuccagcgcgcc

SEQ ID NO: 378405 - RNA, 12 nt, Bordetella pertussis
gccuccaggcgg

SEQ ID NO: 378406 - RNA, 23 nt, Bordetella pertussis
gccuccaggcggcggugccagcg

SEQ ID NO: 378407 - RNA, 21 nt, Bordetella pertussis
gccucccauugcgcggccagg

SEQ ID NO: 378408 - RNA, 15 nt, Bordetella pertussis
gccuccccaggccag

SEQ ID NO: 378409 - RNA, 18 nt, Bordetella pertussis
gccucccggaccagcagu

SEQ ID NO: 378410 - RNA, 15 nt, Bordetella pertussis
gccucggcauggcgc

SEQ ID NO: 378411 - RNA, 16 nt, Bordetella pertussis
gccucggcauggcgcg

SEQ ID NO: 378412 - RNA, 18 nt, Bordetella pertussis
gccucggcauggcgcgcg

SEQ ID NO: 378413 - RNA, 12 nt, Bordetella pertussis
gccucggccacc

SEQ ID NO: 378414 - RNA, 15 nt, Bordetella pertussis
gccucggccaccugg

SEQ ID NO: 378415 - RNA, 13 nt, Bordetella pertussis
gccucggccagcu

SEQ ID NO: 378416 - RNA, 14 nt, Bordetella pertussis
gccucggccagcug

SEQ ID NO: 378417 - RNA, 17 nt, Bordetella pertussis
gccucggccagcugggc

SEQ ID NO: 378418 - RNA, 12 nt, Bordetella pertussis
gccucggccagg

SEQ ID NO: 378419 - RNA, 21 nt, Bordetella pertussis
gccucggccaggaaagccggc

SEQ ID NO: 378420 - RNA, 22 nt, Bordetella pertussis
gccucggccaggaaagccggcg

SEQ ID NO: 378421 - RNA, 12 nt, Bordetella pertussis
gccucggccagc

SEQ ID NO: 378422 - RNA, 14 nt, Bordetella pertussis
gccucggccggcag

SEQ ID NO: 378423 - RNA, 22 nt, Bordetella pertussis
gccucggcgaagugcccgcugg

SEQ ID NO: 378424 - RNA, 13 nt, Bordetella pertussis
gccucggcgcgcg

SEQ ID NO: 378425 - RNA, 19 nt, Bordetella pertussis
gccucggcggccagcgcgc

SEQ ID NO: 378426 - RNA, 21 nt, Bordetella pertussis
gccucggcggccuccggcagg

SEQ ID NO: 378427 - RNA, 17 nt, Bordetella pertussis
gccucggcgggcggcgc

SEQ ID NO: 378428 - RNA, 19 nt, Bordetella pertussis
gccucggcgggcggcgcca

SEQ ID NO: 378429 - RNA, 16 nt, Bordetella pertussis
gccucggcuccgccau

SEQ ID NO: 378430 - RNA, 15 nt, Bordetella pertussis
gccucgggcacggcc

SEQ ID NO: 378431 - RNA, 16 nt, Bordetella pertussis
gccucgggcacggcca

SEQ ID NO: 378432 - RNA, 19 nt, Bordetella pertussis
gccucgggcacggccagca

SEQ ID NO: 378433 - RNA, 14 nt, Bordetella pertussis
gccucggcuugcgc

SEQ ID NO: 378434 - RNA, 18 nt, Bordetella pertussis
gccucggcuugcgcggcg

SEQ ID NO: 378435 - RNA, 13 nt, Bordetella pertussis
gccucgggcgcaa

SEQ ID NO: 378436 - RNA, 22 nt, Bordetella pertussis
gccucgguacuccuugacgcgc

SEQ ID NO: 378437 - RNA, 14 nt, Bordetella pertussis
gccucgguccagcg

SEQ ID NO: 378438 - RNA, 15 nt, Bordetella pertussis
gccucggucgccucg

SEQ ID NO: 378439 - RNA, 16 nt, Bordetella pertussis
gccucguaggccauca

SEQ ID NO: 378440 - RNA, 21 nt, Bordetella pertussis
gccucguaguguucgauggcg

SEQ ID NO: 378441 - RNA, 16 nt, Bordetella pertussis
gccucguccacgucgu

SEQ ID NO: 378442 - RNA, 19 nt, Bordetella pertussis
gccucgucgaccacgccgg

SEQ ID NO: 378443 - RNA, 17 nt, Bordetella pertussis
gccucguccucggugcu

SEQ ID NO: 378444 - RNA, 13 nt, Bordetella pertussis
gccucguccucgu

SEQ ID NO: 378445 - RNA, 13 nt, Bordetella pertussis
gccucgucgcgca

SEQ ID NO: 378446 - RNA, 15 nt, Bordetella pertussis
gccucgucgcgcaac

SEQ ID NO: 378447 - RNA, 21 nt, Bordetella pertussis
gccucgugcugcugcaggcgc

SEQ ID NO: 378448 - RNA, 18 nt, Bordetella pertussis
gccucgugcgaggccacg

SEQ ID NO: 378449 - RNA, 23 nt, Bordetella pertussis
gccucguuggucagcaccucggc

SEQ ID NO: 378450 - RNA, 14 nt, Bordetella pertussis
gccucuggaagacg

SEQ ID NO: 378451 - RNA, 20 nt, Bordetella pertussis
gccucuucgucgccggcgcu

SEQ ID NO: 378452 - RNA, 21 nt, Bordetella pertussis
gccucuucgucgccggcgcug

SEQ ID NO: 378453 - RNA, 15 nt, Bordetella pertussis
gccucuugcgugacc

SEQ ID NO: 378454 - RNA, 23 nt, Bordetella pertussis
gccucuugcgugacccggggcag

SEQ ID NO: 378455 - RNA, 16 nt, Bordetella pertussis
gccugaaaccgcaggc

SEQ ID NO: 378456 - RNA, 17 nt, Bordetella pertussis
gccugaaaccgcaggca

SEQ ID NO: 378457 - RNA, 16 nt, Bordetella pertussis
gccugacgcgcaagcg

SEQ ID NO: 378458 - RNA, 15 nt, Bordetella pertussis
gccugacgggccucg

SEQ ID NO: 378459 - RNA, 16 nt, Bordetella pertussis
gccugacgggccucga

SEQ ID NO: 378460 - RNA, 19 nt, Bordetella pertussis
gccugacgcucauccaggc

SEQ ID NO: 378461 - RNA, 24 nt, Bordetella pertussis
gccugacguucggggcgucgcugc

SEQ ID NO: 378462 - RNA, 14 nt, Bordetella pertussis
gccugaggcccgau

SEQ ID NO: 378463 - RNA, 16 nt, Bordetella pertussis
gccugaggcccgaugg

SEQ ID NO: 378464 - RNA, 17 nt, Bordetella pertussis
gccugaggcccgauggc

SEQ ID NO: 378465 - RNA, 18 nt, Bordetella pertussis
gccugaggcccgauggcg

SEQ ID NO: 378466 - RNA, 17 nt, Bordetella pertussis
gccugagcugccaggcu

SEQ ID NO: 378467 - RNA, 13 nt, Bordetella pertussis
gccugaugcgcag

SEQ ID NO: 378468 - RNA, 14 nt, Bordetella pertussis
gccugaugcgcaga

SEQ ID NO: 378469 - RNA, 16 nt, Bordetella pertussis
gccugaugggugucga

SEQ ID NO: 378470 - RNA, 18 nt, Bordetella pertussis
gccugauucccaggcccg

SEQ ID NO: 378471 - RNA, 21 nt, Bordetella pertussis
gccugauucccaggcccggcc

SEQ ID NO: 378472 - RNA, 22 nt, Bordetella pertussis
gccugcaaccuggucaagggcg

SEQ ID NO: 378473 - RNA, 15 nt, Bordetella pertussis
gccugcaccgccgcg

SEQ ID NO: 378474 - RNA, 14 nt, Bordetella pertussis
gccugcaccggcgc

SEQ ID NO: 378475 - RNA, 17 nt, Bordetella pertussis
gccugcacgaccugcgc

SEQ ID NO: 378476 - RNA, 22 nt, Bordetella pertussis
gccugcacgcucuugagcgcgg

SEQ ID NO: 378477 - RNA, 23 nt, Bordetella pertussis
gccugcacgcucuugagcgcggc

SEQ ID NO: 378478 - RNA, 23 nt, Bordetella pertussis
gccugcacggugggcagcagcac

SEQ ID NO: 378479 - RNA, 23 nt, Bordetella pertussis
gccugcacgucccagucgccgcg

SEQ ID NO: 378480 - RNA, 22 nt, Bordetella pertussis
gccugcagaccagcaccggcac

SEQ ID NO: 378481 - RNA, 14 nt, Bordetella pertussis
gccugcagcacggc

SEQ ID NO: 378482 - RNA, 16 nt, Bordetella pertussis
gccugcagcagcgccu

SEQ ID NO: 378483 - RNA, 16 nt, Bordetella pertussis
gccugcagcagcggca

SEQ ID NO: 378484 - RNA, 23 nt, Bordetella pertussis
gccugcagcagcggcagcucggc

SEQ ID NO: 378485 - RNA, 15 nt, Bordetella pertussis
gccugcagcagcgug

SEQ ID NO: 378486 - RNA, 21 nt, Bordetella pertussis
gccugcagcagcguggccgcc

SEQ ID NO: 378487 - RNA, 15 nt, Bordetella pertussis
gccugcagcaugacc

SEQ ID NO: 378488 - RNA, 15 nt, Bordetella pertussis
gccugcagcgcgcgc

SEQ ID NO: 378489 - RNA, 15 nt, Bordetella pertussis
gccugcaggcccagc

SEQ ID NO: 378490 - RNA, 21 nt, Bordetella pertussis
gccugcaggcccagcacgcgc

SEQ ID NO: 378491 - RNA, 22 nt, Bordetella pertussis
gccugcaggcccagcacgcgcg

SEQ ID NO: 378492 - RNA, 19 nt, Bordetella pertussis
gccugcaggaagccugcgc

SEQ ID NO: 378493 - RNA, 12 nt, Bordetella pertussis
gccugcaggcgg

SEQ ID NO: 378494 - RNA, 15 nt, Bordetella pertussis
gccugcaggcggucg

SEQ ID NO: 378495 - RNA, 16 nt, Bordetella pertussis
gccugcaggugccgcc

SEQ ID NO: 378496 - RNA, 19 nt, Bordetella pertussis
gccugcaggugccgccggc

SEQ ID NO: 378497 - RNA, 21 nt, Bordetella pertussis
gccugcaggugccgccggcgc

SEQ ID NO: 378498 - RNA, 18 nt, Bordetella pertussis
gccugcaguucggccgcc

SEQ ID NO: 378499 - RNA, 19 nt, Bordetella pertussis
gccugcaguucggccgcca

SEQ ID NO: 378500 - RNA, 21 nt, Bordetella pertussis
gccugcaguucggccgccagg

SEQ ID NO: 378501 - RNA, 22 nt, Bordetella pertussis
gccugcaguucggccgccaggu

SEQ ID NO: 378502 - RNA, 13 nt, Bordetella pertussis
gccugcauccggc

SEQ ID NO: 378503 - RNA, 15 nt, Bordetella pertussis
gccugcauccggccc

SEQ ID NO: 378504 - RNA, 19 nt, Bordetella pertussis
gccugcauccggcccagcg

SEQ ID NO: 378505 - RNA, 22 nt, Bordetella pertussis
gccugcauccggcccagcgcca

SEQ ID NO: 378506 - RNA, 16 nt, Bordetella pertussis
gccugcaugccauagu

SEQ ID NO: 378507 - RNA, 15 nt, Bordetella pertussis
gccugcauguccagc

SEQ ID NO: 378508 - RNA, 17 nt, Bordetella pertussis
gccugcauguccagcgg

SEQ ID NO: 378509 - RNA, 20 nt, Bordetella pertussis
gccugcaugucguacaggcc

SEQ ID NO: 378510 - RNA, 22 nt, Bordetella pertussis
gccugcaugucguacaggccgu

SEQ ID NO: 378511 - RNA, 16 nt, Bordetella pertussis
gccugccaagcgccgc

SEQ ID NO: 378512 - RNA, 17 nt, Bordetella pertussis
gccugccaagcgccgcg

SEQ ID NO: 378513 - RNA, 21 nt, Bordetella pertussis
gccugccaagcgccgcggcca

SEQ ID NO: 378514 - RNA, 14 nt, Bordetella pertussis
gccugccacaucga

SEQ ID NO: 378515 - RNA, 18 nt, Bordetella pertussis
gccugccaccagcgcgcc

SEQ ID NO: 378516 - RNA, 22 nt, Bordetella pertussis
gccugccaccagcgcgccagca

SEQ ID NO: 378517 - RNA, 19 nt, Bordetella pertussis
gccugccagaacagccgcg

SEQ ID NO: 378518 - RNA, 13 nt, Bordetella pertussis
gccugccagccca

SEQ ID NO: 378519 - RNA, 21 nt, Bordetella pertussis
gccugccagcccaccagcgcc

SEQ ID NO: 378520 - RNA, 17 nt, Bordetella pertussis
gccugccauccggccgc

SEQ ID NO: 378521 - RNA, 23 nt, Bordetella pertussis
gccugccauccggccgcacgcgg

SEQ ID NO: 378522 - RNA, 13 nt, Bordetella pertussis
gccugcccaggcc

SEQ ID NO: 378523 - RNA, 22 nt, Bordetella pertussis
gccugcccaggccagcgccgcg

SEQ ID NO: 378524 - RNA, 18 nt, Bordetella pertussis
gccugcccauggccugca

SEQ ID NO: 378525 - RNA, 16 nt, Bordetella pertussis
gccugccccgccugcg

SEQ ID NO: 378526 - RNA, 14 nt, Bordetella pertussis
gccugccccggcag

SEQ ID NO: 378527 - RNA, 20 nt, Bordetella pertussis
gccugccccugcggggacag

SEQ ID NO: 378528 - RNA, 14 nt, Bordetella pertussis
gccugccccgccgg

SEQ ID NO: 378529 - RNA, 19 nt, Bordetella pertussis
gccugcggcgucaggccgu

SEQ ID NO: 378530 - RNA, 17 nt, Bordetella pertussis
gccugcgggccgggcag

SEQ ID NO: 378531 - RNA, 21 nt, Bordetella pertussis
gccugcgggccgggcaggccg

SEQ ID NO: 378532 - RNA, 19 nt, Bordetella pertussis
gccugcccgggcaccaggu

SEQ ID NO: 378533 - RNA, 13 nt, Bordetella pertussis
gccugcgggugcg

SEQ ID NO: 378534 - RNA, 13 nt, Bordetella pertussis
gccugcgucgcca

SEQ ID NO: 378535 - RNA, 15 nt, Bordetella pertussis
gccugcgucgccacc

SEQ ID NO: 378536 - RNA, 17 nt, Bordetella pertussis
gccugcgucguugcccc

SEQ ID NO: 378537 - RNA, 20 nt, Bordetella pertussis
gccugcguugcgaucagcgc

SEQ ID NO: 378538 - RNA, 17 nt, Bordetella pertussis
gccugcuccggcgugau

SEQ ID NO: 378539 - RNA, 23 nt, Bordetella pertussis
gccugcuccggcgugauggacgc

SEQ ID NO: 378540 - RNA, 19 nt, Bordetella pertussis
gccugcuugaagacgccca

SEQ ID NO: 378541 - RNA, 23 nt, Bordetella pertussis
gccugcuugcaggaagcgcacca

SEQ ID NO: 378542 - RNA, 15 nt, Bordetella pertussis
gccugcuuggcgcgc

SEQ ID NO: 378543 - RNA, 21 nt, Bordetella pertussis
gccugcuuggcgcgcagcagc

SEQ ID NO: 378544 - RNA, 19 nt, Bordetella pertussis
gccugcuuguacaggcgcg

SEQ ID NO: 378545 - RNA, 22 nt, Bordetella pertussis
gccugcuuguacaggcgcggca

SEQ ID NO: 378546 - RNA, 17 nt, Bordetella pertussis
gccuggaacauggcccg

SEQ ID NO: 378547 - RNA, 14 nt, Bordetella pertussis
gccuggaagcuggc

SEQ ID NO: 378548 - RNA, 19 nt, Bordetella pertussis
gccuggaagugaugccgcc

SEQ ID NO: 378549 - RNA, 21 nt, Bordetella pertussis
gccuggaagugaugccgccgg

SEQ ID NO: 378550 - RNA, 19 nt, Bordetella pertussis
gccuggaccggcuccggcc

SEQ ID NO: 378551 - RNA, 18 nt, Bordetella pertussis
gccuggaccugacccccg

SEQ ID NO: 378552 - RNA, 15 nt, Bordetella pertussis
gccuggaccugagcc

SEQ ID NO: 378553 - RNA, 18 nt, Bordetella pertussis
gccuggaccugagccagg

SEQ ID NO: 378554 - RNA, 20 nt, Bordetella pertussis
gccuggaccuggacgagggc

SEQ ID NO: 378555 - RNA, 13 nt, Bordetella pertussis
gccuggacgcgcu

SEQ ID NO: 378556 - RNA, 14 nt, Bordetella pertussis
gccuggacgcgcug

SEQ ID NO: 378557 - RNA, 15 nt, Bordetella pertussis
gccuggacgcgcugg

SEQ ID NO: 378558 - RNA, 16 nt, Bordetella pertussis
gccuggacgcgcuggc

SEQ ID NO: 378559 - RNA, 17 nt, Bordetella pertussis
gccuggacgcgcuggcc

SEQ ID NO: 378560 - RNA, 19 nt, Bordetella pertussis
gccuggacgcgcuggccga

SEQ ID NO: 378561 - RNA, 21 nt, Bordetella pertussis
gccuggagacuggcaccggcc

SEQ ID NO: 378562 - RNA, 17 nt, Bordetella pertussis
gccuggagcucgggugg

SEQ ID NO: 378563 - RNA, 19 nt, Bordetella pertussis
gccuggaucggggggugcg

SEQ ID NO: 378564 - RNA, 18 nt, Bordetella pertussis
gccuggaugugcaggccg

SEQ ID NO: 378565 - RNA, 20 nt, Bordetella pertussis
gccuggcagaugcgcgccag

SEQ ID NO: 378566 - RNA, 14 nt, Bordetella pertussis
gccuggcaaugcgu

SEQ ID NO: 378567 - RNA, 17 nt, Bordetella pertussis
gccuggcuuacaggccc

SEQ ID NO: 378568 - RNA, 16 nt, Bordetella pertussis
gccuggcuuggcggcc

SEQ ID NO: 378569 - RNA, 17 nt, Bordetella pertussis
gccuggcuuggcggcca

SEQ ID NO: 378570 - RNA, 16 nt, Bordetella pertussis
gccugggaggcgcuga

SEQ ID NO: 378571 - RNA, 17 nt, Bordetella pertussis
gccugggaggcgcugau

SEQ ID NO: 378572 - RNA, 15 nt, Bordetella pertussis
gccugggccauggcc

SEQ ID NO: 378573 - RNA, 22 nt, Bordetella pertussis
gccugggccuucuugucgcugg

SEQ ID NO: 378574 - RNA, 19 nt, Bordetella pertussis
gccugggcgccuggcugca

SEQ ID NO: 378575 - RNA, 14 nt, Bordetella pertussis
gccugggcgcgcgc

SEQ ID NO: 378576 - RNA, 19 nt, Bordetella pertussis
gccugggcgcgguccagca

SEQ ID NO: 378577 - RNA, 21 nt, Bordetella pertussis
gccugggcgcgguccagcaag

SEQ ID NO: 378578 - RNA, 13 nt, Bordetella pertussis
gccugggcggcca

SEQ ID NO: 378579 - RNA, 13 nt, Bordetella pertussis
gccugggcggcgc

SEQ ID NO: 378580 - RNA, 14 nt, Bordetella pertussis
gccugggcggcgcg

SEQ ID NO: 378581 - RNA, 15 nt, Bordetella pertussis
gccugggcggcgcgc

SEQ ID NO: 378582 - RNA, 16 nt, Bordetella pertussis
gccugggcggcgcgcu

SEQ ID NO: 378583 - RNA, 15 nt, Bordetella pertussis
gccugggcggcggcg

SEQ ID NO: 378584 - RNA, 14 nt, Bordetella pertussis
gccugggcgggccg

SEQ ID NO: 378585 - RNA, 16 nt, Bordetella pertussis
gccugggcgucgagcg

SEQ ID NO: 378586 - RNA, 21 nt, Bordetella pertussis
gccugggcgucgagcggcgug

SEQ ID NO: 378587 - RNA, 15 nt, Bordetella pertussis
gccuggggcaggcgg

SEQ ID NO: 378588 - RNA, 17 nt, Bordetella pertussis
gccuggggcaggcggcu

SEQ ID NO: 378589 - RNA, 22 nt, Bordetella pertussis
gccuggggcaguuuccagggcu

SEQ ID NO: 378590 - RNA, 22 nt, Bordetella pertussis
gccuggggcgaggggggcgugg

SEQ ID NO: 378591 - RNA, 15 nt, Bordetella pertussis
gccuggggcgggcgc

SEQ ID NO: 378592 - RNA, 18 nt, Bordetella pertussis
gccuggggacgggcgcac

SEQ ID NO: 378593 - RNA, 19 nt, Bordetella pertussis
gccuggggacgggcgcaca

SEQ ID NO: 378594 - RNA, 16 nt, Bordetella pertussis
gccugggguaggcgcg

SEQ ID NO: 378595 - RNA, 17 nt, Bordetella pertussis
gccugggucaggucggc

SEQ ID NO: 378596 - RNA, 21 nt, Bordetella pertussis
gccugggugcgguaggcgccc

SEQ ID NO: 378597 - RNA, 22 nt, Bordetella pertussis
gccugggugcgguaggcgcccg

SEQ ID NO: 378598 - RNA, 13 nt, Bordetella pertussis
gccuggguggcca

SEQ ID NO: 378599 - RNA, 17 nt, Bordetella pertussis
gccuggguggccagcug

SEQ ID NO: 378600 - RNA, 15 nt, Bordetella pertussis
gccugguacgacagc

SEQ ID NO: 378601 - RNA, 20 nt, Bordetella pertussis
gccugguacgacagcucggg

SEQ ID NO: 378602 - RNA, 23 nt, Bordetella pertussis
gccugguagaguacugcguucgg

SEQ ID NO: 378603 - RNA, 23 nt, Bordetella pertussis
gccuggucgaaguagaacgccgg

SEQ ID NO: 378604 - RNA, 17 nt, Bordetella pertussis
gccuggucgacgccggc

SEQ ID NO: 378605 - RNA, 17 nt, Bordetella pertussis
gccuggucgagcgggcg

SEQ ID NO: 378606 - RNA, 20 nt, Bordetella pertussis
gccuggucgagcgggcgcca

SEQ ID NO: 378607 - RNA, 16 nt, Bordetella pertussis
gccuggucgcgcgccu

SEQ ID NO: 378608 - RNA, 14 nt, Bordetella pertussis
gccuggucgcuggc

SEQ ID NO: 378609 - RNA, 16 nt, Bordetella pertussis
gccuggucgcuggcgc

SEQ ID NO: 378610 - RNA, 17 nt, Bordetella pertussis
gccuggucgcuggcgcc

SEQ ID NO: 378611 - RNA, 18 nt, Bordetella pertussis
gccuggucgcuggcgccg

SEQ ID NO: 378612 - RNA, 20 nt, Bordetella pertussis
gccugguaguaaucgcgcgc

SEQ ID NO: 378613 - RNA, 15 nt, Bordetella pertussis
gccuggucagcgccg

SEQ ID NO: 378614 - RNA, 16 nt, Bordetella pertussis
gccuggucagguugcg

SEQ ID NO: 378615 - RNA, 16 nt, Bordetella pertussis
gccugguccgccgcga

SEQ ID NO: 378616 - RNA, 19 nt, Bordetella pertussis
gccuggucggggucggcca

SEQ ID NO: 378617 - RNA, 21 nt, Bordetella pertussis
gccuggucggggucggccacc

SEQ ID NO: 378618 - RNA, 22 nt, Bordetella pertussis
gccuggucggggucggccacca

SEQ ID NO: 378619 - RNA, 17 nt, Bordetella pertussis
gccuguuuuggcgcacg

SEQ ID NO: 378620 - RNA, 21 nt, Bordetella pertussis
gccuguuuuggcgcacgccgg

SEQ ID NO: 378621 - RNA, 17 nt, Bordetella pertussis
gccuuacgcggcgcgcg

SEQ ID NO: 378622 - RNA, 22 nt, Bordetella pertussis
gccuuacgcgguccgcagcgcu

SEQ ID NO: 378623 - RNA, 15 nt, Bordetella pertussis
gccuucccaggcgag

SEQ ID NO: 378624 - RNA, 16 nt, Bordetella pertussis
gccuucccggccgaaa

SEQ ID NO: 378625 - RNA, 22 nt, Bordetella pertussis
gccuucccggccgaaaccgccg

SEQ ID NO: 378626 - RNA, 14 nt, Bordetella pertussis
gccuuccggcagcg

SEQ ID NO: 378627 - RNA, 21 nt, Bordetella pertussis
gccuuccggcagcggccagcg

SEQ ID NO: 378628 - RNA, 16 nt, Bordetella pertussis
gccuucgaccugcccg

SEQ ID NO: 378629 - RNA, 19 nt, Bordetella pertussis
gccuucgacggcgggaccg

SEQ ID NO: 378630 - RNA, 15 nt, Bordetella pertussis
gccuucgcgauccag

SEQ ID NO: 378631 - RNA, 21 nt, Bordetella pertussis
gccuucgcgguaggacggcag

SEQ ID NO: 378632 - RNA, 19 nt, Bordetella pertussis
gccuucggcaggcgccggc

SEQ ID NO: 378633 - RNA, 20 nt, Bordetella pertussis
gccuucggcaggcgccggcu

SEQ ID NO: 378634 - RNA, 14 nt, Bordetella pertussis
gccuucggccggcu

SEQ ID NO: 378635 - RNA, 22 nt, Bordetella pertussis
gccuucggccggcugcgcgccg

SEQ ID NO: 378636 - RNA, 23 nt, Bordetella pertussis
gccuucggcgacuucggcggcca

SEQ ID NO: 378637 - RNA, 17 nt, Bordetella pertussis
gccuucggcggcgggcu

SEQ ID NO: 378638 - RNA, 14 nt, Bordetella pertussis
gccuucggcgcgcg

SEQ ID NO: 378639 - RNA, 15 nt, Bordetella pertussis
gccuucggcgcgcgc

SEQ ID NO: 378640 - RNA, 14 nt, Bordetella pertussis
gccuucggcggcga

SEQ ID NO: 378641 - RNA, 22 nt, Bordetella pertussis
gccuucggcggcgauggucugg

SEQ ID NO: 378642 - RNA, 12 nt, Bordetella pertussis
gccuucgggcgg

SEQ ID NO: 378643 - RNA, 14 nt, Bordetella pertussis
gccuucgggcgguu

SEQ ID NO: 378644 - RNA, 13 nt, Bordetella pertussis
gccuugcgcggcc

SEQ ID NO: 378645 - RNA, 16 nt, Bordetella pertussis
gccuugcgcggccacc

SEQ ID NO: 378646 - RNA, 17 nt, Bordetella pertussis
gccuugcgcggcgagcg

SEQ ID NO: 378647 - RNA, 21 nt, Bordetella pertussis
gccuugcgcggcgagcgccgc

SEQ ID NO: 378648 - RNA, 22 nt, Bordetella pertussis
gccuugcggcccuugcgcgaac

SEQ ID NO: 378649 - RNA, 14 nt, Bordetella pertussis
gccuugcggcgaug

SEQ ID NO: 378650 - RNA, 15 nt, Bordetella pertussis
gccuugcggcgccgu

SEQ ID NO: 378651 - RNA, 14 nt, Bordetella pertussis
gccuugcgggccgg

SEQ ID NO: 378652 - RNA, 18 nt, Bordetella pertussis
gccuugcgggccggcugg

SEQ ID NO: 378653 - RNA, 23 nt, Bordetella pertussis
gccuugcgggccggcugggcggc

SEQ ID NO: 378654 - RNA, 18 nt, Bordetella pertussis
gccuugcugaaccugcug

SEQ ID NO: 378655 - RNA, 14 nt, Bordetella pertussis
gccuugcugcccga

SEQ ID NO: 378656 - RNA, 15 nt, Bordetella pertussis
gccuugcugcccgac

SEQ ID NO: 378657 - RNA, 16 nt, Bordetella pertussis
gccuuggaguagccgc

SEQ ID NO: 378658 - RNA, 15 nt, Bordetella pertussis
gccuugcuccggcgu

SEQ ID NO: 378659 - RNA, 14 nt, Bordetella pertussis
gccuugcucgacca

SEQ ID NO: 378660 - RNA, 16 nt, Bordetella pertussis
gccuuggccgcagccg

SEQ ID NO: 378661 - RNA, 19 nt, Bordetella pertussis
gccuuggccgcagccggcu

SEQ ID NO: 378662 - RNA, 12 nt, Bordetella pertussis
gccuuggccugg

SEQ ID NO: 378663 - RNA, 13 nt, Bordetella pertussis
gccuuggcgcgca

SEQ ID NO: 378664 - RNA, 15 nt, Bordetella pertussis
gccuugggcgcggcg

SEQ ID NO: 378665 - RNA, 16 nt, Bordetella pertussis
gccuugugcgccagcg

SEQ ID NO: 378666 - RNA, 17 nt, Bordetella pertussis
gccuuguucgcgcgcgg

SEQ ID NO: 378667 - RNA, 22 nt, Bordetella pertussis
gcgaagcuguccuucguggcgc

SEQ ID NO: 378668 - RNA, 19 nt, Bordetella pertussis
gcgaaggccgccgcgccca

SEQ ID NO: 378669 - RNA, 21 nt, Bordetella pertussis
gcgaaggccgccgcgcccagc

SEQ ID NO: 378670 - RNA, 13 nt, Bordetella pertussis
gcgaaggcgcggc

SEQ ID NO: 378671 - RNA, 13 nt, Bordetella pertussis
gcgaagugccugu

SEQ ID NO: 378672 - RNA, 20 nt, Bordetella pertussis
gcgaaucaguucgcgcaggc

SEQ ID NO: 378673 - RNA, 22 nt, Bordetella pertussis
gcgaaucaguucgcgcaggcgu

SEQ ID NO: 378674 - RNA, 18 nt, Bordetella pertussis
gcgaauccaccggcgcgc

SEQ ID NO: 378675 - RNA, 20 nt, Bordetella pertussis
gcgaauccgcaacccagcag

SEQ ID NO: 378676 - RNA, 16 nt, Bordetella pertussis
gcgaaugcgcguaguc

SEQ ID NO: 378677 - RNA, 14 nt, Bordetella pertussis
gcgaaugcgacagc

SEQ ID NO: 378678 - RNA, 17 nt, Bordetella pertussis
gcgaaugcgacagcgac

SEQ ID NO: 378679 - RNA, 21 nt, Bordetella pertussis
gcgacaaauagccgaccgcgc

SEQ ID NO: 378680 - RNA, 23 nt, Bordetella pertussis
gcgacaaauagccgaccgcgcgc

SEQ ID NO: 378681 - RNA, 21 nt, Bordetella pertussis
gcgacaacagcuugcccggcg

SEQ ID NO: 378682 - RNA, 20 nt, Bordetella pertussis
gcgacaacaggucguggccc

SEQ ID NO: 378683 - RNA, 22 nt, Bordetella pertussis
gcgacaacaggucguggcccag

SEQ ID NO: 378684 - RNA, 13 nt, Bordetella pertussis
gcgacacgcagca

SEQ ID NO: 378685 - RNA, 21 nt, Bordetella pertussis
gcgacacggcggugccgcgca

SEQ ID NO: 378686 - RNA, 22 nt, Bordetella pertussis
gcgacagcaccggguaauggcg

SEQ ID NO: 378687 - RNA, 18 nt, Bordetella pertussis
gcgacagcaggccgguca

SEQ ID NO: 378688 - RNA, 19 nt, Bordetella pertussis
gcgacagcagggccaggcc

SEQ ID NO: 378689 - RNA, 14 nt, Bordetella pertussis
gcgacagccaggcc

SEQ ID NO: 378690 - RNA, 15 nt, Bordetella pertussis
gcgacagccaggcca

SEQ ID NO: 378691 - RNA, 22 nt, Bordetella pertussis
gcgacagcccgggaaacucgcg

SEQ ID NO: 378692 - RNA, 22 nt, Bordetella pertussis
gcgacauagaucuccggcgccu

SEQ ID NO: 378693 - RNA, 15 nt, Bordetella pertussis
gcgacaucgugcugu

SEQ ID NO: 378694 - RNA, 16 nt, Bordetella pertussis
gcgacaugucgccgcg

SEQ ID NO: 378695 - RNA, 19 nt, Bordetella pertussis
gcgaccacggucuggcgcg

SEQ ID NO: 378696 - RNA, 21 nt, Bordetella pertussis
gcgaccacggucuggcgcgac

SEQ ID NO: 378697 - RNA, 18 nt, Bordetella pertussis
gcgaccagcuucugcgcc

SEQ ID NO: 378698 - RNA, 16 nt, Bordetella pertussis
gcgaccaggcccacga

SEQ ID NO: 378699 - RNA, 20 nt, Bordetella pertussis
gcgaccaggugcgggccgcu

SEQ ID NO: 378700 - RNA, 20 nt, Bordetella pertussis
gcgaccaggcuggagucggg

SEQ ID NO: 378701 - RNA, 13 nt, Bordetella pertussis
gcgaccaugcggc

SEQ ID NO: 378702 - RNA, 17 nt, Bordetella pertussis
gcgaccaugcggccguc

SEQ ID NO: 378703 - RNA, 22 nt, Bordetella pertussis
gcgaccaugcggccgucgccgc

SEQ ID NO: 378704 - RNA, 16 nt, Bordetella pertussis
gcgacccagaacccgg

SEQ ID NO: 378705 - RNA, 22 nt, Bordetella pertussis
gcgacccagaacccggccggcg

SEQ ID NO: 378706 - RNA, 18 nt, Bordetella pertussis
gcgaccgccggccggugc

SEQ ID NO: 378707 - RNA, 16 nt, Bordetella pertussis
gcgaccgcgcggcgcu

SEQ ID NO: 378708 - RNA, 21 nt, Bordetella pertussis
gcgaccgcggcgguccugcug

SEQ ID NO: 378709 - RNA, 17 nt, Bordetella pertussis
gcgaccggcaccugggc

SEQ ID NO: 378710 - RNA, 14 nt, Bordetella pertussis
gcgaccggcgccgg

SEQ ID NO: 378711 - RNA, 16 nt, Bordetella pertussis
gcgaccggcgccggcu

SEQ ID NO: 378712 - RNA, 16 nt, Bordetella pertussis
gcgaccgggccgaaga

SEQ ID NO: 378713 - RNA, 19 nt, Bordetella pertussis
gcgaccugcgcgaccgccg

SEQ ID NO: 378714 - RNA, 20 nt, Bordetella pertussis
gcgaccugcgcgaccgccgc

SEQ ID NO: 378715 - RNA, 18 nt, Bordetella pertussis
gcgacggcaaugccugcg

SEQ ID NO: 378716 - RNA, 16 nt, Bordetella pertussis
gcgacggcgucggccu

SEQ ID NO: 378717 - RNA, 13 nt, Bordetella pertussis
gcgacggcgugcu

SEQ ID NO: 378718 - RNA, 15 nt, Bordetella pertussis
gcgacggcgugcugc

SEQ ID NO: 378719 - RNA, 14 nt, Bordetella pertussis
gcgacgggcaccga

SEQ ID NO: 378720 - RNA, 15 nt, Bordetella pertussis
gcgacgguccugcgc

SEQ ID NO: 378721 - RNA, 18 nt, Bordetella pertussis
gcgacgguccugcgcgcc

SEQ ID NO: 378722 - RNA, 16 nt, Bordetella pertussis
gcgacggucaggggca

SEQ ID NO: 378723 - RNA, 17 nt, Bordetella pertussis
gcgacgucccaggccga

SEQ ID NO: 378724 - RNA, 16 nt, Bordetella pertussis
gcgacgugucggccac

SEQ ID NO: 378725 - RNA, 17 nt, Bordetella pertussis
gcgacgugucggccacc

SEQ ID NO: 378726 - RNA, 18 nt, Bordetella pertussis
gcgacgugucggccacca

SEQ ID NO: 378727 - RNA, 19 nt, Bordetella pertussis
gcgacguuggucaccacgc

SEQ ID NO: 378728 - RNA, 15 nt, Bordetella pertussis
gcgacuccagcccga

SEQ ID NO: 378729 - RNA, 16 nt, Bordetella pertussis
gcgacuccagcccgau

SEQ ID NO: 378730 - RNA, 13 nt, Bordetella pertussis
gcgacuccggccg

SEQ ID NO: 378731 - RNA, 14 nt, Bordetella pertussis
gcgacuccggccgg

SEQ ID NO: 378732 - RNA, 18 nt, Bordetella pertussis
gcgacuccggccgggcca

SEQ ID NO: 378733 - RNA, 21 nt, Bordetella pertussis
gcgacuccggccgggccagcg

SEQ ID NO: 378734 - RNA, 17 nt, Bordetella pertussis
gcgacucgccgugcugg

SEQ ID NO: 378735 - RNA, 16 nt, Bordetella pertussis
gcgagaccacgauggc

SEQ ID NO: 378736 - RNA, 23 nt, Bordetella pertussis
gcgagaccagcggaucgccgggc

SEQ ID NO: 378737 - RNA, 22 nt, Bordetella pertussis
gcgagaccguggaaaccgcguc

SEQ ID NO: 378738 - RNA, 23 nt, Bordetella pertussis
gcgagacgaaggcgccggccagg

SEQ ID NO: 378739 - RNA, 23 nt, Bordetella pertussis
gcgagacgucggcgauggcccgg

SEQ ID NO: 378740 - RNA, 16 nt, Bordetella pertussis
gcgagagauagcccag

SEQ ID NO: 378741 - RNA, 18 nt, Bordetella pertussis
gcgagagcgccacgccag

SEQ ID NO: 378742 - RNA, 19 nt, Bordetella pertussis
gcgagagcgccacgccagc

SEQ ID NO: 378743 - RNA, 20 nt, Bordetella pertussis
gcgagagcgccacgccagcg

SEQ ID NO: 378744 - RNA, 17 nt, Bordetella pertussis
gcgagagcuccagccgg

SEQ ID NO: 378745 - RNA, 16 nt, Bordetella pertussis
gcgagaucagcaccgc

SEQ ID NO: 378746 - RNA, 20 nt, Bordetella pertussis
gcgagaucagcaccgcgacc

SEQ ID NO: 378747 - RNA, 20 nt, Bordetella pertussis
gcgagaucaucgaggcaauc

SEQ ID NO: 378748 - RNA, 16 nt, Bordetella pertussis
gcgagaucucgaugcg

SEQ ID NO: 378749 - RNA, 23 nt, Bordetella pertussis
gcgagaucucgaugcguucgccc

SEQ ID NO: 378750 - RNA, 19 nt, Bordetella pertussis
gcgagcaaaggacacgcgc

SEQ ID NO: 378751 - RNA, 17 nt, Bordetella pertussis
gcgagcacccgcaggcg

SEQ ID NO: 378752 - RNA, 19 nt, Bordetella pertussis
gcgagcacccgcaggcggc

SEQ ID NO: 378753 - RNA, 20 nt, Bordetella pertussis
gcgagcgcggcgauacgcgc

SEQ ID NO: 378754 - RNA, 15 nt, Bordetella pertussis
gcgagcgcggcgcgc

SEQ ID NO: 378755 - RNA, 13 nt, Bordetella pertussis
gcgagcggccagc

SEQ ID NO: 378756 - RNA, 14 nt, Bordetella pertussis
gcgagcggccagcc

SEQ ID NO: 378757 - RNA, 17 nt, Bordetella pertussis
gcgagcggcggccgcgu

SEQ ID NO: 378758 - RNA, 14 nt, Bordetella pertussis
gcgagcggcgucgc

SEQ ID NO: 378759 - RNA, 13 nt, Bordetella pertussis
gcgaggccgcccg

SEQ ID NO: 378760 - RNA, 22 nt, Bordetella pertussis
gcgaggccgcccgccccggcgc

SEQ ID NO: 378761 - RNA, 18 nt, Bordetella pertussis
gcgaggccucgugcugcu

SEQ ID NO: 378762 - RNA, 16 nt, Bordetella pertussis
gcgaggcgcaggccga

SEQ ID NO: 378763 - RNA, 17 nt, Bordetella pertussis
gcgaggcgcaggccgac

SEQ ID NO: 378764 - RNA, 12 nt, Bordetella pertussis
gcgaggcggccu

SEQ ID NO: 378765 - RNA, 12 nt, Bordetella pertussis
gcgaggcggcga

SEQ ID NO: 378766 - RNA, 17 nt, Bordetella pertussis
gcgaggcggggcuggcg

SEQ ID NO: 378767 - RNA, 18 nt, Bordetella pertussis
gcgaggcggggcuggcgc

SEQ ID NO: 378768 - RNA, 14 nt, Bordetella pertussis
gcgaggcuggcgcc

SEQ ID NO: 378769 - RNA, 16 nt, Bordetella pertussis
gcgaggcuggcgccca

SEQ ID NO: 378770 - RNA, 16 nt, Bordetella pertussis
gcgagggucaggcgcg

SEQ ID NO: 378771 - RNA, 22 nt, Bordetella pertussis
gcgagggcgucguagcccucgc

SEQ ID NO: 378772 - RNA, 17 nt, Bordetella pertussis
gcgaggucagcccggcg

SEQ ID NO: 378773 - RNA, 18 nt, Bordetella pertussis
gcgaggucagcccggcgg

SEQ ID NO: 378774 - RNA, 20 nt, Bordetella pertussis
gcgaggucagcccggcggcc

SEQ ID NO: 378775 - RNA, 21 nt, Bordetella pertussis
gcgaggucagcccggcggcca

SEQ ID NO: 378776 - RNA, 23 nt, Bordetella pertussis
gcgaggucagcccggcggccauc

SEQ ID NO: 378777 - RNA, 14 nt, Bordetella pertussis
gcgagguccaggcg

SEQ ID NO: 378778 - RNA, 19 nt, Bordetella pertussis
gcgagguagggcgcggcca

SEQ ID NO: 378779 - RNA, 21 nt, Bordetella pertussis
gcgagguagggcgcggccagg

SEQ ID NO: 378780 - RNA, 19 nt, Bordetella pertussis
gcgagguauuggccuugcc

SEQ ID NO: 378781 - RNA, 13 nt, Bordetella pertussis
gcgagguggcgcu

SEQ ID NO: 378782 - RNA, 15 nt, Bordetella pertussis
gcgaggugcccgcga

SEQ ID NO: 378783 - RNA, 14 nt, Bordetella pertussis
gcgaggugccggac

SEQ ID NO: 378784 - RNA, 20 nt, Bordetella pertussis
gcgaucaccugcguggccgc

SEQ ID NO: 378785 - RNA, 19 nt, Bordetella pertussis
gcgaucacgccgaaggcgu

SEQ ID NO: 378786 - RNA, 13 nt, Bordetella pertussis
gcgaucacgccgu

SEQ ID NO: 378787 - RNA, 14 nt, Bordetella pertussis
gcgaucagcaccgc

SEQ ID NO: 378788 - RNA, 17 nt, Bordetella pertussis
gcgaucagcaccgcggc

SEQ ID NO: 378789 - RNA, 13 nt, Bordetella pertussis
gcgaucaggccgc

SEQ ID NO: 378790 - RNA, 14 nt, Bordetella pertussis
gcgaucaggccgcc

SEQ ID NO: 378791 - RNA, 16 nt, Bordetella pertussis
gcgaucaggccgcccc

SEQ ID NO: 378792 - RNA, 21 nt, Bordetella pertussis
gcgaucaggccgccccaacgg

SEQ ID NO: 378793 - RNA, 15 nt, Bordetella pertussis
gcgaucagcgcggcc

SEQ ID NO: 378794 - RNA, 16 nt, Bordetella pertussis
gcgaucagcgcggccg

SEQ ID NO: 378795 - RNA, 22 nt, Bordetella pertussis
gcgaucaugcaguacaggcgcg

SEQ ID NO: 378796 - RNA, 16 nt, Bordetella pertussis
gcgaucaugccgccga

SEQ ID NO: 378797 - RNA, 21 nt, Bordetella pertussis
gcgauccagcagcguggccac

SEQ ID NO: 378798 - RNA, 13 nt, Bordetella pertussis
gcgauccagggcc

SEQ ID NO: 378799 - RNA, 20 nt, Bordetella pertussis
gcgauccagggccgccagca

SEQ ID NO: 378800 - RNA, 14 nt, Bordetella pertussis
gcgauccagggcga

SEQ ID NO: 378801 - RNA, 17 nt, Bordetella pertussis
gcgauccgccgcggcca

SEQ ID NO: 378802 - RNA, 22 nt, Bordetella pertussis
gcgauccggcgugguaucgcgc

SEQ ID NO: 378803 - RNA, 15 nt, Bordetella pertussis
gcgauccucgacccg

SEQ ID NO: 378804 - RNA, 20 nt, Bordetella pertussis
gcgauccucgacccgaaggc

SEQ ID NO: 378805 - RNA, 13 nt, Bordetella pertussis
gcgaucgaacgcg

SEQ ID NO: 378806 - RNA, 15 nt, Bordetella pertussis
gcgaucgaacgcggc

SEQ ID NO: 378807 - RNA, 19 nt, Bordetella pertussis
gcgaucgaauggucggccu

SEQ ID NO: 378808 - RNA, 22 nt, Bordetella pertussis
gcgaucgaauggucggccucgg

SEQ ID NO: 378809 - RNA, 21 nt, Bordetella pertussis
gcgauccugcccaccgccgcc

SEQ ID NO: 378810 - RNA, 13 nt, Bordetella pertussis
gcgaucgacagcc

SEQ ID NO: 378811 - RNA, 22 nt, Bordetella pertussis
gcgaucgccagcaggcgcuggu

SEQ ID NO: 378812 - RNA, 23 nt, Bordetella pertussis
gcgaucgcgucggccaaggccgg

SEQ ID NO: 378813 - RNA, 12 nt, Bordetella pertussis
gcgaucggcccg

SEQ ID NO: 378814 - RNA, 17 nt, Bordetella pertussis
gcgaucgucgaccgcga

SEQ ID NO: 378815 - RNA, 18 nt, Bordetella pertussis
gcgaucucgucgaccgcc

SEQ ID NO: 378816 - RNA, 19 nt, Bordetella pertussis
gcgaucugcgcggcggugc

SEQ ID NO: 378817 - RNA, 21 nt, Bordetella pertussis
gcgaucugggccucggccagc

SEQ ID NO: 378818 - RNA, 19 nt, Bordetella pertussis
gcgaucuucagcaccagcu

SEQ ID NO: 378819 - RNA, 21 nt, Bordetella pertussis
gcgaucuucagcaccagcucc

SEQ ID NO: 378820 - RNA, 15 nt, Bordetella pertussis
gcgaucuugccggcc

SEQ ID NO: 378821 - RNA, 16 nt, Bordetella pertussis
gcgaucuugccggccu

SEQ ID NO: 378822 - RNA, 18 nt, Bordetella pertussis
gcgaucuugccggccugg

SEQ ID NO: 378823 - RNA, 15 nt, Bordetella pertussis
gcgaugaacagcggc

SEQ ID NO: 378824 - RNA, 20 nt, Bordetella pertussis
gcgaugaacagcggcacgcc

SEQ ID NO: 378825 - RNA, 22 nt, Bordetella pertussis
gcgaugaacagcggcacgccgg

SEQ ID NO: 378826 - RNA, 22 nt, Bordetella pertussis
gcgaugaagucgcggcccgcca

SEQ ID NO: 378827 - RNA, 14 nt, Bordetella pertussis
gcgaugaccggcaa

SEQ ID NO: 378828 - RNA, 21 nt, Bordetella pertussis
gcgaugacggcuucgaccacg

SEQ ID NO: 378829 - RNA, 20 nt, Bordetella pertussis
gcgaugcacccaggcgccga

SEQ ID NO: 378830 - RNA, 18 nt, Bordetella pertussis
gcgaugcaugaaccgcag

SEQ ID NO: 378831 - RNA, 20 nt, Bordetella pertussis
gcgaugcauucggcggccgg

SEQ ID NO: 378832 - RNA, 21 nt, Bordetella pertussis
gcgaugcccaccagccgcccg

SEQ ID NO: 378833 - RNA, 13 nt, Bordetella pertussis
gcgaugcccagcg

SEQ ID NO: 378834 - RNA, 20 nt, Bordetella pertussis
gcgaugcccagcgccgccga

SEQ ID NO: 378835 - RNA, 21 nt, Bordetella pertussis
gcgaugccccaguccaggccg

SEQ ID NO: 378836 - RNA, 16 nt, Bordetella pertussis
gcgaugcccgcgcacc

SEQ ID NO: 378837 - RNA, 17 nt, Bordetella pertussis
gcgaugcccgcgcacca

SEQ ID NO: 378838 - RNA, 16 nt, Bordetella pertussis
gcgaugccgcugucgg

SEQ ID NO: 378839 - RNA, 12 nt, Bordetella pertussis
gcgaugccggcg

SEQ ID NO: 378840 - RNA, 13 nt, Bordetella pertussis
gcgaugccggcgc

SEQ ID NO: 378841 - RNA, 21 nt, Bordetella pertussis
gcgaugccggcgcugcgcagc

SEQ ID NO: 378842 - RNA, 20 nt, Bordetella pertussis
gcgaugccggcguggcgcgc

SEQ ID NO: 378843 - RNA, 13 nt, Bordetella pertussis
gcgaugccgggca

SEQ ID NO: 378844 - RNA, 18 nt, Bordetella pertussis
gcgaugccggccagcagc

SEQ ID NO: 378845 - RNA, 23 nt, Bordetella pertussis
gcgaugccguacuuggcgauggc

SEQ ID NO: 378846 - RNA, 19 nt, Bordetella pertussis
gcgaugcgcagcagcagcg

SEQ ID NO: 378847 - RNA, 15 nt, Bordetella pertussis
gcgaugcgccaggcg

SEQ ID NO: 378848 - RNA, 17 nt, Bordetella pertussis
gcgaugcgccaggcgcu

SEQ ID NO: 378849 - RNA, 19 nt, Bordetella pertussis
gcgaugcgcgcgcgggcca

SEQ ID NO: 378850 - RNA, 13 nt, Bordetella pertussis
gcgaugcgcgcgu

SEQ ID NO: 378851 - RNA, 20 nt, Bordetella pertussis
gcgaugcgcggcccggccgc

SEQ ID NO: 378852 - RNA, 14 nt, Bordetella pertussis
gcgaugcggcggcc

SEQ ID NO: 378853 - RNA, 18 nt, Bordetella pertussis
gcgaugcggcggccgaag

SEQ ID NO: 378854 - RNA, 16 nt, Bordetella pertussis
gcgaugcgggccacgc

SEQ ID NO: 378855 - RNA, 17 nt, Bordetella pertussis
gcgaugcgggccacgcc

SEQ ID NO: 378856 - RNA, 20 nt, Bordetella pertussis
gcgaugcgggccacgccggc

SEQ ID NO: 378857 - RNA, 21 nt, Bordetella pertussis
gcgaugcgggccacgccggcc

SEQ ID NO: 378858 - RNA, 16 nt, Bordetella pertussis
gcgaugcgggucuggc

SEQ ID NO: 378859 - RNA, 23 nt, Bordetella pertussis
gcgaugcgucaggggcaugccgg

SEQ ID NO: 378860 - RNA, 17 nt, Bordetella pertussis
gcgaugcugaccaccgg

SEQ ID NO: 378861 - RNA, 19 nt, Bordetella pertussis
gcgaugcugcagggccugg

SEQ ID NO: 378862 - RNA, 14 nt, Bordetella pertussis
gcgauggccacgcg

SEQ ID NO: 378863 - RNA, 14 nt, Bordetella pertussis
gcgauggcacggca

SEQ ID NO: 378864 - RNA, 13 nt, Bordetella pertussis
gcgauggcccggu

SEQ ID NO: 378865 - RNA, 16 nt, Bordetella pertussis
gcgauggccgccagcg

SEQ ID NO: 378866 - RNA, 13 nt, Bordetella pertussis
gcgauggccgcca

SEQ ID NO: 378867 - RNA, 16 nt, Bordetella pertussis
gcgauggcgccggcca

SEQ ID NO: 378868 - RNA, 18 nt, Bordetella pertussis
gcgauggcgccggccagc

SEQ ID NO: 378869 - RNA, 14 nt, Bordetella pertussis
gcgauggcgcgcgc

SEQ ID NO: 378870 - RNA, 17 nt, Bordetella pertussis
gcgauggcgcgcgccac

SEQ ID NO: 378871 - RNA, 14 nt, Bordetella pertussis
gcgauggcgcggcc

SEQ ID NO: 378872 - RNA, 16 nt, Bordetella pertussis
gcgauggcgcggccgg

SEQ ID NO: 378873 - RNA, 14 nt, Bordetella pertussis
gcgauguaggccag

SEQ ID NO: 378874 - RNA, 17 nt, Bordetella pertussis
gcgauguaggccagguu

SEQ ID NO: 378875 - RNA, 21 nt, Bordetella pertussis
gcgauguaggccagguucugg

SEQ ID NO: 378876 - RNA, 18 nt, Bordetella pertussis
gcgauguccagcgagcga

SEQ ID NO: 378877 - RNA, 22 nt, Bordetella pertussis
gcgaugucgaauuccgggacgc

SEQ ID NO: 378878 - RNA, 14 nt, Bordetella pertussis
gcgaugucgcgcgc

SEQ ID NO: 378879 - RNA, 19 nt, Bordetella pertussis
gcgaugucgcgcgcgcuca

SEQ ID NO: 378880 - RNA, 22 nt, Bordetella pertussis
gcgaugucgucaucccuugagc

SEQ ID NO: 378881 - RNA, 18 nt, Bordetella pertussis
gcgauguucggaugcgcg

SEQ ID NO: 378882 - RNA, 22 nt, Bordetella pertussis
gcgauguucggaugcgcguugc

SEQ ID NO: 378883 - RNA, 20 nt, Bordetella pertussis
gcgauugaguucgcgcgccg

SEQ ID NO: 378884 - RNA, 21 nt, Bordetella pertussis
gcgauugaguucgcgcgccgg

SEQ ID NO: 378885 - RNA, 14 nt, Bordetella pertussis
gcgauugcaggugg

SEQ ID NO: 378886 - RNA, 20 nt, Bordetella pertussis
gcgauugcagguggccagcc

SEQ ID NO: 378887 - RNA, 15 nt, Bordetella pertussis
gcgauugcgccagcg

SEQ ID NO: 378888 - RNA, 21 nt, Bordetella pertussis
gcgauuuccuugcgccgcccg

SEQ ID NO: 378889 - RNA, 16 nt, Bordetella pertussis
gcgauuugccgcagcc

SEQ ID NO: 378890 - RNA, 17 nt, Bordetella pertussis
gcgauuugccgcagccc

SEQ ID NO: 378891 - RNA, 21 nt, Bordetella pertussis
gcgcaaaagcaacaaccgcgc

SEQ ID NO: 378892 - RNA, 20 nt, Bordetella pertussis
gcgcaaaccgacgcggccag

SEQ ID NO: 378893 - RNA, 23 nt, Bordetella pertussis
gcgcaaacgggggcaggccgcgg

SEQ ID NO: 378894 - RNA, 20 nt, Bordetella pertussis
gcgcaacacgcgcgacgccg

SEQ ID NO: 378895 - RNA, 23 nt, Bordetella pertussis
gcgcaacauggugaccggggcgu

SEQ ID NO: 378896 - RNA, 23 nt, Bordetella pertussis
gcgcaaccaggggcggcgcggcg

SEQ ID NO: 378897 - RNA, 14 nt, Bordetella pertussis
gcgcaacaggucgu

SEQ ID NO: 378898 - RNA, 21 nt, Bordetella pertussis
gcgcaacccggccucgcugcg

SEQ ID NO: 378899 - RNA, 13 nt, Bordetella pertussis
gcgcaacgcaugc

SEQ ID NO: 378900 - RNA, 13 nt, Bordetella pertussis
gcgcaacgccgcc

SEQ ID NO: 378901 - RNA, 14 nt, Bordetella pertussis
gcgcaacgccgcca

SEQ ID NO: 378902 - RNA, 17 nt, Bordetella pertussis
gcgcaacgccggccgcc

SEQ ID NO: 378903 - RNA, 14 nt, Bordetella pertussis
gcgcaacgccgggu

SEQ ID NO: 378904 - RNA, 14 nt, Bordetella pertussis
gcgcaacgggccga

SEQ ID NO: 378905 - RNA, 20 nt, Bordetella pertussis
gcgcaagcaggucacgacgg

SEQ ID NO: 378906 - RNA, 14 nt, Bordetella pertussis
gcgcaagcccaggc

SEQ ID NO: 378907 - RNA, 15 nt, Bordetella pertussis
gcgcaagcccaggcg

SEQ ID NO: 378908 - RNA, 17 nt, Bordetella pertussis
gcgcaagcccaggcggc

SEQ ID NO: 378909 - RNA, 23 nt, Bordetella pertussis
gcgcaagcccaggcggcccagcg

SEQ ID NO: 378910 - RNA, 12 nt, Bordetella pertussis
gcgcaagccgcc

SEQ ID NO: 378911 - RNA, 19 nt, Bordetella pertussis
gcgcaagccgcccgcggcg

SEQ ID NO: 378912 - RNA, 13 nt, Bordetella pertussis
gcgcaagccgccg

SEQ ID NO: 378913 - RNA, 15 nt, Bordetella pertussis
gcgcaagccgccgcc

SEQ ID NO: 378914 - RNA, 20 nt, Bordetella pertussis
gcgcaagccgccgcccucgc

SEQ ID NO: 378915 - RNA, 13 nt, Bordetella pertussis
gcgcaagccgcug

SEQ ID NO: 378916 - RNA, 19 nt, Bordetella pertussis
gcgcaagccggccgcgccg

SEQ ID NO: 378917 - RNA, 20 nt, Bordetella pertussis
gcgcaagccggccgcgcggc

SEQ ID NO: 378918 - RNA, 22 nt, Bordetella pertussis
gcgcaagccggccgcgcggccg

SEQ ID NO: 378919 - RNA, 13 nt, Bordetella pertussis
gcgcaagaucugg

SEQ ID NO: 378920 - RNA, 14 nt, Bordetella pertussis
gcgcaagcgcgccg

SEQ ID NO: 378921 - RNA, 15 nt, Bordetella pertussis
gcgcaagcgcgccga

SEQ ID NO: 378922 - RNA, 17 nt, Bordetella pertussis
gcgcaagcgcgccgaca

SEQ ID NO: 378923 - RNA, 15 nt, Bordetella pertussis
gcgcaagcggcccca

SEQ ID NO: 378924 - RNA, 18 nt, Bordetella pertussis
gcgcaaggacgcguccuc

SEQ ID NO: 378925 - RNA, 16 nt, Bordetella pertussis
gcgcaaggcggcccgg

SEQ ID NO: 378926 - RNA, 22 nt, Bordetella pertussis
gcgcaaggcggcccggccgccg

SEQ ID NO: 378927 - RNA, 14 nt, Bordetella pertussis
gcgcaaggcgggcu

SEQ ID NO: 378928 - RNA, 23 nt, Bordetella pertussis
gcgcaaggcgggcuggucgcgcc

SEQ ID NO: 378929 - RNA, 15 nt, Bordetella pertussis
gcgcaagguggcggu

SEQ ID NO: 378930 - RNA, 20 nt, Bordetella pertussis
gcgcaaguucaucaucgccg

SEQ ID NO: 378931 - RNA, 21 nt, Bordetella pertussis
gcgcaaguucaucaucgccga

SEQ ID NO: 378932 - RNA, 15 nt, Bordetella pertussis
gcgcaauacgccgcc

SEQ ID NO: 378933 - RNA, 16 nt, Bordetella pertussis
gcgcaauacgccgccg

SEQ ID NO: 378934 - RNA, 19 nt, Bordetella pertussis
gcgcaauacgccgccggcg

SEQ ID NO: 378935 - RNA, 21 nt, Bordetella pertussis
gcgcaauacgccgccggcgca

SEQ ID NO: 378936 - RNA, 15 nt, Bordetella pertussis
gcgcaauaggccgcg

SEQ ID NO: 378937 - RNA, 13 nt, Bordetella pertussis
gcgcaaugcgcgg

SEQ ID NO: 378938 - RNA, 15 nt, Bordetella pertussis
gcgcaaugcgcggcg

SEQ ID NO: 378939 - RNA, 19 nt, Bordetella pertussis
gcgcaauggacacagcggc

SEQ ID NO: 378940 - RNA, 16 nt, Bordetella pertussis
gcgcaauugcuucugg

SEQ ID NO: 378941 - RNA, 18 nt, Bordetella pertussis
gcgcacaaucugcgucgc

SEQ ID NO: 378942 - RNA, 15 nt, Bordetella pertussis
gcgcacacauggcgc

SEQ ID NO: 378943 - RNA, 13 nt, Bordetella pertussis
gcgcacaccauca

SEQ ID NO: 378944 - RNA, 17 nt, Bordetella pertussis
gcgcacaccaucagcug

SEQ ID NO: 378945 - RNA, 15 nt, Bordetella pertussis
gcgcacagcgcggcg

SEQ ID NO: 378946 - RNA, 17 nt, Bordetella pertussis
gcgcacaggcggcgccg

SEQ ID NO: 378947 - RNA, 15 nt, Bordetella pertussis
gcgcacagggcgucg

SEQ ID NO: 378948 - RNA, 16 nt, Bordetella pertussis
gcgcacagggcgucgc

SEQ ID NO: 378949 - RNA, 18 nt, Bordetella pertussis
gcgcacaguugcaggcca

SEQ ID NO: 378950 - RNA, 20 nt, Bordetella pertussis
gcgcacaguugcaggccaug

SEQ ID NO: 378951 - RNA, 22 nt, Bordetella pertussis
gcgcacaggcgcucgcccucgc

SEQ ID NO: 378952 - RNA, 19 nt, Bordetella pertussis
gcgcaccaccagcaccgcc

SEQ ID NO: 378953 - RNA, 23 nt, Bordetella pertussis
gcgcaccaccagcaccgccacgc

SEQ ID NO: 378954 - RNA, 20 nt, Bordetella pertussis
gcgcaccaccgagaaaccga

SEQ ID NO: 378955 - RNA, 16 nt, Bordetella pertussis
gcgcaccaccuggcug

SEQ ID NO: 378956 - RNA, 17 nt, Bordetella pertussis
gcgcaccaccuggcuga

SEQ ID NO: 378957 - RNA, 12 nt, Bordetella pertussis
gcgcaccagccc

SEQ ID NO: 378958 - RNA, 11 nt, Bordetella pertussis
gcgcaccagcg

SEQ ID NO: 378959 - RNA, 23 nt, Bordetella pertussis
gcgcaccagcgaguuguccuggc

SEQ ID NO: 378960 - RNA, 12 nt, Bordetella pertussis
gcgcaccagcgg

SEQ ID NO: 378961 - RNA, 17 nt, Bordetella pertussis
gcgcaccagcuuggccu

SEQ ID NO: 378962 - RNA, 14 nt, Bordetella pertussis
gcgcaccaggccug

SEQ ID NO: 378963 - RNA, 19 nt, Bordetella pertussis
gcgcaccaggccugccuga

SEQ ID NO: 378964 - RNA, 14 nt, Bordetella pertussis
gcgcaccaggcgcg

SEQ ID NO: 378965 - RNA, 22 nt, Bordetella pertussis
gcgcaccaggcgcucgcgcgcc

SEQ ID NO: 378966 - RNA, 14 nt, Bordetella pertussis
gcgcaccaggcugg

SEQ ID NO: 378967 - RNA, 23 nt, Bordetella pertussis
gcgcaccaggcuggggccgagcg

SEQ ID NO: 378968 - RNA, 22 nt, Bordetella pertussis
gcgcaugacggcgucgagcacg

SEQ ID NO: 378969 - RNA, 13 nt, Bordetella pertussis
gcgcaugacgggg

SEQ ID NO: 378970 - RNA, 22 nt, Bordetella pertussis
gcgcaugacggggugccugucc

SEQ ID NO: 378971 - RNA, 15 nt, Bordetella pertussis
gcgcaugagccggca

SEQ ID NO: 378972 - RNA, 17 nt, Bordetella pertussis
gcgcaugagccggcaga

SEQ ID NO: 378973 - RNA, 16 nt, Bordetella pertussis
gcgcaugaugcugccg

SEQ ID NO: 378974 - RNA, 16 nt, Bordetella pertussis
gcgcaugauggccggc

SEQ ID NO: 378975 - RNA, 18 nt, Bordetella pertussis
gcgcaugauggccggccu

SEQ ID NO: 378976 - RNA, 19 nt, Bordetella pertussis
gcgcaugauggccggccug

SEQ ID NO: 378977 - RNA, 21 nt, Bordetella pertussis
gcgcaugauggccggccugcc

SEQ ID NO: 378978 - RNA, 15 nt, Bordetella pertussis
gcgcaugcagccgca

SEQ ID NO: 378979 - RNA, 13 nt, Bordetella pertussis
gcgcaugccagcu

SEQ ID NO: 378980 - RNA, 21 nt, Bordetella pertussis
gcgcaugccauggccgcgcgg

SEQ ID NO: 378981 - RNA, 13 nt, Bordetella pertussis
gcgcaugcccgac

SEQ ID NO: 378982 - RNA, 17 nt, Bordetella pertussis
gcgcaugcgccuuacuu

SEQ ID NO: 378983 - RNA, 17 nt, Bordetella pertussis
gcgcaugccgucgagcg

SEQ ID NO: 378984 - RNA, 12 nt, Bordetella pertussis
gcgcaugcugga

SEQ ID NO: 378985 - RNA, 16 nt, Bordetella pertussis
gcgcauggacgccgcc

SEQ ID NO: 378986 - RNA, 17 nt, Bordetella pertussis
gcgcauggacgccgccg

SEQ ID NO: 378987 - RNA, 16 nt, Bordetella pertussis
gcgcauggccagcaca

SEQ ID NO: 378988 - RNA, 24 nt, Bordetella pertussis
gcgcauggccagcacauacgccgc

SEQ ID NO: 378989 - RNA, 17 nt, Bordetella pertussis
gcgcauggcgaugaccu

SEQ ID NO: 378990 - RNA, 16 nt, Bordetella pertussis
gcgcauggcugguccc

SEQ ID NO: 378991 - RNA, 22 nt, Bordetella pertussis
gcgcaugggaaauccgccgggu

SEQ ID NO: 378992 - RNA, 23 nt, Bordetella pertussis
gcgcaugggaaauccgccgggug

SEQ ID NO: 378993 - RNA, 17 nt, Bordetella pertussis
gcgcaugggcgcaggcc

SEQ ID NO: 378994 - RNA, 19 nt, Bordetella pertussis
gcgcaugggcgcaggccgc

SEQ ID NO: 378995 - RNA, 21 nt, Bordetella pertussis
gcgcauggugagggccacgcg

SEQ ID NO: 378996 - RNA, 22 nt, Bordetella pertussis
gcgcauggugagggccacgcgc

SEQ ID NO: 378997 - RNA, 21 nt, Bordetella pertussis
gcgcaugucccgcaugaccug

SEQ ID NO: 378998 - RNA, 17 nt, Bordetella pertussis
gcgcauguccgccacgc

SEQ ID NO: 378999 - RNA, 18 nt, Bordetella pertussis
gcgcauguccgccacgcc

SEQ ID NO: 379000 - RNA, 22 nt, Bordetella pertussis
gcgcauguccgccacgccggcc

SEQ ID NO: 379001 - RNA, 20 nt, Bordetella pertussis
gcgcaugucgaagcaggcgg

SEQ ID NO: 379002 - RNA, 22 nt, Bordetella pertussis
gcgcauguagucgucgcuggcc

SEQ ID NO: 379003 - RNA, 16 nt, Bordetella pertussis
gcgcauucgcgccuga

SEQ ID NO: 379004 - RNA, 18 nt, Bordetella pertussis
gcgcauucgucgcugccg

SEQ ID NO: 379005 - RNA, 22 nt, Bordetella pertussis
gcgcauucgucgcugccgcgcg

SEQ ID NO: 379006 - RNA, 20 nt, Bordetella pertussis
gcgcauugccgccgcccugc

SEQ ID NO: 379007 - RNA, 19 nt, Bordetella pertussis
gcgcauugccgucggccgc

SEQ ID NO: 379008 - RNA, 21 nt, Bordetella pertussis
gcgcauugccgucggccgcgc

SEQ ID NO: 379009 - RNA, 17 nt, Bordetella pertussis
gcgcauugcgguccagg

SEQ ID NO: 379010 - RNA, 17 nt, Bordetella pertussis
gcgcauuggugagcacg

SEQ ID NO: 379011 - RNA, 18 nt, Bordetella pertussis
gcgcauuggugagcacgc

SEQ ID NO: 379012 - RNA, 17 nt, Bordetella pertussis
gcgcauuugccgcggcg

SEQ ID NO: 379013 - RNA, 21 nt, Bordetella pertussis
gcgccaaaaggcagcaggcug

SEQ ID NO: 379014 - RNA, 22 nt, Bordetella pertussis
gcgccaaagcacaggauggcga

SEQ ID NO: 379015 - RNA, 23 nt, Bordetella pertussis
gcgccaacccgccauccuggccg

SEQ ID NO: 379016 - RNA, 17 nt, Bordetella pertussis
gcgccaacggugccagu

SEQ ID NO: 379017 - RNA, 15 nt, Bordetella pertussis
gcgccaacgcgucga

SEQ ID NO: 379018 - RNA, 20 nt, Bordetella pertussis
gcgccaaucagauggcgcag

SEQ ID NO: 379019 - RNA, 13 nt, Bordetella pertussis
gcgccaaucggcg

SEQ ID NO: 379020 - RNA, 18 nt, Bordetella pertussis
gcgccaauuguccugguc

SEQ ID NO: 379021 - RNA, 20 nt, Bordetella pertussis
gcgccaauuguccuggucga

SEQ ID NO: 379022 - RNA, 18 nt, Bordetella pertussis
gcgccacacgggcgccug

SEQ ID NO: 379023 - RNA, 16 nt, Bordetella pertussis
gcgccacagcaugacc

SEQ ID NO: 379024 - RNA, 14 nt, Bordetella pertussis
gcgccacagcgcca

SEQ ID NO: 379025 - RNA, 15 nt, Bordetella pertussis
gcgccacagcgccau

SEQ ID NO: 379026 - RNA, 19 nt, Bordetella pertussis
gcgccacagggccugacgc

SEQ ID NO: 379027 - RNA, 19 nt, Bordetella pertussis
gcgccacaggugcgcggcg

SEQ ID NO: 379028 - RNA, 12 nt, Bordetella pertussis
gcgccaccaccg

SEQ ID NO: 379029 - RNA, 21 nt, Bordetella pertussis
gcgccaccaccggcacgccgg

SEQ ID NO: 379030 - RNA, 22 nt, Bordetella pertussis
gcgccaccaccggcacgccggc

SEQ ID NO: 379031 - RNA, 16 nt, Bordetella pertussis
gcgccaccagcagcgc

SEQ ID NO: 379032 - RNA, 18 nt, Bordetella pertussis
gcgccaccagcagcgcca

SEQ ID NO: 379033 - RNA, 23 nt, Bordetella pertussis
gcgccaccagcagcgccaggaug

SEQ ID NO: 379034 - RNA, 18 nt, Bordetella pertussis
gcgccaccagcuugcgcg

SEQ ID NO: 379035 - RNA, 21 nt, Bordetella pertussis
gcgccaccaugccuugcgcga

SEQ ID NO: 379036 - RNA, 20 nt, Bordetella pertussis
gcgccaccccgccgcugaac

SEQ ID NO: 379037 - RNA, 17 nt, Bordetella pertussis
gcgccaccgcauggggc

SEQ ID NO: 379038 - RNA, 13 nt, Bordetella pertussis
gcgccaccggcug

SEQ ID NO: 379039 - RNA, 13 nt, Bordetella pertussis
gcgccaccggucg

SEQ ID NO: 379040 - RNA, 22 nt, Bordetella pertussis
gcgccaccgugauggcgcgggu

SEQ ID NO: 379041 - RNA, 12 nt, Bordetella pertussis
gcgccaccgugg

SEQ ID NO: 379042 - RNA, 13 nt, Bordetella pertussis
gcgccaccuggcg

SEQ ID NO: 379043 - RNA, 14 nt, Bordetella pertussis
gcgccaccuggcgc

SEQ ID NO: 379044 - RNA, 17 nt, Bordetella pertussis
gcgccaccuucgccgcg

SEQ ID NO: 379045 - RNA, 19 nt, Bordetella pertussis
gcgccacgacguagucggc

SEQ ID NO: 379046 - RNA, 14 nt, Bordetella pertussis
gcgccacgccagcg

SEQ ID NO: 379047 - RNA, 24 nt, Bordetella pertussis
gcgccacgcccacuuccucggcgc

SEQ ID NO: 379048 - RNA, 15 nt, Bordetella pertussis
gcgccacgcccaggc

SEQ ID NO: 379049 - RNA, 17 nt, Bordetella pertussis
gcgccacgcccaggccg

SEQ ID NO: 379050 - RNA, 16 nt, Bordetella pertussis
gcgccacgcccuggcg

SEQ ID NO: 379051 - RNA, 14 nt, Bordetella pertussis
gcgccacgccguca

SEQ ID NO: 379052 - RNA, 14 nt, Bordetella pertussis
gcgccagcagcgcc

SEQ ID NO: 379053 - RNA, 16 nt, Bordetella pertussis
gcgccagcagcgccgg

SEQ ID NO: 379054 - RNA, 17 nt, Bordetella pertussis
gcgccagcagcgccggu

SEQ ID NO: 379055 - RNA, 15 nt, Bordetella pertussis
gcgccagcagcgggc

SEQ ID NO: 379056 - RNA, 16 nt, Bordetella pertussis
gcgccagcagcgggcu

SEQ ID NO: 379057 - RNA, 15 nt, Bordetella pertussis
gcgccagcaggaugu

SEQ ID NO: 379058 - RNA, 20 nt, Bordetella pertussis
gcgccagcagggucagcggc

SEQ ID NO: 379059 - RNA, 14 nt, Bordetella pertussis
gcgccagccacgcg

SEQ ID NO: 379060 - RNA, 15 nt, Bordetella pertussis
gcgccagccacgcgc

SEQ ID NO: 379061 - RNA, 14 nt, Bordetella pertussis
gcgccagccagcgc

SEQ ID NO: 379062 - RNA, 19 nt, Bordetella pertussis
gcgccagccagcgcaugcc

SEQ ID NO: 379063 - RNA, 14 nt, Bordetella pertussis
gcgccagcauccgg

SEQ ID NO: 379064 - RNA, 14 nt, Bordetella pertussis
gcgccagcaugcgc

SEQ ID NO: 379065 - RNA, 12 nt, Bordetella pertussis
gcgccagcccgc

SEQ ID NO: 379066 - RNA, 21 nt, Bordetella pertussis
gcgccagcccgcccgcgagcg

SEQ ID NO: 379067 - RNA, 14 nt, Bordetella pertussis
gcgccagcccgccg

SEQ ID NO: 379068 - RNA, 17 nt, Bordetella pertussis
gcgccagcccgccgcug

SEQ ID NO: 379069 - RNA, 17 nt, Bordetella pertussis
gcgccagcccgcugccg

SEQ ID NO: 379070 - RNA, 19 nt, Bordetella pertussis
gcgccagcggccgucgccu

SEQ ID NO: 379071 - RNA, 13 nt, Bordetella pertussis
gcgccagcggcug

SEQ ID NO: 379072 - RNA, 14 nt, Bordetella pertussis
gcgccagcggcugc

SEQ ID NO: 379073 - RNA, 15 nt, Bordetella pertussis
gcgccagcggcugcu

SEQ ID NO: 379074 - RNA, 18 nt, Bordetella pertussis
gcgccagcggcugcuuga

SEQ ID NO: 379075 - RNA, 14 nt, Bordetella pertussis
gcgccagcguacga

SEQ ID NO: 379076 - RNA, 12 nt, Bordetella pertussis
gcgccagcgugg

SEQ ID NO: 379077 - RNA, 13 nt, Bordetella pertussis
gcgccagcguggc

SEQ ID NO: 379078 - RNA, 15 nt, Bordetella pertussis
gcgccagcguggccg

SEQ ID NO: 379079 - RNA, 18 nt, Bordetella pertussis
gcgccagcguggccgagg

SEQ ID NO: 379080 - RNA, 22 nt, Bordetella pertussis
gcgccagcguggccgaggugcc

SEQ ID NO: 379081 - RNA, 16 nt, Bordetella pertussis
gcgccagcuccagccg

SEQ ID NO: 379082 - RNA, 17 nt, Bordetella pertussis
gcgccagcuccagccgc

SEQ ID NO: 379083 - RNA, 20 nt, Bordetella pertussis
gcgccagcuccagccgcagg

SEQ ID NO: 379084 - RNA, 18 nt, Bordetella pertussis
gcgccagcucgcgcagca

SEQ ID NO: 379085 - RNA, 15 nt, Bordetella pertussis
gcgccagcucggcca

SEQ ID NO: 379086 - RNA, 14 nt, Bordetella pertussis
gcgccagcugcgca

SEQ ID NO: 379087 - RNA, 17 nt, Bordetella pertussis
gcgccagcugcgcagcg

SEQ ID NO: 379088 - RNA, 19 nt, Bordetella pertussis
gcgccagcugcgcagcgac

SEQ ID NO: 379089 - RNA, 12 nt, Bordetella pertussis
gcgccaggccuc

SEQ ID NO: 379090 - RNA, 13 nt, Bordetella pertussis
gcgccaggccucg

SEQ ID NO: 379091 - RNA, 18 nt, Bordetella pertussis
gcgccaggccucggucgc

SEQ ID NO: 379092 - RNA, 16 nt, Bordetella pertussis
gcgccaggcgauggcc

SEQ ID NO: 379093 - RNA, 14 nt, Bordetella pertussis
gcgccaggcgcucg

SEQ ID NO: 379094 - RNA, 15 nt, Bordetella pertussis
gcgccaggcgcucgg

SEQ ID NO: 379095 - RNA, 17 nt, Bordetella pertussis
gcgccaggcgcucggcg

SEQ ID NO: 379096 - RNA, 13 nt, Bordetella pertussis
gcgccaggcgcau

SEQ ID NO: 379097 - RNA, 17 nt, Bordetella pertussis
gcgccaggcgcugcgcg

SEQ ID NO: 379098 - RNA, 14 nt, Bordetella pertussis
gcgccaggcgguac

SEQ ID NO: 379099 - RNA, 16 nt, Bordetella pertussis
gcgccaggcggucaua

SEQ ID NO: 379100 - RNA, 23 nt, Bordetella pertussis
gcgccaggcguagaccaccugcu

SEQ ID NO: 379101 - RNA, 11 nt, Bordetella pertussis
gcgccaggcug

SEQ ID NO: 379102 - RNA, 21 nt, Bordetella pertussis
gcgccaggcugaaugccgccg

SEQ ID NO: 379103 - RNA, 17 nt, Bordetella pertussis
gcgccaggcugucgucg

SEQ ID NO: 379104 - RNA, 18 nt, Bordetella pertussis
gcgccaggcuuugggcaa

SEQ ID NO: 379105 - RNA, 18 nt, Bordetella pertussis
gcgccagggccaggccgc

SEQ ID NO: 379106 - RNA, 20 nt, Bordetella pertussis
gcgccagggccaggccgccg

SEQ ID NO: 379107 - RNA, 17 nt, Bordetella pertussis
gcgccagggccgccgcg

SEQ ID NO: 379108 - RNA, 22 nt, Bordetella pertussis
gcgccagggccgccgcgcccag

SEQ ID NO: 379109 - RNA, 14 nt, Bordetella pertussis
gcgccagggcgccg

SEQ ID NO: 379110 - RNA, 16 nt, Bordetella pertussis
gcgccagggcgccgcg

SEQ ID NO: 379111 - RNA, 19 nt, Bordetella pertussis
gcgccagggcgcggaucau

SEQ ID NO: 379112 - RNA, 19 nt, Bordetella pertussis
gcgccagggugccgaaacc

SEQ ID NO: 379113 - RNA, 20 nt, Bordetella pertussis
gcgccagguaggccggcgcg

SEQ ID NO: 379114 - RNA, 17 nt, Bordetella pertussis
gcgccaggucgcgcacc

SEQ ID NO: 379115 - RNA, 18 nt, Bordetella pertussis
gcgccaggucgcgcacca

SEQ ID NO: 379116 - RNA, 22 nt, Bordetella pertussis
gcgccaggucgcgcaccagguc

SEQ ID NO: 379117 - RNA, 15 nt, Bordetella pertussis
gcgccaggugcacgg

SEQ ID NO: 379118 - RNA, 19 nt, Bordetella pertussis
gcgccaggugcacggugga

SEQ ID NO: 379119 - RNA, 22 nt, Bordetella pertussis
gcgccaggugcuugcggcuguc

SEQ ID NO: 379120 - RNA, 22 nt, Bordetella pertussis
gcgccauauugaugcagcacgu

SEQ ID NO: 379121 - RNA, 23 nt, Bordetella pertussis
gcgccaucaaugccaaucaugcg

SEQ ID NO: 379122 - RNA, 21 nt, Bordetella pertussis
gcgccaucgacgggcggcugc

SEQ ID NO: 379123 - RNA, 14 nt, Bordetella pertussis
gcgccaucgcggua

SEQ ID NO: 379124 - RNA, 15 nt, Bordetella pertussis
gcgccaucgcgucga

SEQ ID NO: 379125 - RNA, 22 nt, Bordetella pertussis
gcgccaucuaccugucgggcgg

SEQ ID NO: 379126 - RNA, 19 nt, Bordetella pertussis
gcgccaucucaaccacgaa

SEQ ID NO: 379127 - RNA, 23 nt, Bordetella pertussis
gcgccaucucaaccacgaacacg

SEQ ID NO: 379128 - RNA, 22 nt, Bordetella pertussis
gcgccaugaacgcuugacggcc

SEQ ID NO: 379129 - RNA, 23 nt, Bordetella pertussis
gcgccaugaacgcuugacggcca

SEQ ID NO: 379130 - RNA, 23 nt, Bordetella pertussis
gcgccaugaacucgcgcucggcg

SEQ ID NO: 379131 - RNA, 22 nt, Bordetella pertussis
gcgccaugaccacgucgaccag

SEQ ID NO: 379132 - RNA, 19 nt, Bordetella pertussis
gcgccaugaucgccggcaa

SEQ ID NO: 379133 - RNA, 17 nt, Bordetella pertussis
gcgccaugaugucgcgc

SEQ ID NO: 379134 - RNA, 21 nt, Bordetella pertussis
gcgccaugcaacacgaccagc

SEQ ID NO: 379135 - RNA, 14 nt, Bordetella pertussis
gcgccaugccgcgc

SEQ ID NO: 379136 - RNA, 18 nt, Bordetella pertussis
gcgccaugcgacagcccg

SEQ ID NO: 379137 - RNA, 21 nt, Bordetella pertussis
gcgccaugcgcaccaccgccg

SEQ ID NO: 379138 - RNA, 22 nt, Bordetella pertussis
gcgccaugcgcaccaccgccga

SEQ ID NO: 379139 - RNA, 15 nt, Bordetella pertussis
gcgccaugcgcccgg

SEQ ID NO: 379140 - RNA, 19 nt, Bordetella pertussis
gcgccaugcucgcgcacag

SEQ ID NO: 379141 - RNA, 18 nt, Bordetella pertussis
gcgccaugcuggccgccg

SEQ ID NO: 379142 - RNA, 23 nt, Bordetella pertussis
gcgccaugcuggccgccgcgcuc

SEQ ID NO: 379143 - RNA, 16 nt, Bordetella pertussis
gcgccauggcaggguc

SEQ ID NO: 379144 - RNA, 14 nt, Bordetella pertussis
gcgccauggccggc

SEQ ID NO: 379145 - RNA, 19 nt, Bordetella pertussis
gcgccauggccggccgccg

SEQ ID NO: 379146 - RNA, 17 nt, Bordetella pertussis
gcgcccccgcggcgccc

SEQ ID NO: 379147 - RNA, 19 nt, Bordetella pertussis
gcgcccccucuucucgucc

SEQ ID NO: 379148 - RNA, 22 nt, Bordetella pertussis
gcgccccgaucagcaagggccc

SEQ ID NO: 379149 - RNA, 15 nt, Bordetella pertussis
gcgccccgccaugcg

SEQ ID NO: 379150 - RNA, 13 nt, Bordetella pertussis
gcgccccgcuggc

SEQ ID NO: 379151 - RNA, 14 nt, Bordetella pertussis
gcgccccgcuggcc

SEQ ID NO: 379152 - RNA, 15 nt, Bordetella pertussis
gcgccccgcuggccg

SEQ ID NO: 379153 - RNA, 21 nt, Bordetella pertussis
gcgccccuagcgccgcgccag

SEQ ID NO: 379154 - RNA, 14 nt, Bordetella pertussis
gcgcccgccacguc

SEQ ID NO: 379155 - RNA, 12 nt, Bordetella pertussis
gcgcccgccccg

SEQ ID NO: 379156 - RNA, 16 nt, Bordetella pertussis
gcgcccgccgccgggc

SEQ ID NO: 379157 - RNA, 14 nt, Bordetella pertussis
gcgcccgccgcgcc

SEQ ID NO: 379158 - RNA, 18 nt, Bordetella pertussis
gcgcccgccgcgucggcg

SEQ ID NO: 379159 - RNA, 13 nt, Bordetella pertussis
gcgcccgccugcg

SEQ ID NO: 379160 - RNA, 19 nt, Bordetella pertussis
gcgcccgccugcgccagcc

SEQ ID NO: 379161 - RNA, 21 nt, Bordetella pertussis
gcgcccgccugcgccagccgc

SEQ ID NO: 379162 - RNA, 23 nt, Bordetella pertussis
gcgcccgccugcgccagccgcgc

SEQ ID NO: 379163 - RNA, 19 nt, Bordetella pertussis
gcgcccgccuucagcgggc

SEQ ID NO: 379164 - RNA, 16 nt, Bordetella pertussis
gcgcccgccguggcca

SEQ ID NO: 379165 - RNA, 15 nt, Bordetella pertussis
gcgcccggccggccc

SEQ ID NO: 379166 - RNA, 13 nt, Bordetella pertussis
gcgcccggcggcc

SEQ ID NO: 379167 - RNA, 14 nt, Bordetella pertussis
gcgcccggcggcca

SEQ ID NO: 379168 - RNA, 15 nt, Bordetella pertussis
gcgcccggcggccag

SEQ ID NO: 379169 - RNA, 17 nt, Bordetella pertussis
gcgcccggcggccaggc

SEQ ID NO: 379170 - RNA, 14 nt, Bordetella pertussis
gcgcccggcggcgc

SEQ ID NO: 379171 - RNA, 23 nt, Bordetella pertussis
gcgcccggcggcgcggcgagcac

SEQ ID NO: 379172 - RNA, 13 nt, Bordetella pertussis
gcgcccggccggc

SEQ ID NO: 379173 - RNA, 17 nt, Bordetella pertussis
gcgcccguccacggccu

SEQ ID NO: 379174 - RNA, 22 nt, Bordetella pertussis
gcgcccguccacggccugcgcg

SEQ ID NO: 379175 - RNA, 23 nt, Bordetella pertussis
gcgcccguccacggccugcgcgc

SEQ ID NO: 379176 - RNA, 16 nt, Bordetella pertussis
gcgcccgugcgcggcg

SEQ ID NO: 379177 - RNA, 20 nt, Bordetella pertussis
gcgcccucaguccagcuggc

SEQ ID NO: 379178 - RNA, 22 nt, Bordetella pertussis
gcgcccucguugacgccgacga

SEQ ID NO: 379179 - RNA, 13 nt, Bordetella pertussis
gcgcccuggcgcg

SEQ ID NO: 379180 - RNA, 14 nt, Bordetella pertussis
gcgcccuggcgcgg

SEQ ID NO: 379181 - RNA, 16 nt, Bordetella pertussis
gcgcccuggcgcggcg

SEQ ID NO: 379182 - RNA, 18 nt, Bordetella pertussis
gcgcccuggcgcggcggc

SEQ ID NO: 379183 - RNA, 13 nt, Bordetella pertussis
gcgcccuggcgug

SEQ ID NO: 379184 - RNA, 21 nt, Bordetella pertussis
gcgcccuggcguggcgcgcgc

SEQ ID NO: 379185 - RNA, 13 nt, Bordetella pertussis
gcgcccuggggcg

SEQ ID NO: 379186 - RNA, 17 nt, Bordetella pertussis
gcgccgaaauuggcgac

SEQ ID NO: 379187 - RNA, 13 nt, Bordetella pertussis
gcgccgaacacca

SEQ ID NO: 379188 - RNA, 16 nt, Bordetella pertussis
gcgccgaacaccagcu

SEQ ID NO: 379189 - RNA, 19 nt, Bordetella pertussis
gcgccgacgaugccgccca

SEQ ID NO: 379190 - RNA, 16 nt, Bordetella pertussis
gcgccgacgcgcuggc

SEQ ID NO: 379191 - RNA, 20 nt, Bordetella pertussis
gcgccgacggcauggccggc

SEQ ID NO: 379192 - RNA, 15 nt, Bordetella pertussis
gcgccgacggcgccc

SEQ ID NO: 379193 - RNA, 18 nt, Bordetella pertussis
gcgccgacggcggcgcgg

SEQ ID NO: 379194 - RNA, 17 nt, Bordetella pertussis
gcgccgaggugaucugg

SEQ ID NO: 379195 - RNA, 16 nt, Bordetella pertussis
gcgccgacgggccggu

SEQ ID NO: 379196 - RNA, 21 nt, Bordetella pertussis
gcgccgaguuuccgcacccgg

SEQ ID NO: 379197 - RNA, 13 nt, Bordetella pertussis
gcgccgaucacca

SEQ ID NO: 379198 - RNA, 22 nt, Bordetella pertussis
gcgccgaucaccacgggcacga

SEQ ID NO: 379199 - RNA, 15 nt, Bordetella pertussis
gcgccgauccggcgc

SEQ ID NO: 379200 - RNA, 17 nt, Bordetella pertussis
gcgccgauccggcgcag

SEQ ID NO: 379201 - RNA, 17 nt, Bordetella pertussis
gcgccgaucgcggcucc

SEQ ID NO: 379202 - RNA, 20 nt, Bordetella pertussis
gcgccgcaacgccgccggca

SEQ ID NO: 379203 - RNA, 19 nt, Bordetella pertussis
gcgccgcaauagaucaucc

SEQ ID NO: 379204 - RNA, 12 nt, Bordetella pertussis
gcgccgcaccag

SEQ ID NO: 379205 - RNA, 14 nt, Bordetella pertussis
gcgccgcaccagcg

SEQ ID NO: 379206 - RNA, 18 nt, Bordetella pertussis
gcgccgcaccagcgccga

SEQ ID NO: 379207 - RNA, 16 nt, Bordetella pertussis
gcgccgcaccagcggc

SEQ ID NO: 379208 - RNA, 17 nt, Bordetella pertussis
gcgccgcaccagcggcg

SEQ ID NO: 379209 - RNA, 17 nt, Bordetella pertussis
gcgccgcacgucggucg

SEQ ID NO: 379210 - RNA, 15 nt, Bordetella pertussis
gcgccgcacgccggu

SEQ ID NO: 379211 - RNA, 14 nt, Bordetella pertussis
gcgccgcagauggc

SEQ ID NO: 379212 - RNA, 20 nt, Bordetella pertussis
gcgccgccacaggcugacgc

SEQ ID NO: 379213 - RNA, 21 nt, Bordetella pertussis
gcgccgccaccucggcgucgc

SEQ ID NO: 379214 - RNA, 23 nt, Bordetella pertussis
gcgccgccagcauggcggccagg

SEQ ID NO: 379215 - RNA, 16 nt, Bordetella pertussis
gcgccgccagccgcug

SEQ ID NO: 379216 - RNA, 17 nt, Bordetella pertussis
gcgccgccagccgcugg

SEQ ID NO: 379217 - RNA, 23 nt, Bordetella pertussis
gcgccgccagccgcuggcgcgcc

SEQ ID NO: 379218 - RNA, 17 nt, Bordetella pertussis
gcgccgccagcgcgcgc

SEQ ID NO: 379219 - RNA, 16 nt, Bordetella pertussis
gcgccgccaggccguc

SEQ ID NO: 379220 - RNA, 18 nt, Bordetella pertussis
gcgccgccaggccgucga

SEQ ID NO: 379221 - RNA, 13 nt, Bordetella pertussis
gcgccgccaggcg

SEQ ID NO: 379222 - RNA, 14 nt, Bordetella pertussis
gcgccgccaggcgc

SEQ ID NO: 379223 - RNA, 15 nt, Bordetella pertussis
gcgccgccaggcgcg

SEQ ID NO: 379224 - RNA, 18 nt, Bordetella pertussis
gcgccgccaucauggcgu

SEQ ID NO: 379225 - RNA, 12 nt, Bordetella pertussis
gcgccgccaugg

SEQ ID NO: 379226 - RNA, 18 nt, Bordetella pertussis
gcgccgcccgcggccagc

SEQ ID NO: 379227 - RNA, 20 nt, Bordetella pertussis
gcgccgcccgcggccagcca

SEQ ID NO: 379228 - RNA, 22 nt, Bordetella pertussis
gcgccgccgacggcauggcggc

SEQ ID NO: 379229 - RNA, 12 nt, Bordetella pertussis
gcgccgccgcca

SEQ ID NO: 379230 - RNA, 23 nt, Bordetella pertussis
gcgccgccgccauggucgcgacc

SEQ ID NO: 379231 - RNA, 13 nt, Bordetella pertussis
gcgccgccgcccg

SEQ ID NO: 379232 - RNA, 18 nt, Bordetella pertussis
gcgccgccgcccgcacga

SEQ ID NO: 379233 - RNA, 22 nt, Bordetella pertussis
gcgccgccgccgcggccuggcc

SEQ ID NO: 379234 - RNA, 14 nt, Bordetella pertussis
gcgccgccgccggu

SEQ ID NO: 379235 - RNA, 15 nt, Bordetella pertussis
gcgccgccgccuggc

SEQ ID NO: 379236 - RNA, 20 nt, Bordetella pertussis
gcgccgccgcgcccuggcgc

SEQ ID NO: 379237 - RNA, 17 nt, Bordetella pertussis
gcgccgccgcgcgcugg

SEQ ID NO: 379238 - RNA, 20 nt, Bordetella pertussis
gcgccgccgcgcgcuggcug

SEQ ID NO: 379239 - RNA, 22 nt, Bordetella pertussis
gcgccgccgcgcugugcgacga

SEQ ID NO: 379240 - RNA, 13 nt, Bordetella pertussis
gcgccggaucgca

SEQ ID NO: 379241 - RNA, 15 nt, Bordetella pertussis
gcgccggaucggccg

SEQ ID NO: 379242 - RNA, 17 nt, Bordetella pertussis
gcgccggaucggccggc

SEQ ID NO: 379243 - RNA, 18 nt, Bordetella pertussis
gcgccggaucggccggca

SEQ ID NO: 379244 - RNA, 15 nt, Bordetella pertussis
gcgccggcacgacga

SEQ ID NO: 379245 - RNA, 13 nt, Bordetella pertussis
gcgccggcacgcu

SEQ ID NO: 379246 - RNA, 18 nt, Bordetella pertussis
gcgccggcacgcugaucg

SEQ ID NO: 379247 - RNA, 14 nt, Bordetella pertussis
gcgccggcaggcgc

SEQ ID NO: 379248 - RNA, 19 nt, Bordetella pertussis
gcgccggcaggcgcgccag

SEQ ID NO: 379249 - RNA, 19 nt, Bordetella pertussis
gcgccggcagggcggccag

SEQ ID NO: 379250 - RNA, 20 nt, Bordetella pertussis
gcgccggcagggcggccagg

SEQ ID NO: 379251 - RNA, 15 nt, Bordetella pertussis
gcgccggcagggugc

SEQ ID NO: 379252 - RNA, 16 nt, Bordetella pertussis
gcgccggcagccccag

SEQ ID NO: 379253 - RNA, 15 nt, Bordetella pertussis
gcgccggcaucggcg

SEQ ID NO: 379254 - RNA, 18 nt, Bordetella pertussis
gcgccggcaucggcggcu

SEQ ID NO: 379255 - RNA, 20 nt, Bordetella pertussis
gcgccggcaugaagcgcagc

SEQ ID NO: 379256 - RNA, 22 nt, Bordetella pertussis
gcgccggcauggccaaugccau

SEQ ID NO: 379257 - RNA, 13 nt, Bordetella pertussis
gcgccggcauggu

SEQ ID NO: 379258 - RNA, 21 nt, Bordetella pertussis
gcgccggcauuucgcugggcg

SEQ ID NO: 379259 - RNA, 22 nt, Bordetella pertussis
gcgccggcauuucgcugggcgc

SEQ ID NO: 379260 - RNA, 12 nt, Bordetella pertussis
gcgccggccacc

SEQ ID NO: 379261 - RNA, 16 nt, Bordetella pertussis
gcgccggccaccgccu

SEQ ID NO: 379262 - RNA, 17 nt, Bordetella pertussis
gcgccggccaccgccug

SEQ ID NO: 379263 - RNA, 13 nt, Bordetella pertussis
gcgccggccagcg

SEQ ID NO: 379264 - RNA, 14 nt, Bordetella pertussis
gcgccggccagcgc

SEQ ID NO: 379265 - RNA, 15 nt, Bordetella pertussis
gcgccggccagcgcg

SEQ ID NO: 379266 - RNA, 16 nt, Bordetella pertussis
gcgccggccagcggca

SEQ ID NO: 379267 - RNA, 13 nt, Bordetella pertussis
gcgccggccagga

SEQ ID NO: 379268 - RNA, 14 nt, Bordetella pertussis
gcgccggcccaggc

SEQ ID NO: 379269 - RNA, 15 nt, Bordetella pertussis
gcgccggcccaggcg

SEQ ID NO: 379270 - RNA, 12 nt, Bordetella pertussis
gcgccggcccgg

SEQ ID NO: 379271 - RNA, 13 nt, Bordetella pertussis
gcgccggcccggc

SEQ ID NO: 379272 - RNA, 17 nt, Bordetella pertussis
gcgccggccgacaggug

SEQ ID NO: 379273 - RNA, 14 nt, Bordetella pertussis
gcgccggccgacgg

SEQ ID NO: 379274 - RNA, 19 nt, Bordetella pertussis
gcgccggccgacggcgcug

SEQ ID NO: 379275 - RNA, 12 nt, Bordetella pertussis
gcgccggccagg

SEQ ID NO: 379276 - RNA, 14 nt, Bordetella pertussis
gcgccggccgccag

SEQ ID NO: 379277 - RNA, 16 nt, Bordetella pertussis
gcgccggccgccagca

SEQ ID NO: 379278 - RNA, 21 nt, Bordetella pertussis
gcgccggccgcccgccugccg

SEQ ID NO: 379279 - RNA, 12 nt, Bordetella pertussis
gcgccggccgcg

SEQ ID NO: 379280 - RNA, 14 nt, Bordetella pertussis
gcgccggccgcgcg

SEQ ID NO: 379281 - RNA, 19 nt, Bordetella pertussis
gcgccggccgcgcgcgcca

SEQ ID NO: 379282 - RNA, 19 nt, Bordetella pertussis
gcgccggccuccagcaucg

SEQ ID NO: 379283 - RNA, 22 nt, Bordetella pertussis
gcgccggccuccagcaucgccg

SEQ ID NO: 379284 - RNA, 16 nt, Bordetella pertussis
gcgccggccugcgccg

SEQ ID NO: 379285 - RNA, 14 nt, Bordetella pertussis
gcgccggccuggcg

SEQ ID NO: 379286 - RNA, 13 nt, Bordetella pertussis
gcgccggccuggg

SEQ ID NO: 379287 - RNA, 14 nt, Bordetella pertussis
gcgccggccugggc

SEQ ID NO: 379288 - RNA, 15 nt, Bordetella pertussis
gcgccggccugggcg

SEQ ID NO: 379289 - RNA, 13 nt, Bordetella pertussis
gcgccggccuugc

SEQ ID NO: 379290 - RNA, 14 nt, Bordetella pertussis
gcgccggccuugcc

SEQ ID NO: 379291 - RNA, 14 nt, Bordetella pertussis
gcgccggcgcccgg

SEQ ID NO: 379292 - RNA, 12 nt, Bordetella pertussis
gcgccggcgccg

SEQ ID NO: 379293 - RNA, 15 nt, Bordetella pertussis
gcgccggcgccggcg

SEQ ID NO: 379294 - RNA, 16 nt, Bordetella pertussis
gcgccggcgccgggca

SEQ ID NO: 379295 - RNA, 14 nt, Bordetella pertussis
gcgccggcgccguu

SEQ ID NO: 379296 - RNA, 18 nt, Bordetella pertussis
gcgccggcgcgccgcccg

SEQ ID NO: 379297 - RNA, 15 nt, Bordetella pertussis
gcgccggcgcgcgcu

SEQ ID NO: 379298 - RNA, 20 nt, Bordetella pertussis
gcgccggcgcgcgcugauuc

SEQ ID NO: 379299 - RNA, 14 nt, Bordetella pertussis
gcgccggcgcggcg

SEQ ID NO: 379300 - RNA, 17 nt, Bordetella pertussis
gcgccggcgcggcgguc

SEQ ID NO: 379301 - RNA, 18 nt, Bordetella pertussis
gcgccggcgcggcggucc

SEQ ID NO: 379302 - RNA, 14 nt, Bordetella pertussis
gcgccggcgcgucc

SEQ ID NO: 379303 - RNA, 22 nt, Bordetella pertussis
gcgccggcggcaagguagccga

SEQ ID NO: 379304 - RNA, 13 nt, Bordetella pertussis
gcgccggcggcac

SEQ ID NO: 379305 - RNA, 23 nt, Bordetella pertussis
gcgccggcggcaccgcgcagccc

SEQ ID NO: 379306 - RNA, 16 nt, Bordetella pertussis
gcgccggcggccugca

SEQ ID NO: 379307 - RNA, 17 nt, Bordetella pertussis
gcgccggcggccugcag

SEQ ID NO: 379308 - RNA, 13 nt, Bordetella pertussis
gcgccggcggcga

SEQ ID NO: 379309 - RNA, 15 nt, Bordetella pertussis
gcgccggcggcgaug

SEQ ID NO: 379310 - RNA, 22 nt, Bordetella pertussis
gcgccggcggcgaugcgggcca

SEQ ID NO: 379311 - RNA, 15 nt, Bordetella pertussis
gcgccggcggcgguc

SEQ ID NO: 379312 - RNA, 17 nt, Bordetella pertussis
gcgccggcggcggucag

SEQ ID NO: 379313 - RNA, 13 nt, Bordetella pertussis
gcgccggcggccu

SEQ ID NO: 379314 - RNA, 13 nt, Bordetella pertussis
gcgccggcgucca

SEQ ID NO: 379315 - RNA, 14 nt, Bordetella pertussis
gcgccggcguccac

SEQ ID NO: 379316 - RNA, 20 nt, Bordetella pertussis
gcgccggcucccgcgcugcc

SEQ ID NO: 379317 - RNA, 22 nt, Bordetella pertussis
gcgccggcucgaacaggcuggc

SEQ ID NO: 379318 - RNA, 22 nt, Bordetella pertussis
gcgccggcugaauuggcgccca

SEQ ID NO: 379319 - RNA, 14 nt, Bordetella pertussis
gcgccggcuugcgc

SEQ ID NO: 379320 - RNA, 20 nt, Bordetella pertussis
gcgccggcuugcgccagcca

SEQ ID NO: 379321 - RNA, 16 nt, Bordetella pertussis
gcgccgggcagcccgc

SEQ ID NO: 379322 - RNA, 17 nt, Bordetella pertussis
gcgccgggcagcccgcg

SEQ ID NO: 379323 - RNA, 18 nt, Bordetella pertussis
gcgccgggcagcccgcgc

SEQ ID NO: 379324 - RNA, 12 nt, Bordetella pertussis
gcgccggcuggg

SEQ ID NO: 379325 - RNA, 22 nt, Bordetella pertussis
gcgccgggcccggccacggccg

SEQ ID NO: 379326 - RNA, 13 nt, Bordetella pertussis
gcgccgggccgcu

SEQ ID NO: 379327 - RNA, 13 nt, Bordetella pertussis
gcgccgggccggc

SEQ ID NO: 379328 - RNA, 14 nt, Bordetella pertussis
gcgccgggccuagc

SEQ ID NO: 379329 - RNA, 20 nt, Bordetella pertussis
gcgccgggccuagcccggcg

SEQ ID NO: 379330 - RNA, 23 nt, Bordetella pertussis
gcgccgggccuagcccggcgcca

SEQ ID NO: 379331 - RNA, 18 nt, Bordetella pertussis
gcgccgggcgaaccggug

SEQ ID NO: 379332 - RNA, 14 nt, Bordetella pertussis
gcgccgggcgccgc

SEQ ID NO: 379333 - RNA, 15 nt, Bordetella pertussis
gcgccgggcgccgcg

SEQ ID NO: 379334 - RNA, 14 nt, Bordetella pertussis
gcgccgggcgcgcc

SEQ ID NO: 379335 - RNA, 15 nt, Bordetella pertussis
gcgccgggcgcggcc

SEQ ID NO: 379336 - RNA, 18 nt, Bordetella pertussis
gcgccgggcgggucggcg

SEQ ID NO: 379337 - RNA, 21 nt, Bordetella pertussis
gcgccgggcgggucggcgaac

SEQ ID NO: 379338 - RNA, 19 nt, Bordetella pertussis
gcgccgggcuggugcgccg

SEQ ID NO: 379339 - RNA, 14 nt, Bordetella pertussis
gcgccggggcgccg

SEQ ID NO: 379340 - RNA, 16 nt, Bordetella pertussis
gcgccggggcgccggu

SEQ ID NO: 379341 - RNA, 17 nt, Bordetella pertussis
gcgccggggcgccggug

SEQ ID NO: 379342 - RNA, 21 nt, Bordetella pertussis
gcgccggggcggcggcgcccg

SEQ ID NO: 379343 - RNA, 16 nt, Bordetella pertussis
gcgccggggcggcucg

SEQ ID NO: 379344 - RNA, 18 nt, Bordetella pertussis
gcgccggggcggcucggc

SEQ ID NO: 379345 - RNA, 14 nt, Bordetella pertussis
gcgccggggcgugg

SEQ ID NO: 379346 - RNA, 18 nt, Bordetella pertussis
gcgccggggcguggccgc

SEQ ID NO: 379347 - RNA, 18 nt, Bordetella pertussis
gcgccggggggcgcacgc

SEQ ID NO: 379348 - RNA, 20 nt, Bordetella pertussis
gcgccggggggcgcacgccg

SEQ ID NO: 379349 - RNA, 22 nt, Bordetella pertussis
gcgccggggggcgcacgccgcg

SEQ ID NO: 379350 - RNA, 23 nt, Bordetella pertussis
gcgccggggggcgcacgccgcgc

SEQ ID NO: 379351 - RNA, 15 nt, Bordetella pertussis
gcgccggggucagcg

SEQ ID NO: 379352 - RNA, 20 nt, Bordetella pertussis
gcgccggggucagcgccggc

SEQ ID NO: 379353 - RNA, 16 nt, Bordetella pertussis
gcgccggguccggccg

SEQ ID NO: 379354 - RNA, 20 nt, Bordetella pertussis
gcgccggguccggccgcgca

SEQ ID NO: 379355 - RNA, 21 nt, Bordetella pertussis
gcgccggguggguucgggcgu

SEQ ID NO: 379356 - RNA, 22 nt, Bordetella pertussis
gcgccggucacgcugguggcca

SEQ ID NO: 379357 - RNA, 14 nt, Bordetella pertussis
gcgccgguccagcg

SEQ ID NO: 379358 - RNA, 16 nt, Bordetella pertussis
gcgccgguccagcgcc

SEQ ID NO: 379359 - RNA, 18 nt, Bordetella pertussis
gcgccgguccagcgcccg

SEQ ID NO: 379360 - RNA, 15 nt, Bordetella pertussis
gcgccgguccgacgg

SEQ ID NO: 379361 - RNA, 14 nt, Bordetella pertussis
gcgccggucgccgc

SEQ ID NO: 379362 - RNA, 17 nt, Bordetella pertussis
gcgccggucguggucga

SEQ ID NO: 379363 - RNA, 15 nt, Bordetella pertussis
gcgccggugaccgcc

SEQ ID NO: 379364 - RNA, 17 nt, Bordetella pertussis
gcgccggugaccgccag

SEQ ID NO: 379365 - RNA, 22 nt, Bordetella pertussis
gcgccggugcaggucaucgcgc

SEQ ID NO: 379366 - RNA, 13 nt, Bordetella pertussis
gcgccgguggcca

SEQ ID NO: 379367 - RNA, 16 nt, Bordetella pertussis
gcgccgguggccagca

SEQ ID NO: 379368 - RNA, 19 nt, Bordetella pertussis
gcgccgguggccagcagcu

SEQ ID NO: 379369 - RNA, 20 nt, Bordetella pertussis
gcgccgguggccagcagcug

SEQ ID NO: 379370 - RNA, 15 nt, Bordetella pertussis
gcgccggugucggcc

SEQ ID NO: 379371 - RNA, 17 nt, Bordetella pertussis
gcgccggugucggccca

SEQ ID NO: 379372 - RNA, 15 nt, Bordetella pertussis
gcgccguacagccgc

SEQ ID NO: 379373 - RNA, 16 nt, Bordetella pertussis
gcgccguacagccgcg

SEQ ID NO: 379374 - RNA, 14 nt, Bordetella pertussis
gcgccguaccagcg

SEQ ID NO: 379375 - RNA, 16 nt, Bordetella pertussis
gcgccguaccagcgcg

SEQ ID NO: 379376 - RNA, 17 nt, Bordetella pertussis
gcgccguaccagcgcga

SEQ ID NO: 379377 - RNA, 21 nt, Bordetella pertussis
gcgccguaccagcgcgaacgc

SEQ ID NO: 379378 - RNA, 22 nt, Bordetella pertussis
gcgccguaccagcgcgaacgcc

SEQ ID NO: 379379 - RNA, 13 nt, Bordetella pertussis
gcgccguaccugc

SEQ ID NO: 379380 - RNA, 13 nt, Bordetella pertussis
gcgccgucagcag

SEQ ID NO: 379381 - RNA, 15 nt, Bordetella pertussis
gcgccgucagcagcg

SEQ ID NO: 379382 - RNA, 16 nt, Bordetella pertussis
gcgccgucagcagcgc

SEQ ID NO: 379383 - RNA, 23 nt, Bordetella pertussis
gcgccgucagcagcgcggcgccg

SEQ ID NO: 379384 - RNA, 22 nt, Bordetella pertussis
gcgccguccgcaucgcgcaagg

SEQ ID NO: 379385 - RNA, 23 nt, Bordetella pertussis
gcgccguccgugagugcagcgcu

SEQ ID NO: 379386 - RNA, 15 nt, Bordetella pertussis
gcgccgucgaagccg

SEQ ID NO: 379387 - RNA, 16 nt, Bordetella pertussis
gcgccgucgaagccgg

SEQ ID NO: 379388 - RNA, 24 nt, Bordetella pertussis
gcgccgucgaucccaucgcgcguc

SEQ ID NO: 379389 - RNA, 16 nt, Bordetella pertussis
gcgccgucgcuggggc

SEQ ID NO: 379390 - RNA, 18 nt, Bordetella pertussis
gcgccgucugcgccgccg

SEQ ID NO: 379391 - RNA, 15 nt, Bordetella pertussis
gcgccgucugugcgc

SEQ ID NO: 379392 - RNA, 19 nt, Bordetella pertussis
gcgccgucugugcgccccg

SEQ ID NO: 379393 - RNA, 22 nt, Bordetella pertussis
gcgccgucugugcgccccgcug

SEQ ID NO: 379394 - RNA, 17 nt, Bordetella pertussis
gcgccgucuucgguggc

SEQ ID NO: 379395 - RNA, 23 nt, Bordetella pertussis
gcgccgucuucgguggcccgcca

SEQ ID NO: 379396 - RNA, 21 nt, Bordetella pertussis
gcgccgugaaugcgccuggcg

SEQ ID NO: 379397 - RNA, 22 nt, Bordetella pertussis
gcgccgugaaugcgccuggcgu

SEQ ID NO: 379398 - RNA, 19 nt, Bordetella pertussis
gcgccgugcagacggcggc

SEQ ID NO: 379399 - RNA, 20 nt, Bordetella pertussis
gcgccgugcagacggcggcu

SEQ ID NO: 379400 - RNA, 23 nt, Bordetella pertussis
gcgccgugcagacggcggcugga

SEQ ID NO: 379401 - RNA, 22 nt, Bordetella pertussis
gcgccgugcccgacggacuggc

SEQ ID NO: 379402 - RNA, 14 nt, Bordetella pertussis
gcgccgugcuggag

SEQ ID NO: 379403 - RNA, 19 nt, Bordetella pertussis
gcgccugacccagucgcag

SEQ ID NO: 379404 - RNA, 16 nt, Bordetella pertussis
gcgccugagcugccag

SEQ ID NO: 379405 - RNA, 19 nt, Bordetella pertussis
gcgccugagcugccaggcu

SEQ ID NO: 379406 - RNA, 18 nt, Bordetella pertussis
gcgccugcaagauggcgu

SEQ ID NO: 379407 - RNA, 22 nt, Bordetella pertussis
gcgccugcaaguccagcguggu

SEQ ID NO: 379408 - RNA, 19 nt, Bordetella pertussis
gcgccugcauccggcccag

SEQ ID NO: 379409 - RNA, 14 nt, Bordetella pertussis
gcgccugcaugcca

SEQ ID NO: 379410 - RNA, 18 nt, Bordetella pertussis
gcgccugcauguccagcg

SEQ ID NO: 379411 - RNA, 20 nt, Bordetella pertussis
gcgccugcauguccagcggc

SEQ ID NO: 379412 - RNA, 16 nt, Bordetella pertussis
gcgccugcccaggcca

SEQ ID NO: 379413 - RNA, 13 nt, Bordetella pertussis
gcgccugccccgc

SEQ ID NO: 379414 - RNA, 19 nt, Bordetella pertussis
gcgccugccccgccugcgc

SEQ ID NO: 379415 - RNA, 14 nt, Bordetella pertussis
gcgccugccccggc

SEQ ID NO: 379416 - RNA, 16 nt, Bordetella pertussis
gcgccugccccggcag

SEQ ID NO: 379417 - RNA, 17 nt, Bordetella pertussis
gcgccugccccggcaga

SEQ ID NO: 379418 - RNA, 13 nt, Bordetella pertussis
gcgccugcccgca

SEQ ID NO: 379419 - RNA, 20 nt, Bordetella pertussis
gcgccugcccgcaacgccgc

SEQ ID NO: 379420 - RNA, 23 nt, Bordetella pertussis
gcgccugcccgcaacgccgcccg

SEQ ID NO: 379421 - RNA, 23 nt, Bordetella pertussis
gcgccugccgaucgugcacgccc

SEQ ID NO: 379422 - RNA, 17 nt, Bordetella pertussis
gcgccugccgcgugccc

SEQ ID NO: 379423 - RNA, 23 nt, Bordetella pertussis
gcgccugccgcgugcccgcgucc

SEQ ID NO: 379424 - RNA, 18 nt, Bordetella pertussis
gcgccugcagcacggcca

SEQ ID NO: 379425 - RNA, 15 nt, Bordetella pertussis
gcgccugcagcagcg

SEQ ID NO: 379426 - RNA, 17 nt, Bordetella pertussis
gcgccugcagcagcggc

SEQ ID NO: 379427 - RNA, 16 nt, Bordetella pertussis
gcgccugcagcagcgu

SEQ ID NO: 379428 - RNA, 14 nt, Bordetella pertussis
gcgccugcagcgcc

SEQ ID NO: 379429 - RNA, 18 nt, Bordetella pertussis
gcgccugcagcgccgccu

SEQ ID NO: 379430 - RNA, 13 nt, Bordetella pertussis
gcgccugcagcgu

SEQ ID NO: 379431 - RNA, 14 nt, Bordetella pertussis
gcgccugcgccaug

SEQ ID NO: 379432 - RNA, 23 nt, Bordetella pertussis
gcgccugcgccauguggcgacgc

SEQ ID NO: 379433 - RNA, 16 nt, Bordetella pertussis
gcgccugcgcgccgcc

SEQ ID NO: 379434 - RNA, 14 nt, Bordetella pertussis
gcgccugcgcgcgc

SEQ ID NO: 379435 - RNA, 15 nt, Bordetella pertussis
gcgccugcgcgcggu

SEQ ID NO: 379436 - RNA, 14 nt, Bordetella pertussis
gcgccugcgcggcg

SEQ ID NO: 379437 - RNA, 22 nt, Bordetella pertussis
gcgccugcgagagauagcccag

SEQ ID NO: 379438 - RNA, 21 nt, Bordetella pertussis
gcgccugcgccaccuggcgcc

SEQ ID NO: 379439 - RNA, 18 nt, Bordetella pertussis
gcgccugcggcaggccgc

SEQ ID NO: 379440 - RNA, 19 nt, Bordetella pertussis
gcgccugcggcaggccgca

SEQ ID NO: 379441 - RNA, 17 nt, Bordetella pertussis
gcgccugcggggccgcu

SEQ ID NO: 379442 - RNA, 21 nt, Bordetella pertussis
gcgccugcguugcgaucagcg

SEQ ID NO: 379443 - RNA, 18 nt, Bordetella pertussis
gcgccugcucacgccccg

SEQ ID NO: 379444 - RNA, 17 nt, Bordetella pertussis
gcgccugcuggucggcc

SEQ ID NO: 379445 - RNA, 20 nt, Bordetella pertussis
gcgccugcuggucggccucg

SEQ ID NO: 379446 - RNA, 21 nt, Bordetella pertussis
gcgccugcuggucggcguggu

SEQ ID NO: 379447 - RNA, 22 nt, Bordetella pertussis
gcgccuggaccuggacgagggc

SEQ ID NO: 379448 - RNA, 13 nt, Bordetella pertussis
gcgccuggcccag

SEQ ID NO: 379449 - RNA, 15 nt, Bordetella pertussis
gcgccuggccgccca

SEQ ID NO: 379450 - RNA, 21 nt, Bordetella pertussis
gcgccuggcgcaugacggcgu

SEQ ID NO: 379451 - RNA, 23 nt, Bordetella pertussis
gcgccuggcgcaugacggcgucg

SEQ ID NO: 379452 - RNA, 13 nt, Bordetella pertussis
gcgccuggcggac

SEQ ID NO: 379453 - RNA, 15 nt, Bordetella pertussis
gcgccuggcggcugg

SEQ ID NO: 379454 - RNA, 19 nt, Bordetella pertussis
gcgccuggcgggccugggc

SEQ ID NO: 379455 - RNA, 23 nt, Bordetella pertussis
gcgccuggcgggccugggcgucg

SEQ ID NO: 379456 - RNA, 12 nt, Bordetella pertussis
gcgccuggcgca

SEQ ID NO: 379457 - RNA, 21 nt, Bordetella pertussis
gcgccuggcuucccgguccag

SEQ ID NO: 379458 - RNA, 13 nt, Bordetella pertussis
gcgccugggccuu

SEQ ID NO: 379459 - RNA, 14 nt, Bordetella pertussis
gcgccugggccuuc

SEQ ID NO: 379460 - RNA, 14 nt, Bordetella pertussis
gcgccugggcggcc

SEQ ID NO: 379461 - RNA, 15 nt, Bordetella pertussis
gcgccugggcggcca

SEQ ID NO: 379462 - RNA, 16 nt, Bordetella pertussis
gcgccugggcggccac

SEQ ID NO: 379463 - RNA, 18 nt, Bordetella pertussis
gcgccugggcggccacgu

SEQ ID NO: 379464 - RNA, 15 nt, Bordetella pertussis
gcgccugggcggcgc

SEQ ID NO: 379465 - RNA, 22 nt, Bordetella pertussis
gcgccugggcggcgcagucgcg

SEQ ID NO: 379466 - RNA, 23 nt, Bordetella pertussis
gcgccugggcggcgcagucgcgc

SEQ ID NO: 379467 - RNA, 15 nt, Bordetella pertussis
gcgccuuucccgcgc

SEQ ID NO: 379468 - RNA, 17 nt, Bordetella pertussis
gcgccuuucccgcgccg

SEQ ID NO: 379469 - RNA, 15 nt, Bordetella pertussis
gcgcgaaacggccgg

SEQ ID NO: 379470 - RNA, 19 nt, Bordetella pertussis
gcgcgaaacggccgggucc

SEQ ID NO: 379471 - RNA, 14 nt, Bordetella pertussis
gcgcgaaauccagc

SEQ ID NO: 379472 - RNA, 16 nt, Bordetella pertussis
gcgcgaaauccagcgc

SEQ ID NO: 379473 - RNA, 17 nt, Bordetella pertussis
gcgcgaaauccagcgcg

SEQ ID NO: 379474 - RNA, 19 nt, Bordetella pertussis
gcgcgaaaugcccagcgag

SEQ ID NO: 379475 - RNA, 21 nt, Bordetella pertussis
gcgcgaaaugcccagcgagcu

SEQ ID NO: 379476 - RNA, 22 nt, Bordetella pertussis
gcgcgaaaugguguacagccgc

SEQ ID NO: 379477 - RNA, 14 nt, Bordetella pertussis
gcgcgaacaccggc

SEQ ID NO: 379478 - RNA, 17 nt, Bordetella pertussis
gcgcgaacaccggcagg

SEQ ID NO: 379479 - RNA, 20 nt, Bordetella pertussis
gcgcgaacaccggcaggccg

SEQ ID NO: 379480 - RNA, 21 nt, Bordetella pertussis
gcgcgaacaccggcaggccgc

SEQ ID NO: 379481 - RNA, 14 nt, Bordetella pertussis
gcgcgaaccccucc

SEQ ID NO: 379482 - RNA, 22 nt, Bordetella pertussis
gcgcgaaccccuccggcguugc

SEQ ID NO: 379483 - RNA, 17 nt, Bordetella pertussis
gcgcgaacgccugccag

SEQ ID NO: 379484 - RNA, 18 nt, Bordetella pertussis
gcgcgaacgcgcgccggc

SEQ ID NO: 379485 - RNA, 19 nt, Bordetella pertussis
gcgcgaacgcgcgccggcc

SEQ ID NO: 379486 - RNA, 17 nt, Bordetella pertussis
gcgcgaacgcggccaug

SEQ ID NO: 379487 - RNA, 19 nt, Bordetella pertussis
gcgcgaacgcggccaugcg

SEQ ID NO: 379488 - RNA, 13 nt, Bordetella pertussis
gcgcgaacggcag

SEQ ID NO: 379489 - RNA, 16 nt, Bordetella pertussis
gcgcgaacggcaggug

SEQ ID NO: 379490 - RNA, 18 nt, Bordetella pertussis
gcgcgaagcgcccuggcg

SEQ ID NO: 379491 - RNA, 14 nt, Bordetella pertussis
gcgcgaaggccgcc

SEQ ID NO: 379492 - RNA, 14 nt, Bordetella pertussis
gcgcgacagcacca

SEQ ID NO: 379493 - RNA, 13 nt, Bordetella pertussis
gcgcgacagcagg

SEQ ID NO: 379494 - RNA, 15 nt, Bordetella pertussis
gcgcgacagcaggcc

SEQ ID NO: 379495 - RNA, 14 nt, Bordetella pertussis
gcgcgacagccgcg

SEQ ID NO: 379496 - RNA, 20 nt, Bordetella pertussis
gcgcgacagccgcgccagcg

SEQ ID NO: 379497 - RNA, 21 nt, Bordetella pertussis
gcgcgacaggcggugcgcgcg

SEQ ID NO: 379498 - RNA, 14 nt, Bordetella pertussis
gcgcgaggcggcga

SEQ ID NO: 379499 - RNA, 16 nt, Bordetella pertussis
gcgcgaggcggcgacg

SEQ ID NO: 379500 - RNA, 17 nt, Bordetella pertussis
gcgcgaggcggcggccg

SEQ ID NO: 379501 - RNA, 18 nt, Bordetella pertussis
gcgcgaggcggcggccgg

SEQ ID NO: 379502 - RNA, 16 nt, Bordetella pertussis
gcgcgagggcaucagc

SEQ ID NO: 379503 - RNA, 13 nt, Bordetella pertussis
gcgcgagggugcc

SEQ ID NO: 379504 - RNA, 19 nt, Bordetella pertussis
gcgcgagguggcgcucgcg

SEQ ID NO: 379505 - RNA, 17 nt, Bordetella pertussis
gcgcgaggugggcggca

SEQ ID NO: 379506 - RNA, 22 nt, Bordetella pertussis
gcgcgaguaucccuaccgccuu

SEQ ID NO: 379507 - RNA, 20 nt, Bordetella pertussis
gcgcgauagauggccaggug

SEQ ID NO: 379508 - RNA, 14 nt, Bordetella pertussis
gcgcgaggugccgg

SEQ ID NO: 379509 - RNA, 19 nt, Bordetella pertussis
gcgcgaucaggcggugccc

SEQ ID NO: 379510 - RNA, 15 nt, Bordetella pertussis
gcgcgauccgcgcca

SEQ ID NO: 379511 - RNA, 17 nt, Bordetella pertussis
gcgcgauccgcgccagg

SEQ ID NO: 379512 - RNA, 19 nt, Bordetella pertussis
gcgcgauccgcgccaggcg

SEQ ID NO: 379513 - RNA, 15 nt, Bordetella pertussis
gcgcgauccuggggc

SEQ ID NO: 379514 - RNA, 20 nt, Bordetella pertussis
gcgcgauccuucgcggccgu

SEQ ID NO: 379515 - RNA, 17 nt, Bordetella pertussis
gcgcgaucucgcgcagg

SEQ ID NO: 379516 - RNA, 21 nt, Bordetella pertussis
gcgcgaucucgcgcagggugg

SEQ ID NO: 379517 - RNA, 17 nt, Bordetella pertussis
gcgcgaucucgggcagg

SEQ ID NO: 379518 - RNA, 16 nt, Bordetella pertussis
gcgcgaucuugccgca

SEQ ID NO: 379519 - RNA, 17 nt, Bordetella pertussis
gcgcgaugagcuggcgc

SEQ ID NO: 379520 - RNA, 18 nt, Bordetella pertussis
gcgcgaugagcuggcgca

SEQ ID NO: 379521 - RNA, 19 nt, Bordetella pertussis
gcgcgaugagcuggcgcag

SEQ ID NO: 379522 - RNA, 20 nt, Bordetella pertussis
gcgcgaugagcuggcgcagg

SEQ ID NO: 379523 - RNA, 14 nt, Bordetella pertussis
gcgcgaugcgcagg

SEQ ID NO: 379524 - RNA, 18 nt, Bordetella pertussis
gcgcgaugcgcaggcugu

SEQ ID NO: 379525 - RNA, 12 nt, Bordetella pertussis
gcgcgaugcgcg

SEQ ID NO: 379526 - RNA, 14 nt, Bordetella pertussis
gcgcgaugcgcgcg

SEQ ID NO: 379527 - RNA, 17 nt, Bordetella pertussis
gcgcgaugcgcgcgcgg

SEQ ID NO: 379528 - RNA, 13 nt, Bordetella pertussis
gcgcgaugcgcgg

SEQ ID NO: 379529 - RNA, 20 nt, Bordetella pertussis
gcgcgaugggccugcccaug

SEQ ID NO: 379530 - RNA, 18 nt, Bordetella pertussis
gcgcgauggucaccaccc

SEQ ID NO: 379531 - RNA, 19 nt, Bordetella pertussis
gcgcgauggucaccacccg

SEQ ID NO: 379532 - RNA, 16 nt, Bordetella pertussis
gcgcgaugucgcccau

SEQ ID NO: 379533 - RNA, 17 nt, Bordetella pertussis
gcgcgaugucgcccaug

SEQ ID NO: 379534 - RNA, 18 nt, Bordetella pertussis
gcgcgauguucaggccgg

SEQ ID NO: 379535 - RNA, 18 nt, Bordetella pertussis
gcgcgauguucggaugcg

SEQ ID NO: 379536 - RNA, 16 nt, Bordetella pertussis
gcgcgauucccuggcg

SEQ ID NO: 379537 - RNA, 21 nt, Bordetella pertussis
gcgcgauucccuggcgcgcca

SEQ ID NO: 379538 - RNA, 21 nt, Bordetella pertussis
gcgcgcaaaccgacgcggcca

SEQ ID NO: 379539 - RNA, 22 nt, Bordetella pertussis
gcgcgcaaaccgacgcggccag

SEQ ID NO: 379540 - RNA, 23 nt, Bordetella pertussis
gcgcgcaaaccgacgcggccagc

SEQ ID NO: 379541 - RNA, 16 nt, Bordetella pertussis
gcgcgcaacacgcgcg

SEQ ID NO: 379542 - RNA, 20 nt, Bordetella pertussis
gcgcgauugcaucuccagga

SEQ ID NO: 379543 - RNA, 23 nt, Bordetella pertussis
gcgcgcaacccacggcguggcgc

SEQ ID NO: 379544 - RNA, 13 nt, Bordetella pertussis
gcgcgcagacgcg

SEQ ID NO: 379545 - RNA, 13 nt, Bordetella pertussis
gcgcgcagcacgc

SEQ ID NO: 379546 - RNA, 16 nt, Bordetella pertussis
gcgcgcagcacgccga

SEQ ID NO: 379547 - RNA, 13 nt, Bordetella pertussis
gcgcgcagcagcg

SEQ ID NO: 379548 - RNA, 18 nt, Bordetella pertussis
gcgcgcagcagcgcaacg

SEQ ID NO: 379549 - RNA, 15 nt, Bordetella pertussis
gcgcgcagcaggccc

SEQ ID NO: 379550 - RNA, 22 nt, Bordetella pertussis
gcgcgcagcaggcccaugccgc

SEQ ID NO: 379551 - RNA, 23 nt, Bordetella pertussis
gcgcgcagcaggcccaugccgcg

SEQ ID NO: 379552 - RNA, 15 nt, Bordetella pertussis
gcgcgcagccaggua

SEQ ID NO: 379553 - RNA, 13 nt, Bordetella pertussis
gcgcgcagccgcg

SEQ ID NO: 379554 - RNA, 16 nt, Bordetella pertussis
gcgcgcagcgaggccu

SEQ ID NO: 379555 - RNA, 13 nt, Bordetella pertussis
gcgcgcagcgcga

SEQ ID NO: 379556 - RNA, 18 nt, Bordetella pertussis
gcgcgcaggcaguuggcg

SEQ ID NO: 379557 - RNA, 18 nt, Bordetella pertussis
gcgcgcaggacaaggcgc

SEQ ID NO: 379558 - RNA, 15 nt, Bordetella pertussis
gcgcgccaccgccag

SEQ ID NO: 379559 - RNA, 18 nt, Bordetella pertussis
gcgcgccagcacgguggc

SEQ ID NO: 379560 - RNA, 14 nt, Bordetella pertussis
gcgcgccagcagcg

SEQ ID NO: 379561 - RNA, 16 nt, Bordetella pertussis
gcgcgccagcaugacg

SEQ ID NO: 379562 - RNA, 16 nt, Bordetella pertussis
gcgcgccagcccgccg

SEQ ID NO: 379563 - RNA, 12 nt, Bordetella pertussis
gcgcgccagccg

SEQ ID NO: 379564 - RNA, 20 nt, Bordetella pertussis
gcgcgccagccgcugcagcg

SEQ ID NO: 379565 - RNA, 11 nt, Bordetella pertussis
gcgcgccagcg

SEQ ID NO: 379566 - RNA, 13 nt, Bordetella pertussis
gcgcgccacggcg

SEQ ID NO: 379567 - RNA, 14 nt, Bordetella pertussis
gcgcgccacggcgu

SEQ ID NO: 379568 - RNA, 14 nt, Bordetella pertussis
gcgcgccacgucga

SEQ ID NO: 379569 - RNA, 16 nt, Bordetella pertussis
gcgcgccacuaugugg

SEQ ID NO: 379570 - RNA, 12 nt, Bordetella pertussis
gcgcgccagcac

SEQ ID NO: 379571 - RNA, 12 nt, Bordetella pertussis
gcgcgccagcgc

SEQ ID NO: 379572 - RNA, 13 nt, Bordetella pertussis
gcgcgccagcgcg

SEQ ID NO: 379573 - RNA, 14 nt, Bordetella pertussis
gcgcgccagcgcgc

SEQ ID NO: 379574 - RNA, 17 nt, Bordetella pertussis
gcgcgccagcgcggcca

SEQ ID NO: 379575 - RNA, 20 nt, Bordetella pertussis
gcgcgccagcgcggccagcg

SEQ ID NO: 379576 - RNA, 13 nt, Bordetella pertussis
gcgcgccagcggc

SEQ ID NO: 379577 - RNA, 14 nt, Bordetella pertussis
gcgcgccagcggcu

SEQ ID NO: 379578 - RNA, 11 nt, Bordetella pertussis
gcgcgccagcu

SEQ ID NO: 379579 - RNA, 16 nt, Bordetella pertussis
gcgcgccagcucgcgc

SEQ ID NO: 379580 - RNA, 17 nt, Bordetella pertussis
gcgcgccagcugggcgu

SEQ ID NO: 379581 - RNA, 20 nt, Bordetella pertussis
gcgcgccagcugggcguugu

SEQ ID NO: 379582 - RNA, 16 nt, Bordetella pertussis
gcgcgccaggaagcgc

SEQ ID NO: 379583 - RNA, 22 nt, Bordetella pertussis
gcgcgccaggaagcgcgccgcg

SEQ ID NO: 379584 - RNA, 14 nt, Bordetella pertussis
gcgcgccaggccca

SEQ ID NO: 379585 - RNA, 15 nt, Bordetella pertussis
gcgcgccagggcgcc

SEQ ID NO: 379586 - RNA, 18 nt, Bordetella pertussis
gcgcgccagggcgccgcg

SEQ ID NO: 379587 - RNA, 15 nt, Bordetella pertussis
gcgcgccaggggaug

SEQ ID NO: 379588 - RNA, 18 nt, Bordetella pertussis
gcgcgccaggggaugacg

SEQ ID NO: 379589 - RNA, 14 nt, Bordetella pertussis
gcgcgccaggucgc

SEQ ID NO: 379590 - RNA, 17 nt, Bordetella pertussis
gcgcgccaggucgcgca

SEQ ID NO: 379591 - RNA, 19 nt, Bordetella pertussis
gcgcgccaguugcgcaccg

SEQ ID NO: 379592 - RNA, 14 nt, Bordetella pertussis
gcgcgccauccggc

SEQ ID NO: 379593 - RNA, 20 nt, Bordetella pertussis
gcgcgccauccggcgcauga

SEQ ID NO: 379594 - RNA, 22 nt, Bordetella pertussis
gcgcgccauccugaacgccgcg

SEQ ID NO: 379595 - RNA, 23 nt, Bordetella pertussis
gcgcgccauccugaacgccgcgc

SEQ ID NO: 379596 - RNA, 17 nt, Bordetella pertussis
gcgcgccaucgacgggc

SEQ ID NO: 379597 - RNA, 15 nt, Bordetella pertussis
gcgcgccaggcgaug

SEQ ID NO: 379598 - RNA, 15 nt, Bordetella pertussis
gcgcgccaggcgcau

SEQ ID NO: 379599 - RNA, 15 nt, Bordetella pertussis
gcgcgccaggcgcug

SEQ ID NO: 379600 - RNA, 13 nt, Bordetella pertussis
gcgcgccaggcug

SEQ ID NO: 379601 - RNA, 14 nt, Bordetella pertussis
gcgcgcccaccagg

SEQ ID NO: 379602 - RNA, 21 nt, Bordetella pertussis
gcgcgcccaccagggugccgc

SEQ ID NO: 379603 - RNA, 11 nt, Bordetella pertussis
gcgcgcccagc

SEQ ID NO: 379604 - RNA, 12 nt, Bordetella pertussis
gcgcgcccagcc

SEQ ID NO: 379605 - RNA, 21 nt, Bordetella pertussis
gcgcgcccagccccgcggccg

SEQ ID NO: 379606 - RNA, 22 nt, Bordetella pertussis
gcgcgcccagccccgcggccgc

SEQ ID NO: 379607 - RNA, 14 nt, Bordetella pertussis
gcgcgcccagcggc

SEQ ID NO: 379608 - RNA, 18 nt, Bordetella pertussis
gcgcgcccagcggcaggc

SEQ ID NO: 379609 - RNA, 14 nt, Bordetella pertussis
gcgcgcccaggcca

SEQ ID NO: 379610 - RNA, 19 nt, Bordetella pertussis
gcgcgcccaggggccggcg

SEQ ID NO: 379611 - RNA, 14 nt, Bordetella pertussis
gcgcgcccccacgc

SEQ ID NO: 379612 - RNA, 15 nt, Bordetella pertussis
gcgcgcccccacgcc

SEQ ID NO: 379613 - RNA, 16 nt, Bordetella pertussis
gcgcgcccccacgccg

SEQ ID NO: 379614 - RNA, 18 nt, Bordetella pertussis
gcgcgcccccacgccgcu

SEQ ID NO: 379615 - RNA, 21 nt, Bordetella pertussis
gcgcgccccgcuucgggccgg

SEQ ID NO: 379616 - RNA, 20 nt, Bordetella pertussis
gcgcggcagguucugcgcgu

SEQ ID NO: 379617 - RNA, 22 nt, Bordetella pertussis
gcgcggcauacgccgauggcgc

SEQ ID NO: 379618 - RNA, 18 nt, Bordetella pertussis
gcgcggcauagcccaggc

SEQ ID NO: 379619 - RNA, 20 nt, Bordetella pertussis
gcgcggcauagcccaggccg

SEQ ID NO: 379620 - RNA, 22 nt, Bordetella pertussis
gcgcggcaucgagaaaccagcc

SEQ ID NO: 379621 - RNA, 14 nt, Bordetella pertussis
gcgcggcaugccgc

SEQ ID NO: 379622 - RNA, 14 nt, Bordetella pertussis
gcgcggcaugcgca

SEQ ID NO: 379623 - RNA, 15 nt, Bordetella pertussis
gcgcggcauggcgcc

SEQ ID NO: 379624 - RNA, 18 nt, Bordetella pertussis
gcgcggcauggcgccgcg

SEQ ID NO: 379625 - RNA, 23 nt, Bordetella pertussis
gcgcggccaaccccgagggcgcg

SEQ ID NO: 379626 - RNA, 17 nt, Bordetella pertussis
gcgcggccacccugccg

SEQ ID NO: 379627 - RNA, 17 nt, Bordetella pertussis
gcgcggccacggccugc

SEQ ID NO: 379628 - RNA, 16 nt, Bordetella pertussis
gcgcggccagcaccgg

SEQ ID NO: 379629 - RNA, 20 nt, Bordetella pertussis
gcgcggccagcaccggcccg

SEQ ID NO: 379630 - RNA, 14 nt, Bordetella pertussis
gcgcggccagcacg

SEQ ID NO: 379631 - RNA, 14 nt, Bordetella pertussis
gcgcggccagcagc

SEQ ID NO: 379632 - RNA, 15 nt, Bordetella pertussis
gcgcggccagcagcg

SEQ ID NO: 379633 - RNA, 12 nt, Bordetella pertussis
gcgcggccagcg

SEQ ID NO: 379634 - RNA, 11 nt, Bordetella pertussis
gcgcggccagg

SEQ ID NO: 379635 - RNA, 12 nt, Bordetella pertussis
gcgcggccaggc

SEQ ID NO: 379636 - RNA, 14 nt, Bordetella pertussis
gcgcggccaggcgc

SEQ ID NO: 379637 - RNA, 16 nt, Bordetella pertussis
gcgcggccaggcgcgu

SEQ ID NO: 379638 - RNA, 15 nt, Bordetella pertussis
gcgcggccaggcgcu

SEQ ID NO: 379639 - RNA, 20 nt, Bordetella pertussis
gcgcggccaggcgcucagcg

SEQ ID NO: 379640 - RNA, 14 nt, Bordetella pertussis
gcgcggccagggcu

SEQ ID NO: 379641 - RNA, 21 nt, Bordetella pertussis
gcgcggccagggucaggggca

SEQ ID NO: 379642 - RNA, 21 nt, Bordetella pertussis
gcgcggccaguucgacgccca

SEQ ID NO: 379643 - RNA, 14 nt, Bordetella pertussis
gcgcggccagcgcc

SEQ ID NO: 379644 - RNA, 16 nt, Bordetella pertussis
gcgcggccagcgccgg

SEQ ID NO: 379645 - RNA, 17 nt, Bordetella pertussis
gcgcggccagcgccggc

SEQ ID NO: 379646 - RNA, 13 nt, Bordetella pertussis
gcgcggccaugcc

SEQ ID NO: 379647 - RNA, 21 nt, Bordetella pertussis
gcgcggccauguccagcagcu

SEQ ID NO: 379648 - RNA, 18 nt, Bordetella pertussis
gcgcggccccaugcgcgg

SEQ ID NO: 379649 - RNA, 13 nt, Bordetella pertussis
gcgcggcccggcc

SEQ ID NO: 379650 - RNA, 14 nt, Bordetella pertussis
gcgcggcccggccg

SEQ ID NO: 379651 - RNA, 17 nt, Bordetella pertussis
gcgcggcccgugccacg

SEQ ID NO: 379652 - RNA, 22 nt, Bordetella pertussis
gcgcggccgagcgggccagcgc

SEQ ID NO: 379653 - RNA, 15 nt, Bordetella pertussis
gcgcggccgccgccc

SEQ ID NO: 379654 - RNA, 15 nt, Bordetella pertussis
gcgcggccgcgcgcu

SEQ ID NO: 379655 - RNA, 14 nt, Bordetella pertussis
gcgcggccggcacc

SEQ ID NO: 379656 - RNA, 15 nt, Bordetella pertussis
gcgcggccggcacca

SEQ ID NO: 379657 - RNA, 22 nt, Bordetella pertussis
gcgcggccggccgcgcccaugc

SEQ ID NO: 379658 - RNA, 14 nt, Bordetella pertussis
gcgcggccggcgcg

SEQ ID NO: 379659 - RNA, 22 nt, Bordetella pertussis
gcgcggccgggcuuccaguugc

SEQ ID NO: 379660 - RNA, 15 nt, Bordetella pertussis
gcgcggccgucaggc

SEQ ID NO: 379661 - RNA, 16 nt, Bordetella pertussis
gcgcggccgucaggcg

SEQ ID NO: 379662 - RNA, 21 nt, Bordetella pertussis
gcgcggccguguucgagcagg

SEQ ID NO: 379663 - RNA, 20 nt, Bordetella pertussis
gcgcggccucgccggccugg

SEQ ID NO: 379664 - RNA, 23 nt, Bordetella pertussis
gcgcggccucgccggccuggcgc

SEQ ID NO: 379665 - RNA, 12 nt, Bordetella pertussis
gcgcggccuggg

SEQ ID NO: 379666 - RNA, 18 nt, Bordetella pertussis
gcgcggccugggcggcgc

SEQ ID NO: 379667 - RNA, 14 nt, Bordetella pertussis
gcgcggcgaccgcg

SEQ ID NO: 379668 - RNA, 22 nt, Bordetella pertussis
gcgcggcgaccgcgaaccggug

SEQ ID NO: 379669 - RNA, 17 nt, Bordetella pertussis
gcgcggcgagcacggcc

SEQ ID NO: 379670 - RNA, 23 nt, Bordetella pertussis
gcgcggcgagcacggccugcucg

SEQ ID NO: 379671 - RNA, 16 nt, Bordetella pertussis
gcgcggcgagccgcgc

SEQ ID NO: 379672 - RNA, 22 nt, Bordetella pertussis
gcgcggcgagcgccgccaggcc

SEQ ID NO: 379673 - RNA, 13 nt, Bordetella pertussis
gcgcggcgaggcg

SEQ ID NO: 379674 - RNA, 16 nt, Bordetella pertussis
gcgcggcgauacgcgc

SEQ ID NO: 379675 - RNA, 17 nt, Bordetella pertussis
gcgcggcgaucggcccg

SEQ ID NO: 379676 - RNA, 19 nt, Bordetella pertussis
gcgcggcgauugcggcccg

SEQ ID NO: 379677 - RNA, 15 nt, Bordetella pertussis
gcgcggcgaucgaca

SEQ ID NO: 379678 - RNA, 23 nt, Bordetella pertussis
gcgcggcgcagcccagcgcgaug

SEQ ID NO: 379679 - RNA, 12 nt, Bordetella pertussis
gcgcggcgcagg

SEQ ID NO: 379680 - RNA, 13 nt, Bordetella pertussis
gcgcggcgcauug

SEQ ID NO: 379681 - RNA, 13 nt, Bordetella pertussis
gcgcggcgccaug

SEQ ID NO: 379682 - RNA, 14 nt, Bordetella pertussis
gcgcggcgccaugc

SEQ ID NO: 379683 - RNA, 14 nt, Bordetella pertussis
gcgcggcgccgcug

SEQ ID NO: 379684 - RNA, 15 nt, Bordetella pertussis
gcgcggcgccggccg

SEQ ID NO: 379685 - RNA, 17 nt, Bordetella pertussis
gcgcggcgccggccucc

SEQ ID NO: 379686 - RNA, 15 nt, Bordetella pertussis
gcgcggcgccgucca

SEQ ID NO: 379687 - RNA, 19 nt, Bordetella pertussis
gcgcggcgccugcgcgcgc

SEQ ID NO: 379688 - RNA, 16 nt, Bordetella pertussis
gcgcggcgcgccgucc

SEQ ID NO: 379689 - RNA, 18 nt, Bordetella pertussis
gcgcggcgcgcgccaggg

SEQ ID NO: 379690 - RNA, 15 nt, Bordetella pertussis
gcgcggcgcgcgccg

SEQ ID NO: 379691 - RNA, 16 nt, Bordetella pertussis
gcgcggcgcgcgccga

SEQ ID NO: 379692 - RNA, 20 nt, Bordetella pertussis
gcgcggcgcgcgccgaggug

SEQ ID NO: 379693 - RNA, 13 nt, Bordetella pertussis
gcgcggcgcugca

SEQ ID NO: 379694 - RNA, 13 nt, Bordetella pertussis
gcgcggcgcuggc

SEQ ID NO: 379695 - RNA, 15 nt, Bordetella pertussis
gcgcggcgcuggcgc

SEQ ID NO: 379696 - RNA, 19 nt, Bordetella pertussis
gcgcggcgcuggcgccgcg

SEQ ID NO: 379697 - RNA, 21 nt, Bordetella pertussis
gcgcggcgcguucagcagcag

SEQ ID NO: 379698 - RNA, 18 nt, Bordetella pertussis
gcgcggcggacugcgccg

SEQ ID NO: 379699 - RNA, 20 nt, Bordetella pertussis
gcgcggcggaucggcguggu

SEQ ID NO: 379700 - RNA, 17 nt, Bordetella pertussis
gcgcggcggcaccagca

SEQ ID NO: 379701 - RNA, 17 nt, Bordetella pertussis
gcgcggcggcagcgcgu

SEQ ID NO: 379702 - RNA, 13 nt, Bordetella pertussis
gcgcggcggcgac

SEQ ID NO: 379703 - RNA, 14 nt, Bordetella pertussis
gcgcggcggcgacc

SEQ ID NO: 379704 - RNA, 17 nt, Bordetella pertussis
gcgcggcggcgaccggc

SEQ ID NO: 379705 - RNA, 18 nt, Bordetella pertussis
gcgcggcggcgaccggcg

SEQ ID NO: 379706 - RNA, 19 nt, Bordetella pertussis
gcgcggcggcgaccggcgc

SEQ ID NO: 379707 - RNA, 16 nt, Bordetella pertussis
gcgcggcggccaggcg

SEQ ID NO: 379708 - RNA, 17 nt, Bordetella pertussis
gcgcggcggccaggcgu

SEQ ID NO: 379709 - RNA, 14 nt, Bordetella pertussis
gcgcggcggcguga

SEQ ID NO: 379710 - RNA, 20 nt, Bordetella pertussis
gcgcggcggcgugaacgcgc

SEQ ID NO: 379711 - RNA, 20 nt, Bordetella pertussis
gcgcggcggcguuccugggc

SEQ ID NO: 379712 - RNA, 21 nt, Bordetella pertussis
gcgcggcggcggaucgaacgc

SEQ ID NO: 379713 - RNA, 22 nt, Bordetella pertussis
gcgcggcggcggaucgaacgcc

SEQ ID NO: 379714 - RNA, 15 nt, Bordetella pertussis
gcgcggcggcggcca

SEQ ID NO: 379715 - RNA, 19 nt, Bordetella pertussis
gcgcggcgggcgcuggcgc

SEQ ID NO: 379716 - RNA, 20 nt, Bordetella pertussis
gcgcggcgggcgcuggcgcg

SEQ ID NO: 379717 - RNA, 15 nt, Bordetella pertussis
gcgcggcggugccgc

SEQ ID NO: 379718 - RNA, 21 nt, Bordetella pertussis
gcgcggcguguagagcugcgg

SEQ ID NO: 379719 - RNA, 19 nt, Bordetella pertussis
gcgcggcguugcggcgcca

SEQ ID NO: 379720 - RNA, 17 nt, Bordetella pertussis
gcgcggcucgccgcgca

SEQ ID NO: 379721 - RNA, 15 nt, Bordetella pertussis
gcgcggcucgccggc

SEQ ID NO: 379722 - RNA, 19 nt, Bordetella pertussis
gcgcggcucgccggccgcg

SEQ ID NO: 379723 - RNA, 23 nt, Bordetella pertussis
gcgcgggcgauggccacgcgcug

SEQ ID NO: 379724 - RNA, 12 nt, Bordetella pertussis
gcgcgggcgcac

SEQ ID NO: 379725 - RNA, 13 nt, Bordetella pertussis
gcgcgggcgcaca

SEQ ID NO: 379726 - RNA, 18 nt, Bordetella pertussis
gcgcgggcgcggcaggcg

SEQ ID NO: 379727 - RNA, 13 nt, Bordetella pertussis
gcgcgggcggccc

SEQ ID NO: 379728 - RNA, 13 nt, Bordetella pertussis
gcgcgggcggcua

SEQ ID NO: 379729 - RNA, 22 nt, Bordetella pertussis
gcgcgggcggcuaggcgcagca

SEQ ID NO: 379730 - RNA, 22 nt, Bordetella pertussis
gcgcgggcggucggcgcggcgc

SEQ ID NO: 379731 - RNA, 15 nt, Bordetella pertussis
gcgcggggccaggcg

SEQ ID NO: 379732 - RNA, 18 nt, Bordetella pertussis
gcgcggggccaggcgcag

SEQ ID NO: 379733 - RNA, 15 nt, Bordetella pertussis
gcgcggggccggucc

SEQ ID NO: 379734 - RNA, 19 nt, Bordetella pertussis
gcgcggggccgguccgcuc

SEQ ID NO: 379735 - RNA, 15 nt, Bordetella pertussis
gcgcgguauggccgc

SEQ ID NO: 379736 - RNA, 18 nt, Bordetella pertussis
gcgcgguauggccgccca

SEQ ID NO: 379737 - RNA, 20 nt, Bordetella pertussis
gcgcgguauggccgcccagc

SEQ ID NO: 379738 - RNA, 19 nt, Bordetella pertussis
gcgcgguauucgcgcuggc

SEQ ID NO: 379739 - RNA, 20 nt, Bordetella pertussis
gcgcgguauucgcgcuggcg

SEQ ID NO: 379740 - RNA, 17 nt, Bordetella pertussis
gcgcggucaugccgaac

SEQ ID NO: 379741 - RNA, 13 nt, Bordetella pertussis
gcgcgguccacgc

SEQ ID NO: 379742 - RNA, 21 nt, Bordetella pertussis
gcgcgguccacgcccuggcug

SEQ ID NO: 379743 - RNA, 17 nt, Bordetella pertussis
gcgcgguccacgcgggc

SEQ ID NO: 379744 - RNA, 13 nt, Bordetella pertussis
gcgcggucggcgg

SEQ ID NO: 379745 - RNA, 15 nt, Bordetella pertussis
gcgcggugucgccgc

SEQ ID NO: 379746 - RNA, 19 nt, Bordetella pertussis
gcgcgguugagcgccaggg

SEQ ID NO: 379747 - RNA, 16 nt, Bordetella pertussis
gcgcgguugggcgcac

SEQ ID NO: 379748 - RNA, 21 nt, Bordetella pertussis
gcgcgguugguuugcggcgcg

SEQ ID NO: 379749 - RNA, 20 nt, Bordetella pertussis
gcgcguauuccggguccagc

SEQ ID NO: 379750 - RNA, 16 nt, Bordetella pertussis
gcgcgucacgcugaac

SEQ ID NO: 379751 - RNA, 14 nt, Bordetella pertussis
gcgcgucaggccgg

SEQ ID NO: 379752 - RNA, 16 nt, Bordetella pertussis
gcgcgucaggccgggc

SEQ ID NO: 379753 - RNA, 18 nt, Bordetella pertussis
gcgcgucaggccgggcag

SEQ ID NO: 379754 - RNA, 17 nt, Bordetella pertussis
gcgcgucaggcgagcgc

SEQ ID NO: 379755 - RNA, 15 nt, Bordetella pertussis
gcgcguccacgccgu

SEQ ID NO: 379756 - RNA, 13 nt, Bordetella pertussis
gcgcguccaggcc

SEQ ID NO: 379757 - RNA, 14 nt, Bordetella pertussis
gcgcguccaggcca

SEQ ID NO: 379758 - RNA, 15 nt, Bordetella pertussis
gcgcguccaggccau

SEQ ID NO: 379759 - RNA, 15 nt, Bordetella pertussis
gcgcguccaggcggu

SEQ ID NO: 379760 - RNA, 18 nt, Bordetella pertussis
gcgcguccaggcgguccu

SEQ ID NO: 379761 - RNA, 22 nt, Bordetella pertussis
gcgcguccaggugcggcggcga

SEQ ID NO: 379762 - RNA, 16 nt, Bordetella pertussis
gcgcgugccgcaggcc

SEQ ID NO: 379763 - RNA, 14 nt, Bordetella pertussis
gcgcgugccgcgca

SEQ ID NO: 379764 - RNA, 12 nt, Bordetella pertussis
gcgcgugcgcag

SEQ ID NO: 379765 - RNA, 15 nt, Bordetella pertussis
gcgcgugcgcgcgcc

SEQ ID NO: 379766 - RNA, 16 nt, Bordetella pertussis
gcgcgugcgcgcgcca

SEQ ID NO: 379767 - RNA, 13 nt, Bordetella pertussis
gcgcgugcggaug

SEQ ID NO: 379768 - RNA, 14 nt, Bordetella pertussis
gcgcgugcggggcg

SEQ ID NO: 379769 - RNA, 21 nt, Bordetella pertussis
gcgcgugcguauucgguggcg

SEQ ID NO: 379770 - RNA, 22 nt, Bordetella pertussis
gcgcgugcguauucgguggcgc

SEQ ID NO: 379771 - RNA, 13 nt, Bordetella pertussis
gcgcgugcuggcg

SEQ ID NO: 379772 - RNA, 15 nt, Bordetella pertussis
gcgcgugcuggcgca

SEQ ID NO: 379773 - RNA, 13 nt, Bordetella pertussis
gcgcgugcugggc

SEQ ID NO: 379774 - RNA, 16 nt, Bordetella pertussis
gcgcguggaaccgccg

SEQ ID NO: 379775 - RNA, 17 nt, Bordetella pertussis
gcgcguggaaccgccgc

SEQ ID NO: 379776 - RNA, 12 nt, Bordetella pertussis
gcgcguggccac

SEQ ID NO: 379777 - RNA, 16 nt, Bordetella pertussis
gcgcguggccacggcg

SEQ ID NO: 379778 - RNA, 12 nt, Bordetella pertussis
gcgcguggccau

SEQ ID NO: 379779 - RNA, 13 nt, Bordetella pertussis
gcgcguggccauc

SEQ ID NO: 379780 - RNA, 14 nt, Bordetella pertussis
gcgcguggccauca

SEQ ID NO: 379781 - RNA, 19 nt, Bordetella pertussis
gcgcguggccaucaacgug

SEQ ID NO: 379782 - RNA, 15 nt, Bordetella pertussis
gcgcguggcccgcgc

SEQ ID NO: 379783 - RNA, 17 nt, Bordetella pertussis
gcgcguggcccgcgccg

SEQ ID NO: 379784 - RNA, 11 nt, Bordetella pertussis
gcgcguggccg

SEQ ID NO: 379785 - RNA, 14 nt, Bordetella pertussis
gcgcguggccgcca

SEQ ID NO: 379786 - RNA, 13 nt, Bordetella pertussis
gcgcguggccggc

SEQ ID NO: 379787 - RNA, 14 nt, Bordetella pertussis
gcgcguggcgccca

SEQ ID NO: 379788 - RNA, 15 nt, Bordetella pertussis
gcgcgugggcaggug

SEQ ID NO: 379789 - RNA, 17 nt, Bordetella pertussis
gcgcgugggccagcaac

SEQ ID NO: 379790 - RNA, 24 nt, Bordetella pertussis
gcgcgugggccagcaacuggugcc

SEQ ID NO: 379791 - RNA, 17 nt, Bordetella pertussis
gcgcguuaaccucccga

SEQ ID NO: 379792 - RNA, 20 nt, Bordetella pertussis
gcgcguucagcagcaggccc

SEQ ID NO: 379793 - RNA, 21 nt, Bordetella pertussis
gcgcguucagcagcaggcccu

SEQ ID NO: 379794 - RNA, 19 nt, Bordetella pertussis
gcgcguucagggcgccgcg

SEQ ID NO: 379795 - RNA, 21 nt, Bordetella pertussis
gcgcguucagggcgccgcggc

SEQ ID NO: 379796 - RNA, 22 nt, Bordetella pertussis
gcgcguucagggcgccgcggcg

SEQ ID NO: 379797 - RNA, 16 nt, Bordetella pertussis
gcgcgugugguuggcg

SEQ ID NO: 379798 - RNA, 20 nt, Bordetella pertussis
gcgcgugugguuggcgcugc

SEQ ID NO: 379799 - RNA, 15 nt, Bordetella pertussis
gcgcguucaggucgc

SEQ ID NO: 379800 - RNA, 14 nt, Bordetella pertussis
gcgcguuccggccg

SEQ ID NO: 379801 - RNA, 15 nt, Bordetella pertussis
gcgcguuccggccgc

SEQ ID NO: 379802 - RNA, 16 nt, Bordetella pertussis
gcgcguuccggccgcg

SEQ ID NO: 379803 - RNA, 22 nt, Bordetella pertussis
gcgcguuccggccgcgccagcc

SEQ ID NO: 379804 - RNA, 18 nt, Bordetella pertussis
gcgcguugagcagcaugu

SEQ ID NO: 379805 - RNA, 20 nt, Bordetella pertussis
gcgcguugaucaucggcccg

SEQ ID NO: 379806 - RNA, 14 nt, Bordetella pertussis
gcgcguugccggug

SEQ ID NO: 379807 - RNA, 22 nt, Bordetella pertussis
gcgcuacagcguggugggccac

SEQ ID NO: 379808 - RNA, 18 nt, Bordetella pertussis
gcgcuacagggugccgcg

SEQ ID NO: 379809 - RNA, 19 nt, Bordetella pertussis
gcgcuacagggugccgcgc

SEQ ID NO: 379810 - RNA, 22 nt, Bordetella pertussis
gcgcuacagggugccgcgccgg

SEQ ID NO: 379811 - RNA, 12 nt, Bordetella pertussis
gcgcuacgccgc

SEQ ID NO: 379812 - RNA, 14 nt, Bordetella pertussis
gcgcuacgccgccg

SEQ ID NO: 379813 - RNA, 13 nt, Bordetella pertussis
gcgcuaugggggc

SEQ ID NO: 379814 - RNA, 17 nt, Bordetella pertussis
gcgcucaggaaccagcg

SEQ ID NO: 379815 - RNA, 20 nt, Bordetella pertussis
gcgcucaggaaccagcggcu

SEQ ID NO: 379816 - RNA, 13 nt, Bordetella pertussis
gcgcucaggccgc

SEQ ID NO: 379817 - RNA, 19 nt, Bordetella pertussis
gcgcucaggccgccggcgc

SEQ ID NO: 379818 - RNA, 18 nt, Bordetella pertussis
gcgcucaggccgcugggc

SEQ ID NO: 379819 - RNA, 16 nt, Bordetella pertussis
gcgcucaucaucgcgc

SEQ ID NO: 379820 - RNA, 19 nt, Bordetella pertussis
gcgcucaucaucgcgcugg

SEQ ID NO: 379821 - RNA, 16 nt, Bordetella pertussis
gcgcucagggggcgcc

SEQ ID NO: 379822 - RNA, 17 nt, Bordetella pertussis
gcgcucauggcgcauga

SEQ ID NO: 379823 - RNA, 13 nt, Bordetella pertussis
gcgcuccucgcgc

SEQ ID NO: 379824 - RNA, 17 nt, Bordetella pertussis
gcgcuccucgcgcgcgg

SEQ ID NO: 379825 - RNA, 22 nt, Bordetella pertussis
gcgcuccuucgugguggcgaaa

SEQ ID NO: 379826 - RNA, 22 nt, Bordetella pertussis
gcgcucgaagcgcaugucgaag

SEQ ID NO: 379827 - RNA, 15 nt, Bordetella pertussis
gcgcucgaaggcgcc

SEQ ID NO: 379828 - RNA, 16 nt, Bordetella pertussis
gcgcucgaaggcgccg

SEQ ID NO: 379829 - RNA, 17 nt, Bordetella pertussis
gcgcucgaaggcgccga

SEQ ID NO: 379830 - RNA, 18 nt, Bordetella pertussis
gcgcucgaauggcugcgc

SEQ ID NO: 379831 - RNA, 20 nt, Bordetella pertussis
gcgcucgaauggcugcgcgc

SEQ ID NO: 379832 - RNA, 22 nt, Bordetella pertussis
gcgcucgaauggcugcgcgccg

SEQ ID NO: 379833 - RNA, 18 nt, Bordetella pertussis
gcgcucgagcgccugcag

SEQ ID NO: 379834 - RNA, 19 nt, Bordetella pertussis
gcgcucgagcgccugcagc

SEQ ID NO: 379835 - RNA, 16 nt, Bordetella pertussis
gcgcucgagcgcggcg

SEQ ID NO: 379836 - RNA, 17 nt, Bordetella pertussis
gcgcucgagcgcggcgc

SEQ ID NO: 379837 - RNA, 16 nt, Bordetella pertussis
gcgcucgaggcgcugg

SEQ ID NO: 379838 - RNA, 18 nt, Bordetella pertussis
gcgcucgaggcgcuggcg

SEQ ID NO: 379839 - RNA, 21 nt, Bordetella pertussis
gcgcucgaggcgcuggcgucc

SEQ ID NO: 379840 - RNA, 22 nt, Bordetella pertussis
gcgcucgacuucgucgggcucg

SEQ ID NO: 379841 - RNA, 13 nt, Bordetella pertussis
gcgcucgcccagc

SEQ ID NO: 379842 - RNA, 18 nt, Bordetella pertussis
gcgcucgcccagcaccuc

SEQ ID NO: 379843 - RNA, 17 nt, Bordetella pertussis
gcgcucgcccagccgcc

SEQ ID NO: 379844 - RNA, 17 nt, Bordetella pertussis
gcgcucgccccggcgcg

SEQ ID NO: 379845 - RNA, 12 nt, Bordetella pertussis
gcgcucgccggc

SEQ ID NO: 379846 - RNA, 13 nt, Bordetella pertussis
gcgcucgccggcg

SEQ ID NO: 379847 - RNA, 14 nt, Bordetella pertussis
gcgcucgccggcgc

SEQ ID NO: 379848 - RNA, 18 nt, Bordetella pertussis
gcgcucgccggcgcgcag

SEQ ID NO: 379849 - RNA, 12 nt, Bordetella pertussis
gcgcucgcccgg

SEQ ID NO: 379850 - RNA, 14 nt, Bordetella pertussis
gcgcucgcccggcc

SEQ ID NO: 379851 - RNA, 17 nt, Bordetella pertussis
gcgcucgcccucgcgcc

SEQ ID NO: 379852 - RNA, 15 nt, Bordetella pertussis
gcgcucgcgcaccgc

SEQ ID NO: 379853 - RNA, 13 nt, Bordetella pertussis
gcgcucgcgccca

SEQ ID NO: 379854 - RNA, 15 nt, Bordetella pertussis
gcgcucgcgcgccag

SEQ ID NO: 379855 - RNA, 18 nt, Bordetella pertussis
gcgcucgcgcucggccag

SEQ ID NO: 379856 - RNA, 13 nt, Bordetella pertussis
gcgcucgcgcugc

SEQ ID NO: 379857 - RNA, 15 nt, Bordetella pertussis
gcgcucggacgccgc

SEQ ID NO: 379858 - RNA, 12 nt, Bordetella pertussis
gcgcucggccag

SEQ ID NO: 379859 - RNA, 13 nt, Bordetella pertussis
gcgcucggccagc

SEQ ID NO: 379860 - RNA, 14 nt, Bordetella pertussis
gcgcucggccagca

SEQ ID NO: 379861 - RNA, 19 nt, Bordetella pertussis
gcgcucggccagcgcgcgg

SEQ ID NO: 379862 - RNA, 22 nt, Bordetella pertussis
gcgcucggccagcgcgcggccg

SEQ ID NO: 379863 - RNA, 12 nt, Bordetella pertussis
gcgcucggccuc

SEQ ID NO: 379864 - RNA, 13 nt, Bordetella pertussis
gcgcucggccucg

SEQ ID NO: 379865 - RNA, 16 nt, Bordetella pertussis
gcgcucggccucgguc

SEQ ID NO: 379866 - RNA, 15 nt, Bordetella pertussis
gcgcucggcgcugcc

SEQ ID NO: 379867 - RNA, 12 nt, Bordetella pertussis
gcgcucggcgcc

SEQ ID NO: 379868 - RNA, 20 nt, Bordetella pertussis
gcgcucggcuuccugccgca

SEQ ID NO: 379869 - RNA, 12 nt, Bordetella pertussis
gcgcucgggcag

SEQ ID NO: 379870 - RNA, 16 nt, Bordetella pertussis
gcgcucgggcgcggca

SEQ ID NO: 379871 - RNA, 20 nt, Bordetella pertussis
gcgcucgggcucgcgcgcgc

SEQ ID NO: 379872 - RNA, 12 nt, Bordetella pertussis
gcgcucuugggc

SEQ ID NO: 379873 - RNA, 14 nt, Bordetella pertussis
gcgcugacagcgcu

SEQ ID NO: 379874 - RNA, 18 nt, Bordetella pertussis
gcgcugcaggaucgcggc

SEQ ID NO: 379875 - RNA, 19 nt, Bordetella pertussis
gcgcugcaggaucgcggcc

SEQ ID NO: 379876 - RNA, 20 nt, Bordetella pertussis
gcgcugcaggaucgcggcca

SEQ ID NO: 379877 - RNA, 21 nt, Bordetella pertussis
gcgcugcaggaucgcggccag

SEQ ID NO: 379878 - RNA, 23 nt, Bordetella pertussis
gcgcugcaggaucgcggccagcg

SEQ ID NO: 379879 - RNA, 18 nt, Bordetella pertussis
gcgcugcaggcgucccgg

SEQ ID NO: 379880 - RNA, 16 nt, Bordetella pertussis
gcgcugcauacgccgc

SEQ ID NO: 379881 - RNA, 18 nt, Bordetella pertussis
gcgcugcauacgccgcug

SEQ ID NO: 379882 - RNA, 12 nt, Bordetella pertussis
gcgcugcagcag

SEQ ID NO: 379883 - RNA, 14 nt, Bordetella pertussis
gcgcugcagcgcag

SEQ ID NO: 379884 - RNA, 16 nt, Bordetella pertussis
gcgcugcccaggaugg

SEQ ID NO: 379885 - RNA, 22 nt, Bordetella pertussis
gcgcugcccaccgccguggccg

SEQ ID NO: 379886 - RNA, 13 nt, Bordetella pertussis
gcgcugcccagcc

SEQ ID NO: 379887 - RNA, 19 nt, Bordetella pertussis
gcgcugcccgucgcuggcg

SEQ ID NO: 379888 - RNA, 15 nt, Bordetella pertussis
gcgcugcucuccaug

SEQ ID NO: 379889 - RNA, 17 nt, Bordetella pertussis
gcgcugcugcaggccgg

SEQ ID NO: 379890 - RNA, 20 nt, Bordetella pertussis
gcgcugcugcaggccggcgc

SEQ ID NO: 379891 - RNA, 13 nt, Bordetella pertussis
gcgcugcugucgc

SEQ ID NO: 379892 - RNA, 16 nt, Bordetella pertussis
gcgcugcugucgcgcg

SEQ ID NO: 379893 - RNA, 19 nt, Bordetella pertussis
gcgcugcugucgcgcugcc

SEQ ID NO: 379894 - RNA, 17 nt, Bordetella pertussis
gcgcugcugcuggcugc

SEQ ID NO: 379895 - RNA, 21 nt, Bordetella pertussis
gcgcugcuggccaagcgcgcc

SEQ ID NO: 379896 - RNA, 17 nt, Bordetella pertussis
gcgcugcuggccggcca

SEQ ID NO: 379897 - RNA, 18 nt, Bordetella pertussis
gcgcugcuggccggccag

SEQ ID NO: 379898 - RNA, 19 nt, Bordetella pertussis
gcgcuggaauauggcgucc

SEQ ID NO: 379899 - RNA, 20 nt, Bordetella pertussis
gcgcuggacgcccuggcgca

SEQ ID NO: 379900 - RNA, 20 nt, Bordetella pertussis
gcgcuggcgcccggccugcg

SEQ ID NO: 379901 - RNA, 13 nt, Bordetella pertussis
gcgcuggcgccgc

SEQ ID NO: 379902 - RNA, 15 nt, Bordetella pertussis
gcgcuggcgccgcgc

SEQ ID NO: 379903 - RNA, 18 nt, Bordetella pertussis
gcgcuggcgccgcgcgcc

SEQ ID NO: 379904 - RNA, 19 nt, Bordetella pertussis
gcgcuggcgccgcgcgcca

SEQ ID NO: 379905 - RNA, 12 nt, Bordetella pertussis
gcgcuggcgcgc

SEQ ID NO: 379906 - RNA, 14 nt, Bordetella pertussis
gcgcuggcgcgcgg

SEQ ID NO: 379907 - RNA, 15 nt, Bordetella pertussis
gcgcuggcgcgcggc

SEQ ID NO: 379908 - RNA, 19 nt, Bordetella pertussis
gcgcuggcgcgcggccgcg

SEQ ID NO: 379909 - RNA, 14 nt, Bordetella pertussis
gcgcuggcggcgca

SEQ ID NO: 379910 - RNA, 17 nt, Bordetella pertussis
gcgcuggcggcgcaggc

SEQ ID NO: 379911 - RNA, 14 nt, Bordetella pertussis
gcgcuggcggcugc

SEQ ID NO: 379912 - RNA, 18 nt, Bordetella pertussis
gcgcuggcgguggccgcg

SEQ ID NO: 379913 - RNA, 19 nt, Bordetella pertussis
gcgcuggcgguggccgcgc

SEQ ID NO: 379914 - RNA, 13 nt, Bordetella pertussis
gcgcuggcgucca

SEQ ID NO: 379915 - RNA, 14 nt, Bordetella pertussis
gcgcuggcguucag

SEQ ID NO: 379916 - RNA, 16 nt, Bordetella pertussis
gcgcuggcuggacgcg

SEQ ID NO: 379917 - RNA, 17 nt, Bordetella pertussis
gcgcuggcuggacgcgc

SEQ ID NO: 379918 - RNA, 18 nt, Bordetella pertussis
gcgcuggcuggacgcgcg

SEQ ID NO: 379919 - RNA, 19 nt, Bordetella pertussis
gcgcugggcaugggcggcc

SEQ ID NO: 379920 - RNA, 15 nt, Bordetella pertussis
gcgcugggccaggcc

SEQ ID NO: 379921 - RNA, 19 nt, Bordetella pertussis
gcgcugggccaggccggcc

SEQ ID NO: 379922 - RNA, 14 nt, Bordetella pertussis
gcgcugggcgcauu

SEQ ID NO: 379923 - RNA, 15 nt, Bordetella pertussis
gcgcugggcgccagc

SEQ ID NO: 379924 - RNA, 21 nt, Bordetella pertussis
gcgcugggcgccagcagcacg

SEQ ID NO: 379925 - RNA, 16 nt, Bordetella pertussis
gcggaacagccugguc

SEQ ID NO: 379926 - RNA, 20 nt, Bordetella pertussis
gcggaaguauucgcgcggcg

SEQ ID NO: 379927 - RNA, 18 nt, Bordetella pertussis
gcggaauggggcccgcau

SEQ ID NO: 379928 - RNA, 21 nt, Bordetella pertussis
gcggaaugucguugcacagca

SEQ ID NO: 379929 - RNA, 17 nt, Bordetella pertussis
gcggacacgcccuggcc

SEQ ID NO: 379930 - RNA, 22 nt, Bordetella pertussis
gcggacacgcccuggccguaca

SEQ ID NO: 379931 - RNA, 22 nt, Bordetella pertussis
gcggacacugacguggauggcu

SEQ ID NO: 379932 - RNA, 21 nt, Bordetella pertussis
gcggacagaugccguccuggc

SEQ ID NO: 379933 - RNA, 13 nt, Bordetella pertussis
gcggaccacacga

SEQ ID NO: 379934 - RNA, 22 nt, Bordetella pertussis
gcggaccagcgguugcgccagc

SEQ ID NO: 379935 - RNA, 22 nt, Bordetella pertussis
gcggacccaggccucggcuugc

SEQ ID NO: 379936 - RNA, 14 nt, Bordetella pertussis
gcggacgaagccua

SEQ ID NO: 379937 - RNA, 21 nt, Bordetella pertussis
gcggacgaagccuaggcugca

SEQ ID NO: 379938 - RNA, 16 nt, Bordetella pertussis
gcggacgauggccugu

SEQ ID NO: 379939 - RNA, 20 nt, Bordetella pertussis
gcggacgauguagaucuggc

SEQ ID NO: 379940 - RNA, 21 nt, Bordetella pertussis
gcggacgauguagaucuggcg

SEQ ID NO: 379941 - RNA, 20 nt, Bordetella pertussis
gcggacgccagcccugggug

SEQ ID NO: 379942 - RNA, 15 nt, Bordetella pertussis
gcggacgccauggcg

SEQ ID NO: 379943 - RNA, 17 nt, Bordetella pertussis
gcggacgccauggcggc

SEQ ID NO: 379944 - RNA, 22 nt, Bordetella pertussis
gcggacgccauggcggcggcca

SEQ ID NO: 379945 - RNA, 16 nt, Bordetella pertussis
gcggacgggccaggcc

SEQ ID NO: 379946 - RNA, 17 nt, Bordetella pertussis
gcggacgggccaggccg

SEQ ID NO: 379947 - RNA, 18 nt, Bordetella pertussis
gcggacgggccaggccga

SEQ ID NO: 379948 - RNA, 14 nt, Bordetella pertussis
gcggacgguagcgc

SEQ ID NO: 379949 - RNA, 18 nt, Bordetella pertussis
gcggacgguagcgcacgc

SEQ ID NO: 379950 - RNA, 16 nt, Bordetella pertussis
gcggacguuggccgau

SEQ ID NO: 379951 - RNA, 13 nt, Bordetella pertussis
gcggacuggccgc

SEQ ID NO: 379952 - RNA, 15 nt, Bordetella pertussis
gcggacuucgcccgg

SEQ ID NO: 379953 - RNA, 15 nt, Bordetella pertussis
gcggagccgcgcaca

SEQ ID NO: 379954 - RNA, 15 nt, Bordetella pertussis
gcggaggcggccgcg

SEQ ID NO: 379955 - RNA, 19 nt, Bordetella pertussis
gcggaggcuuugucguuga

SEQ ID NO: 379956 - RNA, 20 nt, Bordetella pertussis
gcggagggugagugcccaug

SEQ ID NO: 379957 - RNA, 17 nt, Bordetella pertussis
gcggaggugucgccgcc

SEQ ID NO: 379958 - RNA, 22 nt, Bordetella pertussis
gcggaggugucgccgcccaugc

SEQ ID NO: 379959 - RNA, 21 nt, Bordetella pertussis
gcggagucgauaugccgauug

SEQ ID NO: 379960 - RNA, 19 nt, Bordetella pertussis
gcggauacgaaaccaggcc

SEQ ID NO: 379961 - RNA, 15 nt, Bordetella pertussis
gcggauacgcgucau

SEQ ID NO: 379962 - RNA, 17 nt, Bordetella pertussis
gcggauauucgucggcc

SEQ ID NO: 379963 - RNA, 19 nt, Bordetella pertussis
gcggauauucgucggccgc

SEQ ID NO: 379964 - RNA, 14 nt, Bordetella pertussis
gcggaucaagcggc

SEQ ID NO: 379965 - RNA, 13 nt, Bordetella pertussis
gcggaucaugggc

SEQ ID NO: 379966 - RNA, 19 nt, Bordetella pertussis
gcggaucaugggccugccc

SEQ ID NO: 379967 - RNA, 13 nt, Bordetella pertussis
gcggauccagcca

SEQ ID NO: 379968 - RNA, 14 nt, Bordetella pertussis
gcggauccagccau

SEQ ID NO: 379969 - RNA, 14 nt, Bordetella pertussis
gcggaucgaacgcc

SEQ ID NO: 379970 - RNA, 12 nt, Bordetella pertussis
gcggaucgccgg

SEQ ID NO: 379971 - RNA, 20 nt, Bordetella pertussis
gcggaucgucuacgcgaacc

SEQ ID NO: 379972 - RNA, 21 nt, Bordetella pertussis
gcggaucucggccagcagcgc

SEQ ID NO: 379973 - RNA, 20 nt, Bordetella pertussis
gcggaugaacgaccagcacg

SEQ ID NO: 379974 - RNA, 17 nt, Bordetella pertussis
gcggaugaagggcuggc

SEQ ID NO: 379975 - RNA, 20 nt, Bordetella pertussis
gcggaugaagggcuggccgg

SEQ ID NO: 379976 - RNA, 20 nt, Bordetella pertussis
gcggaugaccuggugcacca

SEQ ID NO: 379977 - RNA, 17 nt, Bordetella pertussis
gcggaugagcaggccgg

SEQ ID NO: 379978 - RNA, 18 nt, Bordetella pertussis
gcggaugaucgcgcagca

SEQ ID NO: 379979 - RNA, 22 nt, Bordetella pertussis
gcggaugaucgcgcagcaccgc

SEQ ID NO: 379980 - RNA, 15 nt, Bordetella pertussis
gcggaugcagcagcg

SEQ ID NO: 379981 - RNA, 17 nt, Bordetella pertussis
gcggaugccguccacgc

SEQ ID NO: 379982 - RNA, 21 nt, Bordetella pertussis
gcggaugucaguuuccaucgg

SEQ ID NO: 379983 - RNA, 14 nt, Bordetella pertussis
gcggauguccggcg

SEQ ID NO: 379984 - RNA, 22 nt, Bordetella pertussis
gcggauugaccagcgcggccgu

SEQ ID NO: 379985 - RNA, 18 nt, Bordetella pertussis
gcggauugaugucgcgca

SEQ ID NO: 379986 - RNA, 20 nt, Bordetella pertussis
gcggauugaugucgcgcacc

SEQ ID NO: 379987 - RNA, 20 nt, Bordetella pertussis
gcggauugccguccuggcga

SEQ ID NO: 379988 - RNA, 21 nt, Bordetella pertussis
gcggauugccguccuggcgac

SEQ ID NO: 379989 - RNA, 19 nt, Bordetella pertussis
gcggcaaaaaaaaccgcgc

SEQ ID NO: 379990 - RNA, 23 nt, Bordetella pertussis
gcggcaaaaaaaaccgcgcgccg

SEQ ID NO: 379991 - RNA, 16 nt, Bordetella pertussis
gcggcaaaaugccgcg

SEQ ID NO: 379992 - RNA, 21 nt, Bordetella pertussis
gcggcaaacccggcgaagccg

SEQ ID NO: 379993 - RNA, 17 nt, Bordetella pertussis
gcggcaaagccgcugcg

SEQ ID NO: 379994 - RNA, 14 nt, Bordetella pertussis
gcggcaaauggggc

SEQ ID NO: 379995 - RNA, 17 nt, Bordetella pertussis
gcggcaaauggggcggc

SEQ ID NO: 379996 - RNA, 14 nt, Bordetella pertussis
gcggcaagcagccg

SEQ ID NO: 379997 - RNA, 15 nt, Bordetella pertussis
gcggcaagcagccgg

SEQ ID NO: 379998 - RNA, 13 nt, Bordetella pertussis
gcggcaagccgcg

SEQ ID NO: 379999 - RNA, 14 nt, Bordetella pertussis
gcggcaagccgcgg

SEQ ID NO: 380000 - RNA, 16 nt, Bordetella pertussis
gcggcaagccgcggcg

SEQ ID NO: 380001 - RNA, 12 nt, Bordetella pertussis
gcggcaagcggc

SEQ ID NO: 380002 - RNA, 14 nt, Bordetella pertussis
gcggcaagggugcc

SEQ ID NO: 380003 - RNA, 18 nt, Bordetella pertussis
gcggcaagguagccgaug

SEQ ID NO: 380004 - RNA, 21 nt, Bordetella pertussis
gcggcaauaucggcacccgca

SEQ ID NO: 380005 - RNA, 13 nt, Bordetella pertussis
gcggcaaugcgcg

SEQ ID NO: 380006 - RNA, 22 nt, Bordetella pertussis
gcggcacaucggaauuggcggc

SEQ ID NO: 380007 - RNA, 19 nt, Bordetella pertussis
gcggcaccagcaggccggu

SEQ ID NO: 380008 - RNA, 19 nt, Bordetella pertussis
gcggcaccgcgcagcccgg

SEQ ID NO: 380009 - RNA, 14 nt, Bordetella pertussis
gcggcaccucggcc

SEQ ID NO: 380010 - RNA, 18 nt, Bordetella pertussis
gcggcaccucggccgggg

SEQ ID NO: 380011 - RNA, 13 nt, Bordetella pertussis
gcggcaccugcug

SEQ ID NO: 380012 - RNA, 15 nt, Bordetella pertussis
gcggcaccugcugcu

SEQ ID NO: 380013 - RNA, 19 nt, Bordetella pertussis
gcggcaccugcugcuugac

SEQ ID NO: 380014 - RNA, 13 nt, Bordetella pertussis
gcggcaccucggc

SEQ ID NO: 380015 - RNA, 19 nt, Bordetella pertussis
gcggcacgaaaagccgcgg

SEQ ID NO: 380016 - RNA, 22 nt, Bordetella pertussis
gcggcacgaaaagccgcggccg

SEQ ID NO: 380017 - RNA, 16 nt, Bordetella pertussis
gcggcacgaucggcgc

SEQ ID NO: 380018 - RNA, 21 nt, Bordetella pertussis
gcggcacgaucggcgccuggc

SEQ ID NO: 380019 - RNA, 16 nt, Bordetella pertussis
gcggcacgauuucgcc

SEQ ID NO: 380020 - RNA, 14 nt, Bordetella pertussis
gcggcacgccggcg

SEQ ID NO: 380021 - RNA, 16 nt, Bordetella pertussis
gcggcacgccggcggc

SEQ ID NO: 380022 - RNA, 19 nt, Bordetella pertussis
gcggcacgccggcggccca

SEQ ID NO: 380023 - RNA, 17 nt, Bordetella pertussis
gcggcacgcgcgccggc

SEQ ID NO: 380024 - RNA, 18 nt, Bordetella pertussis
gcggcacgcgcgccggca

SEQ ID NO: 380025 - RNA, 14 nt, Bordetella pertussis
gcggcacgcugcug

SEQ ID NO: 380026 - RNA, 14 nt, Bordetella pertussis
gcggcacggccagc

SEQ ID NO: 380027 - RNA, 17 nt, Bordetella pertussis
gcggcacggccggccug

SEQ ID NO: 380028 - RNA, 19 nt, Bordetella pertussis
gcggcacggccggccugca

SEQ ID NO: 380029 - RNA, 21 nt, Bordetella pertussis
gcggcacggcuggguucaggc

SEQ ID NO: 380030 - RNA, 13 nt, Bordetella pertussis
gcggcacgcugcg

SEQ ID NO: 380031 - RNA, 13 nt, Bordetella pertussis
gcggcacgguggc

SEQ ID NO: 380032 - RNA, 23 nt, Bordetella pertussis
gcggcacgguggcgaaggccgcc

SEQ ID NO: 380033 - RNA, 14 nt, Bordetella pertussis
gcggcacgugccgg

SEQ ID NO: 380034 - RNA, 15 nt, Bordetella pertussis
gcggcacgugccgga

SEQ ID NO: 380035 - RNA, 21 nt, Bordetella pertussis
gcggcacgugccggauggcgc

SEQ ID NO: 380036 - RNA, 17 nt, Bordetella pertussis
gcggcacugaugcuggu

SEQ ID NO: 380037 - RNA, 19 nt, Bordetella pertussis
gcggcagcacgauggcgcc

SEQ ID NO: 380038 - RNA, 22 nt, Bordetella pertussis
gcggcagcacgauggcgcccac

SEQ ID NO: 380039 - RNA, 15 nt, Bordetella pertussis
gcggcagcagcagcg

SEQ ID NO: 380040 - RNA, 20 nt, Bordetella pertussis
gcggcagcagcagcgcgguc

SEQ ID NO: 380041 - RNA, 22 nt, Bordetella pertussis
gcggcagcagggccacgcccag

SEQ ID NO: 380042 - RNA, 12 nt, Bordetella pertussis
gcggcagcacga

SEQ ID NO: 380043 - RNA, 13 nt, Bordetella pertussis
gcggcagccaggu

SEQ ID NO: 380044 - RNA, 14 nt, Bordetella pertussis
gcggcagccaggug

SEQ ID NO: 380045 - RNA, 23 nt, Bordetella pertussis
gcggcagccagguggcgaugccg

SEQ ID NO: 380046 - RNA, 20 nt, Bordetella pertussis
gcggcagcccggcacgucgg

SEQ ID NO: 380047 - RNA, 18 nt, Bordetella pertussis
gcggcagccuggggcgag

SEQ ID NO: 380048 - RNA, 12 nt, Bordetella pertussis
gcggcagcgccg

SEQ ID NO: 380049 - RNA, 13 nt, Bordetella pertussis
gcggcagcgccgc

SEQ ID NO: 380050 - RNA, 16 nt, Bordetella pertussis
gcggcagcgccggguc

SEQ ID NO: 380051 - RNA, 21 nt, Bordetella pertussis
gcggcagcgcgaacggcgggc

SEQ ID NO: 380052 - RNA, 14 nt, Bordetella pertussis
gcggcagcgcaccg

SEQ ID NO: 380053 - RNA, 14 nt, Bordetella pertussis
gcggcagcggccca

SEQ ID NO: 380054 - RNA, 19 nt, Bordetella pertussis
gcggcagcucggcgaagcc

SEQ ID NO: 380055 - RNA, 20 nt, Bordetella pertussis
gcggcagcucggcgaagccg

SEQ ID NO: 380056 - RNA, 23 nt, Bordetella pertussis
gcggcagcucgcgcugcgcgccg

SEQ ID NO: 380057 - RNA, 17 nt, Bordetella pertussis
gcggcaggccccggccc

SEQ ID NO: 380058 - RNA, 18 nt, Bordetella pertussis
gcggcaggccccggcccg

SEQ ID NO: 380059 - RNA, 21 nt, Bordetella pertussis
gcggcaggccccggcccggcg

SEQ ID NO: 380060 - RNA, 12 nt, Bordetella pertussis
gcggcaggccgc

SEQ ID NO: 380061 - RNA, 13 nt, Bordetella pertussis
gcggcaggccgca

SEQ ID NO: 380062 - RNA, 13 nt, Bordetella pertussis
gcggcaggccgcg

SEQ ID NO: 380063 - RNA, 14 nt, Bordetella pertussis
gcggcaggccgcgc

SEQ ID NO: 380064 - RNA, 16 nt, Bordetella pertussis
gcggcaggcgccgccg

SEQ ID NO: 380065 - RNA, 21 nt, Bordetella pertussis
gcggcaggcgccgccgcccgg

SEQ ID NO: 380066 - RNA, 13 nt, Bordetella pertussis
gcggcaggcggca

SEQ ID NO: 380067 - RNA, 18 nt, Bordetella pertussis
gcggcaggcuggccggcg

SEQ ID NO: 380068 - RNA, 23 nt, Bordetella pertussis
gcggcaggcuggccggcguggcc

SEQ ID NO: 380069 - RNA, 18 nt, Bordetella pertussis
gcggcaggggcucgcgcc

SEQ ID NO: 380070 - RNA, 18 nt, Bordetella pertussis
gcggcaggugcgccagca

SEQ ID NO: 380071 - RNA, 21 nt, Bordetella pertussis
gcggcagguucugcgcguccu

SEQ ID NO: 380072 - RNA, 20 nt, Bordetella pertussis
gcggcgaaccgcucagcccu

SEQ ID NO: 380073 - RNA, 13 nt, Bordetella pertussis
gcggcgaaggcgc

SEQ ID NO: 380074 - RNA, 19 nt, Bordetella pertussis
gcggcgaaggcgcggcugc

SEQ ID NO: 380075 - RNA, 22 nt, Bordetella pertussis
gcggcgacacccccagggcgcg

SEQ ID NO: 380076 - RNA, 15 nt, Bordetella pertussis
gcggcgacagcgauu

SEQ ID NO: 380077 - RNA, 16 nt, Bordetella pertussis
gcggcgacagggcguc

SEQ ID NO: 380078 - RNA, 13 nt, Bordetella pertussis
gcggcgaccgcga

SEQ ID NO: 380079 - RNA, 13 nt, Bordetella pertussis
gcggcgaccggcg

SEQ ID NO: 380080 - RNA, 16 nt, Bordetella pertussis
gcggcgaccggcgccg

SEQ ID NO: 380081 - RNA, 22 nt, Bordetella pertussis
gcggcgacgaacccgggcguga

SEQ ID NO: 380082 - RNA, 15 nt, Bordetella pertussis
gcggcgacgaugccg

SEQ ID NO: 380083 - RNA, 14 nt, Bordetella pertussis
gcggcgacggcgcc

SEQ ID NO: 380084 - RNA, 15 nt, Bordetella pertussis
gcggcgacggcgccu

SEQ ID NO: 380085 - RNA, 18 nt, Bordetella pertussis
gcggcgacggcgccuggc

SEQ ID NO: 380086 - RNA, 15 nt, Bordetella pertussis
gcggcgacucggcau

SEQ ID NO: 380087 - RNA, 18 nt, Bordetella pertussis
gcggcgacucggcaucga

SEQ ID NO: 380088 - RNA, 17 nt, Bordetella pertussis
gcggcgacugccccagc

SEQ ID NO: 380089 - RNA, 23 nt, Bordetella pertussis
gcggcgacugccccagcggcugg

SEQ ID NO: 380090 - RNA, 14 nt, Bordetella pertussis
gcggcgagaugccg

SEQ ID NO: 380091 - RNA, 17 nt, Bordetella pertussis
gcggcgagaugccgucg

SEQ ID NO: 380092 - RNA, 18 nt, Bordetella pertussis
gcggcgagcacggccugc

SEQ ID NO: 380093 - RNA, 14 nt, Bordetella pertussis
gcggcgagccgaug

SEQ ID NO: 380094 - RNA, 17 nt, Bordetella pertussis
gcggcgagcgccgccag

SEQ ID NO: 380095 - RNA, 22 nt, Bordetella pertussis
gcggcgagcgccgccaggccgu

SEQ ID NO: 380096 - RNA, 15 nt, Bordetella pertussis
gcggcgagcgcggcg

SEQ ID NO: 380097 - RNA, 15 nt, Bordetella pertussis
gcggcgaggcgucca

SEQ ID NO: 380098 - RNA, 16 nt, Bordetella pertussis
gcggcgauacgcgccg

SEQ ID NO: 380099 - RNA, 20 nt, Bordetella pertussis
gcggcgauacgcgccgccug

SEQ ID NO: 380100 - RNA, 12 nt, Bordetella pertussis
gcggcgauacgg

SEQ ID NO: 380101 - RNA, 14 nt, Bordetella pertussis
gcggcgaucacgcc

SEQ ID NO: 380102 - RNA, 20 nt, Bordetella pertussis
gcggcgauccgccgcggcca

SEQ ID NO: 380103 - RNA, 23 nt, Bordetella pertussis
gcggcgauccgccgcggccagcg

SEQ ID NO: 380104 - RNA, 18 nt, Bordetella pertussis
gcggcgaucucgcgcgcg

SEQ ID NO: 380105 - RNA, 21 nt, Bordetella pertussis
gcggcgaugccccaguccagg

SEQ ID NO: 380106 - RNA, 15 nt, Bordetella pertussis
gcggcgaugccgcug

SEQ ID NO: 380107 - RNA, 18 nt, Bordetella pertussis
gcggcgaugccgcuggcg

SEQ ID NO: 380108 - RNA, 18 nt, Bordetella pertussis
gcggcgaugccgcugucg

SEQ ID NO: 380109 - RNA, 15 nt, Bordetella pertussis
gcggcgaugccggcc

SEQ ID NO: 380110 - RNA, 22 nt, Bordetella pertussis
gcggcgaugccggccagcagcg

SEQ ID NO: 380111 - RNA, 15 nt, Bordetella pertussis
gcggcgaugcaccca

SEQ ID NO: 380112 - RNA, 19 nt, Bordetella pertussis
gcggcgaugcacccaggcg

SEQ ID NO: 380113 - RNA, 21 nt, Bordetella pertussis
gcggcgaugcacccaggcgcc

SEQ ID NO: 380114 - RNA, 23 nt, Bordetella pertussis
gcggcgaugcacccaggcgccga

SEQ ID NO: 380115 - RNA, 13 nt, Bordetella pertussis
gcggcgcagcgcc

SEQ ID NO: 380116 - RNA, 15 nt, Bordetella pertussis
gcggcgcagcgccca

SEQ ID NO: 380117 - RNA, 20 nt, Bordetella pertussis
gcggcgcaggaugcgcuggc

SEQ ID NO: 380118 - RNA, 21 nt, Bordetella pertussis
gcggcgcaggaugcgcuggcc

SEQ ID NO: 380119 - RNA, 17 nt, Bordetella pertussis
gcggcgcaggccagcgc

SEQ ID NO: 380120 - RNA, 18 nt, Bordetella pertussis
gcggcgcaggccagcgcc

SEQ ID NO: 380121 - RNA, 16 nt, Bordetella pertussis
gcggcgcaggccgcgc

SEQ ID NO: 380122 - RNA, 19 nt, Bordetella pertussis
gcggcgauggucuggguga

SEQ ID NO: 380123 - RNA, 13 nt, Bordetella pertussis
gcggcgcaggccu

SEQ ID NO: 380124 - RNA, 15 nt, Bordetella pertussis
gcggcgcaggcgggc

SEQ ID NO: 380125 - RNA, 17 nt, Bordetella pertussis
gcggcgcagguccaccg

SEQ ID NO: 380126 - RNA, 19 nt, Bordetella pertussis
gcggcgcagguccaccgcc

SEQ ID NO: 380127 - RNA, 20 nt, Bordetella pertussis
gcggcgcagguccaccgcca

SEQ ID NO: 380128 - RNA, 14 nt, Bordetella pertussis
gcggcgcaugcagc

SEQ ID NO: 380129 - RNA, 18 nt, Bordetella pertussis
gcggcgcaugcagccgca

SEQ ID NO: 380130 - RNA, 15 nt, Bordetella pertussis
gcggcgcauugccgu

SEQ ID NO: 380131 - RNA, 13 nt, Bordetella pertussis
gcggcgccacgca

SEQ ID NO: 380132 - RNA, 13 nt, Bordetella pertussis
gcggcgccagcgc

SEQ ID NO: 380133 - RNA, 14 nt, Bordetella pertussis
gcggcgccagcgcc

SEQ ID NO: 380134 - RNA, 12 nt, Bordetella pertussis
gcggcgccgccg

SEQ ID NO: 380135 - RNA, 13 nt, Bordetella pertussis
gcggcgccgccgg

SEQ ID NO: 380136 - RNA, 14 nt, Bordetella pertussis
gcggcgccgccggc

SEQ ID NO: 380137 - RNA, 19 nt, Bordetella pertussis
gcggcgccgccggcggccu

SEQ ID NO: 380138 - RNA, 19 nt, Bordetella pertussis
gcggcgccggaucggccgg

SEQ ID NO: 380139 - RNA, 22 nt, Bordetella pertussis
gcggcgccggaucggccggcag

SEQ ID NO: 380140 - RNA, 12 nt, Bordetella pertussis
gcggcgccggca

SEQ ID NO: 380141 - RNA, 12 nt, Bordetella pertussis
gcggcgccggcc

SEQ ID NO: 380142 - RNA, 13 nt, Bordetella pertussis
gcggcgccgcugg

SEQ ID NO: 380143 - RNA, 21 nt, Bordetella pertussis
gcggcgccggccgucauccac

SEQ ID NO: 380144 - RNA, 20 nt, Bordetella pertussis
gcggcgccggugaccgccag

SEQ ID NO: 380145 - RNA, 16 nt, Bordetella pertussis
gcggcgccguccagcg

SEQ ID NO: 380146 - RNA, 17 nt, Bordetella pertussis
gcggcgccguccagcgc

SEQ ID NO: 380147 - RNA, 18 nt, Bordetella pertussis
gcggcgccguccagcgcg

SEQ ID NO: 380148 - RNA, 19 nt, Bordetella pertussis
gcggcgccggugcgcggcg

SEQ ID NO: 380149 - RNA, 18 nt, Bordetella pertussis
gcggcgccugggccuucu

SEQ ID NO: 380150 - RNA, 13 nt, Bordetella pertussis
gcggcgccugguc

SEQ ID NO: 380151 - RNA, 18 nt, Bordetella pertussis
gcggcgccugucccgcug

SEQ ID NO: 380152 - RNA, 20 nt, Bordetella pertussis
gcggcgccugucccgcuggg

SEQ ID NO: 380153 - RNA, 12 nt, Bordetella pertussis
gcggcgccugcg

SEQ ID NO: 380154 - RNA, 17 nt, Bordetella pertussis
gcggcgccugcgcgcgc

SEQ ID NO: 380155 - RNA, 14 nt, Bordetella pertussis
gcggcgcgagcgca

SEQ ID NO: 380156 - RNA, 17 nt, Bordetella pertussis
gcggcgcgagcgcacag

SEQ ID NO: 380157 - RNA, 15 nt, Bordetella pertussis
gcggcgcucaucauc

SEQ ID NO: 380158 - RNA, 22 nt, Bordetella pertussis
gcggcgcucaucaucgcgcugg

SEQ ID NO: 380159 - RNA, 21 nt, Bordetella pertussis
gcggcgcucgaaggcgccgac

SEQ ID NO: 380160 - RNA, 23 nt, Bordetella pertussis
gcggcgcugcacgcggccgcgca

SEQ ID NO: 380161 - RNA, 13 nt, Bordetella pertussis
gcggcgcugcugg

SEQ ID NO: 380162 - RNA, 24 nt, Bordetella pertussis
gcggcgcuggccugccgcgccgac

SEQ ID NO: 380163 - RNA, 18 nt, Bordetella pertussis
gcggcgcuggcgaagaac

SEQ ID NO: 380164 - RNA, 17 nt, Bordetella pertussis
gcggcgcuggcgaugcg

SEQ ID NO: 380165 - RNA, 12 nt, Bordetella pertussis
gcggcgcuggcu

SEQ ID NO: 380166 - RNA, 13 nt, Bordetella pertussis
gcggcgcuggcug

SEQ ID NO: 380167 - RNA, 14 nt, Bordetella pertussis
gcggcgcuggucaa

SEQ ID NO: 380168 - RNA, 18 nt, Bordetella pertussis
gcggcgcuuaccgcgccg

SEQ ID NO: 380169 - RNA, 20 nt, Bordetella pertussis
gcggcgcuuaccgcgccggc

SEQ ID NO: 380170 - RNA, 17 nt, Bordetella pertussis
gcggcgcuuggcguagc

SEQ ID NO: 380171 - RNA, 15 nt, Bordetella pertussis
gcggcggacugcgcc

SEQ ID NO: 380172 - RNA, 14 nt, Bordetella pertussis
gcggcgguagcgcu

SEQ ID NO: 380173 - RNA, 16 nt, Bordetella pertussis
gcggcggugccagcgc

SEQ ID NO: 380174 - RNA, 17 nt, Bordetella pertussis
gcggcggugccagcgca

SEQ ID NO: 380175 - RNA, 13 nt, Bordetella pertussis
gcggcggugccgc

SEQ ID NO: 380176 - RNA, 14 nt, Bordetella pertussis
gcggcggugccugu

SEQ ID NO: 380177 - RNA, 19 nt, Bordetella pertussis
gcggcgguucguccucguc

SEQ ID NO: 380178 - RNA, 22 nt, Bordetella pertussis
gcggcgguuucguagaugggca

SEQ ID NO: 380179 - RNA, 18 nt, Bordetella pertussis
gcggcgguuucggccggg

SEQ ID NO: 380180 - RNA, 14 nt, Bordetella pertussis
gcggcguccugccg

SEQ ID NO: 380181 - RNA, 16 nt, Bordetella pertussis
gcggcguccugccgcg

SEQ ID NO: 380182 - RNA, 19 nt, Bordetella pertussis
gcggcguccugccgcgacc

SEQ ID NO: 380183 - RNA, 20 nt, Bordetella pertussis
gcggcgucgaccgcgggcgc

SEQ ID NO: 380184 - RNA, 19 nt, Bordetella pertussis
gcggcgucgacgcccgcgc

SEQ ID NO: 380185 - RNA, 22 nt, Bordetella pertussis
gcggcgucgacgcccgcgccca

SEQ ID NO: 380186 - RNA, 14 nt, Bordetella pertussis
gcggcgucgaucgg

SEQ ID NO: 380187 - RNA, 21 nt, Bordetella pertussis
gcggcgucgaucggcgcgccc

SEQ ID NO: 380188 - RNA, 13 nt, Bordetella pertussis
gcggcgucgcgcu

SEQ ID NO: 380189 - RNA, 14 nt, Bordetella pertussis
gcggcgucgcuggc

SEQ ID NO: 380190 - RNA, 15 nt, Bordetella pertussis
gcggcgucgcuggca

SEQ ID NO: 380191 - RNA, 18 nt, Bordetella pertussis
gcggcgucgcuggcagcc

SEQ ID NO: 380192 - RNA, 19 nt, Bordetella pertussis
gcggcgucgcuggcagccu

SEQ ID NO: 380193 - RNA, 14 nt, Bordetella pertussis
gcggcgucggcgcc

SEQ ID NO: 380194 - RNA, 16 nt, Bordetella pertussis
gcggcgucggcgcccg

SEQ ID NO: 380195 - RNA, 14 nt, Bordetella pertussis
gcggcuaggcgcag

SEQ ID NO: 380196 - RNA, 21 nt, Bordetella pertussis
gcggcuaggcgcagcaggcca

SEQ ID NO: 380197 - RNA, 22 nt, Bordetella pertussis
gcggcuaggcgcagcaggccag

SEQ ID NO: 380198 - RNA, 17 nt, Bordetella pertussis
gcggcuauugccagggg

SEQ ID NO: 380199 - RNA, 15 nt, Bordetella pertussis
gcggcucaggcgcgg

SEQ ID NO: 380200 - RNA, 17 nt, Bordetella pertussis
gcggcuccagcucagca

SEQ ID NO: 380201 - RNA, 20 nt, Bordetella pertussis
gcggcuccagcucagcagcg

SEQ ID NO: 380202 - RNA, 22 nt, Bordetella pertussis
gcggcucuggaucgugcccagc

SEQ ID NO: 380203 - RNA, 22 nt, Bordetella pertussis
gcggcugaagaagcccggcugc

SEQ ID NO: 380204 - RNA, 23 nt, Bordetella pertussis
gcggcugaagaagcccggcugcu

SEQ ID NO: 380205 - RNA, 16 nt, Bordetella pertussis
gcggcugaucaccgcc

SEQ ID NO: 380206 - RNA, 18 nt, Bordetella pertussis
gcggcugaucaccgccgg

SEQ ID NO: 380207 - RNA, 13 nt, Bordetella pertussis
gcggcugccgaua

SEQ ID NO: 380208 - RNA, 14 nt, Bordetella pertussis
gcggcugcccgggc

SEQ ID NO: 380209 - RNA, 17 nt, Bordetella pertussis
gcggcugcccgggcugc

SEQ ID NO: 380210 - RNA, 15 nt, Bordetella pertussis
gcggcugcgggccgg

SEQ ID NO: 380211 - RNA, 16 nt, Bordetella pertussis
gcggcugcgggccggc

SEQ ID NO: 380212 - RNA, 18 nt, Bordetella pertussis
gcggcugcgggccggcgc

SEQ ID NO: 380213 - RNA, 20 nt, Bordetella pertussis
gcggcugcgggccggcgccg

SEQ ID NO: 380214 - RNA, 19 nt, Bordetella pertussis
gcggcugcuggaacggugc

SEQ ID NO: 380215 - RNA, 14 nt, Bordetella pertussis
gcggcugcuggccc

SEQ ID NO: 380216 - RNA, 19 nt, Bordetella pertussis
gcggcuggccacuggccgc

SEQ ID NO: 380217 - RNA, 23 nt, Bordetella pertussis
gcggcuggcgaucaccgacagcg

SEQ ID NO: 380218 - RNA, 15 nt, Bordetella pertussis
gcggcuggcgauggu

SEQ ID NO: 380219 - RNA, 22 nt, Bordetella pertussis
gcggcuggcgaugguggauccg

SEQ ID NO: 380220 - RNA, 16 nt, Bordetella pertussis
gcggcuggcgcggccg

SEQ ID NO: 380221 - RNA, 23 nt, Bordetella pertussis
gcggcuggggcugcugggccggc

SEQ ID NO: 380222 - RNA, 15 nt, Bordetella pertussis
gcggcuggucaacuc

SEQ ID NO: 380223 - RNA, 21 nt, Bordetella pertussis
gcggcuggugccgacggcgcg

SEQ ID NO: 380224 - RNA, 16 nt, Bordetella pertussis
gcggcuguagucgccg

SEQ ID NO: 380225 - RNA, 19 nt, Bordetella pertussis
gcggcuguagucgccgcug

SEQ ID NO: 380226 - RNA, 20 nt, Bordetella pertussis
gcggcuguagucgccgcugc

SEQ ID NO: 380227 - RNA, 17 nt, Bordetella pertussis
gcggcugguggugccgc

SEQ ID NO: 380228 - RNA, 22 nt, Bordetella pertussis
gcggcugguggugccgcgcacg

SEQ ID NO: 380229 - RNA, 16 nt, Bordetella pertussis
gcggcugucgggcggc

SEQ ID NO: 380230 - RNA, 18 nt, Bordetella pertussis
gcggcugucgggcggcgc

SEQ ID NO: 380231 - RNA, 18 nt, Bordetella pertussis
gcggcuguugggcaaggu

SEQ ID NO: 380232 - RNA, 22 nt, Bordetella pertussis
gcggcuuucaugggccugggcg

SEQ ID NO: 380233 - RNA, 19 nt, Bordetella pertussis
gcggcuuucgccggaggcg

SEQ ID NO: 380234 - RNA, 16 nt, Bordetella pertussis
gcgggaacaggcaccg

SEQ ID NO: 380235 - RNA, 14 nt, Bordetella pertussis
gcgggaucugcaug

SEQ ID NO: 380236 - RNA, 18 nt, Bordetella pertussis
gcgggauucugcugcaug

SEQ ID NO: 380237 - RNA, 19 nt, Bordetella pertussis
gcgggcaaacggcggcagg

SEQ ID NO: 380238 - RNA, 20 nt, Bordetella pertussis
gcgggcaaacggcggcaggc

SEQ ID NO: 380239 - RNA, 22 nt, Bordetella pertussis
gcgggcaaacggcggcaggccg

SEQ ID NO: 380240 - RNA, 17 nt, Bordetella pertussis
gcgggcaaagcccagca

SEQ ID NO: 380241 - RNA, 22 nt, Bordetella pertussis
gcgggcaauuuuguugauggcg

SEQ ID NO: 380242 - RNA, 18 nt, Bordetella pertussis
gcgggcacaacccgcccg

SEQ ID NO: 380243 - RNA, 19 nt, Bordetella pertussis
gcgggcacaacccgcccgg

SEQ ID NO: 380244 - RNA, 17 nt, Bordetella pertussis
gcgggcacgagaucgcc

SEQ ID NO: 380245 - RNA, 15 nt, Bordetella pertussis
gcgggccacgccggc

SEQ ID NO: 380246 - RNA, 16 nt, Bordetella pertussis
gcgggccacgccggcc

SEQ ID NO: 380247 - RNA, 21 nt, Bordetella pertussis
gcgggccacugcgccugggcg

SEQ ID NO: 380248 - RNA, 20 nt, Bordetella pertussis
gcgggccaugucggcuucgg

SEQ ID NO: 380249 - RNA, 14 nt, Bordetella pertussis
gcgggccaggccgg

SEQ ID NO: 380250 - RNA, 19 nt, Bordetella pertussis
gcgggccaggccggcccag

SEQ ID NO: 380251 - RNA, 18 nt, Bordetella pertussis
gcgggcgugaugccgacc

SEQ ID NO: 380252 - RNA, 21 nt, Bordetella pertussis
gcgggcucgagcuggcuggcc

SEQ ID NO: 380253 - RNA, 12 nt, Bordetella pertussis
gcggggacuggc

SEQ ID NO: 380254 - RNA, 18 nt, Bordetella pertussis
gcggggacuggcaccagg

SEQ ID NO: 380255 - RNA, 21 nt, Bordetella pertussis
gcggggacuggcucccaccgg

SEQ ID NO: 380256 - RNA, 17 nt, Bordetella pertussis
gcggggcaggccgaugu

SEQ ID NO: 380257 - RNA, 17 nt, Bordetella pertussis
gcggggccgcgccggcu

SEQ ID NO: 380258 - RNA, 16 nt, Bordetella pertussis
gcggggccgugacgug

SEQ ID NO: 380259 - RNA, 23 nt, Bordetella pertussis
gcggggcgcccagcgcgucggcc

SEQ ID NO: 380260 - RNA, 16 nt, Bordetella pertussis
gcggggcgugagcagg

SEQ ID NO: 380261 - RNA, 14 nt, Bordetella pertussis
gcggggcuggcgcg

SEQ ID NO: 380262 - RNA, 17 nt, Bordetella pertussis
gcggggcuggcgcggcu

SEQ ID NO: 380263 - RNA, 16 nt, Bordetella pertussis
gcggggucugcaggug

SEQ ID NO: 380264 - RNA, 14 nt, Bordetella pertussis
gcggguaaugccgg

SEQ ID NO: 380265 - RNA, 23 nt, Bordetella pertussis
gcggguauucgaaggcagcaccg

SEQ ID NO: 380266 - RNA, 19 nt, Bordetella pertussis
gcgggucccaaccagggcc

SEQ ID NO: 380267 - RNA, 23 nt, Bordetella pertussis
gcgggucccaaccagggccgcca

SEQ ID NO: 380268 - RNA, 13 nt, Bordetella pertussis
gcggguccagcag

SEQ ID NO: 380269 - RNA, 14 nt, Bordetella pertussis
gcggguccagcagg

SEQ ID NO: 380270 - RNA, 17 nt, Bordetella pertussis
gcggguccggcgugcca

SEQ ID NO: 380271 - RNA, 13 nt, Bordetella pertussis
gcggguccuugcc

SEQ ID NO: 380272 - RNA, 22 nt, Bordetella pertussis
gcgggucgaguugcgcgccaug

SEQ ID NO: 380273 - RNA, 14 nt, Bordetella pertussis
gcgggucggcgcca

SEQ ID NO: 380274 - RNA, 16 nt, Bordetella pertussis
gcgggucgucccagcg

SEQ ID NO: 380275 - RNA, 19 nt, Bordetella pertussis
gcgggucuugagcggcccg

SEQ ID NO: 380276 - RNA, 23 nt, Bordetella pertussis
gcgggugaugcugcagcgcaucg

SEQ ID NO: 380277 - RNA, 15 nt, Bordetella pertussis
gcgggugccaguccc

SEQ ID NO: 380278 - RNA, 14 nt, Bordetella pertussis
gcgggugcgcagca

SEQ ID NO: 380279 - RNA, 17 nt, Bordetella pertussis
gcgggugcugcagcgca

SEQ ID NO: 380280 - RNA, 13 nt, Bordetella pertussis
gcggguggccgau

SEQ ID NO: 380281 - RNA, 22 nt, Bordetella pertussis
gcggguggccgauuccagcgcc

SEQ ID NO: 380282 - RNA, 18 nt, Bordetella pertussis
gcggguggccggaucgag

SEQ ID NO: 380283 - RNA, 22 nt, Bordetella pertussis
gcggguggccggaucgagcgcg

SEQ ID NO: 380284 - RNA, 23 nt, Bordetella pertussis
gcggguggccucgcccuggcgca

SEQ ID NO: 380285 - RNA, 21 nt, Bordetella pertussis
gcgggugggcauccagcggca

SEQ ID NO: 380286 - RNA, 13 nt, Bordetella pertussis
gcgggugucccag

SEQ ID NO: 380287 - RNA, 17 nt, Bordetella pertussis
gcggguguugucaugcg

SEQ ID NO: 380288 - RNA, 14 nt, Bordetella pertussis
gcggguucguggcu

SEQ ID NO: 380289 - RNA, 20 nt, Bordetella pertussis
gcggguugcggcagcgccgc

SEQ ID NO: 380290 - RNA, 18 nt, Bordetella pertussis
gcggguuggucgucagcg

SEQ ID NO: 380291 - RNA, 22 nt, Bordetella pertussis
gcggguuggucgucagcgccgc

SEQ ID NO: 380292 - RNA, 19 nt, Bordetella pertussis
gcggguugugcccgcccgg

SEQ ID NO: 380293 - RNA, 19 nt, Bordetella pertussis
gcggguuucucggccuugg

SEQ ID NO: 380294 - RNA, 21 nt, Bordetella pertussis
gcggguuucucggccuugggc

SEQ ID NO: 380295 - RNA, 16 nt, Bordetella pertussis
gcgguaagcguccgcg

SEQ ID NO: 380296 - RNA, 21 nt, Bordetella pertussis
gcgguaagcguccgcgcgccg

SEQ ID NO: 380297 - RNA, 18 nt, Bordetella pertussis
gcgguaaugacgcagccg

SEQ ID NO: 380298 - RNA, 14 nt, Bordetella pertussis
gcgguacaggccgg

SEQ ID NO: 380299 - RNA, 15 nt, Bordetella pertussis
gcgguacaggccggc

SEQ ID NO: 380300 - RNA, 22 nt, Bordetella pertussis
gcgguacaggcugccgucggcc

SEQ ID NO: 380301 - RNA, 19 nt, Bordetella pertussis
gcgguacaggucguagacc

SEQ ID NO: 380302 - RNA, 12 nt, Bordetella pertussis
gcgguaccacgc

SEQ ID NO: 380303 - RNA, 20 nt, Bordetella pertussis
gcgguaccaggccgagaugu

SEQ ID NO: 380304 - RNA, 15 nt, Bordetella pertussis
gcgguacgcaccgcc

SEQ ID NO: 380305 - RNA, 17 nt, Bordetella pertussis
gcgguacgcaccgccgc

SEQ ID NO: 380306 - RNA, 12 nt, Bordetella pertussis
gcgguacgccca

SEQ ID NO: 380307 - RNA, 17 nt, Bordetella pertussis
gcgguacucgcgcgggu

SEQ ID NO: 380308 - RNA, 17 nt, Bordetella pertussis
gcgguagacgccgggac

SEQ ID NO: 380309 - RNA, 20 nt, Bordetella pertussis
gcgguagcgcucguccaugc

SEQ ID NO: 380310 - RNA, 15 nt, Bordetella pertussis
gcgguaggacggcag

SEQ ID NO: 380311 - RNA, 16 nt, Bordetella pertussis
gcgguaggacggcagc

SEQ ID NO: 380312 - RNA, 17 nt, Bordetella pertussis
gcgguaggacggcagca

SEQ ID NO: 380313 - RNA, 22 nt, Bordetella pertussis
gcgguaggacggcagcaccgcc

SEQ ID NO: 380314 - RNA, 16 nt, Bordetella pertussis
gcgguaguagaccgcg

SEQ ID NO: 380315 - RNA, 19 nt, Bordetella pertussis
gcgguaguccaucgcgucc

SEQ ID NO: 380316 - RNA, 13 nt, Bordetella pertussis
gcgguaugcggcg

SEQ ID NO: 380317 - RNA, 22 nt, Bordetella pertussis
gcgguaugcggcgcccaggccc

SEQ ID NO: 380318 - RNA, 21 nt, Bordetella pertussis
gcgguauucgcgcuggcgcga

SEQ ID NO: 380319 - RNA, 21 nt, Bordetella pertussis
gcgguauucgcugcuggccgc

SEQ ID NO: 380320 - RNA, 22 nt, Bordetella pertussis
gcgguauucgcugcuggccgcg

SEQ ID NO: 380321 - RNA, 16 nt, Bordetella pertussis
gcgguauugcgccacc

SEQ ID NO: 380322 - RNA, 17 nt, Bordetella pertussis
gcgguccacgccggguu

SEQ ID NO: 380323 - RNA, 22 nt, Bordetella pertussis
gcgguccacgccggguugcggc

SEQ ID NO: 380324 - RNA, 17 nt, Bordetella pertussis
gcgguccagcaaggcgu

SEQ ID NO: 380325 - RNA, 21 nt, Bordetella pertussis
gcgguccagcaccagggcgcg

SEQ ID NO: 380326 - RNA, 16 nt, Bordetella pertussis
gcgguccagcugcgcg

SEQ ID NO: 380327 - RNA, 23 nt, Bordetella pertussis
gcgguccauggugaugcugucgc

SEQ ID NO: 380328 - RNA, 15 nt, Bordetella pertussis
gcgguccgcagcgcu

SEQ ID NO: 380329 - RNA, 22 nt, Bordetella pertussis
gcggucgaggcgcaguccagcg

SEQ ID NO: 380330 - RNA, 23 nt, Bordetella pertussis
gcggucgaggcgcaguccagcgu

SEQ ID NO: 380331 - RNA, 18 nt, Bordetella pertussis
gcggucgaugaccucgcg

SEQ ID NO: 380332 - RNA, 16 nt, Bordetella pertussis
gcggucgaugcgcacg

SEQ ID NO: 380333 - RNA, 18 nt, Bordetella pertussis
gcggucgaugcgcacgcc

SEQ ID NO: 380334 - RNA, 17 nt, Bordetella pertussis
gcggucgauguccagcg

SEQ ID NO: 380335 - RNA, 19 nt, Bordetella pertussis
gcggucgauguccagcgcc

SEQ ID NO: 380336 - RNA, 22 nt, Bordetella pertussis
gcggucgcauuggccgccgcca

SEQ ID NO: 380337 - RNA, 17 nt, Bordetella pertussis
gcggucgccgcggucgc

SEQ ID NO: 380338 - RNA, 19 nt, Bordetella pertussis
gcggucgccgcggucgcag

SEQ ID NO: 380339 - RNA, 20 nt, Bordetella pertussis
gcggucugggcgucccaggc

SEQ ID NO: 380340 - RNA, 23 nt, Bordetella pertussis
gcggucuucacauagcccggcgc

SEQ ID NO: 380341 - RNA, 16 nt, Bordetella pertussis
gcggugaaggcgcccg

SEQ ID NO: 380342 - RNA, 17 nt, Bordetella pertussis
gcggugaccaccaggcc

SEQ ID NO: 380343 - RNA, 22 nt, Bordetella pertussis
gcggugaccaccaggccgccua

SEQ ID NO: 380344 - RNA, 18 nt, Bordetella pertussis
gcggugaccaugcgcacc

SEQ ID NO: 380345 - RNA, 20 nt, Bordetella pertussis
gcggugaccaugcgcaccga

SEQ ID NO: 380346 - RNA, 20 nt, Bordetella pertussis
gcggugcaucucggcaucgg

SEQ ID NO: 380347 - RNA, 15 nt, Bordetella pertussis
gcggugcccuugcuc

SEQ ID NO: 380348 - RNA, 15 nt, Bordetella pertussis
gcggugccgcccacc

SEQ ID NO: 380349 - RNA, 16 nt, Bordetella pertussis
gcggugccgcccaccg

SEQ ID NO: 380350 - RNA, 14 nt, Bordetella pertussis
gcggugccgcgcac

SEQ ID NO: 380351 - RNA, 15 nt, Bordetella pertussis
gcggugccgcgcacc

SEQ ID NO: 380352 - RNA, 20 nt, Bordetella pertussis
gcggugccgcgcgcggccgg

SEQ ID NO: 380353 - RNA, 16 nt, Bordetella pertussis
gcggugccgccuggcc

SEQ ID NO: 380354 - RNA, 13 nt, Bordetella pertussis
gcggugccgcgca

SEQ ID NO: 380355 - RNA, 20 nt, Bordetella pertussis
gcgguggcgguuggugucgc

SEQ ID NO: 380356 - RNA, 17 nt, Bordetella pertussis
gcgguggcguuggccug

SEQ ID NO: 380357 - RNA, 22 nt, Bordetella pertussis
gcgguggcguuggccugccauc

SEQ ID NO: 380358 - RNA, 18 nt, Bordetella pertussis
gcgguggcuuggcgcagg

SEQ ID NO: 380359 - RNA, 19 nt, Bordetella pertussis
gcgguggcuuggcgcagga

SEQ ID NO: 380360 - RNA, 16 nt, Bordetella pertussis
gcggugggcagcggca

SEQ ID NO: 380361 - RNA, 16 nt, Bordetella pertussis
gcggugggcagggcgg

SEQ ID NO: 380362 - RNA, 19 nt, Bordetella pertussis
gcgguggggcgcaaaagca

SEQ ID NO: 380363 - RNA, 16 nt, Bordetella pertussis
gcggugggucucggcg

SEQ ID NO: 380364 - RNA, 19 nt, Bordetella pertussis
gcggugguccagauugcgc

SEQ ID NO: 380365 - RNA, 14 nt, Bordetella pertussis
gcgguucagggugg

SEQ ID NO: 380366 - RNA, 20 nt, Bordetella pertussis
gcgguucaggguggccgcga

SEQ ID NO: 380367 - RNA, 22 nt, Bordetella pertussis
gcgguucgccgugcagggccag

SEQ ID NO: 380368 - RNA, 21 nt, Bordetella pertussis
gcgguucugggcccgaucgcc

SEQ ID NO: 380369 - RNA, 23 nt, Bordetella pertussis
gcgguucugggcccgaucgccgg

SEQ ID NO: 380370 - RNA, 19 nt, Bordetella pertussis
gcgguuguugcccaccgcc

SEQ ID NO: 380371 - RNA, 22 nt, Bordetella pertussis
gcgguuucuuccagcagggcgg

SEQ ID NO: 380372 - RNA, 20 nt, Bordetella pertussis
gcgguuugcaggaucuccgc

SEQ ID NO: 380373 - RNA, 18 nt, Bordetella pertussis
gcgguuugguagcaggcg

SEQ ID NO: 380374 - RNA, 22 nt, Bordetella pertussis
gcgguuugguagcaggcgcgcu

SEQ ID NO: 380375 - RNA, 20 nt, Bordetella pertussis
gcgguuuuucuuuggccgcg

SEQ ID NO: 380376 - RNA, 20 nt, Bordetella pertussis
gcgguuuuuucuugccggcc

SEQ ID NO: 380377 - RNA, 22 nt, Bordetella pertussis
gcguccgcccgcuccaccagca

SEQ ID NO: 380378 - RNA, 16 nt, Bordetella pertussis
gcguccgcgucgccgc

SEQ ID NO: 380379 - RNA, 14 nt, Bordetella pertussis
gcguccgcucaugc

SEQ ID NO: 380380 - RNA, 23 nt, Bordetella pertussis
gcguccgcucaugccggcaagca

SEQ ID NO: 380381 - RNA, 13 nt, Bordetella pertussis
gcguccggcgccc

SEQ ID NO: 380382 - RNA, 14 nt, Bordetella pertussis
gcguccggcgcgcg

SEQ ID NO: 380383 - RNA, 15 nt, Bordetella pertussis
gcguccggcgcgcgc

SEQ ID NO: 380384 - RNA, 16 nt, Bordetella pertussis
gcguccucggccagcc

SEQ ID NO: 380385 - RNA, 15 nt, Bordetella pertussis
gcguccucggccugg

SEQ ID NO: 380386 - RNA, 16 nt, Bordetella pertussis
gcguccucggccuggc

SEQ ID NO: 380387 - RNA, 13 nt, Bordetella pertussis
gcguccugccagu

SEQ ID NO: 380388 - RNA, 21 nt, Bordetella pertussis
gcguccugccaguugccgccg

SEQ ID NO: 380389 - RNA, 15 nt, Bordetella pertussis
gcguccugcggcggc

SEQ ID NO: 380390 - RNA, 13 nt, Bordetella pertussis
gcguccuggcgcg

SEQ ID NO: 380391 - RNA, 14 nt, Bordetella pertussis
gcguccuuggcggc

SEQ ID NO: 380392 - RNA, 16 nt, Bordetella pertussis
gcgucgaaacgcugcg

SEQ ID NO: 380393 - RNA, 18 nt, Bordetella pertussis
gcgucgaaacgcugcgcg

SEQ ID NO: 380394 - RNA, 23 nt, Bordetella pertussis
gcgucgaaauaggaucccggcgc

SEQ ID NO: 380395 - RNA, 15 nt, Bordetella pertussis
gcgucgaacggccgg

SEQ ID NO: 380396 - RNA, 16 nt, Bordetella pertussis
gcgucgaaggcggccg

SEQ ID NO: 380397 - RNA, 20 nt, Bordetella pertussis
gcgucgaagguuucgcugcg

SEQ ID NO: 380398 - RNA, 18 nt, Bordetella pertussis
gcgucgaaugcacgggcg

SEQ ID NO: 380399 - RNA, 21 nt, Bordetella pertussis
gcgucgaaugcacgggcgcug

SEQ ID NO: 380400 - RNA, 23 nt, Bordetella pertussis
gcgucgaaugcacgggcgcugcc

SEQ ID NO: 380401 - RNA, 14 nt, Bordetella pertussis
gcgucgaccgccau

SEQ ID NO: 380402 - RNA, 18 nt, Bordetella pertussis
gcgucgaccgccaugcgc

SEQ ID NO: 380403 - RNA, 22 nt, Bordetella pertussis
gcgucgaccgcgggcgcgcgcc

SEQ ID NO: 380404 - RNA, 18 nt, Bordetella pertussis
gcgucgacggugcgcgcc

SEQ ID NO: 380405 - RNA, 23 nt, Bordetella pertussis
gcgucgacggugcgcgccacggc

SEQ ID NO: 380406 - RNA, 24 nt, Bordetella pertussis
gcgucgacggugcgcgccacggcg

SEQ ID NO: 380407 - RNA, 17 nt, Bordetella pertussis
gcgucgacguaccaagc

SEQ ID NO: 380408 - RNA, 13 nt, Bordetella pertussis
gcgucgacgcccg

SEQ ID NO: 380409 - RNA, 21 nt, Bordetella pertussis
gcgucgacgcccgcgcccagu

SEQ ID NO: 380410 - RNA, 16 nt, Bordetella pertussis
gcgucgagcacgcggc

SEQ ID NO: 380411 - RNA, 22 nt, Bordetella pertussis
gcgucgagcacgcggcgcggca

SEQ ID NO: 380412 - RNA, 15 nt, Bordetella pertussis
gcgucgagcagcgca

SEQ ID NO: 380413 - RNA, 16 nt, Bordetella pertussis
gcgucgagcaggccgg

SEQ ID NO: 380414 - RNA, 18 nt, Bordetella pertussis
gcgucgagcaggccggcg

SEQ ID NO: 380415 - RNA, 14 nt, Bordetella pertussis
gcgucgagcugacg

SEQ ID NO: 380416 - RNA, 15 nt, Bordetella pertussis
gcgucgagcugacga

SEQ ID NO: 380417 - RNA, 18 nt, Bordetella pertussis
gcgucgagcggcguguga

SEQ ID NO: 380418 - RNA, 15 nt, Bordetella pertussis
gcgucgaucagcgcg

SEQ ID NO: 380419 - RNA, 13 nt, Bordetella pertussis
gcgucgauccggc

SEQ ID NO: 380420 - RNA, 17 nt, Bordetella pertussis
gcgucgauccggcagca

SEQ ID NO: 380421 - RNA, 18 nt, Bordetella pertussis
gcgucgauccggcagcag

SEQ ID NO: 380422 - RNA, 21 nt, Bordetella pertussis
gcgucgauccggcagcagcag

SEQ ID NO: 380423 - RNA, 14 nt, Bordetella pertussis
gcgucgaucggcgc

SEQ ID NO: 380424 - RNA, 20 nt, Bordetella pertussis
gcgucgaugaaauauugggc

SEQ ID NO: 380425 - RNA, 14 nt, Bordetella pertussis
gcgucgaugcgcgc

SEQ ID NO: 380426 - RNA, 15 nt, Bordetella pertussis
gcgucgaugcgcgcg

SEQ ID NO: 380427 - RNA, 20 nt, Bordetella pertussis
gcgucgaugcgcgcgcggau

SEQ ID NO: 380428 - RNA, 18 nt, Bordetella pertussis
gcgucgauggcguacagc

SEQ ID NO: 380429 - RNA, 19 nt, Bordetella pertussis
gcgucgauuucgucgagcu

SEQ ID NO: 380430 - RNA, 22 nt, Bordetella pertussis
gcgucgcacuggguggccagcg

SEQ ID NO: 380431 - RNA, 23 nt, Bordetella pertussis
gcgucgcacuggguggccagcgc

SEQ ID NO: 380432 - RNA, 16 nt, Bordetella pertussis
gcgucgcgcgaucagg

SEQ ID NO: 380433 - RNA, 14 nt, Bordetella pertussis
gcgucgcgcgccag

SEQ ID NO: 380434 - RNA, 16 nt, Bordetella pertussis
gcgucgcgcgccaggc

SEQ ID NO: 380435 - RNA, 13 nt, Bordetella pertussis
gcgucgcgcggcg

SEQ ID NO: 380436 - RNA, 15 nt, Bordetella pertussis
gcgucgcgcggcggc

SEQ ID NO: 380437 - RNA, 17 nt, Bordetella pertussis
gcgucgcguagcgcggc

SEQ ID NO: 380438 - RNA, 18 nt, Bordetella pertussis
gcgucgcguagcgcggcc

SEQ ID NO: 380439 - RNA, 17 nt, Bordetella pertussis
gcgucgcucaggguacg

SEQ ID NO: 380440 - RNA, 23 nt, Bordetella pertussis
gcgucgcucauggaggggcgcag

SEQ ID NO: 380441 - RNA, 13 nt, Bordetella pertussis
gcgucgcugcgcg

SEQ ID NO: 380442 - RNA, 13 nt, Bordetella pertussis
gcgucgcugcugg

SEQ ID NO: 380443 - RNA, 14 nt, Bordetella pertussis
gcgucgcuggccgg

SEQ ID NO: 380444 - RNA, 14 nt, Bordetella pertussis
gcgucggcgcccgg

SEQ ID NO: 380445 - RNA, 21 nt, Bordetella pertussis
gcgucggcgcccggcgccgcg

SEQ ID NO: 380446 - RNA, 13 nt, Bordetella pertussis
gcgucggcgccga

SEQ ID NO: 380447 - RNA, 18 nt, Bordetella pertussis
gcgucggcggcccacagc

SEQ ID NO: 380448 - RNA, 14 nt, Bordetella pertussis
gcgucggcgcgcgc

SEQ ID NO: 380449 - RNA, 16 nt, Bordetella pertussis
gcgucggcgcgcgcga

SEQ ID NO: 380450 - RNA, 18 nt, Bordetella pertussis
gcgucggcgcgcgcgacu

SEQ ID NO: 380451 - RNA, 19 nt, Bordetella pertussis
gcgucggcgcgcgcgacuc

SEQ ID NO: 380452 - RNA, 22 nt, Bordetella pertussis
gcgucggcguaaggccgccggc

SEQ ID NO: 380453 - RNA, 13 nt, Bordetella pertussis
gcgucguccagcu

SEQ ID NO: 380454 - RNA, 19 nt, Bordetella pertussis
gcgucguccguggccggcg

SEQ ID NO: 380455 - RNA, 15 nt, Bordetella pertussis
gcgucgugcccgcca

SEQ ID NO: 380456 - RNA, 21 nt, Bordetella pertussis
gcgucgugcccgccacccagg

SEQ ID NO: 380457 - RNA, 13 nt, Bordetella pertussis
gcgucuccacgcc

SEQ ID NO: 380458 - RNA, 18 nt, Bordetella pertussis
gcgucuccacgccgccga

SEQ ID NO: 380459 - RNA, 22 nt, Bordetella pertussis
gcgucuccacgccgccgaccuc

SEQ ID NO: 380460 - RNA, 15 nt, Bordetella pertussis
gcgucuccagcgcgg

SEQ ID NO: 380461 - RNA, 21 nt, Bordetella pertussis
gcgugacgcgcggguccaggc

SEQ ID NO: 380462 - RNA, 22 nt, Bordetella pertussis
gcgugacgcgcggguccaggcc

SEQ ID NO: 380463 - RNA, 15 nt, Bordetella pertussis
gcgugacggccgcca

SEQ ID NO: 380464 - RNA, 18 nt, Bordetella pertussis
gcgugacgauauccaggc

SEQ ID NO: 380465 - RNA, 14 nt, Bordetella pertussis
gcgugacgcuggag

SEQ ID NO: 380466 - RNA, 21 nt, Bordetella pertussis
gcgugacgcuggagauggcgc

SEQ ID NO: 380467 - RNA, 12 nt, Bordetella pertussis
gcgugacguggc

SEQ ID NO: 380468 - RNA, 18 nt, Bordetella pertussis
gcgugcacgaccugccac

SEQ ID NO: 380469 - RNA, 19 nt, Bordetella pertussis
gcgugcagaucugcacgcu

SEQ ID NO: 380470 - RNA, 19 nt, Bordetella pertussis
gcgugcagcaagcccaccg

SEQ ID NO: 380471 - RNA, 20 nt, Bordetella pertussis
gcgugcagcaagcccaccgg

SEQ ID NO: 380472 - RNA, 14 nt, Bordetella pertussis
gcgugcagccagcg

SEQ ID NO: 380473 - RNA, 17 nt, Bordetella pertussis
gcgugcagccagcggcc

SEQ ID NO: 380474 - RNA, 13 nt, Bordetella pertussis
gcgugcagcgccg

SEQ ID NO: 380475 - RNA, 19 nt, Bordetella pertussis
gcgugcagcgccgcgcgcu

SEQ ID NO: 380476 - RNA, 15 nt, Bordetella pertussis
gcgugcaggccgcgu

SEQ ID NO: 380477 - RNA, 13 nt, Bordetella pertussis
gcgugcaggccgg

SEQ ID NO: 380478 - RNA, 19 nt, Bordetella pertussis
gcgugcagguacgccaugc

SEQ ID NO: 380479 - RNA, 21 nt, Bordetella pertussis
gcgugcauugcuugccggacu

SEQ ID NO: 380480 - RNA, 12 nt, Bordetella pertussis
gcgugccagcag

SEQ ID NO: 380481 - RNA, 20 nt, Bordetella pertussis
gcgugcccaaugucaccgac

SEQ ID NO: 380482 - RNA, 15 nt, Bordetella pertussis
gcgugcccgcgucca

SEQ ID NO: 380483 - RNA, 23 nt, Bordetella pertussis
gcgugcgugccgacgaugccgcc

SEQ ID NO: 380484 - RNA, 20 nt, Bordetella pertussis
gcgugcucaucggcaggccg

SEQ ID NO: 380485 - RNA, 13 nt, Bordetella pertussis
gcgugcucgcgca

SEQ ID NO: 380486 - RNA, 16 nt, Bordetella pertussis
gcgugcucgcgcaacg

SEQ ID NO: 380487 - RNA, 17 nt, Bordetella pertussis
gcgugcucgcgcaacgc

SEQ ID NO: 380488 - RNA, 13 nt, Bordetella pertussis
gcgugcugcgcgu

SEQ ID NO: 380489 - RNA, 13 nt, Bordetella pertussis
gcgugcuggcgca

SEQ ID NO: 380490 - RNA, 23 nt, Bordetella pertussis
gcgugcuggcgcagcagcgccgg

SEQ ID NO: 380491 - RNA, 13 nt, Bordetella pertussis
gcguggccaucaa

SEQ ID NO: 380492 - RNA, 22 nt, Bordetella pertussis
gcguggccaucaagaaggucga

SEQ ID NO: 380493 - RNA, 23 nt, Bordetella pertussis
gcguggccgaggugcccaucagg

SEQ ID NO: 380494 - RNA, 12 nt, Bordetella pertussis
gcguggccgcca

SEQ ID NO: 380495 - RNA, 15 nt, Bordetella pertussis
gcguggccgccacca

SEQ ID NO: 380496 - RNA, 16 nt, Bordetella pertussis
gcguggccgccaccag

SEQ ID NO: 380497 - RNA, 20 nt, Bordetella pertussis
gcguggccgccaccagcgcg

SEQ ID NO: 380498 - RNA, 16 nt, Bordetella pertussis
gcguggccgcgcugcu

SEQ ID NO: 380499 - RNA, 12 nt, Bordetella pertussis
gcguggccggcg

SEQ ID NO: 380500 - RNA, 14 nt, Bordetella pertussis
gcguggccugcccg

SEQ ID NO: 380501 - RNA, 13 nt, Bordetella pertussis
gcguggcgacgcg

SEQ ID NO: 380502 - RNA, 16 nt, Bordetella pertussis
gcguggcgacgcgcug

SEQ ID NO: 380503 - RNA, 12 nt, Bordetella pertussis
gcguggcgcagg

SEQ ID NO: 380504 - RNA, 13 nt, Bordetella pertussis
gcguggcgcaguc

SEQ ID NO: 380505 - RNA, 21 nt, Bordetella pertussis
gcguggcgcagucgagcaccg

SEQ ID NO: 380506 - RNA, 21 nt, Bordetella pertussis
gcguggcgccgaaggcggcgc

SEQ ID NO: 380507 - RNA, 15 nt, Bordetella pertussis
gcguggcgcgcaacc

SEQ ID NO: 380508 - RNA, 20 nt, Bordetella pertussis
gcguggcgcgcaaccagggg

SEQ ID NO: 380509 - RNA, 14 nt, Bordetella pertussis
gcguggcgcgcaca

SEQ ID NO: 380510 - RNA, 12 nt, Bordetella pertussis
gcguggcgcgcg

SEQ ID NO: 380511 - RNA, 16 nt, Bordetella pertussis
gcguggcgcggguggc

SEQ ID NO: 380512 - RNA, 19 nt, Bordetella pertussis
gcguggcgcggguggccgg

SEQ ID NO: 380513 - RNA, 14 nt, Bordetella pertussis
gcguggcggccagg

SEQ ID NO: 380514 - RNA, 17 nt, Bordetella pertussis
gcguggcggccaggccg

SEQ ID NO: 380515 - RNA, 18 nt, Bordetella pertussis
gcguggcggccaggccgg

SEQ ID NO: 380516 - RNA, 14 nt, Bordetella pertussis
gcguggcgggccgc

SEQ ID NO: 380517 - RNA, 20 nt, Bordetella pertussis
gcguggcgggccgcgccgcg

SEQ ID NO: 380518 - RNA, 16 nt, Bordetella pertussis
gcguggcggggauggc

SEQ ID NO: 380519 - RNA, 17 nt, Bordetella pertussis
gcguggcggggauggcu

SEQ ID NO: 380520 - RNA, 19 nt, Bordetella pertussis
gcguggcguaauagcuggc

SEQ ID NO: 380521 - RNA, 12 nt, Bordetella pertussis
gcguggcggcgu

SEQ ID NO: 380522 - RNA, 21 nt, Bordetella pertussis
gcguggcgugccgcagcgagg

SEQ ID NO: 380523 - RNA, 13 nt, Bordetella pertussis
gcguggcuggcgu

SEQ ID NO: 380524 - RNA, 19 nt, Bordetella pertussis
gcguggcuggcgucgauca

SEQ ID NO: 380525 - RNA, 16 nt, Bordetella pertussis
gcgugggcacccggcc

SEQ ID NO: 380526 - RNA, 19 nt, Bordetella pertussis
gcgugggcaugguggcgaa

SEQ ID NO: 380527 - RNA, 13 nt, Bordetella pertussis
gcgugggccagca

SEQ ID NO: 380528 - RNA, 16 nt, Bordetella pertussis
gcguggggagcgcggc

SEQ ID NO: 380529 - RNA, 17 nt, Bordetella pertussis
gcguggggagcgcggcc

SEQ ID NO: 380530 - RNA, 22 nt, Bordetella pertussis
gcguggggccggccgcgcgcgc

SEQ ID NO: 380531 - RNA, 21 nt, Bordetella pertussis
gcgugguacgacgagcgcacc

SEQ ID NO: 380532 - RNA, 16 nt, Bordetella pertussis
gcgugguaucgcgcca

SEQ ID NO: 380533 - RNA, 17 nt, Bordetella pertussis
gcgugguaucgcgccag

SEQ ID NO: 380534 - RNA, 19 nt, Bordetella pertussis
gcgugguaucgcgccagcg

SEQ ID NO: 380535 - RNA, 23 nt, Bordetella pertussis
gcgugguaucgcgccagcgccgc

SEQ ID NO: 380536 - RNA, 16 nt, Bordetella pertussis
gcguggucgcgggugg

SEQ ID NO: 380537 - RNA, 18 nt, Bordetella pertussis
gcguguagagcaggccgc

SEQ ID NO: 380538 - RNA, 21 nt, Bordetella pertussis
gcguguagagcaggccgccca

SEQ ID NO: 380539 - RNA, 16 nt, Bordetella pertussis
gcguguaggcggccgg

SEQ ID NO: 380540 - RNA, 15 nt, Bordetella pertussis
gcguguccagcggcg

SEQ ID NO: 380541 - RNA, 16 nt, Bordetella pertussis
gcgugucccagccggc

SEQ ID NO: 380542 - RNA, 21 nt, Bordetella pertussis
gcguguccgccguagcgcgcc

SEQ ID NO: 380543 - RNA, 15 nt, Bordetella pertussis
gcgugucgaacacca

SEQ ID NO: 380544 - RNA, 15 nt, Bordetella pertussis
gcguguuuuccucgu

SEQ ID NO: 380545 - RNA, 21 nt, Bordetella pertussis
gcguucagcgggcgcgcccgg

SEQ ID NO: 380546 - RNA, 23 nt, Bordetella pertussis
gcguucagguugcuuucggcgac

SEQ ID NO: 380547 - RNA, 14 nt, Bordetella pertussis
gcguucaggcgcgg

SEQ ID NO: 380548 - RNA, 17 nt, Bordetella pertussis
gcguuccaugacgucca

SEQ ID NO: 380549 - RNA, 19 nt, Bordetella pertussis
gcguuccaugacguccagc

SEQ ID NO: 380550 - RNA, 20 nt, Bordetella pertussis
gcguuccaugacguccagcg

SEQ ID NO: 380551 - RNA, 19 nt, Bordetella pertussis
gcguucgcggugggcagcg

SEQ ID NO: 380552 - RNA, 19 nt, Bordetella pertussis
gcguucggcaccggcagcc

SEQ ID NO: 380553 - RNA, 16 nt, Bordetella pertussis
gcguucggccacccgg

SEQ ID NO: 380554 - RNA, 13 nt, Bordetella pertussis
gcguucggccacu

SEQ ID NO: 380555 - RNA, 14 nt, Bordetella pertussis
gcguucggccagcc

SEQ ID NO: 380556 - RNA, 15 nt, Bordetella pertussis
gcguucgccgucguu

SEQ ID NO: 380557 - RNA, 15 nt, Bordetella pertussis
gcguucgggacgcag

SEQ ID NO: 380558 - RNA, 12 nt, Bordetella pertussis
gcguucgggcgg

SEQ ID NO: 380559 - RNA, 18 nt, Bordetella pertussis
gcguucgggcggcaggug

SEQ ID NO: 380560 - RNA, 15 nt, Bordetella pertussis
gcguucgucgccucc

SEQ ID NO: 380561 - RNA, 16 nt, Bordetella pertussis
gcguucguggaugacu

SEQ ID NO: 380562 - RNA, 15 nt, Bordetella pertussis
gcguucguggauggg

SEQ ID NO: 380563 - RNA, 16 nt, Bordetella pertussis
gcguugcagccacagg

SEQ ID NO: 380564 - RNA, 18 nt, Bordetella pertussis
gcguugcagccacaggcc

SEQ ID NO: 380565 - RNA, 20 nt, Bordetella pertussis
gcguugcaccgcgucggccu

SEQ ID NO: 380566 - RNA, 18 nt, Bordetella pertussis
gcuaccccggcagcguca

SEQ ID NO: 380567 - RNA, 14 nt, Bordetella pertussis
gcuaccgcgccauc

SEQ ID NO: 380568 - RNA, 24 nt, Bordetella pertussis
gcuacgaccugaauccguaagcgc

SEQ ID NO: 380569 - RNA, 15 nt, Bordetella pertussis
gcuacgacccgcuga

SEQ ID NO: 380570 - RNA, 14 nt, Bordetella pertussis
gcuacgcggcguca

SEQ ID NO: 380571 - RNA, 15 nt, Bordetella pertussis
gcuacgggcgcugca

SEQ ID NO: 380572 - RNA, 21 nt, Bordetella pertussis
gcuagagcggcguggcgccga

SEQ ID NO: 380573 - RNA, 15 nt, Bordetella pertussis
gcuagcugugaacug

SEQ ID NO: 380574 - RNA, 18 nt, Bordetella pertussis
gcuaggcgcagcaggcca

SEQ ID NO: 380575 - RNA, 16 nt, Bordetella pertussis
gcuauaccgggcuggu

SEQ ID NO: 380576 - RNA, 23 nt, Bordetella pertussis
gcuauaccgucguccucggcacg

SEQ ID NO: 380577 - RNA, 16 nt, Bordetella pertussis
gcuaucauccgcgcau

SEQ ID NO: 380578 - RNA, 20 nt, Bordetella pertussis
gcuaugcagcugcgccagcc

SEQ ID NO: 380579 - RNA, 17 nt, Bordetella pertussis
gcucaaccucgacgcgc

SEQ ID NO: 380580 - RNA, 19 nt, Bordetella pertussis
gcucaaccucgacgcgcau

SEQ ID NO: 380581 - RNA, 18 nt, Bordetella pertussis
gcucaacgaagaacagcc

SEQ ID NO: 380582 - RNA, 14 nt, Bordetella pertussis
gcucaacggccacc

SEQ ID NO: 380583 - RNA, 20 nt, Bordetella pertussis
gcucaagaagaagccgggcu

SEQ ID NO: 380584 - RNA, 22 nt, Bordetella pertussis
gcucacagggucaaggcgcggc

SEQ ID NO: 380585 - RNA, 23 nt, Bordetella pertussis
gcucaccgacuucaccgaggcgc

SEQ ID NO: 380586 - RNA, 23 nt, Bordetella pertussis
gcucaccgagggccggacuggcg

SEQ ID NO: 380587 - RNA, 17 nt, Bordetella pertussis
gcucaccucgaucgcgu

SEQ ID NO: 380588 - RNA, 13 nt, Bordetella pertussis
gcucacgcccagu

SEQ ID NO: 380589 - RNA, 18 nt, Bordetella pertussis
gcucacgcccagucccag

SEQ ID NO: 380590 - RNA, 22 nt, Bordetella pertussis
gcucacgcccagucccaggccg

SEQ ID NO: 380591 - RNA, 17 nt, Bordetella pertussis
gcucacgcccgugucgc

SEQ ID NO: 380592 - RNA, 20 nt, Bordetella pertussis
gcucacggggcugucgcgcg

SEQ ID NO: 380593 - RNA, 21 nt, Bordetella pertussis
gcucacggggcugucgcgcgc

SEQ ID NO: 380594 - RNA, 23 nt, Bordetella pertussis
gcucacggggcugucgcgcgcau

SEQ ID NO: 380595 - RNA, 20 nt, Bordetella pertussis
gcucagagcuugccguacga

SEQ ID NO: 380596 - RNA, 16 nt, Bordetella pertussis
gcucagcaccaggccg

SEQ ID NO: 380597 - RNA, 20 nt, Bordetella pertussis
gcucagcaccaggccgccgg

SEQ ID NO: 380598 - RNA, 14 nt, Bordetella pertussis
gcucagcagcgcca

SEQ ID NO: 380599 - RNA, 14 nt, Bordetella pertussis
gcucagcagggucg

SEQ ID NO: 380600 - RNA, 16 nt, Bordetella pertussis
gcucagcaugcgcugg

SEQ ID NO: 380601 - RNA, 20 nt, Bordetella pertussis
gcucagcccgccuggcgccg

SEQ ID NO: 380602 - RNA, 15 nt, Bordetella pertussis
gcucagcccuugacg

SEQ ID NO: 380603 - RNA, 22 nt, Bordetella pertussis
gcucagcccuugacgcguacga

SEQ ID NO: 380604 - RNA, 14 nt, Bordetella pertussis
gcucagccgugccg

SEQ ID NO: 380605 - RNA, 20 nt, Bordetella pertussis
gcucagccgugccgcgcgca

SEQ ID NO: 380606 - RNA, 14 nt, Bordetella pertussis
gcucagccuugucg

SEQ ID NO: 380607 - RNA, 19 nt, Bordetella pertussis
gcucagccuugucgcgggc

SEQ ID NO: 380608 - RNA, 15 nt, Bordetella pertussis
gcucagcgacgcgcg

SEQ ID NO: 380609 - RNA, 16 nt, Bordetella pertussis
gcucagcgacgcgcgc

SEQ ID NO: 380610 - RNA, 17 nt, Bordetella pertussis
gcucagcgacgcgcgcc

SEQ ID NO: 380611 - RNA, 18 nt, Bordetella pertussis
gcucagcgacgcgcgccg

SEQ ID NO: 380612 - RNA, 17 nt, Bordetella pertussis
gcucagcgcgccgagga

SEQ ID NO: 380613 - RNA, 15 nt, Bordetella pertussis
gcucagcgcggcgcg

SEQ ID NO: 380614 - RNA, 22 nt, Bordetella pertussis
gcucagcgcggcgcggccagca

SEQ ID NO: 380615 - RNA, 23 nt, Bordetella pertussis
gcucagcgcggcgcggccagcag

SEQ ID NO: 380616 - RNA, 20 nt, Bordetella pertussis
gcucaggaaccagcggcugg

SEQ ID NO: 380617 - RNA, 23 nt, Bordetella pertussis
gcucaggaaccagcggcuggcgg

SEQ ID NO: 380618 - RNA, 20 nt, Bordetella pertussis
gcucagcuuguagcccucgg

SEQ ID NO: 380619 - RNA, 13 nt, Bordetella pertussis
gcucaggccagcg

SEQ ID NO: 380620 - RNA, 14 nt, Bordetella pertussis
gcucaggccagcga

SEQ ID NO: 380621 - RNA, 15 nt, Bordetella pertussis
gcucaggccagcgac

SEQ ID NO: 380622 - RNA, 20 nt, Bordetella pertussis
gcucaggccagcgacccgca

SEQ ID NO: 380623 - RNA, 16 nt, Bordetella pertussis
gcucaggccgccggcg

SEQ ID NO: 380624 - RNA, 23 nt, Bordetella pertussis
gcucaggcgcggauugaugucgc

SEQ ID NO: 380625 - RNA, 13 nt, Bordetella pertussis
gcucaggcggcca

SEQ ID NO: 380626 - RNA, 14 nt, Bordetella pertussis
gcucaggcggccag

SEQ ID NO: 380627 - RNA, 22 nt, Bordetella pertussis
gcucaggcugcgcgucggcagg

SEQ ID NO: 380628 - RNA, 15 nt, Bordetella pertussis
gcucagggggcgccc

SEQ ID NO: 380629 - RNA, 16 nt, Bordetella pertussis
gcucagggggcgcccc

SEQ ID NO: 380630 - RNA, 20 nt, Bordetella pertussis
gcucaggucgaacaggcugg

SEQ ID NO: 380631 - RNA, 20 nt, Bordetella pertussis
gcucagucggccuggcgcuc

SEQ ID NO: 380632 - RNA, 22 nt, Bordetella pertussis
gcucagucggccuggcgcuccu

SEQ ID NO: 380633 - RNA, 16 nt, Bordetella pertussis
gcucaucaccagcagg

SEQ ID NO: 380634 - RNA, 22 nt, Bordetella pertussis
gcucaucaucgcgcuggcgcgc

SEQ ID NO: 380635 - RNA, 15 nt, Bordetella pertussis
gcucaucggcaggcc

SEQ ID NO: 380636 - RNA, 17 nt, Bordetella pertussis
gcucaucggcaggccgg

SEQ ID NO: 380637 - RNA, 22 nt, Bordetella pertussis
gcucaucggcaggccggcgcgc

SEQ ID NO: 380638 - RNA, 14 nt, Bordetella pertussis
gcucaugaccagcg

SEQ ID NO: 380639 - RNA, 18 nt, Bordetella pertussis
gcucaugaaacgaucggc

SEQ ID NO: 380640 - RNA, 13 nt, Bordetella pertussis
gcucaugccggca

SEQ ID NO: 380641 - RNA, 20 nt, Bordetella pertussis
gcucauggaggggcgcaggc

SEQ ID NO: 380642 - RNA, 18 nt, Bordetella pertussis
gcucauggcacagcgcgg

SEQ ID NO: 380643 - RNA, 18 nt, Bordetella pertussis
gcucauggcgcaugacga

SEQ ID NO: 380644 - RNA, 20 nt, Bordetella pertussis
gcucaugguuucgagcauca

SEQ ID NO: 380645 - RNA, 18 nt, Bordetella pertussis
gcucauguugggggcgaa

SEQ ID NO: 380646 - RNA, 22 nt, Bordetella pertussis
gcucauguugggggcgaagacg

SEQ ID NO: 380647 - RNA, 16 nt, Bordetella pertussis
gcucauucggcgcgcu

SEQ ID NO: 380648 - RNA, 13 nt, Bordetella pertussis
gcuccaccagcac

SEQ ID NO: 380649 - RNA, 22 nt, Bordetella pertussis
gcuccaccagcaccggcagcgu

SEQ ID NO: 380650 - RNA, 15 nt, Bordetella pertussis
gcuccaccgggcuga

SEQ ID NO: 380651 - RNA, 15 nt, Bordetella pertussis
gcuccacgugcggca

SEQ ID NO: 380652 - RNA, 15 nt, Bordetella pertussis
gcuccagaacgcgcc

SEQ ID NO: 380653 - RNA, 17 nt, Bordetella pertussis
gcuccagaacgcgccgu

SEQ ID NO: 380654 - RNA, 15 nt, Bordetella pertussis
gcuccagagcgcgca

SEQ ID NO: 380655 - RNA, 16 nt, Bordetella pertussis
gcuccagagcgcgcac

SEQ ID NO: 380656 - RNA, 17 nt, Bordetella pertussis
gcuccagcauguacagc

SEQ ID NO: 380657 - RNA, 19 nt, Bordetella pertussis
gcuccagcccuucgcccgc

SEQ ID NO: 380658 - RNA, 15 nt, Bordetella pertussis
gcuccagccgggucg

SEQ ID NO: 380659 - RNA, 14 nt, Bordetella pertussis
gcuccagcgcgccg

SEQ ID NO: 380660 - RNA, 22 nt, Bordetella pertussis
gcuccagcgcuucgugcagcgc

SEQ ID NO: 380661 - RNA, 22 nt, Bordetella pertussis
gcuccagcgugucgaacaccag

SEQ ID NO: 380662 - RNA, 18 nt, Bordetella pertussis
gcuccagcucagcagcgc

SEQ ID NO: 380663 - RNA, 21 nt, Bordetella pertussis
gcuccaggaaaaccuccuccg

SEQ ID NO: 380664 - RNA, 15 nt, Bordetella pertussis
gcuccaggccgccca

SEQ ID NO: 380665 - RNA, 17 nt, Bordetella pertussis
gcuccaggccgcccagc

SEQ ID NO: 380666 - RNA, 16 nt, Bordetella pertussis
gcuccaggcggccagu

SEQ ID NO: 380667 - RNA, 14 nt, Bordetella pertussis
gcuccaggccggca

SEQ ID NO: 380668 - RNA, 17 nt, Bordetella pertussis
gcuccaggccggcaugc

SEQ ID NO: 380669 - RNA, 16 nt, Bordetella pertussis
gcuccagucccgcacc

SEQ ID NO: 380670 - RNA, 18 nt, Bordetella pertussis
gcuccagucccgcaccgg

SEQ ID NO: 380671 - RNA, 20 nt, Bordetella pertussis
gcuccagucccgcaccgggc

SEQ ID NO: 380672 - RNA, 17 nt, Bordetella pertussis
gcuccaugcggcggcgg

SEQ ID NO: 380673 - RNA, 19 nt, Bordetella pertussis
gcuccaugcggcggcgggc

SEQ ID NO: 380674 - RNA, 19 nt, Bordetella pertussis
gcucggagggcuccaggcu

SEQ ID NO: 380675 - RNA, 14 nt, Bordetella pertussis
gcucggcauggcga

SEQ ID NO: 380676 - RNA, 11 nt, Bordetella pertussis
gcucggccacc

SEQ ID NO: 380677 - RNA, 14 nt, Bordetella pertussis
gcucggccaccaug

SEQ ID NO: 380678 - RNA, 16 nt, Bordetella pertussis
gcucggccaccaugcg

SEQ ID NO: 380679 - RNA, 17 nt, Bordetella pertussis
gcucggccaccaugcgg

SEQ ID NO: 380680 - RNA, 14 nt, Bordetella pertussis
gcucggccaccgcc

SEQ ID NO: 380681 - RNA, 21 nt, Bordetella pertussis
gcucggcgaacugggcgucgu

SEQ ID NO: 380682 - RNA, 19 nt, Bordetella pertussis
gcucggcgaagccgcagcg

SEQ ID NO: 380683 - RNA, 14 nt, Bordetella pertussis
gcucggcgaccagg

SEQ ID NO: 380684 - RNA, 16 nt, Bordetella pertussis
gcucggcgaccaggcc

SEQ ID NO: 380685 - RNA, 18 nt, Bordetella pertussis
gcucggcgaccaggccca

SEQ ID NO: 380686 - RNA, 24 nt, Bordetella pertussis
gcucggcgaccaggcccauggcgu

SEQ ID NO: 380687 - RNA, 17 nt, Bordetella pertussis
gcucggcgacggucagg

SEQ ID NO: 380688 - RNA, 16 nt, Bordetella pertussis
gcucggcgcugccggg

SEQ ID NO: 380689 - RNA, 18 nt, Bordetella pertussis
gcucggcggccgccugcg

SEQ ID NO: 380690 - RNA, 15 nt, Bordetella pertussis
gcucggcggucagcg

SEQ ID NO: 380691 - RNA, 16 nt, Bordetella pertussis
gcucggcuuccugccg

SEQ ID NO: 380692 - RNA, 17 nt, Bordetella pertussis
gcucggcuuccugccgc

SEQ ID NO: 380693 - RNA, 14 nt, Bordetella pertussis
gcucgggacgcagg

SEQ ID NO: 380694 - RNA, 17 nt, Bordetella pertussis
gcucgggacgcaggccc

SEQ ID NO: 380695 - RNA, 15 nt, Bordetella pertussis
gcucgggcgccucgu

SEQ ID NO: 380696 - RNA, 15 nt, Bordetella pertussis
gcucgggcgcggcau

SEQ ID NO: 380697 - RNA, 17 nt, Bordetella pertussis
gcucgggcgcggcaucg

SEQ ID NO: 380698 - RNA, 15 nt, Bordetella pertussis
gcucgggcugcggcu

SEQ ID NO: 380699 - RNA, 17 nt, Bordetella pertussis
gcucgggcugcggcucc

SEQ ID NO: 380700 - RNA, 18 nt, Bordetella pertussis
gcucgggcugcggcuccu

SEQ ID NO: 380701 - RNA, 17 nt, Bordetella pertussis
gcucgggugggccggcu

SEQ ID NO: 380702 - RNA, 17 nt, Bordetella pertussis
gcucggugagcggcacg

SEQ ID NO: 380703 - RNA, 22 nt, Bordetella pertussis
gcucggugaugauggccagguc

SEQ ID NO: 380704 - RNA, 17 nt, Bordetella pertussis
gcucggugcagcccagc

SEQ ID NO: 380705 - RNA, 18 nt, Bordetella pertussis
gcucggugcagcccagca

SEQ ID NO: 380706 - RNA, 13 nt, Bordetella pertussis
gcucguacuccau

SEQ ID NO: 380707 - RNA, 21 nt, Bordetella pertussis
gcucguagaucuugccggccg

SEQ ID NO: 380708 - RNA, 23 nt, Bordetella pertussis
gcucguagaugguauguauggcg

SEQ ID NO: 380709 - RNA, 15 nt, Bordetella pertussis
gcucguagcugucga

SEQ ID NO: 380710 - RNA, 13 nt, Bordetella pertussis
gcucguccacggc

SEQ ID NO: 380711 - RNA, 12 nt, Bordetella pertussis
gcucguccaggu

SEQ ID NO: 380712 - RNA, 17 nt, Bordetella pertussis
gcucguccaucgccugc

SEQ ID NO: 380713 - RNA, 13 nt, Bordetella pertussis
gcucgucgccaug

SEQ ID NO: 380714 - RNA, 21 nt, Bordetella pertussis
gcucgucgccaugcggcuggc

SEQ ID NO: 380715 - RNA, 16 nt, Bordetella pertussis
gcucuggcacaccagc

SEQ ID NO: 380716 - RNA, 19 nt, Bordetella pertussis
gcucuggcacaccagcgcc

SEQ ID NO: 380717 - RNA, 20 nt, Bordetella pertussis
gcucuggcacaccagcgcca

SEQ ID NO: 380718 - RNA, 17 nt, Bordetella pertussis
gcucuucgacagcgcgc

SEQ ID NO: 380719 - RNA, 19 nt, Bordetella pertussis
gcucuucgacagcgcgcag

SEQ ID NO: 380720 - RNA, 20 nt, Bordetella pertussis
gcucuucgacagcgcgcagg

SEQ ID NO: 380721 - RNA, 17 nt, Bordetella pertussis
gcucuucgagcgcggcg

SEQ ID NO: 380722 - RNA, 14 nt, Bordetella pertussis
gcucuugaccuggg

SEQ ID NO: 380723 - RNA, 16 nt, Bordetella pertussis
gcucuugaccugggcc

SEQ ID NO: 380724 - RNA, 16 nt, Bordetella pertussis
gcucuugagcgcggcc

SEQ ID NO: 380725 - RNA, 13 nt, Bordetella pertussis
gcucuuggcgccg

SEQ ID NO: 380726 - RNA, 22 nt, Bordetella pertussis
gcugaacguguaggucagcgcc

SEQ ID NO: 380727 - RNA, 15 nt, Bordetella pertussis
gcugaagcgccgcca

SEQ ID NO: 380728 - RNA, 23 nt, Bordetella pertussis
gcugaaggaccucgcgccgguca

SEQ ID NO: 380729 - RNA, 22 nt, Bordetella pertussis
gcugaaggucgcuucgguggcg

SEQ ID NO: 380730 - RNA, 19 nt, Bordetella pertussis
gcugaaguaguacucgccg

SEQ ID NO: 380731 - RNA, 20 nt, Bordetella pertussis
gcugaauccggggugccugu

SEQ ID NO: 380732 - RNA, 17 nt, Bordetella pertussis
gcugacgcccggcucgc

SEQ ID NO: 380733 - RNA, 18 nt, Bordetella pertussis
gcugacgcccggcucgcu

SEQ ID NO: 380734 - RNA, 14 nt, Bordetella pertussis
gcugacggacuggu

SEQ ID NO: 380735 - RNA, 22 nt, Bordetella pertussis
gcugacgguaagcaccagguug

SEQ ID NO: 380736 - RNA, 15 nt, Bordetella pertussis
gcugacggugccggc

SEQ ID NO: 380737 - RNA, 17 nt, Bordetella pertussis
gcugacggugccggcca

SEQ ID NO: 380738 - RNA, 13 nt, Bordetella pertussis
gcugagcgacaug

SEQ ID NO: 380739 - RNA, 18 nt, Bordetella pertussis
gcugauccucgccagcgg

SEQ ID NO: 380740 - RNA, 17 nt, Bordetella pertussis
gcugaucgccggcgccc

SEQ ID NO: 380741 - RNA, 21 nt, Bordetella pertussis
gcugauucgcgucguugcgcc

SEQ ID NO: 380742 - RNA, 12 nt, Bordetella pertussis
gcugcaccugcg

SEQ ID NO: 380743 - RNA, 21 nt, Bordetella pertussis
gcugcaccugcgucugcacgc

SEQ ID NO: 380744 - RNA, 21 nt, Bordetella pertussis
gcugcacgauguugccgccgg

SEQ ID NO: 380745 - RNA, 15 nt, Bordetella pertussis
gcugcacgcagcgca

SEQ ID NO: 380746 - RNA, 16 nt, Bordetella pertussis
gcugcacgcagcgcag

SEQ ID NO: 380747 - RNA, 22 nt, Bordetella pertussis
gcugcacgcgcgcgggcgcgcc

SEQ ID NO: 380748 - RNA, 19 nt, Bordetella pertussis
gcugcacgcggccgcgcag

SEQ ID NO: 380749 - RNA, 15 nt, Bordetella pertussis
gcugcagaucaucga

SEQ ID NO: 380750 - RNA, 20 nt, Bordetella pertussis
gcugcagaucaucggcgcca

SEQ ID NO: 380751 - RNA, 17 nt, Bordetella pertussis
gcugcagcuugcgcgcc

SEQ ID NO: 380752 - RNA, 18 nt, Bordetella pertussis
gcugcagcuugcgcgcca

SEQ ID NO: 380753 - RNA, 21 nt, Bordetella pertussis
gcugcaggaaguccuucagcc

SEQ ID NO: 380754 - RNA, 14 nt, Bordetella pertussis
gcugcaggaucgcg

SEQ ID NO: 380755 - RNA, 19 nt, Bordetella pertussis
gcugcaggaucgcggccag

SEQ ID NO: 380756 - RNA, 21 nt, Bordetella pertussis
gcugcaggaucgcggccagcg

SEQ ID NO: 380757 - RNA, 20 nt, Bordetella pertussis
gcugcaggccggcgcgcauc

SEQ ID NO: 380758 - RNA, 13 nt, Bordetella pertussis
gcugcaggcgcgg

SEQ ID NO: 380759 - RNA, 15 nt, Bordetella pertussis
gcugcaggcgcgggu

SEQ ID NO: 380760 - RNA, 14 nt, Bordetella pertussis
gcugcaguugcgcc

SEQ ID NO: 380761 - RNA, 15 nt, Bordetella pertussis
gcugcauacgccgcu

SEQ ID NO: 380762 - RNA, 22 nt, Bordetella pertussis
gcugcauacgccgcugauggcg

SEQ ID NO: 380763 - RNA, 21 nt, Bordetella pertussis
gcugcaugcgcgaacgcgcgc

SEQ ID NO: 380764 - RNA, 22 nt, Bordetella pertussis
gcugcaugcgcgaacgcgcgcc

SEQ ID NO: 380765 - RNA, 15 nt, Bordetella pertussis
gcugcaugggcggcc

SEQ ID NO: 380766 - RNA, 21 nt, Bordetella pertussis
gcugcaugccccaacggcgca

SEQ ID NO: 380767 - RNA, 23 nt, Bordetella pertussis
gcugccagccauguucgaccagg

SEQ ID NO: 380768 - RNA, 14 nt, Bordetella pertussis
gcugccccccgagg

SEQ ID NO: 380769 - RNA, 16 nt, Bordetella pertussis
gcugcccgaagcgcag

SEQ ID NO: 380770 - RNA, 13 nt, Bordetella pertussis
gcugcccgacgac

SEQ ID NO: 380771 - RNA, 14 nt, Bordetella pertussis
gcugcccgacgacg

SEQ ID NO: 380772 - RNA, 18 nt, Bordetella pertussis
gcugcccgccgccgccca

SEQ ID NO: 380773 - RNA, 14 nt, Bordetella pertussis
gcugcccucgcccg

SEQ ID NO: 380774 - RNA, 22 nt, Bordetella pertussis
gcugcccucgcccgugcgcggu

SEQ ID NO: 380775 - RNA, 22 nt, Bordetella pertussis
gcugcccucggucagcgccagg

SEQ ID NO: 380776 - RNA, 19 nt, Bordetella pertussis
gcugcccugcaugaccgcc

SEQ ID NO: 380777 - RNA, 21 nt, Bordetella pertussis
gcugcccuggaucaggauggg

SEQ ID NO: 380778 - RNA, 22 nt, Bordetella pertussis
gcugccgauacgggcgcggcgu

SEQ ID NO: 380779 - RNA, 17 nt, Bordetella pertussis
gcugccgcgcgauccgg

SEQ ID NO: 380780 - RNA, 18 nt, Bordetella pertussis
gcugccggaaacccgggc

SEQ ID NO: 380781 - RNA, 15 nt, Bordetella pertussis
gcugccggauuggcg

SEQ ID NO: 380782 - RNA, 12 nt, Bordetella pertussis
gcugccgcugca

SEQ ID NO: 380783 - RNA, 15 nt, Bordetella pertussis
gcugccggcagcagg

SEQ ID NO: 380784 - RNA, 11 nt, Bordetella pertussis
gcugccggcau

SEQ ID NO: 380785 - RNA, 21 nt, Bordetella pertussis
gcugcggcugaucaccgccgg

SEQ ID NO: 380786 - RNA, 15 nt, Bordetella pertussis
gcugcgggccggcgc

SEQ ID NO: 380787 - RNA, 17 nt, Bordetella pertussis
gcugcgggccggcgccg

SEQ ID NO: 380788 - RNA, 14 nt, Bordetella pertussis
gcugcgggcggccu

SEQ ID NO: 380789 - RNA, 22 nt, Bordetella pertussis
gcugcgggucgaguugcgcgcc

SEQ ID NO: 380790 - RNA, 23 nt, Bordetella pertussis
gcugcgggucgaguugcgcgcca

SEQ ID NO: 380791 - RNA, 15 nt, Bordetella pertussis
gcugcggucgcgauc

SEQ ID NO: 380792 - RNA, 18 nt, Bordetella pertussis
gcugcucgacagcagccc

SEQ ID NO: 380793 - RNA, 21 nt, Bordetella pertussis
gcugcucgagcaugcgggcca

SEQ ID NO: 380794 - RNA, 19 nt, Bordetella pertussis
gcugcucguucugcgcgcc

SEQ ID NO: 380795 - RNA, 15 nt, Bordetella pertussis
gcugcucuuggcgcc

SEQ ID NO: 380796 - RNA, 20 nt, Bordetella pertussis
gcugcuggaccuggccacca

SEQ ID NO: 380797 - RNA, 20 nt, Bordetella pertussis
gcugcuggagaucgccgagc

SEQ ID NO: 380798 - RNA, 19 nt, Bordetella pertussis
gcugcuggccaagcgcgcc

SEQ ID NO: 380799 - RNA, 14 nt, Bordetella pertussis
gcugcuggccggcc

SEQ ID NO: 380800 - RNA, 16 nt, Bordetella pertussis
gcugcuggccggccag

SEQ ID NO: 380801 - RNA, 17 nt, Bordetella pertussis
gcugcuggaggccggcg

SEQ ID NO: 380802 - RNA, 19 nt, Bordetella pertussis
gcugcuggaggccggcgug

SEQ ID NO: 380803 - RNA, 19 nt, Bordetella pertussis
gcugcuggcgcgccaggcg

SEQ ID NO: 380804 - RNA, 14 nt, Bordetella pertussis
gcugcuggcggcgc

SEQ ID NO: 380805 - RNA, 15 nt, Bordetella pertussis
gcugcuggcuucggc

SEQ ID NO: 380806 - RNA, 15 nt, Bordetella pertussis
gcugcugggcaugga

SEQ ID NO: 380807 - RNA, 15 nt, Bordetella pertussis
gcugcugggccggcg

SEQ ID NO: 380808 - RNA, 17 nt, Bordetella pertussis
gcugcugggccggcgcg

SEQ ID NO: 380809 - RNA, 20 nt, Bordetella pertussis
gcugcugggccggcgcgcgc

SEQ ID NO: 380810 - RNA, 14 nt, Bordetella pertussis
gcugcugggcgcca

SEQ ID NO: 380811 - RNA, 15 nt, Bordetella pertussis
gcugcugggcgccau

SEQ ID NO: 380812 - RNA, 17 nt, Bordetella pertussis
gcugcuguugcgcguga

SEQ ID NO: 380813 - RNA, 22 nt, Bordetella pertussis
gcugcuguuggcguggcuggcg

SEQ ID NO: 380814 - RNA, 14 nt, Bordetella pertussis
gcugcuugcccagg

SEQ ID NO: 380815 - RNA, 15 nt, Bordetella pertussis
gcugcuugcccaggc

SEQ ID NO: 380816 - RNA, 18 nt, Bordetella pertussis
gcugcuugcccaggccgg

SEQ ID NO: 380817 - RNA, 23 nt, Bordetella pertussis
gcuggaaacuaaaucgcggcucg

SEQ ID NO: 380818 - RNA, 16 nt, Bordetella pertussis
gcuggaacaccaugcc

SEQ ID NO: 380819 - RNA, 16 nt, Bordetella pertussis
gcuggaacgcgccgcu

SEQ ID NO: 380820 - RNA, 14 nt, Bordetella pertussis
gcuggaacggugcg

SEQ ID NO: 380821 - RNA, 19 nt, Bordetella pertussis
gcuggaacggugcgagauc

SEQ ID NO: 380822 - RNA, 19 nt, Bordetella pertussis
gcuggaagacgccuguccg

SEQ ID NO: 380823 - RNA, 13 nt, Bordetella pertussis
gcuggaagcgcgc

SEQ ID NO: 380824 - RNA, 19 nt, Bordetella pertussis
gcuggacagauccagcgcg

SEQ ID NO: 380825 - RNA, 19 nt, Bordetella pertussis
gcuggacccggagcugccg

SEQ ID NO: 380826 - RNA, 17 nt, Bordetella pertussis
gcuggaccgccuggccu

SEQ ID NO: 380827 - RNA, 15 nt, Bordetella pertussis
gcuggaccgcgccug

SEQ ID NO: 380828 - RNA, 16 nt, Bordetella pertussis
gcuggaccgcgccugg

SEQ ID NO: 380829 - RNA, 17 nt, Bordetella pertussis
gcuggaccugcuguuca

SEQ ID NO: 380830 - RNA, 16 nt, Bordetella pertussis
gcuggacgcccuggcg

SEQ ID NO: 380831 - RNA, 19 nt, Bordetella pertussis
gcuggacgcccuggcgcag

SEQ ID NO: 380832 - RNA, 17 nt, Bordetella pertussis
gcuggacgcgccgaaca

SEQ ID NO: 380833 - RNA, 21 nt, Bordetella pertussis
gcuggacgcgccgaacaccag

SEQ ID NO: 380834 - RNA, 18 nt, Bordetella pertussis
gcuggacgcgcgcggcga

SEQ ID NO: 380835 - RNA, 16 nt, Bordetella pertussis
gcuggacuauggccug

SEQ ID NO: 380836 - RNA, 20 nt, Bordetella pertussis
gcuggagaacgagccggccg

SEQ ID NO: 380837 - RNA, 14 nt, Bordetella pertussis
gcuggagaucgccg

SEQ ID NO: 380838 - RNA, 16 nt, Bordetella pertussis
gcuggagcgccacgcc

SEQ ID NO: 380839 - RNA, 23 nt, Bordetella pertussis
gcuggagcucuaugucgccggcc

SEQ ID NO: 380840 - RNA, 13 nt, Bordetella pertussis
gcuggaggccggc

SEQ ID NO: 380841 - RNA, 15 nt, Bordetella pertussis
gcuggauggccugcu

SEQ ID NO: 380842 - RNA, 21 nt, Bordetella pertussis
gcuggauggucacgcccaggc

SEQ ID NO: 380843 - RNA, 17 nt, Bordetella pertussis
gcuggauggugccgccg

SEQ ID NO: 380844 - RNA, 16 nt, Bordetella pertussis
gcuggauggcucgggc

SEQ ID NO: 380845 - RNA, 16 nt, Bordetella pertussis
gcuggauucgccgguc

SEQ ID NO: 380846 - RNA, 16 nt, Bordetella pertussis
gcuggcaaagcgcgcg

SEQ ID NO: 380847 - RNA, 17 nt, Bordetella pertussis
gcuggcaaagcgcgcgu

SEQ ID NO: 380848 - RNA, 17 nt, Bordetella pertussis
gcuggcaucgucgcgcu

SEQ ID NO: 380849 - RNA, 16 nt, Bordetella pertussis
gcuggcauugacgacg

SEQ ID NO: 380850 - RNA, 18 nt, Bordetella pertussis
gcuggcauugacgacgcg

SEQ ID NO: 380851 - RNA, 21 nt, Bordetella pertussis
gcuggcauugacgacgcggua

SEQ ID NO: 380852 - RNA, 13 nt, Bordetella pertussis
gcuggccaacgcc

SEQ ID NO: 380853 - RNA, 16 nt, Bordetella pertussis
gcuggccaacgccacg

SEQ ID NO: 380854 - RNA, 19 nt, Bordetella pertussis
gcuggccaacgccacgccc

SEQ ID NO: 380855 - RNA, 17 nt, Bordetella pertussis
gcuggccaagcgcgccg

SEQ ID NO: 380856 - RNA, 20 nt, Bordetella pertussis
gcuggccaagcgcgccggcu

SEQ ID NO: 380857 - RNA, 14 nt, Bordetella pertussis
gcuggccacuggcc

SEQ ID NO: 380858 - RNA, 19 nt, Bordetella pertussis
gcuggccagccggcccagc

SEQ ID NO: 380859 - RNA, 23 nt, Bordetella pertussis
gcuggccagccggcccagcaugc

SEQ ID NO: 380860 - RNA, 23 nt, Bordetella pertussis
gcuggccagcgguacgccgaacu

SEQ ID NO: 380861 - RNA, 13 nt, Bordetella pertussis
gcuggccagcugg

SEQ ID NO: 380862 - RNA, 16 nt, Bordetella pertussis
gcuggccaucaccgcc

SEQ ID NO: 380863 - RNA, 22 nt, Bordetella pertussis
gcuggccaucguacgcgugggc

SEQ ID NO: 380864 - RNA, 12 nt, Bordetella pertussis
gcuggccaugcc

SEQ ID NO: 380865 - RNA, 14 nt, Bordetella pertussis
gcuggcccacgccc

SEQ ID NO: 380866 - RNA, 19 nt, Bordetella pertussis
gcuggcccacucggugcgc

SEQ ID NO: 380867 - RNA, 23 nt, Bordetella pertussis
gcuggcccacucggugcgcgcgc

SEQ ID NO: 380868 - RNA, 17 nt, Bordetella pertussis
gcuggcccagaccaagc

SEQ ID NO: 380869 - RNA, 19 nt, Bordetella pertussis
gcuggcccagaccaagcgc

SEQ ID NO: 380870 - RNA, 19 nt, Bordetella pertussis
gcuggcccaguucgcgcag

SEQ ID NO: 380871 - RNA, 23 nt, Bordetella pertussis
gcuggcccaguucgcgcagcagc

SEQ ID NO: 380872 - RNA, 16 nt, Bordetella pertussis
gcuggccccagaugcc

SEQ ID NO: 380873 - RNA, 14 nt, Bordetella pertussis
gcuggcccgccagc

SEQ ID NO: 380874 - RNA, 15 nt, Bordetella pertussis
gcuggcccgccagca

SEQ ID NO: 380875 - RNA, 17 nt, Bordetella pertussis
gcuggcccgccagcaag

SEQ ID NO: 380876 - RNA, 22 nt, Bordetella pertussis
gcuggcccgucaugggcggggc

SEQ ID NO: 380877 - RNA, 19 nt, Bordetella pertussis
gcuggcccuggcagacgua

SEQ ID NO: 380878 - RNA, 14 nt, Bordetella pertussis
gcuggcccugggcu

SEQ ID NO: 380879 - RNA, 18 nt, Bordetella pertussis
gcuggccgaucaccugca

SEQ ID NO: 380880 - RNA, 16 nt, Bordetella pertussis
gcuggccgccauggcg

SEQ ID NO: 380881 - RNA, 20 nt, Bordetella pertussis
gcuggccgccauggcgcugg

SEQ ID NO: 380882 - RNA, 23 nt, Bordetella pertussis
gcuggccgccauggcgcuggcag

SEQ ID NO: 380883 - RNA, 20 nt, Bordetella pertussis
gcuggccgccgcgcucaccg

SEQ ID NO: 380884 - RNA, 14 nt, Bordetella pertussis
gcuggccgccgcgg

SEQ ID NO: 380885 - RNA, 13 nt, Bordetella pertussis
gcuggccgccggc

SEQ ID NO: 380886 - RNA, 14 nt, Bordetella pertussis
gcuggccgccggcg

SEQ ID NO: 380887 - RNA, 18 nt, Bordetella pertussis
gcuggccgccggcgcggu

SEQ ID NO: 380888 - RNA, 14 nt, Bordetella pertussis
gcuggccgccugcu

SEQ ID NO: 380889 - RNA, 16 nt, Bordetella pertussis
gcuggccgccugcugc

SEQ ID NO: 380890 - RNA, 23 nt, Bordetella pertussis
gcuggccgaugucgccgccugcg

SEQ ID NO: 380891 - RNA, 13 nt, Bordetella pertussis
gcuggccgcgccc

SEQ ID NO: 380892 - RNA, 14 nt, Bordetella pertussis
gcuggccgcgcccg

SEQ ID NO: 380893 - RNA, 13 nt, Bordetella pertussis
gcuggccgcggua

SEQ ID NO: 380894 - RNA, 12 nt, Bordetella pertussis
gcuggccggcca

SEQ ID NO: 380895 - RNA, 14 nt, Bordetella pertussis
gcuggccggccagc

SEQ ID NO: 380896 - RNA, 21 nt, Bordetella pertussis
gcuggccggcguggccugccc

SEQ ID NO: 380897 - RNA, 21 nt, Bordetella pertussis
gcuggccgucgccgcccugcu

SEQ ID NO: 380898 - RNA, 17 nt, Bordetella pertussis
gcuggcgaagaacaccg

SEQ ID NO: 380899 - RNA, 20 nt, Bordetella pertussis
gcuggcgaagaacaccgccg

SEQ ID NO: 380900 - RNA, 21 nt, Bordetella pertussis
gcuggcgaagaacaccgccgc

SEQ ID NO: 380901 - RNA, 19 nt, Bordetella pertussis
gcuggcgaggaccugacca

SEQ ID NO: 380902 - RNA, 16 nt, Bordetella pertussis
gcuggcgaucacggcc

SEQ ID NO: 380903 - RNA, 12 nt, Bordetella pertussis
gcuggcgaucag

SEQ ID NO: 380904 - RNA, 17 nt, Bordetella pertussis
gcuggcgagcauggcau

SEQ ID NO: 380905 - RNA, 15 nt, Bordetella pertussis
gcuggcgaucaggcc

SEQ ID NO: 380906 - RNA, 20 nt, Bordetella pertussis
gcuggcgaugcccaccagcc

SEQ ID NO: 380907 - RNA, 18 nt, Bordetella pertussis
gcuggcgaugcgggccac

SEQ ID NO: 380908 - RNA, 14 nt, Bordetella pertussis
gcuggcgcaccagg

SEQ ID NO: 380909 - RNA, 12 nt, Bordetella pertussis
gcuggcgcagca

SEQ ID NO: 380910 - RNA, 15 nt, Bordetella pertussis
gcuggcgcagcacgc

SEQ ID NO: 380911 - RNA, 20 nt, Bordetella pertussis
gcuggcgcagcacgccgcgc

SEQ ID NO: 380912 - RNA, 22 nt, Bordetella pertussis
gcuggcgcagcacgccgcgcca

SEQ ID NO: 380913 - RNA, 15 nt, Bordetella pertussis
gcuggcgcagcagcg

SEQ ID NO: 380914 - RNA, 18 nt, Bordetella pertussis
gcuggcgcagcagcgccg

SEQ ID NO: 380915 - RNA, 20 nt, Bordetella pertussis
gcuggcgcagcagcgccggc

SEQ ID NO: 380916 - RNA, 21 nt, Bordetella pertussis
gcuggcgcagcagcgccggca

SEQ ID NO: 380917 - RNA, 15 nt, Bordetella pertussis
gcuggcgcccacgca

SEQ ID NO: 380918 - RNA, 21 nt, Bordetella pertussis
gcuggcgcccggccugcgggc

SEQ ID NO: 380919 - RNA, 22 nt, Bordetella pertussis
gcuggcgcaguaucccggccag

SEQ ID NO: 380920 - RNA, 16 nt, Bordetella pertussis
gcuggcgcauggcugg

SEQ ID NO: 380921 - RNA, 23 nt, Bordetella pertussis
gcuggcgccgcgcgccauccggc

SEQ ID NO: 380922 - RNA, 20 nt, Bordetella pertussis
gcuggcgcgagaaccaggcc

SEQ ID NO: 380923 - RNA, 13 nt, Bordetella pertussis
gcuggcgcgcacc

SEQ ID NO: 380924 - RNA, 17 nt, Bordetella pertussis
gcuggcgcgcaccaucg

SEQ ID NO: 380925 - RNA, 18 nt, Bordetella pertussis
gcuggcgcgcaccaucgc

SEQ ID NO: 380926 - RNA, 24 nt, Bordetella pertussis
gcuggcgcgccgccucgcgcucca

SEQ ID NO: 380927 - RNA, 14 nt, Bordetella pertussis
gcuggcgcggcugg

SEQ ID NO: 380928 - RNA, 16 nt, Bordetella pertussis
gcuggcggcgcugguc

SEQ ID NO: 380929 - RNA, 17 nt, Bordetella pertussis
gcuggcgguggccgcgc

SEQ ID NO: 380930 - RNA, 23 nt, Bordetella pertussis
gcuggcguccagccugcccgggc

SEQ ID NO: 380931 - RNA, 13 nt, Bordetella pertussis
gcuggcguccagg

SEQ ID NO: 380932 - RNA, 15 nt, Bordetella pertussis
gcugggccaggccgg

SEQ ID NO: 380933 - RNA, 16 nt, Bordetella pertussis
gcugggccaggccggc

SEQ ID NO: 380934 - RNA, 17 nt, Bordetella pertussis
gcugggccaggccggcc

SEQ ID NO: 380935 - RNA, 15 nt, Bordetella pertussis
gcugggccggcgcgc

SEQ ID NO: 380936 - RNA, 18 nt, Bordetella pertussis
gcugggccggcgcgcgca

SEQ ID NO: 380937 - RNA, 19 nt, Bordetella pertussis
gcugggccggcgcgcgcag

SEQ ID NO: 380938 - RNA, 17 nt, Bordetella pertussis
gcugggccugcugucgc

SEQ ID NO: 380939 - RNA, 17 nt, Bordetella pertussis
gcugggcgaggcgcugg

SEQ ID NO: 380940 - RNA, 20 nt, Bordetella pertussis
gcugggcgaucuucagcacc

SEQ ID NO: 380941 - RNA, 16 nt, Bordetella pertussis
gcugggcgccagcagc

SEQ ID NO: 380942 - RNA, 17 nt, Bordetella pertussis
gcugggcgccaugcgcc

SEQ ID NO: 380943 - RNA, 13 nt, Bordetella pertussis
gcugggcgcgcac

SEQ ID NO: 380944 - RNA, 17 nt, Bordetella pertussis
gcugggcgcgcacaagc

SEQ ID NO: 380945 - RNA, 18 nt, Bordetella pertussis
gcugggcgcgcacaagcg

SEQ ID NO: 380946 - RNA, 17 nt, Bordetella pertussis
gcugggcgcgccgcugc

SEQ ID NO: 380947 - RNA, 18 nt, Bordetella pertussis
gcugggcgcgccgcugca

SEQ ID NO: 380948 - RNA, 23 nt, Bordetella pertussis
gcugggcgcgccgcugcagcgcu

SEQ ID NO: 380949 - RNA, 22 nt, Bordetella pertussis
gcugggcgccaugcgcccggcc

SEQ ID NO: 380950 - RNA, 12 nt, Bordetella pertussis
gcugggcggcca

SEQ ID NO: 380951 - RNA, 14 nt, Bordetella pertussis
gcugggcggccagg

SEQ ID NO: 380952 - RNA, 15 nt, Bordetella pertussis
gcugggcggccaggc

SEQ ID NO: 380953 - RNA, 16 nt, Bordetella pertussis
gcugggcggccaggcg

SEQ ID NO: 380954 - RNA, 14 nt, Bordetella pertussis
gcugggcggcgggc

SEQ ID NO: 380955 - RNA, 17 nt, Bordetella pertussis
gcugggcuuugccugcg

SEQ ID NO: 380956 - RNA, 16 nt, Bordetella pertussis
gcuggggccgcgcgcc

SEQ ID NO: 380957 - RNA, 17 nt, Bordetella pertussis
gcuggggcgucccggug

SEQ ID NO: 380958 - RNA, 14 nt, Bordetella pertussis
gcuggggcugucgc

SEQ ID NO: 380959 - RNA, 19 nt, Bordetella pertussis
gcugggguggagcgcggcg

SEQ ID NO: 380960 - RNA, 18 nt, Bordetella pertussis
gcugggucaggucgcugc

SEQ ID NO: 380961 - RNA, 14 nt, Bordetella pertussis
gcuggucgcgcagc

SEQ ID NO: 380962 - RNA, 13 nt, Bordetella pertussis
gcuggucgcgccg

SEQ ID NO: 380963 - RNA, 13 nt, Bordetella pertussis
gcuggucgcgggc

SEQ ID NO: 380964 - RNA, 14 nt, Bordetella pertussis
gcuggucgcgggcc

SEQ ID NO: 380965 - RNA, 16 nt, Bordetella pertussis
gcuggucgcgggccag

SEQ ID NO: 380966 - RNA, 18 nt, Bordetella pertussis
gcuggucgcgggccaggc

SEQ ID NO: 380967 - RNA, 20 nt, Bordetella pertussis
gcuggucgcgggccaggccg

SEQ ID NO: 380968 - RNA, 21 nt, Bordetella pertussis
gcuggucgcgggccaggccgg

SEQ ID NO: 380969 - RNA, 23 nt, Bordetella pertussis
gcuggucgcgggccaggccggcc

SEQ ID NO: 380970 - RNA, 18 nt, Bordetella pertussis
gcuggucgggaugccccg

SEQ ID NO: 380971 - RNA, 22 nt, Bordetella pertussis
gcuggugauguccugcaggccc

SEQ ID NO: 380972 - RNA, 23 nt, Bordetella pertussis
gcuggugauguccugcaggcccg

SEQ ID NO: 380973 - RNA, 15 nt, Bordetella pertussis
gcuggugccaguccc

SEQ ID NO: 380974 - RNA, 11 nt, Bordetella pertussis
gcuggugccgc

SEQ ID NO: 380975 - RNA, 14 nt, Bordetella pertussis
gcuggugcgccgug

SEQ ID NO: 380976 - RNA, 12 nt, Bordetella pertussis
gcuggugccgcu

SEQ ID NO: 380977 - RNA, 17 nt, Bordetella pertussis
gcuggugccgcuggcgg

SEQ ID NO: 380978 - RNA, 16 nt, Bordetella pertussis
gcuggugcuggugccg

SEQ ID NO: 380979 - RNA, 15 nt, Bordetella pertussis
gcuguaggcgccggc

SEQ ID NO: 380980 - RNA, 16 nt, Bordetella pertussis
gcuguagucgccgcug

SEQ ID NO: 380981 - RNA, 19 nt, Bordetella pertussis
gcuguccaccugcaccguc

SEQ ID NO: 380982 - RNA, 17 nt, Bordetella pertussis
gcugucgcgcgacuggc

SEQ ID NO: 380983 - RNA, 23 nt, Bordetella pertussis
gcugucgcgcgacuggcccaggc

SEQ ID NO: 380984 - RNA, 19 nt, Bordetella pertussis
gcugucgcgcgcaucgccg

SEQ ID NO: 380985 - RNA, 14 nt, Bordetella pertussis
gcugucgcgcgggu

SEQ ID NO: 380986 - RNA, 20 nt, Bordetella pertussis
gcugucgcucaugaccagcg

SEQ ID NO: 380987 - RNA, 14 nt, Bordetella pertussis
gcugucggucagca

SEQ ID NO: 380988 - RNA, 16 nt, Bordetella pertussis
gcugucgugccgcacg

SEQ ID NO: 380989 - RNA, 21 nt, Bordetella pertussis
gcugugccccacacgcgcgca

SEQ ID NO: 380990 - RNA, 18 nt, Bordetella pertussis
gcugugcgacgauccggc

SEQ ID NO: 380991 - RNA, 20 nt, Bordetella pertussis
gcugugcgcguuccggccgc

SEQ ID NO: 380992 - RNA, 16 nt, Bordetella pertussis
gcuguugcccaccagc

SEQ ID NO: 380993 - RNA, 13 nt, Bordetella pertussis
gcuguugcuggcc

SEQ ID NO: 380994 - RNA, 19 nt, Bordetella pertussis
gcuguugcuccaggccggc

SEQ ID NO: 380995 - RNA, 18 nt, Bordetella pertussis
gcuguuggcguggcuggc

SEQ ID NO: 380996 - RNA, 17 nt, Bordetella pertussis
gcuugaccacggccagc

SEQ ID NO: 380997 - RNA, 19 nt, Bordetella pertussis
gcuugaccacggccagcag

SEQ ID NO: 380998 - RNA, 21 nt, Bordetella pertussis
gcuugaccacggccagcagca

SEQ ID NO: 380999 - RNA, 19 nt, Bordetella pertussis
gcuugacccguuugcgcag

SEQ ID NO: 381000 - RNA, 20 nt, Bordetella pertussis
gcuugaccgccucgaucgcc

SEQ ID NO: 381001 - RNA, 21 nt, Bordetella pertussis
gcuugaccgccagcauccagc

SEQ ID NO: 381002 - RNA, 17 nt, Bordetella pertussis
gcuugaccuugagcacg

SEQ ID NO: 381003 - RNA, 20 nt, Bordetella pertussis
gcuugacguagcggaucgcg

SEQ ID NO: 381004 - RNA, 14 nt, Bordetella pertussis
gcuugacguccagc

SEQ ID NO: 381005 - RNA, 16 nt, Bordetella pertussis
gcuugacguccagcca

SEQ ID NO: 381006 - RNA, 20 nt, Bordetella pertussis
gcuugacguccagccagggu

SEQ ID NO: 381007 - RNA, 17 nt, Bordetella pertussis
gcuugaggccgcgcgcc

SEQ ID NO: 381008 - RNA, 15 nt, Bordetella pertussis
gcuugauggccagcg

SEQ ID NO: 381009 - RNA, 17 nt, Bordetella pertussis
gcuugauggccagcgcg

SEQ ID NO: 381010 - RNA, 22 nt, Bordetella pertussis
gcuugauggccagcgcgcgggc

SEQ ID NO: 381011 - RNA, 15 nt, Bordetella pertussis
gcuugaugcccagcu

SEQ ID NO: 381012 - RNA, 16 nt, Bordetella pertussis
gcuugaugccggcguu

SEQ ID NO: 381013 - RNA, 16 nt, Bordetella pertussis
gcuugcacgccggcca

SEQ ID NO: 381014 - RNA, 18 nt, Bordetella pertussis
gcuugcacgccggccacg

SEQ ID NO: 381015 - RNA, 21 nt, Bordetella pertussis
gcuugcacgccggccacgaug

SEQ ID NO: 381016 - RNA, 19 nt, Bordetella pertussis
gcuugccagcucgacgcgc

SEQ ID NO: 381017 - RNA, 18 nt, Bordetella pertussis
gcuugccauaggccagcg

SEQ ID NO: 381018 - RNA, 19 nt, Bordetella pertussis
gcuugccauaggccagcgc

SEQ ID NO: 381019 - RNA, 15 nt, Bordetella pertussis
gcuugcccaggccgg

SEQ ID NO: 381020 - RNA, 20 nt, Bordetella pertussis
gcuugcccaggccggcgcgc

SEQ ID NO: 381021 - RNA, 15 nt, Bordetella pertussis
gcuugcccgcgcgca

SEQ ID NO: 381022 - RNA, 12 nt, Bordetella pertussis
gcuugcccggcg

SEQ ID NO: 381023 - RNA, 22 nt, Bordetella pertussis
gcuugcccgugcgugugccugu

SEQ ID NO: 381024 - RNA, 20 nt, Bordetella pertussis
gcuugccgaccuccaggccc

SEQ ID NO: 381025 - RNA, 23 nt, Bordetella pertussis
gcuugccgcccacugccaggcga

SEQ ID NO: 381026 - RNA, 14 nt, Bordetella pertussis
gcuugccgccggac

SEQ ID NO: 381027 - RNA, 19 nt, Bordetella pertussis
gcuugccgcggcgcggccu

SEQ ID NO: 381028 - RNA, 19 nt, Bordetella pertussis
gcuugccggugcucggcca

SEQ ID NO: 381029 - RNA, 22 nt, Bordetella pertussis
gcuugccggugcucggccagcg

SEQ ID NO: 381030 - RNA, 18 nt, Bordetella pertussis
gcuugcgcaagccggccg

SEQ ID NO: 381031 - RNA, 14 nt, Bordetella pertussis
gcuugcgccagcca

SEQ ID NO: 381032 - RNA, 15 nt, Bordetella pertussis
gcuugcgccagccac

SEQ ID NO: 381033 - RNA, 22 nt, Bordetella pertussis
gcuugcgccagccacgcgcgcu

SEQ ID NO: 381034 - RNA, 15 nt, Bordetella pertussis
gcuugcgcgccacgu

SEQ ID NO: 381035 - RNA, 13 nt, Bordetella pertussis
gcuugcgcgccag

SEQ ID NO: 381036 - RNA, 16 nt, Bordetella pertussis
gcuugcgcgccugcug

SEQ ID NO: 381037 - RNA, 18 nt, Bordetella pertussis
gcuugcgcgccugcuggu

SEQ ID NO: 381038 - RNA, 17 nt, Bordetella pertussis
gcuugcgcguaggcgcg

SEQ ID NO: 381039 - RNA, 21 nt, Bordetella pertussis
gcuugcgcguaggcgcgcgca

SEQ ID NO: 381040 - RNA, 17 nt, Bordetella pertussis
gcuugcgcuggcgcgcg

SEQ ID NO: 381041 - RNA, 20 nt, Bordetella pertussis
gcuugcgcuggcgcgcggcc

SEQ ID NO: 381042 - RNA, 21 nt, Bordetella pertussis
gcuugcgcuggcgcgcggccg

SEQ ID NO: 381043 - RNA, 15 nt, Bordetella pertussis
gcuugcgcuuggcag

SEQ ID NO: 381044 - RNA, 23 nt, Bordetella pertussis
gcuugcgcucgguguggauggcg

SEQ ID NO: 381045 - RNA, 19 nt, Bordetella pertussis
gcuugcggccggcgcugau

SEQ ID NO: 381046 - RNA, 22 nt, Bordetella pertussis
gcuugcgguccguacgccacuu

SEQ ID NO: 381047 - RNA, 18 nt, Bordetella pertussis
gcuugcguuggcauggcg

SEQ ID NO: 381048 - RNA, 19 nt, Bordetella pertussis
gcuugcguuggcauggcgc

SEQ ID NO: 381049 - RNA, 17 nt, Bordetella pertussis
gcuuggccaccacgccc

SEQ ID NO: 381050 - RNA, 12 nt, Bordetella pertussis
gcuuggccagcu

SEQ ID NO: 381051 - RNA, 13 nt, Bordetella pertussis
gcuuggccaggcu

SEQ ID NO: 381052 - RNA, 18 nt, Bordetella pertussis
gcuuggcccugcagcggc

SEQ ID NO: 381053 - RNA, 19 nt, Bordetella pertussis
gcuuggcccugcagcggcc

SEQ ID NO: 381054 - RNA, 18 nt, Bordetella pertussis
gcuuggcgcgcagcagcg

SEQ ID NO: 381055 - RNA, 14 nt, Bordetella pertussis
gcuuggcggccagg

SEQ ID NO: 381056 - RNA, 20 nt, Bordetella pertussis
gcuuggcggccaggaucgcg

SEQ ID NO: 381057 - RNA, 17 nt, Bordetella pertussis
gcuuggcggucugggcg

SEQ ID NO: 381058 - RNA, 15 nt, Bordetella pertussis
gcuuggcguagccgg

SEQ ID NO: 381059 - RNA, 15 nt, Bordetella pertussis
gcuuggcgucagcgu

SEQ ID NO: 381060 - RNA, 23 nt, Bordetella pertussis
gcuugggacgcuucgagaugccg

SEQ ID NO: 381061 - RNA, 21 nt, Bordetella pertussis
gcuugggcccggcguagcugc

SEQ ID NO: 381062 - RNA, 14 nt, Bordetella pertussis
gcuugggggcgugg

SEQ ID NO: 381063 - RNA, 17 nt, Bordetella pertussis
gcuugguugucgcgcac

SEQ ID NO: 381064 - RNA, 19 nt, Bordetella pertussis
gcuugucgaccaccggcuu

SEQ ID NO: 381065 - RNA, 20 nt, Bordetella pertussis
gcuuucagcgccgagcgcca

SEQ ID NO: 381066 - RNA, 17 nt, Bordetella pertussis
gcuuuccaggguggcca

SEQ ID NO: 381067 - RNA, 15 nt, Bordetella pertussis
gcuuuuccacgcccg

SEQ ID NO: 381068 - RNA, 13 nt, Bordetella pertussis
gcuuuuucucggc

SEQ ID NO: 381069 - RNA, 18 nt, Bordetella pertussis
gcuuuuuguugcgcgccg

SEQ ID NO: 381070 - RNA, 15 nt, Bordetella pertussis
ggaaaaccggcgccu

SEQ ID NO: 381071 - RNA, 19 nt, Bordetella pertussis
ggaacgcgccgcuggcguc

SEQ ID NO: 381072 - RNA, 17 nt, Bordetella pertussis
ggaacggcaccagccgg

SEQ ID NO: 381073 - RNA, 13 nt, Bordetella pertussis
ggaacgugccguc

SEQ ID NO: 381074 - RNA, 20 nt, Bordetella pertussis
ggaacgugccgucgggcgcc

SEQ ID NO: 381075 - RNA, 16 nt, Bordetella pertussis
ggaagcugucggcgcu

SEQ ID NO: 381076 - RNA, 17 nt, Bordetella pertussis
ggaaggcgagcgcggca

SEQ ID NO: 381077 - RNA, 20 nt, Bordetella pertussis
ggaaggcgagcgcggcauag

SEQ ID NO: 381078 - RNA, 20 nt, Bordetella pertussis
ggaagguccacggcauggcc

SEQ ID NO: 381079 - RNA, 13 nt, Bordetella pertussis
ggaaucaccgccg

SEQ ID NO: 381080 - RNA, 17 nt, Bordetella pertussis
ggaaucauuggccagcg

SEQ ID NO: 381081 - RNA, 17 nt, Bordetella pertussis
ggaauccuggugccagu

SEQ ID NO: 381082 - RNA, 15 nt, Bordetella pertussis
ggaaucgcguucacg

SEQ ID NO: 381083 - RNA, 13 nt, Bordetella pertussis
ggaaucggcaccu

SEQ ID NO: 381084 - RNA, 20 nt, Bordetella pertussis
ggaaugaagcgcgacaugac

SEQ ID NO: 381085 - RNA, 21 nt, Bordetella pertussis
ggacaagaaagcggcgauacg

SEQ ID NO: 381086 - RNA, 19 nt, Bordetella pertussis
ggacaaggcgcguaugacg

SEQ ID NO: 381087 - RNA, 24 nt, Bordetella pertussis
ggacacgccacuacacucugcccg

SEQ ID NO: 381088 - RNA, 23 nt, Bordetella pertussis
ggacagauacuguucgccgcacc

SEQ ID NO: 381089 - RNA, 16 nt, Bordetella pertussis
ggacagauccagcgcg

SEQ ID NO: 381090 - RNA, 18 nt, Bordetella pertussis
ggacagauccagcgcggc

SEQ ID NO: 381091 - RNA, 18 nt, Bordetella pertussis
ggacagaugccguccugg

SEQ ID NO: 381092 - RNA, 20 nt, Bordetella pertussis
ggacagcaguucggccggcg

SEQ ID NO: 381093 - RNA, 23 nt, Bordetella pertussis
ggacagcaguuucugcaccggcg

SEQ ID NO: 381094 - RNA, 23 nt, Bordetella pertussis
ggacagccccagcagcacgccca

SEQ ID NO: 381095 - RNA, 23 nt, Bordetella pertussis
ggacagcccgcgcuggcgcagca

SEQ ID NO: 381096 - RNA, 15 nt, Bordetella pertussis
ggacagcgccagccc

SEQ ID NO: 381097 - RNA, 20 nt, Bordetella pertussis
ggacagcgcguuggcguugc

SEQ ID NO: 381098 - RNA, 20 nt, Bordetella pertussis
ggacaggcaccccagcaccc

SEQ ID NO: 381099 - RNA, 20 nt, Bordetella pertussis
ggacaggcaccccggcgccg

SEQ ID NO: 381100 - RNA, 15 nt, Bordetella pertussis
ggacaggcacccgcg

SEQ ID NO: 381101 - RNA, 17 nt, Bordetella pertussis
ggacaggcacccgcgcg

SEQ ID NO: 381102 - RNA, 21 nt, Bordetella pertussis
ggacaggcacccgcgcgcagc

SEQ ID NO: 381103 - RNA, 15 nt, Bordetella pertussis
ggacaggcaccgccg

SEQ ID NO: 381104 - RNA, 12 nt, Bordetella pertussis
ggacaggcaccu

SEQ ID NO: 381105 - RNA, 15 nt, Bordetella pertussis
ggacaggcaccugcg

SEQ ID NO: 381106 - RNA, 21 nt, Bordetella pertussis
ggacaggcaccuuggcccggc

SEQ ID NO: 381107 - RNA, 16 nt, Bordetella pertussis
ggacaggcacgcgccg

SEQ ID NO: 381108 - RNA, 21 nt, Bordetella pertussis
ggacaggaacuccggcggcgc

SEQ ID NO: 381109 - RNA, 21 nt, Bordetella pertussis
ggacaggcccagcccgccgau

SEQ ID NO: 381110 - RNA, 19 nt, Bordetella pertussis
ggaccgaggugccagccug

SEQ ID NO: 381111 - RNA, 17 nt, Bordetella pertussis
ggaccgcgaugcugcgc

SEQ ID NO: 381112 - RNA, 15 nt, Bordetella pertussis
ggaccgugccgccga

SEQ ID NO: 381113 - RNA, 17 nt, Bordetella pertussis
ggaccuguggcgcaccc

SEQ ID NO: 381114 - RNA, 21 nt, Bordetella pertussis
ggaccuuacggauaauugggc

SEQ ID NO: 381115 - RNA, 14 nt, Bordetella pertussis
ggaccuguacuggc

SEQ ID NO: 381116 - RNA, 16 nt, Bordetella pertussis
ggacgaacaggccgcc

SEQ ID NO: 381117 - RNA, 17 nt, Bordetella pertussis
ggacgaacaggccgccg

SEQ ID NO: 381118 - RNA, 23 nt, Bordetella pertussis
ggacgaccaacucgaggcggcgc

SEQ ID NO: 381119 - RNA, 21 nt, Bordetella pertussis
ggacgagacaggcgcgccauc

SEQ ID NO: 381120 - RNA, 14 nt, Bordetella pertussis
ggacgagcgcagca

SEQ ID NO: 381121 - RNA, 19 nt, Bordetella pertussis
ggacgccgaccucggcacc

SEQ ID NO: 381122 - RNA, 17 nt, Bordetella pertussis
ggacgagggccgcggcg

SEQ ID NO: 381123 - RNA, 19 nt, Bordetella pertussis
ggacgagggccggcgccag

SEQ ID NO: 381124 - RNA, 16 nt, Bordetella pertussis
ggacgccgccggccca

SEQ ID NO: 381125 - RNA, 16 nt, Bordetella pertussis
ggacgccggcgggcag

SEQ ID NO: 381126 - RNA, 14 nt, Bordetella pertussis
ggacgccucgccgg

SEQ ID NO: 381127 - RNA, 17 nt, Bordetella pertussis
ggagcaacuggggcgcu

SEQ ID NO: 381128 - RNA, 13 nt, Bordetella pertussis
ggagcagcagcgg

SEQ ID NO: 381129 - RNA, 23 nt, Bordetella pertussis
ggagcauggcaugagcgccucgu

SEQ ID NO: 381130 - RNA, 13 nt, Bordetella pertussis
ggagccgcgcaca

SEQ ID NO: 381131 - RNA, 17 nt, Bordetella pertussis
ggagccggagcagucgc

SEQ ID NO: 381132 - RNA, 20 nt, Bordetella pertussis
ggagccugucccugcgggga

SEQ ID NO: 381133 - RNA, 21 nt, Bordetella pertussis
ggagcgacccguggcccgggu

SEQ ID NO: 381134 - RNA, 14 nt, Bordetella pertussis
ggagcgccacgccg

SEQ ID NO: 381135 - RNA, 15 nt, Bordetella pertussis
ggagcgccacgccgu

SEQ ID NO: 381136 - RNA, 20 nt, Bordetella pertussis
ggagcgccacgccgucagcg

SEQ ID NO: 381137 - RNA, 11 nt, Bordetella pertussis
ggagcgcggcg

SEQ ID NO: 381138 - RNA, 14 nt, Bordetella pertussis
ggagcgcggcggcg

SEQ ID NO: 381139 - RNA, 22 nt, Bordetella pertussis
ggagcucuaugucgccggccag

SEQ ID NO: 381140 - RNA, 22 nt, Bordetella pertussis
ggagcugcugugcgccggggcg

SEQ ID NO: 381141 - RNA, 13 nt, Bordetella pertussis
ggaggacgccgac

SEQ ID NO: 381142 - RNA, 14 nt, Bordetella pertussis
ggaggacgccgacc

SEQ ID NO: 381143 - RNA, 23 nt, Bordetella pertussis
ggaggcacuccgucauggcgccg

SEQ ID NO: 381144 - RNA, 17 nt, Bordetella pertussis
ggaggauacggccagcg

SEQ ID NO: 381145 - RNA, 17 nt, Bordetella pertussis
ggaggcgcagcgcggca

SEQ ID NO: 381146 - RNA, 14 nt, Bordetella pertussis
ggaggcgcgcagcu

SEQ ID NO: 381147 - RNA, 13 nt, Bordetella pertussis
ggaggggcgcagg

SEQ ID NO: 381148 - RNA, 21 nt, Bordetella pertussis
ggagguaugcacgaccaggcc

SEQ ID NO: 381149 - RNA, 23 nt, Bordetella pertussis
ggagguucgaauccucucgcccc

SEQ ID NO: 381150 - RNA, 19 nt, Bordetella pertussis
ggaguucuucuuggccaga

SEQ ID NO: 381151 - RNA, 22 nt, Bordetella pertussis
ggauaacaucaugggcgaagcc

SEQ ID NO: 381152 - RNA, 16 nt, Bordetella pertussis
ggauaccggagcggcu

SEQ ID NO: 381153 - RNA, 19 nt, Bordetella pertussis
ggauaccgcuggccaggcu

SEQ ID NO: 381154 - RNA, 17 nt, Bordetella pertussis
ggauagaguucggcgcg

SEQ ID NO: 381155 - RNA, 20 nt, Bordetella pertussis
ggauagaguucggcgcggcc

SEQ ID NO: 381156 - RNA, 19 nt, Bordetella pertussis
ggauauccacgccuucggc

SEQ ID NO: 381157 - RNA, 17 nt, Bordetella pertussis
ggauaucggccaggcgc

SEQ ID NO: 381158 - RNA, 12 nt, Bordetella pertussis
ggauauggcgcc

SEQ ID NO: 381159 - RNA, 15 nt, Bordetella pertussis
ggauauucgucggcc

SEQ ID NO: 381160 - RNA, 18 nt, Bordetella pertussis
ggaucaccagcccggcgg

SEQ ID NO: 381161 - RNA, 20 nt, Bordetella pertussis
ggaucaggaugggcgcggcg

SEQ ID NO: 381162 - RNA, 14 nt, Bordetella pertussis
ggauccacgccgcc

SEQ ID NO: 381163 - RNA, 19 nt, Bordetella pertussis
ggauccacgccgccggcca

SEQ ID NO: 381164 - RNA, 15 nt, Bordetella pertussis
ggauccagccaugga

SEQ ID NO: 381165 - RNA, 14 nt, Bordetella pertussis
ggaucccaggccgg

SEQ ID NO: 381166 - RNA, 15 nt, Bordetella pertussis
ggaucccggcgauca

SEQ ID NO: 381167 - RNA, 17 nt, Bordetella pertussis
ggauccggcgcuggcgc

SEQ ID NO: 381168 - RNA, 16 nt, Bordetella pertussis
ggaucgaaaccggcgc

SEQ ID NO: 381169 - RNA, 17 nt, Bordetella pertussis
ggaucgaaaccggcgcg

SEQ ID NO: 381170 - RNA, 19 nt, Bordetella pertussis
ggaucgaaggcagcgcggc

SEQ ID NO: 381171 - RNA, 23 nt, Bordetella pertussis
ggaucgacugccccauggcaugc

SEQ ID NO: 381172 - RNA, 17 nt, Bordetella pertussis
ggaucgcacacaccgcg

SEQ ID NO: 381173 - RNA, 21 nt, Bordetella pertussis
ggaucgcacacaccgcgucau

SEQ ID NO: 381174 - RNA, 17 nt, Bordetella pertussis
ggaucgcggccagcggc

SEQ ID NO: 381175 - RNA, 18 nt, Bordetella pertussis
ggaucgcggccagcggca

SEQ ID NO: 381176 - RNA, 23 nt, Bordetella pertussis
ggaucgcggccagcggcaggggc

SEQ ID NO: 381177 - RNA, 21 nt, Bordetella pertussis
ggaucgugcccagcuggcacc

SEQ ID NO: 381178 - RNA, 13 nt, Bordetella pertussis
ggaucugcgagcc

SEQ ID NO: 381179 - RNA, 22 nt, Bordetella pertussis
ggaucugcgagccuucggccgg

SEQ ID NO: 381180 - RNA, 23 nt, Bordetella pertussis
ggaugaacaucggcagcgaggcg

SEQ ID NO: 381181 - RNA, 21 nt, Bordetella pertussis
ggaugaagggcuggccggcca

SEQ ID NO: 381182 - RNA, 18 nt, Bordetella pertussis
ggaugcacguagcgcagc

SEQ ID NO: 381183 - RNA, 14 nt, Bordetella pertussis
ggaugccccgcccg

SEQ ID NO: 381184 - RNA, 22 nt, Bordetella pertussis
ggaugcccgggguugccaagau

SEQ ID NO: 381185 - RNA, 17 nt, Bordetella pertussis
ggaugcccuggguggcg

SEQ ID NO: 381186 - RNA, 21 nt, Bordetella pertussis
ggaugcccuggguggcggggc

SEQ ID NO: 381187 - RNA, 23 nt, Bordetella pertussis
ggaugccguccacgccgcgcgcg

SEQ ID NO: 381188 - RNA, 20 nt, Bordetella pertussis
ggaugccgucuuggcgggcu

SEQ ID NO: 381189 - RNA, 16 nt, Bordetella pertussis
ggaugcgcgccaggcu

SEQ ID NO: 381190 - RNA, 22 nt, Bordetella pertussis
ggaugcgcgccaggcugucguc

SEQ ID NO: 381191 - RNA, 20 nt, Bordetella pertussis
ggaugcgcgccccgucggcc

SEQ ID NO: 381192 - RNA, 14 nt, Bordetella pertussis
ggaugcgcgcggcc

SEQ ID NO: 381193 - RNA, 15 nt, Bordetella pertussis
ggaugcgcgcggcca

SEQ ID NO: 381194 - RNA, 12 nt, Bordetella pertussis
ggaugcgcggca

SEQ ID NO: 381195 - RNA, 14 nt, Bordetella pertussis
ggaugcgcggcacg

SEQ ID NO: 381196 - RNA, 14 nt, Bordetella pertussis
ggaugcgcuggccg

SEQ ID NO: 381197 - RNA, 15 nt, Bordetella pertussis
ggaugcgcuugccgc

SEQ ID NO: 381198 - RNA, 18 nt, Bordetella pertussis
ggaugcgcuugccgccca

SEQ ID NO: 381199 - RNA, 20 nt, Bordetella pertussis
ggaugcgguacugcggcgcc

SEQ ID NO: 381200 - RNA, 13 nt, Bordetella pertussis
ggaugcuccagcu

SEQ ID NO: 381201 - RNA, 18 nt, Bordetella pertussis
ggauggaguucagcagcu

SEQ ID NO: 381202 - RNA, 14 nt, Bordetella pertussis
ggauggcgaacaug

SEQ ID NO: 381203 - RNA, 23 nt, Bordetella pertussis
ggauggcgccagcccgcccgcga

SEQ ID NO: 381204 - RNA, 16 nt, Bordetella pertussis
ggauggcuggccgagu

SEQ ID NO: 381205 - RNA, 18 nt, Bordetella pertussis
ggauggcuuccugcggca

SEQ ID NO: 381206 - RNA, 17 nt, Bordetella pertussis
ggauggcuuuggcgaau

SEQ ID NO: 381207 - RNA, 14 nt, Bordetella pertussis
ggauggcggccgcc

SEQ ID NO: 381208 - RNA, 14 nt, Bordetella pertussis
ggaugggccaccca

SEQ ID NO: 381209 - RNA, 14 nt, Bordetella pertussis
ggaugggcgcggcg

SEQ ID NO: 381210 - RNA, 15 nt, Bordetella pertussis
ggauggugcucggcg

SEQ ID NO: 381211 - RNA, 14 nt, Bordetella pertussis
ggauguccggcgcg

SEQ ID NO: 381212 - RNA, 15 nt, Bordetella pertussis
ggauguccggcgcga

SEQ ID NO: 381213 - RNA, 13 nt, Bordetella pertussis
ggaugugcagcgc

SEQ ID NO: 381214 - RNA, 15 nt, Bordetella pertussis
ggaugugcaggccga

SEQ ID NO: 381215 - RNA, 22 nt, Bordetella pertussis
ggcagacgaugcccaggcccgc

SEQ ID NO: 381216 - RNA, 22 nt, Bordetella pertussis
ggcagagggcgacggcggcgug

SEQ ID NO: 381217 - RNA, 20 nt, Bordetella pertussis
ggcagaucggcgcuggccug

SEQ ID NO: 381218 - RNA, 15 nt, Bordetella pertussis
ggcagaugcgcgcca

SEQ ID NO: 381219 - RNA, 17 nt, Bordetella pertussis
ggcagaugcgcgccagg

SEQ ID NO: 381220 - RNA, 18 nt, Bordetella pertussis
ggcagaugaucuacgcgc

SEQ ID NO: 381221 - RNA, 19 nt, Bordetella pertussis
ggcagauugaugcccaugc

SEQ ID NO: 381222 - RNA, 16 nt, Bordetella pertussis
ggcagcaauucgaccg

SEQ ID NO: 381223 - RNA, 19 nt, Bordetella pertussis
ggcagcaauucgaccggca

SEQ ID NO: 381224 - RNA, 21 nt, Bordetella pertussis
ggcagcaauucgaccggcagg

SEQ ID NO: 381225 - RNA, 22 nt, Bordetella pertussis
ggcagcacaagggccccucgcg

SEQ ID NO: 381226 - RNA, 14 nt, Bordetella pertussis
ggcagcacccagcg

SEQ ID NO: 381227 - RNA, 16 nt, Bordetella pertussis
ggcagcaccgccaugu

SEQ ID NO: 381228 - RNA, 20 nt, Bordetella pertussis
ggcagcaccgccaugugcgc

SEQ ID NO: 381229 - RNA, 21 nt, Bordetella pertussis
ggcagcaccggggcagggcgg

SEQ ID NO: 381230 - RNA, 13 nt, Bordetella pertussis
ggcagcaccucgg

SEQ ID NO: 381231 - RNA, 24 nt, Bordetella pertussis
ggcagcaccucggacgagacaggc

SEQ ID NO: 381232 - RNA, 15 nt, Bordetella pertussis
ggcagcacgauggcg

SEQ ID NO: 381233 - RNA, 17 nt, Bordetella pertussis
ggcagcacgauggcgcc

SEQ ID NO: 381234 - RNA, 12 nt, Bordetella pertussis
ggcagcacgcgc

SEQ ID NO: 381235 - RNA, 14 nt, Bordetella pertussis
ggcagcacuaccug

SEQ ID NO: 381236 - RNA, 17 nt, Bordetella pertussis
ggcagcacuaccugcgc

SEQ ID NO: 381237 - RNA, 19 nt, Bordetella pertussis
ggcagcagaucggcggccu

SEQ ID NO: 381238 - RNA, 15 nt, Bordetella pertussis
ggcagcagcacgccc

SEQ ID NO: 381239 - RNA, 14 nt, Bordetella pertussis
ggcagcagcagcgc

SEQ ID NO: 381240 - RNA, 17 nt, Bordetella pertussis
ggcagcagcagcgcggu

SEQ ID NO: 381241 - RNA, 14 nt, Bordetella pertussis
ggcagcagcagcgu

SEQ ID NO: 381242 - RNA, 19 nt, Bordetella pertussis
ggcagcagcgcgccgggcg

SEQ ID NO: 381243 - RNA, 15 nt, Bordetella pertussis
ggcagcaggccggcg

SEQ ID NO: 381244 - RNA, 13 nt, Bordetella pertussis
ggcagcaggcgca

SEQ ID NO: 381245 - RNA, 18 nt, Bordetella pertussis
ggcagcaggcgcaucagc

SEQ ID NO: 381246 - RNA, 16 nt, Bordetella pertussis
ggcagcaggcgcguga

SEQ ID NO: 381247 - RNA, 23 nt, Bordetella pertussis
ggcagcagggauucggcgaacga

SEQ ID NO: 381248 - RNA, 18 nt, Bordetella pertussis
ggcagcauggcgccaugc

SEQ ID NO: 381249 - RNA, 23 nt, Bordetella pertussis
ggcagccagaacaugagccaugc

SEQ ID NO: 381250 - RNA, 13 nt, Bordetella pertussis
ggcagccauccca

SEQ ID NO: 381251 - RNA, 22 nt, Bordetella pertussis
ggcagccccagcgcccaggcga

SEQ ID NO: 381252 - RNA, 13 nt, Bordetella pertussis
ggcagccccagcg

SEQ ID NO: 381253 - RNA, 14 nt, Bordetella pertussis
ggcagcccgcgcac

SEQ ID NO: 381254 - RNA, 15 nt, Bordetella pertussis
ggcagccggccaugg

SEQ ID NO: 381255 - RNA, 16 nt, Bordetella pertussis
ggcagccggccauggc

SEQ ID NO: 381256 - RNA, 21 nt, Bordetella pertussis
ggcagccggccauggccgcca

SEQ ID NO: 381257 - RNA, 14 nt, Bordetella pertussis
ggcagccggccccg

SEQ ID NO: 381258 - RNA, 18 nt, Bordetella pertussis
ggcagccggccccgcaag

SEQ ID NO: 381259 - RNA, 20 nt, Bordetella pertussis
ggcagcgaauacggcaagca

SEQ ID NO: 381260 - RNA, 16 nt, Bordetella pertussis
ggcagcgaggcgcagc

SEQ ID NO: 381261 - RNA, 14 nt, Bordetella pertussis
ggcagcgaggcgcg

SEQ ID NO: 381262 - RNA, 18 nt, Bordetella pertussis
ggcagcgccgcaacccgc

SEQ ID NO: 381263 - RNA, 19 nt, Bordetella pertussis
ggcagcgcccgcgccaucg

SEQ ID NO: 381264 - RNA, 22 nt, Bordetella pertussis
ggcagcgcgaacggcgggcgga

SEQ ID NO: 381265 - RNA, 19 nt, Bordetella pertussis
ggcagcucgcgcugcgcgc

SEQ ID NO: 381266 - RNA, 16 nt, Bordetella pertussis
ggcagcucgcggucgu

SEQ ID NO: 381267 - RNA, 22 nt, Bordetella pertussis
ggcagcucggugcagcccagca

SEQ ID NO: 381268 - RNA, 17 nt, Bordetella pertussis
ggcagcugacgggucuc

SEQ ID NO: 381269 - RNA, 23 nt, Bordetella pertussis
ggcagcugcgcgucgacagcaug

SEQ ID NO: 381270 - RNA, 17 nt, Bordetella pertussis
ggcagcuggcgcgggcg

SEQ ID NO: 381271 - RNA, 15 nt, Bordetella pertussis
ggcagcuugaccgcc

SEQ ID NO: 381272 - RNA, 21 nt, Bordetella pertussis
ggcagcuugucgaucgccacc

SEQ ID NO: 381273 - RNA, 17 nt, Bordetella pertussis
ggcaggaagccggcccg

SEQ ID NO: 381274 - RNA, 14 nt, Bordetella pertussis
ggcaggacgccggc

SEQ ID NO: 381275 - RNA, 20 nt, Bordetella pertussis
ggcaggacgccggcgccggc

SEQ ID NO: 381276 - RNA, 23 nt, Bordetella pertussis
ggcaggacggggaacaggcgcgc

SEQ ID NO: 381277 - RNA, 19 nt, Bordetella pertussis
ggcaggcacacgaccggcu

SEQ ID NO: 381278 - RNA, 15 nt, Bordetella pertussis
ggcaggcacuggcgc

SEQ ID NO: 381279 - RNA, 22 nt, Bordetella pertussis
ggcaggcacuggcgcggcgcua

SEQ ID NO: 381280 - RNA, 22 nt, Bordetella pertussis
ggcaggcauucgaacaacagcg

SEQ ID NO: 381281 - RNA, 23 nt, Bordetella pertussis
ggcaggcauucgaacaacagcgc

SEQ ID NO: 381282 - RNA, 15 nt, Bordetella pertussis
ggcaggccagcgcca

SEQ ID NO: 381283 - RNA, 14 nt, Bordetella pertussis
ggcaggcccagcca

SEQ ID NO: 381284 - RNA, 15 nt, Bordetella pertussis
ggcaggcccagccag

SEQ ID NO: 381285 - RNA, 17 nt, Bordetella pertussis
ggcaggcccagccagcg

SEQ ID NO: 381286 - RNA, 17 nt, Bordetella pertussis
ggcaggcccaugacgcc

SEQ ID NO: 381287 - RNA, 21 nt, Bordetella pertussis
ggcaggcccaugauccgcacc

SEQ ID NO: 381288 - RNA, 16 nt, Bordetella pertussis
ggcaggcccugccgcc

SEQ ID NO: 381289 - RNA, 22 nt, Bordetella pertussis
ggcaggucgauggggucgggcc

SEQ ID NO: 381290 - RNA, 14 nt, Bordetella pertussis
ggcaggucgccagc

SEQ ID NO: 381291 - RNA, 15 nt, Bordetella pertussis
ggcaggucgccagca

SEQ ID NO: 381292 - RNA, 16 nt, Bordetella pertussis
ggcaggucgccagcag

SEQ ID NO: 381293 - RNA, 17 nt, Bordetella pertussis
ggcaggucgccagcagg

SEQ ID NO: 381294 - RNA, 15 nt, Bordetella pertussis
ggcaggucggccagc

SEQ ID NO: 381295 - RNA, 14 nt, Bordetella pertussis
ggcaggucggcgcg

SEQ ID NO: 381296 - RNA, 19 nt, Bordetella pertussis
ggcaggucggugcacacgc

SEQ ID NO: 381297 - RNA, 15 nt, Bordetella pertussis
ggcaggugcgccagc

SEQ ID NO: 381298 - RNA, 16 nt, Bordetella pertussis
ggcaggugcgccagca

SEQ ID NO: 381299 - RNA, 18 nt, Bordetella pertussis
ggcaggugcgccagcacg

SEQ ID NO: 381300 - RNA, 16 nt, Bordetella pertussis
ggcaggugcggccgca

SEQ ID NO: 381301 - RNA, 19 nt, Bordetella pertussis
ggcaggugcgucacgcaca

SEQ ID NO: 381302 - RNA, 24 nt, Bordetella pertussis
ggcaggugcuuggcggucugggcg

SEQ ID NO: 381303 - RNA, 21 nt, Bordetella pertussis
ggcagugguggugcagcggca

SEQ ID NO: 381304 - RNA, 23 nt, Bordetella pertussis
ggcagugguggugcagcggcagc

SEQ ID NO: 381305 - RNA, 19 nt, Bordetella pertussis
ggcaguucgcccggcucca

SEQ ID NO: 381306 - RNA, 22 nt, Bordetella pertussis
ggcaguugcuggcggccgugcc

SEQ ID NO: 381307 - RNA, 20 nt, Bordetella pertussis
ggcaguuggcggcgcagccg

SEQ ID NO: 381308 - RNA, 15 nt, Bordetella pertussis
ggcauagcgcgccac

SEQ ID NO: 381309 - RNA, 17 nt, Bordetella pertussis
ggcauagaugccgaaca

SEQ ID NO: 381310 - RNA, 20 nt, Bordetella pertussis
ggcauagaugccgaacagcc

SEQ ID NO: 381311 - RNA, 21 nt, Bordetella pertussis
ggcauaggcggcgcaggccag

SEQ ID NO: 381312 - RNA, 22 nt, Bordetella pertussis
ggcaucaauagcccgugcgggc

SEQ ID NO: 381313 - RNA, 15 nt, Bordetella pertussis
ggcaucaccaucgau

SEQ ID NO: 381314 - RNA, 19 nt, Bordetella pertussis
ggcaucaggggcucggcca

SEQ ID NO: 381315 - RNA, 17 nt, Bordetella pertussis
ggcauggcccggcucgc

SEQ ID NO: 381316 - RNA, 18 nt, Bordetella pertussis
ggcauggcccggcucgcc

SEQ ID NO: 381317 - RNA, 16 nt, Bordetella pertussis
ggcauggcgccgcgcc

SEQ ID NO: 381318 - RNA, 13 nt, Bordetella pertussis
ggcauggcgaucg

SEQ ID NO: 381319 - RNA, 14 nt, Bordetella pertussis
ggcauggcggccag

SEQ ID NO: 381320 - RNA, 19 nt, Bordetella pertussis
ggcaugggcgugccgcgcu

SEQ ID NO: 381321 - RNA, 22 nt, Bordetella pertussis
ggcauggguaaagcgccggccc

SEQ ID NO: 381322 - RNA, 19 nt, Bordetella pertussis
ggcaugguagcgguccagc

SEQ ID NO: 381323 - RNA, 21 nt, Bordetella pertussis
ggcauggucggcauggccauc

SEQ ID NO: 381324 - RNA, 22 nt, Bordetella pertussis
ggcauggucggcauggccaucg

SEQ ID NO: 381325 - RNA, 18 nt, Bordetella pertussis
ggcaugugccaccgccca

SEQ ID NO: 381326 - RNA, 14 nt, Bordetella pertussis
ggcauucgaacaac

SEQ ID NO: 381327 - RNA, 20 nt, Bordetella pertussis
ggcauugaagcuggcgccgg

SEQ ID NO: 381328 - RNA, 19 nt, Bordetella pertussis
ggcauugccggagcagcag

SEQ ID NO: 381329 - RNA, 17 nt, Bordetella pertussis
ggcauugcgccagccgu

SEQ ID NO: 381330 - RNA, 21 nt, Bordetella pertussis
ggccaacgauuccgcguccau

SEQ ID NO: 381331 - RNA, 16 nt, Bordetella pertussis
ggccaacgggauccgg

SEQ ID NO: 381332 - RNA, 18 nt, Bordetella pertussis
ggccaagauccagcuuca

SEQ ID NO: 381333 - RNA, 15 nt, Bordetella pertussis
ggccaagcgcgccgg

SEQ ID NO: 381334 - RNA, 18 nt, Bordetella pertussis
ggccaaggcaagcagcga

SEQ ID NO: 381335 - RNA, 19 nt, Bordetella pertussis
ggccaaggcauuggcgccg

SEQ ID NO: 381336 - RNA, 22 nt, Bordetella pertussis
ggccaaggcauuggcgccgcgc

SEQ ID NO: 381337 - RNA, 16 nt, Bordetella pertussis
ggccaaggccggcgcg

SEQ ID NO: 381338 - RNA, 15 nt, Bordetella pertussis
ggccaagggcgccgc

SEQ ID NO: 381339 - RNA, 17 nt, Bordetella pertussis
ggccaagggcgccgcgc

SEQ ID NO: 381340 - RNA, 15 nt, Bordetella pertussis
ggccaaucggccugc

SEQ ID NO: 381341 - RNA, 19 nt, Bordetella pertussis
ggccaaugccauuggugcg

SEQ ID NO: 381342 - RNA, 14 nt, Bordetella pertussis
ggccaaugcgccgc

SEQ ID NO: 381343 - RNA, 15 nt, Bordetella pertussis
ggccaaugcgccgcg

SEQ ID NO: 381344 - RNA, 16 nt, Bordetella pertussis
ggccaaugcgccgcgc

SEQ ID NO: 381345 - RNA, 17 nt, Bordetella pertussis
ggccacaucaucgacca

SEQ ID NO: 381346 - RNA, 20 nt, Bordetella pertussis
ggccacauggucgcccagca

SEQ ID NO: 381347 - RNA, 19 nt, Bordetella pertussis
ggccaccaccaggcccagg

SEQ ID NO: 381348 - RNA, 14 nt, Bordetella pertussis
ggccaccacgccca

SEQ ID NO: 381349 - RNA, 17 nt, Bordetella pertussis
ggccaccacgccgaugc

SEQ ID NO: 381350 - RNA, 12 nt, Bordetella pertussis
ggccaccagccc

SEQ ID NO: 381351 - RNA, 13 nt, Bordetella pertussis
ggccaccaggccg

SEQ ID NO: 381352 - RNA, 17 nt, Bordetella pertussis
ggccaccagggcccgga

SEQ ID NO: 381353 - RNA, 22 nt, Bordetella pertussis
ggccaccccguugcagcccagc

SEQ ID NO: 381354 - RNA, 12 nt, Bordetella pertussis
ggccacccgccg

SEQ ID NO: 381355 - RNA, 14 nt, Bordetella pertussis
ggccacccgccgcc

SEQ ID NO: 381356 - RNA, 15 nt, Bordetella pertussis
ggccacccgccgccg

SEQ ID NO: 381357 - RNA, 18 nt, Bordetella pertussis
ggccacccgccgccggcg

SEQ ID NO: 381358 - RNA, 19 nt, Bordetella pertussis
ggccacccgccgccggcga

SEQ ID NO: 381359 - RNA, 20 nt, Bordetella pertussis
ggccacccgccguaccgggc

SEQ ID NO: 381360 - RNA, 22 nt, Bordetella pertussis
ggccacgaagacgaagucccag

SEQ ID NO: 381361 - RNA, 15 nt, Bordetella pertussis
ggccacgaagcgcag

SEQ ID NO: 381362 - RNA, 21 nt, Bordetella pertussis
ggccacgaagcgcagcaccgc

SEQ ID NO: 381363 - RNA, 17 nt, Bordetella pertussis
ggccacgaacggcgcga

SEQ ID NO: 381364 - RNA, 21 nt, Bordetella pertussis
ggccacgaauuccucgccgcc

SEQ ID NO: 381365 - RNA, 16 nt, Bordetella pertussis
ggccacgaccaccagc

SEQ ID NO: 381366 - RNA, 20 nt, Bordetella pertussis
ggccacgaccaccagcguca

SEQ ID NO: 381367 - RNA, 20 nt, Bordetella pertussis
ggccacgagcaguacacgcg

SEQ ID NO: 381368 - RNA, 15 nt, Bordetella pertussis
ggccacgaucaucag

SEQ ID NO: 381369 - RNA, 16 nt, Bordetella pertussis
ggccacgaucaucagg

SEQ ID NO: 381370 - RNA, 14 nt, Bordetella pertussis
ggccacgaccggcu

SEQ ID NO: 381371 - RNA, 19 nt, Bordetella pertussis
ggccacgauguugcgcagg

SEQ ID NO: 381372 - RNA, 17 nt, Bordetella pertussis
ggccacgcccacgcgcc

SEQ ID NO: 381373 - RNA, 17 nt, Bordetella pertussis
ggccacgcccaggccgu

SEQ ID NO: 381374 - RNA, 17 nt, Bordetella pertussis
ggccacgccggccgccu

SEQ ID NO: 381375 - RNA, 19 nt, Bordetella pertussis
ggccacgccggccgccugg

SEQ ID NO: 381376 - RNA, 15 nt, Bordetella pertussis
ggccacgccggccgg

SEQ ID NO: 381377 - RNA, 15 nt, Bordetella pertussis
ggccacugcgccugg

SEQ ID NO: 381378 - RNA, 19 nt, Bordetella pertussis
ggccacuuccagcgccugc

SEQ ID NO: 381379 - RNA, 16 nt, Bordetella pertussis
ggccacuucgcggccg

SEQ ID NO: 381380 - RNA, 22 nt, Bordetella pertussis
ggccacuuucgcgcgcgccugc

SEQ ID NO: 381381 - RNA, 14 nt, Bordetella pertussis
ggccagaccgcgcg

SEQ ID NO: 381382 - RNA, 19 nt, Bordetella pertussis
ggccagauagcccaggcgg

SEQ ID NO: 381383 - RNA, 19 nt, Bordetella pertussis
ggccagaucggacgggccg

SEQ ID NO: 381384 - RNA, 12 nt, Bordetella pertussis
ggccagcagcgc

SEQ ID NO: 381385 - RNA, 17 nt, Bordetella pertussis
ggccagcagcgcaucgc

SEQ ID NO: 381386 - RNA, 18 nt, Bordetella pertussis
ggccagcagcgcaucgcg

SEQ ID NO: 381387 - RNA, 14 nt, Bordetella pertussis
ggccagcagcgccg

SEQ ID NO: 381388 - RNA, 16 nt, Bordetella pertussis
ggccagcagcgccgcc

SEQ ID NO: 381389 - RNA, 22 nt, Bordetella pertussis
ggccagcagcgccgccagcaug

SEQ ID NO: 381390 - RNA, 16 nt, Bordetella pertussis
ggccagcagcgcgugc

SEQ ID NO: 381391 - RNA, 17 nt, Bordetella pertussis
ggccagcagcgcgugca

SEQ ID NO: 381392 - RNA, 22 nt, Bordetella pertussis
ggccagcagcgcgugcagccag

SEQ ID NO: 381393 - RNA, 20 nt, Bordetella pertussis
ggccagcaggagcccgcugc

SEQ ID NO: 381394 - RNA, 18 nt, Bordetella pertussis
ggccagcaggcucagcgg

SEQ ID NO: 381395 - RNA, 14 nt, Bordetella pertussis
ggccagccccggcg

SEQ ID NO: 381396 - RNA, 17 nt, Bordetella pertussis
ggccagcccggugaucg

SEQ ID NO: 381397 - RNA, 16 nt, Bordetella pertussis
ggccagccggcccagc

SEQ ID NO: 381398 - RNA, 17 nt, Bordetella pertussis
ggccagccggcccagca

SEQ ID NO: 381399 - RNA, 21 nt, Bordetella pertussis
ggccagccggcccagcaugcc

SEQ ID NO: 381400 - RNA, 23 nt, Bordetella pertussis
ggccagccggccgauggcaucgc

SEQ ID NO: 381401 - RNA, 14 nt, Bordetella pertussis
ggccagccggcgcg

SEQ ID NO: 381402 - RNA, 20 nt, Bordetella pertussis
ggccagccggcgcgccaugg

SEQ ID NO: 381403 - RNA, 17 nt, Bordetella pertussis
ggccagccgggcgaucg

SEQ ID NO: 381404 - RNA, 14 nt, Bordetella pertussis
ggccagccuggccu

SEQ ID NO: 381405 - RNA, 15 nt, Bordetella pertussis
ggccagccuggcgcc

SEQ ID NO: 381406 - RNA, 19 nt, Bordetella pertussis
ggccagccuggcgccaacc

SEQ ID NO: 381407 - RNA, 22 nt, Bordetella pertussis
ggccagccuggcgccaacccgc

SEQ ID NO: 381408 - RNA, 22 nt, Bordetella pertussis
ggccagcgaaccgaaaugccgc

SEQ ID NO: 381409 - RNA, 16 nt, Bordetella pertussis
ggccagcgccagcacg

SEQ ID NO: 381410 - RNA, 16 nt, Bordetella pertussis
ggccagcgccagccgc

SEQ ID NO: 381411 - RNA, 11 nt, Bordetella pertussis
ggccagcgccg

SEQ ID NO: 381412 - RNA, 12 nt, Bordetella pertussis
ggccagcgccga

SEQ ID NO: 381413 - RNA, 16 nt, Bordetella pertussis
ggccagcgccgccauc

SEQ ID NO: 381414 - RNA, 12 nt, Bordetella pertussis
ggccagcgccgc

SEQ ID NO: 381415 - RNA, 13 nt, Bordetella pertussis
ggccagcgccgcc

SEQ ID NO: 381416 - RNA, 16 nt, Bordetella pertussis
ggccagggaggcgaug

SEQ ID NO: 381417 - RNA, 14 nt, Bordetella pertussis
ggccagcgccgcca

SEQ ID NO: 381418 - RNA, 15 nt, Bordetella pertussis
ggccagcgccgccag

SEQ ID NO: 381419 - RNA, 19 nt, Bordetella pertussis
ggccagggagugcgaggac

SEQ ID NO: 381420 - RNA, 14 nt, Bordetella pertussis
ggccagggccacca

SEQ ID NO: 381421 - RNA, 16 nt, Bordetella pertussis
ggccagggccacgccg

SEQ ID NO: 381422 - RNA, 17 nt, Bordetella pertussis
ggccagggcgaugcggc

SEQ ID NO: 381423 - RNA, 14 nt, Bordetella pertussis
ggccagggcggcga

SEQ ID NO: 381424 - RNA, 18 nt, Bordetella pertussis
ggccagggugccccgccg

SEQ ID NO: 381425 - RNA, 22 nt, Bordetella pertussis
ggccagguaaugaucgcccuug

SEQ ID NO: 381426 - RNA, 20 nt, Bordetella pertussis
ggccagguacaggccgccgg

SEQ ID NO: 381427 - RNA, 23 nt, Bordetella pertussis
ggccagguacaggccgccgguca

SEQ ID NO: 381428 - RNA, 16 nt, Bordetella pertussis
ggccagguagucgucg

SEQ ID NO: 381429 - RNA, 14 nt, Bordetella pertussis
ggccaggucgcgca

SEQ ID NO: 381430 - RNA, 13 nt, Bordetella pertussis
ggccaggucggcg

SEQ ID NO: 381431 - RNA, 16 nt, Bordetella pertussis
ggccaggucggcgucg

SEQ ID NO: 381432 - RNA, 17 nt, Bordetella pertussis
ggccaggucggcgucgu

SEQ ID NO: 381433 - RNA, 12 nt, Bordetella pertussis
ggccagguggcg

SEQ ID NO: 381434 - RNA, 22 nt, Bordetella pertussis
ggccagguucuggucgaacugg

SEQ ID NO: 381435 - RNA, 19 nt, Bordetella pertussis
ggccagguugggugcgccg

SEQ ID NO: 381436 - RNA, 20 nt, Bordetella pertussis
ggccagguugggugcgccgc

SEQ ID NO: 381437 - RNA, 19 nt, Bordetella pertussis
ggccaguccgcagcgcagc

SEQ ID NO: 381438 - RNA, 17 nt, Bordetella pertussis
ggccagucccaggauca

SEQ ID NO: 381439 - RNA, 23 nt, Bordetella pertussis
ggccagucccaggaucaccgccg

SEQ ID NO: 381440 - RNA, 20 nt, Bordetella pertussis
ggccagucuggcuucguugg

SEQ ID NO: 381441 - RNA, 23 nt, Bordetella pertussis
ggccagugauggccugcuuggcg

SEQ ID NO: 381442 - RNA, 20 nt, Bordetella pertussis
ggccagugccuggacgcgcu

SEQ ID NO: 381443 - RNA, 18 nt, Bordetella pertussis
ggccaguuccgugcgcgc

SEQ ID NO: 381444 - RNA, 18 nt, Bordetella pertussis
ggccaguucgacgcccau

SEQ ID NO: 381445 - RNA, 20 nt, Bordetella pertussis
ggccaguucgacgcccaugc

SEQ ID NO: 381446 - RNA, 18 nt, Bordetella pertussis
ggccaguucgcggcgcag

SEQ ID NO: 381447 - RNA, 15 nt, Bordetella pertussis
ggccaguucggcuug

SEQ ID NO: 381448 - RNA, 22 nt, Bordetella pertussis
ggccaguucguccgcuucgucg

SEQ ID NO: 381449 - RNA, 21 nt, Bordetella pertussis
ggccaucaagaaggucgacga

SEQ ID NO: 381450 - RNA, 20 nt, Bordetella pertussis
ggccaucagguuguccagcg

SEQ ID NO: 381451 - RNA, 14 nt, Bordetella pertussis
ggccauccggccac

SEQ ID NO: 381452 - RNA, 17 nt, Bordetella pertussis
ggccauccggccacgca

SEQ ID NO: 381453 - RNA, 17 nt, Bordetella pertussis
ggccauccguccgccag

SEQ ID NO: 381454 - RNA, 15 nt, Bordetella pertussis
ggccaucgccgccgc

SEQ ID NO: 381455 - RNA, 18 nt, Bordetella pertussis
ggccaucgccgccgccgg

SEQ ID NO: 381456 - RNA, 20 nt, Bordetella pertussis
ggccaucgccgccgccgggc

SEQ ID NO: 381457 - RNA, 18 nt, Bordetella pertussis
ggccaucgccauggccac

SEQ ID NO: 381458 - RNA, 22 nt, Bordetella pertussis
ggccaucgccauggccacgacg

SEQ ID NO: 381459 - RNA, 15 nt, Bordetella pertussis
ggccaucggcgccaa

SEQ ID NO: 381460 - RNA, 22 nt, Bordetella pertussis
ggccaucgggauaccgcuggcc

SEQ ID NO: 381461 - RNA, 16 nt, Bordetella pertussis
ggccaucuaugucggc

SEQ ID NO: 381462 - RNA, 16 nt, Bordetella pertussis
ggccaucgccgccacg

SEQ ID NO: 381463 - RNA, 19 nt, Bordetella pertussis
ggccaucuuggugcgcgcc

SEQ ID NO: 381464 - RNA, 21 nt, Bordetella pertussis
ggccaucuuggugcgcgccag

SEQ ID NO: 381465 - RNA, 22 nt, Bordetella pertussis
ggccaucuuggugcgcgccagg

SEQ ID NO: 381466 - RNA, 19 nt, Bordetella pertussis
ggccaugaucaggccgaac

SEQ ID NO: 381467 - RNA, 14 nt, Bordetella pertussis
ggccaugcaccagc

SEQ ID NO: 381468 - RNA, 15 nt, Bordetella pertussis
ggccaugcaccagca

SEQ ID NO: 381469 - RNA, 17 nt, Bordetella pertussis
ggccaugcaccagcaca

SEQ ID NO: 381470 - RNA, 14 nt, Bordetella pertussis
ggccaugccgacgg

SEQ ID NO: 381471 - RNA, 17 nt, Bordetella pertussis
ggccaugccggguugca

SEQ ID NO: 381472 - RNA, 17 nt, Bordetella pertussis
ggccaugccguccugcu

SEQ ID NO: 381473 - RNA, 19 nt, Bordetella pertussis
ggccaugccguccugcugc

SEQ ID NO: 381474 - RNA, 13 nt, Bordetella pertussis
ggccaugcgccgc

SEQ ID NO: 381475 - RNA, 21 nt, Bordetella pertussis
ggccaugcgcuuggaccccgu

SEQ ID NO: 381476 - RNA, 21 nt, Bordetella pertussis
ggccaugcgggucaggccgcc

SEQ ID NO: 381477 - RNA, 23 nt, Bordetella pertussis
ggccaugcgggucaggccgccgu

SEQ ID NO: 381478 - RNA, 19 nt, Bordetella pertussis
ggccaugcucguccaucgc

SEQ ID NO: 381479 - RNA, 18 nt, Bordetella pertussis
ggccaugcugggccauca

SEQ ID NO: 381480 - RNA, 19 nt, Bordetella pertussis
ggccaugcugggcgggcug

SEQ ID NO: 381481 - RNA, 13 nt, Bordetella pertussis
ggccaugcgcgcc

SEQ ID NO: 381482 - RNA, 19 nt, Bordetella pertussis
ggccaugcgcgccagcaug

SEQ ID NO: 381483 - RNA, 16 nt, Bordetella pertussis
ggccauggaugcgcgc

SEQ ID NO: 381484 - RNA, 12 nt, Bordetella pertussis
ggccauggccag

SEQ ID NO: 381485 - RNA, 16 nt, Bordetella pertussis
ggccauggccagcuug

SEQ ID NO: 381486 - RNA, 16 nt, Bordetella pertussis
ggccauggcccuugcc

SEQ ID NO: 381487 - RNA, 13 nt, Bordetella pertussis
ggccauggccgcc

SEQ ID NO: 381488 - RNA, 23 nt, Bordetella pertussis
ggccauggcggccggcguugcgc

SEQ ID NO: 381489 - RNA, 19 nt, Bordetella pertussis
ggccauguagauggccgcc

SEQ ID NO: 381490 - RNA, 14 nt, Bordetella pertussis
ggccauguccagca

SEQ ID NO: 381491 - RNA, 16 nt, Bordetella pertussis
ggccauguggcgcagc

SEQ ID NO: 381492 - RNA, 22 nt, Bordetella pertussis
ggccauugaaagcgcgagcucu

SEQ ID NO: 381493 - RNA, 16 nt, Bordetella pertussis
ggccauugcuggcgcg

SEQ ID NO: 381494 - RNA, 12 nt, Bordetella pertussis
ggcccaagcccg

SEQ ID NO: 381495 - RNA, 13 nt, Bordetella pertussis
ggcccaagcccgu

SEQ ID NO: 381496 - RNA, 14 nt, Bordetella pertussis
ggcccaagcccgug

SEQ ID NO: 381497 - RNA, 19 nt, Bordetella pertussis
ggcccaaggccccgcgacc

SEQ ID NO: 381498 - RNA, 21 nt, Bordetella pertussis
ggcccacaucgucgcgcuggg

SEQ ID NO: 381499 - RNA, 23 nt, Bordetella pertussis
ggcccacaucgucgcgcuggggc

SEQ ID NO: 381500 - RNA, 12 nt, Bordetella pertussis
ggcccaccaggg

SEQ ID NO: 381501 - RNA, 23 nt, Bordetella pertussis
ggcccaccagggaccaauacgcc

SEQ ID NO: 381502 - RNA, 21 nt, Bordetella pertussis
ggcccaccagggccagcuuga

SEQ ID NO: 381503 - RNA, 23 nt, Bordetella pertussis
ggcccacagcgcccccagcacgg

SEQ ID NO: 381504 - RNA, 15 nt, Bordetella pertussis
ggcccaccgcaucgc

SEQ ID NO: 381505 - RNA, 20 nt, Bordetella pertussis
ggcccaccgcaucgcgcagc

SEQ ID NO: 381506 - RNA, 15 nt, Bordetella pertussis
ggcccaccggcaugc

SEQ ID NO: 381507 - RNA, 20 nt, Bordetella pertussis
ggcccaccggcaugccgucc

SEQ ID NO: 381508 - RNA, 17 nt, Bordetella pertussis
ggcccacgaugcgggca

SEQ ID NO: 381509 - RNA, 21 nt, Bordetella pertussis
ggcccacgaugcgggcaucgc

SEQ ID NO: 381510 - RNA, 13 nt, Bordetella pertussis
ggcccacgccgcg

SEQ ID NO: 381511 - RNA, 23 nt, Bordetella pertussis
ggcccacgccgcguucguucuug

SEQ ID NO: 381512 - RNA, 14 nt, Bordetella pertussis
ggcccacgcgcacg

SEQ ID NO: 381513 - RNA, 15 nt, Bordetella pertussis
ggcccacgcgcacga

SEQ ID NO: 381514 - RNA, 13 nt, Bordetella pertussis
ggcccacggccag

SEQ ID NO: 381515 - RNA, 14 nt, Bordetella pertussis
ggcccacggccagc

SEQ ID NO: 381516 - RNA, 15 nt, Bordetella pertussis
ggcccacggcgccaa

SEQ ID NO: 381517 - RNA, 22 nt, Bordetella pertussis
ggcccagcaauuaugcguggcc

SEQ ID NO: 381518 - RNA, 14 nt, Bordetella pertussis
ggcccagcacgcgc

SEQ ID NO: 381519 - RNA, 13 nt, Bordetella pertussis
ggcccagccagcc

SEQ ID NO: 381520 - RNA, 21 nt, Bordetella pertussis
ggcccagccagcccuggccca

SEQ ID NO: 381521 - RNA, 15 nt, Bordetella pertussis
ggcccagccgcaugc

SEQ ID NO: 381522 - RNA, 20 nt, Bordetella pertussis
ggcccagccgcaugccggcg

SEQ ID NO: 381523 - RNA, 15 nt, Bordetella pertussis
ggccccaccuggcgg

SEQ ID NO: 381524 - RNA, 14 nt, Bordetella pertussis
ggccccagcgccgc

SEQ ID NO: 381525 - RNA, 14 nt, Bordetella pertussis
ggccccaggcgccc

SEQ ID NO: 381526 - RNA, 16 nt, Bordetella pertussis
ggccccaugcgcggca

SEQ ID NO: 381527 - RNA, 22 nt, Bordetella pertussis
ggccccaugucgaucuggcuca

SEQ ID NO: 381528 - RNA, 14 nt, Bordetella pertussis
ggccccccggcgcg

SEQ ID NO: 381529 - RNA, 13 nt, Bordetella pertussis
ggccccgcagggc

SEQ ID NO: 381530 - RNA, 18 nt, Bordetella pertussis
ggccccguugucgccgcg

SEQ ID NO: 381531 - RNA, 12 nt, Bordetella pertussis
ggccccucgcgg

SEQ ID NO: 381532 - RNA, 24 nt, Bordetella pertussis
ggccccucgcggggcccuugugcg

SEQ ID NO: 381533 - RNA, 17 nt, Bordetella pertussis
ggcccgaaacgcgcagc

SEQ ID NO: 381534 - RNA, 21 nt, Bordetella pertussis
ggcccgacaccuggacccgcu

SEQ ID NO: 381535 - RNA, 23 nt, Bordetella pertussis
ggcccgacaccuggacccgcucg

SEQ ID NO: 381536 - RNA, 22 nt, Bordetella pertussis
ggcccgaagauuuccucgcgca

SEQ ID NO: 381537 - RNA, 19 nt, Bordetella pertussis
ggcccgcaucgcgcgccgc

SEQ ID NO: 381538 - RNA, 14 nt, Bordetella pertussis
ggcccgccaccacg

SEQ ID NO: 381539 - RNA, 21 nt, Bordetella pertussis
ggcccgccaccacggcgcgga

SEQ ID NO: 381540 - RNA, 23 nt, Bordetella pertussis
ggcccgccacgcaggcgggcgcc

SEQ ID NO: 381541 - RNA, 18 nt, Bordetella pertussis
ggcccgccacgcgggccg

SEQ ID NO: 381542 - RNA, 17 nt, Bordetella pertussis
ggcccgccacggcgccc

SEQ ID NO: 381543 - RNA, 12 nt, Bordetella pertussis
ggcccgccaggg

SEQ ID NO: 381544 - RNA, 20 nt, Bordetella pertussis
ggcccgccauugcacgcgca

SEQ ID NO: 381545 - RNA, 22 nt, Bordetella pertussis
ggcccgcccgcggaucggggca

SEQ ID NO: 381546 - RNA, 20 nt, Bordetella pertussis
ggcccgccgacugggcuugc

SEQ ID NO: 381547 - RNA, 14 nt, Bordetella pertussis
ggcccgccagcaag

SEQ ID NO: 381548 - RNA, 19 nt, Bordetella pertussis
ggcccgccgcggcaggccc

SEQ ID NO: 381549 - RNA, 12 nt, Bordetella pertussis
ggcccgcgcaga

SEQ ID NO: 381550 - RNA, 12 nt, Bordetella pertussis
ggcccgcgccag

SEQ ID NO: 381551 - RNA, 14 nt, Bordetella pertussis
ggcccgcgcccugc

SEQ ID NO: 381552 - RNA, 13 nt, Bordetella pertussis
ggcccgcgccgcg

SEQ ID NO: 381553 - RNA, 19 nt, Bordetella pertussis
ggcccgcgccgcgucaugg

SEQ ID NO: 381554 - RNA, 13 nt, Bordetella pertussis
ggcccgcgcgagc

SEQ ID NO: 381555 - RNA, 18 nt, Bordetella pertussis
ggcccggaauaccgccag

SEQ ID NO: 381556 - RNA, 21 nt, Bordetella pertussis
ggcccggaauaccgccagcuc

SEQ ID NO: 381557 - RNA, 23 nt, Bordetella pertussis
ggcccggaauaccgccagcucgg

SEQ ID NO: 381558 - RNA, 17 nt, Bordetella pertussis
ggcccggauauggccgg

SEQ ID NO: 381559 - RNA, 18 nt, Bordetella pertussis
ggcccggauauggccggc

SEQ ID NO: 381560 - RNA, 14 nt, Bordetella pertussis
ggcccggccgccgc

SEQ ID NO: 381561 - RNA, 15 nt, Bordetella pertussis
ggcccggccgccgcc

SEQ ID NO: 381562 - RNA, 17 nt, Bordetella pertussis
ggcccggccgccgccgg

SEQ ID NO: 381563 - RNA, 15 nt, Bordetella pertussis
ggcccggccgcaggg

SEQ ID NO: 381564 - RNA, 16 nt, Bordetella pertussis
ggcccggccgcagggc

SEQ ID NO: 381565 - RNA, 20 nt, Bordetella pertussis
ggcccggcgccggugggcag

SEQ ID NO: 381566 - RNA, 13 nt, Bordetella pertussis
ggcccggcgcgac

SEQ ID NO: 381567 - RNA, 22 nt, Bordetella pertussis
ggcccggcggaucacccagcgg

SEQ ID NO: 381568 - RNA, 14 nt, Bordetella pertussis
ggcccggcgggaac

SEQ ID NO: 381569 - RNA, 23 nt, Bordetella pertussis
ggcccggugcagccgccgcaggc

SEQ ID NO: 381570 - RNA, 16 nt, Bordetella pertussis
ggcccgguucaaccgg

SEQ ID NO: 381571 - RNA, 19 nt, Bordetella pertussis
ggcccgucaugggcggggc

SEQ ID NO: 381572 - RNA, 13 nt, Bordetella pertussis
ggcccgucgcgcc

SEQ ID NO: 381573 - RNA, 16 nt, Bordetella pertussis
ggcccgucgcgccagg

SEQ ID NO: 381574 - RNA, 18 nt, Bordetella pertussis
ggcccgucgcgccaggcc

SEQ ID NO: 381575 - RNA, 18 nt, Bordetella pertussis
ggcccgugcgcaacgcgc

SEQ ID NO: 381576 - RNA, 22 nt, Bordetella pertussis
ggcccguuccacaggcgaugau

SEQ ID NO: 381577 - RNA, 18 nt, Bordetella pertussis
ggcccguuggcaggccag

SEQ ID NO: 381578 - RNA, 19 nt, Bordetella pertussis
ggcccguuggcaggccagc

SEQ ID NO: 381579 - RNA, 22 nt, Bordetella pertussis
ggcccguuggcaggccagcaug

SEQ ID NO: 381580 - RNA, 15 nt, Bordetella pertussis
ggcccucgcggccgu

SEQ ID NO: 381581 - RNA, 15 nt, Bordetella pertussis
ggcccuccggcgcca

SEQ ID NO: 381582 - RNA, 17 nt, Bordetella pertussis
ggcccuccggcgccagc

SEQ ID NO: 381583 - RNA, 20 nt, Bordetella pertussis
ggcccuccggcgccagcaug

SEQ ID NO: 381584 - RNA, 21 nt, Bordetella pertussis
ggcccucggugcggaagacga

SEQ ID NO: 381585 - RNA, 21 nt, Bordetella pertussis
ggccgacagcgucgagcugac

SEQ ID NO: 381586 - RNA, 23 nt, Bordetella pertussis
ggccgacaggugguagaccgggu

SEQ ID NO: 381587 - RNA, 12 nt, Bordetella pertussis
ggccgaccagca

SEQ ID NO: 381588 - RNA, 14 nt, Bordetella pertussis
ggccgaccaggccg

SEQ ID NO: 381589 - RNA, 16 nt, Bordetella pertussis
ggccgaccaggccggc

SEQ ID NO: 381590 - RNA, 19 nt, Bordetella pertussis
ggccgaccaggccggcggc

SEQ ID NO: 381591 - RNA, 22 nt, Bordetella pertussis
ggccgaccagcacgauccagcc

SEQ ID NO: 381592 - RNA, 16 nt, Bordetella pertussis
ggccgacggccucggc

SEQ ID NO: 381593 - RNA, 14 nt, Bordetella pertussis
ggccgacggcucgc

SEQ ID NO: 381594 - RNA, 13 nt, Bordetella pertussis
ggccgacgggcgg

SEQ ID NO: 381595 - RNA, 19 nt, Bordetella pertussis
ggccgacguggaccgcgcg

SEQ ID NO: 381596 - RNA, 21 nt, Bordetella pertussis
ggccgacguggaccgcgcggu

SEQ ID NO: 381597 - RNA, 15 nt, Bordetella pertussis
ggccgagaacgccgu

SEQ ID NO: 381598 - RNA, 18 nt, Bordetella pertussis
ggccgagaugugcggcgu

SEQ ID NO: 381599 - RNA, 20 nt, Bordetella pertussis
ggccgagaugugcggcgugg

SEQ ID NO: 381600 - RNA, 14 nt, Bordetella pertussis
ggccgagcccgcgu

SEQ ID NO: 381601 - RNA, 12 nt, Bordetella pertussis
ggccgagcgcac

SEQ ID NO: 381602 - RNA, 21 nt, Bordetella pertussis
ggccgagcgcaccccggccga

SEQ ID NO: 381603 - RNA, 22 nt, Bordetella pertussis
ggccgagccgccccggcgcggc

SEQ ID NO: 381604 - RNA, 12 nt, Bordetella pertussis
ggccgagcgcga

SEQ ID NO: 381605 - RNA, 14 nt, Bordetella pertussis
ggccgagcgcgcca

SEQ ID NO: 381606 - RNA, 16 nt, Bordetella pertussis
ggccgagcgcgccagc

SEQ ID NO: 381607 - RNA, 19 nt, Bordetella pertussis
ggccgagcgcgccagcacg

SEQ ID NO: 381608 - RNA, 18 nt, Bordetella pertussis
ggccgagcgggccagcgc

SEQ ID NO: 381609 - RNA, 21 nt, Bordetella pertussis
ggccgagcgggccagcgcggc

SEQ ID NO: 381610 - RNA, 17 nt, Bordetella pertussis
ggccgagcgugccggga

SEQ ID NO: 381611 - RNA, 13 nt, Bordetella pertussis
ggccgagcgcggc

SEQ ID NO: 381612 - RNA, 16 nt, Bordetella pertussis
ggccgaggaccugcug

SEQ ID NO: 381613 - RNA, 20 nt, Bordetella pertussis
ggccgaggaccugcuggcgu

SEQ ID NO: 381614 - RNA, 13 nt, Bordetella pertussis
ggccgaggccagc

SEQ ID NO: 381615 - RNA, 14 nt, Bordetella pertussis
ggccgaggccagcg

SEQ ID NO: 381616 - RNA, 14 nt, Bordetella pertussis
ggccgaggcgccgc

SEQ ID NO: 381617 - RNA, 14 nt, Bordetella pertussis
ggccgaggcugcgc

SEQ ID NO: 381618 - RNA, 22 nt, Bordetella pertussis
ggccgaggcugcgcgcgccagc

SEQ ID NO: 381619 - RNA, 23 nt, Bordetella pertussis
ggccgaggcugcgcgcgccagcg

SEQ ID NO: 381620 - RNA, 22 nt, Bordetella pertussis
ggccgauacgcgugcgcggccg

SEQ ID NO: 381621 - RNA, 16 nt, Bordetella pertussis
ggccgauagccgcggc

SEQ ID NO: 381622 - RNA, 17 nt, Bordetella pertussis
ggccgauagccgcggcg

SEQ ID NO: 381623 - RNA, 20 nt, Bordetella pertussis
ggccgaucaccugcaggccc

SEQ ID NO: 381624 - RNA, 17 nt, Bordetella pertussis
ggccgaucagcaccacg

SEQ ID NO: 381625 - RNA, 18 nt, Bordetella pertussis
ggccgaucagcaccacgg

SEQ ID NO: 381626 - RNA, 15 nt, Bordetella pertussis
ggccgaucagcgaca

SEQ ID NO: 381627 - RNA, 15 nt, Bordetella pertussis
ggccgaucagcggau

SEQ ID NO: 381628 - RNA, 23 nt, Bordetella pertussis
ggccgcgcaggauuucaucgccc

SEQ ID NO: 381629 - RNA, 12 nt, Bordetella pertussis
ggccgcgcccaa

SEQ ID NO: 381630 - RNA, 13 nt, Bordetella pertussis
ggccgcgcccaca

SEQ ID NO: 381631 - RNA, 12 nt, Bordetella pertussis
ggccgcgcccag

SEQ ID NO: 381632 - RNA, 22 nt, Bordetella pertussis
ggccgcgcccagguccugcgcc

SEQ ID NO: 381633 - RNA, 12 nt, Bordetella pertussis
ggccgcgcaugc

SEQ ID NO: 381634 - RNA, 19 nt, Bordetella pertussis
ggccgcgcaugccagcuug

SEQ ID NO: 381635 - RNA, 18 nt, Bordetella pertussis
ggccgcgccccuagcgcc

SEQ ID NO: 381636 - RNA, 23 nt, Bordetella pertussis
ggccgcgcccaugcgcuggcgca

SEQ ID NO: 381637 - RNA, 16 nt, Bordetella pertussis
ggccgcgccgccgccc

SEQ ID NO: 381638 - RNA, 12 nt, Bordetella pertussis
ggccgcgccgcg

SEQ ID NO: 381639 - RNA, 14 nt, Bordetella pertussis
ggccgcgccgcggc

SEQ ID NO: 381640 - RNA, 15 nt, Bordetella pertussis
ggccgcgccgcggca

SEQ ID NO: 381641 - RNA, 13 nt, Bordetella pertussis
ggccgcgccgcug

SEQ ID NO: 381642 - RNA, 23 nt, Bordetella pertussis
ggccgcgccggcucccgcgcugc

SEQ ID NO: 381643 - RNA, 22 nt, Bordetella pertussis
ggccgcgccguucucaggccga

SEQ ID NO: 381644 - RNA, 19 nt, Bordetella pertussis
ggccgcgcgauccuggggc

SEQ ID NO: 381645 - RNA, 14 nt, Bordetella pertussis
ggccgcgcgccggc

SEQ ID NO: 381646 - RNA, 18 nt, Bordetella pertussis
ggccgcgcgccggcgccg

SEQ ID NO: 381647 - RNA, 20 nt, Bordetella pertussis
ggccgcgcgccggcgccguu

SEQ ID NO: 381648 - RNA, 14 nt, Bordetella pertussis
ggccgcgcgccugc

SEQ ID NO: 381649 - RNA, 15 nt, Bordetella pertussis
ggccgcgcgcgccag

SEQ ID NO: 381650 - RNA, 19 nt, Bordetella pertussis
ggccgcgcgcgccaggccu

SEQ ID NO: 381651 - RNA, 15 nt, Bordetella pertussis
ggccgcgcgcaucac

SEQ ID NO: 381652 - RNA, 17 nt, Bordetella pertussis
ggccgcgcgcgggcgcc

SEQ ID NO: 381653 - RNA, 18 nt, Bordetella pertussis
ggccgcgcgcgggcgccc

SEQ ID NO: 381654 - RNA, 20 nt, Bordetella pertussis
ggccgcgcgcgggcgcccgc

SEQ ID NO: 381655 - RNA, 20 nt, Bordetella pertussis
ggccgcgcgcuucaggcgcc

SEQ ID NO: 381656 - RNA, 21 nt, Bordetella pertussis
ggccgcgcgcuucaggcgccg

SEQ ID NO: 381657 - RNA, 22 nt, Bordetella pertussis
ggccgcgcgcuucaggcgccgc

SEQ ID NO: 381658 - RNA, 15 nt, Bordetella pertussis
ggccgcgcggcgccu

SEQ ID NO: 381659 - RNA, 19 nt, Bordetella pertussis
ggccgcgcgccaaucagau

SEQ ID NO: 381660 - RNA, 22 nt, Bordetella pertussis
ggccgcgcgggccuggcucagg

SEQ ID NO: 381661 - RNA, 22 nt, Bordetella pertussis
ggccgcgcgggcggcccgcaug

SEQ ID NO: 381662 - RNA, 23 nt, Bordetella pertussis
ggccgcgcgggcggcccgcaugu

SEQ ID NO: 381663 - RNA, 17 nt, Bordetella pertussis
ggccgcgcgugcggggc

SEQ ID NO: 381664 - RNA, 17 nt, Bordetella pertussis
ggccgcgcucaggccgc

SEQ ID NO: 381665 - RNA, 23 nt, Bordetella pertussis
ggccgcgcuggcgcuggccgccc

SEQ ID NO: 381666 - RNA, 15 nt, Bordetella pertussis
ggccgcgcuggcggc

SEQ ID NO: 381667 - RNA, 19 nt, Bordetella pertussis
ggccgcgcuggcggcgcag

SEQ ID NO: 381668 - RNA, 17 nt, Bordetella pertussis
ggccgcgcuggugcugg

SEQ ID NO: 381669 - RNA, 18 nt, Bordetella pertussis
ggccgcggaagucgggca

SEQ ID NO: 381670 - RNA, 14 nt, Bordetella pertussis
ggccgcggcccagc

SEQ ID NO: 381671 - RNA, 18 nt, Bordetella pertussis
ggccgcggcccagcgcgg

SEQ ID NO: 381672 - RNA, 12 nt, Bordetella pertussis
ggccgcggccgg

SEQ ID NO: 381673 - RNA, 23 nt, Bordetella pertussis
ggccgcggccuucaccccgccac

SEQ ID NO: 381674 - RNA, 19 nt, Bordetella pertussis
ggccgcggcgagcucggca

SEQ ID NO: 381675 - RNA, 15 nt, Bordetella pertussis
ggccgcggcgcccgg

SEQ ID NO: 381676 - RNA, 16 nt, Bordetella pertussis
ggccgcggcgcgcgcg

SEQ ID NO: 381677 - RNA, 22 nt, Bordetella pertussis
ggccgcggcgcgcgcggcgccu

SEQ ID NO: 381678 - RNA, 22 nt, Bordetella pertussis
ggccgcggcguccgcgccgaac

SEQ ID NO: 381679 - RNA, 12 nt, Bordetella pertussis
ggccgcgggcag

SEQ ID NO: 381680 - RNA, 14 nt, Bordetella pertussis
ggccgcgggcagca

SEQ ID NO: 381681 - RNA, 16 nt, Bordetella pertussis
ggccgcgggccgcugg

SEQ ID NO: 381682 - RNA, 20 nt, Bordetella pertussis
ggccgcggcguugcggcagc

SEQ ID NO: 381683 - RNA, 13 nt, Bordetella pertussis
ggccgcgggcgug

SEQ ID NO: 381684 - RNA, 20 nt, Bordetella pertussis
ggccgcggggcuggccagcu

SEQ ID NO: 381685 - RNA, 13 nt, Bordetella pertussis
ggccgcggguggc

SEQ ID NO: 381686 - RNA, 17 nt, Bordetella pertussis
ggccgcggucagccaga

SEQ ID NO: 381687 - RNA, 15 nt, Bordetella pertussis
ggccgcgguccgggc

SEQ ID NO: 381688 - RNA, 17 nt, Bordetella pertussis
ggccgcggugguccaga

SEQ ID NO: 381689 - RNA, 15 nt, Bordetella pertussis
ggccgcguacaacgc

SEQ ID NO: 381690 - RNA, 17 nt, Bordetella pertussis
ggccgcguacaacgccg

SEQ ID NO: 381691 - RNA, 20 nt, Bordetella pertussis
ggccgcguacaacgccgcgu

SEQ ID NO: 381692 - RNA, 19 nt, Bordetella pertussis
ggccgcgucauacgacgcg

SEQ ID NO: 381693 - RNA, 14 nt, Bordetella pertussis
ggccgcguccagcg

SEQ ID NO: 381694 - RNA, 17 nt, Bordetella pertussis
ggccgcguccagcgcgc

SEQ ID NO: 381695 - RNA, 13 nt, Bordetella pertussis
ggccgcgucgauc

SEQ ID NO: 381696 - RNA, 19 nt, Bordetella pertussis
ggccgcguggccgcgcugc

SEQ ID NO: 381697 - RNA, 15 nt, Bordetella pertussis
ggccgcuacggcggu

SEQ ID NO: 381698 - RNA, 22 nt, Bordetella pertussis
ggccgcuaggccuugccgccgc

SEQ ID NO: 381699 - RNA, 13 nt, Bordetella pertussis
ggccgcuccgcca

SEQ ID NO: 381700 - RNA, 14 nt, Bordetella pertussis
ggccggaccuugcg

SEQ ID NO: 381701 - RNA, 15 nt, Bordetella pertussis
ggccggaccuugcga

SEQ ID NO: 381702 - RNA, 20 nt, Bordetella pertussis
ggccggacuggcgcgcacca

SEQ ID NO: 381703 - RNA, 15 nt, Bordetella pertussis
ggccggagccaggua

SEQ ID NO: 381704 - RNA, 14 nt, Bordetella pertussis
ggccggaggccgcc

SEQ ID NO: 381705 - RNA, 15 nt, Bordetella pertussis
ggccggaggccgccc

SEQ ID NO: 381706 - RNA, 16 nt, Bordetella pertussis
ggccggaggccgccca

SEQ ID NO: 381707 - RNA, 15 nt, Bordetella pertussis
ggccggcccgugcgc

SEQ ID NO: 381708 - RNA, 17 nt, Bordetella pertussis
ggccggccgccgggccg

SEQ ID NO: 381709 - RNA, 13 nt, Bordetella pertussis
ggccggccgcgcg

SEQ ID NO: 381710 - RNA, 17 nt, Bordetella pertussis
ggccggccgcgcgcgcc

SEQ ID NO: 381711 - RNA, 12 nt, Bordetella pertussis
ggccggccgcgu

SEQ ID NO: 381712 - RNA, 14 nt, Bordetella pertussis
ggccggccgcgccc

SEQ ID NO: 381713 - RNA, 15 nt, Bordetella pertussis
ggccggccgcgccca

SEQ ID NO: 381714 - RNA, 21 nt, Bordetella pertussis
ggccggccgggcgcggcgccc

SEQ ID NO: 381715 - RNA, 18 nt, Bordetella pertussis
ggccggccugcaggcucu

SEQ ID NO: 381716 - RNA, 17 nt, Bordetella pertussis
ggccggccugcaggugc

SEQ ID NO: 381717 - RNA, 16 nt, Bordetella pertussis
ggccggccugcgggcu

SEQ ID NO: 381718 - RNA, 12 nt, Bordetella pertussis
ggccggccuggc

SEQ ID NO: 381719 - RNA, 17 nt, Bordetella pertussis
ggccggccuggcgcgca

SEQ ID NO: 381720 - RNA, 17 nt, Bordetella pertussis
ggccggccuuggccaug

SEQ ID NO: 381721 - RNA, 14 nt, Bordetella pertussis
ggccggcgacggca

SEQ ID NO: 381722 - RNA, 19 nt, Bordetella pertussis
ggccggcgauugcgccagc

SEQ ID NO: 381723 - RNA, 20 nt, Bordetella pertussis
ggccggcgauugcgccagcg

SEQ ID NO: 381724 - RNA, 21 nt, Bordetella pertussis
ggccggcgauugcgccagcgc

SEQ ID NO: 381725 - RNA, 13 nt, Bordetella pertussis
ggccggcgcacgc

SEQ ID NO: 381726 - RNA, 12 nt, Bordetella pertussis
ggccggcgccag

SEQ ID NO: 381727 - RNA, 13 nt, Bordetella pertussis
ggccggcgccagc

SEQ ID NO: 381728 - RNA, 23 nt, Bordetella pertussis
ggccggcgccgacaacggcgugc

SEQ ID NO: 381729 - RNA, 15 nt, Bordetella pertussis
ggccggcgccagccg

SEQ ID NO: 381730 - RNA, 14 nt, Bordetella pertussis
ggccggcgccggca

SEQ ID NO: 381731 - RNA, 22 nt, Bordetella pertussis
ggccggcgccguuuucagcgca

SEQ ID NO: 381732 - RNA, 11 nt, Bordetella pertussis
ggccggcgccu

SEQ ID NO: 381733 - RNA, 17 nt, Bordetella pertussis
ggccggcgccuggggcg

SEQ ID NO: 381734 - RNA, 22 nt, Bordetella pertussis
ggccggcgccuggggcgggcgg

SEQ ID NO: 381735 - RNA, 13 nt, Bordetella pertussis
ggccggcgccggu

SEQ ID NO: 381736 - RNA, 14 nt, Bordetella pertussis
ggccggcgcgaacc

SEQ ID NO: 381737 - RNA, 17 nt, Bordetella pertussis
ggccggcgcgaccgccu

SEQ ID NO: 381738 - RNA, 18 nt, Bordetella pertussis
ggccggcgcgaccgccuc

SEQ ID NO: 381739 - RNA, 23 nt, Bordetella pertussis
ggccggcgcgaccgccuccagcg

SEQ ID NO: 381740 - RNA, 14 nt, Bordetella pertussis
ggccggcgugcugu

SEQ ID NO: 381741 - RNA, 20 nt, Bordetella pertussis
ggccggcguguucagcgcgc

SEQ ID NO: 381742 - RNA, 14 nt, Bordetella pertussis
ggccggcguugcgc

SEQ ID NO: 381743 - RNA, 15 nt, Bordetella pertussis
ggccggcucgccgca

SEQ ID NO: 381744 - RNA, 17 nt, Bordetella pertussis
ggccggcugcaccagcg

SEQ ID NO: 381745 - RNA, 12 nt, Bordetella pertussis
ggccggcugcgc

SEQ ID NO: 381746 - RNA, 16 nt, Bordetella pertussis
ggccggcugcgcgccg

SEQ ID NO: 381747 - RNA, 20 nt, Bordetella pertussis
ggccggcugcgcgccgacca

SEQ ID NO: 381748 - RNA, 16 nt, Bordetella pertussis
ggccggcugggcggcc

SEQ ID NO: 381749 - RNA, 17 nt, Bordetella pertussis
ggccggcugggcggccu

SEQ ID NO: 381750 - RNA, 21 nt, Bordetella pertussis
ggccggcugggcggccuuggc

SEQ ID NO: 381751 - RNA, 11 nt, Bordetella pertussis
ggccggcuugc

SEQ ID NO: 381752 - RNA, 13 nt, Bordetella pertussis
ggccggcuugcgc

SEQ ID NO: 381753 - RNA, 17 nt, Bordetella pertussis
ggccggcuugcgcaagc

SEQ ID NO: 381754 - RNA, 22 nt, Bordetella pertussis
ggccggcuuuggacaggcgugc

SEQ ID NO: 381755 - RNA, 13 nt, Bordetella pertussis
ggccgggagcggc

SEQ ID NO: 381756 - RNA, 20 nt, Bordetella pertussis
ggccgggagcggccagcaag

SEQ ID NO: 381757 - RNA, 14 nt, Bordetella pertussis
ggccggggccgccc

SEQ ID NO: 381758 - RNA, 15 nt, Bordetella pertussis
ggccggggccgccca

SEQ ID NO: 381759 - RNA, 17 nt, Bordetella pertussis
ggccggggccgcccugg

SEQ ID NO: 381760 - RNA, 22 nt, Bordetella pertussis
ggccgggguccugaggccaggc

SEQ ID NO: 381761 - RNA, 23 nt, Bordetella pertussis
ggccgggguccugaggccaggcc

SEQ ID NO: 381762 - RNA, 15 nt, Bordetella pertussis
ggccgggucggccug

SEQ ID NO: 381763 - RNA, 17 nt, Bordetella pertussis
ggccggguggccgcggu

SEQ ID NO: 381764 - RNA, 22 nt, Bordetella pertussis
ggccgguaaggcgcuugcgcag

SEQ ID NO: 381765 - RNA, 18 nt, Bordetella pertussis
ggccgguaccagacggua

SEQ ID NO: 381766 - RNA, 17 nt, Bordetella pertussis
ggccgguaucggccucg

SEQ ID NO: 381767 - RNA, 23 nt, Bordetella pertussis
ggccggucagcccaggcgggcgu

SEQ ID NO: 381768 - RNA, 15 nt, Bordetella pertussis
ggccgucggggccga

SEQ ID NO: 381769 - RNA, 19 nt, Bordetella pertussis
ggccgucggggccgauggu

SEQ ID NO: 381770 - RNA, 20 nt, Bordetella pertussis
ggccgucgucaucgccaucg

SEQ ID NO: 381771 - RNA, 19 nt, Bordetella pertussis
ggccgucgugcgccuggcg

SEQ ID NO: 381772 - RNA, 19 nt, Bordetella pertussis
ggccgucuacaggcccagc

SEQ ID NO: 381773 - RNA, 20 nt, Bordetella pertussis
ggccgucuacaggcccagcg

SEQ ID NO: 381774 - RNA, 15 nt, Bordetella pertussis
ggccgucugggcgug

SEQ ID NO: 381775 - RNA, 16 nt, Bordetella pertussis
ggccgucugggcguga

SEQ ID NO: 381776 - RNA, 16 nt, Bordetella pertussis
ggccgugagcgccgcc

SEQ ID NO: 381777 - RNA, 17 nt, Bordetella pertussis
ggccgugagcgccgccg

SEQ ID NO: 381778 - RNA, 20 nt, Bordetella pertussis
ggccgugagcgccgccgcca

SEQ ID NO: 381779 - RNA, 20 nt, Bordetella pertussis
ggccgugcgaggcgaacagg

SEQ ID NO: 381780 - RNA, 15 nt, Bordetella pertussis
ggccgugcgccagcg

SEQ ID NO: 381781 - RNA, 16 nt, Bordetella pertussis
ggccgugcgcccgacg

SEQ ID NO: 381782 - RNA, 17 nt, Bordetella pertussis
ggccgugcgccgggcgu

SEQ ID NO: 381783 - RNA, 18 nt, Bordetella pertussis
ggccgugcgccgggcguc

SEQ ID NO: 381784 - RNA, 20 nt, Bordetella pertussis
ggccguggaggcggcggccg

SEQ ID NO: 381785 - RNA, 14 nt, Bordetella pertussis
ggccguggcccagc

SEQ ID NO: 381786 - RNA, 14 nt, Bordetella pertussis
ggccguggcggcca

SEQ ID NO: 381787 - RNA, 17 nt, Bordetella pertussis
ggccguggcggccugcg

SEQ ID NO: 381788 - RNA, 18 nt, Bordetella pertussis
ggccguggcggccugcgc

SEQ ID NO: 381789 - RNA, 22 nt, Bordetella pertussis
ggccguggcggccugcgccggc

SEQ ID NO: 381790 - RNA, 17 nt, Bordetella pertussis
ggccguggcgugcaggc

SEQ ID NO: 381791 - RNA, 20 nt, Bordetella pertussis
ggccguggcgugcaggccgg

SEQ ID NO: 381792 - RNA, 18 nt, Bordetella pertussis
ggccguguucgagcaggc

SEQ ID NO: 381793 - RNA, 21 nt, Bordetella pertussis
ggccguuaugguucggccucg

SEQ ID NO: 381794 - RNA, 15 nt, Bordetella pertussis
ggccguuccagucca

SEQ ID NO: 381795 - RNA, 19 nt, Bordetella pertussis
ggccguuccaguccagcgu

SEQ ID NO: 381796 - RNA, 15 nt, Bordetella pertussis
ggccguucggugcgc

SEQ ID NO: 381797 - RNA, 18 nt, Bordetella pertussis
ggccguucggugcgcagc

SEQ ID NO: 381798 - RNA, 22 nt, Bordetella pertussis
ggccguucggugcgcagcggca

SEQ ID NO: 381799 - RNA, 15 nt, Bordetella pertussis
ggccguugcuccagc

SEQ ID NO: 381800 - RNA, 14 nt, Bordetella pertussis
ggccguuggccagc

SEQ ID NO: 381801 - RNA, 15 nt, Bordetella pertussis
ggccguuggccgcgc

SEQ ID NO: 381802 - RNA, 16 nt, Bordetella pertussis
ggccguuggccgcgcg

SEQ ID NO: 381803 - RNA, 17 nt, Bordetella pertussis
ggccguuggcgauggcg

SEQ ID NO: 381804 - RNA, 15 nt, Bordetella pertussis
ggccguuggcgugca

SEQ ID NO: 381805 - RNA, 14 nt, Bordetella pertussis
ggccguuguccugg

SEQ ID NO: 381806 - RNA, 17 nt, Bordetella pertussis
ggccguuguccuggcgc

SEQ ID NO: 381807 - RNA, 23 nt, Bordetella pertussis
ggccguuguccuggcgcgccagg

SEQ ID NO: 381808 - RNA, 16 nt, Bordetella pertussis
ggccguuuacucccca

SEQ ID NO: 381809 - RNA, 14 nt, Bordetella pertussis
ggccuagcccggcg

SEQ ID NO: 381810 - RNA, 16 nt, Bordetella pertussis
ggccuagcccggcgcc

SEQ ID NO: 381811 - RNA, 18 nt, Bordetella pertussis
ggccuagcccggcgccac

SEQ ID NO: 381812 - RNA, 18 nt, Bordetella pertussis
ggccuauuuggcggccug

SEQ ID NO: 381813 - RNA, 19 nt, Bordetella pertussis
ggccucccgccgcccggcc

SEQ ID NO: 381814 - RNA, 13 nt, Bordetella pertussis
ggccuccgcgcac

SEQ ID NO: 381815 - RNA, 22 nt, Bordetella pertussis
ggccuccgcgcacagcgcggcg

SEQ ID NO: 381816 - RNA, 19 nt, Bordetella pertussis
ggccucgaagcccggcagg

SEQ ID NO: 381817 - RNA, 22 nt, Bordetella pertussis
ggccucgacgauggccggggcg

SEQ ID NO: 381818 - RNA, 14 nt, Bordetella pertussis
ggccugacgcgcaa

SEQ ID NO: 381819 - RNA, 22 nt, Bordetella pertussis
ggccugacgcucauccaggcgc

SEQ ID NO: 381820 - RNA, 14 nt, Bordetella pertussis
ggccugaucggggc

SEQ ID NO: 381821 - RNA, 14 nt, Bordetella pertussis
ggccugcaaccugg

SEQ ID NO: 381822 - RNA, 15 nt, Bordetella pertussis
ggccugcgucgccac

SEQ ID NO: 381823 - RNA, 16 nt, Bordetella pertussis
ggccugcgucgccacc

SEQ ID NO: 381824 - RNA, 17 nt, Bordetella pertussis
ggccugcucgcccacau

SEQ ID NO: 381825 - RNA, 23 nt, Bordetella pertussis
ggccugcucgcccacauagcggc

SEQ ID NO: 381826 - RNA, 19 nt, Bordetella pertussis
ggccugcucgccggccagc

SEQ ID NO: 381827 - RNA, 15 nt, Bordetella pertussis
ggccugcucgggcgc

SEQ ID NO: 381828 - RNA, 21 nt, Bordetella pertussis
ggccugcucgugcaucaucug

SEQ ID NO: 381829 - RNA, 19 nt, Bordetella pertussis
ggccugcugugcgauggca

SEQ ID NO: 381830 - RNA, 17 nt, Bordetella pertussis
ggccugcuuggcagccu

SEQ ID NO: 381831 - RNA, 17 nt, Bordetella pertussis
ggccugcuuggccgcgu

SEQ ID NO: 381832 - RNA, 17 nt, Bordetella pertussis
ggccuggaagcuggcca

SEQ ID NO: 381833 - RNA, 21 nt, Bordetella pertussis
ggccuggaagcuggccagcgg

SEQ ID NO: 381834 - RNA, 18 nt, Bordetella pertussis
ggccuggaccugagccag

SEQ ID NO: 381835 - RNA, 14 nt, Bordetella pertussis
ggccuggaggccga

SEQ ID NO: 381836 - RNA, 19 nt, Bordetella pertussis
ggccuggaggccgagcgcg

SEQ ID NO: 381837 - RNA, 17 nt, Bordetella pertussis
ggccuggaugugcaggc

SEQ ID NO: 381838 - RNA, 19 nt, Bordetella pertussis
ggccuggaugugcaggccg

SEQ ID NO: 381839 - RNA, 21 nt, Bordetella pertussis
ggccuggcagaugcgcgccag

SEQ ID NO: 381840 - RNA, 21 nt, Bordetella pertussis
ggccuggcccagcuccagcug

SEQ ID NO: 381841 - RNA, 17 nt, Bordetella pertussis
ggccuggccccaggcgc

SEQ ID NO: 381842 - RNA, 19 nt, Bordetella pertussis
ggccuggccccaggcgccc

SEQ ID NO: 381843 - RNA, 16 nt, Bordetella pertussis
ggccuggccccgcgcg

SEQ ID NO: 381844 - RNA, 14 nt, Bordetella pertussis
ggccuggccgccgg

SEQ ID NO: 381845 - RNA, 17 nt, Bordetella pertussis
ggccuggccgccggcgg

SEQ ID NO: 381846 - RNA, 14 nt, Bordetella pertussis
ggccuggccgcgcg

SEQ ID NO: 381847 - RNA, 14 nt, Bordetella pertussis
ggccuggccugcgc

SEQ ID NO: 381848 - RNA, 16 nt, Bordetella pertussis
ggccuggccugcgccg

SEQ ID NO: 381849 - RNA, 17 nt, Bordetella pertussis
ggccuggccugcgccgc

SEQ ID NO: 381850 - RNA, 17 nt, Bordetella pertussis
ggccuggcgcgcaucgg

SEQ ID NO: 381851 - RNA, 18 nt, Bordetella pertussis
ggccuggcgcgcaucggc

SEQ ID NO: 381852 - RNA, 22 nt, Bordetella pertussis
ggccuggcgcgcaucggcgccg

SEQ ID NO: 381853 - RNA, 14 nt, Bordetella pertussis
ggccuggcgcgcgg

SEQ ID NO: 381854 - RNA, 16 nt, Bordetella pertussis
ggccuggcgcgcggcc

SEQ ID NO: 381855 - RNA, 20 nt, Bordetella pertussis
ggccuggcgcuccucgcgcg

SEQ ID NO: 381856 - RNA, 22 nt, Bordetella pertussis
ggccuggcggaucucggccagc

SEQ ID NO: 381857 - RNA, 18 nt, Bordetella pertussis
ggccuggcucaggccugc

SEQ ID NO: 381858 - RNA, 18 nt, Bordetella pertussis
ggccuggcuuggcggcca

SEQ ID NO: 381859 - RNA, 19 nt, Bordetella pertussis
ggccuggcuuggcggccag

SEQ ID NO: 381860 - RNA, 13 nt, Bordetella pertussis
ggccugggaacgc

SEQ ID NO: 381861 - RNA, 15 nt, Bordetella pertussis
ggccugggcggcgcg

SEQ ID NO: 381862 - RNA, 21 nt, Bordetella pertussis
ggccugggcgggccguugcgc

SEQ ID NO: 381863 - RNA, 13 nt, Bordetella pertussis
ggccugggcgucg

SEQ ID NO: 381864 - RNA, 15 nt, Bordetella pertussis
ggccuucaccuugcc

SEQ ID NO: 381865 - RNA, 16 nt, Bordetella pertussis
ggccuucauggcgucg

SEQ ID NO: 381866 - RNA, 23 nt, Bordetella pertussis
ggccuuccaaguugcucauggcg

SEQ ID NO: 381867 - RNA, 14 nt, Bordetella pertussis
ggccuuccugcuga

SEQ ID NO: 381868 - RNA, 16 nt, Bordetella pertussis
ggccuucgcugcccug

SEQ ID NO: 381869 - RNA, 16 nt, Bordetella pertussis
ggccuucggcggcgcg

SEQ ID NO: 381870 - RNA, 19 nt, Bordetella pertussis
ggccuucguaaacaucgcg

SEQ ID NO: 381871 - RNA, 21 nt, Bordetella pertussis
ggccuucuucacguagccggc

SEQ ID NO: 381872 - RNA, 23 nt, Bordetella pertussis
ggccuucuucacguagccggcca

SEQ ID NO: 381873 - RNA, 16 nt, Bordetella pertussis
ggccuucugcgccagc

SEQ ID NO: 381874 - RNA, 19 nt, Bordetella pertussis
ggccuugccgccgccgcgc

SEQ ID NO: 381875 - RNA, 23 nt, Bordetella pertussis
ggccuugccgccgccgcgcgcgg

SEQ ID NO: 381876 - RNA, 15 nt, Bordetella pertussis
ggccuugcucgccca

SEQ ID NO: 381877 - RNA, 23 nt, Bordetella pertussis
ggccuugcugcccgacggcgccg

SEQ ID NO: 381878 - RNA, 15 nt, Bordetella pertussis
ggccuugccauuggu

SEQ ID NO: 381879 - RNA, 19 nt, Bordetella pertussis
ggccuuggaguagccgcuc

SEQ ID NO: 381880 - RNA, 13 nt, Bordetella pertussis
ggccuuggcaucg

SEQ ID NO: 381881 - RNA, 13 nt, Bordetella pertussis
ggccuuggccagc

SEQ ID NO: 381882 - RNA, 14 nt, Bordetella pertussis
ggccuuggccagca

SEQ ID NO: 381883 - RNA, 17 nt, Bordetella pertussis
ggccuuggccagcagcg

SEQ ID NO: 381884 - RNA, 18 nt, Bordetella pertussis
ggccuuggccgcagccgg

SEQ ID NO: 381885 - RNA, 18 nt, Bordetella pertussis
ggcgaaauggugcggcca

SEQ ID NO: 381886 - RNA, 21 nt, Bordetella pertussis
ggcgaaauggugcggccauga

SEQ ID NO: 381887 - RNA, 19 nt, Bordetella pertussis
ggcgaacaccaggguggcg

SEQ ID NO: 381888 - RNA, 19 nt, Bordetella pertussis
ggcgacacccccagggcgc

SEQ ID NO: 381889 - RNA, 21 nt, Bordetella pertussis
ggcgacacccccagggcgcgc

SEQ ID NO: 381890 - RNA, 14 nt, Bordetella pertussis
ggcgacaccgcggc

SEQ ID NO: 381891 - RNA, 20 nt, Bordetella pertussis
ggcgacaccgcggccuugcc

SEQ ID NO: 381892 - RNA, 17 nt, Bordetella pertussis
ggcgacagcaaugacga

SEQ ID NO: 381893 - RNA, 16 nt, Bordetella pertussis
ggcgacaggcgcgccc

SEQ ID NO: 381894 - RNA, 18 nt, Bordetella pertussis
ggcgacagggcgucgucg

SEQ ID NO: 381895 - RNA, 21 nt, Bordetella pertussis
ggcgacauagaucuccggcgc

SEQ ID NO: 381896 - RNA, 22 nt, Bordetella pertussis
ggcgacauagaucuccggcgcc

SEQ ID NO: 381897 - RNA, 14 nt, Bordetella pertussis
ggcgacauugcgcc

SEQ ID NO: 381898 - RNA, 20 nt, Bordetella pertussis
ggcgaccacuaucagcgcgu

SEQ ID NO: 381899 - RNA, 19 nt, Bordetella pertussis
ggcgaccaggcccacgacg

SEQ ID NO: 381900 - RNA, 20 nt, Bordetella pertussis
ggcgaccaggcccauggcgu

SEQ ID NO: 381901 - RNA, 14 nt, Bordetella pertussis
ggcgaccgcgaacc

SEQ ID NO: 381902 - RNA, 23 nt, Bordetella pertussis
ggcgaccgcgaaccggugcuggu

SEQ ID NO: 381903 - RNA, 14 nt, Bordetella pertussis
ggcgaccgacggca

SEQ ID NO: 381904 - RNA, 13 nt, Bordetella pertussis
ggcgaccggcacc

SEQ ID NO: 381905 - RNA, 17 nt, Bordetella pertussis
ggcgaccggcgccggcu

SEQ ID NO: 381906 - RNA, 16 nt, Bordetella pertussis
ggcgaccggcggcacc

SEQ ID NO: 381907 - RNA, 21 nt, Bordetella pertussis
ggcgaccgugcgccaacgcgu

SEQ ID NO: 381908 - RNA, 18 nt, Bordetella pertussis
ggcgacgaacccgggcgu

SEQ ID NO: 381909 - RNA, 20 nt, Bordetella pertussis
ggcgacgaucuccacccccg

SEQ ID NO: 381910 - RNA, 17 nt, Bordetella pertussis
ggcgacgcccagccugc

SEQ ID NO: 381911 - RNA, 16 nt, Bordetella pertussis
ggcgacgcgcugccgg

SEQ ID NO: 381912 - RNA, 12 nt, Bordetella pertussis
ggcgacgcggcg

SEQ ID NO: 381913 - RNA, 22 nt, Bordetella pertussis
ggcgacggcgccuggcgcauga

SEQ ID NO: 381914 - RNA, 14 nt, Bordetella pertussis
ggcgacggcgugcu

SEQ ID NO: 381915 - RNA, 19 nt, Bordetella pertussis
ggcgacggcgugcugcgcg

SEQ ID NO: 381916 - RNA, 20 nt, Bordetella pertussis
ggcgacggucaggggcaggc

SEQ ID NO: 381917 - RNA, 21 nt, Bordetella pertussis
ggcgacgugaugcucgaucuu

SEQ ID NO: 381918 - RNA, 12 nt, Bordetella pertussis
ggcgacguggcg

SEQ ID NO: 381919 - RNA, 20 nt, Bordetella pertussis
ggcgacguggcgcuccaugc

SEQ ID NO: 381920 - RNA, 13 nt, Bordetella pertussis
ggcgacuccagcc

SEQ ID NO: 381921 - RNA, 18 nt, Bordetella pertussis
ggcgacugccccagcggc

SEQ ID NO: 381922 - RNA, 23 nt, Bordetella pertussis
ggcgacugccccagcggcuggcg

SEQ ID NO: 381923 - RNA, 22 nt, Bordetella pertussis
ggcgacugcagcaggcugggcg

SEQ ID NO: 381924 - RNA, 21 nt, Bordetella pertussis
ggcgacuuccgcuuccggccg

SEQ ID NO: 381925 - RNA, 17 nt, Bordetella pertussis
ggcgacuucggcggcca

SEQ ID NO: 381926 - RNA, 21 nt, Bordetella pertussis
ggcgacuucggcggccaugcc

SEQ ID NO: 381927 - RNA, 19 nt, Bordetella pertussis
ggcgacuucggcggccugc

SEQ ID NO: 381928 - RNA, 21 nt, Bordetella pertussis
ggcgacuucggcggccugcuu

SEQ ID NO: 381929 - RNA, 24 nt, Bordetella pertussis
ggcgagcacccgcaggcggcuggu

SEQ ID NO: 381930 - RNA, 16 nt, Bordetella pertussis
ggcgagcacggccugc

SEQ ID NO: 381931 - RNA, 17 nt, Bordetella pertussis
ggcgagcauggcaucgg

SEQ ID NO: 381932 - RNA, 22 nt, Bordetella pertussis
ggcgagcauggcgguggccagc

SEQ ID NO: 381933 - RNA, 23 nt, Bordetella pertussis
ggcgagcauggcgguggccagcg

SEQ ID NO: 381934 - RNA, 23 nt, Bordetella pertussis
ggcgagcgccgccaggccgucga

SEQ ID NO: 381935 - RNA, 17 nt, Bordetella pertussis
ggcgagcgccgcgcucc

SEQ ID NO: 381936 - RNA, 19 nt, Bordetella pertussis
ggcgagcgccucgcgcucc

SEQ ID NO: 381937 - RNA, 12 nt, Bordetella pertussis
ggcgagcgcggc

SEQ ID NO: 381938 - RNA, 21 nt, Bordetella pertussis
ggcgagcgcggcgcgcgccag

SEQ ID NO: 381939 - RNA, 22 nt, Bordetella pertussis
ggcgagcgcggcgcgcgccagg

SEQ ID NO: 381940 - RNA, 23 nt, Bordetella pertussis
ggcgagcgcggcgggugccgcga

SEQ ID NO: 381941 - RNA, 12 nt, Bordetella pertussis
ggcgagcggcgu

SEQ ID NO: 381942 - RNA, 14 nt, Bordetella pertussis
ggcgagcggcgucg

SEQ ID NO: 381943 - RNA, 20 nt, Bordetella pertussis
ggcgagcgggccggucgcga

SEQ ID NO: 381944 - RNA, 16 nt, Bordetella pertussis
ggcgagcucggcaugg

SEQ ID NO: 381945 - RNA, 15 nt, Bordetella pertussis
ggcgaggacaggcca

SEQ ID NO: 381946 - RNA, 17 nt, Bordetella pertussis
ggcgaggcgcuggccgg

SEQ ID NO: 381947 - RNA, 15 nt, Bordetella pertussis
ggcgaggcguccagc

SEQ ID NO: 381948 - RNA, 15 nt, Bordetella pertussis
ggcgaggcuggcgcc

SEQ ID NO: 381949 - RNA, 21 nt, Bordetella pertussis
ggcgagggcugcccucgcccg

SEQ ID NO: 381950 - RNA, 20 nt, Bordetella pertussis
ggcgagguagggcgcggcca

SEQ ID NO: 381951 - RNA, 16 nt, Bordetella pertussis
ggcgaggucagcccgg

SEQ ID NO: 381952 - RNA, 15 nt, Bordetella pertussis
ggcgauagcgcucca

SEQ ID NO: 381953 - RNA, 18 nt, Bordetella pertussis
ggcgauauccaucggcgc

SEQ ID NO: 381954 - RNA, 20 nt, Bordetella pertussis
ggcgaucaacgugcgccagg

SEQ ID NO: 381955 - RNA, 21 nt, Bordetella pertussis
ggcgaucaacgugcgccaggc

SEQ ID NO: 381956 - RNA, 22 nt, Bordetella pertussis
ggcgaucaccgacagcgccagc

SEQ ID NO: 381957 - RNA, 21 nt, Bordetella pertussis
ggcgaucaccugcguggccgc

SEQ ID NO: 381958 - RNA, 20 nt, Bordetella pertussis
ggcgaucacgccgucgagcu

SEQ ID NO: 381959 - RNA, 16 nt, Bordetella pertussis
ggcgaucagcaccgcg

SEQ ID NO: 381960 - RNA, 18 nt, Bordetella pertussis
ggcgaucagcaccgcggc

SEQ ID NO: 381961 - RNA, 20 nt, Bordetella pertussis
ggcgaucaggaaaagcaggc

SEQ ID NO: 381962 - RNA, 17 nt, Bordetella pertussis
ggcgaucaugccgccga

SEQ ID NO: 381963 - RNA, 14 nt, Bordetella pertussis
ggcgauccaggcca

SEQ ID NO: 381964 - RNA, 22 nt, Bordetella pertussis
ggcgauccaggccaccgcggcg

SEQ ID NO: 381965 - RNA, 20 nt, Bordetella pertussis
ggcgauccauguggccagcu

SEQ ID NO: 381966 - RNA, 16 nt, Bordetella pertussis
ggcgauccgccgcggc

SEQ ID NO: 381967 - RNA, 18 nt, Bordetella pertussis
ggcgauccgccgcggcca

SEQ ID NO: 381968 - RNA, 21 nt, Bordetella pertussis
ggcgauccgccgcggccagcg

SEQ ID NO: 381969 - RNA, 14 nt, Bordetella pertussis
ggcgauccugccca

SEQ ID NO: 381970 - RNA, 13 nt, Bordetella pertussis
ggcgaucgaacgc

SEQ ID NO: 381971 - RNA, 14 nt, Bordetella pertussis
ggcgaucgaacgcg

SEQ ID NO: 381972 - RNA, 19 nt, Bordetella pertussis
ggcgaucgaacgcggccag

SEQ ID NO: 381973 - RNA, 22 nt, Bordetella pertussis
ggcgaucgaauggucggccucg

SEQ ID NO: 381974 - RNA, 22 nt, Bordetella pertussis
ggcgaucgccuguaucugcgcc

SEQ ID NO: 381975 - RNA, 21 nt, Bordetella pertussis
ggcgaucgucaccaucgccgc

SEQ ID NO: 381976 - RNA, 20 nt, Bordetella pertussis
ggcgaucucgcgcgcgcggu

SEQ ID NO: 381977 - RNA, 16 nt, Bordetella pertussis
ggcgaucucgucgacc

SEQ ID NO: 381978 - RNA, 21 nt, Bordetella pertussis
ggcgaucucgucgaccgccuc

SEQ ID NO: 381979 - RNA, 14 nt, Bordetella pertussis
ggcgaucugcgcgg

SEQ ID NO: 381980 - RNA, 15 nt, Bordetella pertussis
ggcgaucugcgcggc

SEQ ID NO: 381981 - RNA, 16 nt, Bordetella pertussis
ggcgaucugcgcggcg

SEQ ID NO: 381982 - RNA, 18 nt, Bordetella pertussis
ggcgaucugggccucggc

SEQ ID NO: 381983 - RNA, 18 nt, Bordetella pertussis
ggcgaucuugccggccug

SEQ ID NO: 381984 - RNA, 19 nt, Bordetella pertussis
ggcgaucuugccggccugg

SEQ ID NO: 381985 - RNA, 20 nt, Bordetella pertussis
ggcgaucuugccggccuggc

SEQ ID NO: 381986 - RNA, 21 nt, Bordetella pertussis
ggcgaucuugccggccuggcg

SEQ ID NO: 381987 - RNA, 14 nt, Bordetella pertussis
ggcgaugaccucgg

SEQ ID NO: 381988 - RNA, 17 nt, Bordetella pertussis
ggcgaugaccucggcga

SEQ ID NO: 381989 - RNA, 21 nt, Bordetella pertussis
ggcgaugaccucggcgagcgc

SEQ ID NO: 381990 - RNA, 14 nt, Bordetella pertussis
ggcgaugaucgccu

SEQ ID NO: 381991 - RNA, 17 nt, Bordetella pertussis
ggcgaugauggggucgc

SEQ ID NO: 381992 - RNA, 20 nt, Bordetella pertussis
ggcgaugauggggucgccgg

SEQ ID NO: 381993 - RNA, 20 nt, Bordetella pertussis
ggcgaugcauucggcggccg

SEQ ID NO: 381994 - RNA, 17 nt, Bordetella pertussis
ggcgaugcccaccagcc

SEQ ID NO: 381995 - RNA, 22 nt, Bordetella pertussis
ggcgaugcccaccagccgcccg

SEQ ID NO: 381996 - RNA, 14 nt, Bordetella pertussis
ggcgaugcccagcg

SEQ ID NO: 381997 - RNA, 21 nt, Bordetella pertussis
ggcgaugccccaguccaggcc

SEQ ID NO: 381998 - RNA, 14 nt, Bordetella pertussis
ggcgaugccggcca

SEQ ID NO: 381999 - RNA, 21 nt, Bordetella pertussis
ggcgaugccggccagcagcga

SEQ ID NO: 382000 - RNA, 12 nt, Bordetella pertussis
ggcgauugcgcc

SEQ ID NO: 382001 - RNA, 13 nt, Bordetella pertussis
ggcgauugcggcc

SEQ ID NO: 382002 - RNA, 15 nt, Bordetella pertussis
ggcgauugcucgaca

SEQ ID NO: 382003 - RNA, 18 nt, Bordetella pertussis
ggcgauuucuacgccgaa

SEQ ID NO: 382004 - RNA, 13 nt, Bordetella pertussis
ggcgauuugccgc

SEQ ID NO: 382005 - RNA, 19 nt, Bordetella pertussis
ggcgauuugccgcagcccg

SEQ ID NO: 382006 - RNA, 20 nt, Bordetella pertussis
ggcgauuugccgcagcccgc

SEQ ID NO: 382007 - RNA, 17 nt, Bordetella pertussis
ggcgauuucgucaucgg

SEQ ID NO: 382008 - RNA, 21 nt, Bordetella pertussis
ggcgauuucgucaucggugcg

SEQ ID NO: 382009 - RNA, 18 nt, Bordetella pertussis
ggcgcaaaccacgucggu

SEQ ID NO: 382010 - RNA, 18 nt, Bordetella pertussis
ggcgcaaaagcaacaacc

SEQ ID NO: 382011 - RNA, 22 nt, Bordetella pertussis
ggcgcacaguugcaggccaugc

SEQ ID NO: 382012 - RNA, 12 nt, Bordetella pertussis
ggcgcaccagcg

SEQ ID NO: 382013 - RNA, 17 nt, Bordetella pertussis
ggcgcaccagcgcgccg

SEQ ID NO: 382014 - RNA, 18 nt, Bordetella pertussis
ggcgcaccagcgcgccga

SEQ ID NO: 382015 - RNA, 19 nt, Bordetella pertussis
ggcgcaccagcgcgccgau

SEQ ID NO: 382016 - RNA, 17 nt, Bordetella pertussis
ggcgcaccagguuggcg

SEQ ID NO: 382017 - RNA, 22 nt, Bordetella pertussis
ggcgcaccaugcggugcgcccu

SEQ ID NO: 382018 - RNA, 20 nt, Bordetella pertussis
ggcgcaccgacagcaagggc

SEQ ID NO: 382019 - RNA, 14 nt, Bordetella pertussis
ggcgcaccaggcug

SEQ ID NO: 382020 - RNA, 15 nt, Bordetella pertussis
ggcgcaccgcgcugg

SEQ ID NO: 382021 - RNA, 16 nt, Bordetella pertussis
ggcgcaccgcgcuggg

SEQ ID NO: 382022 - RNA, 18 nt, Bordetella pertussis
ggcgcaccggcacgcgcc

SEQ ID NO: 382023 - RNA, 20 nt, Bordetella pertussis
ggcgcaccggcacgcgccag

SEQ ID NO: 382024 - RNA, 21 nt, Bordetella pertussis
ggcgcaccggcacgcgccagc

SEQ ID NO: 382025 - RNA, 17 nt, Bordetella pertussis
ggcgcgaggcggcgacg

SEQ ID NO: 382026 - RNA, 19 nt, Bordetella pertussis
ggcgcgaguauucacgccg

SEQ ID NO: 382027 - RNA, 22 nt, Bordetella pertussis
ggcgcgagcgccgggcgccgcg

SEQ ID NO: 382028 - RNA, 17 nt, Bordetella pertussis
ggcgcgauagcgcuugc

SEQ ID NO: 382029 - RNA, 22 nt, Bordetella pertussis
ggcgcgaugggccugcccaugg

SEQ ID NO: 382030 - RNA, 19 nt, Bordetella pertussis
ggcgcgaugugacggcucg

SEQ ID NO: 382031 - RNA, 23 nt, Bordetella pertussis
ggcgcgcaaaccgacgcggccag

SEQ ID NO: 382032 - RNA, 17 nt, Bordetella pertussis
ggcgcgcaaccaggggc

SEQ ID NO: 382033 - RNA, 18 nt, Bordetella pertussis
ggcgcgcacacuggccag

SEQ ID NO: 382034 - RNA, 19 nt, Bordetella pertussis
ggcgcgcacacuggccagc

SEQ ID NO: 382035 - RNA, 20 nt, Bordetella pertussis
ggcgcgcacacuggccagca

SEQ ID NO: 382036 - RNA, 14 nt, Bordetella pertussis
ggcgcgcaccagcc

SEQ ID NO: 382037 - RNA, 16 nt, Bordetella pertussis
ggcgcgcaccagcccg

SEQ ID NO: 382038 - RNA, 21 nt, Bordetella pertussis
ggcgcgcaccagcccgcccgc

SEQ ID NO: 382039 - RNA, 14 nt, Bordetella pertussis
ggcgcgcaccaugg

SEQ ID NO: 382040 - RNA, 11 nt, Bordetella pertussis
ggcgcgcaccu

SEQ ID NO: 382041 - RNA, 20 nt, Bordetella pertussis
ggcgcgcaccugggaggggc

SEQ ID NO: 382042 - RNA, 12 nt, Bordetella pertussis
ggcgcgcacgcu

SEQ ID NO: 382043 - RNA, 13 nt, Bordetella pertussis
ggcgcgcacgggc

SEQ ID NO: 382044 - RNA, 16 nt, Bordetella pertussis
ggcgcgcacgggcgag

SEQ ID NO: 382045 - RNA, 14 nt, Bordetella pertussis
ggcgcgcagcacgc

SEQ ID NO: 382046 - RNA, 16 nt, Bordetella pertussis
ggcgcgcagcacgccg

SEQ ID NO: 382047 - RNA, 17 nt, Bordetella pertussis
ggcgcgcagcacgccga

SEQ ID NO: 382048 - RNA, 21 nt, Bordetella pertussis
ggcgcgcagcacgccgaucgc

SEQ ID NO: 382049 - RNA, 12 nt, Bordetella pertussis
ggcgcgcagcag

SEQ ID NO: 382050 - RNA, 16 nt, Bordetella pertussis
ggcgcgcagcagacgc

SEQ ID NO: 382051 - RNA, 14 nt, Bordetella pertussis
ggcgcgcagcagcg

SEQ ID NO: 382052 - RNA, 15 nt, Bordetella pertussis
ggcgcgcagcagcgc

SEQ ID NO: 382053 - RNA, 14 nt, Bordetella pertussis
ggcgcgcagcgcga

SEQ ID NO: 382054 - RNA, 14 nt, Bordetella pertussis
ggcgcgcagcuccg

SEQ ID NO: 382055 - RNA, 19 nt, Bordetella pertussis
ggcgcgcaggccucgcccg

SEQ ID NO: 382056 - RNA, 17 nt, Bordetella pertussis
ggcgcgcaggcgggccu

SEQ ID NO: 382057 - RNA, 20 nt, Bordetella pertussis
ggcgcgcaggcgggccucga

SEQ ID NO: 382058 - RNA, 12 nt, Bordetella pertussis
ggcgcgcaucgc

SEQ ID NO: 382059 - RNA, 23 nt, Bordetella pertussis
ggcgcgcaucgcgcggcaugggc

SEQ ID NO: 382060 - RNA, 20 nt, Bordetella pertussis
ggcgcgcaucggcgccgagc

SEQ ID NO: 382061 - RNA, 21 nt, Bordetella pertussis
ggcgcgcaucgucaggcaggc

SEQ ID NO: 382062 - RNA, 14 nt, Bordetella pertussis
ggcgcgccagcccg

SEQ ID NO: 382063 - RNA, 13 nt, Bordetella pertussis
ggcgcgccagccg

SEQ ID NO: 382064 - RNA, 15 nt, Bordetella pertussis
ggcgcgccagccgcg

SEQ ID NO: 382065 - RNA, 16 nt, Bordetella pertussis
ggcgcgccagccgcgc

SEQ ID NO: 382066 - RNA, 17 nt, Bordetella pertussis
ggcgcgccagccgcugc

SEQ ID NO: 382067 - RNA, 18 nt, Bordetella pertussis
ggcgcgccagcgcggcca

SEQ ID NO: 382068 - RNA, 24 nt, Bordetella pertussis
ggcgcgccagcgcggccagcgcgu

SEQ ID NO: 382069 - RNA, 12 nt, Bordetella pertussis
ggcgcgccagga

SEQ ID NO: 382070 - RNA, 12 nt, Bordetella pertussis
ggcgcgccaggc

SEQ ID NO: 382071 - RNA, 15 nt, Bordetella pertussis
ggcgcgcccaccagg

SEQ ID NO: 382072 - RNA, 12 nt, Bordetella pertussis
ggcgcgcccagc

SEQ ID NO: 382073 - RNA, 15 nt, Bordetella pertussis
ggcgcgcccagcccc

SEQ ID NO: 382074 - RNA, 14 nt, Bordetella pertussis
ggcgcgcccagcgg

SEQ ID NO: 382075 - RNA, 15 nt, Bordetella pertussis
ggcgcgccauccuga

SEQ ID NO: 382076 - RNA, 23 nt, Bordetella pertussis
ggcgcgccauccugaacgccgcg

SEQ ID NO: 382077 - RNA, 14 nt, Bordetella pertussis
ggcgcgcccgccac

SEQ ID NO: 382078 - RNA, 19 nt, Bordetella pertussis
ggcgcgcccgccuucggcg

SEQ ID NO: 382079 - RNA, 16 nt, Bordetella pertussis
ggcgcgcccggcgcgc

SEQ ID NO: 382080 - RNA, 13 nt, Bordetella pertussis
ggcgcgccgcccg

SEQ ID NO: 382081 - RNA, 14 nt, Bordetella pertussis
ggcgcgccgcccgc

SEQ ID NO: 382082 - RNA, 13 nt, Bordetella pertussis
ggcgcgccgccuc

SEQ ID NO: 382083 - RNA, 15 nt, Bordetella pertussis
ggcgcgccgccucgc

SEQ ID NO: 382084 - RNA, 20 nt, Bordetella pertussis
ggcgcgccgccucgcgcucc

SEQ ID NO: 382085 - RNA, 13 nt, Bordetella pertussis
ggcgcgccgcggc

SEQ ID NO: 382086 - RNA, 22 nt, Bordetella pertussis
ggcgcgccgcugcagcgcuggu

SEQ ID NO: 382087 - RNA, 23 nt, Bordetella pertussis
ggcgcgccggaacauggcgguga

SEQ ID NO: 382088 - RNA, 12 nt, Bordetella pertussis
ggcgcgccggcc

SEQ ID NO: 382089 - RNA, 13 nt, Bordetella pertussis
ggcgcgccggccg

SEQ ID NO: 382090 - RNA, 17 nt, Bordetella pertussis
ggcgcgccggccgccag

SEQ ID NO: 382091 - RNA, 18 nt, Bordetella pertussis
ggcgcgccggccgccagc

SEQ ID NO: 382092 - RNA, 19 nt, Bordetella pertussis
ggcgcgccggccgccagca

SEQ ID NO: 382093 - RNA, 16 nt, Bordetella pertussis
ggcgcgccgggccaga

SEQ ID NO: 382094 - RNA, 21 nt, Bordetella pertussis
ggcgcgccgucgcuggggcgc

SEQ ID NO: 382095 - RNA, 14 nt, Bordetella pertussis
ggcgcgccucggcg

SEQ ID NO: 382096 - RNA, 15 nt, Bordetella pertussis
ggcgcgccucggcgc

SEQ ID NO: 382097 - RNA, 14 nt, Bordetella pertussis
ggcgcgccuggcgc

SEQ ID NO: 382098 - RNA, 15 nt, Bordetella pertussis
ggcgcgccuggcgcg

SEQ ID NO: 382099 - RNA, 18 nt, Bordetella pertussis
ggcgcgccuggcgcgccc

SEQ ID NO: 382100 - RNA, 18 nt, Bordetella pertussis
ggcgcgccuuacgcggcg

SEQ ID NO: 382101 - RNA, 19 nt, Bordetella pertussis
ggcgcgcgaccaggcugga

SEQ ID NO: 382102 - RNA, 17 nt, Bordetella pertussis
ggcgcgcgacggcgccg

SEQ ID NO: 382103 - RNA, 18 nt, Bordetella pertussis
ggcgcgcgauacgucgaa

SEQ ID NO: 382104 - RNA, 19 nt, Bordetella pertussis
ggcgcgcgcaagccgccgc

SEQ ID NO: 382105 - RNA, 12 nt, Bordetella pertussis
ggcgcgcgcacg

SEQ ID NO: 382106 - RNA, 15 nt, Bordetella pertussis
ggcgcgcgcaggcgc

SEQ ID NO: 382107 - RNA, 16 nt, Bordetella pertussis
ggcgcgcucagcgcca

SEQ ID NO: 382108 - RNA, 23 nt, Bordetella pertussis
ggcgcgcucagcgccaucaucgc

SEQ ID NO: 382109 - RNA, 14 nt, Bordetella pertussis
ggcgcgcuccagca

SEQ ID NO: 382110 - RNA, 16 nt, Bordetella pertussis
ggcgcgcucggcgccg

SEQ ID NO: 382111 - RNA, 13 nt, Bordetella pertussis
ggcgcgcugccca

SEQ ID NO: 382112 - RNA, 17 nt, Bordetella pertussis
ggcgcgcugcccagcca

SEQ ID NO: 382113 - RNA, 13 nt, Bordetella pertussis
ggcgcgcuggcgc

SEQ ID NO: 382114 - RNA, 20 nt, Bordetella pertussis
ggcgcgcuggcgcucgggcg

SEQ ID NO: 382115 - RNA, 20 nt, Bordetella pertussis
ggcgcgcuugagcggcucgc

SEQ ID NO: 382116 - RNA, 17 nt, Bordetella pertussis
ggcgcgcuuggucagca

SEQ ID NO: 382117 - RNA, 20 nt, Bordetella pertussis
ggcgcggaacagccugguca

SEQ ID NO: 382118 - RNA, 22 nt, Bordetella pertussis
ggcgcggaacagccuggucagg

SEQ ID NO: 382119 - RNA, 20 nt, Bordetella pertussis
ggcgcggaccugcucgagcg

SEQ ID NO: 382120 - RNA, 17 nt, Bordetella pertussis
ggcgcggcgagcacggc

SEQ ID NO: 382121 - RNA, 20 nt, Bordetella pertussis
ggcgcggcgauugcggcccg

SEQ ID NO: 382122 - RNA, 14 nt, Bordetella pertussis
ggcgcggcgcaggc

SEQ ID NO: 382123 - RNA, 18 nt, Bordetella pertussis
ggcgcggcgcaggccugc

SEQ ID NO: 382124 - RNA, 13 nt, Bordetella pertussis
ggcgcggcgccau

SEQ ID NO: 382125 - RNA, 23 nt, Bordetella pertussis
ggcgcggcgccaugccgcgcccg

SEQ ID NO: 382126 - RNA, 13 nt, Bordetella pertussis
ggcgcggcgcccg

SEQ ID NO: 382127 - RNA, 12 nt, Bordetella pertussis
ggcgcggcgccg

SEQ ID NO: 382128 - RNA, 13 nt, Bordetella pertussis
ggcgcggcgccgc

SEQ ID NO: 382129 - RNA, 19 nt, Bordetella pertussis
ggcgcggcgccguccagcg

SEQ ID NO: 382130 - RNA, 14 nt, Bordetella pertussis
ggcgcggcgcgugc

SEQ ID NO: 382131 - RNA, 18 nt, Bordetella pertussis
ggcgcggcgcgugccagc

SEQ ID NO: 382132 - RNA, 20 nt, Bordetella pertussis
ggcgcggcgcuacgccgccg

SEQ ID NO: 382133 - RNA, 18 nt, Bordetella pertussis
ggcgcggcggccugggcg

SEQ ID NO: 382134 - RNA, 13 nt, Bordetella pertussis
ggcgcggcggcgu

SEQ ID NO: 382135 - RNA, 14 nt, Bordetella pertussis
ggcgcggcgggcgc

SEQ ID NO: 382136 - RNA, 16 nt, Bordetella pertussis
ggcgcggcgggcgcug

SEQ ID NO: 382137 - RNA, 17 nt, Bordetella pertussis
ggcgcggcgggcgcugg

SEQ ID NO: 382138 - RNA, 21 nt, Bordetella pertussis
ggcgcggcgggcgcuggcgcg

SEQ ID NO: 382139 - RNA, 13 nt, Bordetella pertussis
ggcgcggcgggcu

SEQ ID NO: 382140 - RNA, 17 nt, Bordetella pertussis
ggcgcggcggcguuccu

SEQ ID NO: 382141 - RNA, 14 nt, Bordetella pertussis
ggcgcggcgucgaa

SEQ ID NO: 382142 - RNA, 15 nt, Bordetella pertussis
ggcgcggcgucgaug

SEQ ID NO: 382143 - RNA, 16 nt, Bordetella pertussis
ggcgcguggccgccac

SEQ ID NO: 382144 - RNA, 13 nt, Bordetella pertussis
ggcgcguggcgcc

SEQ ID NO: 382145 - RNA, 14 nt, Bordetella pertussis
ggcgcguggcgccc

SEQ ID NO: 382146 - RNA, 20 nt, Bordetella pertussis
ggcgcggcugcccucgguca

SEQ ID NO: 382147 - RNA, 13 nt, Bordetella pertussis
ggcgcgugucaug

SEQ ID NO: 382148 - RNA, 14 nt, Bordetella pertussis
ggcgcguucagcag

SEQ ID NO: 382149 - RNA, 16 nt, Bordetella pertussis
ggcgcguuccaugcga

SEQ ID NO: 382150 - RNA, 20 nt, Bordetella pertussis
ggcgcguucucagccgcccg

SEQ ID NO: 382151 - RNA, 17 nt, Bordetella pertussis
ggcgcguugcgcaucgc

SEQ ID NO: 382152 - RNA, 19 nt, Bordetella pertussis
ggcgcguuuucgcuggcgg

SEQ ID NO: 382153 - RNA, 22 nt, Bordetella pertussis
ggcgcuacagggugccgcgccg

SEQ ID NO: 382154 - RNA, 20 nt, Bordetella pertussis
ggcgcucgaaaaagcccugc

SEQ ID NO: 382155 - RNA, 13 nt, Bordetella pertussis
ggcgcucgagcgc

SEQ ID NO: 382156 - RNA, 20 nt, Bordetella pertussis
ggcgcucgaggcgcuggcgu

SEQ ID NO: 382157 - RNA, 22 nt, Bordetella pertussis
ggcgcucgcccucgcgccacca

SEQ ID NO: 382158 - RNA, 19 nt, Bordetella pertussis
ggcgcucgcgcaccgcaug

SEQ ID NO: 382159 - RNA, 13 nt, Bordetella pertussis
ggcgcucgcgccc

SEQ ID NO: 382160 - RNA, 15 nt, Bordetella pertussis
ggcgcucgcgggugc

SEQ ID NO: 382161 - RNA, 13 nt, Bordetella pertussis
ggcgcucggccag

SEQ ID NO: 382162 - RNA, 19 nt, Bordetella pertussis
ggcgcucggccagcgaggc

SEQ ID NO: 382163 - RNA, 13 nt, Bordetella pertussis
ggcgcucgggcgc

SEQ ID NO: 382164 - RNA, 14 nt, Bordetella pertussis
ggcgcugacgccga

SEQ ID NO: 382165 - RNA, 15 nt, Bordetella pertussis
ggcgcugcacgcagc

SEQ ID NO: 382166 - RNA, 22 nt, Bordetella pertussis
ggcgcugccgggguccuuggag

SEQ ID NO: 382167 - RNA, 18 nt, Bordetella pertussis
ggcgcugccugccggccg

SEQ ID NO: 382168 - RNA, 18 nt, Bordetella pertussis
ggcgcugcgcagcagggc

SEQ ID NO: 382169 - RNA, 14 nt, Bordetella pertussis
ggcgcugcgccggc

SEQ ID NO: 382170 - RNA, 21 nt, Bordetella pertussis
ggcgcugcgcgaaacggccgg

SEQ ID NO: 382171 - RNA, 13 nt, Bordetella pertussis
ggcgcuggcgaug

SEQ ID NO: 382172 - RNA, 21 nt, Bordetella pertussis
ggcgcuggcgaugcgggccac

SEQ ID NO: 382173 - RNA, 14 nt, Bordetella pertussis
ggcgcuggcgccgc

SEQ ID NO: 382174 - RNA, 12 nt, Bordetella pertussis
ggcgcuggcgcg

SEQ ID NO: 382175 - RNA, 13 nt, Bordetella pertussis
ggcgcuggcggcu

SEQ ID NO: 382176 - RNA, 17 nt, Bordetella pertussis
ggcgcuggcggcugcgc

SEQ ID NO: 382177 - RNA, 23 nt, Bordetella pertussis
ggcgcuggcguucagcgggcgcg

SEQ ID NO: 382178 - RNA, 17 nt, Bordetella pertussis
ggcgcuggcuggacgcg

SEQ ID NO: 382179 - RNA, 22 nt, Bordetella pertussis
ggcgcuggcuggacgcgcgcgg

SEQ ID NO: 382180 - RNA, 21 nt, Bordetella pertussis
ggcgcugggcaggcuggcgcg

SEQ ID NO: 382181 - RNA, 22 nt, Bordetella pertussis
ggcgcugggcaggcuggcgcgg

SEQ ID NO: 382182 - RNA, 17 nt, Bordetella pertussis
ggcgcuggcguccagcc

SEQ ID NO: 382183 - RNA, 19 nt, Bordetella pertussis
ggcgcuggucaaccuggug

SEQ ID NO: 382184 - RNA, 20 nt, Bordetella pertussis
ggcgcuggucaaccuggugu

SEQ ID NO: 382185 - RNA, 15 nt, Bordetella pertussis
ggcgcuguccggcgc

SEQ ID NO: 382186 - RNA, 16 nt, Bordetella pertussis
ggcgcuguccggcgcu

SEQ ID NO: 382187 - RNA, 18 nt, Bordetella pertussis
ggcgcuguccggcgcucg

SEQ ID NO: 382188 - RNA, 22 nt, Bordetella pertussis
ggcgcuguauauauagggggca

SEQ ID NO: 382189 - RNA, 17 nt, Bordetella pertussis
ggcgcuuuccgagccgg

SEQ ID NO: 382190 - RNA, 18 nt, Bordetella pertussis
ggcgcuuuccgagccggu

SEQ ID NO: 382191 - RNA, 17 nt, Bordetella pertussis
ggcggaaaacagcacca

SEQ ID NO: 382192 - RNA, 20 nt, Bordetella pertussis
ggcggaaaacagcaccagca

SEQ ID NO: 382193 - RNA, 21 nt, Bordetella pertussis
ggcggaaaacagcaccagcau

SEQ ID NO: 382194 - RNA, 22 nt, Bordetella pertussis
ggcggaaaacagcaccagcaug

SEQ ID NO: 382195 - RNA, 17 nt, Bordetella pertussis
ggcggcaacgugcaggc

SEQ ID NO: 382196 - RNA, 19 nt, Bordetella pertussis
ggcggcaacgugcaggcca

SEQ ID NO: 382197 - RNA, 15 nt, Bordetella pertussis
ggcggcaagcggcgu

SEQ ID NO: 382198 - RNA, 18 nt, Bordetella pertussis
ggcggcaagcggcguggg

SEQ ID NO: 382199 - RNA, 18 nt, Bordetella pertussis
ggcggacacgcaugcagg

SEQ ID NO: 382200 - RNA, 14 nt, Bordetella pertussis
ggcggcaauuucgc

SEQ ID NO: 382201 - RNA, 15 nt, Bordetella pertussis
ggcggcaccagcagg

SEQ ID NO: 382202 - RNA, 16 nt, Bordetella pertussis
ggcggcaccagcaggc

SEQ ID NO: 382203 - RNA, 18 nt, Bordetella pertussis
ggcggcaccauugccggc

SEQ ID NO: 382204 - RNA, 20 nt, Bordetella pertussis
ggcggcaccauugccggcgc

SEQ ID NO: 382205 - RNA, 12 nt, Bordetella pertussis
ggcggcaccgcg

SEQ ID NO: 382206 - RNA, 17 nt, Bordetella pertussis
ggcggcacgcugcgcag

SEQ ID NO: 382207 - RNA, 22 nt, Bordetella pertussis
ggcggcacgcugcgcaggcgcg

SEQ ID NO: 382208 - RNA, 19 nt, Bordetella pertussis
ggcggcacggccggccugc

SEQ ID NO: 382209 - RNA, 13 nt, Bordetella pertussis
ggcggcagcgcga

SEQ ID NO: 382210 - RNA, 23 nt, Bordetella pertussis
ggcggcagcucgcgcugcgcgcc

SEQ ID NO: 382211 - RNA, 15 nt, Bordetella pertussis
ggcggcaggccgcgc

SEQ ID NO: 382212 - RNA, 13 nt, Bordetella pertussis
ggcggcaggcgcg

SEQ ID NO: 382213 - RNA, 14 nt, Bordetella pertussis
ggcggcaggcgcga

SEQ ID NO: 382214 - RNA, 20 nt, Bordetella pertussis
ggcggcaucguucaggcgca

SEQ ID NO: 382215 - RNA, 24 nt, Bordetella pertussis
ggcggcaucguucaggcgcauggu

SEQ ID NO: 382216 - RNA, 23 nt, Bordetella pertussis
ggcggcaucuugccuuggcgaau

SEQ ID NO: 382217 - RNA, 18 nt, Bordetella pertussis
ggcggccaccaccaggcc

SEQ ID NO: 382218 - RNA, 15 nt, Bordetella pertussis
ggcggccacgaccgg

SEQ ID NO: 382219 - RNA, 12 nt, Bordetella pertussis
ggcggccagcag

SEQ ID NO: 382220 - RNA, 15 nt, Bordetella pertussis
ggcggccagcagcgg

SEQ ID NO: 382221 - RNA, 13 nt, Bordetella pertussis
ggcggccaggccc

SEQ ID NO: 382222 - RNA, 14 nt, Bordetella pertussis
ggcggccaggccga

SEQ ID NO: 382223 - RNA, 17 nt, Bordetella pertussis
ggcggccaggccggcgc

SEQ ID NO: 382224 - RNA, 18 nt, Bordetella pertussis
ggcggccaggccggcgcg

SEQ ID NO: 382225 - RNA, 12 nt, Bordetella pertussis
ggcggccaggcg

SEQ ID NO: 382226 - RNA, 14 nt, Bordetella pertussis
ggcggccaggcgcg

SEQ ID NO: 382227 - RNA, 15 nt, Bordetella pertussis
ggcggccaggcgcgc

SEQ ID NO: 382228 - RNA, 17 nt, Bordetella pertussis
ggcggccaggcgcgccg

SEQ ID NO: 382229 - RNA, 20 nt, Bordetella pertussis
ggcggccaggcgcgccgcga

SEQ ID NO: 382230 - RNA, 13 nt, Bordetella pertussis
ggcggcccggccg

SEQ ID NO: 382231 - RNA, 15 nt, Bordetella pertussis
ggcggccgaccagca

SEQ ID NO: 382232 - RNA, 14 nt, Bordetella pertussis
ggcggccgccagcg

SEQ ID NO: 382233 - RNA, 13 nt, Bordetella pertussis
ggcggccgccagc

SEQ ID NO: 382234 - RNA, 12 nt, Bordetella pertussis
ggcggccgccca

SEQ ID NO: 382235 - RNA, 15 nt, Bordetella pertussis
ggcggccgcccagca

SEQ ID NO: 382236 - RNA, 15 nt, Bordetella pertussis
ggcggccgccgccag

SEQ ID NO: 382237 - RNA, 14 nt, Bordetella pertussis
ggcggccugggcca

SEQ ID NO: 382238 - RNA, 17 nt, Bordetella pertussis
ggcggccugggccaugg

SEQ ID NO: 382239 - RNA, 16 nt, Bordetella pertussis
ggcggccugggcgggc

SEQ ID NO: 382240 - RNA, 19 nt, Bordetella pertussis
ggcggccugggcgggccgu

SEQ ID NO: 382241 - RNA, 14 nt, Bordetella pertussis
ggcggccuugaugg

SEQ ID NO: 382242 - RNA, 21 nt, Bordetella pertussis
ggcggccuuggccgcagccgg

SEQ ID NO: 382243 - RNA, 17 nt, Bordetella pertussis
ggcggccuuugcgcgcu

SEQ ID NO: 382244 - RNA, 18 nt, Bordetella pertussis
ggcggccuugccggccac

SEQ ID NO: 382245 - RNA, 16 nt, Bordetella pertussis
ggcggcgaccggcgcc

SEQ ID NO: 382246 - RNA, 15 nt, Bordetella pertussis
ggcggcgacgcagca

SEQ ID NO: 382247 - RNA, 17 nt, Bordetella pertussis
ggcggcgacgcagcacg

SEQ ID NO: 382248 - RNA, 12 nt, Bordetella pertussis
ggcggcgcacca

SEQ ID NO: 382249 - RNA, 21 nt, Bordetella pertussis
ggcggcgcagcgcccaggcga

SEQ ID NO: 382250 - RNA, 15 nt, Bordetella pertussis
ggcggcgcaggccag

SEQ ID NO: 382251 - RNA, 15 nt, Bordetella pertussis
ggcggcgcaucagcg

SEQ ID NO: 382252 - RNA, 14 nt, Bordetella pertussis
ggcggcgccggccg

SEQ ID NO: 382253 - RNA, 16 nt, Bordetella pertussis
ggcggcgccuggucgc

SEQ ID NO: 382254 - RNA, 13 nt, Bordetella pertussis
ggcggcggcgucg

SEQ ID NO: 382255 - RNA, 14 nt, Bordetella pertussis
ggcggcggcgucgc

SEQ ID NO: 382256 - RNA, 15 nt, Bordetella pertussis
ggcggcggccggggc

SEQ ID NO: 382257 - RNA, 13 nt, Bordetella pertussis
ggcggcgggcggc

SEQ ID NO: 382258 - RNA, 14 nt, Bordetella pertussis
ggcggcgggcguga

SEQ ID NO: 382259 - RNA, 14 nt, Bordetella pertussis
ggcggcgggcugca

SEQ ID NO: 382260 - RNA, 22 nt, Bordetella pertussis
ggcggcgggucaaguccggcgc

SEQ ID NO: 382261 - RNA, 23 nt, Bordetella pertussis
ggcggcgggucaaguccggcgcc

SEQ ID NO: 382262 - RNA, 22 nt, Bordetella pertussis
ggcggcgguuucuuccagcagg

SEQ ID NO: 382263 - RNA, 19 nt, Bordetella pertussis
ggcggcguagagcgccgcg

SEQ ID NO: 382264 - RNA, 15 nt, Bordetella pertussis
ggcggcgucaaugcc

SEQ ID NO: 382265 - RNA, 19 nt, Bordetella pertussis
ggcggcgucgaucggcgcg

SEQ ID NO: 382266 - RNA, 17 nt, Bordetella pertussis
ggcggcgucgccgcgca

SEQ ID NO: 382267 - RNA, 19 nt, Bordetella pertussis
ggcggcgucgcuggcagcc

SEQ ID NO: 382268 - RNA, 15 nt, Bordetella pertussis
ggcggcgucggcgcc

SEQ ID NO: 382269 - RNA, 16 nt, Bordetella pertussis
ggcggcgucggcgccc

SEQ ID NO: 382270 - RNA, 16 nt, Bordetella pertussis
ggcggcgucuucgcgg

SEQ ID NO: 382271 - RNA, 20 nt, Bordetella pertussis
ggcggcgucuucgcgggaau

SEQ ID NO: 382272 - RNA, 16 nt, Bordetella pertussis
ggcggcgugaccgcga

SEQ ID NO: 382273 - RNA, 12 nt, Bordetella pertussis
ggcggcgugccc

SEQ ID NO: 382274 - RNA, 15 nt, Bordetella pertussis
ggcggcgugcccugc

SEQ ID NO: 382275 - RNA, 21 nt, Bordetella pertussis
ggcggcgugcccugcggcgcg

SEQ ID NO: 382276 - RNA, 16 nt, Bordetella pertussis
ggcggcgugcgccugc

SEQ ID NO: 382277 - RNA, 19 nt, Bordetella pertussis
ggcggcgugcgccugcugg

SEQ ID NO: 382278 - RNA, 23 nt, Bordetella pertussis
ggcggcuaggcgcagcaggccag

SEQ ID NO: 382279 - RNA, 22 nt, Bordetella pertussis
ggcggcuuucaugggccugggc

SEQ ID NO: 382280 - RNA, 22 nt, Bordetella pertussis
ggcggcuuucgauuugcagcag

SEQ ID NO: 382281 - RNA, 15 nt, Bordetella pertussis
ggcgggaacaggcac

SEQ ID NO: 382282 - RNA, 17 nt, Bordetella pertussis
ggcgggacgcaggccca

SEQ ID NO: 382283 - RNA, 17 nt, Bordetella pertussis
ggcgggacggccauuca

SEQ ID NO: 382284 - RNA, 14 nt, Bordetella pertussis
ggcgggcaccaugc

SEQ ID NO: 382285 - RNA, 15 nt, Bordetella pertussis
ggcgggcaccaugcg

SEQ ID NO: 382286 - RNA, 23 nt, Bordetella pertussis
ggcgggcgauauccaucggcgcg

SEQ ID NO: 382287 - RNA, 16 nt, Bordetella pertussis
ggcgggcgccgcgccc

SEQ ID NO: 382288 - RNA, 23 nt, Bordetella pertussis
ggcgggcgcuucgucggccgcca

SEQ ID NO: 382289 - RNA, 23 nt, Bordetella pertussis
ggcgggcggccggcgcgucgccg

SEQ ID NO: 382290 - RNA, 15 nt, Bordetella pertussis
ggcgggcggcgccag

SEQ ID NO: 382291 - RNA, 13 nt, Bordetella pertussis
ggcgggcggcgcg

SEQ ID NO: 382292 - RNA, 20 nt, Bordetella pertussis
ggcgggcgugaugccgacca

SEQ ID NO: 382293 - RNA, 20 nt, Bordetella pertussis
ggcgggcucagcccgccugg

SEQ ID NO: 382294 - RNA, 14 nt, Bordetella pertussis
ggcgggcuggucgc

SEQ ID NO: 382295 - RNA, 18 nt, Bordetella pertussis
ggcgggcuggucgcgccg

SEQ ID NO: 382296 - RNA, 20 nt, Bordetella pertussis
ggcgggcuggucgcgccggu

SEQ ID NO: 382297 - RNA, 16 nt, Bordetella pertussis
ggcgggcucggcgccg

SEQ ID NO: 382298 - RNA, 17 nt, Bordetella pertussis
ggcggggaauucgaccg

SEQ ID NO: 382299 - RNA, 15 nt, Bordetella pertussis
ggcggugccgcgcac

SEQ ID NO: 382300 - RNA, 16 nt, Bordetella pertussis
ggcggugcgccgcaug

SEQ ID NO: 382301 - RNA, 21 nt, Bordetella pertussis
ggcggugcguccaggacgcga

SEQ ID NO: 382302 - RNA, 13 nt, Bordetella pertussis
ggcgguggccucg

SEQ ID NO: 382303 - RNA, 13 nt, Bordetella pertussis
ggcgguggccagc

SEQ ID NO: 382304 - RNA, 14 nt, Bordetella pertussis
ggcgguggccagcg

SEQ ID NO: 382305 - RNA, 14 nt, Bordetella pertussis
ggcgguggccgcgc

SEQ ID NO: 382306 - RNA, 21 nt, Bordetella pertussis
ggcgguggccgcgcaugccag

SEQ ID NO: 382307 - RNA, 23 nt, Bordetella pertussis
ggcgguggucaucgaugcgccgc

SEQ ID NO: 382308 - RNA, 20 nt, Bordetella pertussis
ggcgguguagaccaccagca

SEQ ID NO: 382309 - RNA, 21 nt, Bordetella pertussis
ggcgguguagaccaccagcag

SEQ ID NO: 382310 - RNA, 20 nt, Bordetella pertussis
ggcgguuccagccuggcaau

SEQ ID NO: 382311 - RNA, 22 nt, Bordetella pertussis
ggcgguuguugcccaccgccag

SEQ ID NO: 382312 - RNA, 23 nt, Bordetella pertussis
ggcgguuuuucuuuggccgcgcg

SEQ ID NO: 382313 - RNA, 14 nt, Bordetella pertussis
ggcguaaggccgcc

SEQ ID NO: 382314 - RNA, 17 nt, Bordetella pertussis
ggcguaaggccgccggc

SEQ ID NO: 382315 - RNA, 18 nt, Bordetella pertussis
ggcguaaggccgccggcc

SEQ ID NO: 382316 - RNA, 17 nt, Bordetella pertussis
ggcguaauagcuggcgg

SEQ ID NO: 382317 - RNA, 17 nt, Bordetella pertussis
ggcguaauugggcuggu

SEQ ID NO: 382318 - RNA, 15 nt, Bordetella pertussis
ggcguaccgguccag

SEQ ID NO: 382319 - RNA, 21 nt, Bordetella pertussis
ggcguacgcuuaucgcggcgc

SEQ ID NO: 382320 - RNA, 16 nt, Bordetella pertussis
ggcguacuggcgcggc

SEQ ID NO: 382321 - RNA, 13 nt, Bordetella pertussis
ggcguagagcgcc

SEQ ID NO: 382322 - RNA, 15 nt, Bordetella pertussis
ggcguagagcgccgc

SEQ ID NO: 382323 - RNA, 16 nt, Bordetella pertussis
ggcguagagcgccgcg

SEQ ID NO: 382324 - RNA, 21 nt, Bordetella pertussis
ggcguagauccaggcggccac

SEQ ID NO: 382325 - RNA, 23 nt, Bordetella pertussis
ggcguagauccaggcggccacca

SEQ ID NO: 382326 - RNA, 19 nt, Bordetella pertussis
ggcguagccggugcgcagc

SEQ ID NO: 382327 - RNA, 23 nt, Bordetella pertussis
ggcguagccggugcgcagcacca

SEQ ID NO: 382328 - RNA, 21 nt, Bordetella pertussis
ggcguagcccuuguggccgcc

SEQ ID NO: 382329 - RNA, 20 nt, Bordetella pertussis
ggcguaguagcccaggccca

SEQ ID NO: 382330 - RNA, 14 nt, Bordetella pertussis
ggcguagucguugc

SEQ ID NO: 382331 - RNA, 17 nt, Bordetella pertussis
ggcguauggcccgccac

SEQ ID NO: 382332 - RNA, 20 nt, Bordetella pertussis
ggcgucaagccagcggcgcg

SEQ ID NO: 382333 - RNA, 21 nt, Bordetella pertussis
ggcgucaagccagcggcgcgg

SEQ ID NO: 382334 - RNA, 19 nt, Bordetella pertussis
ggcgucaaugccagucgcc

SEQ ID NO: 382335 - RNA, 21 nt, Bordetella pertussis
ggcgucaaugccagucgccgc

SEQ ID NO: 382336 - RNA, 21 nt, Bordetella pertussis
ggcgucaaaccaagcagggac

SEQ ID NO: 382337 - RNA, 13 nt, Bordetella pertussis
ggcgucaccggcg

SEQ ID NO: 382338 - RNA, 15 nt, Bordetella pertussis
ggcgucaccggcgag

SEQ ID NO: 382339 - RNA, 21 nt, Bordetella pertussis
ggcgucaccggcgagccgaug

SEQ ID NO: 382340 - RNA, 15 nt, Bordetella pertussis
ggcgucaccuuggga

SEQ ID NO: 382341 - RNA, 24 nt, Bordetella pertussis
ggcgucagcgcccaaucgggcagc

SEQ ID NO: 382342 - RNA, 17 nt, Bordetella pertussis
ggcgucagcgugcgccc

SEQ ID NO: 382343 - RNA, 15 nt, Bordetella pertussis
ggcgucaucggcgcg

SEQ ID NO: 382344 - RNA, 18 nt, Bordetella pertussis
ggcguccaccgccgaugc

SEQ ID NO: 382345 - RNA, 16 nt, Bordetella pertussis
ggcgucaugcgcuugu

SEQ ID NO: 382346 - RNA, 20 nt, Bordetella pertussis
ggcgucaugcgcuugucgcc

SEQ ID NO: 382347 - RNA, 17 nt, Bordetella pertussis
ggcguccaccuugacgc

SEQ ID NO: 382348 - RNA, 20 nt, Bordetella pertussis
ggcguccaccuugacgcgca

SEQ ID NO: 382349 - RNA, 16 nt, Bordetella pertussis
ggcguccagccccugc

SEQ ID NO: 382350 - RNA, 14 nt, Bordetella pertussis
ggcguccagccugc

SEQ ID NO: 382351 - RNA, 18 nt, Bordetella pertussis
ggcguccagccugcccgg

SEQ ID NO: 382352 - RNA, 17 nt, Bordetella pertussis
ggcguccaggcgcgcca

SEQ ID NO: 382353 - RNA, 18 nt, Bordetella pertussis
ggcguccaggcgcgccag

SEQ ID NO: 382354 - RNA, 17 nt, Bordetella pertussis
ggcguccaggcugccgg

SEQ ID NO: 382355 - RNA, 20 nt, Bordetella pertussis
ggcguccaggcugccggcgu

SEQ ID NO: 382356 - RNA, 15 nt, Bordetella pertussis
ggcguccagcagcag

SEQ ID NO: 382357 - RNA, 15 nt, Bordetella pertussis
ggcguccagguuggg

SEQ ID NO: 382358 - RNA, 12 nt, Bordetella pertussis
ggcguccaugca

SEQ ID NO: 382359 - RNA, 18 nt, Bordetella pertussis
ggcguccaugcagguggc

SEQ ID NO: 382360 - RNA, 22 nt, Bordetella pertussis
ggcguccauuagggcccagcug

SEQ ID NO: 382361 - RNA, 23 nt, Bordetella pertussis
ggcguccauuagggcccagcugc

SEQ ID NO: 382362 - RNA, 21 nt, Bordetella pertussis
ggcguccgauaucccauggga

SEQ ID NO: 382363 - RNA, 14 nt, Bordetella pertussis
ggcguccgcgucgc

SEQ ID NO: 382364 - RNA, 17 nt, Bordetella pertussis
ggcguccugccgcgacc

SEQ ID NO: 382365 - RNA, 16 nt, Bordetella pertussis
ggcguccugcggcggc

SEQ ID NO: 382366 - RNA, 17 nt, Bordetella pertussis
ggcguccugcggcggca

SEQ ID NO: 382367 - RNA, 17 nt, Bordetella pertussis
ggcgucgaaacgcugcg

SEQ ID NO: 382368 - RNA, 19 nt, Bordetella pertussis
ggcgucgaaacgcugcgcg

SEQ ID NO: 382369 - RNA, 21 nt, Bordetella pertussis
ggcgucgaaggcggccggcag

SEQ ID NO: 382370 - RNA, 20 nt, Bordetella pertussis
ggcgucgaaugcacgggcgc

SEQ ID NO: 382371 - RNA, 23 nt, Bordetella pertussis
ggcgucgaaugcacgggcgcugc

SEQ ID NO: 382372 - RNA, 18 nt, Bordetella pertussis
ggcgucgaccgcgggcgc

SEQ ID NO: 382373 - RNA, 20 nt, Bordetella pertussis
ggcgucgacgcccgcgccca

SEQ ID NO: 382374 - RNA, 18 nt, Bordetella pertussis
ggcgucgagcacgcggcg

SEQ ID NO: 382375 - RNA, 22 nt, Bordetella pertussis
ggcgucgagcacgcggcgcggc

SEQ ID NO: 382376 - RNA, 15 nt, Bordetella pertussis
ggcgucgaucggcgc

SEQ ID NO: 382377 - RNA, 16 nt, Bordetella pertussis
ggcgucgaucggcgcg

SEQ ID NO: 382378 - RNA, 19 nt, Bordetella pertussis
ggcgucgaucggcgcgccc

SEQ ID NO: 382379 - RNA, 19 nt, Bordetella pertussis
ggcgucgaucuucgccugc

SEQ ID NO: 382380 - RNA, 19 nt, Bordetella pertussis
ggcgucgaugcgcgcgcgg

SEQ ID NO: 382381 - RNA, 20 nt, Bordetella pertussis
ggcgucgauuucgucgagcu

SEQ ID NO: 382382 - RNA, 18 nt, Bordetella pertussis
ggcgucgcccggggcggc

SEQ ID NO: 382383 - RNA, 18 nt, Bordetella pertussis
ggcgugaugcccaggccc

SEQ ID NO: 382384 - RNA, 19 nt, Bordetella pertussis
ggcgugaugccgaccaggc

SEQ ID NO: 382385 - RNA, 22 nt, Bordetella pertussis
ggcgugauggacgccggguugc

SEQ ID NO: 382386 - RNA, 20 nt, Bordetella pertussis
ggcgugcagagcaccacggc

SEQ ID NO: 382387 - RNA, 23 nt, Bordetella pertussis
ggcgugcagagcaccacggcgcg

SEQ ID NO: 382388 - RNA, 20 nt, Bordetella pertussis
ggcgugcagcaagcccaccg

SEQ ID NO: 382389 - RNA, 21 nt, Bordetella pertussis
ggcgugcagccauucggccag

SEQ ID NO: 382390 - RNA, 14 nt, Bordetella pertussis
ggcgugcaggccgg

SEQ ID NO: 382391 - RNA, 16 nt, Bordetella pertussis
ggcgugcaggccggcg

SEQ ID NO: 382392 - RNA, 14 nt, Bordetella pertussis
ggcgugcaggcugg

SEQ ID NO: 382393 - RNA, 20 nt, Bordetella pertussis
ggcgugcagguacgccaugc

SEQ ID NO: 382394 - RNA, 13 nt, Bordetella pertussis
ggcgugccaggug

SEQ ID NO: 382395 - RNA, 19 nt, Bordetella pertussis
ggcgugccauggacgccgg

SEQ ID NO: 382396 - RNA, 21 nt, Bordetella pertussis
ggcgugcccaguuucgcgacc

SEQ ID NO: 382397 - RNA, 14 nt, Bordetella pertussis
ggcgugcuugccgc

SEQ ID NO: 382398 - RNA, 17 nt, Bordetella pertussis
ggcgugcuugccgccgg

SEQ ID NO: 382399 - RNA, 22 nt, Bordetella pertussis
ggcgugcuugccgccggacggc

SEQ ID NO: 382400 - RNA, 21 nt, Bordetella pertussis
ggcguggcaggugcggccgca

SEQ ID NO: 382401 - RNA, 16 nt, Bordetella pertussis
ggcguggcgcagggug

SEQ ID NO: 382402 - RNA, 15 nt, Bordetella pertussis
ggcguggcgccgacc

SEQ ID NO: 382403 - RNA, 14 nt, Bordetella pertussis
ggcguggcgcgccc

SEQ ID NO: 382404 - RNA, 16 nt, Bordetella pertussis
ggcguggcgcgcgccg

SEQ ID NO: 382405 - RNA, 14 nt, Bordetella pertussis
ggcguggcggccag

SEQ ID NO: 382406 - RNA, 15 nt, Bordetella pertussis
ggcguggcuggcguc

SEQ ID NO: 382407 - RNA, 16 nt, Bordetella pertussis
ggcguggcuggcgucg

SEQ ID NO: 382408 - RNA, 15 nt, Bordetella pertussis
ggcguggcgucgugg

SEQ ID NO: 382409 - RNA, 18 nt, Bordetella pertussis
ggcguggggagcgcggcc

SEQ ID NO: 382410 - RNA, 18 nt, Bordetella pertussis
ggcgugguaucgcgccag

SEQ ID NO: 382411 - RNA, 19 nt, Bordetella pertussis
ggcgugguaucgcgccagc

SEQ ID NO: 382412 - RNA, 22 nt, Bordetella pertussis
ggcguggucaucgauggccacg

SEQ ID NO: 382413 - RNA, 21 nt, Bordetella pertussis
ggcguguccagcggcgccagc

SEQ ID NO: 382414 - RNA, 15 nt, Bordetella pertussis
ggcguucaaucgcgc

SEQ ID NO: 382415 - RNA, 19 nt, Bordetella pertussis
ggcguucaaucgcgcuucu

SEQ ID NO: 382416 - RNA, 19 nt, Bordetella pertussis
ggcguucaccaggaagcgc

SEQ ID NO: 382417 - RNA, 21 nt, Bordetella pertussis
ggcguucagcgggcgcgcccg

SEQ ID NO: 382418 - RNA, 14 nt, Bordetella pertussis
ggcguugaaggcga

SEQ ID NO: 382419 - RNA, 16 nt, Bordetella pertussis
ggcguugaaggcgaug

SEQ ID NO: 382420 - RNA, 20 nt, Bordetella pertussis
ggcguugaccggguugagcg

SEQ ID NO: 382421 - RNA, 17 nt, Bordetella pertussis
ggcguugacggcccagc

SEQ ID NO: 382422 - RNA, 16 nt, Bordetella pertussis
ggcguugcggcgccau

SEQ ID NO: 382423 - RNA, 18 nt, Bordetella pertussis
ggcguugcggcgccauuc

SEQ ID NO: 382424 - RNA, 19 nt, Bordetella pertussis
ggcguugcuggcaaagcgc

SEQ ID NO: 382425 - RNA, 22 nt, Bordetella pertussis
ggcguugccggccugaggcccg

SEQ ID NO: 382426 - RNA, 18 nt, Bordetella pertussis
ggcuacagcucgccggcg

SEQ ID NO: 382427 - RNA, 22 nt, Bordetella pertussis
ggcucagccccccguaggcggc

SEQ ID NO: 382428 - RNA, 13 nt, Bordetella pertussis
ggcucagcgggcu

SEQ ID NO: 382429 - RNA, 16 nt, Bordetella pertussis
ggcucaggcggccagg

SEQ ID NO: 382430 - RNA, 15 nt, Bordetella pertussis
ggcucauucggcgcg

SEQ ID NO: 382431 - RNA, 19 nt, Bordetella pertussis
ggcuccagcucagcagcgc

SEQ ID NO: 382432 - RNA, 21 nt, Bordetella pertussis
ggcuccagcucagcagcgcca

SEQ ID NO: 382433 - RNA, 22 nt, Bordetella pertussis
ggcuccagcucagcagcgccag

SEQ ID NO: 382434 - RNA, 14 nt, Bordetella pertussis
ggcuccaggccgcc

SEQ ID NO: 382435 - RNA, 18 nt, Bordetella pertussis
ggcuccaggccgcccagc

SEQ ID NO: 382436 - RNA, 16 nt, Bordetella pertussis
ggcuccaggcugagcg

SEQ ID NO: 382437 - RNA, 20 nt, Bordetella pertussis
ggcuccggcuugccgaaggu

SEQ ID NO: 382438 - RNA, 22 nt, Bordetella pertussis
ggcuccucgcccgaccugcugg

SEQ ID NO: 382439 - RNA, 14 nt, Bordetella pertussis
ggcuccugcuggcg

SEQ ID NO: 382440 - RNA, 16 nt, Bordetella pertussis
ggcuccugcuggcgcg

SEQ ID NO: 382441 - RNA, 21 nt, Bordetella pertussis
ggcuccugugggggcgcggcg

SEQ ID NO: 382442 - RNA, 19 nt, Bordetella pertussis
ggcucgaaguacagcuuga

SEQ ID NO: 382443 - RNA, 16 nt, Bordetella pertussis
ggcucgaccgccgcca

SEQ ID NO: 382444 - RNA, 19 nt, Bordetella pertussis
ggcucgagcggcagcagcg

SEQ ID NO: 382445 - RNA, 19 nt, Bordetella pertussis
ggcucgaggaaccagccgu

SEQ ID NO: 382446 - RNA, 15 nt, Bordetella pertussis
ggcucgaucgccgcc

SEQ ID NO: 382447 - RNA, 18 nt, Bordetella pertussis
ggcucgaucgccgccggc

SEQ ID NO: 382448 - RNA, 19 nt, Bordetella pertussis
ggcucgaucgccgccggca

SEQ ID NO: 382449 - RNA, 21 nt, Bordetella pertussis
ggcucgaucgccgccggcacg

SEQ ID NO: 382450 - RNA, 16 nt, Bordetella pertussis
ggcucgaugaccagca

SEQ ID NO: 382451 - RNA, 17 nt, Bordetella pertussis
ggcucgaugaccagcag

SEQ ID NO: 382452 - RNA, 14 nt, Bordetella pertussis
ggcucgaugcgucc

SEQ ID NO: 382453 - RNA, 22 nt, Bordetella pertussis
ggcucgccgagccgggccaugc

SEQ ID NO: 382454 - RNA, 13 nt, Bordetella pertussis
ggcucgccggccg

SEQ ID NO: 382455 - RNA, 14 nt, Bordetella pertussis
ggcucgccucccca

SEQ ID NO: 382456 - RNA, 21 nt, Bordetella pertussis
ggcucgccuccccaggccagc

SEQ ID NO: 382457 - RNA, 16 nt, Bordetella pertussis
ggcucgcgcucgcccg

SEQ ID NO: 382458 - RNA, 19 nt, Bordetella pertussis
ggcucgcgcucgcccggcc

SEQ ID NO: 382459 - RNA, 23 nt, Bordetella pertussis
ggcucgcugucgugccgcacggu

SEQ ID NO: 382460 - RNA, 15 nt, Bordetella pertussis
ggcucggccaccaug

SEQ ID NO: 382461 - RNA, 16 nt, Bordetella pertussis
ggcucggccaccaugc

SEQ ID NO: 382462 - RNA, 20 nt, Bordetella pertussis
ggcucggcccuagagcaugc

SEQ ID NO: 382463 - RNA, 23 nt, Bordetella pertussis
ggcucggcccuagagcaugcggc

SEQ ID NO: 382464 - RNA, 19 nt, Bordetella pertussis
ggcucggucucgcccaugg

SEQ ID NO: 382465 - RNA, 20 nt, Bordetella pertussis
ggcucguacggcgucgggca

SEQ ID NO: 382466 - RNA, 15 nt, Bordetella pertussis
ggcucgucgaacagc

SEQ ID NO: 382467 - RNA, 13 nt, Bordetella pertussis
ggcucgucgacgc

SEQ ID NO: 382468 - RNA, 17 nt, Bordetella pertussis
ggcucgucgacgcggcc

SEQ ID NO: 382469 - RNA, 20 nt, Bordetella pertussis
ggcucgucgacgcggccgug

SEQ ID NO: 382470 - RNA, 22 nt, Bordetella pertussis
ggcucgugcagcaggggcugcc

SEQ ID NO: 382471 - RNA, 18 nt, Bordetella pertussis
ggcuguaucuggccuguc

SEQ ID NO: 382472 - RNA, 17 nt, Bordetella pertussis
ggcuguccaccugcacc

SEQ ID NO: 382473 - RNA, 14 nt, Bordetella pertussis
ggcugucccagaug

SEQ ID NO: 382474 - RNA, 15 nt, Bordetella pertussis
ggcuguccccgcgcg

SEQ ID NO: 382475 - RNA, 17 nt, Bordetella pertussis
ggcugucgcgcgcaucg

SEQ ID NO: 382476 - RNA, 18 nt, Bordetella pertussis
ggcugucgcgcgcaucgc

SEQ ID NO: 382477 - RNA, 21 nt, Bordetella pertussis
ggcugucgcgcgcaucgccga

SEQ ID NO: 382478 - RNA, 20 nt, Bordetella pertussis
ggcugucgucgucggcaccu

SEQ ID NO: 382479 - RNA, 14 nt, Bordetella pertussis
ggcuguggccgcgg

SEQ ID NO: 382480 - RNA, 13 nt, Bordetella pertussis
ggcugugggccuc

SEQ ID NO: 382481 - RNA, 15 nt, Bordetella pertussis
ggcuguucgccaugu

SEQ ID NO: 382482 - RNA, 17 nt, Bordetella pertussis
ggcuguucgcgcagcag

SEQ ID NO: 382483 - RNA, 19 nt, Bordetella pertussis
ggcuguucguagucgagcc

SEQ ID NO: 382484 - RNA, 22 nt, Bordetella pertussis
ggcuuccaucaggaacggcaug

SEQ ID NO: 382485 - RNA, 21 nt, Bordetella pertussis
ggcuucccgguccaggccgaa

SEQ ID NO: 382486 - RNA, 19 nt, Bordetella pertussis
ggcuuccugcaccucagga

SEQ ID NO: 382487 - RNA, 17 nt, Bordetella pertussis
ggcuuccugcggcacga

SEQ ID NO: 382488 - RNA, 17 nt, Bordetella pertussis
ggcuucgagcgcgacga

SEQ ID NO: 382489 - RNA, 21 nt, Bordetella pertussis
ggcuucgaucaugcccgccac

SEQ ID NO: 382490 - RNA, 24 nt, Bordetella pertussis
ggcuucgcccagcgcuugcacgcc

SEQ ID NO: 382491 - RNA, 22 nt, Bordetella pertussis
ggcuucgcgcacauccagccga

SEQ ID NO: 382492 - RNA, 21 nt, Bordetella pertussis
ggcuucggccgucagcagcag

SEQ ID NO: 382493 - RNA, 14 nt, Bordetella pertussis
ggcuucggcgcugg

SEQ ID NO: 382494 - RNA, 15 nt, Bordetella pertussis
ggcuucggcgcuggg

SEQ ID NO: 382495 - RNA, 17 nt, Bordetella pertussis
ggcuucggcgcugggcg

SEQ ID NO: 382496 - RNA, 20 nt, Bordetella pertussis
ggcuugcacgccggccacga

SEQ ID NO: 382497 - RNA, 20 nt, Bordetella pertussis
ggcuugcagcaacgcggcgu

SEQ ID NO: 382498 - RNA, 20 nt, Bordetella pertussis
ggcuugcagcggacggcgcg

SEQ ID NO: 382499 - RNA, 20 nt, Bordetella pertussis
ggcuugcagcuugcgcgccc

SEQ ID NO: 382500 - RNA, 22 nt, Bordetella pertussis
ggcuugccgguuuuuuugcgcc

SEQ ID NO: 382501 - RNA, 19 nt, Bordetella pertussis
ggcuugcgcaagccggccg

SEQ ID NO: 382502 - RNA, 15 nt, Bordetella pertussis
ggcuugcgcauacgc

SEQ ID NO: 382503 - RNA, 21 nt, Bordetella pertussis
ggcuugcgccagccacgcgcg

SEQ ID NO: 382504 - RNA, 16 nt, Bordetella pertussis
ggcuugcggcgcuggc

SEQ ID NO: 382505 - RNA, 12 nt, Bordetella pertussis
ggcuuggccgaa

SEQ ID NO: 382506 - RNA, 16 nt, Bordetella pertussis
ggcuuggccucggccg

SEQ ID NO: 382507 - RNA, 15 nt, Bordetella pertussis
ggcuugggcccggcg

SEQ ID NO: 382508 - RNA, 13 nt, Bordetella pertussis
gggaaagcggcga

SEQ ID NO: 382509 - RNA, 23 nt, Bordetella pertussis
gggaacaggcgcgccagccgcgc

SEQ ID NO: 382510 - RNA, 19 nt, Bordetella pertussis
gggacaggcacccgcacgg

SEQ ID NO: 382511 - RNA, 20 nt, Bordetella pertussis
gggacaggcacccugucaua

SEQ ID NO: 382512 - RNA, 16 nt, Bordetella pertussis
gggacaggcacgccgg

SEQ ID NO: 382513 - RNA, 15 nt, Bordetella pertussis
gggacaggcaucagg

SEQ ID NO: 382514 - RNA, 19 nt, Bordetella pertussis
gggacuggcucccaccggu

SEQ ID NO: 382515 - RNA, 20 nt, Bordetella pertussis
gggagccaguccccgcgggg

SEQ ID NO: 382516 - RNA, 16 nt, Bordetella pertussis
gggagcgacacccgcg

SEQ ID NO: 382517 - RNA, 15 nt, Bordetella pertussis
gggauaccgcuggcc

SEQ ID NO: 382518 - RNA, 14 nt, Bordetella pertussis
gggaugcaggucgg

SEQ ID NO: 382519 - RNA, 14 nt, Bordetella pertussis
gggaugccccgccc

SEQ ID NO: 382520 - RNA, 14 nt, Bordetella pertussis
gggauggaugccgu

SEQ ID NO: 382521 - RNA, 22 nt, Bordetella pertussis
gggcaacgacgcaggcgccgca

SEQ ID NO: 382522 - RNA, 18 nt, Bordetella pertussis
gggcaagcgcgucgaugg

SEQ ID NO: 382523 - RNA, 20 nt, Bordetella pertussis
gggcaauuuuguugauggcg

SEQ ID NO: 382524 - RNA, 14 nt, Bordetella pertussis
gggcacauccagcg

SEQ ID NO: 382525 - RNA, 18 nt, Bordetella pertussis
gggcacaucggccacccg

SEQ ID NO: 382526 - RNA, 14 nt, Bordetella pertussis
gggcaucgcccugc

SEQ ID NO: 382527 - RNA, 17 nt, Bordetella pertussis
gggcaucgcccugcucg

SEQ ID NO: 382528 - RNA, 13 nt, Bordetella pertussis
gggcaucguugga

SEQ ID NO: 382529 - RNA, 15 nt, Bordetella pertussis
gggcauguugcgcga

SEQ ID NO: 382530 - RNA, 19 nt, Bordetella pertussis
gggccaccacgccgaugca

SEQ ID NO: 382531 - RNA, 14 nt, Bordetella pertussis
gggccaccuggcag

SEQ ID NO: 382532 - RNA, 12 nt, Bordetella pertussis
gggccacgccca

SEQ ID NO: 382533 - RNA, 18 nt, Bordetella pertussis
gggccacgcccaggccgu

SEQ ID NO: 382534 - RNA, 13 nt, Bordetella pertussis
gggccacgccggc

SEQ ID NO: 382535 - RNA, 20 nt, Bordetella pertussis
gggccacugcgccugggcgg

SEQ ID NO: 382536 - RNA, 15 nt, Bordetella pertussis
gggccagcagcuggc

SEQ ID NO: 382537 - RNA, 21 nt, Bordetella pertussis
gggccagcagcuggcgcagca

SEQ ID NO: 382538 - RNA, 15 nt, Bordetella pertussis
gggccagccagcgcc

SEQ ID NO: 382539 - RNA, 17 nt, Bordetella pertussis
gggccagccccggcgcg

SEQ ID NO: 382540 - RNA, 13 nt, Bordetella pertussis
gggccagcgcgau

SEQ ID NO: 382541 - RNA, 16 nt, Bordetella pertussis
gggccagccuggcgcc

SEQ ID NO: 382542 - RNA, 15 nt, Bordetella pertussis
gggccaggcccacgg

SEQ ID NO: 382543 - RNA, 19 nt, Bordetella pertussis
gggccaguagcgugugcag

SEQ ID NO: 382544 - RNA, 17 nt, Bordetella pertussis
gggccaguucggcuugc

SEQ ID NO: 382545 - RNA, 21 nt, Bordetella pertussis
gggccaucagguuguccagcg

SEQ ID NO: 382546 - RNA, 18 nt, Bordetella pertussis
gggcccacaugccgugcc

SEQ ID NO: 382547 - RNA, 20 nt, Bordetella pertussis
gggcccacaugccgugccag

SEQ ID NO: 382548 - RNA, 23 nt, Bordetella pertussis
gggccccagcaucugccccagcu

SEQ ID NO: 382549 - RNA, 17 nt, Bordetella pertussis
gggccccuccggcgccg

SEQ ID NO: 382550 - RNA, 14 nt, Bordetella pertussis
gggccgagccggau

SEQ ID NO: 382551 - RNA, 15 nt, Bordetella pertussis
gggccgagcgcgcca

SEQ ID NO: 382552 - RNA, 18 nt, Bordetella pertussis
gggccgagcgcgccagca

SEQ ID NO: 382553 - RNA, 17 nt, Bordetella pertussis
gggccgaggcuucgaug

SEQ ID NO: 382554 - RNA, 20 nt, Bordetella pertussis
gggccgaugaagacgccguc

SEQ ID NO: 382555 - RNA, 13 nt, Bordetella pertussis
gggccgcccagca

SEQ ID NO: 382556 - RNA, 21 nt, Bordetella pertussis
gggccgcccagucguccagca

SEQ ID NO: 382557 - RNA, 17 nt, Bordetella pertussis
gggccgcagcauggcgc

SEQ ID NO: 382558 - RNA, 14 nt, Bordetella pertussis
gggccgccagcacc

SEQ ID NO: 382559 - RNA, 17 nt, Bordetella pertussis
gggccgguccgcucgag

SEQ ID NO: 382560 - RNA, 21 nt, Bordetella pertussis
gggccgguccgcucgaggcca

SEQ ID NO: 382561 - RNA, 16 nt, Bordetella pertussis
gggccgguuucggccu

SEQ ID NO: 382562 - RNA, 17 nt, Bordetella pertussis
gggccgucgccgcgcgg

SEQ ID NO: 382563 - RNA, 21 nt, Bordetella pertussis
gggccgucgugcgccuggcgg

SEQ ID NO: 382564 - RNA, 23 nt, Bordetella pertussis
gggccgucuacaggcccagcgcc

SEQ ID NO: 382565 - RNA, 16 nt, Bordetella pertussis
gggccgugcgccgggc

SEQ ID NO: 382566 - RNA, 17 nt, Bordetella pertussis
gggccgugcgccgggcg

SEQ ID NO: 382567 - RNA, 16 nt, Bordetella pertussis
gggccuggucagcgcc

SEQ ID NO: 382568 - RNA, 18 nt, Bordetella pertussis
gggccuggucagcgccga

SEQ ID NO: 382569 - RNA, 20 nt, Bordetella pertussis
gggcgaaacggccagcguca

SEQ ID NO: 382570 - RNA, 19 nt, Bordetella pertussis
gggcgaaccgcggcgcagg

SEQ ID NO: 382571 - RNA, 21 nt, Bordetella pertussis
gggcgaaccgcggcgcagguc

SEQ ID NO: 382572 - RNA, 14 nt, Bordetella pertussis
gggcgaacugcucg

SEQ ID NO: 382573 - RNA, 14 nt, Bordetella pertussis
gggcgaacuggucg

SEQ ID NO: 382574 - RNA, 14 nt, Bordetella pertussis
gggcgaagccacgg

SEQ ID NO: 382575 - RNA, 18 nt, Bordetella pertussis
gggcgaagccacggcccg

SEQ ID NO: 382576 - RNA, 16 nt, Bordetella pertussis
gggcgaauccaccggc

SEQ ID NO: 382577 - RNA, 15 nt, Bordetella pertussis
gggcgaugccgcaga

SEQ ID NO: 382578 - RNA, 20 nt, Bordetella pertussis
gggcgaugcggcggccgaag

SEQ ID NO: 382579 - RNA, 13 nt, Bordetella pertussis
gggcgaugcggcg

SEQ ID NO: 382580 - RNA, 19 nt, Bordetella pertussis
gggcgauuugccgcagccc

SEQ ID NO: 382581 - RNA, 23 nt, Bordetella pertussis
gggcgcaaaagcaacaaccgcgc

SEQ ID NO: 382582 - RNA, 13 nt, Bordetella pertussis
gggcgcaacgccg

SEQ ID NO: 382583 - RNA, 21 nt, Bordetella pertussis
gggcgcacaguugcaggccau

SEQ ID NO: 382584 - RNA, 20 nt, Bordetella pertussis
gggcgcaccaugcggugcgc

SEQ ID NO: 382585 - RNA, 12 nt, Bordetella pertussis
gggcgcacgccg

SEQ ID NO: 382586 - RNA, 17 nt, Bordetella pertussis
gggcgcacgccgcgccg

SEQ ID NO: 382587 - RNA, 20 nt, Bordetella pertussis
gggcgcacgccgcgccggcg

SEQ ID NO: 382588 - RNA, 12 nt, Bordetella pertussis
gggcgcaggccg

SEQ ID NO: 382589 - RNA, 24 nt, Bordetella pertussis
gggcgcauagcgaaagccgauacc

SEQ ID NO: 382590 - RNA, 18 nt, Bordetella pertussis
gggcgcauuggcccugcu

SEQ ID NO: 382591 - RNA, 21 nt, Bordetella pertussis
gggcgccaggcugaaugccgc

SEQ ID NO: 382592 - RNA, 14 nt, Bordetella pertussis
gggcgcccagcgcg

SEQ ID NO: 382593 - RNA, 19 nt, Bordetella pertussis
gggcgccccaacgcggcca

SEQ ID NO: 382594 - RNA, 18 nt, Bordetella pertussis
gggcgccgaccgggccga

SEQ ID NO: 382595 - RNA, 15 nt, Bordetella pertussis
gggcgccgauccagc

SEQ ID NO: 382596 - RNA, 19 nt, Bordetella pertussis
gggcgccgcaacgccgggc

SEQ ID NO: 382597 - RNA, 15 nt, Bordetella pertussis
gggcgccagcagcac

SEQ ID NO: 382598 - RNA, 15 nt, Bordetella pertussis
gggcgccgcgcccca

SEQ ID NO: 382599 - RNA, 15 nt, Bordetella pertussis
gggcgccgcggggcg

SEQ ID NO: 382600 - RNA, 13 nt, Bordetella pertussis
gggcgccuggcug

SEQ ID NO: 382601 - RNA, 20 nt, Bordetella pertussis
gggcgccuguccccgcagga

SEQ ID NO: 382602 - RNA, 20 nt, Bordetella pertussis
gggcgccuugccgccgcgca

SEQ ID NO: 382603 - RNA, 21 nt, Bordetella pertussis
gggcgcgacgccagcgcgcca

SEQ ID NO: 382604 - RNA, 15 nt, Bordetella pertussis
gggcgcgcagcaggc

SEQ ID NO: 382605 - RNA, 15 nt, Bordetella pertussis
gggcgcgcccagccc

SEQ ID NO: 382606 - RNA, 16 nt, Bordetella pertussis
gggcgucgucgccguc

SEQ ID NO: 382607 - RNA, 16 nt, Bordetella pertussis
gggcgucgucgcgguc

SEQ ID NO: 382608 - RNA, 17 nt, Bordetella pertussis
gggcgucguagcccucg

SEQ ID NO: 382609 - RNA, 20 nt, Bordetella pertussis
gggcgucugcccgcggucca

SEQ ID NO: 382610 - RNA, 23 nt, Bordetella pertussis
gggcgucugcccgcgguccagca

SEQ ID NO: 382611 - RNA, 19 nt, Bordetella pertussis
gggcgucugcucgccguuc

SEQ ID NO: 382612 - RNA, 21 nt, Bordetella pertussis
gggcgugaaaggccagcggcg

SEQ ID NO: 382613 - RNA, 22 nt, Bordetella pertussis
gggcgugagcaggcgccugccc

SEQ ID NO: 382614 - RNA, 14 nt, Bordetella pertussis
gggcgugagcgccu

SEQ ID NO: 382615 - RNA, 20 nt, Bordetella pertussis
gggcgugaugccgaccaggc

SEQ ID NO: 382616 - RNA, 23 nt, Bordetella pertussis
gggcgugcccucgcugcgcguca

SEQ ID NO: 382617 - RNA, 13 nt, Bordetella pertussis
gggcgugccugcu

SEQ ID NO: 382618 - RNA, 13 nt, Bordetella pertussis
gggcguucgacgg

SEQ ID NO: 382619 - RNA, 23 nt, Bordetella pertussis
gggcguuuuugcguccggcgcgc

SEQ ID NO: 382620 - RNA, 21 nt, Bordetella pertussis
gggcucaggcugcgcgucggc

SEQ ID NO: 382621 - RNA, 15 nt, Bordetella pertussis
gggcuccucgcccga

SEQ ID NO: 382622 - RNA, 15 nt, Bordetella pertussis
gggcucgaccgccgc

SEQ ID NO: 382623 - RNA, 16 nt, Bordetella pertussis
gggcucgcgcgagccc

SEQ ID NO: 382624 - RNA, 16 nt, Bordetella pertussis
gggcucgcgcgcgcgg

SEQ ID NO: 382625 - RNA, 12 nt, Bordetella pertussis
gggcucggccac

SEQ ID NO: 382626 - RNA, 13 nt, Bordetella pertussis
gggcucggccagg

SEQ ID NO: 382627 - RNA, 19 nt, Bordetella pertussis
gggcucgucgacgcggccg

SEQ ID NO: 382628 - RNA, 18 nt, Bordetella pertussis
gggcucuucgacagcgcg

SEQ ID NO: 382629 - RNA, 23 nt, Bordetella pertussis
gggcugcaugcucuggcacacca

SEQ ID NO: 382630 - RNA, 20 nt, Bordetella pertussis
gggcugccauuccagcuccg

SEQ ID NO: 382631 - RNA, 19 nt, Bordetella pertussis
gggcugaucuugaugcggc

SEQ ID NO: 382632 - RNA, 18 nt, Bordetella pertussis
gggcugaugcaggccugc

SEQ ID NO: 382633 - RNA, 15 nt, Bordetella pertussis
gggcuggccggccaa

SEQ ID NO: 382634 - RNA, 15 nt, Bordetella pertussis
gggcuggucgggcgu

SEQ ID NO: 382635 - RNA, 14 nt, Bordetella pertussis
gggcuguccgccac

SEQ ID NO: 382636 - RNA, 17 nt, Bordetella pertussis
gggcuugauggccagcg

SEQ ID NO: 382637 - RNA, 17 nt, Bordetella pertussis
gggcuuugacgccggcu

SEQ ID NO: 382638 - RNA, 22 nt, Bordetella pertussis
gggcuuuuuccuguucggccac

SEQ ID NO: 382639 - RNA, 20 nt, Bordetella pertussis
gggcuuuuugccuuggggcg

SEQ ID NO: 382640 - RNA, 20 nt, Bordetella pertussis
gggcuuuuuguugcgcgccg

SEQ ID NO: 382641 - RNA, 14 nt, Bordetella pertussis
ggggacaggcaccu

SEQ ID NO: 382642 - RNA, 13 nt, Bordetella pertussis
ggggaugacgggc

SEQ ID NO: 382643 - RNA, 13 nt, Bordetella pertussis
ggggcaaccggcc

SEQ ID NO: 382644 - RNA, 14 nt, Bordetella pertussis
ggggcagcaggccg

SEQ ID NO: 382645 - RNA, 17 nt, Bordetella pertussis
ggggcaggccuggucga

SEQ ID NO: 382646 - RNA, 21 nt, Bordetella pertussis
ggggcaguuuccagggcuugc

SEQ ID NO: 382647 - RNA, 21 nt, Bordetella pertussis
ggggcauggcgccgcgcgccg

SEQ ID NO: 382648 - RNA, 17 nt, Bordetella pertussis
ggggccagccuggcgcc

SEQ ID NO: 382649 - RNA, 14 nt, Bordetella pertussis
ggggcccgcgggcg

SEQ ID NO: 382650 - RNA, 14 nt, Bordetella pertussis
ggggccgagcgugc

SEQ ID NO: 382651 - RNA, 23 nt, Bordetella pertussis
ggggccgauggucagcgugucgc

SEQ ID NO: 382652 - RNA, 17 nt, Bordetella pertussis
ggggccgcccagcaccu

SEQ ID NO: 382653 - RNA, 17 nt, Bordetella pertussis
ggggccggccgcgcgcg

SEQ ID NO: 382654 - RNA, 13 nt, Bordetella pertussis
ggggccggcgccg

SEQ ID NO: 382655 - RNA, 11 nt, Bordetella pertussis
ggggccgcggc

SEQ ID NO: 382656 - RNA, 19 nt, Bordetella pertussis
ggggccgggccggcgggcg

SEQ ID NO: 382657 - RNA, 16 nt, Bordetella pertussis
ggggcgagcgcagccg

SEQ ID NO: 382658 - RNA, 13 nt, Bordetella pertussis
ggggcgcaccggc

SEQ ID NO: 382659 - RNA, 22 nt, Bordetella pertussis
ggggcgcccagcgcgucggcca

SEQ ID NO: 382660 - RNA, 20 nt, Bordetella pertussis
ggggcgccccaacgcggcca

SEQ ID NO: 382661 - RNA, 20 nt, Bordetella pertussis
ggggcgcgagaggguguugc

SEQ ID NO: 382662 - RNA, 14 nt, Bordetella pertussis
ggggcgcuggucga

SEQ ID NO: 382663 - RNA, 13 nt, Bordetella pertussis
ggggcggccggga

SEQ ID NO: 382664 - RNA, 15 nt, Bordetella pertussis
ggggcggcucggccc

SEQ ID NO: 382665 - RNA, 12 nt, Bordetella pertussis
ggggcggcgccu

SEQ ID NO: 382666 - RNA, 20 nt, Bordetella pertussis
ggggcguagcucagccuggu

SEQ ID NO: 382667 - RNA, 22 nt, Bordetella pertussis
ggggcguggggagcgcggcccg

SEQ ID NO: 382668 - RNA, 19 nt, Bordetella pertussis
ggggcucgcgcccgagcgc

SEQ ID NO: 382669 - RNA, 17 nt, Bordetella pertussis
ggggcuguaccuggcga

SEQ ID NO: 382670 - RNA, 23 nt, Bordetella pertussis
ggggcuuuuuguugcgcgccgua

SEQ ID NO: 382671 - RNA, 11 nt, Bordetella pertussis
gggggacuggc

SEQ ID NO: 382672 - RNA, 14 nt, Bordetella pertussis
gggggacuggcacc

SEQ ID NO: 382673 - RNA, 19 nt, Bordetella pertussis
gggggucaggccguuggcg

SEQ ID NO: 382674 - RNA, 15 nt, Bordetella pertussis
ggggguucgugggcg

SEQ ID NO: 382675 - RNA, 11 nt, Bordetella pertussis
ggggguuggcc

SEQ ID NO: 382676 - RNA, 14 nt, Bordetella pertussis
ggggucagcgccga

SEQ ID NO: 382677 - RNA, 13 nt, Bordetella pertussis
ggggucaggccgu

SEQ ID NO: 382678 - RNA, 20 nt, Bordetella pertussis
ggggucgggccgcgcgcggg

SEQ ID NO: 382679 - RNA, 14 nt, Bordetella pertussis
ggggucuugccgcg

SEQ ID NO: 382680 - RNA, 22 nt, Bordetella pertussis
ggggugauggcgaaacuggccg

SEQ ID NO: 382681 - RNA, 16 nt, Bordetella pertussis
gggguggccggcgcgc

SEQ ID NO: 382682 - RNA, 13 nt, Bordetella pertussis
gggguggcugucc

SEQ ID NO: 382683 - RNA, 22 nt, Bordetella pertussis
gggguguucuccaacugggcca

SEQ ID NO: 382684 - RNA, 20 nt, Bordetella pertussis
gggguucuguccggcgcugg

SEQ ID NO: 382685 - RNA, 16 nt, Bordetella pertussis
ggguacagcgcgcccg

SEQ ID NO: 382686 - RNA, 15 nt, Bordetella pertussis
gggucaaggcgcggc

SEQ ID NO: 382687 - RNA, 12 nt, Bordetella pertussis
gggucagcgccg

SEQ ID NO: 382688 - RNA, 13 nt, Bordetella pertussis
gggucagcgccgg

SEQ ID NO: 382689 - RNA, 12 nt, Bordetella pertussis
gggucaggccgu

SEQ ID NO: 382690 - RNA, 13 nt, Bordetella pertussis
gggucaggggcag

SEQ ID NO: 382691 - RNA, 22 nt, Bordetella pertussis
gggucaugaugucggccaggga

SEQ ID NO: 382692 - RNA, 14 nt, Bordetella pertussis
ggguccagcacgcc

SEQ ID NO: 382693 - RNA, 14 nt, Bordetella pertussis
ggguccggccgcgc

SEQ ID NO: 382694 - RNA, 22 nt, Bordetella pertussis
ggguccugaggccaggccggau

SEQ ID NO: 382695 - RNA, 15 nt, Bordetella pertussis
gggucgaucauggcc

SEQ ID NO: 382696 - RNA, 15 nt, Bordetella pertussis
gggucgccgggcagc

SEQ ID NO: 382697 - RNA, 20 nt, Bordetella pertussis
gggucgcuguagcgcagccc

SEQ ID NO: 382698 - RNA, 15 nt, Bordetella pertussis
gggucgcugugcgcg

SEQ ID NO: 382699 - RNA, 19 nt, Bordetella pertussis
gggucggucugcgugcgcg

SEQ ID NO: 382700 - RNA, 16 nt, Bordetella pertussis
gggucguacgagccga

SEQ ID NO: 382701 - RNA, 18 nt, Bordetella pertussis
gggucgucccagcgcacg

SEQ ID NO: 382702 - RNA, 13 nt, Bordetella pertussis
gggucgucgggcg

SEQ ID NO: 382703 - RNA, 16 nt, Bordetella pertussis
gggucugccccauggc

SEQ ID NO: 382704 - RNA, 22 nt, Bordetella pertussis
gggucugcuggucgcgggccag

SEQ ID NO: 382705 - RNA, 16 nt, Bordetella pertussis
gggucuggcggccggu

SEQ ID NO: 382706 - RNA, 13 nt, Bordetella pertussis
gggugaccauguc

SEQ ID NO: 382707 - RNA, 20 nt, Bordetella pertussis
gggugaccuuggucgggucc

SEQ ID NO: 382708 - RNA, 13 nt, Bordetella pertussis
ggucagcgcggcg

SEQ ID NO: 382709 - RNA, 13 nt, Bordetella pertussis
ggucagcggccgg

SEQ ID NO: 382710 - RNA, 16 nt, Bordetella pertussis
ggucagcggccggccc

SEQ ID NO: 382711 - RNA, 22 nt, Bordetella pertussis
ggucagcgugucgccgacccgg

SEQ ID NO: 382712 - RNA, 15 nt, Bordetella pertussis
ggucagcuugccgcc

SEQ ID NO: 382713 - RNA, 17 nt, Bordetella pertussis
ggucagcuugccgccca

SEQ ID NO: 382714 - RNA, 20 nt, Bordetella pertussis
ggucaggaugcgcgccaggc

SEQ ID NO: 382715 - RNA, 23 nt, Bordetella pertussis
ggucaggcccacgccgccgaagu

SEQ ID NO: 382716 - RNA, 11 nt, Bordetella pertussis
ggucaggccgu

SEQ ID NO: 382717 - RNA, 16 nt, Bordetella pertussis
ggucaggccguuggcg

SEQ ID NO: 382718 - RNA, 21 nt, Bordetella pertussis
ggucaggccguuggcgcgccu

SEQ ID NO: 382719 - RNA, 16 nt, Bordetella pertussis
ggucaucgagguggcg

SEQ ID NO: 382720 - RNA, 14 nt, Bordetella pertussis
ggucaucgaugcgc

SEQ ID NO: 382721 - RNA, 14 nt, Bordetella pertussis
ggucaucgccaggc

SEQ ID NO: 382722 - RNA, 15 nt, Bordetella pertussis
ggucaucgccaggcg

SEQ ID NO: 382723 - RNA, 18 nt, Bordetella pertussis
ggucaucgccaggcgcgu

SEQ ID NO: 382724 - RNA, 14 nt, Bordetella pertussis
ggucaugacgggcg

SEQ ID NO: 382725 - RNA, 18 nt, Bordetella pertussis
ggucaugcccaugccgcc

SEQ ID NO: 382726 - RNA, 20 nt, Bordetella pertussis
ggucaugcccuccucggcca

SEQ ID NO: 382727 - RNA, 20 nt, Bordetella pertussis
gguccagcaaaugggccgca

SEQ ID NO: 382728 - RNA, 14 nt, Bordetella pertussis
gguccagcaccagg

SEQ ID NO: 382729 - RNA, 22 nt, Bordetella pertussis
gguccagcaccagggcgcgcag

SEQ ID NO: 382730 - RNA, 21 nt, Bordetella pertussis
gguccagcaaggcgucgaagc

SEQ ID NO: 382731 - RNA, 21 nt, Bordetella pertussis
gguccagccccugcccgucua

SEQ ID NO: 382732 - RNA, 15 nt, Bordetella pertussis
gguccagcgccacgg

SEQ ID NO: 382733 - RNA, 15 nt, Bordetella pertussis
gguccagcugcgcgc

SEQ ID NO: 382734 - RNA, 17 nt, Bordetella pertussis
gguccagguggcccgca

SEQ ID NO: 382735 - RNA, 19 nt, Bordetella pertussis
gguccagguggcccgcacc

SEQ ID NO: 382736 - RNA, 23 nt, Bordetella pertussis
gguccaggcgguuggccuugacg

SEQ ID NO: 382737 - RNA, 22 nt, Bordetella pertussis
gguccaugaacgccgcgcccgc

SEQ ID NO: 382738 - RNA, 22 nt, Bordetella pertussis
gguccaugcgaaagcggccagc

SEQ ID NO: 382739 - RNA, 13 nt, Bordetella pertussis
ggucccaaccagg

SEQ ID NO: 382740 - RNA, 15 nt, Bordetella pertussis
gguccgcucgaggcc

SEQ ID NO: 382741 - RNA, 14 nt, Bordetella pertussis
gguccggcgugcca

SEQ ID NO: 382742 - RNA, 15 nt, Bordetella pertussis
gguccggggcgggcg

SEQ ID NO: 382743 - RNA, 16 nt, Bordetella pertussis
gguccggggcgggcgc

SEQ ID NO: 382744 - RNA, 19 nt, Bordetella pertussis
gguccggggcgggcgcggu

SEQ ID NO: 382745 - RNA, 14 nt, Bordetella pertussis
gguccggucgcgcg

SEQ ID NO: 382746 - RNA, 18 nt, Bordetella pertussis
gguccggucgcgcgugca

SEQ ID NO: 382747 - RNA, 17 nt, Bordetella pertussis
gguccgguucgcccacc

SEQ ID NO: 382748 - RNA, 17 nt, Bordetella pertussis
gguccuaaauugccgcg

SEQ ID NO: 382749 - RNA, 22 nt, Bordetella pertussis
ggucgacagguagcggucgccg

SEQ ID NO: 382750 - RNA, 20 nt, Bordetella pertussis
ggucgacauagacgcgcagc

SEQ ID NO: 382751 - RNA, 21 nt, Bordetella pertussis
ggucgacauagacgcgcagcg

SEQ ID NO: 382752 - RNA, 16 nt, Bordetella pertussis
ggucgaccagcagccg

SEQ ID NO: 382753 - RNA, 20 nt, Bordetella pertussis
ggucgacccacuugagcagc

SEQ ID NO: 382754 - RNA, 21 nt, Bordetella pertussis
ggucgaccugcuugcccagca

SEQ ID NO: 382755 - RNA, 12 nt, Bordetella pertussis
ggucgacgccgg

SEQ ID NO: 382756 - RNA, 15 nt, Bordetella pertussis
ggucgacgccggcga

SEQ ID NO: 382757 - RNA, 19 nt, Bordetella pertussis
ggucgacgaaauagccgac

SEQ ID NO: 382758 - RNA, 19 nt, Bordetella pertussis
ggucgagacgauggccgaa

SEQ ID NO: 382759 - RNA, 18 nt, Bordetella pertussis
ggucgagagccugggcgc

SEQ ID NO: 382760 - RNA, 20 nt, Bordetella pertussis
ggucgagagccugggcgcgc

SEQ ID NO: 382761 - RNA, 23 nt, Bordetella pertussis
ggucgagagccugggcgcgcgcc

SEQ ID NO: 382762 - RNA, 14 nt, Bordetella pertussis
ggucgagaccagca

SEQ ID NO: 382763 - RNA, 15 nt, Bordetella pertussis
ggucgagaccagcag

SEQ ID NO: 382764 - RNA, 19 nt, Bordetella pertussis
ggucgaucauggccagccg

SEQ ID NO: 382765 - RNA, 20 nt, Bordetella pertussis
ggucgaucauggccagccgc

SEQ ID NO: 382766 - RNA, 15 nt, Bordetella pertussis
ggucgaucgcaucgc

SEQ ID NO: 382767 - RNA, 18 nt, Bordetella pertussis
ggucgaucgcaucgcggc

SEQ ID NO: 382768 - RNA, 22 nt, Bordetella pertussis
ggucgaucgucuugaccagcag

SEQ ID NO: 382769 - RNA, 19 nt, Bordetella pertussis
ggucgaucuccacgaaggc

SEQ ID NO: 382770 - RNA, 22 nt, Bordetella pertussis
ggucgaugaacaagguacccgc

SEQ ID NO: 382771 - RNA, 22 nt, Bordetella pertussis
ggucgauggggucgggccgcgc

SEQ ID NO: 382772 - RNA, 18 nt, Bordetella pertussis
ggucgauguccagcgcca

SEQ ID NO: 382773 - RNA, 12 nt, Bordetella pertussis
ggucgcgcagcu

SEQ ID NO: 382774 - RNA, 14 nt, Bordetella pertussis
ggucgcgcgccugc

SEQ ID NO: 382775 - RNA, 15 nt, Bordetella pertussis
ggucgcgcuggcccg

SEQ ID NO: 382776 - RNA, 17 nt, Bordetella pertussis
ggucgcgcugggucagg

SEQ ID NO: 382777 - RNA, 22 nt, Bordetella pertussis
ggucgcggcacgaaaagccgcg

SEQ ID NO: 382778 - RNA, 14 nt, Bordetella pertussis
ggucggccagccgg

SEQ ID NO: 382779 - RNA, 13 nt, Bordetella pertussis
ggucggccagcgu

SEQ ID NO: 382780 - RNA, 14 nt, Bordetella pertussis
ggucggccgcgccg

SEQ ID NO: 382781 - RNA, 15 nt, Bordetella pertussis
ggucggccggcagcg

SEQ ID NO: 382782 - RNA, 21 nt, Bordetella pertussis
ggucggcggccagcgcgcaac

SEQ ID NO: 382783 - RNA, 16 nt, Bordetella pertussis
ggucgggccgcgcgcg

SEQ ID NO: 382784 - RNA, 17 nt, Bordetella pertussis
ggucguacagcgccugc

SEQ ID NO: 382785 - RNA, 22 nt, Bordetella pertussis
ggucguacagcgccugcgcggc

SEQ ID NO: 382786 - RNA, 23 nt, Bordetella pertussis
ggucguacagcgccugcgcggcg

SEQ ID NO: 382787 - RNA, 20 nt, Bordetella pertussis
ggucguagaccgccgcgccc

SEQ ID NO: 382788 - RNA, 21 nt, Bordetella pertussis
ggucguagaccgccgcgccca

SEQ ID NO: 382789 - RNA, 23 nt, Bordetella pertussis
ggucguaguauccgacgcguucg

SEQ ID NO: 382790 - RNA, 17 nt, Bordetella pertussis
ggucgucagcacgcccu

SEQ ID NO: 382791 - RNA, 14 nt, Bordetella pertussis
ggucgucagcgccg

SEQ ID NO: 382792 - RNA, 16 nt, Bordetella pertussis
ggucgucagcgccgcg

SEQ ID NO: 382793 - RNA, 14 nt, Bordetella pertussis
ggucucagaccauc

SEQ ID NO: 382794 - RNA, 18 nt, Bordetella pertussis
ggucuccagcgcgucggc

SEQ ID NO: 382795 - RNA, 19 nt, Bordetella pertussis
ggucucguagaccggcacc

SEQ ID NO: 382796 - RNA, 22 nt, Bordetella pertussis
ggucugccaguccauccagcgg

SEQ ID NO: 382797 - RNA, 13 nt, Bordetella pertussis
ggucugccgcuga

SEQ ID NO: 382798 - RNA, 20 nt, Bordetella pertussis
ggucugcgcgaugagcuggc

SEQ ID NO: 382799 - RNA, 18 nt, Bordetella pertussis
ggugaaacagcagcgggc

SEQ ID NO: 382800 - RNA, 20 nt, Bordetella pertussis
ggugaaacagcaucagcggc

SEQ ID NO: 382801 - RNA, 23 nt, Bordetella pertussis
ggugaaacagcaucagcggcagc

SEQ ID NO: 382802 - RNA, 17 nt, Bordetella pertussis
ggugaaagccgccggcg

SEQ ID NO: 382803 - RNA, 21 nt, Bordetella pertussis
ggugaaaucccccgccacggc

SEQ ID NO: 382804 - RNA, 19 nt, Bordetella pertussis
ggugaacaccaggguggcg

SEQ ID NO: 382805 - RNA, 19 nt, Bordetella pertussis
ggugaacgccaccaggccg

SEQ ID NO: 382806 - RNA, 18 nt, Bordetella pertussis
ggugaccacggcgcgccc

SEQ ID NO: 382807 - RNA, 13 nt, Bordetella pertussis
ggugaccaccagg

SEQ ID NO: 382808 - RNA, 14 nt, Bordetella pertussis
ggugaccgccagca

SEQ ID NO: 382809 - RNA, 13 nt, Bordetella pertussis
ggugagcaagcgc

SEQ ID NO: 382810 - RNA, 14 nt, Bordetella pertussis
ggugaggcgacggu

SEQ ID NO: 382811 - RNA, 22 nt, Bordetella pertussis
ggugaucgaguaggccggcacg

SEQ ID NO: 382812 - RNA, 14 nt, Bordetella pertussis
ggugaucguccuga

SEQ ID NO: 382813 - RNA, 17 nt, Bordetella pertussis
ggugaugauccugcugg

SEQ ID NO: 382814 - RNA, 22 nt, Bordetella pertussis
ggugaugauccugcugguggcg

SEQ ID NO: 382815 - RNA, 14 nt, Bordetella pertussis
ggugauuucggcgc

SEQ ID NO: 382816 - RNA, 19 nt, Bordetella pertussis
ggugauuucggcgcaucgg

SEQ ID NO: 382817 - RNA, 20 nt, Bordetella pertussis
ggugcaacuccacgcccugc

SEQ ID NO: 382818 - RNA, 18 nt, Bordetella pertussis
ggugcaauaacgccacuu

SEQ ID NO: 382819 - RNA, 17 nt, Bordetella pertussis
ggugcagguccggucgc

SEQ ID NO: 382820 - RNA, 16 nt, Bordetella pertussis
ggugcaucggccggcg

SEQ ID NO: 382821 - RNA, 19 nt, Bordetella pertussis
ggugccaguccccugcggg

SEQ ID NO: 382822 - RNA, 22 nt, Bordetella pertussis
ggugccccacgccgaugccgcg

SEQ ID NO: 382823 - RNA, 17 nt, Bordetella pertussis
ggugccccaugcgcggu

SEQ ID NO: 382824 - RNA, 21 nt, Bordetella pertussis
ggugcccgacgccgcgcgcga

SEQ ID NO: 382825 - RNA, 16 nt, Bordetella pertussis
ggugccgacggcgcgg

SEQ ID NO: 382826 - RNA, 23 nt, Bordetella pertussis
ggugccgagcagaugcgacuggc

SEQ ID NO: 382827 - RNA, 12 nt, Bordetella pertussis
ggugccgccgag

SEQ ID NO: 382828 - RNA, 15 nt, Bordetella pertussis
ggugccgccuggcca

SEQ ID NO: 382829 - RNA, 16 nt, Bordetella pertussis
ggugccgccuggccag

SEQ ID NO: 382830 - RNA, 17 nt, Bordetella pertussis
ggugccgccuggccaga

SEQ ID NO: 382831 - RNA, 16 nt, Bordetella pertussis
ggugccgccuucgccg

SEQ ID NO: 382832 - RNA, 15 nt, Bordetella pertussis
ggugccggaaaaugc

SEQ ID NO: 382833 - RNA, 19 nt, Bordetella pertussis
ggugccggaaaaugccgcg

SEQ ID NO: 382834 - RNA, 17 nt, Bordetella pertussis
ggugccggugaccgcau

SEQ ID NO: 382835 - RNA, 13 nt, Bordetella pertussis
ggugccgguugcg

SEQ ID NO: 382836 - RNA, 19 nt, Bordetella pertussis
ggugccguucccgccgggc

SEQ ID NO: 382837 - RNA, 16 nt, Bordetella pertussis
ggugccguucggccag

SEQ ID NO: 382838 - RNA, 21 nt, Bordetella pertussis
ggugccugucccaaccgggac

SEQ ID NO: 382839 - RNA, 18 nt, Bordetella pertussis
ggugccuguccccaccgg

SEQ ID NO: 382840 - RNA, 21 nt, Bordetella pertussis
ggugccuguccccaccgggac

SEQ ID NO: 382841 - RNA, 21 nt, Bordetella pertussis
ggugccuguccccgcagggac

SEQ ID NO: 382842 - RNA, 15 nt, Bordetella pertussis
ggugccugucccugc

SEQ ID NO: 382843 - RNA, 21 nt, Bordetella pertussis
ggugccugucccugccgggac

SEQ ID NO: 382844 - RNA, 21 nt, Bordetella pertussis
ggugccugucccugcgggggc

SEQ ID NO: 382845 - RNA, 13 nt, Bordetella pertussis
ggugccuggcucc

SEQ ID NO: 382846 - RNA, 21 nt, Bordetella pertussis
ggugccuggcuccccgggcac

SEQ ID NO: 382847 - RNA, 17 nt, Bordetella pertussis
ggugccuugcggcgccg

SEQ ID NO: 382848 - RNA, 19 nt, Bordetella pertussis
ggugccuugcggcgccguu

SEQ ID NO: 382849 - RNA, 20 nt, Bordetella pertussis
ggugcgacugcaggaugagg

SEQ ID NO: 382850 - RNA, 17 nt, Bordetella pertussis
ggugcgcacaucgcccg

SEQ ID NO: 382851 - RNA, 15 nt, Bordetella pertussis
ggugcgcacgauggg

SEQ ID NO: 382852 - RNA, 13 nt, Bordetella pertussis
ggugcgcaggggc

SEQ ID NO: 382853 - RNA, 18 nt, Bordetella pertussis
ggugcgccaaucggcguu

SEQ ID NO: 382854 - RNA, 20 nt, Bordetella pertussis
ggugcgccaaucggcguuga

SEQ ID NO: 382855 - RNA, 16 nt, Bordetella pertussis
ggugcgccagcacggc

SEQ ID NO: 382856 - RNA, 17 nt, Bordetella pertussis
ggugcgccgcaugcggc

SEQ ID NO: 382857 - RNA, 15 nt, Bordetella pertussis
ggugcgccgccggcc

SEQ ID NO: 382858 - RNA, 19 nt, Bordetella pertussis
ggugcgccgccggccugcu

SEQ ID NO: 382859 - RNA, 15 nt, Bordetella pertussis
ggugcgccucgaaga

SEQ ID NO: 382860 - RNA, 22 nt, Bordetella pertussis
ggugcgcgcagggcggccggca

SEQ ID NO: 382861 - RNA, 13 nt, Bordetella pertussis
ggugcgcgcgccc

SEQ ID NO: 382862 - RNA, 16 nt, Bordetella pertussis
ggugcgcgcggccgag

SEQ ID NO: 382863 - RNA, 23 nt, Bordetella pertussis
ggugcgcgcggccgaggucggcg

SEQ ID NO: 382864 - RNA, 14 nt, Bordetella pertussis
ggugcgcgccacgg

SEQ ID NO: 382865 - RNA, 13 nt, Bordetella pertussis
ggugcgcgccagg

SEQ ID NO: 382866 - RNA, 16 nt, Bordetella pertussis
ggugcgcucgaagcgc

SEQ ID NO: 382867 - RNA, 14 nt, Bordetella pertussis
ggugcggaggcggc

SEQ ID NO: 382868 - RNA, 22 nt, Bordetella pertussis
ggugcggaggcggccgcgggcg

SEQ ID NO: 382869 - RNA, 23 nt, Bordetella pertussis
ggugcggcgccacugccaggcgc

SEQ ID NO: 382870 - RNA, 14 nt, Bordetella pertussis
ggugcgggccgcgc

SEQ ID NO: 382871 - RNA, 15 nt, Bordetella pertussis
ggugcgggugggcgc

SEQ ID NO: 382872 - RNA, 21 nt, Bordetella pertussis
ggugcgggugggcgcgccgcg

SEQ ID NO: 382873 - RNA, 13 nt, Bordetella pertussis
gguggacagcgcc

SEQ ID NO: 382874 - RNA, 19 nt, Bordetella pertussis
gguggacagcgccagcccg

SEQ ID NO: 382875 - RNA, 21 nt, Bordetella pertussis
gguggaccugccguucgcgcu

SEQ ID NO: 382876 - RNA, 13 nt, Bordetella pertussis
gguggacacgccc

SEQ ID NO: 382877 - RNA, 14 nt, Bordetella pertussis
gguggacacgccca

SEQ ID NO: 382878 - RNA, 14 nt, Bordetella pertussis
gguggccaccagcc

SEQ ID NO: 382879 - RNA, 17 nt, Bordetella pertussis
gguggccauggacagca

SEQ ID NO: 382880 - RNA, 14 nt, Bordetella pertussis
gguggccagcgccu

SEQ ID NO: 382881 - RNA, 17 nt, Bordetella pertussis
gguggccgccgcgcgcc

SEQ ID NO: 382882 - RNA, 13 nt, Bordetella pertussis
gguggccggcgcg

SEQ ID NO: 382883 - RNA, 16 nt, Bordetella pertussis
gguggccggcgcgcgg

SEQ ID NO: 382884 - RNA, 17 nt, Bordetella pertussis
gguggccggcgcgcggc

SEQ ID NO: 382885 - RNA, 22 nt, Bordetella pertussis
gguggccucguccacgucgucg

SEQ ID NO: 382886 - RNA, 13 nt, Bordetella pertussis
gguggggcagcag

SEQ ID NO: 382887 - RNA, 15 nt, Bordetella pertussis
gguggggcuggccgc

SEQ ID NO: 382888 - RNA, 14 nt, Bordetella pertussis
ggugggucucggcg

SEQ ID NO: 382889 - RNA, 15 nt, Bordetella pertussis
gguggguucgggcgu

SEQ ID NO: 382890 - RNA, 20 nt, Bordetella pertussis
gguggguuggccuugcgcgu

SEQ ID NO: 382891 - RNA, 22 nt, Bordetella pertussis
ggugguagaccgggucgggcgu

SEQ ID NO: 382892 - RNA, 13 nt, Bordetella pertussis
gguggugucggcg

SEQ ID NO: 382893 - RNA, 17 nt, Bordetella pertussis
gguguacagccgccugg

SEQ ID NO: 382894 - RNA, 20 nt, Bordetella pertussis
gguguaccgggccgacgcgc

SEQ ID NO: 382895 - RNA, 15 nt, Bordetella pertussis
gguguugaccacgcc

SEQ ID NO: 382896 - RNA, 16 nt, Bordetella pertussis
gguucaggguggccgc

SEQ ID NO: 382897 - RNA, 22 nt, Bordetella pertussis
gguucgcagggcgcaacgccgg

SEQ ID NO: 382898 - RNA, 13 nt, Bordetella pertussis
gguucggcgcggc

SEQ ID NO: 382899 - RNA, 14 nt, Bordetella pertussis
gguucggcgcggcg

SEQ ID NO: 382900 - RNA, 22 nt, Bordetella pertussis
gguucggcgguuccagccuggc

SEQ ID NO: 382901 - RNA, 18 nt, Bordetella pertussis
gguucggucgacgacggc

SEQ ID NO: 382902 - RNA, 18 nt, Bordetella pertussis
gguucguccucgucggcc

SEQ ID NO: 382903 - RNA, 16 nt, Bordetella pertussis
gguucuguccggcgcu

SEQ ID NO: 382904 - RNA, 15 nt, Bordetella pertussis
gguugaagccgacgg

SEQ ID NO: 382905 - RNA, 19 nt, Bordetella pertussis
gguugaucagggccgccag

SEQ ID NO: 382906 - RNA, 16 nt, Bordetella pertussis
gguugcagcgcgccag

SEQ ID NO: 382907 - RNA, 18 nt, Bordetella pertussis
gguugcaggaugcgcggc

SEQ ID NO: 382908 - RNA, 14 nt, Bordetella pertussis
gguugcaggccagg

SEQ ID NO: 382909 - RNA, 16 nt, Bordetella pertussis
gguugcaggccaggcu

SEQ ID NO: 382910 - RNA, 17 nt, Bordetella pertussis
gguugcccugcgcaucg

SEQ ID NO: 382911 - RNA, 18 nt, Bordetella pertussis
gguugccgcugcaugggc

SEQ ID NO: 382912 - RNA, 14 nt, Bordetella pertussis
gguugcgaggcggc

SEQ ID NO: 382913 - RNA, 21 nt, Bordetella pertussis
gguugcgccagcuugcgcgcc

SEQ ID NO: 382914 - RNA, 13 nt, Bordetella pertussis
gguugcgcgccag

SEQ ID NO: 382915 - RNA, 21 nt, Bordetella pertussis
gguugcgguaguucagcagcg

SEQ ID NO: 382916 - RNA, 16 nt, Bordetella pertussis
gguuucuugcugcugu

SEQ ID NO: 382917 - RNA, 20 nt, Bordetella pertussis
guaaacaucgcgcauggcga

SEQ ID NO: 382918 - RNA, 20 nt, Bordetella pertussis
guaagcguccgcgcgccgcu

SEQ ID NO: 382919 - RNA, 18 nt, Bordetella pertussis
guaaggcgcuugcgcagg

SEQ ID NO: 382920 - RNA, 14 nt, Bordetella pertussis
guaaguggcggcgg

SEQ ID NO: 382921 - RNA, 15 nt, Bordetella pertussis
guaaucgcccggcgc

SEQ ID NO: 382922 - RNA, 18 nt, Bordetella pertussis
guacgcgugggcggcggc

SEQ ID NO: 382923 - RNA, 20 nt, Bordetella pertussis
guacggcgaugccggcgcug

SEQ ID NO: 382924 - RNA, 12 nt, Bordetella pertussis
guacucggccag

SEQ ID NO: 382925 - RNA, 22 nt, Bordetella pertussis
guacugccauggccccgggcgg

SEQ ID NO: 382926 - RNA, 16 nt, Bordetella pertussis
guacuggcgcggcggc

SEQ ID NO: 382927 - RNA, 20 nt, Bordetella pertussis
guacugguaccaggcggcga

SEQ ID NO: 382928 - RNA, 22 nt, Bordetella pertussis
guacugguaccaggcggcgacg

SEQ ID NO: 382929 - RNA, 23 nt, Bordetella pertussis
guacugguaccaggcggcgacga

SEQ ID NO: 382930 - RNA, 16 nt, Bordetella pertussis
guacuggucgcgcagc

SEQ ID NO: 382931 - RNA, 17 nt, Bordetella pertussis
guacuggugggccgacg

SEQ ID NO: 382932 - RNA, 15 nt, Bordetella pertussis
guagaccacgcgcug

SEQ ID NO: 382933 - RNA, 18 nt, Bordetella pertussis
guagaccugcgggccgca

SEQ ID NO: 382934 - RNA, 17 nt, Bordetella pertussis
guagacgcagccgcagu

SEQ ID NO: 382935 - RNA, 14 nt, Bordetella pertussis
guagagcaggccgc

SEQ ID NO: 382936 - RNA, 19 nt, Bordetella pertussis
guagagcaggccgcccagc

SEQ ID NO: 382937 - RNA, 16 nt, Bordetella pertussis
guagagcgccgcgugg

SEQ ID NO: 382938 - RNA, 22 nt, Bordetella pertussis
guagaguacugcguucgggacg

SEQ ID NO: 382939 - RNA, 18 nt, Bordetella pertussis
guagauccaggcggccac

SEQ ID NO: 382940 - RNA, 15 nt, Bordetella pertussis
guagaugcgggucgg

SEQ ID NO: 382941 - RNA, 20 nt, Bordetella pertussis
guagaugcgggucggcgcca

SEQ ID NO: 382942 - RNA, 16 nt, Bordetella pertussis
guagaugggcaggccc

SEQ ID NO: 382943 - RNA, 20 nt, Bordetella pertussis
guagccgaauccggccagca

SEQ ID NO: 382944 - RNA, 19 nt, Bordetella pertussis
guagccgaucuggcccuug

SEQ ID NO: 382945 - RNA, 15 nt, Bordetella pertussis
guagccgcugcgcgc

SEQ ID NO: 382946 - RNA, 17 nt, Bordetella pertussis
guagccgcugcgcgcgg

SEQ ID NO: 382947 - RNA, 23 nt, Bordetella pertussis
guagccgcugcgcgcggccuggc

SEQ ID NO: 382948 - RNA, 23 nt, Bordetella pertussis
guagccggaaugcaccacggcca

SEQ ID NO: 382949 - RNA, 16 nt, Bordetella pertussis
guagcggucgccgcgg

SEQ ID NO: 382950 - RNA, 18 nt, Bordetella pertussis
guagcggucgccgcgguc

SEQ ID NO: 382951 - RNA, 18 nt, Bordetella pertussis
guagcguuggcggccggc

SEQ ID NO: 382952 - RNA, 19 nt, Bordetella pertussis
guagcguuggcggccggcc

SEQ ID NO: 382953 - RNA, 21 nt, Bordetella pertussis
guagcucgaccaucauggcca

SEQ ID NO: 382954 - RNA, 17 nt, Bordetella pertussis
guaggcaaagcgcagca

SEQ ID NO: 382955 - RNA, 21 nt, Bordetella pertussis
guaggccacgcgcgggcuggg

SEQ ID NO: 382956 - RNA, 23 nt, Bordetella pertussis
guaggccggcacguccggcacgg

SEQ ID NO: 382957 - RNA, 19 nt, Bordetella pertussis
guaggccucgcgcucgaac

SEQ ID NO: 382958 - RNA, 12 nt, Bordetella pertussis
guaggcgccgcg

SEQ ID NO: 382959 - RNA, 12 nt, Bordetella pertussis
guaggcgccggc

SEQ ID NO: 382960 - RNA, 23 nt, Bordetella pertussis
guaggcgccggccuugccguagg

SEQ ID NO: 382961 - RNA, 15 nt, Bordetella pertussis
guaggcgccggcgcc

SEQ ID NO: 382962 - RNA, 13 nt, Bordetella pertussis
guaggcgccgguc

SEQ ID NO: 382963 - RNA, 21 nt, Bordetella pertussis
guaggcgccgguccagcgccc

SEQ ID NO: 382964 - RNA, 19 nt, Bordetella pertussis
guaggcgcgcgcaucggcc

SEQ ID NO: 382965 - RNA, 22 nt, Bordetella pertussis
guaggcgcgcgcaucggccgga

SEQ ID NO: 382966 - RNA, 16 nt, Bordetella pertussis
guaggcggccaggccg

SEQ ID NO: 382967 - RNA, 16 nt, Bordetella pertussis
guaggcggcccaggcg

SEQ ID NO: 382968 - RNA, 21 nt, Bordetella pertussis
guaggcgggcagcggcgacgg

SEQ ID NO: 382969 - RNA, 16 nt, Bordetella pertussis
guaggcggucagcugg

SEQ ID NO: 382970 - RNA, 21 nt, Bordetella pertussis
guagggaaucgucaugaacgu

SEQ ID NO: 382971 - RNA, 13 nt, Bordetella pertussis
guagggcagcagg

SEQ ID NO: 382972 - RNA, 14 nt, Bordetella pertussis
guagggcgcggcca

SEQ ID NO: 382973 - RNA, 14 nt, Bordetella pertussis
guagguagcgcgca

SEQ ID NO: 382974 - RNA, 14 nt, Bordetella pertussis
guaggucaggccca

SEQ ID NO: 382975 - RNA, 19 nt, Bordetella pertussis
guaggucaggcccacgccg

SEQ ID NO: 382976 - RNA, 15 nt, Bordetella pertussis
guaggugcgcgccac

SEQ ID NO: 382977 - RNA, 19 nt, Bordetella pertussis
guaucgcggccgagcuccu

SEQ ID NO: 382978 - RNA, 14 nt, Bordetella pertussis
guaucgcggcgcag

SEQ ID NO: 382979 - RNA, 13 nt, Bordetella pertussis
guaucggccagca

SEQ ID NO: 382980 - RNA, 12 nt, Bordetella pertussis
guaucggcgcga

SEQ ID NO: 382981 - RNA, 18 nt, Bordetella pertussis
guaucgggcaacaaggcc

SEQ ID NO: 382982 - RNA, 17 nt, Bordetella pertussis
guaucguucgcgcgcgc

SEQ ID NO: 382983 - RNA, 16 nt, Bordetella pertussis
guaucguugucgcgcc

SEQ ID NO: 382984 - RNA, 17 nt, Bordetella pertussis
guaucugucccggcggg

SEQ ID NO: 382985 - RNA, 18 nt, Bordetella pertussis
guauucagugcgacggau

SEQ ID NO: 382986 - RNA, 21 nt, Bordetella pertussis
guauuccaucuugccggccug

SEQ ID NO: 382987 - RNA, 14 nt, Bordetella pertussis
guauucgcgcggcg

SEQ ID NO: 382988 - RNA, 13 nt, Bordetella pertussis
guauugcaugacc

SEQ ID NO: 382989 - RNA, 14 nt, Bordetella pertussis
guauugcggggcgg

SEQ ID NO: 382990 - RNA, 15 nt, Bordetella pertussis
guauugcuccacagg

SEQ ID NO: 382991 - RNA, 13 nt, Bordetella pertussis
gucaacgcccagg

SEQ ID NO: 382992 - RNA, 15 nt, Bordetella pertussis
gucaagcagcgccgg

SEQ ID NO: 382993 - RNA, 14 nt, Bordetella pertussis
gucaagggcggcca

SEQ ID NO: 382994 - RNA, 16 nt, Bordetella pertussis
gucaagggcggccaug

SEQ ID NO: 382995 - RNA, 18 nt, Bordetella pertussis
gucaaguccggcgccgcc

SEQ ID NO: 382996 - RNA, 18 nt, Bordetella pertussis
gucaagcguucauggcgc

SEQ ID NO: 382997 - RNA, 18 nt, Bordetella pertussis
gucacaaagacggcuuga

SEQ ID NO: 382998 - RNA, 18 nt, Bordetella pertussis
gucaccccgcccugcccg

SEQ ID NO: 382999 - RNA, 20 nt, Bordetella pertussis
gucacugccgaaacgcuggc

SEQ ID NO: 383000 - RNA, 16 nt, Bordetella pertussis
gucagaacgacgaucu

SEQ ID NO: 383001 - RNA, 22 nt, Bordetella pertussis
gucagcacgcccuggcugagcg

SEQ ID NO: 383002 - RNA, 15 nt, Bordetella pertussis
gucagcacggucggc

SEQ ID NO: 383003 - RNA, 18 nt, Bordetella pertussis
gucagcacggucggcgcg

SEQ ID NO: 383004 - RNA, 18 nt, Bordetella pertussis
gucagcagcgcggcgccg

SEQ ID NO: 383005 - RNA, 14 nt, Bordetella pertussis
gucagcagggcgcc

SEQ ID NO: 383006 - RNA, 19 nt, Bordetella pertussis
gucagcaucagcagacccu

SEQ ID NO: 383007 - RNA, 19 nt, Bordetella pertussis
gucagcaugaagcgguggc

SEQ ID NO: 383008 - RNA, 19 nt, Bordetella pertussis
gucagcaugaagcugccca

SEQ ID NO: 383009 - RNA, 22 nt, Bordetella pertussis
gucagcaugaagcugcccagca

SEQ ID NO: 383010 - RNA, 23 nt, Bordetella pertussis
gucagcaugaagcugcccagcaa

SEQ ID NO: 383011 - RNA, 17 nt, Bordetella pertussis
gucagcaugucgacguu

SEQ ID NO: 383012 - RNA, 15 nt, Bordetella pertussis
gucagcccgccaucg

SEQ ID NO: 383013 - RNA, 16 nt, Bordetella pertussis
gucagcccggcggcca

SEQ ID NO: 383014 - RNA, 20 nt, Bordetella pertussis
gucagccugccggcgcgccc

SEQ ID NO: 383015 - RNA, 15 nt, Bordetella pertussis
gucagccugggcgcc

SEQ ID NO: 383016 - RNA, 16 nt, Bordetella pertussis
gucagcgaaaugccga

SEQ ID NO: 383017 - RNA, 19 nt, Bordetella pertussis
gucagcgaaaugccgaagc

SEQ ID NO: 383018 - RNA, 21 nt, Bordetella pertussis
gucagccguucauggcguaga

SEQ ID NO: 383019 - RNA, 23 nt, Bordetella pertussis
gucagccugauucccaggcccgg

SEQ ID NO: 383020 - RNA, 12 nt, Bordetella pertussis
gucagcgccgac

SEQ ID NO: 383021 - RNA, 14 nt, Bordetella pertussis
gucagcgccgacga

SEQ ID NO: 383022 - RNA, 21 nt, Bordetella pertussis
gucagcgccgacgauaucgcg

SEQ ID NO: 383023 - RNA, 17 nt, Bordetella pertussis
gucagcgccgcgaugcg

SEQ ID NO: 383024 - RNA, 14 nt, Bordetella pertussis
gucagcgccggcac

SEQ ID NO: 383025 - RNA, 14 nt, Bordetella pertussis
gucagcgcggcgca

SEQ ID NO: 383026 - RNA, 15 nt, Bordetella pertussis
gucagcgcggcgcac

SEQ ID NO: 383027 - RNA, 15 nt, Bordetella pertussis
gucagcgcggcgccg

SEQ ID NO: 383028 - RNA, 16 nt, Bordetella pertussis
gucagcggccggcccg

SEQ ID NO: 383029 - RNA, 22 nt, Bordetella pertussis
gucagcggccggcccgugcgca

SEQ ID NO: 383030 - RNA, 23 nt, Bordetella pertussis
gucagcggccggcccgugcgcaa

SEQ ID NO: 383031 - RNA, 21 nt, Bordetella pertussis
gucagcggcgcgcccaccagg

SEQ ID NO: 383032 - RNA, 17 nt, Bordetella pertussis
gucagcgugucgccgac

SEQ ID NO: 383033 - RNA, 19 nt, Bordetella pertussis
gucagcucgaucaggcgcu

SEQ ID NO: 383034 - RNA, 18 nt, Bordetella pertussis
gucagcucgucgccgcug

SEQ ID NO: 383035 - RNA, 19 nt, Bordetella pertussis
gucagcugugguaggccga

SEQ ID NO: 383036 - RNA, 19 nt, Bordetella pertussis
gucagcuugccgcccaggu

SEQ ID NO: 383037 - RNA, 22 nt, Bordetella pertussis
gucaggaugcccuggguggcgg

SEQ ID NO: 383038 - RNA, 13 nt, Bordetella pertussis
gucaggaugcgcg

SEQ ID NO: 383039 - RNA, 17 nt, Bordetella pertussis
gucaggcaggcgcgccg

SEQ ID NO: 383040 - RNA, 19 nt, Bordetella pertussis
gucaggcaggcgcgccggg

SEQ ID NO: 383041 - RNA, 18 nt, Bordetella pertussis
gucaggcccacgccgccg

SEQ ID NO: 383042 - RNA, 16 nt, Bordetella pertussis
gucaggcguggcgaca

SEQ ID NO: 383043 - RNA, 18 nt, Bordetella pertussis
gucaggcguugcgccgca

SEQ ID NO: 383044 - RNA, 16 nt, Bordetella pertussis
gucagggccgcccagu

SEQ ID NO: 383045 - RNA, 16 nt, Bordetella pertussis
gucaggggcaggcgca

SEQ ID NO: 383046 - RNA, 17 nt, Bordetella pertussis
gucaggggcaggcgcac

SEQ ID NO: 383047 - RNA, 16 nt, Bordetella pertussis
gucaggguacgcucga

SEQ ID NO: 383048 - RNA, 23 nt, Bordetella pertussis
gucagguuagccagugccucagg

SEQ ID NO: 383049 - RNA, 17 nt, Bordetella pertussis
gucaguccguggcgcgg

SEQ ID NO: 383050 - RNA, 20 nt, Bordetella pertussis
gucaguccguggcgcggcca

SEQ ID NO: 383051 - RNA, 23 nt, Bordetella pertussis
gucaguccgcccagccaggcgcc

SEQ ID NO: 383052 - RNA, 17 nt, Bordetella pertussis
gucagucgggacggcgc

SEQ ID NO: 383053 - RNA, 19 nt, Bordetella pertussis
gucagucgggacggcgcgg

SEQ ID NO: 383054 - RNA, 14 nt, Bordetella pertussis
gucauacgccauga

SEQ ID NO: 383055 - RNA, 20 nt, Bordetella pertussis
gucauaggcuucgcccgcca

SEQ ID NO: 383056 - RNA, 19 nt, Bordetella pertussis
gucaucaccaggguggcgg

SEQ ID NO: 383057 - RNA, 21 nt, Bordetella pertussis
gucaucaccaggguggcgggc

SEQ ID NO: 383058 - RNA, 12 nt, Bordetella pertussis
gucaucacgcgg

SEQ ID NO: 383059 - RNA, 12 nt, Bordetella pertussis
gucauccacagg

SEQ ID NO: 383060 - RNA, 16 nt, Bordetella pertussis
gucaucgagguggcgg

SEQ ID NO: 383061 - RNA, 18 nt, Bordetella pertussis
gucaucgagguggcgggc

SEQ ID NO: 383062 - RNA, 14 nt, Bordetella pertussis
gucaucgaugcgcc

SEQ ID NO: 383063 - RNA, 14 nt, Bordetella pertussis
gucaucgccgcggc

SEQ ID NO: 383064 - RNA, 17 nt, Bordetella pertussis
gucaucgccgcggcggg

SEQ ID NO: 383065 - RNA, 14 nt, Bordetella pertussis
gucaucgcgcuggc

SEQ ID NO: 383066 - RNA, 15 nt, Bordetella pertussis
gucaucgcgcuggcg

SEQ ID NO: 383067 - RNA, 15 nt, Bordetella pertussis
gucaucuacagcgcc

SEQ ID NO: 383068 - RNA, 19 nt, Bordetella pertussis
gucaucuacagcgccuggc

SEQ ID NO: 383069 - RNA, 17 nt, Bordetella pertussis
gucaugacgggcggcgg

SEQ ID NO: 383070 - RNA, 19 nt, Bordetella pertussis
gucaugaggccccuguccu

SEQ ID NO: 383071 - RNA, 16 nt, Bordetella pertussis
gucaugcaccugcagg

SEQ ID NO: 383072 - RNA, 22 nt, Bordetella pertussis
gucaugcagaacagggugccgc

SEQ ID NO: 383073 - RNA, 16 nt, Bordetella pertussis
gucaugcccaugccgc

SEQ ID NO: 383074 - RNA, 18 nt, Bordetella pertussis
gucaugcccaugccgcca

SEQ ID NO: 383075 - RNA, 22 nt, Bordetella pertussis
gucaugcccaugccgccaugca

SEQ ID NO: 383076 - RNA, 13 nt, Bordetella pertussis
gucaugccgaaca

SEQ ID NO: 383077 - RNA, 15 nt, Bordetella pertussis
gucaugccgaacagc

SEQ ID NO: 383078 - RNA, 16 nt, Bordetella pertussis
gucaugcugucgcuca

SEQ ID NO: 383079 - RNA, 22 nt, Bordetella pertussis
gucauggcgccgugaaugcgcc

SEQ ID NO: 383080 - RNA, 19 nt, Bordetella pertussis
gucauggcggcaggcgcga

SEQ ID NO: 383081 - RNA, 15 nt, Bordetella pertussis
gucauggcgugcgcg

SEQ ID NO: 383082 - RNA, 14 nt, Bordetella pertussis
gucauggucgacca

SEQ ID NO: 383083 - RNA, 17 nt, Bordetella pertussis
gucauggucgaccagca

SEQ ID NO: 383084 - RNA, 19 nt, Bordetella pertussis
gucauggucgaccagcagc

SEQ ID NO: 383085 - RNA, 22 nt, Bordetella pertussis
gucauggucgaccagcagccgg

SEQ ID NO: 383086 - RNA, 14 nt, Bordetella pertussis
gucauguccagcgc

SEQ ID NO: 383087 - RNA, 15 nt, Bordetella pertussis
gucauguagcggccg

SEQ ID NO: 383088 - RNA, 18 nt, Bordetella pertussis
gucauguagcggccgccc

SEQ ID NO: 383089 - RNA, 22 nt, Bordetella pertussis
gucaugugcugcggcagccagg

SEQ ID NO: 383090 - RNA, 19 nt, Bordetella pertussis
guccaagcagacccgcgcc

SEQ ID NO: 383091 - RNA, 15 nt, Bordetella pertussis
guccaaugccagggu

SEQ ID NO: 383092 - RNA, 15 nt, Bordetella pertussis
guccaccaccaggcc

SEQ ID NO: 383093 - RNA, 18 nt, Bordetella pertussis
guccaccaccaggccggc

SEQ ID NO: 383094 - RNA, 21 nt, Bordetella pertussis
guccaccaccaggccggccag

SEQ ID NO: 383095 - RNA, 22 nt, Bordetella pertussis
guccaccaccaggccggccagg

SEQ ID NO: 383096 - RNA, 15 nt, Bordetella pertussis
guccaccacccaggc

SEQ ID NO: 383097 - RNA, 16 nt, Bordetella pertussis
guccacauccgcgcug

SEQ ID NO: 383098 - RNA, 23 nt, Bordetella pertussis
guccacauccgcgcugcugccgu

SEQ ID NO: 383099 - RNA, 21 nt, Bordetella pertussis
guccaccaccuucagggcgcc

SEQ ID NO: 383100 - RNA, 22 nt, Bordetella pertussis
guccaccaccuucagggcgccg

SEQ ID NO: 383101 - RNA, 14 nt, Bordetella pertussis
guccaccagccggc

SEQ ID NO: 383102 - RNA, 16 nt, Bordetella pertussis
guccaccagccggccg

SEQ ID NO: 383103 - RNA, 17 nt, Bordetella pertussis
guccaccagccggccgc

SEQ ID NO: 383104 - RNA, 19 nt, Bordetella pertussis
guccaccagccggccgccg

SEQ ID NO: 383105 - RNA, 20 nt, Bordetella pertussis
guccacccccgucagcacgg

SEQ ID NO: 383106 - RNA, 16 nt, Bordetella pertussis
guccaccuugacgcgc

SEQ ID NO: 383107 - RNA, 13 nt, Bordetella pertussis
guccacgaaggca

SEQ ID NO: 383108 - RNA, 14 nt, Bordetella pertussis
guccacgaaggcgc

SEQ ID NO: 383109 - RNA, 17 nt, Bordetella pertussis
guccacgaaggcgccga

SEQ ID NO: 383110 - RNA, 19 nt, Bordetella pertussis
guccacgaaggcgccgaaa

SEQ ID NO: 383111 - RNA, 23 nt, Bordetella pertussis
guccacgauauugguguugccgg

SEQ ID NO: 383112 - RNA, 21 nt, Bordetella pertussis
guccacgaugucguccagcuc

SEQ ID NO: 383113 - RNA, 22 nt, Bordetella pertussis
guccacgcagaaauggaugcgc

SEQ ID NO: 383114 - RNA, 23 nt, Bordetella pertussis
guccacgcagaaauggaugcgcg

SEQ ID NO: 383115 - RNA, 18 nt, Bordetella pertussis
guccacgcccagcgccgg

SEQ ID NO: 383116 - RNA, 19 nt, Bordetella pertussis
guccacgcccagcgccggc

SEQ ID NO: 383117 - RNA, 22 nt, Bordetella pertussis
guccacgcccagcgccggcacg

SEQ ID NO: 383118 - RNA, 14 nt, Bordetella pertussis
guccacgccgaagu

SEQ ID NO: 383119 - RNA, 16 nt, Bordetella pertussis
guccacgccgcgcgcg

SEQ ID NO: 383120 - RNA, 13 nt, Bordetella pertussis
guccacgccgggu

SEQ ID NO: 383121 - RNA, 23 nt, Bordetella pertussis
guccacgccggguugcggcggac

SEQ ID NO: 383122 - RNA, 18 nt, Bordetella pertussis
guccacggcaucggccag

SEQ ID NO: 383123 - RNA, 13 nt, Bordetella pertussis
guccacggccugc

SEQ ID NO: 383124 - RNA, 16 nt, Bordetella pertussis
guccacggccugcgcg

SEQ ID NO: 383125 - RNA, 20 nt, Bordetella pertussis
guccacggccugcgcgccga

SEQ ID NO: 383126 - RNA, 13 nt, Bordetella pertussis
guccacggcggcg

SEQ ID NO: 383127 - RNA, 14 nt, Bordetella pertussis
guccacggcggcgg

SEQ ID NO: 383128 - RNA, 14 nt, Bordetella pertussis
guccacgcgggugg

SEQ ID NO: 383129 - RNA, 17 nt, Bordetella pertussis
guccacggucgccggca

SEQ ID NO: 383130 - RNA, 16 nt, Bordetella pertussis
guccacgucgucgaug

SEQ ID NO: 383131 - RNA, 22 nt, Bordetella pertussis
guccacguggcgacgucgggca

SEQ ID NO: 383132 - RNA, 16 nt, Bordetella pertussis
guccagacgggcugga

SEQ ID NO: 383133 - RNA, 23 nt, Bordetella pertussis
guccagcaccagggcgcgcagca

SEQ ID NO: 383134 - RNA, 23 nt, Bordetella pertussis
guccagcacgccuugcucgacca

SEQ ID NO: 383135 - RNA, 19 nt, Bordetella pertussis
guccagcacgcggcgcagc

SEQ ID NO: 383136 - RNA, 20 nt, Bordetella pertussis
guccagcacgcggcgcagca

SEQ ID NO: 383137 - RNA, 15 nt, Bordetella pertussis
guccagcacggccgc

SEQ ID NO: 383138 - RNA, 17 nt, Bordetella pertussis
guccagcacggccgcgg

SEQ ID NO: 383139 - RNA, 23 nt, Bordetella pertussis
guccagcacggcgaggaugccgc

SEQ ID NO: 383140 - RNA, 14 nt, Bordetella pertussis
guccagcaccggcu

SEQ ID NO: 383141 - RNA, 17 nt, Bordetella pertussis
guccagcagcagcgccg

SEQ ID NO: 383142 - RNA, 14 nt, Bordetella pertussis
guccagcagcagcg

SEQ ID NO: 383143 - RNA, 18 nt, Bordetella pertussis
guccagccccacgccgac

SEQ ID NO: 383144 - RNA, 16 nt, Bordetella pertussis
guccagccugcccggg

SEQ ID NO: 383145 - RNA, 13 nt, Bordetella pertussis
guccagcgccacc

SEQ ID NO: 383146 - RNA, 19 nt, Bordetella pertussis
guccagcgccaccagcagc

SEQ ID NO: 383147 - RNA, 23 nt, Bordetella pertussis
guccagcgccaccagcagcgcca

SEQ ID NO: 383148 - RNA, 20 nt, Bordetella pertussis
guccagcgccacggcgguga

SEQ ID NO: 383149 - RNA, 15 nt, Bordetella pertussis
guccagcgccagcag

SEQ ID NO: 383150 - RNA, 17 nt, Bordetella pertussis
guccagcgccagcaggg

SEQ ID NO: 383151 - RNA, 13 nt, Bordetella pertussis
guccagcgccagg

SEQ ID NO: 383152 - RNA, 15 nt, Bordetella pertussis
guccagcgccaggcc

SEQ ID NO: 383153 - RNA, 16 nt, Bordetella pertussis
guccagcgccaggccg

SEQ ID NO: 383154 - RNA, 17 nt, Bordetella pertussis
guccagcgccaggccgc

SEQ ID NO: 383155 - RNA, 19 nt, Bordetella pertussis
guccagcgccaggccgcgc

SEQ ID NO: 383156 - RNA, 13 nt, Bordetella pertussis
guccagcgcgccc

SEQ ID NO: 383157 - RNA, 18 nt, Bordetella pertussis
guccagcgcgcggccucg

SEQ ID NO: 383158 - RNA, 13 nt, Bordetella pertussis
guccagcgcggca

SEQ ID NO: 383159 - RNA, 16 nt, Bordetella pertussis
guccagcgcggcgcca

SEQ ID NO: 383160 - RNA, 14 nt, Bordetella pertussis
guccagcggcagcg

SEQ ID NO: 383161 - RNA, 16 nt, Bordetella pertussis
guccagcggcgccagc

SEQ ID NO: 383162 - RNA, 18 nt, Bordetella pertussis
guccagcggcgccagcgg

SEQ ID NO: 383163 - RNA, 14 nt, Bordetella pertussis
guccagcggcgcga

SEQ ID NO: 383164 - RNA, 19 nt, Bordetella pertussis
guccagcgucaugcgcacc

SEQ ID NO: 383165 - RNA, 13 nt, Bordetella pertussis
guccaggcgccgc

SEQ ID NO: 383166 - RNA, 16 nt, Bordetella pertussis
guccaggcgccgcacg

SEQ ID NO: 383167 - RNA, 12 nt, Bordetella pertussis
guccaggcgcgc

SEQ ID NO: 383168 - RNA, 16 nt, Bordetella pertussis
guccaggcgcgccagc

SEQ ID NO: 383169 - RNA, 16 nt, Bordetella pertussis
guccaggcggccgcgg

SEQ ID NO: 383170 - RNA, 20 nt, Bordetella pertussis
guccaggcugccggcguugg

SEQ ID NO: 383171 - RNA, 22 nt, Bordetella pertussis
guccaggugcggcggcgacucg

SEQ ID NO: 383172 - RNA, 20 nt, Bordetella pertussis
guccaugaacgccgcgcccg

SEQ ID NO: 383173 - RNA, 20 nt, Bordetella pertussis
guccaugccggccaugcuca

SEQ ID NO: 383174 - RNA, 20 nt, Bordetella pertussis
guccaugcgaaagcggccag

SEQ ID NO: 383175 - RNA, 23 nt, Bordetella pertussis
guccauggugggcaggucgggca

SEQ ID NO: 383176 - RNA, 16 nt, Bordetella pertussis
guccaugucggccgac

SEQ ID NO: 383177 - RNA, 17 nt, Bordetella pertussis
guccauuagggcccagc

SEQ ID NO: 383178 - RNA, 19 nt, Bordetella pertussis
gucccacaggcgcgcggcg

SEQ ID NO: 383179 - RNA, 22 nt, Bordetella pertussis
gucccacugccaguaggcgccc

SEQ ID NO: 383180 - RNA, 14 nt, Bordetella pertussis
gucccagccggccc

SEQ ID NO: 383181 - RNA, 14 nt, Bordetella pertussis
gucccagcgcacgc

SEQ ID NO: 383182 - RNA, 19 nt, Bordetella pertussis
gucccagcggggacaggca

SEQ ID NO: 383183 - RNA, 22 nt, Bordetella pertussis
gucccaggaucaccgccgcgcc

SEQ ID NO: 383184 - RNA, 13 nt, Bordetella pertussis
gucccaggcgcuc

SEQ ID NO: 383185 - RNA, 14 nt, Bordetella pertussis
gucccagucgccgc

SEQ ID NO: 383186 - RNA, 20 nt, Bordetella pertussis
gucccagucgccgcgcccgc

SEQ ID NO: 383187 - RNA, 21 nt, Bordetella pertussis
guccccacauggggacuggca

SEQ ID NO: 383188 - RNA, 19 nt, Bordetella pertussis
guccccaccgggacaggca

SEQ ID NO: 383189 - RNA, 19 nt, Bordetella pertussis
guccccacguggacaggca

SEQ ID NO: 383190 - RNA, 21 nt, Bordetella pertussis
guccccauguggggacaggca

SEQ ID NO: 383191 - RNA, 21 nt, Bordetella pertussis
guccccccauggggacuggca

SEQ ID NO: 383192 - RNA, 19 nt, Bordetella pertussis
gucccggcggggcaggcgc

SEQ ID NO: 383193 - RNA, 15 nt, Bordetella pertussis
gucccgugccggccg

SEQ ID NO: 383194 - RNA, 16 nt, Bordetella pertussis
gucccgugccggccgg

SEQ ID NO: 383195 - RNA, 18 nt, Bordetella pertussis
gucccgugccggccggac

SEQ ID NO: 383196 - RNA, 20 nt, Bordetella pertussis
guccgacgacaaacccgacg

SEQ ID NO: 383197 - RNA, 22 nt, Bordetella pertussis
guccgauggcgauguaggccag

SEQ ID NO: 383198 - RNA, 15 nt, Bordetella pertussis
guccgcagcgcagcg

SEQ ID NO: 383199 - RNA, 19 nt, Bordetella pertussis
guccgcagcgcagcgccac

SEQ ID NO: 383200 - RNA, 16 nt, Bordetella pertussis
guccgcaucgcgcaag

SEQ ID NO: 383201 - RNA, 19 nt, Bordetella pertussis
guccgccacgccggccacg

SEQ ID NO: 383202 - RNA, 15 nt, Bordetella pertussis
guccgccaggacggg

SEQ ID NO: 383203 - RNA, 14 nt, Bordetella pertussis
gucgacgcugaucg

SEQ ID NO: 383204 - RNA, 16 nt, Bordetella pertussis
gucgacgcugaucggc

SEQ ID NO: 383205 - RNA, 13 nt, Bordetella pertussis
gucgacgcggccg

SEQ ID NO: 383206 - RNA, 14 nt, Bordetella pertussis
gucgacggugcgcg

SEQ ID NO: 383207 - RNA, 15 nt, Bordetella pertussis
gucgacggugcgcgc

SEQ ID NO: 383208 - RNA, 18 nt, Bordetella pertussis
gucgacggugcgcgccac

SEQ ID NO: 383209 - RNA, 19 nt, Bordetella pertussis
gucgagcacgcggcgcggc

SEQ ID NO: 383210 - RNA, 20 nt, Bordetella pertussis
gucgagcacgcggcgcggca

SEQ ID NO: 383211 - RNA, 13 nt, Bordetella pertussis
gucgagcagcgca

SEQ ID NO: 383212 - RNA, 16 nt, Bordetella pertussis
gucgagcagcgcaucg

SEQ ID NO: 383213 - RNA, 17 nt, Bordetella pertussis
gucgagcagcgcaucga

SEQ ID NO: 383214 - RNA, 14 nt, Bordetella pertussis
gucgagccaggugg

SEQ ID NO: 383215 - RNA, 12 nt, Bordetella pertussis
gucgagccgggc

SEQ ID NO: 383216 - RNA, 16 nt, Bordetella pertussis
gucgagccgggccacg

SEQ ID NO: 383217 - RNA, 22 nt, Bordetella pertussis
gucgagccgggccacgcgcaca

SEQ ID NO: 383218 - RNA, 15 nt, Bordetella pertussis
gucgagccgggcgcc

SEQ ID NO: 383219 - RNA, 12 nt, Bordetella pertussis
gucgagcgccga

SEQ ID NO: 383220 - RNA, 15 nt, Bordetella pertussis
gucgagcgccgaagu

SEQ ID NO: 383221 - RNA, 16 nt, Bordetella pertussis
gucgagcgccugcgcc

SEQ ID NO: 383222 - RNA, 20 nt, Bordetella pertussis
gucgagcgccugcgccacgu

SEQ ID NO: 383223 - RNA, 23 nt, Bordetella pertussis
gucgagcgcgaaauccagcgcgc

SEQ ID NO: 383224 - RNA, 15 nt, Bordetella pertussis
gucgagcgcggccag

SEQ ID NO: 383225 - RNA, 13 nt, Bordetella pertussis
gucgagcgcucgc

SEQ ID NO: 383226 - RNA, 16 nt, Bordetella pertussis
gucgagcucgauggcu

SEQ ID NO: 383227 - RNA, 15 nt, Bordetella pertussis
gucgagcgggcgcca

SEQ ID NO: 383228 - RNA, 13 nt, Bordetella pertussis
gucgaggaucaag

SEQ ID NO: 383229 - RNA, 14 nt, Bordetella pertussis
gucgaucgccacca

SEQ ID NO: 383230 - RNA, 17 nt, Bordetella pertussis
gucgaucgccaccagcg

SEQ ID NO: 383231 - RNA, 14 nt, Bordetella pertussis
gucgaucggcgcgc

SEQ ID NO: 383232 - RNA, 22 nt, Bordetella pertussis
gucgaugaccagccagccgccg

SEQ ID NO: 383233 - RNA, 18 nt, Bordetella pertussis
gucgaugaccagcgccgg

SEQ ID NO: 383234 - RNA, 14 nt, Bordetella pertussis
gucgaugccaguug

SEQ ID NO: 383235 - RNA, 15 nt, Bordetella pertussis
gucgaugacgcgccg

SEQ ID NO: 383236 - RNA, 19 nt, Bordetella pertussis
gucgaugccgaccaggcug

SEQ ID NO: 383237 - RNA, 13 nt, Bordetella pertussis
gucgaugccggaa

SEQ ID NO: 383238 - RNA, 14 nt, Bordetella pertussis
gucgaugccguaca

SEQ ID NO: 383239 - RNA, 20 nt, Bordetella pertussis
gucgcaacagcccccuggua

SEQ ID NO: 383240 - RNA, 17 nt, Bordetella pertussis
gucgcacaucaggucga

SEQ ID NO: 383241 - RNA, 20 nt, Bordetella pertussis
gucgcacaucaggucgaccu

SEQ ID NO: 383242 - RNA, 19 nt, Bordetella pertussis
gucgcaaucgacgaacaag

SEQ ID NO: 383243 - RNA, 22 nt, Bordetella pertussis
gucgcacuggguggccagcgcc

SEQ ID NO: 383244 - RNA, 16 nt, Bordetella pertussis
gucgccagggcgauga

SEQ ID NO: 383245 - RNA, 19 nt, Bordetella pertussis
gucgccagggcgaugaccg

SEQ ID NO: 383246 - RNA, 23 nt, Bordetella pertussis
gucgccaucugcugcgagacgcg

SEQ ID NO: 383247 - RNA, 17 nt, Bordetella pertussis
gucgccaugcggcuggc

SEQ ID NO: 383248 - RNA, 20 nt, Bordetella pertussis
gucgccaugcggcuggccga

SEQ ID NO: 383249 - RNA, 20 nt, Bordetella pertussis
gucgcccacauagaccggcu

SEQ ID NO: 383250 - RNA, 21 nt, Bordetella pertussis
gucgcccaccacgccgcccag

SEQ ID NO: 383251 - RNA, 16 nt, Bordetella pertussis
gucgcccaacccggcg

SEQ ID NO: 383252 - RNA, 18 nt, Bordetella pertussis
gucgcccaacccggcgag

SEQ ID NO: 383253 - RNA, 22 nt, Bordetella pertussis
gucgcccaacccggcgaggccg

SEQ ID NO: 383254 - RNA, 13 nt, Bordetella pertussis
gucgcccagcaga

SEQ ID NO: 383255 - RNA, 23 nt, Bordetella pertussis
gucgccccccaugccggaacagg

SEQ ID NO: 383256 - RNA, 13 nt, Bordetella pertussis
gucgcccgccgcg

SEQ ID NO: 383257 - RNA, 16 nt, Bordetella pertussis
gucgcccggggcggcg

SEQ ID NO: 383258 - RNA, 18 nt, Bordetella pertussis
gucgccgccugcggcgcg

SEQ ID NO: 383259 - RNA, 20 nt, Bordetella pertussis
gucgccgccugcggcgcggc

SEQ ID NO: 383260 - RNA, 11 nt, Bordetella pertussis
gucgccgcgcg

SEQ ID NO: 383261 - RNA, 12 nt, Bordetella pertussis
gucgccgcgggc

SEQ ID NO: 383262 - RNA, 14 nt, Bordetella pertussis
gucgccgcuggcca

SEQ ID NO: 383263 - RNA, 15 nt, Bordetella pertussis
gucgccgcuggccag

SEQ ID NO: 383264 - RNA, 13 nt, Bordetella pertussis
gucgccgucggca

SEQ ID NO: 383265 - RNA, 17 nt, Bordetella pertussis
gucgccgucgcccuggc

SEQ ID NO: 383266 - RNA, 20 nt, Bordetella pertussis
gucgccguucuggcugcgcg

SEQ ID NO: 383267 - RNA, 21 nt, Bordetella pertussis
gucgccguucuggcugcgcgc

SEQ ID NO: 383268 - RNA, 22 nt, Bordetella pertussis
gucgccguucuggcugcgcgcc

SEQ ID NO: 383269 - RNA, 22 nt, Bordetella pertussis
gucgccucgaagaccucggcgc

SEQ ID NO: 383270 - RNA, 19 nt, Bordetella pertussis
gucgccucccauugcgcgg

SEQ ID NO: 383271 - RNA, 21 nt, Bordetella pertussis
gucgccucccauugcgcggcc

SEQ ID NO: 383272 - RNA, 22 nt, Bordetella pertussis
gucgccucccauugcgcggcca

SEQ ID NO: 383273 - RNA, 15 nt, Bordetella pertussis
gucgcgcagcgccgc

SEQ ID NO: 383274 - RNA, 23 nt, Bordetella pertussis
gucgcgcagcugccugagcaccg

SEQ ID NO: 383275 - RNA, 14 nt, Bordetella pertussis
gucgcgccacggcu

SEQ ID NO: 383276 - RNA, 18 nt, Bordetella pertussis
gucgcgccagcggccguc

SEQ ID NO: 383277 - RNA, 16 nt, Bordetella pertussis
gucgcgccaggccggc

SEQ ID NO: 383278 - RNA, 19 nt, Bordetella pertussis
gucgcgccaggccggcggc

SEQ ID NO: 383279 - RNA, 21 nt, Bordetella pertussis
gucgcgccaggccggcggcga

SEQ ID NO: 383280 - RNA, 14 nt, Bordetella pertussis
gucgcgcucgagca

SEQ ID NO: 383281 - RNA, 22 nt, Bordetella pertussis
gucgcgcucgagcaucuggcgc

SEQ ID NO: 383282 - RNA, 14 nt, Bordetella pertussis
gucgcgcuggcccc

SEQ ID NO: 383283 - RNA, 22 nt, Bordetella pertussis
gucgcgcuggccccagaugccg

SEQ ID NO: 383284 - RNA, 22 nt, Bordetella pertussis
gucgcgcuggcccgcgcgagcg

SEQ ID NO: 383285 - RNA, 15 nt, Bordetella pertussis
gucgcggaugcgcgc

SEQ ID NO: 383286 - RNA, 22 nt, Bordetella pertussis
gucgcggcccacggccagcacu

SEQ ID NO: 383287 - RNA, 14 nt, Bordetella pertussis
gucgcggcccgcca

SEQ ID NO: 383288 - RNA, 15 nt, Bordetella pertussis
gucgcggcccgccag

SEQ ID NO: 383289 - RNA, 23 nt, Bordetella pertussis
gucgcggccguuggcgauggcgc

SEQ ID NO: 383290 - RNA, 20 nt, Bordetella pertussis
gucgcguagcgcggccgggu

SEQ ID NO: 383291 - RNA, 14 nt, Bordetella pertussis
gucgcugccaguug

SEQ ID NO: 383292 - RNA, 15 nt, Bordetella pertussis
gucgcuguagcgcag

SEQ ID NO: 383293 - RNA, 16 nt, Bordetella pertussis
gucgcugucggcgaug

SEQ ID NO: 383294 - RNA, 15 nt, Bordetella pertussis
gucgcugugcgcggc

SEQ ID NO: 383295 - RNA, 14 nt, Bordetella pertussis
gucgcuucgguggc

SEQ ID NO: 383296 - RNA, 17 nt, Bordetella pertussis
gucgcuucgguggcgcg

SEQ ID NO: 383297 - RNA, 15 nt, Bordetella pertussis
gucggacagggcccc

SEQ ID NO: 383298 - RNA, 20 nt, Bordetella pertussis
gucggacagggccccggccu

SEQ ID NO: 383299 - RNA, 18 nt, Bordetella pertussis
gucggcaaccgucgccag

SEQ ID NO: 383300 - RNA, 19 nt, Bordetella pertussis
gucggcaaccgucgccagc

SEQ ID NO: 383301 - RNA, 21 nt, Bordetella pertussis
gucggcaaccgucgccagcgc

SEQ ID NO: 383302 - RNA, 18 nt, Bordetella pertussis
gucggcaccuucgcgcag

SEQ ID NO: 383303 - RNA, 20 nt, Bordetella pertussis
gucggcaccuucgcgcagcg

SEQ ID NO: 383304 - RNA, 16 nt, Bordetella pertussis
gucggccagccggccg

SEQ ID NO: 383305 - RNA, 14 nt, Bordetella pertussis
gucggccagcgccg

SEQ ID NO: 383306 - RNA, 23 nt, Bordetella pertussis
gucggccagcgcgaaguaccagc

SEQ ID NO: 383307 - RNA, 13 nt, Bordetella pertussis
gucggccagcgcc

SEQ ID NO: 383308 - RNA, 12 nt, Bordetella pertussis
gucggccagcgu

SEQ ID NO: 383309 - RNA, 16 nt, Bordetella pertussis
gucggccagcgugccg

SEQ ID NO: 383310 - RNA, 13 nt, Bordetella pertussis
gucggccaggccg

SEQ ID NO: 383311 - RNA, 14 nt, Bordetella pertussis
gucggccaggccga

SEQ ID NO: 383312 - RNA, 12 nt, Bordetella pertussis
gucggccagggc

SEQ ID NO: 383313 - RNA, 16 nt, Bordetella pertussis
gucggccaggcgccag

SEQ ID NO: 383314 - RNA, 20 nt, Bordetella pertussis
gucggccaugcgcgccagca

SEQ ID NO: 383315 - RNA, 21 nt, Bordetella pertussis
gucggcccacuggaucgccga

SEQ ID NO: 383316 - RNA, 19 nt, Bordetella pertussis
gucggcccaggucaucgcc

SEQ ID NO: 383317 - RNA, 22 nt, Bordetella pertussis
gucggcccaggucaucgccagg

SEQ ID NO: 383318 - RNA, 22 nt, Bordetella pertussis
gucggcccgcccgcccugggca

SEQ ID NO: 383319 - RNA, 19 nt, Bordetella pertussis
gucggcccugucggccgaa

SEQ ID NO: 383320 - RNA, 16 nt, Bordetella pertussis
gucggccgaaccgcgc

SEQ ID NO: 383321 - RNA, 18 nt, Bordetella pertussis
gucggccgaaccgcgcag

SEQ ID NO: 383322 - RNA, 21 nt, Bordetella pertussis
gucggccgaaccgcgcagccg

SEQ ID NO: 383323 - RNA, 17 nt, Bordetella pertussis
gucggccgccgccguga

SEQ ID NO: 383324 - RNA, 13 nt, Bordetella pertussis
gucggccgcgccc

SEQ ID NO: 383325 - RNA, 12 nt, Bordetella pertussis
gucggccgcgcg

SEQ ID NO: 383326 - RNA, 15 nt, Bordetella pertussis
gucggccgcgcgcau

SEQ ID NO: 383327 - RNA, 17 nt, Bordetella pertussis
gucggccgccagccacc

SEQ ID NO: 383328 - RNA, 18 nt, Bordetella pertussis
gucggccgcuccgccaug

SEQ ID NO: 383329 - RNA, 23 nt, Bordetella pertussis
gucggccggaugcgcaggacggc

SEQ ID NO: 383330 - RNA, 21 nt, Bordetella pertussis
gucggccucgcgcagggcggc

SEQ ID NO: 383331 - RNA, 14 nt, Bordetella pertussis
gucggccucggcga

SEQ ID NO: 383332 - RNA, 13 nt, Bordetella pertussis
gucggccuggcgc

SEQ ID NO: 383333 - RNA, 13 nt, Bordetella pertussis
gucggcgaacagc

SEQ ID NO: 383334 - RNA, 17 nt, Bordetella pertussis
gucggcgaacagcgcgu

SEQ ID NO: 383335 - RNA, 24 nt, Bordetella pertussis
gucggcgaagccuugcgcggccag

SEQ ID NO: 383336 - RNA, 18 nt, Bordetella pertussis
gucggcgaccgugcgcca

SEQ ID NO: 383337 - RNA, 13 nt, Bordetella pertussis
gucggcgauggcg

SEQ ID NO: 383338 - RNA, 16 nt, Bordetella pertussis
gucggcgauggcgcgc

SEQ ID NO: 383339 - RNA, 17 nt, Bordetella pertussis
gucggcgauggcgcgcg

SEQ ID NO: 383340 - RNA, 13 nt, Bordetella pertussis
gucggcgaugccg

SEQ ID NO: 383341 - RNA, 18 nt, Bordetella pertussis
gucggcgcagauggcggc

SEQ ID NO: 383342 - RNA, 14 nt, Bordetella pertussis
gucggcgcccggcg

SEQ ID NO: 383343 - RNA, 13 nt, Bordetella pertussis
gucggcgccaugc

SEQ ID NO: 383344 - RNA, 21 nt, Bordetella pertussis
gucggcgccaugcuggccgcc

SEQ ID NO: 383345 - RNA, 16 nt, Bordetella pertussis
gucggcgcccacgccg

SEQ ID NO: 383346 - RNA, 12 nt, Bordetella pertussis
gucggcgccgcg

SEQ ID NO: 383347 - RNA, 12 nt, Bordetella pertussis
gucggcgcgcgc

SEQ ID NO: 383348 - RNA, 13 nt, Bordetella pertussis
gucggcgcgcgcc

SEQ ID NO: 383349 - RNA, 13 nt, Bordetella pertussis
gucggcgcggcag

SEQ ID NO: 383350 - RNA, 19 nt, Bordetella pertussis
gucggcgcggcgccgucca

SEQ ID NO: 383351 - RNA, 15 nt, Bordetella pertussis
gucggcgcggucggc

SEQ ID NO: 383352 - RNA, 16 nt, Bordetella pertussis
gucggcgcggggcacc

SEQ ID NO: 383353 - RNA, 17 nt, Bordetella pertussis
gucggcgcggggcaccg

SEQ ID NO: 383354 - RNA, 11 nt, Bordetella pertussis
gucggcgcugc

SEQ ID NO: 383355 - RNA, 17 nt, Bordetella pertussis
gucggcgcugcagcgca

SEQ ID NO: 383356 - RNA, 15 nt, Bordetella pertussis
gucggcgcuggccau

SEQ ID NO: 383357 - RNA, 16 nt, Bordetella pertussis
gucggcgcuggcgcgc

SEQ ID NO: 383358 - RNA, 14 nt, Bordetella pertussis
gucggcggcaagca

SEQ ID NO: 383359 - RNA, 20 nt, Bordetella pertussis
gucggcggcaagcagccgga

SEQ ID NO: 383360 - RNA, 12 nt, Bordetella pertussis
gucggcggccag

SEQ ID NO: 383361 - RNA, 13 nt, Bordetella pertussis
gucggcggccagc

SEQ ID NO: 383362 - RNA, 15 nt, Bordetella pertussis
gucggcggccagcgc

SEQ ID NO: 383363 - RNA, 19 nt, Bordetella pertussis
gucggcgggacgcaggccc

SEQ ID NO: 383364 - RNA, 20 nt, Bordetella pertussis
gucggcgucgaagguuucgc

SEQ ID NO: 383365 - RNA, 18 nt, Bordetella pertussis
gucggcgugacguugccg

SEQ ID NO: 383366 - RNA, 17 nt, Bordetella pertussis
gucggcguuccuggcgc

SEQ ID NO: 383367 - RNA, 20 nt, Bordetella pertussis
gucggcguuccuggcgcugu

SEQ ID NO: 383368 - RNA, 19 nt, Bordetella pertussis
gucggcguugugccggcgc

SEQ ID NO: 383369 - RNA, 20 nt, Bordetella pertussis
gucggcguugugccggcgca

SEQ ID NO: 383370 - RNA, 18 nt, Bordetella pertussis
gucgggauaguccagcac

SEQ ID NO: 383371 - RNA, 18 nt, Bordetella pertussis
gucgggaugccccgcccg

SEQ ID NO: 383372 - RNA, 17 nt, Bordetella pertussis
gucgggcagcaggcgca

SEQ ID NO: 383373 - RNA, 14 nt, Bordetella pertussis
gucgggcagcgccc

SEQ ID NO: 383374 - RNA, 15 nt, Bordetella pertussis
gucgggcagcgcggc

SEQ ID NO: 383375 - RNA, 15 nt, Bordetella pertussis
gucgggcagggcgac

SEQ ID NO: 383376 - RNA, 20 nt, Bordetella pertussis
gucgggcagggugggcacgc

SEQ ID NO: 383377 - RNA, 18 nt, Bordetella pertussis
gucgggcaguugcuggcg

SEQ ID NO: 383378 - RNA, 19 nt, Bordetella pertussis
gucgggcaguugcuggcgg

SEQ ID NO: 383379 - RNA, 12 nt, Bordetella pertussis
gucgggccgcgc

SEQ ID NO: 383380 - RNA, 17 nt, Bordetella pertussis
gucgggcggcgccuggu

SEQ ID NO: 383381 - RNA, 13 nt, Bordetella pertussis
gucgggcggcgcg

SEQ ID NO: 383382 - RNA, 13 nt, Bordetella pertussis
gucgggcgccgca

SEQ ID NO: 383383 - RNA, 15 nt, Bordetella pertussis
gucgggcgugagcgc

SEQ ID NO: 383384 - RNA, 21 nt, Bordetella pertussis
gucgggcugcugcccgaagcg

SEQ ID NO: 383385 - RNA, 15 nt, Bordetella pertussis
gucggucaucacgcg

SEQ ID NO: 383386 - RNA, 19 nt, Bordetella pertussis
gucggucaugcccaugccg

SEQ ID NO: 383387 - RNA, 20 nt, Bordetella pertussis
gucggucaugcccaugccgc

SEQ ID NO: 383388 - RNA, 21 nt, Bordetella pertussis
gucggucugcgugcgcggcgu

SEQ ID NO: 383389 - RNA, 19 nt, Bordetella pertussis
gucggucgcuuccagcgca

SEQ ID NO: 383390 - RNA, 19 nt, Bordetella pertussis
gucgguggggugauggcga

SEQ ID NO: 383391 - RNA, 18 nt, Bordetella pertussis
gucguccaucgacgcggc

SEQ ID NO: 383392 - RNA, 14 nt, Bordetella pertussis
gucgucccagcgca

SEQ ID NO: 383393 - RNA, 16 nt, Bordetella pertussis
gucgucccagcgcacg

SEQ ID NO: 383394 - RNA, 15 nt, Bordetella pertussis
gucguccguccuggc

SEQ ID NO: 383395 - RNA, 16 nt, Bordetella pertussis
gucguccguggccggc

SEQ ID NO: 383396 - RNA, 22 nt, Bordetella pertussis
gucguccguggccggcgcggca

SEQ ID NO: 383397 - RNA, 14 nt, Bordetella pertussis
gucguccucggcca

SEQ ID NO: 383398 - RNA, 17 nt, Bordetella pertussis
gucguccucggccacgu

SEQ ID NO: 383399 - RNA, 23 nt, Bordetella pertussis
gucguccucggccacgucggcgg

SEQ ID NO: 383400 - RNA, 16 nt, Bordetella pertussis
gucguccugcagcagg

SEQ ID NO: 383401 - RNA, 12 nt, Bordetella pertussis
gucgucgaaggc

SEQ ID NO: 383402 - RNA, 16 nt, Bordetella pertussis
gucgucgaaggcgcgc

SEQ ID NO: 383403 - RNA, 21 nt, Bordetella pertussis
gucgucgcgcgagaauggcgc

SEQ ID NO: 383404 - RNA, 11 nt, Bordetella pertussis
gucgucgcgcu

SEQ ID NO: 383405 - RNA, 17 nt, Bordetella pertussis
gucgucgcgguccagca

SEQ ID NO: 383406 - RNA, 14 nt, Bordetella pertussis
gucgucgcuggccc

SEQ ID NO: 383407 - RNA, 15 nt, Bordetella pertussis
gucgucgcuggccca

SEQ ID NO: 383408 - RNA, 24 nt, Bordetella pertussis
gucgucgcuggcccacucggugcg

SEQ ID NO: 383409 - RNA, 15 nt, Bordetella pertussis
gucgucggccacgcc

SEQ ID NO: 383410 - RNA, 14 nt, Bordetella pertussis
gucgugcagcgugg

SEQ ID NO: 383411 - RNA, 19 nt, Bordetella pertussis
gucgugcaggauggcgucg

SEQ ID NO: 383412 - RNA, 22 nt, Bordetella pertussis
gucgugcaucgugacaugcacg

SEQ ID NO: 383413 - RNA, 17 nt, Bordetella pertussis
gucgugcccgccaccca

SEQ ID NO: 383414 - RNA, 13 nt, Bordetella pertussis
gucgugcggcacg

SEQ ID NO: 383415 - RNA, 12 nt, Bordetella pertussis
gucgugcuggcg

SEQ ID NO: 383416 - RNA, 14 nt, Bordetella pertussis
gucgugcuggcgcg

SEQ ID NO: 383417 - RNA, 23 nt, Bordetella pertussis
gucguggccgugcgaggcgaaca

SEQ ID NO: 383418 - RNA, 20 nt, Bordetella pertussis
gucguucugcguggcggcgu

SEQ ID NO: 383419 - RNA, 20 nt, Bordetella pertussis
gucguucugggagcgcgggc

SEQ ID NO: 383420 - RNA, 20 nt, Bordetella pertussis
gucguggcgauagcgcucca

SEQ ID NO: 383421 - RNA, 14 nt, Bordetella pertussis
gucguugacgggga

SEQ ID NO: 383422 - RNA, 22 nt, Bordetella pertussis
gucguugccccgauccgcgggc

SEQ ID NO: 383423 - RNA, 21 nt, Bordetella pertussis
gucguugcgccgaucgcggcu

SEQ ID NO: 383424 - RNA, 16 nt, Bordetella pertussis
gucguugcgcgaagcg

SEQ ID NO: 383425 - RNA, 20 nt, Bordetella pertussis
gucguuguggcaggcgucgg

SEQ ID NO: 383426 - RNA, 16 nt, Bordetella pertussis
gucguuucccagcaag

SEQ ID NO: 383427 - RNA, 19 nt, Bordetella pertussis
gucuaucauggccuuggca

SEQ ID NO: 383428 - RNA, 17 nt, Bordetella pertussis
gucuauuuccgacgaga

SEQ ID NO: 383429 - RNA, 14 nt, Bordetella pertussis
gucuccacgccgcc

SEQ ID NO: 383430 - RNA, 21 nt, Bordetella pertussis
gucuccagcgcgucggccagg

SEQ ID NO: 383431 - RNA, 22 nt, Bordetella pertussis
gucuccagcgcgucggccaggc

SEQ ID NO: 383432 - RNA, 22 nt, Bordetella pertussis
gucucccccucggccugcgcga

SEQ ID NO: 383433 - RNA, 15 nt, Bordetella pertussis
gucugagcgccgggg

SEQ ID NO: 383434 - RNA, 19 nt, Bordetella pertussis
gucugcaccugcguggccu

SEQ ID NO: 383435 - RNA, 16 nt, Bordetella pertussis
gucugcacgcugaacg

SEQ ID NO: 383436 - RNA, 14 nt, Bordetella pertussis
gucugcaccggcuu

SEQ ID NO: 383437 - RNA, 16 nt, Bordetella pertussis
gucugcaccggcuugu

SEQ ID NO: 383438 - RNA, 17 nt, Bordetella pertussis
gucugccacaucacgcc

SEQ ID NO: 383439 - RNA, 19 nt, Bordetella pertussis
gucugccacaucacgccgg

SEQ ID NO: 383440 - RNA, 19 nt, Bordetella pertussis
gucugcgcaucgaugcggc

SEQ ID NO: 383441 - RNA, 15 nt, Bordetella pertussis
gucugcgccgccgcg

SEQ ID NO: 383442 - RNA, 13 nt, Bordetella pertussis
gucugcgccuucc

SEQ ID NO: 383443 - RNA, 16 nt, Bordetella pertussis
gucugcgccuuccggg

SEQ ID NO: 383444 - RNA, 22 nt, Bordetella pertussis
gucugcgccuuccgggcgaccc

SEQ ID NO: 383445 - RNA, 15 nt, Bordetella pertussis
gucuuccaggcgcag

SEQ ID NO: 383446 - RNA, 12 nt, Bordetella pertussis
gucuugcgcugg

SEQ ID NO: 383447 - RNA, 14 nt, Bordetella pertussis
gugaaacagcauca

SEQ ID NO: 383448 - RNA, 23 nt, Bordetella pertussis
gugaacaccucgaacucgaacgc

SEQ ID NO: 383449 - RNA, 14 nt, Bordetella pertussis
gugaacgacagcga

SEQ ID NO: 383450 - RNA, 22 nt, Bordetella pertussis
gugaacgccccggccgaucgcg

SEQ ID NO: 383451 - RNA, 13 nt, Bordetella pertussis
gugaacgcgcauu

SEQ ID NO: 383452 - RNA, 14 nt, Bordetella pertussis
gugagcggcacgac

SEQ ID NO: 383453 - RNA, 16 nt, Bordetella pertussis
gugauccacugcagca

SEQ ID NO: 383454 - RNA, 20 nt, Bordetella pertussis
gugaucgacaacaagccggg

SEQ ID NO: 383455 - RNA, 21 nt, Bordetella pertussis
gugaucgacaacaagccgggc

SEQ ID NO: 383456 - RNA, 18 nt, Bordetella pertussis
gugaucgaguaggccggc

SEQ ID NO: 383457 - RNA, 18 nt, Bordetella pertussis
gugaucgccagcgccggg

SEQ ID NO: 383458 - RNA, 22 nt, Bordetella pertussis
gugaugcaggcggucgaggcgc

SEQ ID NO: 383459 - RNA, 19 nt, Bordetella pertussis
gugaugcccgaggcggcgc

SEQ ID NO: 383460 - RNA, 13 nt, Bordetella pertussis
gugaugcgcgcgg

SEQ ID NO: 383461 - RNA, 15 nt, Bordetella pertussis
gugaugcgcgcggcc

SEQ ID NO: 383462 - RNA, 16 nt, Bordetella pertussis
gugaugcggcgcgccg

SEQ ID NO: 383463 - RNA, 16 nt, Bordetella pertussis
gugauggacgccgggu

SEQ ID NO: 383464 - RNA, 21 nt, Bordetella pertussis
gugcacacgccuucggcgacu

SEQ ID NO: 383465 - RNA, 12 nt, Bordetella pertussis
gugcaccagccc

SEQ ID NO: 383466 - RNA, 20 nt, Bordetella pertussis
gugcaccaggccacccgccg

SEQ ID NO: 383467 - RNA, 13 nt, Bordetella pertussis
gugcagccacgcc

SEQ ID NO: 383468 - RNA, 14 nt, Bordetella pertussis
gugcagcccagcac

SEQ ID NO: 383469 - RNA, 16 nt, Bordetella pertussis
gugcagccgccgcagg

SEQ ID NO: 383470 - RNA, 13 nt, Bordetella pertussis
gugcagcgccgcg

SEQ ID NO: 383471 - RNA, 13 nt, Bordetella pertussis
gugcagcggcucg

SEQ ID NO: 383472 - RNA, 16 nt, Bordetella pertussis
gugcaggacgaacagg

SEQ ID NO: 383473 - RNA, 22 nt, Bordetella pertussis
gugcaggacgaacaggccgccg

SEQ ID NO: 383474 - RNA, 20 nt, Bordetella pertussis
gugcaucccaauuggccgcc

SEQ ID NO: 383475 - RNA, 14 nt, Bordetella pertussis
gugcaucggccggc

SEQ ID NO: 383476 - RNA, 20 nt, Bordetella pertussis
gugcaugacggccaggaugg

SEQ ID NO: 383477 - RNA, 13 nt, Bordetella pertussis
gugcaugcgcgcc

SEQ ID NO: 383478 - RNA, 14 nt, Bordetella pertussis
gugccagccgcugg

SEQ ID NO: 383479 - RNA, 15 nt, Bordetella pertussis
gugccagccgcuggc

SEQ ID NO: 383480 - RNA, 12 nt, Bordetella pertussis
gugccagcuggc

SEQ ID NO: 383481 - RNA, 22 nt, Bordetella pertussis
gugccaguccccauguggggac

SEQ ID NO: 383482 - RNA, 22 nt, Bordetella pertussis
gugccagucccccugcggggac

SEQ ID NO: 383483 - RNA, 21 nt, Bordetella pertussis
gugccaguccccugcggggac

SEQ ID NO: 383484 - RNA, 20 nt, Bordetella pertussis
gugccaucgauaugggcggc

SEQ ID NO: 383485 - RNA, 18 nt, Bordetella pertussis
gugccauggacgccggua

SEQ ID NO: 383486 - RNA, 13 nt, Bordetella pertussis
gugcccagcgagc

SEQ ID NO: 383487 - RNA, 12 nt, Bordetella pertussis
gugcccaggccc

SEQ ID NO: 383488 - RNA, 14 nt, Bordetella pertussis
gugcccagggccac

SEQ ID NO: 383489 - RNA, 21 nt, Bordetella pertussis
gugcccaguuucgcgaccacc

SEQ ID NO: 383490 - RNA, 14 nt, Bordetella pertussis
gugccccacgccga

SEQ ID NO: 383491 - RNA, 23 nt, Bordetella pertussis
gugccccacgccgaugccgcgca

SEQ ID NO: 383492 - RNA, 13 nt, Bordetella pertussis
gugcccgacggac

SEQ ID NO: 383493 - RNA, 17 nt, Bordetella pertussis
gugcccgacggacuggc

SEQ ID NO: 383494 - RNA, 22 nt, Bordetella pertussis
gugcccgagggcgcgucgaccu

SEQ ID NO: 383495 - RNA, 16 nt, Bordetella pertussis
gugcccgccacccagg

SEQ ID NO: 383496 - RNA, 16 nt, Bordetella pertussis
gugcccgcuggccaug

SEQ ID NO: 383497 - RNA, 13 nt, Bordetella pertussis
gugcccggcgggc

SEQ ID NO: 383498 - RNA, 14 nt, Bordetella pertussis
gugccgccggcgcg

SEQ ID NO: 383499 - RNA, 22 nt, Bordetella pertussis
gugccgccggcgcggcugcugg

SEQ ID NO: 383500 - RNA, 16 nt, Bordetella pertussis
gugccgccuggccaga

SEQ ID NO: 383501 - RNA, 13 nt, Bordetella pertussis
gugccgccuucgc

SEQ ID NO: 383502 - RNA, 19 nt, Bordetella pertussis
gugccgccuucgccguggu

SEQ ID NO: 383503 - RNA, 15 nt, Bordetella pertussis
gugccgcgcgcaccg

SEQ ID NO: 383504 - RNA, 18 nt, Bordetella pertussis
gugccgcgcgcggccggc

SEQ ID NO: 383505 - RNA, 21 nt, Bordetella pertussis
gugccgcgcgcggccggcacc

SEQ ID NO: 383506 - RNA, 22 nt, Bordetella pertussis
gugccgcgcgcggccggcacca

SEQ ID NO: 383507 - RNA, 17 nt, Bordetella pertussis
gugccgcuggcggcccu

SEQ ID NO: 383508 - RNA, 15 nt, Bordetella pertussis
gugccggacgcccug

SEQ ID NO: 383509 - RNA, 18 nt, Bordetella pertussis
gugccggccggaccgcug

SEQ ID NO: 383510 - RNA, 16 nt, Bordetella pertussis
gugccugccaagcgcc

SEQ ID NO: 383511 - RNA, 20 nt, Bordetella pertussis
gugccugucccagcggggac

SEQ ID NO: 383512 - RNA, 20 nt, Bordetella pertussis
gugccuguccccacggggac

SEQ ID NO: 383513 - RNA, 22 nt, Bordetella pertussis
gugccuguccccgaacggggac

SEQ ID NO: 383514 - RNA, 22 nt, Bordetella pertussis
gugccuguccccgcacggggac

SEQ ID NO: 383515 - RNA, 20 nt, Bordetella pertussis
gugccuguccccgcugggac

SEQ ID NO: 383516 - RNA, 20 nt, Bordetella pertussis
gugccuguccccguggggac

SEQ ID NO: 383517 - RNA, 16 nt, Bordetella pertussis
gugccugucccugccg

SEQ ID NO: 383518 - RNA, 20 nt, Bordetella pertussis
gugccugucccugccgggac

SEQ ID NO: 383519 - RNA, 20 nt, Bordetella pertussis
gugccugucccugcgggggc

SEQ ID NO: 383520 - RNA, 23 nt, Bordetella pertussis
gugccugcgaacgcccggcccag

SEQ ID NO: 383521 - RNA, 22 nt, Bordetella pertussis
gugccuggacgcgcuggccgac

SEQ ID NO: 383522 - RNA, 16 nt, Bordetella pertussis
gugccuguucccgccg

SEQ ID NO: 383523 - RNA, 13 nt, Bordetella pertussis
gugccuugcggcg

SEQ ID NO: 383524 - RNA, 19 nt, Bordetella pertussis
gugcgacggaugggcgccg

SEQ ID NO: 383525 - RNA, 20 nt, Bordetella pertussis
gugcgagagcuccagccggg

SEQ ID NO: 383526 - RNA, 15 nt, Bordetella pertussis
gugcgaggacgacca

SEQ ID NO: 383527 - RNA, 14 nt, Bordetella pertussis
gugcgaggccacgg

SEQ ID NO: 383528 - RNA, 16 nt, Bordetella pertussis
gugcgcagcggcaggc

SEQ ID NO: 383529 - RNA, 19 nt, Bordetella pertussis
gugcgcaggcgcguggcca

SEQ ID NO: 383530 - RNA, 19 nt, Bordetella pertussis
gugcgcauacagggcggug

SEQ ID NO: 383531 - RNA, 12 nt, Bordetella pertussis
gugcgcaucagc

SEQ ID NO: 383532 - RNA, 15 nt, Bordetella pertussis
gugcgccacagcaug

SEQ ID NO: 383533 - RNA, 16 nt, Bordetella pertussis
gugcgccacuucgccu

SEQ ID NO: 383534 - RNA, 20 nt, Bordetella pertussis
gugcgccacgauguagccga

SEQ ID NO: 383535 - RNA, 12 nt, Bordetella pertussis
gugcgccagcgc

SEQ ID NO: 383536 - RNA, 14 nt, Bordetella pertussis
gugcgccagcgcca

SEQ ID NO: 383537 - RNA, 12 nt, Bordetella pertussis
gugcgccaggca

SEQ ID NO: 383538 - RNA, 17 nt, Bordetella pertussis
gugcgccgccggccugc

SEQ ID NO: 383539 - RNA, 13 nt, Bordetella pertussis
gugcgccggcgcg

SEQ ID NO: 383540 - RNA, 15 nt, Bordetella pertussis
gugcgccggcgcggc

SEQ ID NO: 383541 - RNA, 14 nt, Bordetella pertussis
gugcgccggcggcg

SEQ ID NO: 383542 - RNA, 14 nt, Bordetella pertussis
gugcgggacaggca

SEQ ID NO: 383543 - RNA, 20 nt, Bordetella pertussis
gugcgggacggccaggggca

SEQ ID NO: 383544 - RNA, 20 nt, Bordetella pertussis
gugcgggcaaacggcggcag

SEQ ID NO: 383545 - RNA, 12 nt, Bordetella pertussis
gugcgggccugc

SEQ ID NO: 383546 - RNA, 15 nt, Bordetella pertussis
gugcggggaccggca

SEQ ID NO: 383547 - RNA, 17 nt, Bordetella pertussis
gugcggggaccggcacc

SEQ ID NO: 383548 - RNA, 13 nt, Bordetella pertussis
gugcggggcggca

SEQ ID NO: 383549 - RNA, 15 nt, Bordetella pertussis
gugcguaccagccca

SEQ ID NO: 383550 - RNA, 20 nt, Bordetella pertussis
gugcucaaccucgacgcgca

SEQ ID NO: 383551 - RNA, 21 nt, Bordetella pertussis
gugcucaucggcaggccggcg

SEQ ID NO: 383552 - RNA, 23 nt, Bordetella pertussis
gugcucccaggaaaucaggcgca

SEQ ID NO: 383553 - RNA, 18 nt, Bordetella pertussis
gugcucgaggugcacgug

SEQ ID NO: 383554 - RNA, 20 nt, Bordetella pertussis
gugcugacggugccggccag

SEQ ID NO: 383555 - RNA, 16 nt, Bordetella pertussis
gugcugcagcgcacca

SEQ ID NO: 383556 - RNA, 12 nt, Bordetella pertussis
gugcugccgcug

SEQ ID NO: 383557 - RNA, 17 nt, Bordetella pertussis
gugcugcugcaggcgcg

SEQ ID NO: 383558 - RNA, 23 nt, Bordetella pertussis
gugcugcuggagaucgccgagcg

SEQ ID NO: 383559 - RNA, 13 nt, Bordetella pertussis
gugcugcugggcg

SEQ ID NO: 383560 - RNA, 14 nt, Bordetella pertussis
gugcugcugggcgc

SEQ ID NO: 383561 - RNA, 15 nt, Bordetella pertussis
gugcugcugggcgcc

SEQ ID NO: 383562 - RNA, 23 nt, Bordetella pertussis
gugcugcgccgccucgaccggcg

SEQ ID NO: 383563 - RNA, 13 nt, Bordetella pertussis
gugcuggccaucu

SEQ ID NO: 383564 - RNA, 12 nt, Bordetella pertussis
gugcuggcccgc

SEQ ID NO: 383565 - RNA, 12 nt, Bordetella pertussis
gugcuggccgac

SEQ ID NO: 383566 - RNA, 18 nt, Bordetella pertussis
gugcugggcggccaggcg

SEQ ID NO: 383567 - RNA, 18 nt, Bordetella pertussis
gugcugggcggcgggcac

SEQ ID NO: 383568 - RNA, 19 nt, Bordetella pertussis
gugcugggcggcgggcacg

SEQ ID NO: 383569 - RNA, 13 nt, Bordetella pertussis
gugcuggugcugg

SEQ ID NO: 383570 - RNA, 17 nt, Bordetella pertussis
gugcuguucggcgaccg

SEQ ID NO: 383571 - RNA, 23 nt, Bordetella pertussis
gugcuugccgcagcggccaugga

SEQ ID NO: 383572 - RNA, 12 nt, Bordetella pertussis
guggacacgccc

SEQ ID NO: 383573 - RNA, 15 nt, Bordetella pertussis
guggacacgcccaug

SEQ ID NO: 383574 - RNA, 17 nt, Bordetella pertussis
guggaccgcgcgguggc

SEQ ID NO: 383575 - RNA, 14 nt, Bordetella pertussis
guggaccugccguu

SEQ ID NO: 383576 - RNA, 20 nt, Bordetella pertussis
guggacgccaagaccgcggc

SEQ ID NO: 383577 - RNA, 22 nt, Bordetella pertussis
guggacgccaagaccgcggccg

SEQ ID NO: 383578 - RNA, 16 nt, Bordetella pertussis
guggacgccgccggcc

SEQ ID NO: 383579 - RNA, 14 nt, Bordetella pertussis
guggacggccagca

SEQ ID NO: 383580 - RNA, 15 nt, Bordetella pertussis
guggacucgauggcg

SEQ ID NO: 383581 - RNA, 18 nt, Bordetella pertussis
guggacucgauggcgcag

SEQ ID NO: 383582 - RNA, 15 nt, Bordetella pertussis
guggaggacgccgac

SEQ ID NO: 383583 - RNA, 13 nt, Bordetella pertussis
guggaggcggcgg

SEQ ID NO: 383584 - RNA, 15 nt, Bordetella pertussis
guggaugggcuuuga

SEQ ID NO: 383585 - RNA, 20 nt, Bordetella pertussis
guggcacagccgcagccguc

SEQ ID NO: 383586 - RNA, 19 nt, Bordetella pertussis
guggcaggcgucggccagc

SEQ ID NO: 383587 - RNA, 17 nt, Bordetella pertussis
guggcaggugcggccgc

SEQ ID NO: 383588 - RNA, 21 nt, Bordetella pertussis
guggcauugacgcccacgcuc

SEQ ID NO: 383589 - RNA, 22 nt, Bordetella pertussis
guggccaacgauuccgcgucca

SEQ ID NO: 383590 - RNA, 16 nt, Bordetella pertussis
guggccaagggcgccg

SEQ ID NO: 383591 - RNA, 21 nt, Bordetella pertussis
guggccaagggcgccgcgccg

SEQ ID NO: 383592 - RNA, 15 nt, Bordetella pertussis
guggccaccaggcgc

SEQ ID NO: 383593 - RNA, 16 nt, Bordetella pertussis
guggccaccaggcgcg

SEQ ID NO: 383594 - RNA, 13 nt, Bordetella pertussis
guggccagcgccg

SEQ ID NO: 383595 - RNA, 14 nt, Bordetella pertussis
guggccagcgccgc

SEQ ID NO: 383596 - RNA, 17 nt, Bordetella pertussis
guggccagcgccgccag

SEQ ID NO: 383597 - RNA, 12 nt, Bordetella pertussis
guggccagcgua

SEQ ID NO: 383598 - RNA, 17 nt, Bordetella pertussis
guggccaugcaccagca

SEQ ID NO: 383599 - RNA, 12 nt, Bordetella pertussis
guggccaugcug

SEQ ID NO: 383600 - RNA, 17 nt, Bordetella pertussis
guggccaugcugggcgg

SEQ ID NO: 383601 - RNA, 18 nt, Bordetella pertussis
guggccauggacagcacc

SEQ ID NO: 383602 - RNA, 20 nt, Bordetella pertussis
guggccauggacagcaccga

SEQ ID NO: 383603 - RNA, 20 nt, Bordetella pertussis
guggcccaagcccguggcgg

SEQ ID NO: 383604 - RNA, 14 nt, Bordetella pertussis
guggcccagccgca

SEQ ID NO: 383605 - RNA, 12 nt, Bordetella pertussis
guggcccagcac

SEQ ID NO: 383606 - RNA, 15 nt, Bordetella pertussis
guggcccagcaccgc

SEQ ID NO: 383607 - RNA, 13 nt, Bordetella pertussis
guggcccagccgc

SEQ ID NO: 383608 - RNA, 14 nt, Bordetella pertussis
guggccccaggcgu

SEQ ID NO: 383609 - RNA, 21 nt, Bordetella pertussis
guggcccgccauugcacgcgc

SEQ ID NO: 383610 - RNA, 16 nt, Bordetella pertussis
guggcccgcgugacgg

SEQ ID NO: 383611 - RNA, 18 nt, Bordetella pertussis
guggccgauuccagcgcc

SEQ ID NO: 383612 - RNA, 15 nt, Bordetella pertussis
guggccgcagucagg

SEQ ID NO: 383613 - RNA, 13 nt, Bordetella pertussis
guggccgccgggu

SEQ ID NO: 383614 - RNA, 14 nt, Bordetella pertussis
guggccgccggguc

SEQ ID NO: 383615 - RNA, 21 nt, Bordetella pertussis
guggccgccgggucgcugugc

SEQ ID NO: 383616 - RNA, 13 nt, Bordetella pertussis
guggccgcgcaag

SEQ ID NO: 383617 - RNA, 13 nt, Bordetella pertussis
guggccgcggucc

SEQ ID NO: 383618 - RNA, 19 nt, Bordetella pertussis
guggccgcgguccgggcca

SEQ ID NO: 383619 - RNA, 12 nt, Bordetella pertussis
guggccgcucca

SEQ ID NO: 383620 - RNA, 22 nt, Bordetella pertussis
guggccgcuccagagcgcgcac

SEQ ID NO: 383621 - RNA, 15 nt, Bordetella pertussis
guggccgcuucggcg

SEQ ID NO: 383622 - RNA, 20 nt, Bordetella pertussis
guggccgcuucggcggccgc

SEQ ID NO: 383623 - RNA, 20 nt, Bordetella pertussis
guggccgcggcccagcgcgg

SEQ ID NO: 383624 - RNA, 19 nt, Bordetella pertussis
guggccggaucgagcgcgg

SEQ ID NO: 383625 - RNA, 18 nt, Bordetella pertussis
guggccggcaucgcgcug

SEQ ID NO: 383626 - RNA, 21 nt, Bordetella pertussis
guggccggcgcggcagccugg

SEQ ID NO: 383627 - RNA, 18 nt, Bordetella pertussis
guggccgggcccggcgcg

SEQ ID NO: 383628 - RNA, 20 nt, Bordetella pertussis
guggccguagagggucuggc

SEQ ID NO: 383629 - RNA, 22 nt, Bordetella pertussis
guggccguagagggucuggcgg

SEQ ID NO: 383630 - RNA, 22 nt, Bordetella pertussis
guggccgugcgaggcgaacagg

SEQ ID NO: 383631 - RNA, 13 nt, Bordetella pertussis
guggccguggcgg

SEQ ID NO: 383632 - RNA, 17 nt, Bordetella pertussis
guggccguggcggccac

SEQ ID NO: 383633 - RNA, 20 nt, Bordetella pertussis
guggccucguaucgccugac

SEQ ID NO: 383634 - RNA, 21 nt, Bordetella pertussis
guggccucguaucgccugacg

SEQ ID NO: 383635 - RNA, 24 nt, Bordetella pertussis
guggcgaaauggugcggccaugau

SEQ ID NO: 383636 - RNA, 23 nt, Bordetella pertussis
guggcgaaggccgccgcgcccag

SEQ ID NO: 383637 - RNA, 22 nt, Bordetella pertussis
guggcgaagguggcacaucagc

SEQ ID NO: 383638 - RNA, 23 nt, Bordetella pertussis
guggcgauagcgcuccagcguca

SEQ ID NO: 383639 - RNA, 13 nt, Bordetella pertussis
guggcgaugccgg

SEQ ID NO: 383640 - RNA, 17 nt, Bordetella pertussis
guggcgauguucacgcg

SEQ ID NO: 383641 - RNA, 16 nt, Bordetella pertussis
guggcgcacccugcag

SEQ ID NO: 383642 - RNA, 21 nt, Bordetella pertussis
guggcgcagaugggcggcgac

SEQ ID NO: 383643 - RNA, 16 nt, Bordetella pertussis
guggcgcagugggcca

SEQ ID NO: 383644 - RNA, 17 nt, Bordetella pertussis
guggcgcagugggccag

SEQ ID NO: 383645 - RNA, 14 nt, Bordetella pertussis
guggcgcauucgcc

SEQ ID NO: 383646 - RNA, 22 nt, Bordetella pertussis
guggcgccgacccugcccggca

SEQ ID NO: 383647 - RNA, 15 nt, Bordetella pertussis
guggcgccgcgggcc

SEQ ID NO: 383648 - RNA, 16 nt, Bordetella pertussis
guggcgccgcgggccu

SEQ ID NO: 383649 - RNA, 13 nt, Bordetella pertussis
guggcgccggcca

SEQ ID NO: 383650 - RNA, 14 nt, Bordetella pertussis
guggcgccggccac

SEQ ID NO: 383651 - RNA, 13 nt, Bordetella pertussis
guggcgcggcugc

SEQ ID NO: 383652 - RNA, 14 nt, Bordetella pertussis
guggcgcggguggc

SEQ ID NO: 383653 - RNA, 13 nt, Bordetella pertussis
guggcgcgcgccg

SEQ ID NO: 383654 - RNA, 16 nt, Bordetella pertussis
guggcgcucgcgccca

SEQ ID NO: 383655 - RNA, 17 nt, Bordetella pertussis
guggcgcuggcggcugc

SEQ ID NO: 383656 - RNA, 14 nt, Bordetella pertussis
guggcggacaggcc

SEQ ID NO: 383657 - RNA, 16 nt, Bordetella pertussis
guggcggccgcgggca

SEQ ID NO: 383658 - RNA, 13 nt, Bordetella pertussis
guggcggccgucg

SEQ ID NO: 383659 - RNA, 12 nt, Bordetella pertussis
guggcggccugc

SEQ ID NO: 383660 - RNA, 22 nt, Bordetella pertussis
guggcggccugcgccggcaugg

SEQ ID NO: 383661 - RNA, 18 nt, Bordetella pertussis
guggcggcgcagcgccca

SEQ ID NO: 383662 - RNA, 12 nt, Bordetella pertussis
guggcgggccag

SEQ ID NO: 383663 - RNA, 14 nt, Bordetella pertussis
guggcgggccagcu

SEQ ID NO: 383664 - RNA, 22 nt, Bordetella pertussis
guggcgggcgccugcggcaggc

SEQ ID NO: 383665 - RNA, 15 nt, Bordetella pertussis
guggcggggauggcu

SEQ ID NO: 383666 - RNA, 14 nt, Bordetella pertussis
guggcggggcgcau

SEQ ID NO: 383667 - RNA, 19 nt, Bordetella pertussis
guggcgguguuggcgucca

SEQ ID NO: 383668 - RNA, 21 nt, Bordetella pertussis
guggcgucgaguucgagcacg

SEQ ID NO: 383669 - RNA, 23 nt, Bordetella pertussis
guggcgucgaguucgagcacggu

SEQ ID NO: 383670 - RNA, 17 nt, Bordetella pertussis
guggcgugcaggccggc

SEQ ID NO: 383671 - RNA, 16 nt, Bordetella pertussis
guggcugaacaucagc

SEQ ID NO: 383672 - RNA, 23 nt, Bordetella pertussis
guggcugcgcaggucggccagga

SEQ ID NO: 383673 - RNA, 15 nt, Bordetella pertussis
guggcuggcgaggac

SEQ ID NO: 383674 - RNA, 14 nt, Bordetella pertussis
guggcuggcgucga

SEQ ID NO: 383675 - RNA, 15 nt, Bordetella pertussis
guggcuggggcuggc

SEQ ID NO: 383676 - RNA, 23 nt, Bordetella pertussis
gugggaagacuucgucaacgccc

SEQ ID NO: 383677 - RNA, 16 nt, Bordetella pertussis
gugggcacccggccgc

SEQ ID NO: 383678 - RNA, 14 nt, Bordetella pertussis
gugggcacgccggc

SEQ ID NO: 383679 - RNA, 16 nt, Bordetella pertussis
gugggcacgccggccu

SEQ ID NO: 383680 - RNA, 21 nt, Bordetella pertussis
gugggcagaacggaaacgccc

SEQ ID NO: 383681 - RNA, 18 nt, Bordetella pertussis
gugggcagcagcacgccc

SEQ ID NO: 383682 - RNA, 18 nt, Bordetella pertussis
gugggcagcggcaucacg

SEQ ID NO: 383683 - RNA, 20 nt, Bordetella pertussis
gugggccaguucgcggcgca

SEQ ID NO: 383684 - RNA, 23 nt, Bordetella pertussis
gugggccaguucgcggcgcagcg

SEQ ID NO: 383685 - RNA, 20 nt, Bordetella pertussis
gugggccaguccgcagcgca

SEQ ID NO: 383686 - RNA, 19 nt, Bordetella pertussis
gugggcgaaccgcggcgca

SEQ ID NO: 383687 - RNA, 20 nt, Bordetella pertussis
gugggcgaaccgcggcgcag

SEQ ID NO: 383688 - RNA, 13 nt, Bordetella pertussis
gugggcgacgcgg

SEQ ID NO: 383689 - RNA, 15 nt, Bordetella pertussis
gugggcggcagcagg

SEQ ID NO: 383690 - RNA, 21 nt, Bordetella pertussis
gugggcggccuugccggccac

SEQ ID NO: 383691 - RNA, 17 nt, Bordetella pertussis
gugggcugcggcguggc

SEQ ID NO: 383692 - RNA, 21 nt, Bordetella pertussis
guggggcagcaggccggcggc

SEQ ID NO: 383693 - RNA, 21 nt, Bordetella pertussis
guggggcaggucgccagcagg

SEQ ID NO: 383694 - RNA, 22 nt, Bordetella pertussis
guggggccggccgcgcgcgcca

SEQ ID NO: 383695 - RNA, 12 nt, Bordetella pertussis
guggggccgggc

SEQ ID NO: 383696 - RNA, 17 nt, Bordetella pertussis
guggggggucaggccgu

SEQ ID NO: 383697 - RNA, 13 nt, Bordetella pertussis
guggggcgcggcg

SEQ ID NO: 383698 - RNA, 23 nt, Bordetella pertussis
guggguguggccaugcaccagca

SEQ ID NO: 383699 - RNA, 13 nt, Bordetella pertussis
gugguaggccgau

SEQ ID NO: 383700 - RNA, 20 nt, Bordetella pertussis
gugguaugaccggcgcggcc

SEQ ID NO: 383701 - RNA, 22 nt, Bordetella pertussis
gugguccacgaagcaggugaug

SEQ ID NO: 383702 - RNA, 10 nt, Bordetella pertussis
guggucgcgc

SEQ ID NO: 383703 - RNA, 16 nt, Bordetella pertussis
guggucgugcuggcgc

SEQ ID NO: 383704 - RNA, 15 nt, Bordetella pertussis
guggugacgaugccc

SEQ ID NO: 383705 - RNA, 23 nt, Bordetella pertussis
guucguagccgguaucgcggcgc

SEQ ID NO: 383706 - RNA, 18 nt, Bordetella pertussis
guucguagucgagccagg

SEQ ID NO: 383707 - RNA, 18 nt, Bordetella pertussis
guucguccucgucggcca

SEQ ID NO: 383708 - RNA, 17 nt, Bordetella pertussis
guucgucgcgcagcagg

SEQ ID NO: 383709 - RNA, 17 nt, Bordetella pertussis
guucgucgucggucggc

SEQ ID NO: 383710 - RNA, 18 nt, Bordetella pertussis
guucgucgucggucggcu

SEQ ID NO: 383711 - RNA, 15 nt, Bordetella pertussis
guucuaccugaucgc

SEQ ID NO: 383712 - RNA, 16 nt, Bordetella pertussis
guucuccaacugggcc

SEQ ID NO: 383713 - RNA, 15 nt, Bordetella pertussis
guucuccagcgccgu

SEQ ID NO: 383714 - RNA, 17 nt, Bordetella pertussis
guucuccuugagcacgu

SEQ ID NO: 383715 - RNA, 17 nt, Bordetella pertussis
guugaacugcaggccgc

SEQ ID NO: 383716 - RNA, 15 nt, Bordetella pertussis
guugaaucggcgcga

SEQ ID NO: 383717 - RNA, 19 nt, Bordetella pertussis
guugaaucggcgcgagcgu

SEQ ID NO: 383718 - RNA, 18 nt, Bordetella pertussis
guugaccaccacgcuggc

SEQ ID NO: 383719 - RNA, 17 nt, Bordetella pertussis
guugagcacgguguuga

SEQ ID NO: 383720 - RNA, 13 nt, Bordetella pertussis
guugagcgccgac

SEQ ID NO: 383721 - RNA, 22 nt, Bordetella pertussis
guugcaccgcgucggccugcca

SEQ ID NO: 383722 - RNA, 13 nt, Bordetella pertussis
guugcagcgcgcc

SEQ ID NO: 383723 - RNA, 18 nt, Bordetella pertussis
guugcaggaugcgcggca

SEQ ID NO: 383724 - RNA, 19 nt, Bordetella pertussis
guugcauaccucgauggcg

SEQ ID NO: 383725 - RNA, 12 nt, Bordetella pertussis
guugccaggcga

SEQ ID NO: 383726 - RNA, 15 nt, Bordetella pertussis
guugccgcugcaugg

SEQ ID NO: 383727 - RNA, 17 nt, Bordetella pertussis
guugccgcugcaugggc

SEQ ID NO: 383728 - RNA, 13 nt, Bordetella pertussis
guugccggccagg

SEQ ID NO: 383729 - RNA, 14 nt, Bordetella pertussis
guugccggccagga

SEQ ID NO: 383730 - RNA, 14 nt, Bordetella pertussis
guugcggaucacgc

SEQ ID NO: 383731 - RNA, 22 nt, Bordetella pertussis
guugcggccgugcgccagcgcc

SEQ ID NO: 383732 - RNA, 14 nt, Bordetella pertussis
guugcuuggcguca

SEQ ID NO: 383733 - RNA, 19 nt, Bordetella pertussis
guuggagaucaugaccacg

SEQ ID NO: 383734 - RNA, 12 nt, Bordetella pertussis
guuggccagcgc

SEQ ID NO: 383735 - RNA, 13 nt, Bordetella pertussis
guuggccagcgcc

SEQ ID NO: 383736 - RNA, 14 nt, Bordetella pertussis
guuggccagcgcgc

SEQ ID NO: 383737 - RNA, 17 nt, Bordetella pertussis
guuggugccgaguucga

SEQ ID NO: 383738 - RNA, 21 nt, Bordetella pertussis
guuguccgaaccacccggcca

SEQ ID NO: 383739 - RNA, 19 nt, Bordetella pertussis
guuuccaagcgcacgcgca

SEQ ID NO: 383740 - RNA, 22 nt, Bordetella pertussis
guuuccagggcuugcggcgcug

SEQ ID NO: 383741 - RNA, 20 nt, Bordetella pertussis
guuucccucggugcugcugu

SEQ ID NO: 383742 - RNA, 23 nt, Bordetella pertussis
guuuccgcacccgguauccgcgc

SEQ ID NO: 383743 - RNA, 17 nt, Bordetella pertussis
guuuccgggccuggccu

SEQ ID NO: 383744 - RNA, 16 nt, Bordetella pertussis
guuuccucgccgacga

SEQ ID NO: 383745 - RNA, 16 nt, Bordetella pertussis
guuucgagcaucaugg

SEQ ID NO: 383746 - RNA, 21 nt, Bordetella pertussis
guuucgcgaccaccaggucgu

SEQ ID NO: 383747 - RNA, 16 nt, Bordetella pertussis
guuucggccugcaggc

SEQ ID NO: 383748 - RNA, 16 nt, Bordetella pertussis
guuucggccugcucgc

SEQ ID NO: 383749 - RNA, 16 nt, Bordetella pertussis
guuucguagccgccga

SEQ ID NO: 383750 - RNA, 20 nt, Bordetella pertussis
guuucucaacccgccggcca

SEQ ID NO: 383751 - RNA, 21 nt, Bordetella pertussis
guuucucaacccgccggccau

SEQ ID NO: 383752 - RNA, 20 nt, Bordetella pertussis
guuugcccuucgcggcuggu

SEQ ID NO: 383753 - RNA, 15 nt, Bordetella pertussis
guuugcgcgcgcgcu

SEQ ID NO: 383754 - RNA, 12 nt, Bordetella pertussis
guuugcuggcgc

SEQ ID NO: 383755 - RNA, 21 nt, Bordetella pertussis
guuuggcgaaggcgucggcca

SEQ ID NO: 383756 - RNA, 16 nt, Bordetella pertussis
guuuucagcgcaggcu

SEQ ID NO: 383757 - RNA, 16 nt, Bordetella pertussis
guuuuuuugcgccgcu

SEQ ID NO: 383758 - RNA, 20 nt, Bordetella pertussis
uaacagaggaacgccgcgcu

SEQ ID NO: 383759 - RNA, 21 nt, Bordetella pertussis
uaagcacaagcgcguggccgg

SEQ ID NO: 383760 - RNA, 23 nt, Bordetella pertussis
uacaaaauacuuguccgccaccc

SEQ ID NO: 383761 - RNA, 16 nt, Bordetella pertussis
uacaaggugccugucc

SEQ ID NO: 383762 - RNA, 12 nt, Bordetella pertussis
uacaaggcgcgg

SEQ ID NO: 383763 - RNA, 18 nt, Bordetella pertussis
uacaccuuguuggcgccg

SEQ ID NO: 383764 - RNA, 20 nt, Bordetella pertussis
uacaccuuguuggcgccggc

SEQ ID NO: 383765 - RNA, 14 nt, Bordetella pertussis
uacacggccgccac

SEQ ID NO: 383766 - RNA, 17 nt, Bordetella pertussis
uacacggugggcgacgc

SEQ ID NO: 383767 - RNA, 17 nt, Bordetella pertussis
uacagcggagccgcgca

SEQ ID NO: 383768 - RNA, 14 nt, Bordetella pertussis
uacagcgucacggc

SEQ ID NO: 383769 - RNA, 14 nt, Bordetella pertussis
uacagcucgccggc

SEQ ID NO: 383770 - RNA, 17 nt, Bordetella pertussis
uacagcuucgcgguaac

SEQ ID NO: 383771 - RNA, 15 nt, Bordetella pertussis
uacagcuuggcgcgc

SEQ ID NO: 383772 - RNA, 16 nt, Bordetella pertussis
uacaggcagcggccgc

SEQ ID NO: 383773 - RNA, 19 nt, Bordetella pertussis
uacaggcagcggccgcgcg

SEQ ID NO: 383774 - RNA, 14 nt, Bordetella pertussis
uacaggccggcggc

SEQ ID NO: 383775 - RNA, 23 nt, Bordetella pertussis
uacaggccggcggcgagcgcggc

SEQ ID NO: 383776 - RNA, 16 nt, Bordetella pertussis
uacagggugccgcgcc

SEQ ID NO: 383777 - RNA, 19 nt, Bordetella pertussis
uacaugaguucuggcauca

SEQ ID NO: 383778 - RNA, 18 nt, Bordetella pertussis
uaccucagccugcuggug

SEQ ID NO: 383779 - RNA, 12 nt, Bordetella pertussis
uacgaaaaccag

SEQ ID NO: 383780 - RNA, 13 nt, Bordetella pertussis
uacgacacgccgc

SEQ ID NO: 383781 - RNA, 19 nt, Bordetella pertussis
uacgacgccgugcugaucg

SEQ ID NO: 383782 - RNA, 12 nt, Bordetella pertussis
uacgacggccgg

SEQ ID NO: 383783 - RNA, 15 nt, Bordetella pertussis
uacgcgacaguucgc

SEQ ID NO: 383784 - RNA, 15 nt, Bordetella pertussis
uacgcgaccagcuuc

SEQ ID NO: 383785 - RNA, 13 nt, Bordetella pertussis
uacgcgaugccga

SEQ ID NO: 383786 - RNA, 15 nt, Bordetella pertussis
uacgcgcgcgccggc

SEQ ID NO: 383787 - RNA, 14 nt, Bordetella pertussis
uacgcgcuggcgca

SEQ ID NO: 383788 - RNA, 20 nt, Bordetella pertussis
uacgcgggcauugggcagcg

SEQ ID NO: 383789 - RNA, 18 nt, Bordetella pertussis
uacgcgguccgcagcgcu

SEQ ID NO: 383790 - RNA, 13 nt, Bordetella pertussis
uacgcgugcgcgg

SEQ ID NO: 383791 - RNA, 17 nt, Bordetella pertussis
uacgcgugcgcggccgc

SEQ ID NO: 383792 - RNA, 20 nt, Bordetella pertussis
uacgcgugcgcggccgcgcg

SEQ ID NO: 383793 - RNA, 13 nt, Bordetella pertussis
uacgcuggcgcgu

SEQ ID NO: 383794 - RNA, 14 nt, Bordetella pertussis
uacgcuggcgcguc

SEQ ID NO: 383795 - RNA, 21 nt, Bordetella pertussis
uacggcaagguccaggcgcgc

SEQ ID NO: 383796 - RNA, 15 nt, Bordetella pertussis
uacggccagcgccag

SEQ ID NO: 383797 - RNA, 11 nt, Bordetella pertussis
uacggcgcggu

SEQ ID NO: 383798 - RNA, 22 nt, Bordetella pertussis
uacgggcgcugcacgcagcgca

SEQ ID NO: 383799 - RNA, 18 nt, Bordetella pertussis
uacgucgcagcacgccca

SEQ ID NO: 383800 - RNA, 19 nt, Bordetella pertussis
uagaaguaguucggcgcgu

SEQ ID NO: 383801 - RNA, 19 nt, Bordetella pertussis
uagaucagcgcgucggcgc

SEQ ID NO: 383802 - RNA, 15 nt, Bordetella pertussis
uagaucuugccggcc

SEQ ID NO: 383803 - RNA, 15 nt, Bordetella pertussis
uagccgcugcgcgcg

SEQ ID NO: 383804 - RNA, 16 nt, Bordetella pertussis
uagccgcugcgcgcgg

SEQ ID NO: 383805 - RNA, 17 nt, Bordetella pertussis
uagccggcgacguggcg

SEQ ID NO: 383806 - RNA, 19 nt, Bordetella pertussis
uagccgggucuggccggcc

SEQ ID NO: 383807 - RNA, 17 nt, Bordetella pertussis
uagccggucuggucggc

SEQ ID NO: 383808 - RNA, 19 nt, Bordetella pertussis
uagccguccucgcgggccu

SEQ ID NO: 383809 - RNA, 22 nt, Bordetella pertussis
uagccguccucgcgggccuggc

SEQ ID NO: 383810 - RNA, 12 nt, Bordetella pertussis
uagcgccgcgcc

SEQ ID NO: 383811 - RNA, 14 nt, Bordetella pertussis
uagcgccgcgccag

SEQ ID NO: 383812 - RNA, 14 nt, Bordetella pertussis
uagcguucgccguc

SEQ ID NO: 383813 - RNA, 16 nt, Bordetella pertussis
uaggcaaagcgcagca

SEQ ID NO: 383814 - RNA, 18 nt, Bordetella pertussis
uaggccgcgaugucgcgc

SEQ ID NO: 383815 - RNA, 13 nt, Bordetella pertussis
uaggccucgggcc

SEQ ID NO: 383816 - RNA, 23 nt, Bordetella pertussis
uaggccggcacguccggcacggc

SEQ ID NO: 383817 - RNA, 14 nt, Bordetella pertussis
uaggcgaagcgcgg

SEQ ID NO: 383818 - RNA, 16 nt, Bordetella pertussis
uaggcgcccgacggcg

SEQ ID NO: 383819 - RNA, 23 nt, Bordetella pertussis
uaggcgccgcgcccguccacggc

SEQ ID NO: 383820 - RNA, 21 nt, Bordetella pertussis
uagggcgauggcgcgucgccg

SEQ ID NO: 383821 - RNA, 17 nt, Bordetella pertussis
uagggugccuguccccg

SEQ ID NO: 383822 - RNA, 13 nt, Bordetella pertussis
uaguacucgcugc

SEQ ID NO: 383823 - RNA, 13 nt, Bordetella pertussis
uaguagccgccgc

SEQ ID NO: 383824 - RNA, 23 nt, Bordetella pertussis
uaguccagcagcagcgccgcgcc

SEQ ID NO: 383825 - RNA, 22 nt, Bordetella pertussis
uagucgagccagguggacagcg

SEQ ID NO: 383826 - RNA, 15 nt, Bordetella pertussis
uagucggucaccguc

SEQ ID NO: 383827 - RNA, 17 nt, Bordetella pertussis
uagucgucgaaggcgcg

SEQ ID NO: 383828 - RNA, 15 nt, Bordetella pertussis
uagucguugccggcc

SEQ ID NO: 383829 - RNA, 16 nt, Bordetella pertussis
uagugcaggccgcgca

SEQ ID NO: 383830 - RNA, 17 nt, Bordetella pertussis
uagugcaggccgcgcag

SEQ ID NO: 383831 - RNA, 18 nt, Bordetella pertussis
uagugcuccaccaccauc

SEQ ID NO: 383832 - RNA, 17 nt, Bordetella pertussis
uaguugcgccccgccau

SEQ ID NO: 383833 - RNA, 19 nt, Bordetella pertussis
uauccacgccuucggcgcg

SEQ ID NO: 383834 - RNA, 21 nt, Bordetella pertussis
uauccagguaggcggcgcgcc

SEQ ID NO: 383835 - RNA, 14 nt, Bordetella pertussis
uauccaucggcgcg

SEQ ID NO: 383836 - RNA, 23 nt, Bordetella pertussis
uauccgccguugcucgcgcgcag

SEQ ID NO: 383837 - RNA, 21 nt, Bordetella pertussis
uaucggccaggcgcugcgcgg

SEQ ID NO: 383838 - RNA, 16 nt, Bordetella pertussis
uaucggcccgcgccag

SEQ ID NO: 383839 - RNA, 20 nt, Bordetella pertussis
uaucggcgcgagcgaugccc

SEQ ID NO: 383840 - RNA, 18 nt, Bordetella pertussis
uaucgucgcugcggccgg

SEQ ID NO: 383841 - RNA, 15 nt, Bordetella pertussis
uaucguugucgcgcc

SEQ ID NO: 383842 - RNA, 15 nt, Bordetella pertussis
uaugaccggcgcggc

SEQ ID NO: 383843 - RNA, 17 nt, Bordetella pertussis
uauggagccaggcggcg

SEQ ID NO: 383844 - RNA, 13 nt, Bordetella pertussis
uauggccgcccag

SEQ ID NO: 383845 - RNA, 20 nt, Bordetella pertussis
uauggccguuggccagcgcc

SEQ ID NO: 383846 - RNA, 14 nt, Bordetella pertussis
uaugggggcgagcg

SEQ ID NO: 383847 - RNA, 17 nt, Bordetella pertussis
uauguaggcgccgcgcc

SEQ ID NO: 383848 - RNA, 15 nt, Bordetella pertussis
uauucacgccgcgac

SEQ ID NO: 383849 - RNA, 18 nt, Bordetella pertussis
uauuccucgacgauggcg

SEQ ID NO: 383850 - RNA, 20 nt, Bordetella pertussis
uauucgcauacggacgagcg

SEQ ID NO: 383851 - RNA, 15 nt, Bordetella pertussis
uauucgguggcgcgc

SEQ ID NO: 383852 - RNA, 18 nt, Bordetella pertussis
uauucgucggccgccgcc

SEQ ID NO: 383853 - RNA, 22 nt, Bordetella pertussis
uauuuggcggccuggccgcgcg

SEQ ID NO: 383854 - RNA, 19 nt, Bordetella pertussis
ucaccgacgccagcaugau

SEQ ID NO: 383855 - RNA, 15 nt, Bordetella pertussis
ucaccgaggcgcugc

SEQ ID NO: 383856 - RNA, 22 nt, Bordetella pertussis
ucaccgccauggcggccgccgc

SEQ ID NO: 383857 - RNA, 16 nt, Bordetella pertussis
ucaccggcgagccgau

SEQ ID NO: 383858 - RNA, 15 nt, Bordetella pertussis
ucacgaacagcgcca

SEQ ID NO: 383859 - RNA, 22 nt, Bordetella pertussis
ucacgaucuggcaaucggggug

SEQ ID NO: 383860 - RNA, 12 nt, Bordetella pertussis
ucacgcacagca

SEQ ID NO: 383861 - RNA, 16 nt, Bordetella pertussis
ucacgcacagcaccug

SEQ ID NO: 383862 - RNA, 17 nt, Bordetella pertussis
ucacgcccaggcgcugg

SEQ ID NO: 383863 - RNA, 20 nt, Bordetella pertussis
ucacgcccgagauggcgcag

SEQ ID NO: 383864 - RNA, 19 nt, Bordetella pertussis
ucacgcccgugucgccguc

SEQ ID NO: 383865 - RNA, 20 nt, Bordetella pertussis
ucacgcuguucuucggcaac

SEQ ID NO: 383866 - RNA, 19 nt, Bordetella pertussis
ucacugccgaaacgcuggc

SEQ ID NO: 383867 - RNA, 21 nt, Bordetella pertussis
ucagaccacgacggucugggc

SEQ ID NO: 383868 - RNA, 19 nt, Bordetella pertussis
ucagcaaccccagcagcgc

SEQ ID NO: 383869 - RNA, 17 nt, Bordetella pertussis
ucagcaagggccccagc

SEQ ID NO: 383870 - RNA, 17 nt, Bordetella pertussis
ucagcaccacggcggcc

SEQ ID NO: 383871 - RNA, 21 nt, Bordetella pertussis
ucagccacacgaucagcgccc

SEQ ID NO: 383872 - RNA, 20 nt, Bordetella pertussis
ucagccaccgguugcagcgc

SEQ ID NO: 383873 - RNA, 18 nt, Bordetella pertussis
ucagccacgugaagcgcc

SEQ ID NO: 383874 - RNA, 13 nt, Bordetella pertussis
ucagccagccggc

SEQ ID NO: 383875 - RNA, 16 nt, Bordetella pertussis
ucagccagccggcggc

SEQ ID NO: 383876 - RNA, 19 nt, Bordetella pertussis
ucagccagccggcggccag

SEQ ID NO: 383877 - RNA, 13 nt, Bordetella pertussis
ucagcccggcggc

SEQ ID NO: 383878 - RNA, 17 nt, Bordetella pertussis
ucagcccggcggccauc

SEQ ID NO: 383879 - RNA, 21 nt, Bordetella pertussis
ucagccgcaagcuggcggcgc

SEQ ID NO: 383880 - RNA, 23 nt, Bordetella pertussis
ucagccgcaagcuggcggcgcgc

SEQ ID NO: 383881 - RNA, 21 nt, Bordetella pertussis
ucagccgcccgccgggccguc

SEQ ID NO: 383882 - RNA, 23 nt, Bordetella pertussis
ucagccgcgcgcggccggcgcgc

SEQ ID NO: 383883 - RNA, 16 nt, Bordetella pertussis
ucagccgcugcagcac

SEQ ID NO: 383884 - RNA, 19 nt, Bordetella pertussis
ucagccgcugcagcacgca

SEQ ID NO: 383885 - RNA, 19 nt, Bordetella pertussis
ucagccgcuuggccugcgc

SEQ ID NO: 383886 - RNA, 21 nt, Bordetella pertussis
ucagccgcuuggccugcgcca

SEQ ID NO: 383887 - RNA, 13 nt, Bordetella pertussis
ucagcgccgacga

SEQ ID NO: 383888 - RNA, 15 nt, Bordetella pertussis
ucagcgccgagcgcc

SEQ ID NO: 383889 - RNA, 20 nt, Bordetella pertussis
ucagcgccuugccgccgugc

SEQ ID NO: 383890 - RNA, 12 nt, Bordetella pertussis
ucagcgcgcgcg

SEQ ID NO: 383891 - RNA, 16 nt, Bordetella pertussis
ucagcgcggcgccggc

SEQ ID NO: 383892 - RNA, 15 nt, Bordetella pertussis
ucagcgcggcgcggc

SEQ ID NO: 383893 - RNA, 22 nt, Bordetella pertussis
ucagcgcggcgcggccagcagc

SEQ ID NO: 383894 - RNA, 14 nt, Bordetella pertussis
ucagcgcggcgcac

SEQ ID NO: 383895 - RNA, 16 nt, Bordetella pertussis
ucagcgcggcgcacag

SEQ ID NO: 383896 - RNA, 23 nt, Bordetella pertussis
ucagcgcggcgcacagggcgucg

SEQ ID NO: 383897 - RNA, 22 nt, Bordetella pertussis
ucagcggauugaccagcgcggc

SEQ ID NO: 383898 - RNA, 15 nt, Bordetella pertussis
ucagcggcagcacga

SEQ ID NO: 383899 - RNA, 16 nt, Bordetella pertussis
ucagcggcagcacgau

SEQ ID NO: 383900 - RNA, 12 nt, Bordetella pertussis
ucagcggcagca

SEQ ID NO: 383901 - RNA, 14 nt, Bordetella pertussis
ucagcggccgcugc

SEQ ID NO: 383902 - RNA, 22 nt, Bordetella pertussis
ucagcggccgcugccgcgcgcc

SEQ ID NO: 383903 - RNA, 12 nt, Bordetella pertussis
ucagcggccggc

SEQ ID NO: 383904 - RNA, 12 nt, Bordetella pertussis
ucagcggcgcgc

SEQ ID NO: 383905 - RNA, 19 nt, Bordetella pertussis
ucagcggcggcacgcgcgc

SEQ ID NO: 383906 - RNA, 17 nt, Bordetella pertussis
ucagcgggccggcacca

SEQ ID NO: 383907 - RNA, 13 nt, Bordetella pertussis
ucagcgggcgcgc

SEQ ID NO: 383908 - RNA, 16 nt, Bordetella pertussis
ucagcgucucgggcug

SEQ ID NO: 383909 - RNA, 16 nt, Bordetella pertussis
ucagcgugccgccggc

SEQ ID NO: 383910 - RNA, 14 nt, Bordetella pertussis
ucagcgugucgccg

SEQ ID NO: 383911 - RNA, 19 nt, Bordetella pertussis
ucagcguuuccagggcgcg

SEQ ID NO: 383912 - RNA, 15 nt, Bordetella pertussis
ucagcuacggcuggc

SEQ ID NO: 383913 - RNA, 19 nt, Bordetella pertussis
ucagcuacggcuggccguc

SEQ ID NO: 383914 - RNA, 14 nt, Bordetella pertussis
ucagcugcggcccc

SEQ ID NO: 383915 - RNA, 17 nt, Bordetella pertussis
ucagcugcggccccggc

SEQ ID NO: 383916 - RNA, 17 nt, Bordetella pertussis
ucagcuuccagaucgac

SEQ ID NO: 383917 - RNA, 17 nt, Bordetella pertussis
ucagcuugaugccggcg

SEQ ID NO: 383918 - RNA, 18 nt, Bordetella pertussis
ucagcuugaugccggcgu

SEQ ID NO: 383919 - RNA, 19 nt, Bordetella pertussis
ucagcuuggucacggccuc

SEQ ID NO: 383920 - RNA, 21 nt, Bordetella pertussis
ucaggaaaaucgauacgccgg

SEQ ID NO: 383921 - RNA, 16 nt, Bordetella pertussis
ucaggaaguccugguu

SEQ ID NO: 383922 - RNA, 15 nt, Bordetella pertussis
ucaggaugggcgcgg

SEQ ID NO: 383923 - RNA, 20 nt, Bordetella pertussis
ucaggaugggcgcggcgcgc

SEQ ID NO: 383924 - RNA, 16 nt, Bordetella pertussis
ucaggccccggccggu

SEQ ID NO: 383925 - RNA, 16 nt, Bordetella pertussis
ucaggcccgcggcgcc

SEQ ID NO: 383926 - RNA, 19 nt, Bordetella pertussis
ucaggccgaacugggacag

SEQ ID NO: 383927 - RNA, 21 nt, Bordetella pertussis
ucaggccgaggcugcgcgcgc

SEQ ID NO: 383928 - RNA, 23 nt, Bordetella pertussis
ucaggccgaugcguccgccgugc

SEQ ID NO: 383929 - RNA, 17 nt, Bordetella pertussis
ucaggccgccggcgcgg

SEQ ID NO: 383930 - RNA, 13 nt, Bordetella pertussis
ucaggccggcgau

SEQ ID NO: 383931 - RNA, 17 nt, Bordetella pertussis
ucaggccguuggcgcgc

SEQ ID NO: 383932 - RNA, 18 nt, Bordetella pertussis
ucaggccguuggcgcgcc

SEQ ID NO: 383933 - RNA, 21 nt, Bordetella pertussis
ucaggccguuggcgcgccuug

SEQ ID NO: 383934 - RNA, 18 nt, Bordetella pertussis
ucaggccugcggcgccag

SEQ ID NO: 383935 - RNA, 15 nt, Bordetella pertussis
ucagguagccgaagu

SEQ ID NO: 383936 - RNA, 22 nt, Bordetella pertussis
ucagguagccgaaguugucgcc

SEQ ID NO: 383937 - RNA, 19 nt, Bordetella pertussis
ucaggucgauguggccguc

SEQ ID NO: 383938 - RNA, 15 nt, Bordetella pertussis
ucaggugcagcgaga

SEQ ID NO: 383939 - RNA, 22 nt, Bordetella pertussis
ucaggugcaggguuggcgcgcc

SEQ ID NO: 383940 - RNA, 21 nt, Bordetella pertussis
ucaguccucaugcgggacagg

SEQ ID NO: 383941 - RNA, 16 nt, Bordetella pertussis
ucagucggccuggcgc

SEQ ID NO: 383942 - RNA, 16 nt, Bordetella pertussis
ucagucgggcagcgcc

SEQ ID NO: 383943 - RNA, 22 nt, Bordetella pertussis
ucaguugggcgcgcccagcccc

SEQ ID NO: 383944 - RNA, 17 nt, Bordetella pertussis
ucaucaccaagggcgcc

SEQ ID NO: 383945 - RNA, 14 nt, Bordetella pertussis
ucaucagcgcgcgc

SEQ ID NO: 383946 - RNA, 16 nt, Bordetella pertussis
ucaucagcgcgcgcag

SEQ ID NO: 383947 - RNA, 16 nt, Bordetella pertussis
ucaucaucgccgacgc

SEQ ID NO: 383948 - RNA, 12 nt, Bordetella pertussis
ucaucaucgcgc

SEQ ID NO: 383949 - RNA, 19 nt, Bordetella pertussis
ucauccaggccgugagcgc

SEQ ID NO: 383950 - RNA, 14 nt, Bordetella pertussis
ucauccaggcgcgu

SEQ ID NO: 383951 - RNA, 17 nt, Bordetella pertussis
ucaucgcgcuggcgcgc

SEQ ID NO: 383952 - RNA, 17 nt, Bordetella pertussis
ucaucggcaggccggcg

SEQ ID NO: 383953 - RNA, 20 nt, Bordetella pertussis
ucaucggcaggccggcgcgc

SEQ ID NO: 383954 - RNA, 16 nt, Bordetella pertussis
ucaucgggccggcggc

SEQ ID NO: 383955 - RNA, 10 nt, Bordetella pertussis
ucaucgucau

SEQ ID NO: 383956 - RNA, 18 nt, Bordetella pertussis
ucaucguggccgcgcaag

SEQ ID NO: 383957 - RNA, 19 nt, Bordetella pertussis
ucaugucguccucggccac

SEQ ID NO: 383958 - RNA, 13 nt, Bordetella pertussis
ucauucggcgcgc

SEQ ID NO: 383959 - RNA, 19 nt, Bordetella pertussis
uccaaaacagacaggccgg

SEQ ID NO: 383960 - RNA, 21 nt, Bordetella pertussis
uccaagcagacccgcgcccag

SEQ ID NO: 383961 - RNA, 22 nt, Bordetella pertussis
uccacagccacugcggcccgag

SEQ ID NO: 383962 - RNA, 12 nt, Bordetella pertussis
uccacagcgccg

SEQ ID NO: 383963 - RNA, 15 nt, Bordetella pertussis
uccacagcgccgacc

SEQ ID NO: 383964 - RNA, 16 nt, Bordetella pertussis
uccaccaccaggccgg

SEQ ID NO: 383965 - RNA, 18 nt, Bordetella pertussis
uccaccacccaggcccag

SEQ ID NO: 383966 - RNA, 20 nt, Bordetella pertussis
uccaccaccuucagggcgcc

SEQ ID NO: 383967 - RNA, 15 nt, Bordetella pertussis
uccaccagcaccggc

SEQ ID NO: 383968 - RNA, 13 nt, Bordetella pertussis
uccaccggcgcgc

SEQ ID NO: 383969 - RNA, 14 nt, Bordetella pertussis
uccaccggcgcgcg

SEQ ID NO: 383970 - RNA, 14 nt, Bordetella pertussis
uccacgccgccgac

SEQ ID NO: 383971 - RNA, 13 nt, Bordetella pertussis
uccacgccgcgcg

SEQ ID NO: 383972 - RNA, 20 nt, Bordetella pertussis
uccacgccgcgcgcgucgcc

SEQ ID NO: 383973 - RNA, 21 nt, Bordetella pertussis
uccacgccgcgcgcgucgccg

SEQ ID NO: 383974 - RNA, 18 nt, Bordetella pertussis
uccacgccuucggcgcgc

SEQ ID NO: 383975 - RNA, 17 nt, Bordetella pertussis
uccacggucgccggcau

SEQ ID NO: 383976 - RNA, 20 nt, Bordetella pertussis
uccacgucaguccguggcgc

SEQ ID NO: 383977 - RNA, 22 nt, Bordetella pertussis
uccacgucaguccguggcgcgg

SEQ ID NO: 383978 - RNA, 23 nt, Bordetella pertussis
uccacgucaguccguggcgcggc

SEQ ID NO: 383979 - RNA, 12 nt, Bordetella pertussis
uccacguggcga

SEQ ID NO: 383980 - RNA, 14 nt, Bordetella pertussis
uccacucggccagc

SEQ ID NO: 383981 - RNA, 21 nt, Bordetella pertussis
uccacuugcggguccagcagg

SEQ ID NO: 383982 - RNA, 18 nt, Bordetella pertussis
uccagcaccagggcgcgc

SEQ ID NO: 383983 - RNA, 22 nt, Bordetella pertussis
uccagcaccagggcgcgcagca

SEQ ID NO: 383984 - RNA, 19 nt, Bordetella pertussis
uccagcauuucucgggcgc

SEQ ID NO: 383985 - RNA, 22 nt, Bordetella pertussis
uccagcccgcggguucgcccgg

SEQ ID NO: 383986 - RNA, 13 nt, Bordetella pertussis
uccagcggcgcca

SEQ ID NO: 383987 - RNA, 18 nt, Bordetella pertussis
uccagcgucauggccugg

SEQ ID NO: 383988 - RNA, 13 nt, Bordetella pertussis
uccagcguggcgc

SEQ ID NO: 383989 - RNA, 18 nt, Bordetella pertussis
uccagcgugucgaacacc

SEQ ID NO: 383990 - RNA, 20 nt, Bordetella pertussis
uccagcgugucgaacaccag

SEQ ID NO: 383991 - RNA, 14 nt, Bordetella pertussis
uccagcuccagcgc

SEQ ID NO: 383992 - RNA, 14 nt, Bordetella pertussis
uccagcuccaggug

SEQ ID NO: 383993 - RNA, 15 nt, Bordetella pertussis
uccagcuccggcggc

SEQ ID NO: 383994 - RNA, 16 nt, Bordetella pertussis
uccaggccaccgcggc

SEQ ID NO: 383995 - RNA, 13 nt, Bordetella pertussis
uccaggcccagcg

SEQ ID NO: 383996 - RNA, 13 nt, Bordetella pertussis
uccaggcccaggc

SEQ ID NO: 383997 - RNA, 20 nt, Bordetella pertussis
uccaggcccgaaacgcgcag

SEQ ID NO: 383998 - RNA, 24 nt, Bordetella pertussis
uccaggcccgaaacgcgcagcacc

SEQ ID NO: 383999 - RNA, 14 nt, Bordetella pertussis
uccaggcccggcag

SEQ ID NO: 384000 - RNA, 19 nt, Bordetella pertussis
uccaggccggggccgccca

SEQ ID NO: 384001 - RNA, 14 nt, Bordetella pertussis
uccaggcggccauc

SEQ ID NO: 384002 - RNA, 15 nt, Bordetella pertussis
uccaggcugccggcg

SEQ ID NO: 384003 - RNA, 17 nt, Bordetella pertussis
uccagggccacgcccac

SEQ ID NO: 384004 - RNA, 15 nt, Bordetella pertussis
uccagggccgcagca

SEQ ID NO: 384005 - RNA, 16 nt, Bordetella pertussis
uccagggcgucgcggc

SEQ ID NO: 384006 - RNA, 21 nt, Bordetella pertussis
uccagggcuugcggcgcuggc

SEQ ID NO: 384007 - RNA, 14 nt, Bordetella pertussis
uccagguggcccgc

SEQ ID NO: 384008 - RNA, 20 nt, Bordetella pertussis
uccagguggcccgcaccggg

SEQ ID NO: 384009 - RNA, 19 nt, Bordetella pertussis
uccaucaucagcauggcgu

SEQ ID NO: 384010 - RNA, 20 nt, Bordetella pertussis
uccaucgccugcacgaccug

SEQ ID NO: 384011 - RNA, 17 nt, Bordetella pertussis
uccaucgcgugcagcga

SEQ ID NO: 384012 - RNA, 21 nt, Bordetella pertussis
uccaucggggggcaggcugga

SEQ ID NO: 384013 - RNA, 13 nt, Bordetella pertussis
uccaucggcgcgc

SEQ ID NO: 384014 - RNA, 15 nt, Bordetella pertussis
uccaucggcgcgcgc

SEQ ID NO: 384015 - RNA, 14 nt, Bordetella pertussis
uccaucuggaccgc

SEQ ID NO: 384016 - RNA, 18 nt, Bordetella pertussis
uccaucuugccggccugu

SEQ ID NO: 384017 - RNA, 22 nt, Bordetella pertussis
uccaugaacgccgcgcccgccc

SEQ ID NO: 384018 - RNA, 18 nt, Bordetella pertussis
uccaugaggaacggcacc

SEQ ID NO: 384019 - RNA, 19 nt, Bordetella pertussis
uccaugaggaacggcacca

SEQ ID NO: 384020 - RNA, 21 nt, Bordetella pertussis
uccaugaggaacggcaccagc

SEQ ID NO: 384021 - RNA, 19 nt, Bordetella pertussis
uccaugacguccagcgcca

SEQ ID NO: 384022 - RNA, 12 nt, Bordetella pertussis
uccauggcgccg

SEQ ID NO: 384023 - RNA, 16 nt, Bordetella pertussis
uccauguaaaaacccg

SEQ ID NO: 384024 - RNA, 23 nt, Bordetella pertussis
uccauguaaaaacccggccugcg

SEQ ID NO: 384025 - RNA, 22 nt, Bordetella pertussis
ucccaaaaaaaaaccccgccag

SEQ ID NO: 384026 - RNA, 13 nt, Bordetella pertussis
ucccgcaggccca

SEQ ID NO: 384027 - RNA, 17 nt, Bordetella pertussis
ucccgcccugacgccug

SEQ ID NO: 384028 - RNA, 18 nt, Bordetella pertussis
ucccggccaggcgccggc

SEQ ID NO: 384029 - RNA, 22 nt, Bordetella pertussis
ucccggccgaaaccgccgcggc

SEQ ID NO: 384030 - RNA, 20 nt, Bordetella pertussis
ucccggcgcucagcgcgccg

SEQ ID NO: 384031 - RNA, 20 nt, Bordetella pertussis
ucccggcggggacaggcgcc

SEQ ID NO: 384032 - RNA, 18 nt, Bordetella pertussis
ucccggcugggacaggca

SEQ ID NO: 384033 - RNA, 22 nt, Bordetella pertussis
ucccuacccgccgggcggcgcc

SEQ ID NO: 384034 - RNA, 18 nt, Bordetella pertussis
ucccugccgggacaggca

SEQ ID NO: 384035 - RNA, 14 nt, Bordetella pertussis
ucccugcggggacu

SEQ ID NO: 384036 - RNA, 16 nt, Bordetella pertussis
ucccugcgggggcagg

SEQ ID NO: 384037 - RNA, 18 nt, Bordetella pertussis
ucccugcgggggcaggca

SEQ ID NO: 384038 - RNA, 20 nt, Bordetella pertussis
ucccugcgggggcaggcacg

SEQ ID NO: 384039 - RNA, 17 nt, Bordetella pertussis
ucccugcuugcgcggac

SEQ ID NO: 384040 - RNA, 16 nt, Bordetella pertussis
ucccuggcgcgccagc

SEQ ID NO: 384041 - RNA, 16 nt, Bordetella pertussis
ucccuggcccuggcgg

SEQ ID NO: 384042 - RNA, 15 nt, Bordetella pertussis
ucccugugggggaca

SEQ ID NO: 384043 - RNA, 19 nt, Bordetella pertussis
uccgaaccacccggccauc

SEQ ID NO: 384044 - RNA, 19 nt, Bordetella pertussis
uccgagauggccuuuucca

SEQ ID NO: 384045 - RNA, 22 nt, Bordetella pertussis
uccgagggacaccgcaggugcc

SEQ ID NO: 384046 - RNA, 15 nt, Bordetella pertussis
uccgcagcgcagcgc

SEQ ID NO: 384047 - RNA, 22 nt, Bordetella pertussis
uccgcagcgcagcgccacgcug

SEQ ID NO: 384048 - RNA, 19 nt, Bordetella pertussis
uccgcauggguucgagguc

SEQ ID NO: 384049 - RNA, 20 nt, Bordetella pertussis
uccgccccauccacggcgcc

SEQ ID NO: 384050 - RNA, 22 nt, Bordetella pertussis
uccgccccauccacggcgccau

SEQ ID NO: 384051 - RNA, 17 nt, Bordetella pertussis
uccgcccguugcggcgc

SEQ ID NO: 384052 - RNA, 13 nt, Bordetella pertussis
uccgccgccagca

SEQ ID NO: 384053 - RNA, 14 nt, Bordetella pertussis
uccgccgccagcac

SEQ ID NO: 384054 - RNA, 16 nt, Bordetella pertussis
uccgccgccagcacgc

SEQ ID NO: 384055 - RNA, 17 nt, Bordetella pertussis
uccgccgccagcacgcc

SEQ ID NO: 384056 - RNA, 21 nt, Bordetella pertussis
uccgccgcgaccaccagcacc

SEQ ID NO: 384057 - RNA, 15 nt, Bordetella pertussis
uccgcgaaacggcgg

SEQ ID NO: 384058 - RNA, 21 nt, Bordetella pertussis
uccgcgaaacggcgggcgcgc

SEQ ID NO: 384059 - RNA, 22 nt, Bordetella pertussis
uccgcgaaacggcgggcgcgca

SEQ ID NO: 384060 - RNA, 18 nt, Bordetella pertussis
uccgcgacgguccugcgc

SEQ ID NO: 384061 - RNA, 18 nt, Bordetella pertussis
uccgcuggcgaucacggc

SEQ ID NO: 384062 - RNA, 21 nt, Bordetella pertussis
uccgcuuccggccgggccagu

SEQ ID NO: 384063 - RNA, 19 nt, Bordetella pertussis
uccgcuucgucgggcagcg

SEQ ID NO: 384064 - RNA, 23 nt, Bordetella pertussis
uccgcuucgucgggcagcgcggc

SEQ ID NO: 384065 - RNA, 13 nt, Bordetella pertussis
uccggcagcggcc

SEQ ID NO: 384066 - RNA, 21 nt, Bordetella pertussis
uccggcaggaucugcaccuug

SEQ ID NO: 384067 - RNA, 15 nt, Bordetella pertussis
uccggccagcacgcc

SEQ ID NO: 384068 - RNA, 22 nt, Bordetella pertussis
uccggccagcacgccggcgggc

SEQ ID NO: 384069 - RNA, 18 nt, Bordetella pertussis
uccggccgcacgcggccg

SEQ ID NO: 384070 - RNA, 14 nt, Bordetella pertussis
uccggcgccagcau

SEQ ID NO: 384071 - RNA, 20 nt, Bordetella pertussis
uccggcgccagcaugcgcgc

SEQ ID NO: 384072 - RNA, 14 nt, Bordetella pertussis
uccggcgccuggcc

SEQ ID NO: 384073 - RNA, 10 nt, Bordetella pertussis
uccggcgcga

SEQ ID NO: 384074 - RNA, 20 nt, Bordetella pertussis
uccggcgcucgccccggcgc

SEQ ID NO: 384075 - RNA, 14 nt, Bordetella pertussis
uccggcgcuggcgc

SEQ ID NO: 384076 - RNA, 21 nt, Bordetella pertussis
uccggcgcuggcgcauggcug

SEQ ID NO: 384077 - RNA, 17 nt, Bordetella pertussis
uccggcugcgcgcgcag

SEQ ID NO: 384078 - RNA, 21 nt, Bordetella pertussis
uccggcuggauggugccgccg

SEQ ID NO: 384079 - RNA, 16 nt, Bordetella pertussis
uccggcuugccgaagg

SEQ ID NO: 384080 - RNA, 18 nt, Bordetella pertussis
uccgggagccuguccccg

SEQ ID NO: 384081 - RNA, 17 nt, Bordetella pertussis
uccgguauccuggcgcg

SEQ ID NO: 384082 - RNA, 17 nt, Bordetella pertussis
uccguaaagaugcgcgc

SEQ ID NO: 384083 - RNA, 20 nt, Bordetella pertussis
uccgucaccgacgccagcau

SEQ ID NO: 384084 - RNA, 23 nt, Bordetella pertussis
uccgucucgcccaggcccagcau

SEQ ID NO: 384085 - RNA, 23 nt, Bordetella pertussis
uccgugcaucggcacgggucagg

SEQ ID NO: 384086 - RNA, 14 nt, Bordetella pertussis
uccgugcggcgcgc

SEQ ID NO: 384087 - RNA, 17 nt, Bordetella pertussis
uccguggccggcgcggc

SEQ ID NO: 384088 - RNA, 19 nt, Bordetella pertussis
uccucccagaccugcgcgc

SEQ ID NO: 384089 - RNA, 19 nt, Bordetella pertussis
uccuccccaacggggacgg

SEQ ID NO: 384090 - RNA, 14 nt, Bordetella pertussis
uccuccugccggcg

SEQ ID NO: 384091 - RNA, 16 nt, Bordetella pertussis
uccuccugucaugguu

SEQ ID NO: 384092 - RNA, 17 nt, Bordetella pertussis
uccucgaacaggccauc

SEQ ID NO: 384093 - RNA, 23 nt, Bordetella pertussis
uccucgaccagcccggccgccag

SEQ ID NO: 384094 - RNA, 12 nt, Bordetella pertussis
uccucgcaggaa

SEQ ID NO: 384095 - RNA, 20 nt, Bordetella pertussis
uccucgccacacgccagaac

SEQ ID NO: 384096 - RNA, 21 nt, Bordetella pertussis
uccucgcccgaccugcuggcg

SEQ ID NO: 384097 - RNA, 13 nt, Bordetella pertussis
uccucgcgcacca

SEQ ID NO: 384098 - RNA, 11 nt, Bordetella pertussis
uccucgcugcc

SEQ ID NO: 384099 - RNA, 17 nt, Bordetella pertussis
uccucggcacggccagc

SEQ ID NO: 384100 - RNA, 14 nt, Bordetella pertussis
uccucggccacguc

SEQ ID NO: 384101 - RNA, 18 nt, Bordetella pertussis
uccucggccacgucggcg

SEQ ID NO: 384102 - RNA, 13 nt, Bordetella pertussis
uccucggcgcgcg

SEQ ID NO: 384103 - RNA, 14 nt, Bordetella pertussis
uccucgucggccau

SEQ ID NO: 384104 - RNA, 15 nt, Bordetella pertussis
uccucgucggccaug

SEQ ID NO: 384105 - RNA, 15 nt, Bordetella pertussis
uccucguugcccgcg

SEQ ID NO: 384106 - RNA, 16 nt, Bordetella pertussis
uccucuacuggcugau

SEQ ID NO: 384107 - RNA, 15 nt, Bordetella pertussis
uccugaacgccgggc

SEQ ID NO: 384108 - RNA, 14 nt, Bordetella pertussis
uccugaggccaggc

SEQ ID NO: 384109 - RNA, 19 nt, Bordetella pertussis
uccugcaacuggugcacga

SEQ ID NO: 384110 - RNA, 19 nt, Bordetella pertussis
uccugcaccucaggaugcc

SEQ ID NO: 384111 - RNA, 14 nt, Bordetella pertussis
uccugcaggauggg

SEQ ID NO: 384112 - RNA, 15 nt, Bordetella pertussis
uccugcaggcccggc

SEQ ID NO: 384113 - RNA, 20 nt, Bordetella pertussis
uccugcaggcccggcgcgac

SEQ ID NO: 384114 - RNA, 22 nt, Bordetella pertussis
uccugcagggcgucugcucgcc

SEQ ID NO: 384115 - RNA, 20 nt, Bordetella pertussis
uccugcaucgccaugccggc

SEQ ID NO: 384116 - RNA, 17 nt, Bordetella pertussis
uccugccauugcgcggc

SEQ ID NO: 384117 - RNA, 20 nt, Bordetella pertussis
uccugcccaccgccgcccgc

SEQ ID NO: 384118 - RNA, 13 nt, Bordetella pertussis
uccugcggcgcgg

SEQ ID NO: 384119 - RNA, 15 nt, Bordetella pertussis
uccugcuggcgcguc

SEQ ID NO: 384120 - RNA, 19 nt, Bordetella pertussis
uccugcugugccccacacg

SEQ ID NO: 384121 - RNA, 21 nt, Bordetella pertussis
uccuggagacguagccgcugc

SEQ ID NO: 384122 - RNA, 21 nt, Bordetella pertussis
uccuggccggcgccgacaacg

SEQ ID NO: 384123 - RNA, 13 nt, Bordetella pertussis
uccuggccacugc

SEQ ID NO: 384124 - RNA, 12 nt, Bordetella pertussis
uccuggcgaccg

SEQ ID NO: 384125 - RNA, 19 nt, Bordetella pertussis
uccuggcggccgcccagca

SEQ ID NO: 384126 - RNA, 21 nt, Bordetella pertussis
uccuggcucugaucgcgcugg

SEQ ID NO: 384127 - RNA, 23 nt, Bordetella pertussis
uccugggccgagcgcgccagcac

SEQ ID NO: 384128 - RNA, 13 nt, Bordetella pertussis
uccugggugcgcc

SEQ ID NO: 384129 - RNA, 21 nt, Bordetella pertussis
uccugguagccggcgacgugg

SEQ ID NO: 384130 - RNA, 16 nt, Bordetella pertussis
uccuggucgaccaggc

SEQ ID NO: 384131 - RNA, 14 nt, Bordetella pertussis
uccuggucgacgcg

SEQ ID NO: 384132 - RNA, 18 nt, Bordetella pertussis
uccugguugccgaggacg

SEQ ID NO: 384133 - RNA, 17 nt, Bordetella pertussis
uccugugggggcgcggc

SEQ ID NO: 384134 - RNA, 20 nt, Bordetella pertussis
uccuguucggccacggcugg

SEQ ID NO: 384135 - RNA, 21 nt, Bordetella pertussis
uccuugaggaacuggacggcg

SEQ ID NO: 384136 - RNA, 21 nt, Bordetella pertussis
uccuugcgcucgcccagcacc

SEQ ID NO: 384137 - RNA, 15 nt, Bordetella pertussis
ucgaaaccggcgcgc

SEQ ID NO: 384138 - RNA, 19 nt, Bordetella pertussis
ucgaacaaggcgguggcca

SEQ ID NO: 384139 - RNA, 23 nt, Bordetella pertussis
ucgaacaaggcgguggccagcgu

SEQ ID NO: 384140 - RNA, 15 nt, Bordetella pertussis
ucgaacaccagguuu

SEQ ID NO: 384141 - RNA, 15 nt, Bordetella pertussis
ucgaacacgccgacc

SEQ ID NO: 384142 - RNA, 15 nt, Bordetella pertussis
ucgaacagcagcuug

SEQ ID NO: 384143 - RNA, 17 nt, Bordetella pertussis
ucgaacagcugcagcga

SEQ ID NO: 384144 - RNA, 11 nt, Bordetella pertussis
ucgaacaggcu

SEQ ID NO: 384145 - RNA, 18 nt, Bordetella pertussis
ucgaaccacacgaccgag

SEQ ID NO: 384146 - RNA, 14 nt, Bordetella pertussis
ucgaacccaugcag

SEQ ID NO: 384147 - RNA, 16 nt, Bordetella pertussis
ucgaacgcggccagac

SEQ ID NO: 384148 - RNA, 23 nt, Bordetella pertussis
ucgaacgcguucaagucgcccug

SEQ ID NO: 384149 - RNA, 22 nt, Bordetella pertussis
ucgaacgcuuccugggccugcg

SEQ ID NO: 384150 - RNA, 17 nt, Bordetella pertussis
ucgaacggccgggcgcc

SEQ ID NO: 384151 - RNA, 14 nt, Bordetella pertussis
ucgaacguccgccc

SEQ ID NO: 384152 - RNA, 21 nt, Bordetella pertussis
ucgaacuccucgacgucgccc

SEQ ID NO: 384153 - RNA, 12 nt, Bordetella pertussis
ucgaacucgccg

SEQ ID NO: 384154 - RNA, 19 nt, Bordetella pertussis
ucgaacugguacagcguga

SEQ ID NO: 384155 - RNA, 14 nt, Bordetella pertussis
ucgaacuugcgcgc

SEQ ID NO: 384156 - RNA, 23 nt, Bordetella pertussis
ucgaagacaugcugcgacagcag

SEQ ID NO: 384157 - RNA, 22 nt, Bordetella pertussis
ucgaagaggguuauuuccggcc

SEQ ID NO: 384158 - RNA, 22 nt, Bordetella pertussis
ucgaagcaggcgguacagcgga

SEQ ID NO: 384159 - RNA, 13 nt, Bordetella pertussis
ucgaagccgggcg

SEQ ID NO: 384160 - RNA, 18 nt, Bordetella pertussis
ucgaagcggcucaggcgc

SEQ ID NO: 384161 - RNA, 20 nt, Bordetella pertussis
ucgaagcggcucaggcgcgg

SEQ ID NO: 384162 - RNA, 14 nt, Bordetella pertussis
ucgaaggcagcgcg

SEQ ID NO: 384163 - RNA, 20 nt, Bordetella pertussis
ucgaaggcagcgcggccggc

SEQ ID NO: 384164 - RNA, 18 nt, Bordetella pertussis
ucgaaggccgccggacgc

SEQ ID NO: 384165 - RNA, 16 nt, Bordetella pertussis
ucgaaggcgccgacgg

SEQ ID NO: 384166 - RNA, 12 nt, Bordetella pertussis
ucgaaggcgcgc

SEQ ID NO: 384167 - RNA, 15 nt, Bordetella pertussis
ucgaaggcggccggc

SEQ ID NO: 384168 - RNA, 17 nt, Bordetella pertussis
ucgaaggcggccggcag

SEQ ID NO: 384169 - RNA, 19 nt, Bordetella pertussis
ucgaaggcggccggcaggc

SEQ ID NO: 384170 - RNA, 17 nt, Bordetella pertussis
ucgacaccaaccugcug

SEQ ID NO: 384171 - RNA, 22 nt, Bordetella pertussis
ucgacaccuacauccuggaugu

SEQ ID NO: 384172 - RNA, 13 nt, Bordetella pertussis
ucgacacggggca

SEQ ID NO: 384173 - RNA, 20 nt, Bordetella pertussis
ucgacacggggcaaccggcc

SEQ ID NO: 384174 - RNA, 20 nt, Bordetella pertussis
ucgacagcaugaacggcagc

SEQ ID NO: 384175 - RNA, 17 nt, Bordetella pertussis
ucgacauagacgcgcag

SEQ ID NO: 384176 - RNA, 20 nt, Bordetella pertussis
ucgacauagagauuguccag

SEQ ID NO: 384177 - RNA, 23 nt, Bordetella pertussis
ucgacauacgcgaugccgaucgc

SEQ ID NO: 384178 - RNA, 17 nt, Bordetella pertussis
ucgacaugcccgccggc

SEQ ID NO: 384179 - RNA, 16 nt, Bordetella pertussis
ucgacaugcuggccca

SEQ ID NO: 384180 - RNA, 13 nt, Bordetella pertussis
ucgaccaccagcg

SEQ ID NO: 384181 - RNA, 22 nt, Bordetella pertussis
ucgaccaccggcuugggcgugc

SEQ ID NO: 384182 - RNA, 14 nt, Bordetella pertussis
ucgaccacgcgcgc

SEQ ID NO: 384183 - RNA, 14 nt, Bordetella pertussis
ucgaccacggcggc

SEQ ID NO: 384184 - RNA, 13 nt, Bordetella pertussis
ucgaccagcgaca

SEQ ID NO: 384185 - RNA, 17 nt, Bordetella pertussis
ucgaccagcgacagcac

SEQ ID NO: 384186 - RNA, 15 nt, Bordetella pertussis
ucgaccagcgcgcgg

SEQ ID NO: 384187 - RNA, 22 nt, Bordetella pertussis
ucgaccagcgcgcggugccgcc

SEQ ID NO: 384188 - RNA, 21 nt, Bordetella pertussis
ucgaccaggaaguugcccacc

SEQ ID NO: 384189 - RNA, 20 nt, Bordetella pertussis
ucgaccaggccggugcgcac

SEQ ID NO: 384190 - RNA, 16 nt, Bordetella pertussis
ucgaccaggucgaagc

SEQ ID NO: 384191 - RNA, 16 nt, Bordetella pertussis
ucgaccauguccgcgc

SEQ ID NO: 384192 - RNA, 17 nt, Bordetella pertussis
ucgaccauguccgcgcc

SEQ ID NO: 384193 - RNA, 17 nt, Bordetella pertussis
ucgacccaggccggcgc

SEQ ID NO: 384194 - RNA, 18 nt, Bordetella pertussis
ucgacccaggccggcgcc

SEQ ID NO: 384195 - RNA, 15 nt, Bordetella pertussis
ucgaccccgucgacc

SEQ ID NO: 384196 - RNA, 18 nt, Bordetella pertussis
ucgacccgaaggcgcggc

SEQ ID NO: 384197 - RNA, 17 nt, Bordetella pertussis
ucgacccgcucggccac

SEQ ID NO: 384198 - RNA, 17 nt, Bordetella pertussis
ucgacccggacaacgcg

SEQ ID NO: 384199 - RNA, 21 nt, Bordetella pertussis
ucgacccggacaacgcgcgcc

SEQ ID NO: 384200 - RNA, 14 nt, Bordetella pertussis
ucgacccgcgccuc

SEQ ID NO: 384201 - RNA, 16 nt, Bordetella pertussis
ucgaccgacagcacau

SEQ ID NO: 384202 - RNA, 18 nt, Bordetella pertussis
ucgaccgccucgacgccc

SEQ ID NO: 384203 - RNA, 11 nt, Bordetella pertussis
ucgaccgcgaa

SEQ ID NO: 384204 - RNA, 16 nt, Bordetella pertussis
ucgaccgcgggcgcgc

SEQ ID NO: 384205 - RNA, 13 nt, Bordetella pertussis
ucgaccggcccgc

SEQ ID NO: 384206 - RNA, 20 nt, Bordetella pertussis
ucgaccugcuugcccagcag

SEQ ID NO: 384207 - RNA, 18 nt, Bordetella pertussis
ucgacgaacacgcgcgcc

SEQ ID NO: 384208 - RNA, 16 nt, Bordetella pertussis
ucgaccuugcugacgc

SEQ ID NO: 384209 - RNA, 21 nt, Bordetella pertussis
ucgacgacggcaagucgacgc

SEQ ID NO: 384210 - RNA, 15 nt, Bordetella pertussis
ucgacgagaugccga

SEQ ID NO: 384211 - RNA, 18 nt, Bordetella pertussis
ucgacgaucucgcggcug

SEQ ID NO: 384212 - RNA, 19 nt, Bordetella pertussis
ucgacgaugcccugcgcca

SEQ ID NO: 384213 - RNA, 19 nt, Bordetella pertussis
ucgacgccaucucgcgcgc

SEQ ID NO: 384214 - RNA, 18 nt, Bordetella pertussis
ucgacgcccgcgcccagu

SEQ ID NO: 384215 - RNA, 20 nt, Bordetella pertussis
ucgacgcgaugcccgcgcac

SEQ ID NO: 384216 - RNA, 20 nt, Bordetella pertussis
ucgacgcgcauuucgaccug

SEQ ID NO: 384217 - RNA, 14 nt, Bordetella pertussis
ucgccaucggccgg

SEQ ID NO: 384218 - RNA, 23 nt, Bordetella pertussis
ucgccaugacgcuggucgagagc

SEQ ID NO: 384219 - RNA, 13 nt, Bordetella pertussis
ucgccaugcggcu

SEQ ID NO: 384220 - RNA, 15 nt, Bordetella pertussis
ucgccaugcggcugg

SEQ ID NO: 384221 - RNA, 14 nt, Bordetella pertussis
ucgcccaacccggc

SEQ ID NO: 384222 - RNA, 20 nt, Bordetella pertussis
ucgcccacauagcggccggc

SEQ ID NO: 384223 - RNA, 20 nt, Bordetella pertussis
ucgcccaccacgccgcccag

SEQ ID NO: 384224 - RNA, 20 nt, Bordetella pertussis
ucgcccacccccggcaccag

SEQ ID NO: 384225 - RNA, 24 nt, Bordetella pertussis
ucgcccagcagauaccggcauggc

SEQ ID NO: 384226 - RNA, 22 nt, Bordetella pertussis
ucgcccagcagguccugcacgc

SEQ ID NO: 384227 - RNA, 21 nt, Bordetella pertussis
ucgcccagcgagccggccagc

SEQ ID NO: 384228 - RNA, 23 nt, Bordetella pertussis
ucgcccagcgcuugcacgccaua

SEQ ID NO: 384229 - RNA, 15 nt, Bordetella pertussis
ucgcccagcggcgcc

SEQ ID NO: 384230 - RNA, 16 nt, Bordetella pertussis
ucgcccagcggcgccg

SEQ ID NO: 384231 - RNA, 19 nt, Bordetella pertussis
ucgcccagcggcgccgacc

SEQ ID NO: 384232 - RNA, 18 nt, Bordetella pertussis
ucgcccgaccugcuggcg

SEQ ID NO: 384233 - RNA, 22 nt, Bordetella pertussis
ucgcccgaccugcuggcgcgca

SEQ ID NO: 384234 - RNA, 16 nt, Bordetella pertussis
ucgcccgaucggccgg

SEQ ID NO: 384235 - RNA, 19 nt, Bordetella pertussis
ucgcccgaucggccggccg

SEQ ID NO: 384236 - RNA, 22 nt, Bordetella pertussis
ucgcccgcgcgguauugcgcca

SEQ ID NO: 384237 - RNA, 14 nt, Bordetella pertussis
ucgcccgcgugcgu

SEQ ID NO: 384238 - RNA, 21 nt, Bordetella pertussis
ucgcccgcgugcgugccgacg

SEQ ID NO: 384239 - RNA, 17 nt, Bordetella pertussis
ucgcccugcucgaucug

SEQ ID NO: 384240 - RNA, 22 nt, Bordetella pertussis
ucgcccugcucgcgcagcgugg

SEQ ID NO: 384241 - RNA, 13 nt, Bordetella pertussis
ucgcccugcuggc

SEQ ID NO: 384242 - RNA, 16 nt, Bordetella pertussis
ucgcccugcuggcgca

SEQ ID NO: 384243 - RNA, 18 nt, Bordetella pertussis
ucgcccuggauggcggcc

SEQ ID NO: 384244 - RNA, 13 nt, Bordetella pertussis
ucgcccuggcgca

SEQ ID NO: 384245 - RNA, 12 nt, Bordetella pertussis
ucgcccuggcgg

SEQ ID NO: 384246 - RNA, 16 nt, Bordetella pertussis
ucgccgaacugccggc

SEQ ID NO: 384247 - RNA, 17 nt, Bordetella pertussis
ucgccgaacugccggcg

SEQ ID NO: 384248 - RNA, 18 nt, Bordetella pertussis
ucgccgaacugccggcgc

SEQ ID NO: 384249 - RNA, 20 nt, Bordetella pertussis
ucgccgaagcaaugcagcgc

SEQ ID NO: 384250 - RNA, 21 nt, Bordetella pertussis
ucgccgaagcaaugcagcgcg

SEQ ID NO: 384251 - RNA, 18 nt, Bordetella pertussis
ucgccgaagucggcgcgc

SEQ ID NO: 384252 - RNA, 19 nt, Bordetella pertussis
ucgccgaccagcucgacgc

SEQ ID NO: 384253 - RNA, 13 nt, Bordetella pertussis
ucgccgacgcgcc

SEQ ID NO: 384254 - RNA, 12 nt, Bordetella pertussis
ucgccgaucggc

SEQ ID NO: 384255 - RNA, 21 nt, Bordetella pertussis
ucgccgaucggcuugccgcgc

SEQ ID NO: 384256 - RNA, 24 nt, Bordetella pertussis
ucgccgaucggcuugccgcgcggc

SEQ ID NO: 384257 - RNA, 21 nt, Bordetella pertussis
ucgccgaugaccagcagcgcc

SEQ ID NO: 384258 - RNA, 18 nt, Bordetella pertussis
ucgccgcgcacagcccga

SEQ ID NO: 384259 - RNA, 23 nt, Bordetella pertussis
ucgccgcgcacagcccgaucgac

SEQ ID NO: 384260 - RNA, 14 nt, Bordetella pertussis
ucgccgcgcacgau

SEQ ID NO: 384261 - RNA, 23 nt, Bordetella pertussis
ucgccgcgcacgggcgccugucc

SEQ ID NO: 384262 - RNA, 19 nt, Bordetella pertussis
ucgccgcgccagcugcgca

SEQ ID NO: 384263 - RNA, 20 nt, Bordetella pertussis
ucgccgcgccagcugcgcag

SEQ ID NO: 384264 - RNA, 12 nt, Bordetella pertussis
ucgccgcgcccg

SEQ ID NO: 384265 - RNA, 23 nt, Bordetella pertussis
ucgccgcgcgacagccgcgccag

SEQ ID NO: 384266 - RNA, 12 nt, Bordetella pertussis
ucgccgcgcgcu

SEQ ID NO: 384267 - RNA, 19 nt, Bordetella pertussis
ucgccgcgcggcgaggcgu

SEQ ID NO: 384268 - RNA, 23 nt, Bordetella pertussis
ucgccgcgcggcgaggcguccag

SEQ ID NO: 384269 - RNA, 14 nt, Bordetella pertussis
ucgccgcggccggc

SEQ ID NO: 384270 - RNA, 19 nt, Bordetella pertussis
ucgccgcggccggcgcagu

SEQ ID NO: 384271 - RNA, 22 nt, Bordetella pertussis
ucgccgcucaggauacgugcug

SEQ ID NO: 384272 - RNA, 16 nt, Bordetella pertussis
ucgccgcuccggcaug

SEQ ID NO: 384273 - RNA, 14 nt, Bordetella pertussis
ucgccgcugcgcag

SEQ ID NO: 384274 - RNA, 13 nt, Bordetella pertussis
ucgccgcuggcca

SEQ ID NO: 384275 - RNA, 14 nt, Bordetella pertussis
ucgccgcugucgca

SEQ ID NO: 384276 - RNA, 23 nt, Bordetella pertussis
ucgccggacacguacaaccgcgc

SEQ ID NO: 384277 - RNA, 15 nt, Bordetella pertussis
ucgccggaggcgcgc

SEQ ID NO: 384278 - RNA, 18 nt, Bordetella pertussis
ucgccggcgaugacggcu

SEQ ID NO: 384279 - RNA, 16 nt, Bordetella pertussis
ucgccggcgcccccag

SEQ ID NO: 384280 - RNA, 12 nt, Bordetella pertussis
ucgccggcgccg

SEQ ID NO: 384281 - RNA, 12 nt, Bordetella pertussis
ucgccggcgcgc

SEQ ID NO: 384282 - RNA, 14 nt, Bordetella pertussis
ucgccggcgcgcag

SEQ ID NO: 384283 - RNA, 17 nt, Bordetella pertussis
ucgccggcgcgcaggca

SEQ ID NO: 384284 - RNA, 16 nt, Bordetella pertussis
ucgccggcggcguggc

SEQ ID NO: 384285 - RNA, 18 nt, Bordetella pertussis
ucgccggcuacggcaagg

SEQ ID NO: 384286 - RNA, 15 nt, Bordetella pertussis
ucgccguccaggcgc

SEQ ID NO: 384287 - RNA, 16 nt, Bordetella pertussis
ucgcgaccaccagguc

SEQ ID NO: 384288 - RNA, 14 nt, Bordetella pertussis
ucgcgaccaccgug

SEQ ID NO: 384289 - RNA, 21 nt, Bordetella pertussis
ucgcgaccgccaagcagaccu

SEQ ID NO: 384290 - RNA, 17 nt, Bordetella pertussis
ucgcgaccugcgggcgc

SEQ ID NO: 384291 - RNA, 22 nt, Bordetella pertussis
ucgcgaccugcgggcgcagcgc

SEQ ID NO: 384292 - RNA, 20 nt, Bordetella pertussis
ucgcgacggccucccgccgc

SEQ ID NO: 384293 - RNA, 15 nt, Bordetella pertussis
ucgcgauccagcagc

SEQ ID NO: 384294 - RNA, 13 nt, Bordetella pertussis
ucgcgaucgucga

SEQ ID NO: 384295 - RNA, 15 nt, Bordetella pertussis
ucgcgaugcgcagca

SEQ ID NO: 384296 - RNA, 22 nt, Bordetella pertussis
ucgcgaugcgcagcagcagcgc

SEQ ID NO: 384297 - RNA, 13 nt, Bordetella pertussis
ucgcgaugcgcca

SEQ ID NO: 384298 - RNA, 20 nt, Bordetella pertussis
ucgcgaugcgccaggcgcuc

SEQ ID NO: 384299 - RNA, 23 nt, Bordetella pertussis
ucgcgaugcgccaggcgcucggc

SEQ ID NO: 384300 - RNA, 23 nt, Bordetella pertussis
ucgcgaugcgucaggggcaugcc

SEQ ID NO: 384301 - RNA, 22 nt, Bordetella pertussis
ucgcgcacggugcgcacgaugg

SEQ ID NO: 384302 - RNA, 14 nt, Bordetella pertussis
ucgcgcagcacgau

SEQ ID NO: 384303 - RNA, 16 nt, Bordetella pertussis
ucgcgcagcacgaugg

SEQ ID NO: 384304 - RNA, 21 nt, Bordetella pertussis
ucgcgcagcacgauggggcca

SEQ ID NO: 384305 - RNA, 14 nt, Bordetella pertussis
ucgcgcagcaggcc

SEQ ID NO: 384306 - RNA, 18 nt, Bordetella pertussis
ucgcgcagcagggccugg

SEQ ID NO: 384307 - RNA, 22 nt, Bordetella pertussis
ucgcgcagcaggguggccacgc

SEQ ID NO: 384308 - RNA, 12 nt, Bordetella pertussis
ucgcgcagcgcc

SEQ ID NO: 384309 - RNA, 13 nt, Bordetella pertussis
ucgcgcagcgccg

SEQ ID NO: 384310 - RNA, 20 nt, Bordetella pertussis
ucgcgcagcgccgccaccuc

SEQ ID NO: 384311 - RNA, 13 nt, Bordetella pertussis
ucgcgcagcgccu

SEQ ID NO: 384312 - RNA, 15 nt, Bordetella pertussis
ucgcgcaugcagcga

SEQ ID NO: 384313 - RNA, 18 nt, Bordetella pertussis
ucgcgcaugcagcgagcg

SEQ ID NO: 384314 - RNA, 17 nt, Bordetella pertussis
ucgcgccagcggccguc

SEQ ID NO: 384315 - RNA, 20 nt, Bordetella pertussis
ucgcgccaggcgccgggccg

SEQ ID NO: 384316 - RNA, 21 nt, Bordetella pertussis
ucgcgccaggcgccgggccgc

SEQ ID NO: 384317 - RNA, 20 nt, Bordetella pertussis
ucgcgccaggccccgccggg

SEQ ID NO: 384318 - RNA, 19 nt, Bordetella pertussis
ucgcgcccaucucggccgc

SEQ ID NO: 384319 - RNA, 22 nt, Bordetella pertussis
ucgcgcccaucucggccgcggc

SEQ ID NO: 384320 - RNA, 15 nt, Bordetella pertussis
ucgcgcccagcgagc

SEQ ID NO: 384321 - RNA, 15 nt, Bordetella pertussis
ucgcgcccgagcgcc

SEQ ID NO: 384322 - RNA, 16 nt, Bordetella pertussis
ucgcgcgccaggugca

SEQ ID NO: 384323 - RNA, 14 nt, Bordetella pertussis
ucgcgcgcgccggc

SEQ ID NO: 384324 - RNA, 22 nt, Bordetella pertussis
ucgcgcgcgccugccccgccug

SEQ ID NO: 384325 - RNA, 14 nt, Bordetella pertussis
ucgcgcgcgcggau

SEQ ID NO: 384326 - RNA, 16 nt, Bordetella pertussis
ucgcgcgcgcgggcgc

SEQ ID NO: 384327 - RNA, 18 nt, Bordetella pertussis
ucgcgcgcgcgggcgcgc

SEQ ID NO: 384328 - RNA, 19 nt, Bordetella pertussis
ucgcgcgcgcgggcgcgca

SEQ ID NO: 384329 - RNA, 14 nt, Bordetella pertussis
ucgcgcgccggcag

SEQ ID NO: 384330 - RNA, 20 nt, Bordetella pertussis
ucgcgcgccggcagggcggc

SEQ ID NO: 384331 - RNA, 13 nt, Bordetella pertussis
ucgcgcgcggggu

SEQ ID NO: 384332 - RNA, 14 nt, Bordetella pertussis
ucgcggaugcgcgc

SEQ ID NO: 384333 - RNA, 18 nt, Bordetella pertussis
ucgcggaugcgcgccuug

SEQ ID NO: 384334 - RNA, 19 nt, Bordetella pertussis
ucgcggaugucaguuucca

SEQ ID NO: 384335 - RNA, 22 nt, Bordetella pertussis
ucgcggcacgaaaagccgcggc

SEQ ID NO: 384336 - RNA, 18 nt, Bordetella pertussis
ucgcggcccacggccagc

SEQ ID NO: 384337 - RNA, 12 nt, Bordetella pertussis
ucgcggccgagc

SEQ ID NO: 384338 - RNA, 21 nt, Bordetella pertussis
ucgcggccgaggccagcgugc

SEQ ID NO: 384339 - RNA, 14 nt, Bordetella pertussis
ucgcggccgucggc

SEQ ID NO: 384340 - RNA, 12 nt, Bordetella pertussis
ucgcggcgcggc

SEQ ID NO: 384341 - RNA, 16 nt, Bordetella pertussis
ucgcggcgcggcgcag

SEQ ID NO: 384342 - RNA, 18 nt, Bordetella pertussis
ucgcggcgcggcgcaggc

SEQ ID NO: 384343 - RNA, 19 nt, Bordetella pertussis
ucgcggcgcggcgcaggcc

SEQ ID NO: 384344 - RNA, 20 nt, Bordetella pertussis
ucgcggcgucgaccgcgggc

SEQ ID NO: 384345 - RNA, 19 nt, Bordetella pertussis
ucgcggcugguggugccgc

SEQ ID NO: 384346 - RNA, 23 nt, Bordetella pertussis
ucgcggcugguggugccgcgcac

SEQ ID NO: 384347 - RNA, 15 nt, Bordetella pertussis
ucgcggcugggcaau

SEQ ID NO: 384348 - RNA, 17 nt, Bordetella pertussis
ucgcgggcccgcucggc

SEQ ID NO: 384349 - RNA, 21 nt, Bordetella pertussis
ucgcgggccuuggccagcagc

SEQ ID NO: 384350 - RNA, 17 nt, Bordetella pertussis
ucgcgguauucggcgac

SEQ ID NO: 384351 - RNA, 20 nt, Bordetella pertussis
ucgcgguccagcaccagggc

SEQ ID NO: 384352 - RNA, 20 nt, Bordetella pertussis
ucgcggugcaagcggccggc

SEQ ID NO: 384353 - RNA, 13 nt, Bordetella pertussis
ucgcggugcgcca

SEQ ID NO: 384354 - RNA, 18 nt, Bordetella pertussis
ucgcggugggcagcggca

SEQ ID NO: 384355 - RNA, 20 nt, Bordetella pertussis
ucgcggugggcagcggcauc

SEQ ID NO: 384356 - RNA, 20 nt, Bordetella pertussis
ucgcgguucaggguggccgc

SEQ ID NO: 384357 - RNA, 17 nt, Bordetella pertussis
ucgcguccaggcccagc

SEQ ID NO: 384358 - RNA, 20 nt, Bordetella pertussis
ucgcguccgcucaugccggc

SEQ ID NO: 384359 - RNA, 20 nt, Bordetella pertussis
ucgcgucgacggugcgcgcc

SEQ ID NO: 384360 - RNA, 16 nt, Bordetella pertussis
ucgcgucggccaaggc

SEQ ID NO: 384361 - RNA, 17 nt, Bordetella pertussis
ucgcuccuccccaacgg

SEQ ID NO: 384362 - RNA, 13 nt, Bordetella pertussis
ucgcucggcgucc

SEQ ID NO: 384363 - RNA, 18 nt, Bordetella pertussis
ucgcucugcgcggcauac

SEQ ID NO: 384364 - RNA, 12 nt, Bordetella pertussis
ucgcugaccggc

SEQ ID NO: 384365 - RNA, 23 nt, Bordetella pertussis
ucgcugaccggcguauggcccgc

SEQ ID NO: 384366 - RNA, 15 nt, Bordetella pertussis
ucgcuguucggggca

SEQ ID NO: 384367 - RNA, 14 nt, Bordetella pertussis
ucgcuuucgguggc

SEQ ID NO: 384368 - RNA, 19 nt, Bordetella pertussis
ucggaaacacguccagcgc

SEQ ID NO: 384369 - RNA, 19 nt, Bordetella pertussis
ucggaaacagguucacgcc

SEQ ID NO: 384370 - RNA, 16 nt, Bordetella pertussis
ucggaagacauggcgc

SEQ ID NO: 384371 - RNA, 16 nt, Bordetella pertussis
ucggcaaccugcacgc

SEQ ID NO: 384372 - RNA, 17 nt, Bordetella pertussis
ucggcaaccugcacgcg

SEQ ID NO: 384373 - RNA, 14 nt, Bordetella pertussis
ucggcaaggcgcac

SEQ ID NO: 384374 - RNA, 17 nt, Bordetella pertussis
ucggcagcgaggcgcgg

SEQ ID NO: 384375 - RNA, 15 nt, Bordetella pertussis
ucggcaggccggcgc

SEQ ID NO: 384376 - RNA, 16 nt, Bordetella pertussis
ucggccaacggcuggc

SEQ ID NO: 384377 - RNA, 19 nt, Bordetella pertussis
ucggccaaggccggcgcgu

SEQ ID NO: 384378 - RNA, 15 nt, Bordetella pertussis
ucggccacccggccc

SEQ ID NO: 384379 - RNA, 16 nt, Bordetella pertussis
ucggccaccuggcgca

SEQ ID NO: 384380 - RNA, 14 nt, Bordetella pertussis
ucggccaccugguc

SEQ ID NO: 384381 - RNA, 18 nt, Bordetella pertussis
ucggccacgcgcaacgcc

SEQ ID NO: 384382 - RNA, 21 nt, Bordetella pertussis
ucggccacgcucacgcccgug

SEQ ID NO: 384383 - RNA, 15 nt, Bordetella pertussis
ucggccacggcugga

SEQ ID NO: 384384 - RNA, 15 nt, Bordetella pertussis
ucggccacggucggc

SEQ ID NO: 384385 - RNA, 16 nt, Bordetella pertussis
ucggccagcggcaggc

SEQ ID NO: 384386 - RNA, 17 nt, Bordetella pertussis
ucggccacgucggcggc

SEQ ID NO: 384387 - RNA, 18 nt, Bordetella pertussis
ucggccaggaaagccggc

SEQ ID NO: 384388 - RNA, 23 nt, Bordetella pertussis
ucggccaggacggugucgcugac

SEQ ID NO: 384389 - RNA, 21 nt, Bordetella pertussis
ucggccaggccauggcgcgau

SEQ ID NO: 384390 - RNA, 20 nt, Bordetella pertussis
ucggccaggccgaugaauug

SEQ ID NO: 384391 - RNA, 14 nt, Bordetella pertussis
ucggccaggccggc

SEQ ID NO: 384392 - RNA, 22 nt, Bordetella pertussis
ucggccaggccggccugcaggc

SEQ ID NO: 384393 - RNA, 17 nt, Bordetella pertussis
ucggccagggaggcgau

SEQ ID NO: 384394 - RNA, 15 nt, Bordetella pertussis
ucggccaggcgcugc

SEQ ID NO: 384395 - RNA, 14 nt, Bordetella pertussis
ucggccagggcggc

SEQ ID NO: 384396 - RNA, 15 nt, Bordetella pertussis
ucggccaggugcgcc

SEQ ID NO: 384397 - RNA, 12 nt, Bordetella pertussis
ucggccgccggc

SEQ ID NO: 384398 - RNA, 16 nt, Bordetella pertussis
ucggccgccggcgaga

SEQ ID NO: 384399 - RNA, 14 nt, Bordetella pertussis
ucggccgcgcccag

SEQ ID NO: 384400 - RNA, 13 nt, Bordetella pertussis
ucggccgcgccgc

SEQ ID NO: 384401 - RNA, 13 nt, Bordetella pertussis
ucggccgcgucga

SEQ ID NO: 384402 - RNA, 23 nt, Bordetella pertussis
ucggccggcagcgcgaccggcgc

SEQ ID NO: 384403 - RNA, 13 nt, Bordetella pertussis
ucggccggcggcc

SEQ ID NO: 384404 - RNA, 17 nt, Bordetella pertussis
ucggccggcggcccauc

SEQ ID NO: 384405 - RNA, 17 nt, Bordetella pertussis
ucggccggcggucgcgc

SEQ ID NO: 384406 - RNA, 20 nt, Bordetella pertussis
ucggccgggccgggcacgau

SEQ ID NO: 384407 - RNA, 20 nt, Bordetella pertussis
ucggccgucagcagcaggcu

SEQ ID NO: 384408 - RNA, 21 nt, Bordetella pertussis
ucggccucccgucgucgucca

SEQ ID NO: 384409 - RNA, 15 nt, Bordetella pertussis
ucggccucgcggcgc

SEQ ID NO: 384410 - RNA, 14 nt, Bordetella pertussis
ucggccucgcuggc

SEQ ID NO: 384411 - RNA, 19 nt, Bordetella pertussis
ucggccucgguggucaggu

SEQ ID NO: 384412 - RNA, 20 nt, Bordetella pertussis
ucggccugaaccaggccgcc

SEQ ID NO: 384413 - RNA, 22 nt, Bordetella pertussis
ucggccugaaccaggccgccag

SEQ ID NO: 384414 - RNA, 14 nt, Bordetella pertussis
ucggccugcacgcu

SEQ ID NO: 384415 - RNA, 13 nt, Bordetella pertussis
ucggccugcaggc

SEQ ID NO: 384416 - RNA, 22 nt, Bordetella pertussis
ucggccugccaccagcgcgcca

SEQ ID NO: 384417 - RNA, 23 nt, Bordetella pertussis
ucggccugccaccagcgcgccag

SEQ ID NO: 384418 - RNA, 15 nt, Bordetella pertussis
ucggccugccggcgc

SEQ ID NO: 384419 - RNA, 17 nt, Bordetella pertussis
ucggccugccggcgcgc

SEQ ID NO: 384420 - RNA, 18 nt, Bordetella pertussis
ucggcgaacugggcgucg

SEQ ID NO: 384421 - RNA, 19 nt, Bordetella pertussis
ucggcgaagccgcagcggc

SEQ ID NO: 384422 - RNA, 22 nt, Bordetella pertussis
ucggcgaagccgcagcggcagc

SEQ ID NO: 384423 - RNA, 16 nt, Bordetella pertussis
ucggcgaagugcccgc

SEQ ID NO: 384424 - RNA, 13 nt, Bordetella pertussis
ucggcgaccgccg

SEQ ID NO: 384425 - RNA, 15 nt, Bordetella pertussis
ucggcgagccgggca

SEQ ID NO: 384426 - RNA, 21 nt, Bordetella pertussis
ucggcgagccgggcaccgagc

SEQ ID NO: 384427 - RNA, 14 nt, Bordetella pertussis
ucggcgcccgcggc

SEQ ID NO: 384428 - RNA, 16 nt, Bordetella pertussis
ucggcgcccgcggccu

SEQ ID NO: 384429 - RNA, 14 nt, Bordetella pertussis
ucggcgccgagcag

SEQ ID NO: 384430 - RNA, 14 nt, Bordetella pertussis
ucggcgccgccggc

SEQ ID NO: 384431 - RNA, 19 nt, Bordetella pertussis
ucggcgcuggccuggccgc

SEQ ID NO: 384432 - RNA, 23 nt, Bordetella pertussis
ucggcgcuggccuggccgccggc

SEQ ID NO: 384433 - RNA, 16 nt, Bordetella pertussis
ucggcgcugggcgcau

SEQ ID NO: 384434 - RNA, 18 nt, Bordetella pertussis
ucggcggccagcagcggc

SEQ ID NO: 384435 - RNA, 18 nt, Bordetella pertussis
ucggcggccagccggcgc

SEQ ID NO: 384436 - RNA, 14 nt, Bordetella pertussis
ucggcggccagcgc

SEQ ID NO: 384437 - RNA, 15 nt, Bordetella pertussis
ucggcggcgcccauc

SEQ ID NO: 384438 - RNA, 22 nt, Bordetella pertussis
ucggcggcgucgcuggcagccu

SEQ ID NO: 384439 - RNA, 24 nt, Bordetella pertussis
ucggcggcgucgcuggcagccuug

SEQ ID NO: 384440 - RNA, 17 nt, Bordetella pertussis
ucggcgggcggcgccag

SEQ ID NO: 384441 - RNA, 20 nt, Bordetella pertussis
ucggcggguuucucggccuu

SEQ ID NO: 384442 - RNA, 14 nt, Bordetella pertussis
ucggcggucagcgc

SEQ ID NO: 384443 - RNA, 22 nt, Bordetella pertussis
ucggcguaaggccgccggccac

SEQ ID NO: 384444 - RNA, 21 nt, Bordetella pertussis
ucggcguaccaggcagccggc

SEQ ID NO: 384445 - RNA, 19 nt, Bordetella pertussis
ucggcguauugcuccacag

SEQ ID NO: 384446 - RNA, 19 nt, Bordetella pertussis
ucggcguccucgcgguccu

SEQ ID NO: 384447 - RNA, 22 nt, Bordetella pertussis
ucggcgucgaaugcacgggcgc

SEQ ID NO: 384448 - RNA, 17 nt, Bordetella pertussis
ucggcguuccuggcgcu

SEQ ID NO: 384449 - RNA, 23 nt, Bordetella pertussis
ucgggguucuccuugagcacguc

SEQ ID NO: 384450 - RNA, 16 nt, Bordetella pertussis
ucgguauggcggcaac

SEQ ID NO: 384451 - RNA, 13 nt, Bordetella pertussis
ucggugacggcgu

SEQ ID NO: 384452 - RNA, 15 nt, Bordetella pertussis
ucggugagcggcacg

SEQ ID NO: 384453 - RNA, 22 nt, Bordetella pertussis
ucggugcaaugcccaguucguc

SEQ ID NO: 384454 - RNA, 16 nt, Bordetella pertussis
ucggugccuguccccg

SEQ ID NO: 384455 - RNA, 21 nt, Bordetella pertussis
ucggugccuguucccgccggg

SEQ ID NO: 384456 - RNA, 13 nt, Bordetella pertussis
ucgguggcgcgca

SEQ ID NO: 384457 - RNA, 19 nt, Bordetella pertussis
ucgguggucaacggcaaga

SEQ ID NO: 384458 - RNA, 15 nt, Bordetella pertussis
ucguaaacaucgcgc

SEQ ID NO: 384459 - RNA, 17 nt, Bordetella pertussis
ucguacacaugcuugcc

SEQ ID NO: 384460 - RNA, 20 nt, Bordetella pertussis
ucguacagcgccugcgcggc

SEQ ID NO: 384461 - RNA, 16 nt, Bordetella pertussis
ucguacgagccgacgc

SEQ ID NO: 384462 - RNA, 16 nt, Bordetella pertussis
ucguccaucgccugca

SEQ ID NO: 384463 - RNA, 18 nt, Bordetella pertussis
ucgucccagggggucagg

SEQ ID NO: 384464 - RNA, 22 nt, Bordetella pertussis
ucguccccaauacccgccacag

SEQ ID NO: 384465 - RNA, 17 nt, Bordetella pertussis
ucguccccacggggacu

SEQ ID NO: 384466 - RNA, 19 nt, Bordetella pertussis
ucguccccacggggacugg

SEQ ID NO: 384467 - RNA, 23 nt, Bordetella pertussis
ucguccccacggggacuggcucc

SEQ ID NO: 384468 - RNA, 21 nt, Bordetella pertussis
ucgucccagcgcacgcagcgc

SEQ ID NO: 384469 - RNA, 14 nt, Bordetella pertussis
ucguccggcgcguc

SEQ ID NO: 384470 - RNA, 19 nt, Bordetella pertussis
ucguccguggccggcgcgg

SEQ ID NO: 384471 - RNA, 20 nt, Bordetella pertussis
ucguccguggccggcgcggc

SEQ ID NO: 384472 - RNA, 21 nt, Bordetella pertussis
ucguccguuucgucggcgcgc

SEQ ID NO: 384473 - RNA, 16 nt, Bordetella pertussis
ucguccucggccacgu

SEQ ID NO: 384474 - RNA, 20 nt, Bordetella pertussis
ucguccucggccacgucggc

SEQ ID NO: 384475 - RNA, 24 nt, Bordetella pertussis
ucgucgagcacuucgagcgacggc

SEQ ID NO: 384476 - RNA, 17 nt, Bordetella pertussis
ucgucgaggaugcgagc

SEQ ID NO: 384477 - RNA, 18 nt, Bordetella pertussis
ucgucgaucauggcgccg

SEQ ID NO: 384478 - RNA, 23 nt, Bordetella pertussis
ucgucgccaugcggcuggccgau

SEQ ID NO: 384479 - RNA, 13 nt, Bordetella pertussis
ucgucgcgcaugg

SEQ ID NO: 384480 - RNA, 13 nt, Bordetella pertussis
ucgucgcggaagc

SEQ ID NO: 384481 - RNA, 15 nt, Bordetella pertussis
ucgucgccggcgcug

SEQ ID NO: 384482 - RNA, 14 nt, Bordetella pertussis
ucgucgcggccguu

SEQ ID NO: 384483 - RNA, 18 nt, Bordetella pertussis
ucgucgcgguccagcacc

SEQ ID NO: 384484 - RNA, 16 nt, Bordetella pertussis
ucgucgcugccgcgcg

SEQ ID NO: 384485 - RNA, 20 nt, Bordetella pertussis
ucgucggcaccuucgcgcag

SEQ ID NO: 384486 - RNA, 11 nt, Bordetella pertussis
ucgucgguggg

SEQ ID NO: 384487 - RNA, 22 nt, Bordetella pertussis
ucgucgucaugauguagcccau

SEQ ID NO: 384488 - RNA, 16 nt, Bordetella pertussis
ucguggucgugcuggc

SEQ ID NO: 384489 - RNA, 14 nt, Bordetella pertussis
ucguguagggccug

SEQ ID NO: 384490 - RNA, 14 nt, Bordetella pertussis
ucguguucgcggcc

SEQ ID NO: 384491 - RNA, 15 nt, Bordetella pertussis
ucguucacgcccgag

SEQ ID NO: 384492 - RNA, 22 nt, Bordetella pertussis
ucguuccagaugcgcagcaggc

SEQ ID NO: 384493 - RNA, 18 nt, Bordetella pertussis
ucguucgaaguccgcgcg

SEQ ID NO: 384494 - RNA, 14 nt, Bordetella pertussis
ucguucugcgcgcc

SEQ ID NO: 384495 - RNA, 14 nt, Bordetella pertussis
ucguugacgccgac

SEQ ID NO: 384496 - RNA, 21 nt, Bordetella pertussis
ucguugccccgauccgcgggc

SEQ ID NO: 384497 - RNA, 15 nt, Bordetella pertussis
ucguugccggccagc

SEQ ID NO: 384498 - RNA, 14 nt, Bordetella pertussis
ucuacgcgcgcgcc

SEQ ID NO: 384499 - RNA, 16 nt, Bordetella pertussis
ucuaucugccgcgcau

SEQ ID NO: 384500 - RNA, 18 nt, Bordetella pertussis
ucucagcgcgccgcgccg

SEQ ID NO: 384501 - RNA, 18 nt, Bordetella pertussis
ucuccgguucggcgcggc

SEQ ID NO: 384502 - RNA, 19 nt, Bordetella pertussis
ucuccgugcaucggcacgg

SEQ ID NO: 384503 - RNA, 14 nt, Bordetella pertussis
ucucgaugcgcgcc

SEQ ID NO: 384504 - RNA, 15 nt, Bordetella pertussis
ucucgaugcgcgcca

SEQ ID NO: 384505 - RNA, 16 nt, Bordetella pertussis
ucucgaugcgcgccac

SEQ ID NO: 384506 - RNA, 23 nt, Bordetella pertussis
ucucgcaagugcuggcccgccag

SEQ ID NO: 384507 - RNA, 19 nt, Bordetella pertussis
ucucgcccugcucgcgcag

SEQ ID NO: 384508 - RNA, 19 nt, Bordetella pertussis
ucucgcgcaggguggcauc

SEQ ID NO: 384509 - RNA, 13 nt, Bordetella pertussis
ucucgcgcgccag

SEQ ID NO: 384510 - RNA, 18 nt, Bordetella pertussis
ucucgcgcgcgcggucca

SEQ ID NO: 384511 - RNA, 21 nt, Bordetella pertussis
ucucggcaucggccacgcugc

SEQ ID NO: 384512 - RNA, 13 nt, Bordetella pertussis
ucucggccagcag

SEQ ID NO: 384513 - RNA, 17 nt, Bordetella pertussis
ucucggccagcagcgcc

SEQ ID NO: 384514 - RNA, 14 nt, Bordetella pertussis
ucucggccagcgcc

SEQ ID NO: 384515 - RNA, 19 nt, Bordetella pertussis
ucucggccucgcggcgcag

SEQ ID NO: 384516 - RNA, 24 nt, Bordetella pertussis
ucucgggcaggucggccagcgugc

SEQ ID NO: 384517 - RNA, 15 nt, Bordetella pertussis
ucucguccgauggcg

SEQ ID NO: 384518 - RNA, 15 nt, Bordetella pertussis
ucucguuccagaugc

SEQ ID NO: 384519 - RNA, 13 nt, Bordetella pertussis
ucucuccgaacgc

SEQ ID NO: 384520 - RNA, 21 nt, Bordetella pertussis
ucugcaagguggcgugcagca

SEQ ID NO: 384521 - RNA, 16 nt, Bordetella pertussis
ucugcaccggcgccac

SEQ ID NO: 384522 - RNA, 17 nt, Bordetella pertussis
ucugcaccugcguggcc

SEQ ID NO: 384523 - RNA, 18 nt, Bordetella pertussis
ucugcaccugcguggccu

SEQ ID NO: 384524 - RNA, 19 nt, Bordetella pertussis
ucugcaccuuguacugguc

SEQ ID NO: 384525 - RNA, 23 nt, Bordetella pertussis
ucugcaccuuguacuggucgcgc

SEQ ID NO: 384526 - RNA, 18 nt, Bordetella pertussis
ucugcacgccgggcgcgc

SEQ ID NO: 384527 - RNA, 11 nt, Bordetella pertussis
ucugcagcgcg

SEQ ID NO: 384528 - RNA, 19 nt, Bordetella pertussis
ucugccgcugaccggcggc

SEQ ID NO: 384529 - RNA, 23 nt, Bordetella pertussis
ucugccgguaaccgacgcagcgc

SEQ ID NO: 384530 - RNA, 14 nt, Bordetella pertussis
ucugcgagccguag

SEQ ID NO: 384531 - RNA, 20 nt, Bordetella pertussis
ucugcgagccuucggccggc

SEQ ID NO: 384532 - RNA, 23 nt, Bordetella pertussis
ucugcgagccuucggccggcugc

SEQ ID NO: 384533 - RNA, 19 nt, Bordetella pertussis
ucugcgcaucgaugcggcc

SEQ ID NO: 384534 - RNA, 13 nt, Bordetella pertussis
ucugcgccgccgc

SEQ ID NO: 384535 - RNA, 22 nt, Bordetella pertussis
ucugcgccgccgcguggcggcg

SEQ ID NO: 384536 - RNA, 16 nt, Bordetella pertussis
ucugcgccugcugguc

SEQ ID NO: 384537 - RNA, 16 nt, Bordetella pertussis
ucugcgcguucauguc

SEQ ID NO: 384538 - RNA, 12 nt, Bordetella pertussis
ucugcggcgugg

SEQ ID NO: 384539 - RNA, 13 nt, Bordetella pertussis
ucugcgugcgcgg

SEQ ID NO: 384540 - RNA, 18 nt, Bordetella pertussis
ucugcgugugccgccagc

SEQ ID NO: 384541 - RNA, 23 nt, Bordetella pertussis
ucugcucgccgcgcgacagccgc

SEQ ID NO: 384542 - RNA, 17 nt, Bordetella pertussis
ucuggacuugcggcacg

SEQ ID NO: 384543 - RNA, 15 nt, Bordetella pertussis
ucuggaucgcgccca

SEQ ID NO: 384544 - RNA, 16 nt, Bordetella pertussis
ucuggcacaccagcgc

SEQ ID NO: 384545 - RNA, 17 nt, Bordetella pertussis
ucuggcacaccagcgcc

SEQ ID NO: 384546 - RNA, 19 nt, Bordetella pertussis
ucuggcacaccagcgccag

SEQ ID NO: 384547 - RNA, 24 nt, Bordetella pertussis
ucuggccgauggccucgcugccag

SEQ ID NO: 384548 - RNA, 18 nt, Bordetella pertussis
ucuggccggccgcguuca

SEQ ID NO: 384549 - RNA, 23 nt, Bordetella pertussis
ucuggcgcagcaaggcgcgccac

SEQ ID NO: 384550 - RNA, 16 nt, Bordetella pertussis
ucuggcugcgcgccug

SEQ ID NO: 384551 - RNA, 15 nt, Bordetella pertussis
ucugggccagcaggc

SEQ ID NO: 384552 - RNA, 13 nt, Bordetella pertussis
ucugguccugggc

SEQ ID NO: 384553 - RNA, 22 nt, Bordetella pertussis
ucuggugggcauagcgcgccac

SEQ ID NO: 384554 - RNA, 20 nt, Bordetella pertussis
ucuguccccgcggggacagg

SEQ ID NO: 384555 - RNA, 18 nt, Bordetella pertussis
ucugugcgccccgcuggc

SEQ ID NO: 384556 - RNA, 14 nt, Bordetella pertussis
ucuuccagcagggc

SEQ ID NO: 384557 - RNA, 22 nt, Bordetella pertussis
ucuuccucccagaccugcgcgc

SEQ ID NO: 384558 - RNA, 15 nt, Bordetella pertussis
ucuucgacagcgcgc

SEQ ID NO: 384559 - RNA, 15 nt, Bordetella pertussis
ucuucgaugcuggcg

SEQ ID NO: 384560 - RNA, 17 nt, Bordetella pertussis
ucuucggcgcggcgggc

SEQ ID NO: 384561 - RNA, 22 nt, Bordetella pertussis
ucuucgggauuucgcuggccau

SEQ ID NO: 384562 - RNA, 23 nt, Bordetella pertussis
ucuucgggauuucgcuggccauc

SEQ ID NO: 384563 - RNA, 16 nt, Bordetella pertussis
ucuucgugcuggccau

SEQ ID NO: 384564 - RNA, 18 nt, Bordetella pertussis
ucuucuuugcccuggcca

SEQ ID NO: 384565 - RNA, 16 nt, Bordetella pertussis
ucuugaccagcaggcc

SEQ ID NO: 384566 - RNA, 15 nt, Bordetella pertussis
ucuugagaauggcgc

SEQ ID NO: 384567 - RNA, 16 nt, Bordetella pertussis
ucuugagcgcggccuc

SEQ ID NO: 384568 - RNA, 12 nt, Bordetella pertussis
ucuugaugcggc

SEQ ID NO: 384569 - RNA, 15 nt, Bordetella pertussis
ucuugcaggcgccag

SEQ ID NO: 384570 - RNA, 12 nt, Bordetella pertussis
ucuugccgcgca

SEQ ID NO: 384571 - RNA, 13 nt, Bordetella pertussis
ucuugccgcgcag

SEQ ID NO: 384572 - RNA, 23 nt, Bordetella pertussis
ucuugcgcuggaucccggcgauc

SEQ ID NO: 384573 - RNA, 13 nt, Bordetella pertussis
ucuuggccgucaa

SEQ ID NO: 384574 - RNA, 22 nt, Bordetella pertussis
ucuuggugaaaucccccgccac

SEQ ID NO: 384575 - RNA, 20 nt, Bordetella pertussis
ugaacaccaggguggcgccg

SEQ ID NO: 384576 - RNA, 15 nt, Bordetella pertussis
ugaacaccggcgcgc

SEQ ID NO: 384577 - RNA, 12 nt, Bordetella pertussis
ugaacagccgcc

SEQ ID NO: 384578 - RNA, 22 nt, Bordetella pertussis
ugaacagccgccccagcagcag

SEQ ID NO: 384579 - RNA, 20 nt, Bordetella pertussis
ugaacagcuggaagcgcgcc

SEQ ID NO: 384580 - RNA, 22 nt, Bordetella pertussis
ugaacagcuggaagcgcgccag

SEQ ID NO: 384581 - RNA, 15 nt, Bordetella pertussis
ugaacgccgcgcccg

SEQ ID NO: 384582 - RNA, 16 nt, Bordetella pertussis
ugaacgcguccaggcc

SEQ ID NO: 384583 - RNA, 22 nt, Bordetella pertussis
ugaacggccccgccagggcggg

SEQ ID NO: 384584 - RNA, 20 nt, Bordetella pertussis
ugaacggcagcgcgcgcgug

SEQ ID NO: 384585 - RNA, 19 nt, Bordetella pertussis
ugaacguggcguccacgcg

SEQ ID NO: 384586 - RNA, 14 nt, Bordetella pertussis
ugaacuauggcgcg

SEQ ID NO: 384587 - RNA, 16 nt, Bordetella pertussis
ugaacucggccagcag

SEQ ID NO: 384588 - RNA, 16 nt, Bordetella pertussis
ugaagcccgagcggcg

SEQ ID NO: 384589 - RNA, 20 nt, Bordetella pertussis
ugaagcccgagcggcgccag

SEQ ID NO: 384590 - RNA, 22 nt, Bordetella pertussis
ugaagccguccuugagggcgcg

SEQ ID NO: 384591 - RNA, 22 nt, Bordetella pertussis
ugaagcggucgauguccagcgc

SEQ ID NO: 384592 - RNA, 15 nt, Bordetella pertussis
ugacguugccgcgcg

SEQ ID NO: 384593 - RNA, 18 nt, Bordetella pertussis
ugacguugccgcgcgcgu

SEQ ID NO: 384594 - RNA, 21 nt, Bordetella pertussis
ugagaaaagugaucaccgcca

SEQ ID NO: 384595 - RNA, 14 nt, Bordetella pertussis
ugagaauggcgcgg

SEQ ID NO: 384596 - RNA, 15 nt, Bordetella pertussis
ugagaauggcgcggu

SEQ ID NO: 384597 - RNA, 14 nt, Bordetella pertussis
ugagaucgcccgcg

SEQ ID NO: 384598 - RNA, 22 nt, Bordetella pertussis
ugagaucgcccgcgugcgugcc

SEQ ID NO: 384599 - RNA, 15 nt, Bordetella pertussis
ugagauugugcagca

SEQ ID NO: 384600 - RNA, 22 nt, Bordetella pertussis
ugagcaccacguccuggggcgc

SEQ ID NO: 384601 - RNA, 14 nt, Bordetella pertussis
ugagcccgaugccg

SEQ ID NO: 384602 - RNA, 15 nt, Bordetella pertussis
ugagcccgaugccgc

SEQ ID NO: 384603 - RNA, 16 nt, Bordetella pertussis
ugagccgauacaggcg

SEQ ID NO: 384604 - RNA, 17 nt, Bordetella pertussis
ugagccgauacaggcgc

SEQ ID NO: 384605 - RNA, 18 nt, Bordetella pertussis
ugaggaacggcaccagcc

SEQ ID NO: 384606 - RNA, 13 nt, Bordetella pertussis
ugaggaugcgcgc

SEQ ID NO: 384607 - RNA, 21 nt, Bordetella pertussis
ugaggccagcacgccggccag

SEQ ID NO: 384608 - RNA, 14 nt, Bordetella pertussis
ugaggcccgauggc

SEQ ID NO: 384609 - RNA, 14 nt, Bordetella pertussis
ugaucaccgccaug

SEQ ID NO: 384610 - RNA, 14 nt, Bordetella pertussis
ugaucaccgccggu

SEQ ID NO: 384611 - RNA, 19 nt, Bordetella pertussis
ugaucagggccgccagggc

SEQ ID NO: 384612 - RNA, 23 nt, Bordetella pertussis
ugaucagggccgccagggcggcu

SEQ ID NO: 384613 - RNA, 16 nt, Bordetella pertussis
ugaucagggccgugcc

SEQ ID NO: 384614 - RNA, 20 nt, Bordetella pertussis
ugaucagggccgugcccgag

SEQ ID NO: 384615 - RNA, 23 nt, Bordetella pertussis
ugaucagguccaugaacgccgcg

SEQ ID NO: 384616 - RNA, 15 nt, Bordetella pertussis
ugaugagcgcgccgc

SEQ ID NO: 384617 - RNA, 23 nt, Bordetella pertussis
ugaugagguaggugaacgacagc

SEQ ID NO: 384618 - RNA, 19 nt, Bordetella pertussis
ugaugaucggcgccaugau

SEQ ID NO: 384619 - RNA, 14 nt, Bordetella pertussis
ugaugcaggccugc

SEQ ID NO: 384620 - RNA, 21 nt, Bordetella pertussis
ugaugcaggcggucgaggcgc

SEQ ID NO: 384621 - RNA, 13 nt, Bordetella pertussis
ugaugcccagcuc

SEQ ID NO: 384622 - RNA, 15 nt, Bordetella pertussis
ugaugcccagcucau

SEQ ID NO: 384623 - RNA, 18 nt, Bordetella pertussis
ugaugcccagcucauggc

SEQ ID NO: 384624 - RNA, 13 nt, Bordetella pertussis
ugaugcccagcgc

SEQ ID NO: 384625 - RNA, 23 nt, Bordetella pertussis
ugaugcccaugcgcugcgccuug

SEQ ID NO: 384626 - RNA, 18 nt, Bordetella pertussis
ugaugcccuucggcaugc

SEQ ID NO: 384627 - RNA, 21 nt, Bordetella pertussis
ugaugcccuucggcaugcugc

SEQ ID NO: 384628 - RNA, 13 nt, Bordetella pertussis
ugaugccgaccag

SEQ ID NO: 384629 - RNA, 20 nt, Bordetella pertussis
ugaugccgaccaggcccgcc

SEQ ID NO: 384630 - RNA, 21 nt, Bordetella pertussis
ugaugccguaccaggugcgca

SEQ ID NO: 384631 - RNA, 15 nt, Bordetella pertussis
ugaugccugucccgc

SEQ ID NO: 384632 - RNA, 17 nt, Bordetella pertussis
ugauggauucgcgccgg

SEQ ID NO: 384633 - RNA, 17 nt, Bordetella pertussis
ugauggauuucgaccgc

SEQ ID NO: 384634 - RNA, 12 nt, Bordetella pertussis
ugauggcccggu

SEQ ID NO: 384635 - RNA, 19 nt, Bordetella pertussis
ugauggccgaguccugguu

SEQ ID NO: 384636 - RNA, 13 nt, Bordetella pertussis
ugauggccgccag

SEQ ID NO: 384637 - RNA, 17 nt, Bordetella pertussis
ugauggccgccagcggc

SEQ ID NO: 384638 - RNA, 13 nt, Bordetella pertussis
ugauggccgcgcg

SEQ ID NO: 384639 - RNA, 19 nt, Bordetella pertussis
ugauggccucggcggccuc

SEQ ID NO: 384640 - RNA, 22 nt, Bordetella pertussis
ugauggccugcuuggcgcgcag

SEQ ID NO: 384641 - RNA, 17 nt, Bordetella pertussis
ugauggggccgcgccgu

SEQ ID NO: 384642 - RNA, 18 nt, Bordetella pertussis
ugauggggucgccgggca

SEQ ID NO: 384643 - RNA, 19 nt, Bordetella pertussis
ugauggggucgccgggcag

SEQ ID NO: 384644 - RNA, 15 nt, Bordetella pertussis
ugauguagcccaugu

SEQ ID NO: 384645 - RNA, 15 nt, Bordetella pertussis
ugaugucgcgcgccu

SEQ ID NO: 384646 - RNA, 13 nt, Bordetella pertussis
ugcaccacgcgcu

SEQ ID NO: 384647 - RNA, 16 nt, Bordetella pertussis
ugcaccacggccacgu

SEQ ID NO: 384648 - RNA, 21 nt, Bordetella pertussis
ugcaccagccauucgauggcg

SEQ ID NO: 384649 - RNA, 21 nt, Bordetella pertussis
ugcaccagcccgaugcgccag

SEQ ID NO: 384650 - RNA, 14 nt, Bordetella pertussis
ugcaccagcgcgcc

SEQ ID NO: 384651 - RNA, 22 nt, Bordetella pertussis
ugcaccagcgcgccgcgcgcgg

SEQ ID NO: 384652 - RNA, 14 nt, Bordetella pertussis
ugcaccaugccgac

SEQ ID NO: 384653 - RNA, 21 nt, Bordetella pertussis
ugcaccagugcgccggcgcgg

SEQ ID NO: 384654 - RNA, 13 nt, Bordetella pertussis
ugcacgcgggcca

SEQ ID NO: 384655 - RNA, 18 nt, Bordetella pertussis
ugcacgcgggccaguugc

SEQ ID NO: 384656 - RNA, 19 nt, Bordetella pertussis
ugcacgcucuugagcgcgg

SEQ ID NO: 384657 - RNA, 18 nt, Bordetella pertussis
ugcacggcggaaugcggc

SEQ ID NO: 384658 - RNA, 22 nt, Bordetella pertussis
ugcacgggccauggaugcgcgc

SEQ ID NO: 384659 - RNA, 17 nt, Bordetella pertussis
ugcacgguggacaggcu

SEQ ID NO: 384660 - RNA, 17 nt, Bordetella pertussis
ugcacgugggcacgccg

SEQ ID NO: 384661 - RNA, 18 nt, Bordetella pertussis
ugcacgugggcacgccgg

SEQ ID NO: 384662 - RNA, 19 nt, Bordetella pertussis
ugcacgugggcacgccggc

SEQ ID NO: 384663 - RNA, 20 nt, Bordetella pertussis
ugcacuucgaaaaugacggc

SEQ ID NO: 384664 - RNA, 14 nt, Bordetella pertussis
ugcagaccagcacc

SEQ ID NO: 384665 - RNA, 16 nt, Bordetella pertussis
ugcagacggcggcugg

SEQ ID NO: 384666 - RNA, 18 nt, Bordetella pertussis
ugcagcaagcccaccggg

SEQ ID NO: 384667 - RNA, 20 nt, Bordetella pertussis
ugcagcaagcccaccgggcc

SEQ ID NO: 384668 - RNA, 15 nt, Bordetella pertussis
ugcagcacgcaccag

SEQ ID NO: 384669 - RNA, 19 nt, Bordetella pertussis
ugcagcacgcaccaggcgc

SEQ ID NO: 384670 - RNA, 20 nt, Bordetella pertussis
ugcagcacgcaccaggcgca

SEQ ID NO: 384671 - RNA, 21 nt, Bordetella pertussis
ugcagcacggccacggccggc

SEQ ID NO: 384672 - RNA, 20 nt, Bordetella pertussis
ugcagcagcauuucgaugcg

SEQ ID NO: 384673 - RNA, 16 nt, Bordetella pertussis
ugcagcaggcgcacca

SEQ ID NO: 384674 - RNA, 17 nt, Bordetella pertussis
ugcagcaggcgcaccag

SEQ ID NO: 384675 - RNA, 23 nt, Bordetella pertussis
ugcagcaggcgcaccagcgcgcc

SEQ ID NO: 384676 - RNA, 17 nt, Bordetella pertussis
ugcagcaggcugggcga

SEQ ID NO: 384677 - RNA, 23 nt, Bordetella pertussis
ugcagcagggucaugaugucggc

SEQ ID NO: 384678 - RNA, 13 nt, Bordetella pertussis
ugcagcagguagu

SEQ ID NO: 384679 - RNA, 19 nt, Bordetella pertussis
ugcagcaguucggcgucgg

SEQ ID NO: 384680 - RNA, 21 nt, Bordetella pertussis
ugcagccacaggcccaugccg

SEQ ID NO: 384681 - RNA, 22 nt, Bordetella pertussis
ugcagccacaggcccaugccgc

SEQ ID NO: 384682 - RNA, 22 nt, Bordetella pertussis
ugcagccacgccuggccgcgcu

SEQ ID NO: 384683 - RNA, 15 nt, Bordetella pertussis
ugcagccagcggccg

SEQ ID NO: 384684 - RNA, 18 nt, Bordetella pertussis
ugcagccauucggccagg

SEQ ID NO: 384685 - RNA, 13 nt, Bordetella pertussis
ugcagcccagcac

SEQ ID NO: 384686 - RNA, 15 nt, Bordetella pertussis
ugcagcccagcacca

SEQ ID NO: 384687 - RNA, 20 nt, Bordetella pertussis
ugcagcccagcaccacggca

SEQ ID NO: 384688 - RNA, 12 nt, Bordetella pertussis
ugcagcccagcg

SEQ ID NO: 384689 - RNA, 13 nt, Bordetella pertussis
ugcagcccagcgc

SEQ ID NO: 384690 - RNA, 17 nt, Bordetella pertussis
ugcagccgcaccagcgc

SEQ ID NO: 384691 - RNA, 12 nt, Bordetella pertussis
ugcagccgccgc

SEQ ID NO: 384692 - RNA, 15 nt, Bordetella pertussis
ugcagcgccgccugg

SEQ ID NO: 384693 - RNA, 16 nt, Bordetella pertussis
ugcagcgccgcgcgcu

SEQ ID NO: 384694 - RNA, 20 nt, Bordetella pertussis
ugcagcgccgcgcgcucgga

SEQ ID NO: 384695 - RNA, 20 nt, Bordetella pertussis
ugcagcgcgccaggcgcugc

SEQ ID NO: 384696 - RNA, 21 nt, Bordetella pertussis
ugcagcggcagcauggcgcgc

SEQ ID NO: 384697 - RNA, 23 nt, Bordetella pertussis
ugcagcggcagcauggcgcgcgg

SEQ ID NO: 384698 - RNA, 13 nt, Bordetella pertussis
ugcagcggcggca

SEQ ID NO: 384699 - RNA, 22 nt, Bordetella pertussis
ugcagcggcggcacgguggcga

SEQ ID NO: 384700 - RNA, 21 nt, Bordetella pertussis
ugcagcggcuucaugccggcg

SEQ ID NO: 384701 - RNA, 13 nt, Bordetella pertussis
ugcagcugcgcca

SEQ ID NO: 384702 - RNA, 20 nt, Bordetella pertussis
ugcagcuguagcccuggcgc

SEQ ID NO: 384703 - RNA, 14 nt, Bordetella pertussis
ugcagcuugcgcgc

SEQ ID NO: 384704 - RNA, 18 nt, Bordetella pertussis
ugcagcuugcgcgccagu

SEQ ID NO: 384705 - RNA, 22 nt, Bordetella pertussis
ugcaggaacucgcacacgcgcu

SEQ ID NO: 384706 - RNA, 18 nt, Bordetella pertussis
ugcaggaagccugcgcgc

SEQ ID NO: 384707 - RNA, 16 nt, Bordetella pertussis
ugcaggaucgcggcca

SEQ ID NO: 384708 - RNA, 21 nt, Bordetella pertussis
ugcaggacgaacaggccgccg

SEQ ID NO: 384709 - RNA, 22 nt, Bordetella pertussis
ugcaggauggcgucgaccgcca

SEQ ID NO: 384710 - RNA, 19 nt, Bordetella pertussis
ugcaggccaugcucgucca

SEQ ID NO: 384711 - RNA, 21 nt, Bordetella pertussis
ugcaggccaugcucguccauc

SEQ ID NO: 384712 - RNA, 20 nt, Bordetella pertussis
ugcaggcccagcacgcgcgc

SEQ ID NO: 384713 - RNA, 16 nt, Bordetella pertussis
ugcaggcccggcgcga

SEQ ID NO: 384714 - RNA, 23 nt, Bordetella pertussis
ugcaggcccgggcgccugcgcca

SEQ ID NO: 384715 - RNA, 18 nt, Bordetella pertussis
ugcaggccgccggccagc

SEQ ID NO: 384716 - RNA, 14 nt, Bordetella pertussis
ugcaggccgcgcag

SEQ ID NO: 384717 - RNA, 16 nt, Bordetella pertussis
ugcaggccggcgcgca

SEQ ID NO: 384718 - RNA, 17 nt, Bordetella pertussis
ugcaggccggcgcgcau

SEQ ID NO: 384719 - RNA, 18 nt, Bordetella pertussis
ugcaggccggcgcgcauc

SEQ ID NO: 384720 - RNA, 20 nt, Bordetella pertussis
ugcaggcgccuucggcgcgg

SEQ ID NO: 384721 - RNA, 21 nt, Bordetella pertussis
ugcaggcgccuucggcgcggc

SEQ ID NO: 384722 - RNA, 16 nt, Bordetella pertussis
ugcaggcggcgcauca

SEQ ID NO: 384723 - RNA, 22 nt, Bordetella pertussis
ugcaggcggcgcaucagcgcgc

SEQ ID NO: 384724 - RNA, 20 nt, Bordetella pertussis
ugcagggcgucugcucgccg

SEQ ID NO: 384725 - RNA, 19 nt, Bordetella pertussis
ugcaggggccgcacgcgcg

SEQ ID NO: 384726 - RNA, 19 nt, Bordetella pertussis
ugcagggucagcccgccau

SEQ ID NO: 384727 - RNA, 18 nt, Bordetella pertussis
ugcagggugucggccagg

SEQ ID NO: 384728 - RNA, 19 nt, Bordetella pertussis
ugcaggguuggcgcgccgu

SEQ ID NO: 384729 - RNA, 20 nt, Bordetella pertussis
ugcauguaguucacccaggu

SEQ ID NO: 384730 - RNA, 12 nt, Bordetella pertussis
ugcauguccagc

SEQ ID NO: 384731 - RNA, 18 nt, Bordetella pertussis
ugccaaucaugcgcugcu

SEQ ID NO: 384732 - RNA, 20 nt, Bordetella pertussis
ugccacacgcgguagguagc

SEQ ID NO: 384733 - RNA, 17 nt, Bordetella pertussis
ugccacagcgugacggc

SEQ ID NO: 384734 - RNA, 19 nt, Bordetella pertussis
ugccacuccugguugaccg

SEQ ID NO: 384735 - RNA, 14 nt, Bordetella pertussis
ugccagacggccag

SEQ ID NO: 384736 - RNA, 21 nt, Bordetella pertussis
ugccagacggccagcgcgcgu

SEQ ID NO: 384737 - RNA, 14 nt, Bordetella pertussis
ugccagcuggccca

SEQ ID NO: 384738 - RNA, 17 nt, Bordetella pertussis
ugccaggcccggcgcgc

SEQ ID NO: 384739 - RNA, 18 nt, Bordetella pertussis
ugccaggcccggcgcgca

SEQ ID NO: 384740 - RNA, 13 nt, Bordetella pertussis
ugccaggcgccgc

SEQ ID NO: 384741 - RNA, 22 nt, Bordetella pertussis
ugccaggcgccgcguccggcgc

SEQ ID NO: 384742 - RNA, 16 nt, Bordetella pertussis
ugccaguccccugcgg

SEQ ID NO: 384743 - RNA, 21 nt, Bordetella pertussis
ugccaguccccugcggggaca

SEQ ID NO: 384744 - RNA, 24 nt, Bordetella pertussis
ugccagugaaacgcgacgcgccgg

SEQ ID NO: 384745 - RNA, 18 nt, Bordetella pertussis
ugccaguugaaccgcaac

SEQ ID NO: 384746 - RNA, 13 nt, Bordetella pertussis
ugccauacggcac

SEQ ID NO: 384747 - RNA, 15 nt, Bordetella pertussis
ugccauacggcacgg

SEQ ID NO: 384748 - RNA, 15 nt, Bordetella pertussis
ugccauagucgcgca

SEQ ID NO: 384749 - RNA, 15 nt, Bordetella pertussis
ugccauccagccagg

SEQ ID NO: 384750 - RNA, 18 nt, Bordetella pertussis
ugccauccagccaggccg

SEQ ID NO: 384751 - RNA, 18 nt, Bordetella pertussis
ugccaucgauaugggcgg

SEQ ID NO: 384752 - RNA, 14 nt, Bordetella pertussis
ugccaugccgcgcg

SEQ ID NO: 384753 - RNA, 20 nt, Bordetella pertussis
ugccauuccagcuccggcgg

SEQ ID NO: 384754 - RNA, 15 nt, Bordetella pertussis
ugcccgacggacugg

SEQ ID NO: 384755 - RNA, 15 nt, Bordetella pertussis
ugcccgacggcgccg

SEQ ID NO: 384756 - RNA, 13 nt, Bordetella pertussis
ugcccgaggcggc

SEQ ID NO: 384757 - RNA, 17 nt, Bordetella pertussis
ugcccgaggcggcgcgg

SEQ ID NO: 384758 - RNA, 23 nt, Bordetella pertussis
ugcccgccccgugcaccaugccg

SEQ ID NO: 384759 - RNA, 21 nt, Bordetella pertussis
ugcccgccuggucgcuggcgc

SEQ ID NO: 384760 - RNA, 18 nt, Bordetella pertussis
ugcccgcgcaccaggcgc

SEQ ID NO: 384761 - RNA, 15 nt, Bordetella pertussis
ugcccgcgguccagc

SEQ ID NO: 384762 - RNA, 24 nt, Bordetella pertussis
ugcccgcggucgagacgauggccg

SEQ ID NO: 384763 - RNA, 15 nt, Bordetella pertussis
ugcccgcguccacca

SEQ ID NO: 384764 - RNA, 21 nt, Bordetella pertussis
ugcccgcuggccaugccgucg

SEQ ID NO: 384765 - RNA, 17 nt, Bordetella pertussis
ugcccgggcuggccgcc

SEQ ID NO: 384766 - RNA, 23 nt, Bordetella pertussis
ugcccgggcuggccgccugcugc

SEQ ID NO: 384767 - RNA, 17 nt, Bordetella pertussis
ugcccgggguugccaag

SEQ ID NO: 384768 - RNA, 20 nt, Bordetella pertussis
ugcccgguucugcggcgcgu

SEQ ID NO: 384769 - RNA, 23 nt, Bordetella pertussis
ugcccgucaugcgccgcagcacc

SEQ ID NO: 384770 - RNA, 18 nt, Bordetella pertussis
ugcccgucuauggccugc

SEQ ID NO: 384771 - RNA, 17 nt, Bordetella pertussis
ugcccgucuuggcgugg

SEQ ID NO: 384772 - RNA, 16 nt, Bordetella pertussis
ugcccgugcgugcgcc

SEQ ID NO: 384773 - RNA, 16 nt, Bordetella pertussis
ugcccguucacgcgca

SEQ ID NO: 384774 - RNA, 20 nt, Bordetella pertussis
ugcccguucacgcgcagcgu

SEQ ID NO: 384775 - RNA, 17 nt, Bordetella pertussis
ugcccuacgacacgcuc

SEQ ID NO: 384776 - RNA, 22 nt, Bordetella pertussis
ugcccucccagaaacuggcgcu

SEQ ID NO: 384777 - RNA, 17 nt, Bordetella pertussis
ugcccuccucggccagg

SEQ ID NO: 384778 - RNA, 23 nt, Bordetella pertussis
ugcccuccucggccaggucgcgc

SEQ ID NO: 384779 - RNA, 19 nt, Bordetella pertussis
ugcccucgcccgugcgcgg

SEQ ID NO: 384780 - RNA, 16 nt, Bordetella pertussis
ugcccucgggcgacag

SEQ ID NO: 384781 - RNA, 19 nt, Bordetella pertussis
ugcccucgggcgacaggcg

SEQ ID NO: 384782 - RNA, 22 nt, Bordetella pertussis
ugcccucgggcgacaggcgcgc

SEQ ID NO: 384783 - RNA, 20 nt, Bordetella pertussis
ugcccucgggaaacaggccc

SEQ ID NO: 384784 - RNA, 19 nt, Bordetella pertussis
ugcccucuucggcggccag

SEQ ID NO: 384785 - RNA, 16 nt, Bordetella pertussis
ugcccugacccgcugg

SEQ ID NO: 384786 - RNA, 13 nt, Bordetella pertussis
ugcccugcgccag

SEQ ID NO: 384787 - RNA, 14 nt, Bordetella pertussis
ugcccugcgccagc

SEQ ID NO: 384788 - RNA, 12 nt, Bordetella pertussis
ugcccugcggcg

SEQ ID NO: 384789 - RNA, 16 nt, Bordetella pertussis
ugcccugcggcgcggc

SEQ ID NO: 384790 - RNA, 22 nt, Bordetella pertussis
ugcccugcggcgcggccagcac

SEQ ID NO: 384791 - RNA, 15 nt, Bordetella pertussis
ugcccugcgugugcc

SEQ ID NO: 384792 - RNA, 22 nt, Bordetella pertussis
ugcccugcaugaccgccgccag

SEQ ID NO: 384793 - RNA, 13 nt, Bordetella pertussis
ugcccuggcccag

SEQ ID NO: 384794 - RNA, 22 nt, Bordetella pertussis
ugcccuggaucaggaugggcgc

SEQ ID NO: 384795 - RNA, 17 nt, Bordetella pertussis
ugcccuggauggccugg

SEQ ID NO: 384796 - RNA, 14 nt, Bordetella pertussis
ugcccuuggcggcg

SEQ ID NO: 384797 - RNA, 16 nt, Bordetella pertussis
ugccgaacagccaggg

SEQ ID NO: 384798 - RNA, 17 nt, Bordetella pertussis
ugccgaacugucgcgcc

SEQ ID NO: 384799 - RNA, 19 nt, Bordetella pertussis
ugccgaacugucgcgccac

SEQ ID NO: 384800 - RNA, 19 nt, Bordetella pertussis
ugccgaagcgucggccugc

SEQ ID NO: 384801 - RNA, 22 nt, Bordetella pertussis
ugccgaaggguugcaguucgcc

SEQ ID NO: 384802 - RNA, 17 nt, Bordetella pertussis
ugccgaccaggcccgcc

SEQ ID NO: 384803 - RNA, 14 nt, Bordetella pertussis
ugccgauccagcgc

SEQ ID NO: 384804 - RNA, 21 nt, Bordetella pertussis
ugccgaugcgguaggcccagc

SEQ ID NO: 384805 - RNA, 16 nt, Bordetella pertussis
ugccgcagcggggaca

SEQ ID NO: 384806 - RNA, 22 nt, Bordetella pertussis
ugccgcagcggggacaggcgcc

SEQ ID NO: 384807 - RNA, 15 nt, Bordetella pertussis
ugccgcaggccagcc

SEQ ID NO: 384808 - RNA, 22 nt, Bordetella pertussis
ugccgccaacgcggcgcgugca

SEQ ID NO: 384809 - RNA, 22 nt, Bordetella pertussis
ugccgccaagggcgcgccagca

SEQ ID NO: 384810 - RNA, 21 nt, Bordetella pertussis
ugccgccacgggcccgcgcag

SEQ ID NO: 384811 - RNA, 16 nt, Bordetella pertussis
ugccgccaugcgccag

SEQ ID NO: 384812 - RNA, 19 nt, Bordetella pertussis
ugccgccaugcgccagcag

SEQ ID NO: 384813 - RNA, 18 nt, Bordetella pertussis
ugccgccgaugugcggcg

SEQ ID NO: 384814 - RNA, 14 nt, Bordetella pertussis
ugccgccgcccgac

SEQ ID NO: 384815 - RNA, 17 nt, Bordetella pertussis
ugccgccgccggcgcgg

SEQ ID NO: 384816 - RNA, 12 nt, Bordetella pertussis
ugccgccgcgca

SEQ ID NO: 384817 - RNA, 13 nt, Bordetella pertussis
ugccgccgcgcag

SEQ ID NO: 384818 - RNA, 15 nt, Bordetella pertussis
ugccgccgcgcagcc

SEQ ID NO: 384819 - RNA, 15 nt, Bordetella pertussis
ugccgccgcgcagga

SEQ ID NO: 384820 - RNA, 20 nt, Bordetella pertussis
ugccgccgcgcaggaugacg

SEQ ID NO: 384821 - RNA, 20 nt, Bordetella pertussis
ugccgccuucgucgcgcacc

SEQ ID NO: 384822 - RNA, 15 nt, Bordetella pertussis
ugccgcgaggcgcag

SEQ ID NO: 384823 - RNA, 20 nt, Bordetella pertussis
ugccgcgcaccugggcgucg

SEQ ID NO: 384824 - RNA, 15 nt, Bordetella pertussis
ugccgcgcacgaugg

SEQ ID NO: 384825 - RNA, 13 nt, Bordetella pertussis
ugccgcgcagcgu

SEQ ID NO: 384826 - RNA, 20 nt, Bordetella pertussis
ugccgcgcauuugccgcggc

SEQ ID NO: 384827 - RNA, 20 nt, Bordetella pertussis
ugccgcgcccggcggccagg

SEQ ID NO: 384828 - RNA, 20 nt, Bordetella pertussis
ugccgcgcgauccggcgugg

SEQ ID NO: 384829 - RNA, 13 nt, Bordetella pertussis
ugccgcgcgcacc

SEQ ID NO: 384830 - RNA, 19 nt, Bordetella pertussis
ugccgcgcgccggcgccgg

SEQ ID NO: 384831 - RNA, 13 nt, Bordetella pertussis
ugccgcgcgcgca

SEQ ID NO: 384832 - RNA, 16 nt, Bordetella pertussis
ugccgcgcgcggccgg

SEQ ID NO: 384833 - RNA, 19 nt, Bordetella pertussis
ugccgcgcggcguauggcg

SEQ ID NO: 384834 - RNA, 22 nt, Bordetella pertussis
ugccgcgcggcguauggcgcgg

SEQ ID NO: 384835 - RNA, 18 nt, Bordetella pertussis
ugccgcgcugggcgcugc

SEQ ID NO: 384836 - RNA, 20 nt, Bordetella pertussis
ugccgcggcaaauggggcgg

SEQ ID NO: 384837 - RNA, 22 nt, Bordetella pertussis
ugccgcggcaaauggggcggcc

SEQ ID NO: 384838 - RNA, 18 nt, Bordetella pertussis
ugccgcggccgcccccag

SEQ ID NO: 384839 - RNA, 21 nt, Bordetella pertussis
ugccgcggcgcggcccgccac

SEQ ID NO: 384840 - RNA, 17 nt, Bordetella pertussis
ugccgcgggcggcgccg

SEQ ID NO: 384841 - RNA, 19 nt, Bordetella pertussis
ugccgcgggcggcgccggc

SEQ ID NO: 384842 - RNA, 15 nt, Bordetella pertussis
ugccgcgggugucgc

SEQ ID NO: 384843 - RNA, 16 nt, Bordetella pertussis
ugccgcgguggcgggc

SEQ ID NO: 384844 - RNA, 20 nt, Bordetella pertussis
ugccgcgguggcgggcgugc

SEQ ID NO: 384845 - RNA, 19 nt, Bordetella pertussis
ugccgcguaugcggcagca

SEQ ID NO: 384846 - RNA, 17 nt, Bordetella pertussis
ugccgcgucccgugccg

SEQ ID NO: 384847 - RNA, 21 nt, Bordetella pertussis
ugccgcgucgauccggcagca

SEQ ID NO: 384848 - RNA, 19 nt, Bordetella pertussis
ugccgcgugcccgcgucca

SEQ ID NO: 384849 - RNA, 15 nt, Bordetella pertussis
ugccguaccaggugc

SEQ ID NO: 384850 - RNA, 19 nt, Bordetella pertussis
ugccguacgccaucgacgc

SEQ ID NO: 384851 - RNA, 22 nt, Bordetella pertussis
ugccguagcccagguccagcgc

SEQ ID NO: 384852 - RNA, 21 nt, Bordetella pertussis
ugccguagcgcguggccagca

SEQ ID NO: 384853 - RNA, 16 nt, Bordetella pertussis
ugccguccacgcccag

SEQ ID NO: 384854 - RNA, 19 nt, Bordetella pertussis
ugccguccacgcccagcgc

SEQ ID NO: 384855 - RNA, 15 nt, Bordetella pertussis
ugccgucuggcggca

SEQ ID NO: 384856 - RNA, 17 nt, Bordetella pertussis
ugccgucuuggcgggcu

SEQ ID NO: 384857 - RNA, 13 nt, Bordetella pertussis
ugccgugccagau

SEQ ID NO: 384858 - RNA, 15 nt, Bordetella pertussis
ugccguucggccagc

SEQ ID NO: 384859 - RNA, 17 nt, Bordetella pertussis
ugccguucggccagcgc

SEQ ID NO: 384860 - RNA, 23 nt, Bordetella pertussis
ugccguugcccagauccagcuug

SEQ ID NO: 384861 - RNA, 24 nt, Bordetella pertussis
ugccguugcccagauccagcuugc

SEQ ID NO: 384862 - RNA, 14 nt, Bordetella pertussis
ugccguugucgguc

SEQ ID NO: 384863 - RNA, 20 nt, Bordetella pertussis
ugccguuucucaacccgccg

SEQ ID NO: 384864 - RNA, 23 nt, Bordetella pertussis
ugccguuucucaacccgccggcc

SEQ ID NO: 384865 - RNA, 16 nt, Bordetella pertussis
ugccguuuucgaucag

SEQ ID NO: 384866 - RNA, 13 nt, Bordetella pertussis
ugccuucgacggc

SEQ ID NO: 384867 - RNA, 15 nt, Bordetella pertussis
ugccuucgacggcgg

SEQ ID NO: 384868 - RNA, 16 nt, Bordetella pertussis
ugccuucgacggcggg

SEQ ID NO: 384869 - RNA, 16 nt, Bordetella pertussis
ugccuugcggcgccgu

SEQ ID NO: 384870 - RNA, 22 nt, Bordetella pertussis
ugccuugggcaaaaaaagaggc

SEQ ID NO: 384871 - RNA, 19 nt, Bordetella pertussis
ugcgaaacccgcugggcca

SEQ ID NO: 384872 - RNA, 14 nt, Bordetella pertussis
ugcgaaagccggcc

SEQ ID NO: 384873 - RNA, 13 nt, Bordetella pertussis
ugcgaaaggccga

SEQ ID NO: 384874 - RNA, 20 nt, Bordetella pertussis
ugcgaaaucuucugcgccac

SEQ ID NO: 384875 - RNA, 20 nt, Bordetella pertussis
ugcgaacgcccggcccaggc

SEQ ID NO: 384876 - RNA, 12 nt, Bordetella pertussis
ugcgaacggccg

SEQ ID NO: 384877 - RNA, 14 nt, Bordetella pertussis
ugcgaacggccgcc

SEQ ID NO: 384878 - RNA, 17 nt, Bordetella pertussis
ugcgagccuucggccgg

SEQ ID NO: 384879 - RNA, 18 nt, Bordetella pertussis
ugcgagccuucggccggc

SEQ ID NO: 384880 - RNA, 21 nt, Bordetella pertussis
ugcgagccgccgcccuugcgc

SEQ ID NO: 384881 - RNA, 17 nt, Bordetella pertussis
ugcgaggcccggccugc

SEQ ID NO: 384882 - RNA, 15 nt, Bordetella pertussis
ugcgaggcggccuug

SEQ ID NO: 384883 - RNA, 16 nt, Bordetella pertussis
ugcgauaggugcgcag

SEQ ID NO: 384884 - RNA, 18 nt, Bordetella pertussis
ugcgauaggugcgcagcc

SEQ ID NO: 384885 - RNA, 18 nt, Bordetella pertussis
ugcgcaagccgcccgcgg

SEQ ID NO: 384886 - RNA, 18 nt, Bordetella pertussis
ugcgcaagccggccgcgc

SEQ ID NO: 384887 - RNA, 21 nt, Bordetella pertussis
ugcgcaaguucaucaucgccg

SEQ ID NO: 384888 - RNA, 22 nt, Bordetella pertussis
ugcgcaaguucaucaucgccga

SEQ ID NO: 384889 - RNA, 18 nt, Bordetella pertussis
ugcgcacaucgcccgugc

SEQ ID NO: 384890 - RNA, 15 nt, Bordetella pertussis
ugcgcaccaccgccg

SEQ ID NO: 384891 - RNA, 16 nt, Bordetella pertussis
ugcgcaccaccgccga

SEQ ID NO: 384892 - RNA, 20 nt, Bordetella pertussis
ugcgcaccaggcccaugaag

SEQ ID NO: 384893 - RNA, 20 nt, Bordetella pertussis
ugcgcaccaggcgcucgcgc

SEQ ID NO: 384894 - RNA, 14 nt, Bordetella pertussis
ugcgcacccgccug

SEQ ID NO: 384895 - RNA, 23 nt, Bordetella pertussis
ugcgcaccgacugcgcauggucg

SEQ ID NO: 384896 - RNA, 21 nt, Bordetella pertussis
ugcgcaccgcuucuucgucgc

SEQ ID NO: 384897 - RNA, 13 nt, Bordetella pertussis
ugcgcaccggccg

SEQ ID NO: 384898 - RNA, 18 nt, Bordetella pertussis
ugcgcaccuugcccacgc

SEQ ID NO: 384899 - RNA, 13 nt, Bordetella pertussis
ugcgcacgcccag

SEQ ID NO: 384900 - RNA, 22 nt, Bordetella pertussis
ugcgcacgcguucgggcggcag

SEQ ID NO: 384901 - RNA, 18 nt, Bordetella pertussis
ugcgcacgcuggcgcccg

SEQ ID NO: 384902 - RNA, 15 nt, Bordetella pertussis
ugcgcagacgacgca

SEQ ID NO: 384903 - RNA, 21 nt, Bordetella pertussis
ugcgcagcacaugggcgcggu

SEQ ID NO: 384904 - RNA, 14 nt, Bordetella pertussis
ugcgcagcaccagc

SEQ ID NO: 384905 - RNA, 16 nt, Bordetella pertussis
ugcgcagcaccagcau

SEQ ID NO: 384906 - RNA, 17 nt, Bordetella pertussis
ugcgcagcagcagcgca

SEQ ID NO: 384907 - RNA, 11 nt, Bordetella pertussis
ugcgcagcgcg

SEQ ID NO: 384908 - RNA, 15 nt, Bordetella pertussis
ugcgcagcgcggcgu

SEQ ID NO: 384909 - RNA, 19 nt, Bordetella pertussis
ugcgcauggucgcgaugcg

SEQ ID NO: 384910 - RNA, 14 nt, Bordetella pertussis
ugcgcagcucgugg

SEQ ID NO: 384911 - RNA, 21 nt, Bordetella pertussis
ugcgccaccagcuugcgcgcc

SEQ ID NO: 384912 - RNA, 22 nt, Bordetella pertussis
ugcgccacgcccacuuccucgg

SEQ ID NO: 384913 - RNA, 20 nt, Bordetella pertussis
ugcgccacggucugcacgcc

SEQ ID NO: 384914 - RNA, 21 nt, Bordetella pertussis
ugcgccacggucugcacgccg

SEQ ID NO: 384915 - RNA, 22 nt, Bordetella pertussis
ugcgccacguccagcacggccg

SEQ ID NO: 384916 - RNA, 21 nt, Bordetella pertussis
ugcgccagcaggauguccacg

SEQ ID NO: 384917 - RNA, 16 nt, Bordetella pertussis
ugcgccagccacgcgc

SEQ ID NO: 384918 - RNA, 15 nt, Bordetella pertussis
ugcgccauggcgcgc

SEQ ID NO: 384919 - RNA, 17 nt, Bordetella pertussis
ugcgccauggcgcgcag

SEQ ID NO: 384920 - RNA, 21 nt, Bordetella pertussis
ugcgccauguggcgacgccca

SEQ ID NO: 384921 - RNA, 16 nt, Bordetella pertussis
ugcgcccauggcgcgc

SEQ ID NO: 384922 - RNA, 18 nt, Bordetella pertussis
ugcgcccauggcgcgcag

SEQ ID NO: 384923 - RNA, 17 nt, Bordetella pertussis
ugcgcccccauguccag

SEQ ID NO: 384924 - RNA, 19 nt, Bordetella pertussis
ugcgccccgccaugcgcag

SEQ ID NO: 384925 - RNA, 21 nt, Bordetella pertussis
ugcgccccgccucgacgaugc

SEQ ID NO: 384926 - RNA, 20 nt, Bordetella pertussis
ugcgcccugcgaacccgccg

SEQ ID NO: 384927 - RNA, 13 nt, Bordetella pertussis
ugcgcgaagcgcc

SEQ ID NO: 384928 - RNA, 20 nt, Bordetella pertussis
ugcgcgaagcggaaacgcgc

SEQ ID NO: 384929 - RNA, 15 nt, Bordetella pertussis
ugcgcgaaggccgcc

SEQ ID NO: 384930 - RNA, 20 nt, Bordetella pertussis
ugcgcgacagcuugaugggc

SEQ ID NO: 384931 - RNA, 17 nt, Bordetella pertussis
ugcgcgaccgcgcggcg

SEQ ID NO: 384932 - RNA, 18 nt, Bordetella pertussis
ugcgcgaccuccggcaac

SEQ ID NO: 384933 - RNA, 18 nt, Bordetella pertussis
ugcgcgacuucagguagg

SEQ ID NO: 384934 - RNA, 15 nt, Bordetella pertussis
ugcgcgagcgcgugg

SEQ ID NO: 384935 - RNA, 19 nt, Bordetella pertussis
ugcgcgaggugccggacgc

SEQ ID NO: 384936 - RNA, 22 nt, Bordetella pertussis
ugcgcgaggugccggacgccga

SEQ ID NO: 384937 - RNA, 14 nt, Bordetella pertussis
ugcgcgaugcgcgc

SEQ ID NO: 384938 - RNA, 15 nt, Bordetella pertussis
ugcgcgaugcgcgcg

SEQ ID NO: 384939 - RNA, 16 nt, Bordetella pertussis
ugcgcgcagggcggcc

SEQ ID NO: 384940 - RNA, 18 nt, Bordetella pertussis
ugcgcgcagggcggccgg

SEQ ID NO: 384941 - RNA, 22 nt, Bordetella pertussis
ugcgcgccagcucuucgagcgc

SEQ ID NO: 384942 - RNA, 16 nt, Bordetella pertussis
ugcgcgccaggcgcgc

SEQ ID NO: 384943 - RNA, 15 nt, Bordetella pertussis
ugcgcgccaggucgc

SEQ ID NO: 384944 - RNA, 19 nt, Bordetella pertussis
ugcgcgcccccacgccgcu

SEQ ID NO: 384945 - RNA, 16 nt, Bordetella pertussis
ugcgcgcccgaugccc

SEQ ID NO: 384946 - RNA, 13 nt, Bordetella pertussis
ugcgcgccgacag

SEQ ID NO: 384947 - RNA, 18 nt, Bordetella pertussis
ugcgcgccgaccaccugc

SEQ ID NO: 384948 - RNA, 16 nt, Bordetella pertussis
ugcgcgccgccgcgcu

SEQ ID NO: 384949 - RNA, 22 nt, Bordetella pertussis
ugcgcgccgccgcgcugugcga

SEQ ID NO: 384950 - RNA, 17 nt, Bordetella pertussis
ugcgcgccgcucuuggc

SEQ ID NO: 384951 - RNA, 17 nt, Bordetella pertussis
ugcgcgccggcaugguc

SEQ ID NO: 384952 - RNA, 13 nt, Bordetella pertussis
ugcgcggccgcgc

SEQ ID NO: 384953 - RNA, 17 nt, Bordetella pertussis
ugcgcggcgagcgccgc

SEQ ID NO: 384954 - RNA, 13 nt, Bordetella pertussis
ugcgcggcgcgcc

SEQ ID NO: 384955 - RNA, 14 nt, Bordetella pertussis
ugcgcggcgcgccg

SEQ ID NO: 384956 - RNA, 19 nt, Bordetella pertussis
ugcgcggcgggacggccau

SEQ ID NO: 384957 - RNA, 13 nt, Bordetella pertussis
ugcgcggcgggcu

SEQ ID NO: 384958 - RNA, 15 nt, Bordetella pertussis
ugcgcggcggugccg

SEQ ID NO: 384959 - RNA, 22 nt, Bordetella pertussis
ugcgcggcgcagcccagcgcga

SEQ ID NO: 384960 - RNA, 14 nt, Bordetella pertussis
ugcgcgggcgcggc

SEQ ID NO: 384961 - RNA, 22 nt, Bordetella pertussis
ugcgcgggcgcgggcugucgca

SEQ ID NO: 384962 - RNA, 13 nt, Bordetella pertussis
ugcgcggggccag

SEQ ID NO: 384963 - RNA, 12 nt, Bordetella pertussis
ugcgcugcccgu

SEQ ID NO: 384964 - RNA, 17 nt, Bordetella pertussis
ugcgcugcugucgcgcu

SEQ ID NO: 384965 - RNA, 19 nt, Bordetella pertussis
ugcgcuggaauauggcguc

SEQ ID NO: 384966 - RNA, 12 nt, Bordetella pertussis
ugcgcuggcgca

SEQ ID NO: 384967 - RNA, 18 nt, Bordetella pertussis
ugcgcuggcugggccugc

SEQ ID NO: 384968 - RNA, 12 nt, Bordetella pertussis
ugcgcugggcau

SEQ ID NO: 384969 - RNA, 15 nt, Bordetella pertussis
ugcgcuggucgcgca

SEQ ID NO: 384970 - RNA, 14 nt, Bordetella pertussis
ugcgcuuguggucg

SEQ ID NO: 384971 - RNA, 16 nt, Bordetella pertussis
ugcgcuuguggucggc

SEQ ID NO: 384972 - RNA, 22 nt, Bordetella pertussis
ugcgcuuuuuucuccagcgcca

SEQ ID NO: 384973 - RNA, 22 nt, Bordetella pertussis
ugcggaccagcgguugcgccag

SEQ ID NO: 384974 - RNA, 16 nt, Bordetella pertussis
ugcggacggcgggcgc

SEQ ID NO: 384975 - RNA, 15 nt, Bordetella pertussis
ugcggacgggccagu

SEQ ID NO: 384976 - RNA, 16 nt, Bordetella pertussis
ugcggccgugcgccag

SEQ ID NO: 384977 - RNA, 22 nt, Bordetella pertussis
ugcggcgaugcacccaggcgcc

SEQ ID NO: 384978 - RNA, 16 nt, Bordetella pertussis
ugcggcgccacgcaga

SEQ ID NO: 384979 - RNA, 17 nt, Bordetella pertussis
ugcggcgccacgcagaa

SEQ ID NO: 384980 - RNA, 11 nt, Bordetella pertussis
ugcggcgccag

SEQ ID NO: 384981 - RNA, 19 nt, Bordetella pertussis
ugcggcgccagcugggcga

SEQ ID NO: 384982 - RNA, 14 nt, Bordetella pertussis
ugcggcgcccaggc

SEQ ID NO: 384983 - RNA, 23 nt, Bordetella pertussis
ugcggcgcccaggcccagcgcgc

SEQ ID NO: 384984 - RNA, 17 nt, Bordetella pertussis
ugcggcgccucggucca

SEQ ID NO: 384985 - RNA, 20 nt, Bordetella pertussis
ugcggcgccugucccgcugg

SEQ ID NO: 384986 - RNA, 15 nt, Bordetella pertussis
ugcggcgcggcgcgu

SEQ ID NO: 384987 - RNA, 15 nt, Bordetella pertussis
ugcggcgcggccagc

SEQ ID NO: 384988 - RNA, 15 nt, Bordetella pertussis
ugcggcggcagcuug

SEQ ID NO: 384989 - RNA, 20 nt, Bordetella pertussis
ugcggcugggugcggucagu

SEQ ID NO: 384990 - RNA, 14 nt, Bordetella pertussis
ugcgggacaggcgc

SEQ ID NO: 384991 - RNA, 15 nt, Bordetella pertussis
ugcgggacaggcgcc

SEQ ID NO: 384992 - RNA, 17 nt, Bordetella pertussis
ugcgggacaggcgccac

SEQ ID NO: 384993 - RNA, 15 nt, Bordetella pertussis
ugcgggacggccagg

SEQ ID NO: 384994 - RNA, 16 nt, Bordetella pertussis
ugcgggccacgccggc

SEQ ID NO: 384995 - RNA, 18 nt, Bordetella pertussis
ugcgggccggcgcgccug

SEQ ID NO: 384996 - RNA, 22 nt, Bordetella pertussis
ugcgggccgggcaggccgcgcu

SEQ ID NO: 384997 - RNA, 19 nt, Bordetella pertussis
ugcgggucgucccagcgca

SEQ ID NO: 384998 - RNA, 15 nt, Bordetella pertussis
ugcgggugggcaucc

SEQ ID NO: 384999 - RNA, 17 nt, Bordetella pertussis
ugcgggugggcgcgccg

SEQ ID NO: 385000 - RNA, 15 nt, Bordetella pertussis
ugcgguccgaugucg

SEQ ID NO: 385001 - RNA, 23 nt, Bordetella pertussis
ugcggucgcggccggccugcuug

SEQ ID NO: 385002 - RNA, 18 nt, Bordetella pertussis
ugcggucuaccgaagccg

SEQ ID NO: 385003 - RNA, 17 nt, Bordetella pertussis
ugcggugccugucccca

SEQ ID NO: 385004 - RNA, 16 nt, Bordetella pertussis
ugcggugcgccgcguc

SEQ ID NO: 385005 - RNA, 17 nt, Bordetella pertussis
ugcggugcgcgaugccg

SEQ ID NO: 385006 - RNA, 14 nt, Bordetella pertussis
ugcgguggugcgcc

SEQ ID NO: 385007 - RNA, 18 nt, Bordetella pertussis
ugcgguucgucagggccg

SEQ ID NO: 385008 - RNA, 19 nt, Bordetella pertussis
ugcgguucgucagggccgc

SEQ ID NO: 385009 - RNA, 22 nt, Bordetella pertussis
ugcgguugaucagggccgccag

SEQ ID NO: 385010 - RNA, 18 nt, Bordetella pertussis
ugcgguuucucagcgcgc

SEQ ID NO: 385011 - RNA, 19 nt, Bordetella pertussis
ugcgguuucucagcgcgcu

SEQ ID NO: 385012 - RNA, 21 nt, Bordetella pertussis
ugcgguuugguagcaggcgcg

SEQ ID NO: 385013 - RNA, 22 nt, Bordetella pertussis
ugcgguuugguagcaggcgcgc

SEQ ID NO: 385014 - RNA, 14 nt, Bordetella pertussis
ugcguaccagccca

SEQ ID NO: 385015 - RNA, 21 nt, Bordetella pertussis
ugcguaggcaggggcuccagg

SEQ ID NO: 385016 - RNA, 15 nt, Bordetella pertussis
ugcguauucgguggc

SEQ ID NO: 385017 - RNA, 17 nt, Bordetella pertussis
ugcgucacgaaagcgcc

SEQ ID NO: 385018 - RNA, 20 nt, Bordetella pertussis
ugcgucacgaaagcgcccag

SEQ ID NO: 385019 - RNA, 20 nt, Bordetella pertussis
ugcgucaggggcaugccggc

SEQ ID NO: 385020 - RNA, 14 nt, Bordetella pertussis
ugcguccaccacca

SEQ ID NO: 385021 - RNA, 18 nt, Bordetella pertussis
ugcguccaccaccaggcc

SEQ ID NO: 385022 - RNA, 19 nt, Bordetella pertussis
ugcguccagccgagccugg

SEQ ID NO: 385023 - RNA, 20 nt, Bordetella pertussis
ugcgucgccuggucgacgcc

SEQ ID NO: 385024 - RNA, 23 nt, Bordetella pertussis
ugcgucgccuggucgacgccggc

SEQ ID NO: 385025 - RNA, 14 nt, Bordetella pertussis
ugcgucucggccug

SEQ ID NO: 385026 - RNA, 15 nt, Bordetella pertussis
ugcgucucggccugu

SEQ ID NO: 385027 - RNA, 21 nt, Bordetella pertussis
ugcgugaccacgaucaugguc

SEQ ID NO: 385028 - RNA, 18 nt, Bordetella pertussis
ugcgugccgacgaugccg

SEQ ID NO: 385029 - RNA, 19 nt, Bordetella pertussis
ugcgugccgacgaugccgc

SEQ ID NO: 385030 - RNA, 14 nt, Bordetella pertussis
ugcgugccgcccag

SEQ ID NO: 385031 - RNA, 18 nt, Bordetella pertussis
ugcgugcgccuguccccg

SEQ ID NO: 385032 - RNA, 15 nt, Bordetella pertussis
ugcgugcgggacagg

SEQ ID NO: 385033 - RNA, 14 nt, Bordetella pertussis
ugcguggcgggccg

SEQ ID NO: 385034 - RNA, 15 nt, Bordetella pertussis
ugcguggcgggccgc

SEQ ID NO: 385035 - RNA, 18 nt, Bordetella pertussis
ugcguggcgggccgcgcc

SEQ ID NO: 385036 - RNA, 17 nt, Bordetella pertussis
ugcguggucgcgggugg

SEQ ID NO: 385037 - RNA, 15 nt, Bordetella pertussis
ugcgugucaggcgga

SEQ ID NO: 385038 - RNA, 13 nt, Bordetella pertussis
ugcgugugccgcc

SEQ ID NO: 385039 - RNA, 17 nt, Bordetella pertussis
ugcguguuccagcgccu

SEQ ID NO: 385040 - RNA, 19 nt, Bordetella pertussis
ugcguucgaaagccagcgc

SEQ ID NO: 385041 - RNA, 15 nt, Bordetella pertussis
ugcguucgcccgugc

SEQ ID NO: 385042 - RNA, 14 nt, Bordetella pertussis
ugcguucggccagc

SEQ ID NO: 385043 - RNA, 16 nt, Bordetella pertussis
ugcuacaccgugcugg

SEQ ID NO: 385044 - RNA, 19 nt, Bordetella pertussis
ugcucaaccucgacgcgca

SEQ ID NO: 385045 - RNA, 20 nt, Bordetella pertussis
ugcucaucggcaggccggcg

SEQ ID NO: 385046 - RNA, 20 nt, Bordetella pertussis
ugcuccagccaggcgcgcag

SEQ ID NO: 385047 - RNA, 20 nt, Bordetella pertussis
ugcucccaguucugcagcgu

SEQ ID NO: 385048 - RNA, 14 nt, Bordetella pertussis
ugcuccggcgugac

SEQ ID NO: 385049 - RNA, 18 nt, Bordetella pertussis
ugcucgagcaugcgggcc

SEQ ID NO: 385050 - RNA, 15 nt, Bordetella pertussis
ugcucgaugccggcc

SEQ ID NO: 385051 - RNA, 17 nt, Bordetella pertussis
ugcucgcaggccugcug

SEQ ID NO: 385052 - RNA, 18 nt, Bordetella pertussis
ugcucgcaggccugcugc

SEQ ID NO: 385053 - RNA, 22 nt, Bordetella pertussis
ugcucgcccacauagcggccgg

SEQ ID NO: 385054 - RNA, 17 nt, Bordetella pertussis
ugcucgcccauggcauc

SEQ ID NO: 385055 - RNA, 13 nt, Bordetella pertussis
ugcucgccgcgcg

SEQ ID NO: 385056 - RNA, 14 nt, Bordetella pertussis
ugcucgccgcgcga

SEQ ID NO: 385057 - RNA, 13 nt, Bordetella pertussis
ugcucgccggcgc

SEQ ID NO: 385058 - RNA, 21 nt, Bordetella pertussis
ugcucgcgcagcguggcggcg

SEQ ID NO: 385059 - RNA, 14 nt, Bordetella pertussis
ugcucggccagcgc

SEQ ID NO: 385060 - RNA, 20 nt, Bordetella pertussis
ugcucggccagcgcgcgcca

SEQ ID NO: 385061 - RNA, 14 nt, Bordetella pertussis
ugcucggcgaugcg

SEQ ID NO: 385062 - RNA, 12 nt, Bordetella pertussis
ugcucgggcgcc

SEQ ID NO: 385063 - RNA, 22 nt, Bordetella pertussis
ugcucgggcucgacuucggccg

SEQ ID NO: 385064 - RNA, 13 nt, Bordetella pertussis
ugcucggugagcg

SEQ ID NO: 385065 - RNA, 21 nt, Bordetella pertussis
ugcucguagcugucgaccgga

SEQ ID NO: 385066 - RNA, 19 nt, Bordetella pertussis
ugcucgucgccaugcggcu

SEQ ID NO: 385067 - RNA, 12 nt, Bordetella pertussis
ugcucugcccgu

SEQ ID NO: 385068 - RNA, 14 nt, Bordetella pertussis
ugcucugcccguac

SEQ ID NO: 385069 - RNA, 22 nt, Bordetella pertussis
ugcucuggcacaccagcgccag

SEQ ID NO: 385070 - RNA, 15 nt, Bordetella pertussis
ugcugaaccugcugg

SEQ ID NO: 385071 - RNA, 17 nt, Bordetella pertussis
ugcugaaccugcuggcc

SEQ ID NO: 385072 - RNA, 17 nt, Bordetella pertussis
ugcugaccgacggccug

SEQ ID NO: 385073 - RNA, 17 nt, Bordetella pertussis
ugcugacggugccggcc

SEQ ID NO: 385074 - RNA, 24 nt, Bordetella pertussis
ugcugacggugccggccagccugc

SEQ ID NO: 385075 - RNA, 14 nt, Bordetella pertussis
ugcugagacggcgg

SEQ ID NO: 385076 - RNA, 20 nt, Bordetella pertussis
ugcugaucgacaugcuggcc

SEQ ID NO: 385077 - RNA, 15 nt, Bordetella pertussis
ugcugcaauucgccg

SEQ ID NO: 385078 - RNA, 11 nt, Bordetella pertussis
ugcugcagcgc

SEQ ID NO: 385079 - RNA, 20 nt, Bordetella pertussis
ugcugcagcgcaucgccgca

SEQ ID NO: 385080 - RNA, 15 nt, Bordetella pertussis
ugcugcagggcugcg

SEQ ID NO: 385081 - RNA, 20 nt, Bordetella pertussis
ugcugccggauuggcgcugc

SEQ ID NO: 385082 - RNA, 23 nt, Bordetella pertussis
ugcugccguuucucaacccgccg

SEQ ID NO: 385083 - RNA, 16 nt, Bordetella pertussis
ugcugcgccuggccgc

SEQ ID NO: 385084 - RNA, 16 nt, Bordetella pertussis
ugcugcgcguggccau

SEQ ID NO: 385085 - RNA, 17 nt, Bordetella pertussis
ugcugcgcguggccauc

SEQ ID NO: 385086 - RNA, 15 nt, Bordetella pertussis
ugcugcggcacgauu

SEQ ID NO: 385087 - RNA, 22 nt, Bordetella pertussis
ugcugcggcacggccagcggcg

SEQ ID NO: 385088 - RNA, 14 nt, Bordetella pertussis
ugcugcucggccau

SEQ ID NO: 385089 - RNA, 22 nt, Bordetella pertussis
ugcugcuggagaucgccgagcg

SEQ ID NO: 385090 - RNA, 24 nt, Bordetella pertussis
ugcugcuggagaucgccgagcggc

SEQ ID NO: 385091 - RNA, 16 nt, Bordetella pertussis
ugcugcugggcgccau

SEQ ID NO: 385092 - RNA, 20 nt, Bordetella pertussis
ugcugcuguucgccacgcug

SEQ ID NO: 385093 - RNA, 14 nt, Bordetella pertussis
ugcuggaacaccau

SEQ ID NO: 385094 - RNA, 15 nt, Bordetella pertussis
ugcuggacccgcugc

SEQ ID NO: 385095 - RNA, 20 nt, Bordetella pertussis
ugcuggagaucgccgagcgg

SEQ ID NO: 385096 - RNA, 21 nt, Bordetella pertussis
ugcuggagcgccacgccguca

SEQ ID NO: 385097 - RNA, 22 nt, Bordetella pertussis
ugcuggagcgccacgccgucag

SEQ ID NO: 385098 - RNA, 21 nt, Bordetella pertussis
ugcuggcaaagcgcgcguccu

SEQ ID NO: 385099 - RNA, 19 nt, Bordetella pertussis
ugcuggcccagcugggcgg

SEQ ID NO: 385100 - RNA, 21 nt, Bordetella pertussis
ugcuggcccagcugggcggcg

SEQ ID NO: 385101 - RNA, 13 nt, Bordetella pertussis
ugcuggcccagga

SEQ ID NO: 385102 - RNA, 12 nt, Bordetella pertussis
ugcuggcccgcc

SEQ ID NO: 385103 - RNA, 14 nt, Bordetella pertussis
ugcuggcccgccag

SEQ ID NO: 385104 - RNA, 14 nt, Bordetella pertussis
ugcuggccggccag

SEQ ID NO: 385105 - RNA, 23 nt, Bordetella pertussis
ugcuggcgcagcagcgccggcag

SEQ ID NO: 385106 - RNA, 21 nt, Bordetella pertussis
ugcuggcgcaguaucccggcc

SEQ ID NO: 385107 - RNA, 11 nt, Bordetella pertussis
ugcuggcgcgc

SEQ ID NO: 385108 - RNA, 12 nt, Bordetella pertussis
ugcuggcgcgcc

SEQ ID NO: 385109 - RNA, 13 nt, Bordetella pertussis
ugcuggcgcgcca

SEQ ID NO: 385110 - RNA, 11 nt, Bordetella pertussis
ugcuggcgcgu

SEQ ID NO: 385111 - RNA, 21 nt, Bordetella pertussis
ugcuggcgcgucggcgcgcgc

SEQ ID NO: 385112 - RNA, 13 nt, Bordetella pertussis
ugcuggcggcauc

SEQ ID NO: 385113 - RNA, 19 nt, Bordetella pertussis
ugcugggcaugauggugcu

SEQ ID NO: 385114 - RNA, 14 nt, Bordetella pertussis
ugcugggccgcgcu

SEQ ID NO: 385115 - RNA, 15 nt, Bordetella pertussis
ugcugguacagcccc

SEQ ID NO: 385116 - RNA, 12 nt, Bordetella pertussis
ugcuggucgcgc

SEQ ID NO: 385117 - RNA, 14 nt, Bordetella pertussis
ugcuggucggcgug

SEQ ID NO: 385118 - RNA, 23 nt, Bordetella pertussis
ugcugucgcucaugaccagcggc

SEQ ID NO: 385119 - RNA, 20 nt, Bordetella pertussis
ugcugugccugccaagcgcc

SEQ ID NO: 385120 - RNA, 20 nt, Bordetella pertussis
ugcuucgagauccgccggcg

SEQ ID NO: 385121 - RNA, 17 nt, Bordetella pertussis
ugcuugaggccgcgcgc

SEQ ID NO: 385122 - RNA, 20 nt, Bordetella pertussis
ugcuugccgcagcggccaug

SEQ ID NO: 385123 - RNA, 19 nt, Bordetella pertussis
ugcuugcgauaggugcgca

SEQ ID NO: 385124 - RNA, 16 nt, Bordetella pertussis
ugcuugccugucccca

SEQ ID NO: 385125 - RNA, 21 nt, Bordetella pertussis
ugcuugcggcuguccaccugc

SEQ ID NO: 385126 - RNA, 15 nt, Bordetella pertussis
ugcuugggggcgugg

SEQ ID NO: 385127 - RNA, 17 nt, Bordetella pertussis
ugcuuugcgggcgcgcu

SEQ ID NO: 385128 - RNA, 21 nt, Bordetella pertussis
uggaaauacagaucgccgccg

SEQ ID NO: 385129 - RNA, 14 nt, Bordetella pertussis
uggaaaugccggcg

SEQ ID NO: 385130 - RNA, 16 nt, Bordetella pertussis
uggaaaugccggcggc

SEQ ID NO: 385131 - RNA, 12 nt, Bordetella pertussis
uggccgcgccca

SEQ ID NO: 385132 - RNA, 12 nt, Bordetella pertussis
uggccgcgcccg

SEQ ID NO: 385133 - RNA, 21 nt, Bordetella pertussis
uggccgcgcccgccgcgccau

SEQ ID NO: 385134 - RNA, 14 nt, Bordetella pertussis
uggccgcgccguuc

SEQ ID NO: 385135 - RNA, 15 nt, Bordetella pertussis
uggccgcgcgccggc

SEQ ID NO: 385136 - RNA, 18 nt, Bordetella pertussis
uggccgcgcgccggcgcc

SEQ ID NO: 385137 - RNA, 20 nt, Bordetella pertussis
uggccgcgcgccggcgccgu

SEQ ID NO: 385138 - RNA, 15 nt, Bordetella pertussis
uggccgcgcggcgcc

SEQ ID NO: 385139 - RNA, 17 nt, Bordetella pertussis
uggccgcgcuggcggcg

SEQ ID NO: 385140 - RNA, 20 nt, Bordetella pertussis
uggccgcgcuggcggcgcag

SEQ ID NO: 385141 - RNA, 12 nt, Bordetella pertussis
uggccgcggcgu

SEQ ID NO: 385142 - RNA, 21 nt, Bordetella pertussis
uggccgcggcguccgcgccga

SEQ ID NO: 385143 - RNA, 18 nt, Bordetella pertussis
uggccgcgguccgggcca

SEQ ID NO: 385144 - RNA, 18 nt, Bordetella pertussis
uggccgcguacaacgccg

SEQ ID NO: 385145 - RNA, 16 nt, Bordetella pertussis
uggccgcguagcccau

SEQ ID NO: 385146 - RNA, 14 nt, Bordetella pertussis
uggccgcggcccag

SEQ ID NO: 385147 - RNA, 20 nt, Bordetella pertussis
uggccgcggcccagcgcggc

SEQ ID NO: 385148 - RNA, 15 nt, Bordetella pertussis
uggccgcuucggcgg

SEQ ID NO: 385149 - RNA, 19 nt, Bordetella pertussis
uggccgcuucggcggccau

SEQ ID NO: 385150 - RNA, 16 nt, Bordetella pertussis
uggccggaucgagcgc

SEQ ID NO: 385151 - RNA, 12 nt, Bordetella pertussis
uggccggggcgu

SEQ ID NO: 385152 - RNA, 15 nt, Bordetella pertussis
uggccgggucgcgca

SEQ ID NO: 385153 - RNA, 19 nt, Bordetella pertussis
uggccgggucgcgcagcag

SEQ ID NO: 385154 - RNA, 19 nt, Bordetella pertussis
uggccgggugguccaugcg

SEQ ID NO: 385155 - RNA, 20 nt, Bordetella pertussis
uggccggugagauccagcga

SEQ ID NO: 385156 - RNA, 16 nt, Bordetella pertussis
uggccggugaugcggc

SEQ ID NO: 385157 - RNA, 18 nt, Bordetella pertussis
uggccggugaugcggcgc

SEQ ID NO: 385158 - RNA, 17 nt, Bordetella pertussis
uggccguacauggccag

SEQ ID NO: 385159 - RNA, 23 nt, Bordetella pertussis
uggccguagcguuggcggccggc

SEQ ID NO: 385160 - RNA, 18 nt, Bordetella pertussis
uggccgucgccagcgacg

SEQ ID NO: 385161 - RNA, 16 nt, Bordetella pertussis
uggccguucggugcgc

SEQ ID NO: 385162 - RNA, 18 nt, Bordetella pertussis
uggccucgcccuggcgca

SEQ ID NO: 385163 - RNA, 17 nt, Bordetella pertussis
uggccucggcggccucc

SEQ ID NO: 385164 - RNA, 16 nt, Bordetella pertussis
uggccucggcauggcg

SEQ ID NO: 385165 - RNA, 19 nt, Bordetella pertussis
uggcgaaugccugguaggc

SEQ ID NO: 385166 - RNA, 19 nt, Bordetella pertussis
uggcgaccacuaucagcgc

SEQ ID NO: 385167 - RNA, 12 nt, Bordetella pertussis
uggcgacggccu

SEQ ID NO: 385168 - RNA, 15 nt, Bordetella pertussis
uggcgacggccugcc

SEQ ID NO: 385169 - RNA, 21 nt, Bordetella pertussis
uggcgacgucgggcagggcga

SEQ ID NO: 385170 - RNA, 15 nt, Bordetella pertussis
uggcgagcacccgca

SEQ ID NO: 385171 - RNA, 16 nt, Bordetella pertussis
uggcgagcacccgcag

SEQ ID NO: 385172 - RNA, 19 nt, Bordetella pertussis
uggcgagcaguucgacacc

SEQ ID NO: 385173 - RNA, 19 nt, Bordetella pertussis
uggcgagggucaggcgcgc

SEQ ID NO: 385174 - RNA, 21 nt, Bordetella pertussis
uggcgagggucaggcgcgcuu

SEQ ID NO: 385175 - RNA, 18 nt, Bordetella pertussis
uggcgauagcgcuccagc

SEQ ID NO: 385176 - RNA, 13 nt, Bordetella pertussis
uggcgaucacggc

SEQ ID NO: 385177 - RNA, 16 nt, Bordetella pertussis
uggcgaucacggccaa

SEQ ID NO: 385178 - RNA, 20 nt, Bordetella pertussis
uggcgaucaguuccuucugg

SEQ ID NO: 385179 - RNA, 20 nt, Bordetella pertussis
uggcgaucgaacgcggccag

SEQ ID NO: 385180 - RNA, 22 nt, Bordetella pertussis
uggcgaucgaacgcggccagac

SEQ ID NO: 385181 - RNA, 18 nt, Bordetella pertussis
uggcgauccagggccgcc

SEQ ID NO: 385182 - RNA, 20 nt, Bordetella pertussis
uggcgaucucguccugcagg

SEQ ID NO: 385183 - RNA, 18 nt, Bordetella pertussis
uggcgaucuucugggcgg

SEQ ID NO: 385184 - RNA, 19 nt, Bordetella pertussis
uggcgaucuucugggcggc

SEQ ID NO: 385185 - RNA, 18 nt, Bordetella pertussis
uggcgaugaccucggcga

SEQ ID NO: 385186 - RNA, 12 nt, Bordetella pertussis
uggcgaugccgg

SEQ ID NO: 385187 - RNA, 13 nt, Bordetella pertussis
uggcgaugcgggc

SEQ ID NO: 385188 - RNA, 20 nt, Bordetella pertussis
uggcgaugcgggccacgccg

SEQ ID NO: 385189 - RNA, 19 nt, Bordetella pertussis
uggcgaugcccaccagccg

SEQ ID NO: 385190 - RNA, 16 nt, Bordetella pertussis
uggcgauguucacgcg

SEQ ID NO: 385191 - RNA, 16 nt, Bordetella pertussis
uggcgcaaaccacguc

SEQ ID NO: 385192 - RNA, 18 nt, Bordetella pertussis
uggcgcaagacgcggcag

SEQ ID NO: 385193 - RNA, 20 nt, Bordetella pertussis
uggcgcaaggcaugcgccag

SEQ ID NO: 385194 - RNA, 20 nt, Bordetella pertussis
uggcgccgacccugcccggc

SEQ ID NO: 385195 - RNA, 13 nt, Bordetella pertussis
uggcgccgcgccg

SEQ ID NO: 385196 - RNA, 12 nt, Bordetella pertussis
uggcgccgcgcg

SEQ ID NO: 385197 - RNA, 13 nt, Bordetella pertussis
uggcgccgcgcgc

SEQ ID NO: 385198 - RNA, 14 nt, Bordetella pertussis
uggcgccgcggccg

SEQ ID NO: 385199 - RNA, 22 nt, Bordetella pertussis
uggcgccgcugucgcugaucug

SEQ ID NO: 385200 - RNA, 23 nt, Bordetella pertussis
uggcgccgcugucgcugaucugc

SEQ ID NO: 385201 - RNA, 19 nt, Bordetella pertussis
uggcgccggacugggcguc

SEQ ID NO: 385202 - RNA, 18 nt, Bordetella pertussis
uggcgccggccaccgccu

SEQ ID NO: 385203 - RNA, 13 nt, Bordetella pertussis
uggcgccggccag

SEQ ID NO: 385204 - RNA, 16 nt, Bordetella pertussis
uggcgccggccagcgc

SEQ ID NO: 385205 - RNA, 19 nt, Bordetella pertussis
uggcgccggccagcgcgcc

SEQ ID NO: 385206 - RNA, 17 nt, Bordetella pertussis
uggcgccggcggccucc

SEQ ID NO: 385207 - RNA, 21 nt, Bordetella pertussis
uggcgccggucugggcgcgga

SEQ ID NO: 385208 - RNA, 23 nt, Bordetella pertussis
uggcgccguuccugcagcgugcu

SEQ ID NO: 385209 - RNA, 22 nt, Bordetella pertussis
uggcgccuuccggcagcggcca

SEQ ID NO: 385210 - RNA, 22 nt, Bordetella pertussis
uggcgccuucgaacucgauggc

SEQ ID NO: 385211 - RNA, 19 nt, Bordetella pertussis
uggcgcggcgccugcgcgc

SEQ ID NO: 385212 - RNA, 21 nt, Bordetella pertussis
uggcgcggcgcuacgccgccg

SEQ ID NO: 385213 - RNA, 20 nt, Bordetella pertussis
uggcgcggaugaccugcgcc

SEQ ID NO: 385214 - RNA, 18 nt, Bordetella pertussis
uggcgcggcuggcgaugg

SEQ ID NO: 385215 - RNA, 14 nt, Bordetella pertussis
uggcgcgugcgcgc

SEQ ID NO: 385216 - RNA, 19 nt, Bordetella pertussis
uggcgcuccucgcgcgcgg

SEQ ID NO: 385217 - RNA, 14 nt, Bordetella pertussis
uggcgcucgggcgc

SEQ ID NO: 385218 - RNA, 16 nt, Bordetella pertussis
uggcgcucgggcgcgg

SEQ ID NO: 385219 - RNA, 17 nt, Bordetella pertussis
uggcgcucgggcgcggc

SEQ ID NO: 385220 - RNA, 15 nt, Bordetella pertussis
uggcgcugcacaggg

SEQ ID NO: 385221 - RNA, 16 nt, Bordetella pertussis
uggcggccgccgccag

SEQ ID NO: 385222 - RNA, 14 nt, Bordetella pertussis
uggcggccggccag

SEQ ID NO: 385223 - RNA, 13 nt, Bordetella pertussis
uggcggccggcgu

SEQ ID NO: 385224 - RNA, 13 nt, Bordetella pertussis
uggcggccgugcc

SEQ ID NO: 385225 - RNA, 19 nt, Bordetella pertussis
uggcggccuucaugaucug

SEQ ID NO: 385226 - RNA, 23 nt, Bordetella pertussis
uggcggccuugcgggccggcugg

SEQ ID NO: 385227 - RNA, 22 nt, Bordetella pertussis
uggcggcgacggcgucggccug

SEQ ID NO: 385228 - RNA, 16 nt, Bordetella pertussis
uggcggcgaugccgcu

SEQ ID NO: 385229 - RNA, 19 nt, Bordetella pertussis
uggcggcgauguggcgcgc

SEQ ID NO: 385230 - RNA, 13 nt, Bordetella pertussis
uggcggcgcagcc

SEQ ID NO: 385231 - RNA, 20 nt, Bordetella pertussis
uggcggcgcaggccgcgccg

SEQ ID NO: 385232 - RNA, 17 nt, Bordetella pertussis
uggcggcgcgcggcugg

SEQ ID NO: 385233 - RNA, 22 nt, Bordetella pertussis
uggcggcgcgcuuggucagcau

SEQ ID NO: 385234 - RNA, 14 nt, Bordetella pertussis
uggcggcggucaau

SEQ ID NO: 385235 - RNA, 19 nt, Bordetella pertussis
uggcggcuggcgcggccgu

SEQ ID NO: 385236 - RNA, 19 nt, Bordetella pertussis
uggcggcugucgggcggcg

SEQ ID NO: 385237 - RNA, 22 nt, Bordetella pertussis
uggcgggaggaagggugcggcg

SEQ ID NO: 385238 - RNA, 14 nt, Bordetella pertussis
uggcgggccagcuc

SEQ ID NO: 385239 - RNA, 15 nt, Bordetella pertussis
uggcgggccgcgccg

SEQ ID NO: 385240 - RNA, 19 nt, Bordetella pertussis
uggcgggcgagaucagcca

SEQ ID NO: 385241 - RNA, 21 nt, Bordetella pertussis
uggcggggaauucgaccggac

SEQ ID NO: 385242 - RNA, 20 nt, Bordetella pertussis
uggcggggugccuguccccg

SEQ ID NO: 385243 - RNA, 17 nt, Bordetella pertussis
uggcgggguuggccgcc

SEQ ID NO: 385244 - RNA, 19 nt, Bordetella pertussis
uggcgggguuggccgccag

SEQ ID NO: 385245 - RNA, 18 nt, Bordetella pertussis
uggcggguccacguggcg

SEQ ID NO: 385246 - RNA, 22 nt, Bordetella pertussis
uggcggguccacguggcgacgu

SEQ ID NO: 385247 - RNA, 15 nt, Bordetella pertussis
uggcggggcguucga

SEQ ID NO: 385248 - RNA, 19 nt, Bordetella pertussis
uggcgguagacgccgggac

SEQ ID NO: 385249 - RNA, 16 nt, Bordetella pertussis
uggcggucaccaacgc

SEQ ID NO: 385250 - RNA, 21 nt, Bordetella pertussis
uggcggugaaggcgcccgggc

SEQ ID NO: 385251 - RNA, 16 nt, Bordetella pertussis
uggcggugcgugcgcc

SEQ ID NO: 385252 - RNA, 16 nt, Bordetella pertussis
uggcgguggccgcgca

SEQ ID NO: 385253 - RNA, 14 nt, Bordetella pertussis
uggcguuugcgcgc

SEQ ID NO: 385254 - RNA, 17 nt, Bordetella pertussis
uggcguuuuuccaggaa

SEQ ID NO: 385255 - RNA, 21 nt, Bordetella pertussis
uggcucagucggccuggcgcu

SEQ ID NO: 385256 - RNA, 15 nt, Bordetella pertussis
uggcucgggcagcag

SEQ ID NO: 385257 - RNA, 13 nt, Bordetella pertussis
uggcucugaucgc

SEQ ID NO: 385258 - RNA, 14 nt, Bordetella pertussis
uggcugggccugcu

SEQ ID NO: 385259 - RNA, 20 nt, Bordetella pertussis
uggcuggggcuggcauggcg

SEQ ID NO: 385260 - RNA, 22 nt, Bordetella pertussis
uggcuggggcuggcauggcggu

SEQ ID NO: 385261 - RNA, 14 nt, Bordetella pertussis
uggcuugcagcgcc

SEQ ID NO: 385262 - RNA, 16 nt, Bordetella pertussis
uggcuuggcggccagg

SEQ ID NO: 385263 - RNA, 14 nt, Bordetella pertussis
ugggaucgcgccag

SEQ ID NO: 385264 - RNA, 21 nt, Bordetella pertussis
ugggcaaaacgcgcauucgac

SEQ ID NO: 385265 - RNA, 15 nt, Bordetella pertussis
ugggcacauccagcg

SEQ ID NO: 385266 - RNA, 21 nt, Bordetella pertussis
ugggcaccgugaugcgcgccg

SEQ ID NO: 385267 - RNA, 15 nt, Bordetella pertussis
ugggcacgcgcgcgg

SEQ ID NO: 385268 - RNA, 20 nt, Bordetella pertussis
ugggcacgcgcgcggcgcgg

SEQ ID NO: 385269 - RNA, 22 nt, Bordetella pertussis
ugggcagaacggaaacgcccag

SEQ ID NO: 385270 - RNA, 19 nt, Bordetella pertussis
ugggccaguccgcagcgca

SEQ ID NO: 385271 - RNA, 13 nt, Bordetella pertussis
ugggcccgggcgc

SEQ ID NO: 385272 - RNA, 16 nt, Bordetella pertussis
ugggcccgggcgcgcu

SEQ ID NO: 385273 - RNA, 17 nt, Bordetella pertussis
ugggccgagcgcgccag

SEQ ID NO: 385274 - RNA, 15 nt, Bordetella pertussis
ugggccgacaugccg

SEQ ID NO: 385275 - RNA, 23 nt, Bordetella pertussis
ugggccgccugcugggccgcgcu

SEQ ID NO: 385276 - RNA, 13 nt, Bordetella pertussis
ugggccgcgccug

SEQ ID NO: 385277 - RNA, 14 nt, Bordetella pertussis
ugggccggcgcgcg

SEQ ID NO: 385278 - RNA, 15 nt, Bordetella pertussis
ugggccggcgcgcgc

SEQ ID NO: 385279 - RNA, 16 nt, Bordetella pertussis
ugggccgucaugcgcc

SEQ ID NO: 385280 - RNA, 14 nt, Bordetella pertussis
ugggcgccagcagc

SEQ ID NO: 385281 - RNA, 14 nt, Bordetella pertussis
ugggcgccggccag

SEQ ID NO: 385282 - RNA, 15 nt, Bordetella pertussis
ugggcgccggccagg

SEQ ID NO: 385283 - RNA, 17 nt, Bordetella pertussis
ugggcgccgugcccgac

SEQ ID NO: 385284 - RNA, 19 nt, Bordetella pertussis
ugggcgccuacggcggcgg

SEQ ID NO: 385285 - RNA, 19 nt, Bordetella pertussis
ugggcgcgcacaagcgcga

SEQ ID NO: 385286 - RNA, 14 nt, Bordetella pertussis
ugggcgcgcgccca

SEQ ID NO: 385287 - RNA, 16 nt, Bordetella pertussis
ugggcgcggcgcgcgc

SEQ ID NO: 385288 - RNA, 17 nt, Bordetella pertussis
ugggcgcggcggccugg

SEQ ID NO: 385289 - RNA, 21 nt, Bordetella pertussis
ugggcgcggcggccugggcgg

SEQ ID NO: 385290 - RNA, 22 nt, Bordetella pertussis
ugggcggagucgauaugccgau

SEQ ID NO: 385291 - RNA, 13 nt, Bordetella pertussis
ugggcucgaugcg

SEQ ID NO: 385292 - RNA, 21 nt, Bordetella pertussis
ugggcucgaugcguccgucgg

SEQ ID NO: 385293 - RNA, 14 nt, Bordetella pertussis
ugggcucgcgcgag

SEQ ID NO: 385294 - RNA, 15 nt, Bordetella pertussis
ugggcugcggcgugg

SEQ ID NO: 385295 - RNA, 19 nt, Bordetella pertussis
ugggcugguaggggaugcg

SEQ ID NO: 385296 - RNA, 20 nt, Bordetella pertussis
ugggcuguauagaugcgcgg

SEQ ID NO: 385297 - RNA, 23 nt, Bordetella pertussis
ugggcuguucguagucgagccag

SEQ ID NO: 385298 - RNA, 13 nt, Bordetella pertussis
uggggaagcgcuc

SEQ ID NO: 385299 - RNA, 19 nt, Bordetella pertussis
uggggacaugcaugaacgc

SEQ ID NO: 385300 - RNA, 13 nt, Bordetella pertussis
uggggacgggcgc

SEQ ID NO: 385301 - RNA, 14 nt, Bordetella pertussis
uggggacgggcgca

SEQ ID NO: 385302 - RNA, 16 nt, Bordetella pertussis
uggggacuggcacccg

SEQ ID NO: 385303 - RNA, 12 nt, Bordetella pertussis
uggggcagcagg

SEQ ID NO: 385304 - RNA, 13 nt, Bordetella pertussis
uggggcaggcgca

SEQ ID NO: 385305 - RNA, 16 nt, Bordetella pertussis
uggggcaggcgcagcg

SEQ ID NO: 385306 - RNA, 15 nt, Bordetella pertussis
uggggccgccuggac

SEQ ID NO: 385307 - RNA, 16 nt, Bordetella pertussis
uggggccgcggcgcgc

SEQ ID NO: 385308 - RNA, 22 nt, Bordetella pertussis
uggggccggccgcgcgcgccag

SEQ ID NO: 385309 - RNA, 14 nt, Bordetella pertussis
uggguacagcgcgc

SEQ ID NO: 385310 - RNA, 15 nt, Bordetella pertussis
uggguacagcgcgcc

SEQ ID NO: 385311 - RNA, 17 nt, Bordetella pertussis
ugggucaucagcacgau

SEQ ID NO: 385312 - RNA, 16 nt, Bordetella pertussis
ugggucugcaccggcu

SEQ ID NO: 385313 - RNA, 18 nt, Bordetella pertussis
ugguacgaucaggcggcg

SEQ ID NO: 385314 - RNA, 14 nt, Bordetella pertussis
ugguagaugcgcgc

SEQ ID NO: 385315 - RNA, 15 nt, Bordetella pertussis
ugguagccggcgacg

SEQ ID NO: 385316 - RNA, 13 nt, Bordetella pertussis
ugguagcgcaacu

SEQ ID NO: 385317 - RNA, 18 nt, Bordetella pertussis
ugguagcgguccagcugc

SEQ ID NO: 385318 - RNA, 23 nt, Bordetella pertussis
ugguaggccgauucgccguggcu

SEQ ID NO: 385319 - RNA, 15 nt, Bordetella pertussis
uggucaagggcggcc

SEQ ID NO: 385320 - RNA, 20 nt, Bordetella pertussis
uggucaagggcggccaugcc

SEQ ID NO: 385321 - RNA, 20 nt, Bordetella pertussis
uggucaccacccgcacgccg

SEQ ID NO: 385322 - RNA, 14 nt, Bordetella pertussis
uggucacggccucg

SEQ ID NO: 385323 - RNA, 19 nt, Bordetella pertussis
uggucagcaccucggcgcc

SEQ ID NO: 385324 - RNA, 13 nt, Bordetella pertussis
uggucagccgugu

SEQ ID NO: 385325 - RNA, 17 nt, Bordetella pertussis
uggucaucgccaugcug

SEQ ID NO: 385326 - RNA, 17 nt, Bordetella pertussis
ugguccaggcggugcgu

SEQ ID NO: 385327 - RNA, 20 nt, Bordetella pertussis
uggucgaaguagaacgccgg

SEQ ID NO: 385328 - RNA, 19 nt, Bordetella pertussis
uggucgacauagacgcgca

SEQ ID NO: 385329 - RNA, 19 nt, Bordetella pertussis
uggucgagagccugggcgc

SEQ ID NO: 385330 - RNA, 22 nt, Bordetella pertussis
uggucgagagccugggcgcgcg

SEQ ID NO: 385331 - RNA, 19 nt, Bordetella pertussis
uggucgagcgccugcgcca

SEQ ID NO: 385332 - RNA, 18 nt, Bordetella pertussis
uggucgagcgggcgccag

SEQ ID NO: 385333 - RNA, 14 nt, Bordetella pertussis
uggucgauggucag

SEQ ID NO: 385334 - RNA, 15 nt, Bordetella pertussis
uggucgccagcacgc

SEQ ID NO: 385335 - RNA, 18 nt, Bordetella pertussis
uggucgccagcacgcgca

SEQ ID NO: 385336 - RNA, 20 nt, Bordetella pertussis
uggucgcgaccucggcggcg

SEQ ID NO: 385337 - RNA, 15 nt, Bordetella pertussis
uggucgcgcagcugc

SEQ ID NO: 385338 - RNA, 15 nt, Bordetella pertussis
uggucgcgcccgccg

SEQ ID NO: 385339 - RNA, 20 nt, Bordetella pertussis
uggucgcgcccgccguggcc

SEQ ID NO: 385340 - RNA, 17 nt, Bordetella pertussis
uggucgcgggugguggc

SEQ ID NO: 385341 - RNA, 16 nt, Bordetella pertussis
uggucgcuggcgccgg

SEQ ID NO: 385342 - RNA, 17 nt, Bordetella pertussis
uggucggcauggccauc

SEQ ID NO: 385343 - RNA, 20 nt, Bordetella pertussis
uggucgggaugccccgcccg

SEQ ID NO: 385344 - RNA, 16 nt, Bordetella pertussis
uggucgugcuggcgcg

SEQ ID NO: 385345 - RNA, 19 nt, Bordetella pertussis
uggucgugcuggcgcgugc

SEQ ID NO: 385346 - RNA, 20 nt, Bordetella pertussis
uggucucccccucggccugc

SEQ ID NO: 385347 - RNA, 22 nt, Bordetella pertussis
uggugaaacagcaucagcggca

SEQ ID NO: 385348 - RNA, 19 nt, Bordetella pertussis
uggugaaaucccccgccac

SEQ ID NO: 385349 - RNA, 23 nt, Bordetella pertussis
uggugaagcccucgucgcggccg

SEQ ID NO: 385350 - RNA, 19 nt, Bordetella pertussis
uggugcaccacgcgcucca

SEQ ID NO: 385351 - RNA, 23 nt, Bordetella pertussis
uggugcacgaugcccagggccgc

SEQ ID NO: 385352 - RNA, 20 nt, Bordetella pertussis
uggugcagcggcagcauggc

SEQ ID NO: 385353 - RNA, 22 nt, Bordetella pertussis
uggugcagcggcagcauggcgc

SEQ ID NO: 385354 - RNA, 13 nt, Bordetella pertussis
uggugccgcgcag

SEQ ID NO: 385355 - RNA, 14 nt, Bordetella pertussis
uggugcgcaccuug

SEQ ID NO: 385356 - RNA, 13 nt, Bordetella pertussis
uggugcgcgccag

SEQ ID NO: 385357 - RNA, 13 nt, Bordetella pertussis
uggugcgcguccu

SEQ ID NO: 385358 - RNA, 16 nt, Bordetella pertussis
uggugucggcggccag

SEQ ID NO: 385359 - RNA, 20 nt, Bordetella pertussis
uggugucggcggcgagcugg

SEQ ID NO: 385360 - RNA, 22 nt, Bordetella pertussis
uguaaaaacccggccugcgcgc

SEQ ID NO: 385361 - RNA, 17 nt, Bordetella pertussis
uguaucguugucgcgcc

SEQ ID NO: 385362 - RNA, 19 nt, Bordetella pertussis
uguauuccaucuugccggc

SEQ ID NO: 385363 - RNA, 14 nt, Bordetella pertussis
ugucaagcagcgcc

SEQ ID NO: 385364 - RNA, 15 nt, Bordetella pertussis
ugucaagcagcgccg

SEQ ID NO: 385365 - RNA, 13 nt, Bordetella pertussis
uguccagcgcgcc

SEQ ID NO: 385366 - RNA, 16 nt, Bordetella pertussis
uguccagcgcgcccag

SEQ ID NO: 385367 - RNA, 17 nt, Bordetella pertussis
uguccagcgcgcccagc

SEQ ID NO: 385368 - RNA, 14 nt, Bordetella pertussis
ugucacacgaagaa

SEQ ID NO: 385369 - RNA, 14 nt, Bordetella pertussis
uguccagcuccagc

SEQ ID NO: 385370 - RNA, 15 nt, Bordetella pertussis
uguccaggccggggc

SEQ ID NO: 385371 - RNA, 22 nt, Bordetella pertussis
uguccaggccggggccgcccag

SEQ ID NO: 385372 - RNA, 20 nt, Bordetella pertussis
ugucccaaccgggacaggca

SEQ ID NO: 385373 - RNA, 17 nt, Bordetella pertussis
ugucccagcggggacag

SEQ ID NO: 385374 - RNA, 20 nt, Bordetella pertussis
ugucccagcggggacaggca

SEQ ID NO: 385375 - RNA, 22 nt, Bordetella pertussis
uguccccacagggggacuggca

SEQ ID NO: 385376 - RNA, 20 nt, Bordetella pertussis
uguccccacggggacaggca

SEQ ID NO: 385377 - RNA, 22 nt, Bordetella pertussis
uguccccgaacggggacuggca

SEQ ID NO: 385378 - RNA, 23 nt, Bordetella pertussis
uguccccgcaagggggacuggca

SEQ ID NO: 385379 - RNA, 20 nt, Bordetella pertussis
uguccccgccgggacaggca

SEQ ID NO: 385380 - RNA, 20 nt, Bordetella pertussis
uguccccgcugggacaggca

SEQ ID NO: 385381 - RNA, 23 nt, Bordetella pertussis
uguccccgcugggacaggcacac

SEQ ID NO: 385382 - RNA, 18 nt, Bordetella pertussis
ugucccgacggggacagg

SEQ ID NO: 385383 - RNA, 20 nt, Bordetella pertussis
ugucccgacggggacaggcu

SEQ ID NO: 385384 - RNA, 13 nt, Bordetella pertussis
ugucccgaggcgc

SEQ ID NO: 385385 - RNA, 15 nt, Bordetella pertussis
ugucccgaggcgccc

SEQ ID NO: 385386 - RNA, 20 nt, Bordetella pertussis
uguccccguggggacaggca

SEQ ID NO: 385387 - RNA, 13 nt, Bordetella pertussis
uguccuggcgcgc

SEQ ID NO: 385388 - RNA, 18 nt, Bordetella pertussis
uguccuggucggcgcggc

SEQ ID NO: 385389 - RNA, 19 nt, Bordetella pertussis
uguccugguugccgaggac

SEQ ID NO: 385390 - RNA, 15 nt, Bordetella pertussis
ugucgaacaccaggu

SEQ ID NO: 385391 - RNA, 19 nt, Bordetella pertussis
ugucgcaggccgcggccag

SEQ ID NO: 385392 - RNA, 16 nt, Bordetella pertussis
ugucgcagucggggcc

SEQ ID NO: 385393 - RNA, 22 nt, Bordetella pertussis
ugucgcccaccacgccgcccag

SEQ ID NO: 385394 - RNA, 15 nt, Bordetella pertussis
ugucgccgccgcgca

SEQ ID NO: 385395 - RNA, 18 nt, Bordetella pertussis
ugucgccgccgcgcacca

SEQ ID NO: 385396 - RNA, 15 nt, Bordetella pertussis
ugucgccgccugcgg

SEQ ID NO: 385397 - RNA, 17 nt, Bordetella pertussis
ugucgccgcggccggcg

SEQ ID NO: 385398 - RNA, 20 nt, Bordetella pertussis
ugucgccgcggccggcgcag

SEQ ID NO: 385399 - RNA, 23 nt, Bordetella pertussis
ugucgccggucacguacucgccg

SEQ ID NO: 385400 - RNA, 13 nt, Bordetella pertussis
ugucggacgagca

SEQ ID NO: 385401 - RNA, 23 nt, Bordetella pertussis
ugucggccagggaggcgaugcug

SEQ ID NO: 385402 - RNA, 19 nt, Bordetella pertussis
ugucggccgaaccgcgcag

SEQ ID NO: 385403 - RNA, 15 nt, Bordetella pertussis
ugucggccgcgcgca

SEQ ID NO: 385404 - RNA, 23 nt, Bordetella pertussis
ugucggggaagauguggucggcg

SEQ ID NO: 385405 - RNA, 17 nt, Bordetella pertussis
ugucggugauccacugc

SEQ ID NO: 385406 - RNA, 14 nt, Bordetella pertussis
ugucgucgagcacu

SEQ ID NO: 385407 - RNA, 14 nt, Bordetella pertussis
ugucgucgcgcgag

SEQ ID NO: 385408 - RNA, 20 nt, Bordetella pertussis
ugucgucgcgcuggccccag

SEQ ID NO: 385409 - RNA, 18 nt, Bordetella pertussis
ugucuuugaagggcggcg

SEQ ID NO: 385410 - RNA, 12 nt, Bordetella pertussis
ugugccagcugg

SEQ ID NO: 385411 - RNA, 14 nt, Bordetella pertussis
ugugccagcuggcc

SEQ ID NO: 385412 - RNA, 13 nt, Bordetella pertussis
ugugccggcgcag

SEQ ID NO: 385413 - RNA, 21 nt, Bordetella pertussis
ugugcgagggcucgaccgccg

SEQ ID NO: 385414 - RNA, 17 nt, Bordetella pertussis
ugugcgccggggcgccg

SEQ ID NO: 385415 - RNA, 12 nt, Bordetella pertussis
ugugcgcgccaa

SEQ ID NO: 385416 - RNA, 13 nt, Bordetella pertussis
ugugcgcgggcgc

SEQ ID NO: 385417 - RNA, 13 nt, Bordetella pertussis
ugugcgccagcgc

SEQ ID NO: 385418 - RNA, 12 nt, Bordetella pertussis
uguggccagcuc

SEQ ID NO: 385419 - RNA, 22 nt, Bordetella pertussis
uguggccgucgucaucgccauc

SEQ ID NO: 385420 - RNA, 18 nt, Bordetella pertussis
uguuggucgccacgccau

SEQ ID NO: 385421 - RNA, 22 nt, Bordetella pertussis
uguuguagugcuccaccaccau

SEQ ID NO: 385422 - RNA, 13 nt, Bordetella pertussis
uuauacggcgcga

SEQ ID NO: 385423 - RNA, 14 nt, Bordetella pertussis
uucaaggcgcgagu

SEQ ID NO: 385424 - RNA, 16 nt, Bordetella pertussis
uucaccgaggcgcugc

SEQ ID NO: 385425 - RNA, 17 nt, Bordetella pertussis
uucaccgcugaucaggu

SEQ ID NO: 385426 - RNA, 16 nt, Bordetella pertussis
uucagcauggagcugg

SEQ ID NO: 385427 - RNA, 13 nt, Bordetella pertussis
uucagcccggcgc

SEQ ID NO: 385428 - RNA, 18 nt, Bordetella pertussis
uucagcccggcgcgccac

SEQ ID NO: 385429 - RNA, 20 nt, Bordetella pertussis
uucagccgcaagcuggcggc

SEQ ID NO: 385430 - RNA, 18 nt, Bordetella pertussis
uucagcgccgagcgccag

SEQ ID NO: 385431 - RNA, 20 nt, Bordetella pertussis
uucagcgcgccagcgcgcga

SEQ ID NO: 385432 - RNA, 15 nt, Bordetella pertussis
uucagcgcgcgcgcc

SEQ ID NO: 385433 - RNA, 17 nt, Bordetella pertussis
uucagcgggccggcacc

SEQ ID NO: 385434 - RNA, 21 nt, Bordetella pertussis
uucagcgggcgcgcccggcgc

SEQ ID NO: 385435 - RNA, 23 nt, Bordetella pertussis
uucagcgggcgcgcccggcgcgc

SEQ ID NO: 385436 - RNA, 18 nt, Bordetella pertussis
uucagcuucagccugggc

SEQ ID NO: 385437 - RNA, 15 nt, Bordetella pertussis
uucaggaugccgccu

SEQ ID NO: 385438 - RNA, 19 nt, Bordetella pertussis
uucaggccugcggcgccag

SEQ ID NO: 385439 - RNA, 13 nt, Bordetella pertussis
uucaugggccugg

SEQ ID NO: 385440 - RNA, 18 nt, Bordetella pertussis
uucaugggccugggcgcc

SEQ ID NO: 385441 - RNA, 17 nt, Bordetella pertussis
uuccaggcgugcccggu

SEQ ID NO: 385442 - RNA, 17 nt, Bordetella pertussis
uuccagggcgcgccgca

SEQ ID NO: 385443 - RNA, 17 nt, Bordetella pertussis
uuccaguugcgggcgca

SEQ ID NO: 385444 - RNA, 16 nt, Bordetella pertussis
uuccaucagcucgacc

SEQ ID NO: 385445 - RNA, 19 nt, Bordetella pertussis
uucccagcuccacgcacac

SEQ ID NO: 385446 - RNA, 14 nt, Bordetella pertussis
uucccauccuggcc

SEQ ID NO: 385447 - RNA, 15 nt, Bordetella pertussis
uucccauccuggccg

SEQ ID NO: 385448 - RNA, 16 nt, Bordetella pertussis
uucccuggcgcgccag

SEQ ID NO: 385449 - RNA, 21 nt, Bordetella pertussis
uuccgcacgccgaccuggcgc

SEQ ID NO: 385450 - RNA, 22 nt, Bordetella pertussis
uuccgcacgccgaccuggcgcc

SEQ ID NO: 385451 - RNA, 19 nt, Bordetella pertussis
uuccgccaacucgcuccag

SEQ ID NO: 385452 - RNA, 19 nt, Bordetella pertussis
uuccucgccgcccagccgg

SEQ ID NO: 385453 - RNA, 13 nt, Bordetella pertussis
uuccugcugcgcc

SEQ ID NO: 385454 - RNA, 15 nt, Bordetella pertussis
uuccuggccggcgcc

SEQ ID NO: 385455 - RNA, 13 nt, Bordetella pertussis
uuccugggugcgc

SEQ ID NO: 385456 - RNA, 18 nt, Bordetella pertussis
uuccuggucacccggcgc

SEQ ID NO: 385457 - RNA, 15 nt, Bordetella pertussis
uuccuugcgaugcca

SEQ ID NO: 385458 - RNA, 16 nt, Bordetella pertussis
uucgaacaacagcgcc

SEQ ID NO: 385459 - RNA, 18 nt, Bordetella pertussis
uucgaauccucucgcccc

SEQ ID NO: 385460 - RNA, 15 nt, Bordetella pertussis
uucgaccugcccgag

SEQ ID NO: 385461 - RNA, 12 nt, Bordetella pertussis
uucgacgccggc

SEQ ID NO: 385462 - RNA, 18 nt, Bordetella pertussis
uucgacuucguccggcgc

SEQ ID NO: 385463 - RNA, 22 nt, Bordetella pertussis
uucgagcaucauggcgcgcgcc

SEQ ID NO: 385464 - RNA, 18 nt, Bordetella pertussis
uucgagcgcggcgcgcga

SEQ ID NO: 385465 - RNA, 19 nt, Bordetella pertussis
uucgaucacggcgcgcgcc

SEQ ID NO: 385466 - RNA, 15 nt, Bordetella pertussis
uucgaugcuggcggc

SEQ ID NO: 385467 - RNA, 17 nt, Bordetella pertussis
uucgcaauacgucgcga

SEQ ID NO: 385468 - RNA, 21 nt, Bordetella pertussis
uucgcacagccggggcgagcg

SEQ ID NO: 385469 - RNA, 22 nt, Bordetella pertussis
uucgccaaucugccgcugaccg

SEQ ID NO: 385470 - RNA, 13 nt, Bordetella pertussis
uucgcccgugccg

SEQ ID NO: 385471 - RNA, 12 nt, Bordetella pertussis
uucgccgauccg

SEQ ID NO: 385472 - RNA, 19 nt, Bordetella pertussis
uucgccgaucgagcaggcc

SEQ ID NO: 385473 - RNA, 19 nt, Bordetella pertussis
uucgccgaugaccagcagc

SEQ ID NO: 385474 - RNA, 22 nt, Bordetella pertussis
uucgccgaugaccagcagcgcc

SEQ ID NO: 385475 - RNA, 13 nt, Bordetella pertussis
uucgccgcaccag

SEQ ID NO: 385476 - RNA, 12 nt, Bordetella pertussis
uucgccgcgcac

SEQ ID NO: 385477 - RNA, 14 nt, Bordetella pertussis
uucgccgcgcacag

SEQ ID NO: 385478 - RNA, 18 nt, Bordetella pertussis
uucgccggaggcgcgcag

SEQ ID NO: 385479 - RNA, 16 nt, Bordetella pertussis
uucgccgugcagggcc

SEQ ID NO: 385480 - RNA, 20 nt, Bordetella pertussis
uucgccgugcagggccaggu

SEQ ID NO: 385481 - RNA, 12 nt, Bordetella pertussis
uucgccuggcgg

SEQ ID NO: 385482 - RNA, 12 nt, Bordetella pertussis
uucgcgcagcgc

SEQ ID NO: 385483 - RNA, 12 nt, Bordetella pertussis
uucgcgcgcgcc

SEQ ID NO: 385484 - RNA, 14 nt, Bordetella pertussis
uucgcgcgcgccug

SEQ ID NO: 385485 - RNA, 12 nt, Bordetella pertussis
uucgcgcgccag

SEQ ID NO: 385486 - RNA, 15 nt, Bordetella pertussis
uucgcggcccugggc

SEQ ID NO: 385487 - RNA, 22 nt, Bordetella pertussis
uucgcgguaggacggcagcacc

SEQ ID NO: 385488 - RNA, 23 nt, Bordetella pertussis
uucgcgguaggacggcagcaccg

SEQ ID NO: 385489 - RNA, 15 nt, Bordetella pertussis
uucgcuggcggaccg

SEQ ID NO: 385490 - RNA, 16 nt, Bordetella pertussis
uucgcuuuccagggug

SEQ ID NO: 385491 - RNA, 17 nt, Bordetella pertussis
uucggcaggcgccggcu

SEQ ID NO: 385492 - RNA, 21 nt, Bordetella pertussis
uucggccacuuucgcgcgcgc

SEQ ID NO: 385493 - RNA, 14 nt, Bordetella pertussis
uucggccagcggca

SEQ ID NO: 385494 - RNA, 16 nt, Bordetella pertussis
uucggccagcgcgcgg

SEQ ID NO: 385495 - RNA, 12 nt, Bordetella pertussis
uucggccgccag

SEQ ID NO: 385496 - RNA, 19 nt, Bordetella pertussis
uucggccggcugcgcgccg

SEQ ID NO: 385497 - RNA, 19 nt, Bordetella pertussis
uucggcgaacgacagaccg

SEQ ID NO: 385498 - RNA, 12 nt, Bordetella pertussis
uucggcgagccg

SEQ ID NO: 385499 - RNA, 19 nt, Bordetella pertussis
uucggcgcaucggcgccag

SEQ ID NO: 385500 - RNA, 12 nt, Bordetella pertussis
uucggcgaugcg

SEQ ID NO: 385501 - RNA, 14 nt, Bordetella pertussis
uucggcgcgcgccg

SEQ ID NO: 385502 - RNA, 20 nt, Bordetella pertussis
uucggcgcgcgugccgcgca

SEQ ID NO: 385503 - RNA, 20 nt, Bordetella pertussis
uucggcgcggcgggcgcugg

SEQ ID NO: 385504 - RNA, 12 nt, Bordetella pertussis
uucggcgcguac

SEQ ID NO: 385505 - RNA, 15 nt, Bordetella pertussis
uucggcgcgugcgga

SEQ ID NO: 385506 - RNA, 12 nt, Bordetella pertussis
uucggcggccag

SEQ ID NO: 385507 - RNA, 21 nt, Bordetella pertussis
uucggcggccagccggcgcgc

SEQ ID NO: 385508 - RNA, 16 nt, Bordetella pertussis
uucggcgucggugccg

SEQ ID NO: 385509 - RNA, 15 nt, Bordetella pertussis
uucggcuugcacgcc

SEQ ID NO: 385510 - RNA, 19 nt, Bordetella pertussis
uucgggcaugucgcggccc

SEQ ID NO: 385511 - RNA, 20 nt, Bordetella pertussis
uucgggcggcaggugcgcca

SEQ ID NO: 385512 - RNA, 20 nt, Bordetella pertussis
uucggggcgucgcugcuggc

SEQ ID NO: 385513 - RNA, 19 nt, Bordetella pertussis
uucgggugaggggccagcc

SEQ ID NO: 385514 - RNA, 15 nt, Bordetella pertussis
uucgguggcgcgcag

SEQ ID NO: 385515 - RNA, 20 nt, Bordetella pertussis
uucgucagggccgcagcacc

SEQ ID NO: 385516 - RNA, 16 nt, Bordetella pertussis
uucgucgagcucgaug

SEQ ID NO: 385517 - RNA, 14 nt, Bordetella pertussis
uucgucgcgcagca

SEQ ID NO: 385518 - RNA, 13 nt, Bordetella pertussis
uucgucgcgccag

SEQ ID NO: 385519 - RNA, 17 nt, Bordetella pertussis
uucgugaugccccaggu

SEQ ID NO: 385520 - RNA, 13 nt, Bordetella pertussis
uucgugcagcgcg

SEQ ID NO: 385521 - RNA, 13 nt, Bordetella pertussis
uucucgcugcuga

SEQ ID NO: 385522 - RNA, 19 nt, Bordetella pertussis
uucucggccucgcggcgca

SEQ ID NO: 385523 - RNA, 19 nt, Bordetella pertussis
uucugcaaggccugcugca

SEQ ID NO: 385524 - RNA, 14 nt, Bordetella pertussis
uucugcaccggcgc

SEQ ID NO: 385525 - RNA, 18 nt, Bordetella pertussis
uucugcgcguccuggcgc

SEQ ID NO: 385526 - RNA, 15 nt, Bordetella pertussis
uucugcuugccggcc

SEQ ID NO: 385527 - RNA, 21 nt, Bordetella pertussis
uucuugaaaaagcugccggca

SEQ ID NO: 385528 - RNA, 21 nt, Bordetella pertussis
uucuugucgaacaggcgcuug

SEQ ID NO: 385529 - RNA, 20 nt, Bordetella pertussis
uuggcgaugcucacgcccag

SEQ ID NO: 385530 - RNA, 16 nt, Bordetella pertussis
uuggcgccgcgcucgc

SEQ ID NO: 385531 - RNA, 20 nt, Bordetella pertussis
uuggcgccgcgcucgcgcca

SEQ ID NO: 385532 - RNA, 21 nt, Bordetella pertussis
uuggcgccggccgcgcgcgcc

SEQ ID NO: 385533 - RNA, 17 nt, Bordetella pertussis
uuggcgcugcugcuggc

SEQ ID NO: 385534 - RNA, 16 nt, Bordetella pertussis
uuggcggccggccagc

SEQ ID NO: 385535 - RNA, 22 nt, Bordetella pertussis
uuggcggccuggccgcgcgccu

SEQ ID NO: 385536 - RNA, 14 nt, Bordetella pertussis
uuggcggcgaucga

SEQ ID NO: 385537 - RNA, 15 nt, Bordetella pertussis
uuggcggcuggcgcg

SEQ ID NO: 385538 - RNA, 15 nt, Bordetella pertussis
uuggcguccggcccc

SEQ ID NO: 385539 - RNA, 17 nt, Bordetella pertussis
uuggcgugcuugccgcc

SEQ ID NO: 385540 - RNA, 20 nt, Bordetella pertussis
uugggauggaugccgucggc

SEQ ID NO: 385541 - RNA, 14 nt, Bordetella pertussis
uuuccagggcgcgc

SEQ ID NO: 385542 - RNA, 20 nt, Bordetella pertussis
uuucucgggcgucaugcgcu

SEQ ID NO: 385543 - RNA, 15 nt, Bordetella pertussis
uuugcgcaguggcga

SEQ ID NO: 385544 - RNA, 15 nt, Bordetella pertussis
cggcguacugcugca

SEQ ID NO: 385545 - RNA, 14 nt, Bordetella pertussis
cguaaugcaucuuu

SEQ ID NO: 385546 - RNA, 16 nt, Bordetella pertussis
cguacagccgcggcag

SEQ ID NO: 385547 - RNA, 19 nt, Bordetella pertussis
cguaccaggcagccggccc

SEQ ID NO: 385548 - RNA, 14 nt, Bordetella pertussis
cguaccgguccaga

SEQ ID NO: 385549 - RNA, 14 nt, Bordetella pertussis
cguaccugcagcag

SEQ ID NO: 385550 - RNA, 21 nt, Bordetella pertussis
cguacgaggcauacaggcugu

SEQ ID NO: 385551 - RNA, 21 nt, Bordetella pertussis
cguacgagugcaggcccgaca

SEQ ID NO: 385552 - RNA, 18 nt, Bordetella pertussis
cguacgaucuucuggacu

SEQ ID NO: 385553 - RNA, 12 nt, Bordetella pertussis
cguacgcggcgc

SEQ ID NO: 385554 - RNA, 17 nt, Bordetella pertussis
cguacggcgucgggcag

SEQ ID NO: 385555 - RNA, 15 nt, Bordetella pertussis
cguacuggcgcggcg

SEQ ID NO: 385556 - RNA, 17 nt, Bordetella pertussis
cguacuuccucgaccag

SEQ ID NO: 385557 - RNA, 17 nt, Bordetella pertussis
cguagaaauacgcgcgc

SEQ ID NO: 385558 - RNA, 18 nt, Bordetella pertussis
cguagaaauacgcgcgcg

SEQ ID NO: 385559 - RNA, 19 nt, Bordetella pertussis
cguagaaauacgcgcgcgc

SEQ ID NO: 385560 - RNA, 18 nt, Bordetella pertussis
cguagagaccaagcugcg

SEQ ID NO: 385561 - RNA, 13 nt, Bordetella pertussis
cguagagggucug

SEQ ID NO: 385562 - RNA, 22 nt, Bordetella pertussis
cguagagggucuggcggccggu

SEQ ID NO: 385563 - RNA, 19 nt, Bordetella pertussis
cguagaugcgggucggcgc

SEQ ID NO: 385564 - RNA, 13 nt, Bordetella pertussis
cguagaugggcag

SEQ ID NO: 385565 - RNA, 19 nt, Bordetella pertussis
cguagccggugcgcagcac

SEQ ID NO: 385566 - RNA, 13 nt, Bordetella pertussis
cguaggacagccc

SEQ ID NO: 385567 - RNA, 21 nt, Bordetella pertussis
cguaggacagccccagcagca

SEQ ID NO: 385568 - RNA, 23 nt, Bordetella pertussis
cguaggcaaagcgcggcugcggg

SEQ ID NO: 385569 - RNA, 15 nt, Bordetella pertussis
cguaggcgcuguugg

SEQ ID NO: 385570 - RNA, 16 nt, Bordetella pertussis
cguaggcggcccaggc

SEQ ID NO: 385571 - RNA, 21 nt, Bordetella pertussis
cguagggcacaucggccaccc

SEQ ID NO: 385572 - RNA, 21 nt, Bordetella pertussis
cguaggucaggcccacgccgc

SEQ ID NO: 385573 - RNA, 15 nt, Bordetella pertussis
cguaggugcgcgcca

SEQ ID NO: 385574 - RNA, 16 nt, Bordetella pertussis
cguaguacagcagcag

SEQ ID NO: 385575 - RNA, 15 nt, Bordetella pertussis
cguaguagcccaggc

SEQ ID NO: 385576 - RNA, 16 nt, Bordetella pertussis
cguaucaacuuccagc

SEQ ID NO: 385577 - RNA, 22 nt, Bordetella pertussis
cguaucgccgcugaugcuggca

SEQ ID NO: 385578 - RNA, 17 nt, Bordetella pertussis
cguauucgguggcgcgc

SEQ ID NO: 385579 - RNA, 15 nt, Bordetella pertussis
cguauugcugcugcu

SEQ ID NO: 385580 - RNA, 19 nt, Bordetella pertussis
cguauugcugcugcuggcu

SEQ ID NO: 385581 - RNA, 16 nt, Bordetella pertussis
cgucaccgacgccagc

SEQ ID NO: 385582 - RNA, 19 nt, Bordetella pertussis
cgucaccgccgccgcgccg

SEQ ID NO: 385583 - RNA, 20 nt, Bordetella pertussis
cgucacgaaagcgcccaggc

SEQ ID NO: 385584 - RNA, 21 nt, Bordetella pertussis
cgucacgaaagcgcccaggcc

SEQ ID NO: 385585 - RNA, 22 nt, Bordetella pertussis
cgucacgaaagcgcccaggccg

SEQ ID NO: 385586 - RNA, 12 nt, Bordetella pertussis
cgucagacgcgc

SEQ ID NO: 385587 - RNA, 11 nt, Bordetella pertussis
cgucagagccc

SEQ ID NO: 385588 - RNA, 23 nt, Bordetella pertussis
cgucagagcccuucgacgcggcg

SEQ ID NO: 385589 - RNA, 15 nt, Bordetella pertussis
cgucaggaagcccga

SEQ ID NO: 385590 - RNA, 20 nt, Bordetella pertussis
cgucaggcgagcgcggcggg

SEQ ID NO: 385591 - RNA, 22 nt, Bordetella pertussis
cgucaggcugggagagccggcc

SEQ ID NO: 385592 - RNA, 23 nt, Bordetella pertussis
cgucaggcugggagagccggcca

SEQ ID NO: 385593 - RNA, 17 nt, Bordetella pertussis
cgucagggccgcagcac

SEQ ID NO: 385594 - RNA, 15 nt, Bordetella pertussis
cgucaggggcaugcc

SEQ ID NO: 385595 - RNA, 17 nt, Bordetella pertussis
cgucauccugggcgcgc

SEQ ID NO: 385596 - RNA, 19 nt, Bordetella pertussis
cgucaucguggccgcgcaa

SEQ ID NO: 385597 - RNA, 19 nt, Bordetella pertussis
cgucaugaucccgcgccua

SEQ ID NO: 385598 - RNA, 14 nt, Bordetella pertussis
cgucaugcgccaug

SEQ ID NO: 385599 - RNA, 17 nt, Bordetella pertussis
cgucaugugcugcggca

SEQ ID NO: 385600 - RNA, 22 nt, Bordetella pertussis
cgucaugugcugcggcagccag

SEQ ID NO: 385601 - RNA, 19 nt, Bordetella pertussis
cgucauggucgaccagcag

SEQ ID NO: 385602 - RNA, 19 nt, Bordetella pertussis
cgucauugcaucgcagcag

SEQ ID NO: 385603 - RNA, 17 nt, Bordetella pertussis
cguccaagcagacccgc

SEQ ID NO: 385604 - RNA, 21 nt, Bordetella pertussis
cguccaagcagacccgcgccc

SEQ ID NO: 385605 - RNA, 14 nt, Bordetella pertussis
cguccaaugccagg

SEQ ID NO: 385606 - RNA, 14 nt, Bordetella pertussis
cguccaccaccagg

SEQ ID NO: 385607 - RNA, 14 nt, Bordetella pertussis
cguccacgaaggca

SEQ ID NO: 385608 - RNA, 19 nt, Bordetella pertussis
cguccacgaaggcagcacc

SEQ ID NO: 385609 - RNA, 21 nt, Bordetella pertussis
cguccacgaaggcagcaccuc

SEQ ID NO: 385610 - RNA, 21 nt, Bordetella pertussis
cguccaccuugacgcgcaggc

SEQ ID NO: 385611 - RNA, 14 nt, Bordetella pertussis
cguccacgcccagc

SEQ ID NO: 385612 - RNA, 18 nt, Bordetella pertussis
cguccacgcccagcgccg

SEQ ID NO: 385613 - RNA, 21 nt, Bordetella pertussis
cguccacgcggguggugcugc

SEQ ID NO: 385614 - RNA, 23 nt, Bordetella pertussis
cguccacgcggguggugcugcuc

SEQ ID NO: 385615 - RNA, 20 nt, Bordetella pertussis
cguccacggccugcgcgccg

SEQ ID NO: 385616 - RNA, 21 nt, Bordetella pertussis
cguccacggccugcgcgccga

SEQ ID NO: 385617 - RNA, 19 nt, Bordetella pertussis
cguccacugaaagaaccgc

SEQ ID NO: 385618 - RNA, 22 nt, Bordetella pertussis
cguccacugaaagaaccgccuu

SEQ ID NO: 385619 - RNA, 19 nt, Bordetella pertussis
cguccagagucugccuggc

SEQ ID NO: 385620 - RNA, 18 nt, Bordetella pertussis
cguccagcacgcggcgca

SEQ ID NO: 385621 - RNA, 24 nt, Bordetella pertussis
cguccagcacggccgcggccggca

SEQ ID NO: 385622 - RNA, 12 nt, Bordetella pertussis
cguccagcagca

SEQ ID NO: 385623 - RNA, 13 nt, Bordetella pertussis
cgucccggaugcg

SEQ ID NO: 385624 - RNA, 23 nt, Bordetella pertussis
cguccgccccauccacggcgcca

SEQ ID NO: 385625 - RNA, 22 nt, Bordetella pertussis
cguccgcccgcuccaccagcac

SEQ ID NO: 385626 - RNA, 17 nt, Bordetella pertussis
cgucgccaaagcgcagc

SEQ ID NO: 385627 - RNA, 18 nt, Bordetella pertussis
cgucgccaugcggcuggc

SEQ ID NO: 385628 - RNA, 20 nt, Bordetella pertussis
cgucgcccuggcggcgguca

SEQ ID NO: 385629 - RNA, 22 nt, Bordetella pertussis
cgucgccgcccaugcgcauggc

SEQ ID NO: 385630 - RNA, 16 nt, Bordetella pertussis
cgucgccgcccugcug

SEQ ID NO: 385631 - RNA, 14 nt, Bordetella pertussis
cgucgccgcgccgu

SEQ ID NO: 385632 - RNA, 20 nt, Bordetella pertussis
cgucgccgcuggccagccgc

SEQ ID NO: 385633 - RNA, 14 nt, Bordetella pertussis
cgucgccggccagg

SEQ ID NO: 385634 - RNA, 13 nt, Bordetella pertussis
cgucgcgcggcgg

SEQ ID NO: 385635 - RNA, 18 nt, Bordetella pertussis
cgucgcgcugcgacagca

SEQ ID NO: 385636 - RNA, 14 nt, Bordetella pertussis
cgucgcggaccucc

SEQ ID NO: 385637 - RNA, 19 nt, Bordetella pertussis
cgucgcggaccuccugguc

SEQ ID NO: 385638 - RNA, 23 nt, Bordetella pertussis
cgucgcguccuucgucggcggga

SEQ ID NO: 385639 - RNA, 12 nt, Bordetella pertussis
cgucgcucaugg

SEQ ID NO: 385640 - RNA, 16 nt, Bordetella pertussis
cgucggacgcgcgccg

SEQ ID NO: 385641 - RNA, 18 nt, Bordetella pertussis
cgucggccaaggccggcg

SEQ ID NO: 385642 - RNA, 16 nt, Bordetella pertussis
cgucggccagcgccgc

SEQ ID NO: 385643 - RNA, 14 nt, Bordetella pertussis
cgucggccagcuug

SEQ ID NO: 385644 - RNA, 15 nt, Bordetella pertussis
cgucggccaggccga

SEQ ID NO: 385645 - RNA, 14 nt, Bordetella pertussis
cgucggccgcgccc

SEQ ID NO: 385646 - RNA, 11 nt, Bordetella pertussis
cgucggccugg

SEQ ID NO: 385647 - RNA, 19 nt, Bordetella pertussis
cgucggcgccgaucagcag

SEQ ID NO: 385648 - RNA, 20 nt, Bordetella pertussis
cgucggcgccgaucagcagg

SEQ ID NO: 385649 - RNA, 13 nt, Bordetella pertussis
cgucggcgcgcgc

SEQ ID NO: 385650 - RNA, 14 nt, Bordetella pertussis
cgucggcgcgcgcc

SEQ ID NO: 385651 - RNA, 15 nt, Bordetella pertussis
cgucggcgcgcgcca

SEQ ID NO: 385652 - RNA, 16 nt, Bordetella pertussis
cgucggcgcugcagcg

SEQ ID NO: 385653 - RNA, 11 nt, Bordetella pertussis
cgucggcggca

SEQ ID NO: 385654 - RNA, 15 nt, Bordetella pertussis
cgucggcggcaagca

SEQ ID NO: 385655 - RNA, 18 nt, Bordetella pertussis
cgucggcggcccacagcg

SEQ ID NO: 385656 - RNA, 16 nt, Bordetella pertussis
cgucggcggccgccuu

SEQ ID NO: 385657 - RNA, 22 nt, Bordetella pertussis
cgucggcgcgguauucgcgcug

SEQ ID NO: 385658 - RNA, 23 nt, Bordetella pertussis
cgucggcgggacgcaggcccagc

SEQ ID NO: 385659 - RNA, 19 nt, Bordetella pertussis
cgucggcguaaggccgccg

SEQ ID NO: 385660 - RNA, 16 nt, Bordetella pertussis
cgucggcucaguccaa

SEQ ID NO: 385661 - RNA, 13 nt, Bordetella pertussis
cgucgggacaggc

SEQ ID NO: 385662 - RNA, 20 nt, Bordetella pertussis
cgucgggcagcgcggcggcg

SEQ ID NO: 385663 - RNA, 14 nt, Bordetella pertussis
cgucgggcgccgca

SEQ ID NO: 385664 - RNA, 18 nt, Bordetella pertussis
cgucguagcgcugcagcc

SEQ ID NO: 385665 - RNA, 18 nt, Bordetella pertussis
cgucguagugcgcgccgc

SEQ ID NO: 385666 - RNA, 18 nt, Bordetella pertussis
cgucguccguccuggcca

SEQ ID NO: 385667 - RNA, 21 nt, Bordetella pertussis
cgucgucgaugaugacgaccu

SEQ ID NO: 385668 - RNA, 14 nt, Bordetella pertussis
cgucgucgccaccg

SEQ ID NO: 385669 - RNA, 15 nt, Bordetella pertussis
cgucgucggcaccuu

SEQ ID NO: 385670 - RNA, 15 nt, Bordetella pertussis
cgucgugcgccuggc

SEQ ID NO: 385671 - RNA, 17 nt, Bordetella pertussis
cgucguggggcgcggcg

SEQ ID NO: 385672 - RNA, 20 nt, Bordetella pertussis
cgucuacaggcccagcgcca

SEQ ID NO: 385673 - RNA, 21 nt, Bordetella pertussis
cgucuacaggcccagcgccag

SEQ ID NO: 385674 - RNA, 22 nt, Bordetella pertussis
cgucuacaggcccagcgccagc

SEQ ID NO: 385675 - RNA, 14 nt, Bordetella pertussis
cgucuccagcgccg

SEQ ID NO: 385676 - RNA, 16 nt, Bordetella pertussis
cgucuccagcgccggc

SEQ ID NO: 385677 - RNA, 18 nt, Bordetella pertussis
cgucuccagcgccggcag

SEQ ID NO: 385678 - RNA, 22 nt, Bordetella pertussis
cgucuccagcgccggcagcccc

SEQ ID NO: 385679 - RNA, 23 nt, Bordetella pertussis
cgucuccagcgccggcagcccca

SEQ ID NO: 385680 - RNA, 15 nt, Bordetella pertussis
cgucucgggcugggu

SEQ ID NO: 385681 - RNA, 14 nt, Bordetella pertussis
cgucugcgccgccg

SEQ ID NO: 385682 - RNA, 17 nt, Bordetella pertussis
cgucuucgccgaccagc

SEQ ID NO: 385683 - RNA, 16 nt, Bordetella pertussis
cgucuucguacagccu

SEQ ID NO: 385684 - RNA, 16 nt, Bordetella pertussis
cgucuugcccgccagc

SEQ ID NO: 385685 - RNA, 20 nt, Bordetella pertussis
cgucuuggcgggcaccaugc

SEQ ID NO: 385686 - RNA, 18 nt, Bordetella pertussis
cgugaaggucggcacgac

SEQ ID NO: 385687 - RNA, 20 nt, Bordetella pertussis
cgugaaggugccggacgccc

SEQ ID NO: 385688 - RNA, 18 nt, Bordetella pertussis
cgugaauaccgcgcacag

SEQ ID NO: 385689 - RNA, 16 nt, Bordetella pertussis
cgugacguugagcgcc

SEQ ID NO: 385690 - RNA, 15 nt, Bordetella pertussis
cgugagcgccgccgc

SEQ ID NO: 385691 - RNA, 18 nt, Bordetella pertussis
cgugagcgccgccgccau

SEQ ID NO: 385692 - RNA, 21 nt, Bordetella pertussis
cgugaugcccaggcccuggcu

SEQ ID NO: 385693 - RNA, 16 nt, Bordetella pertussis
cgugaugccgaccagg

SEQ ID NO: 385694 - RNA, 20 nt, Bordetella pertussis
cgugaugccgaccaggcccg

SEQ ID NO: 385695 - RNA, 21 nt, Bordetella pertussis
cgugaugccgcccgcaugcag

SEQ ID NO: 385696 - RNA, 20 nt, Bordetella pertussis
cgugaugccgucgagcgcgg

SEQ ID NO: 385697 - RNA, 15 nt, Bordetella pertussis
cgugauggacgccgg

SEQ ID NO: 385698 - RNA, 20 nt, Bordetella pertussis
cgugcagacggcggcuggac

SEQ ID NO: 385699 - RNA, 18 nt, Bordetella pertussis
cgugcagcaggggcugcc

SEQ ID NO: 385700 - RNA, 14 nt, Bordetella pertussis
cgugcagcagguag

SEQ ID NO: 385701 - RNA, 16 nt, Bordetella pertussis
cgugcagccagcggcc

SEQ ID NO: 385702 - RNA, 20 nt, Bordetella pertussis
cgugcagcgacuugucgcgc

SEQ ID NO: 385703 - RNA, 18 nt, Bordetella pertussis
cgugcaggcccgggcgcc

SEQ ID NO: 385704 - RNA, 15 nt, Bordetella pertussis
cgugcaggccggcgg

SEQ ID NO: 385705 - RNA, 18 nt, Bordetella pertussis
cgugcagguacugggcca

SEQ ID NO: 385706 - RNA, 18 nt, Bordetella pertussis
cgugcccagcuggcaccg

SEQ ID NO: 385707 - RNA, 17 nt, Bordetella pertussis
cgugcccgcguccacca

SEQ ID NO: 385708 - RNA, 14 nt, Bordetella pertussis
cgugcccggcgggc

SEQ ID NO: 385709 - RNA, 19 nt, Bordetella pertussis
cgugcccguugccgcgcgc

SEQ ID NO: 385710 - RNA, 17 nt, Bordetella pertussis
cgugcccuugggggccc

SEQ ID NO: 385711 - RNA, 17 nt, Bordetella pertussis
cgugccgacgaugccgc

SEQ ID NO: 385712 - RNA, 13 nt, Bordetella pertussis
cgugccgcagaag

SEQ ID NO: 385713 - RNA, 15 nt, Bordetella pertussis
cgugccgcagauguc

SEQ ID NO: 385714 - RNA, 14 nt, Bordetella pertussis
cgugccgcaggcca

SEQ ID NO: 385715 - RNA, 18 nt, Bordetella pertussis
cgugccgcaggccagccc

SEQ ID NO: 385716 - RNA, 15 nt, Bordetella pertussis
cgugccgccggcgcg

SEQ ID NO: 385717 - RNA, 15 nt, Bordetella pertussis
cgugccuguccccgc

SEQ ID NO: 385718 - RNA, 14 nt, Bordetella pertussis
cgugcugaacgcgc

SEQ ID NO: 385719 - RNA, 17 nt, Bordetella pertussis
cgugcugcaccugcguc

SEQ ID NO: 385720 - RNA, 16 nt, Bordetella pertussis
cgugcugcagggcugc

SEQ ID NO: 385721 - RNA, 17 nt, Bordetella pertussis
cgugcugcugcaggcgc

SEQ ID NO: 385722 - RNA, 12 nt, Bordetella pertussis
cgugcuggaggu

SEQ ID NO: 385723 - RNA, 16 nt, Bordetella pertussis
cgugcuggcgcagcag

SEQ ID NO: 385724 - RNA, 12 nt, Bordetella pertussis
cgugcugguugu

SEQ ID NO: 385725 - RNA, 19 nt, Bordetella pertussis
cguggauuuugcggaaggc

SEQ ID NO: 385726 - RNA, 22 nt, Bordetella pertussis
cguggcaggugcggccgcagcg

SEQ ID NO: 385727 - RNA, 18 nt, Bordetella pertussis
cguggccaagggcgccgc

SEQ ID NO: 385728 - RNA, 20 nt, Bordetella pertussis
cguggccaccaggcgcgcgc

SEQ ID NO: 385729 - RNA, 21 nt, Bordetella pertussis
cguucaccaggaagcgcgccu

SEQ ID NO: 385730 - RNA, 14 nt, Bordetella pertussis
cguucaccccccga

SEQ ID NO: 385731 - RNA, 17 nt, Bordetella pertussis
cguucacgccggcgcgc

SEQ ID NO: 385732 - RNA, 12 nt, Bordetella pertussis
cguucagcagca

SEQ ID NO: 385733 - RNA, 22 nt, Bordetella pertussis
cguucagggcgccgcggcggcg

SEQ ID NO: 385734 - RNA, 21 nt, Bordetella pertussis
cguucccgccgggcuccucgc

SEQ ID NO: 385735 - RNA, 17 nt, Bordetella pertussis
cguucgaaagccagcgc

SEQ ID NO: 385736 - RNA, 21 nt, Bordetella pertussis
cguucgggcggcaggugcgcc

SEQ ID NO: 385737 - RNA, 16 nt, Bordetella pertussis
cguucggugcgcagcg

SEQ ID NO: 385738 - RNA, 19 nt, Bordetella pertussis
cguucggugcgcagcggca

SEQ ID NO: 385739 - RNA, 22 nt, Bordetella pertussis
cguucggugcgcagcggcaggc

SEQ ID NO: 385740 - RNA, 19 nt, Bordetella pertussis
cguucguauugcugcugcu

SEQ ID NO: 385741 - RNA, 16 nt, Bordetella pertussis
cguugcagcccagcgc

SEQ ID NO: 385742 - RNA, 12 nt, Bordetella pertussis
cguugcauugca

SEQ ID NO: 385743 - RNA, 17 nt, Bordetella pertussis
cguuggugucggcggcg

SEQ ID NO: 385744 - RNA, 15 nt, Bordetella pertussis
cguuguucgggccgg

SEQ ID NO: 385745 - RNA, 16 nt, Bordetella pertussis
cguuuccagggcgcgc

SEQ ID NO: 385746 - RNA, 14 nt, Bordetella pertussis
cguuuuccagcauc

SEQ ID NO: 385747 - RNA, 17 nt, Bordetella pertussis
cuacaccgugcuggccg

SEQ ID NO: 385748 - RNA, 23 nt, Bordetella pertussis
cuacagcgucacggcaagacggc

SEQ ID NO: 385749 - RNA, 15 nt, Bordetella pertussis
cuacagcgugguggg

SEQ ID NO: 385750 - RNA, 13 nt, Bordetella pertussis
cuacaggcccagc

SEQ ID NO: 385751 - RNA, 14 nt, Bordetella pertussis
cuacauccuggaug

SEQ ID NO: 385752 - RNA, 15 nt, Bordetella pertussis
cuacauccuggaugu

SEQ ID NO: 385753 - RNA, 15 nt, Bordetella pertussis
cuaccccggcagcgu

SEQ ID NO: 385754 - RNA, 15 nt, Bordetella pertussis
cuacccgcgcgagcu

SEQ ID NO: 385755 - RNA, 19 nt, Bordetella pertussis
cuaccgcuucccuggcaag

SEQ ID NO: 385756 - RNA, 23 nt, Bordetella pertussis
cuacgggcgcugcacgcagcgca

SEQ ID NO: 385757 - RNA, 12 nt, Bordetella pertussis
cuacgugcugga

SEQ ID NO: 385758 - RNA, 22 nt, Bordetella pertussis
cuagucaugcgugaacuggucc

SEQ ID NO: 385759 - RNA, 13 nt, Bordetella pertussis
cuaugaagacgcg

SEQ ID NO: 385760 - RNA, 21 nt, Bordetella pertussis
cuaugggggcgagcgggccgg

SEQ ID NO: 385761 - RNA, 18 nt, Bordetella pertussis
cuauuggcuguaucuggc

SEQ ID NO: 385762 - RNA, 21 nt, Bordetella pertussis
cuauuuccgacgagaaugcgc

SEQ ID NO: 385763 - RNA, 17 nt, Bordetella pertussis
cuauuuggcggccuggc

SEQ ID NO: 385764 - RNA, 13 nt, Bordetella pertussis
cucacgccccgcc

SEQ ID NO: 385765 - RNA, 14 nt, Bordetella pertussis
cucacgccccgccc

SEQ ID NO: 385766 - RNA, 14 nt, Bordetella pertussis
cucacggggcuguc

SEQ ID NO: 385767 - RNA, 15 nt, Bordetella pertussis
cucagcaccaggccg

SEQ ID NO: 385768 - RNA, 16 nt, Bordetella pertussis
cucagcaccaggccgc

SEQ ID NO: 385769 - RNA, 18 nt, Bordetella pertussis
cucagcaccaggccgccg

SEQ ID NO: 385770 - RNA, 14 nt, Bordetella pertussis
cucagcagcgccag

SEQ ID NO: 385771 - RNA, 23 nt, Bordetella pertussis
cucagcagcgccagggccaggcc

SEQ ID NO: 385772 - RNA, 14 nt, Bordetella pertussis
cucagcccgccugg

SEQ ID NO: 385773 - RNA, 23 nt, Bordetella pertussis
cucagcccggcgagguugcaggc

SEQ ID NO: 385774 - RNA, 19 nt, Bordetella pertussis
cucagccuugucgcgggca

SEQ ID NO: 385775 - RNA, 15 nt, Bordetella pertussis
cucagcgccaucauc

SEQ ID NO: 385776 - RNA, 17 nt, Bordetella pertussis
cucagcgcggcgcggcc

SEQ ID NO: 385777 - RNA, 19 nt, Bordetella pertussis
cucagcgcggcgcggccag

SEQ ID NO: 385778 - RNA, 16 nt, Bordetella pertussis
cucagcgggcugcugg

SEQ ID NO: 385779 - RNA, 13 nt, Bordetella pertussis
cucaggaaccagc

SEQ ID NO: 385780 - RNA, 13 nt, Bordetella pertussis
cucaggccagcga

SEQ ID NO: 385781 - RNA, 18 nt, Bordetella pertussis
cucaggcccgcggcgcca

SEQ ID NO: 385782 - RNA, 9 nt, Bordetella pertussis
cucaggccg

SEQ ID NO: 385783 - RNA, 15 nt, Bordetella pertussis
cucaggccgcugggc

SEQ ID NO: 385784 - RNA, 21 nt, Bordetella pertussis
cucaggcgcggauugaugucg

SEQ ID NO: 385785 - RNA, 15 nt, Bordetella pertussis
cucaggcggccaggg

SEQ ID NO: 385786 - RNA, 18 nt, Bordetella pertussis
cucaggcggccagggccu

SEQ ID NO: 385787 - RNA, 16 nt, Bordetella pertussis
cucauucggcgcgcuc

SEQ ID NO: 385788 - RNA, 14 nt, Bordetella pertussis
cuccaacugggcca

SEQ ID NO: 385789 - RNA, 23 nt, Bordetella pertussis
cuccaaugaaaaaccccgccagg

SEQ ID NO: 385790 - RNA, 13 nt, Bordetella pertussis
cuccacagccacu

SEQ ID NO: 385791 - RNA, 14 nt, Bordetella pertussis
cuccaccagcaccg

SEQ ID NO: 385792 - RNA, 17 nt, Bordetella pertussis
cuccacccccgggcgca

SEQ ID NO: 385793 - RNA, 16 nt, Bordetella pertussis
cuccaccgccagcccg

SEQ ID NO: 385794 - RNA, 20 nt, Bordetella pertussis
cuccacgugcggcagggccu

SEQ ID NO: 385795 - RNA, 22 nt, Bordetella pertussis
cuccacgugcggcagggccucc

SEQ ID NO: 385796 - RNA, 15 nt, Bordetella pertussis
cuccagaacgcgccg

SEQ ID NO: 385797 - RNA, 16 nt, Bordetella pertussis
cuccagagcgcgcaca

SEQ ID NO: 385798 - RNA, 10 nt, Bordetella pertussis
cuccagcagg

SEQ ID NO: 385799 - RNA, 17 nt, Bordetella pertussis
cuccagcaucgccgcca

SEQ ID NO: 385800 - RNA, 22 nt, Bordetella pertussis
cuccaugcggcggcgggcggcc

SEQ ID NO: 385801 - RNA, 16 nt, Bordetella pertussis
cuccauggcgccggcg

SEQ ID NO: 385802 - RNA, 20 nt, Bordetella pertussis
cuccccgugcggggaccggc

SEQ ID NO: 385803 - RNA, 23 nt, Bordetella pertussis
cucccggaccagcaguugcgcca

SEQ ID NO: 385804 - RNA, 14 nt, Bordetella pertussis
cuccgaagggcugc

SEQ ID NO: 385805 - RNA, 15 nt, Bordetella pertussis
cuccgagggacaccg

SEQ ID NO: 385806 - RNA, 18 nt, Bordetella pertussis
cuccgauagcggcgccgc

SEQ ID NO: 385807 - RNA, 21 nt, Bordetella pertussis
cuccgauagcggcgccgcuuc

SEQ ID NO: 385808 - RNA, 22 nt, Bordetella pertussis
cuccgauagcggcgccgcuucc

SEQ ID NO: 385809 - RNA, 17 nt, Bordetella pertussis
cuccgcguugcgcugcc

SEQ ID NO: 385810 - RNA, 20 nt, Bordetella pertussis
cuccgcuaucauccgcgcau

SEQ ID NO: 385811 - RNA, 19 nt, Bordetella pertussis
cuccggcgugauggacgcc

SEQ ID NO: 385812 - RNA, 14 nt, Bordetella pertussis
cuccuccgcggggg

SEQ ID NO: 385813 - RNA, 20 nt, Bordetella pertussis
cucgaagaccucggcgcuca

SEQ ID NO: 385814 - RNA, 14 nt, Bordetella pertussis
cucgaagcccggca

SEQ ID NO: 385815 - RNA, 20 nt, Bordetella pertussis
cucgaaggcgccgacggcgc

SEQ ID NO: 385816 - RNA, 17 nt, Bordetella pertussis
cucgaaguacagcuuga

SEQ ID NO: 385817 - RNA, 14 nt, Bordetella pertussis
cucgaccaggaugu

SEQ ID NO: 385818 - RNA, 13 nt, Bordetella pertussis
cucgaccaggcgg

SEQ ID NO: 385819 - RNA, 23 nt, Bordetella pertussis
cucgacccgaaggcgcggccggg

SEQ ID NO: 385820 - RNA, 20 nt, Bordetella pertussis
cucgacccgcucggccacgc

SEQ ID NO: 385821 - RNA, 23 nt, Bordetella pertussis
cucgacgaugcccugcgccagcg

SEQ ID NO: 385822 - RNA, 13 nt, Bordetella pertussis
cucgacgcagccu

SEQ ID NO: 385823 - RNA, 23 nt, Bordetella pertussis
cucgaugaaggugcgcagcaggu

SEQ ID NO: 385824 - RNA, 23 nt, Bordetella pertussis
cucgaugcccagcaccgccaccg

SEQ ID NO: 385825 - RNA, 14 nt, Bordetella pertussis
cucgaugcgcgcca

SEQ ID NO: 385826 - RNA, 14 nt, Bordetella pertussis
cucgaugggcgcgc

SEQ ID NO: 385827 - RNA, 15 nt, Bordetella pertussis
cucgaugggcgcgcg

SEQ ID NO: 385828 - RNA, 17 nt, Bordetella pertussis
cucgaugggcgcgcgca

SEQ ID NO: 385829 - RNA, 21 nt, Bordetella pertussis
cucgauguggcgcuggcggcu

SEQ ID NO: 385830 - RNA, 17 nt, Bordetella pertussis
cucgauugaccagcacc

SEQ ID NO: 385831 - RNA, 22 nt, Bordetella pertussis
cucgcacaguucgugcaccagc

SEQ ID NO: 385832 - RNA, 21 nt, Bordetella pertussis
cucgcccagcaccucgacgca

SEQ ID NO: 385833 - RNA, 16 nt, Bordetella pertussis
cucgcccagccgccug

SEQ ID NO: 385834 - RNA, 19 nt, Bordetella pertussis
cucgcccagccgccugagc

SEQ ID NO: 385835 - RNA, 12 nt, Bordetella pertussis
cucgcccaggcc

SEQ ID NO: 385836 - RNA, 13 nt, Bordetella pertussis
cucgcccaggccg

SEQ ID NO: 385837 - RNA, 15 nt, Bordetella pertussis
cucgcccaggccggg

SEQ ID NO: 385838 - RNA, 20 nt, Bordetella pertussis
cucgcccaugaucagggccg

SEQ ID NO: 385839 - RNA, 18 nt, Bordetella pertussis
cucgcccccgaaggccgc

SEQ ID NO: 385840 - RNA, 18 nt, Bordetella pertussis
cucgcccucgcgccacca

SEQ ID NO: 385841 - RNA, 17 nt, Bordetella pertussis
cucgccgagccgggcca

SEQ ID NO: 385842 - RNA, 13 nt, Bordetella pertussis
cucgccgcccagc

SEQ ID NO: 385843 - RNA, 14 nt, Bordetella pertussis
cucgccgcccagcc

SEQ ID NO: 385844 - RNA, 16 nt, Bordetella pertussis
cucgccgcgcgacagc

SEQ ID NO: 385845 - RNA, 12 nt, Bordetella pertussis
cucgccggcccu

SEQ ID NO: 385846 - RNA, 15 nt, Bordetella pertussis
cucgccggcccugcc

SEQ ID NO: 385847 - RNA, 20 nt, Bordetella pertussis
cucgccggccgcgcccagcg

SEQ ID NO: 385848 - RNA, 14 nt, Bordetella pertussis
cucgccggccuggc

SEQ ID NO: 385849 - RNA, 13 nt, Bordetella pertussis
cucgccggcgccg

SEQ ID NO: 385850 - RNA, 18 nt, Bordetella pertussis
cucgccggcgccgccccu

SEQ ID NO: 385851 - RNA, 16 nt, Bordetella pertussis
cucgccggcgcgcagg

SEQ ID NO: 385852 - RNA, 19 nt, Bordetella pertussis
cucgccggcgcgcaggcag

SEQ ID NO: 385853 - RNA, 16 nt, Bordetella pertussis
cucgccuccccaggcc

SEQ ID NO: 385854 - RNA, 17 nt, Bordetella pertussis
cucgccuccccaggcca

SEQ ID NO: 385855 - RNA, 13 nt, Bordetella pertussis
cucgcgccaccau

SEQ ID NO: 385856 - RNA, 13 nt, Bordetella pertussis
cucgcgccaggcc

SEQ ID NO: 385857 - RNA, 18 nt, Bordetella pertussis
cucgcgccagggccccuc

SEQ ID NO: 385858 - RNA, 22 nt, Bordetella pertussis
cucgcgccagggccccuccggc

SEQ ID NO: 385859 - RNA, 20 nt, Bordetella pertussis
cucgcgcccaucucggccgc

SEQ ID NO: 385860 - RNA, 16 nt, Bordetella pertussis
cucgcgcgaccacugg

SEQ ID NO: 385861 - RNA, 15 nt, Bordetella pertussis
cucgcgcgccagcag

SEQ ID NO: 385862 - RNA, 12 nt, Bordetella pertussis
cucgcgcuccag

SEQ ID NO: 385863 - RNA, 14 nt, Bordetella pertussis
cucgcgcuccagca

SEQ ID NO: 385864 - RNA, 16 nt, Bordetella pertussis
cucgcgcuccagcaug

SEQ ID NO: 385865 - RNA, 17 nt, Bordetella pertussis
cucgcgcuccaugggcg

SEQ ID NO: 385866 - RNA, 14 nt, Bordetella pertussis
cucgcgcucgcgcu

SEQ ID NO: 385867 - RNA, 15 nt, Bordetella pertussis
cucgcgcgcgugcuc

SEQ ID NO: 385868 - RNA, 18 nt, Bordetella pertussis
cucgcgcggguccuugcc

SEQ ID NO: 385869 - RNA, 17 nt, Bordetella pertussis
cucgcggaugaccuggu

SEQ ID NO: 385870 - RNA, 23 nt, Bordetella pertussis
cucgcggaugaccuggugcacca

SEQ ID NO: 385871 - RNA, 15 nt, Bordetella pertussis
cucgcggcgcagcau

SEQ ID NO: 385872 - RNA, 15 nt, Bordetella pertussis
cucgcggcuguccug

SEQ ID NO: 385873 - RNA, 17 nt, Bordetella pertussis
cucgcgggccuuggcca

SEQ ID NO: 385874 - RNA, 22 nt, Bordetella pertussis
cucgcugccggcguccugcggc

SEQ ID NO: 385875 - RNA, 17 nt, Bordetella pertussis
cucggcgcccagcugcu

SEQ ID NO: 385876 - RNA, 13 nt, Bordetella pertussis
cucggcgccgcgg

SEQ ID NO: 385877 - RNA, 12 nt, Bordetella pertussis
cucggcgccggg

SEQ ID NO: 385878 - RNA, 16 nt, Bordetella pertussis
cucggcgcgcgcggcg

SEQ ID NO: 385879 - RNA, 12 nt, Bordetella pertussis
cucggcggccgc

SEQ ID NO: 385880 - RNA, 12 nt, Bordetella pertussis
cucggcggccuc

SEQ ID NO: 385881 - RNA, 16 nt, Bordetella pertussis
cucggcggccuccggc

SEQ ID NO: 385882 - RNA, 13 nt, Bordetella pertussis
cucggcgggcggc

SEQ ID NO: 385883 - RNA, 14 nt, Bordetella pertussis
cucggcgggcggcg

SEQ ID NO: 385884 - RNA, 21 nt, Bordetella pertussis
cucggcguccucgcgguccug

SEQ ID NO: 385885 - RNA, 14 nt, Bordetella pertussis
cucgggcugcggcu

SEQ ID NO: 385886 - RNA, 22 nt, Bordetella pertussis
cucgggcugggugaagccaagc

SEQ ID NO: 385887 - RNA, 16 nt, Bordetella pertussis
cucgggugggccggcu

SEQ ID NO: 385888 - RNA, 14 nt, Bordetella pertussis
cucggugaugaugg

SEQ ID NO: 385889 - RNA, 20 nt, Bordetella pertussis
cucggugaugauggccaggu

SEQ ID NO: 385890 - RNA, 23 nt, Bordetella pertussis
cucggugcgccgccgccgcggcc

SEQ ID NO: 385891 - RNA, 17 nt, Bordetella pertussis
cucggugcgggccggcg

SEQ ID NO: 385892 - RNA, 19 nt, Bordetella pertussis
cucggugcucuggcccgcc

SEQ ID NO: 385893 - RNA, 21 nt, Bordetella pertussis
cucgugaucgaccgccagcag

SEQ ID NO: 385894 - RNA, 19 nt, Bordetella pertussis
cucgugcagcaggggcugc

SEQ ID NO: 385895 - RNA, 14 nt, Bordetella pertussis
cucgugcugcugca

SEQ ID NO: 385896 - RNA, 17 nt, Bordetella pertussis
cucguggcgcgccucca

SEQ ID NO: 385897 - RNA, 15 nt, Bordetella pertussis
cucguuccagaugcg

SEQ ID NO: 385898 - RNA, 14 nt, Bordetella pertussis
cucguugacgccga

SEQ ID NO: 385899 - RNA, 12 nt, Bordetella pertussis
cucguuggccag

SEQ ID NO: 385900 - RNA, 16 nt, Bordetella pertussis
cucguuggucagcacc

SEQ ID NO: 385901 - RNA, 14 nt, Bordetella pertussis
cucuacacggccgc

SEQ ID NO: 385902 - RNA, 21 nt, Bordetella pertussis
cucuaccaacccugccuccag

SEQ ID NO: 385903 - RNA, 23 nt, Bordetella pertussis
cugaauccggggugccuguccuc

SEQ ID NO: 385904 - RNA, 24 nt, Bordetella pertussis
cugaauccggggugccuguccucc

SEQ ID NO: 385905 - RNA, 22 nt, Bordetella pertussis
cugaaugccgccgugaugccgc

SEQ ID NO: 385906 - RNA, 15 nt, Bordetella pertussis
cugaccggcggcgcu

SEQ ID NO: 385907 - RNA, 22 nt, Bordetella pertussis
cugacgauguucaggccaugcu

SEQ ID NO: 385908 - RNA, 17 nt, Bordetella pertussis
cugacgguaagcaccag

SEQ ID NO: 385909 - RNA, 14 nt, Bordetella pertussis
cugacuucgccguc

SEQ ID NO: 385910 - RNA, 18 nt, Bordetella pertussis
cugaggcuuucgaagcgc

SEQ ID NO: 385911 - RNA, 21 nt, Bordetella pertussis
cugaugcuggucagccugggc

SEQ ID NO: 385912 - RNA, 17 nt, Bordetella pertussis
cugauggccgccagcgg

SEQ ID NO: 385913 - RNA, 15 nt, Bordetella pertussis
cugcaaccagcucag

SEQ ID NO: 385914 - RNA, 13 nt, Bordetella pertussis
cugcacagggacc

SEQ ID NO: 385915 - RNA, 13 nt, Bordetella pertussis
cugcaccagcgcg

SEQ ID NO: 385916 - RNA, 17 nt, Bordetella pertussis
cugcaccagcgcgccgc

SEQ ID NO: 385917 - RNA, 14 nt, Bordetella pertussis
cugcaccgucaggu

SEQ ID NO: 385918 - RNA, 19 nt, Bordetella pertussis
cugcaccucaggaugcccg

SEQ ID NO: 385919 - RNA, 14 nt, Bordetella pertussis
cugcaccuugggcg

SEQ ID NO: 385920 - RNA, 19 nt, Bordetella pertussis
cugcacgauggcgccggcu

SEQ ID NO: 385921 - RNA, 15 nt, Bordetella pertussis
cugcacgccgggcgc

SEQ ID NO: 385922 - RNA, 22 nt, Bordetella pertussis
cugcacgcgcgcgggcgcgccg

SEQ ID NO: 385923 - RNA, 18 nt, Bordetella pertussis
cugcacgcggccgcgcag

SEQ ID NO: 385924 - RNA, 15 nt, Bordetella pertussis
cugcacgcgggcgcu

SEQ ID NO: 385925 - RNA, 18 nt, Bordetella pertussis
cugcacgcgguccacgcc

SEQ ID NO: 385926 - RNA, 15 nt, Bordetella pertussis
cugcacgcuguacug

SEQ ID NO: 385927 - RNA, 14 nt, Bordetella pertussis
cugcacggccuugu

SEQ ID NO: 385928 - RNA, 23 nt, Bordetella pertussis
cugcacggccuugucgcgcccga

SEQ ID NO: 385929 - RNA, 16 nt, Bordetella pertussis
cugcacggcggaaugc

SEQ ID NO: 385930 - RNA, 18 nt, Bordetella pertussis
cugcacggugggcagcag

SEQ ID NO: 385931 - RNA, 22 nt, Bordetella pertussis
cugcacggugggcagcagcacg

SEQ ID NO: 385932 - RNA, 19 nt, Bordetella pertussis
cugcacgugaugcaggcgg

SEQ ID NO: 385933 - RNA, 22 nt, Bordetella pertussis
cugcagaucaucgagcaccgcc

SEQ ID NO: 385934 - RNA, 17 nt, Bordetella pertussis
cugcagaucaucggcgc

SEQ ID NO: 385935 - RNA, 18 nt, Bordetella pertussis
cugcagcacgcuggccuu

SEQ ID NO: 385936 - RNA, 19 nt, Bordetella pertussis
cugcagcacggccacggcc

SEQ ID NO: 385937 - RNA, 19 nt, Bordetella pertussis
cugcagcagcggcagcucg

SEQ ID NO: 385938 - RNA, 20 nt, Bordetella pertussis
cugcagcagcguggccgcca

SEQ ID NO: 385939 - RNA, 17 nt, Bordetella pertussis
cugcagcaggcugggcg

SEQ ID NO: 385940 - RNA, 18 nt, Bordetella pertussis
cugcagcaggcugggcga

SEQ ID NO: 385941 - RNA, 22 nt, Bordetella pertussis
cugcagcaggucggucgccugu

SEQ ID NO: 385942 - RNA, 15 nt, Bordetella pertussis
cugcagccagaucuc

SEQ ID NO: 385943 - RNA, 16 nt, Bordetella pertussis
cugcagccaguugggc

SEQ ID NO: 385944 - RNA, 15 nt, Bordetella pertussis
cugcagcgcaccacc

SEQ ID NO: 385945 - RNA, 18 nt, Bordetella pertussis
cugcagcgcaggaugggc

SEQ ID NO: 385946 - RNA, 23 nt, Bordetella pertussis
cugcagcgcaucgccgcaggcgu

SEQ ID NO: 385947 - RNA, 15 nt, Bordetella pertussis
cugcagcgcgcgcgc

SEQ ID NO: 385948 - RNA, 14 nt, Bordetella pertussis
cugcagcgcugguu

SEQ ID NO: 385949 - RNA, 15 nt, Bordetella pertussis
cugcagcggccaguc

SEQ ID NO: 385950 - RNA, 21 nt, Bordetella pertussis
cugcagcgugauggggccggg

SEQ ID NO: 385951 - RNA, 15 nt, Bordetella pertussis
cugcagcugcuugcc

SEQ ID NO: 385952 - RNA, 16 nt, Bordetella pertussis
cugcagcugcuugccc

SEQ ID NO: 385953 - RNA, 21 nt, Bordetella pertussis
cugcaggaacucgcacacgcg

SEQ ID NO: 385954 - RNA, 18 nt, Bordetella pertussis
cugcaggaagccugcgcg

SEQ ID NO: 385955 - RNA, 20 nt, Bordetella pertussis
cugcaggaaguccuucagcc

SEQ ID NO: 385956 - RNA, 17 nt, Bordetella pertussis
cugcaggaugaggcgcc

SEQ ID NO: 385957 - RNA, 17 nt, Bordetella pertussis
cugcaggaugggccguc

SEQ ID NO: 385958 - RNA, 13 nt, Bordetella pertussis
cugcaggccaucg

SEQ ID NO: 385959 - RNA, 14 nt, Bordetella pertussis
cugcaggcccaccg

SEQ ID NO: 385960 - RNA, 22 nt, Bordetella pertussis
cugcaggcccagcacgcgcgcc

SEQ ID NO: 385961 - RNA, 23 nt, Bordetella pertussis
cugcaggcccagcacgcgcgcca

SEQ ID NO: 385962 - RNA, 16 nt, Bordetella pertussis
cugcaggcccggcgcg

SEQ ID NO: 385963 - RNA, 21 nt, Bordetella pertussis
cugcaggccgccggccagcgc

SEQ ID NO: 385964 - RNA, 14 nt, Bordetella pertussis
cugcaggccggcgc

SEQ ID NO: 385965 - RNA, 15 nt, Bordetella pertussis
cugcaggccggcgcg

SEQ ID NO: 385966 - RNA, 17 nt, Bordetella pertussis
cugcaggccggcgcgca

SEQ ID NO: 385967 - RNA, 18 nt, Bordetella pertussis
cugcaggcgucccggaug

SEQ ID NO: 385968 - RNA, 22 nt, Bordetella pertussis
cugcagggccuggaagcuggcc

SEQ ID NO: 385969 - RNA, 19 nt, Bordetella pertussis
cugcagggcgucugcucgc

SEQ ID NO: 385970 - RNA, 22 nt, Bordetella pertussis
cugcaucacgguaggcgcgucg

SEQ ID NO: 385971 - RNA, 24 nt, Bordetella pertussis
cugcaucacgguaggcgcgucgcu

SEQ ID NO: 385972 - RNA, 14 nt, Bordetella pertussis
cugccaccagcgcg

SEQ ID NO: 385973 - RNA, 13 nt, Bordetella pertussis
cugccagccugcc

SEQ ID NO: 385974 - RNA, 17 nt, Bordetella pertussis
cugccagccugccacau

SEQ ID NO: 385975 - RNA, 18 nt, Bordetella pertussis
cugccagccugccacauc

SEQ ID NO: 385976 - RNA, 21 nt, Bordetella pertussis
cugccaggcgagcgccgcgcu

SEQ ID NO: 385977 - RNA, 23 nt, Bordetella pertussis
cugccaggcgagcgccgcgcucc

SEQ ID NO: 385978 - RNA, 15 nt, Bordetella pertussis
cugccaggcgccgcg

SEQ ID NO: 385979 - RNA, 16 nt, Bordetella pertussis
cugccaggcgccgcgu

SEQ ID NO: 385980 - RNA, 20 nt, Bordetella pertussis
cugccaggcuaucguggcug

SEQ ID NO: 385981 - RNA, 19 nt, Bordetella pertussis
cugccagggugcaccaggu

SEQ ID NO: 385982 - RNA, 14 nt, Bordetella pertussis
cugccauggccccg

SEQ ID NO: 385983 - RNA, 16 nt, Bordetella pertussis
cugccauggccccggg

SEQ ID NO: 385984 - RNA, 18 nt, Bordetella pertussis
cugccauggccccgggcg

SEQ ID NO: 385985 - RNA, 19 nt, Bordetella pertussis
cugccauuccagcuccggc

SEQ ID NO: 385986 - RNA, 17 nt, Bordetella pertussis
cugccauugcgcggccu

SEQ ID NO: 385987 - RNA, 21 nt, Bordetella pertussis
cugccauugcgcggccugcuc

SEQ ID NO: 385988 - RNA, 14 nt, Bordetella pertussis
cugcccaccgccgc

SEQ ID NO: 385989 - RNA, 13 nt, Bordetella pertussis
cugcccaccuucc

SEQ ID NO: 385990 - RNA, 17 nt, Bordetella pertussis
cugcccaccuuccugcu

SEQ ID NO: 385991 - RNA, 12 nt, Bordetella pertussis
cugccccauggc

SEQ ID NO: 385992 - RNA, 15 nt, Bordetella pertussis
cugccccauggccug

SEQ ID NO: 385993 - RNA, 13 nt, Bordetella pertussis
cugccccccgagg

SEQ ID NO: 385994 - RNA, 23 nt, Bordetella pertussis
cugccccggcagagacagauacc

SEQ ID NO: 385995 - RNA, 20 nt, Bordetella pertussis
cugccccugcggggacaggc

SEQ ID NO: 385996 - RNA, 23 nt, Bordetella pertussis
cugccccugcggggacaggcacc

SEQ ID NO: 385997 - RNA, 16 nt, Bordetella pertussis
cugcccgaagcggccc

SEQ ID NO: 385998 - RNA, 13 nt, Bordetella pertussis
cugcccgggcagc

SEQ ID NO: 385999 - RNA, 14 nt, Bordetella pertussis
cugcccgugcgugu

SEQ ID NO: 386000 - RNA, 19 nt, Bordetella pertussis
cugcccucggucagcgcca

SEQ ID NO: 386001 - RNA, 13 nt, Bordetella pertussis
cugcccugcauga

SEQ ID NO: 386002 - RNA, 18 nt, Bordetella pertussis
cugcccugcugcugcagc

SEQ ID NO: 386003 - RNA, 22 nt, Bordetella pertussis
cugcccuggacgucugagcgcc

SEQ ID NO: 386004 - RNA, 19 nt, Bordetella pertussis
cugcccuggaucaggaugg

SEQ ID NO: 386005 - RNA, 17 nt, Bordetella pertussis
cugcccuggcccaggcc

SEQ ID NO: 386006 - RNA, 19 nt, Bordetella pertussis
cugccgaaucggccccugc

SEQ ID NO: 386007 - RNA, 21 nt, Bordetella pertussis
cugccgaucaagagccuggag

SEQ ID NO: 386008 - RNA, 21 nt, Bordetella pertussis
cugccgcccuggcgcagggca

SEQ ID NO: 386009 - RNA, 18 nt, Bordetella pertussis
cugccgccgaugugcggc

SEQ ID NO: 386010 - RNA, 14 nt, Bordetella pertussis
cugccgcgccgacc

SEQ ID NO: 386011 - RNA, 22 nt, Bordetella pertussis
cugccgcggauugccguccugg

SEQ ID NO: 386012 - RNA, 17 nt, Bordetella pertussis
cugccgcgugcccgcgu

SEQ ID NO: 386013 - RNA, 16 nt, Bordetella pertussis
cugccggcagcaggga

SEQ ID NO: 386014 - RNA, 23 nt, Bordetella pertussis
cugccggccgaccggcgcgcgcg

SEQ ID NO: 386015 - RNA, 12 nt, Bordetella pertussis
cugccggcgcgc

SEQ ID NO: 386016 - RNA, 13 nt, Bordetella pertussis
cugccggcggccu

SEQ ID NO: 386017 - RNA, 14 nt, Bordetella pertussis
cugccggcggccua

SEQ ID NO: 386018 - RNA, 16 nt, Bordetella pertussis
cugccguagcccaggu

SEQ ID NO: 386019 - RNA, 16 nt, Bordetella pertussis
cugccgucgccaaagc

SEQ ID NO: 386020 - RNA, 18 nt, Bordetella pertussis
cugccguccuugugccag

SEQ ID NO: 386021 - RNA, 16 nt, Bordetella pertussis
cugccgugcagauggc

SEQ ID NO: 386022 - RNA, 20 nt, Bordetella pertussis
cugcgaaaaagcccgcgcca

SEQ ID NO: 386023 - RNA, 21 nt, Bordetella pertussis
cugcgaaagcgcgucgagcag

SEQ ID NO: 386024 - RNA, 16 nt, Bordetella pertussis
cugcgaacgcccggcc

SEQ ID NO: 386025 - RNA, 14 nt, Bordetella pertussis
cugcgacagcaccg

SEQ ID NO: 386026 - RNA, 15 nt, Bordetella pertussis
cugcgacagcagcau

SEQ ID NO: 386027 - RNA, 19 nt, Bordetella pertussis
cugcgacagcagggccagg

SEQ ID NO: 386028 - RNA, 16 nt, Bordetella pertussis
cugcgacaggcgcagc

SEQ ID NO: 386029 - RNA, 21 nt, Bordetella pertussis
cugcgagagauagcccagcac

SEQ ID NO: 386030 - RNA, 17 nt, Bordetella pertussis
cugcgagccgccgcccu

SEQ ID NO: 386031 - RNA, 18 nt, Bordetella pertussis
cugcgagccuucggccgg

SEQ ID NO: 386032 - RNA, 14 nt, Bordetella pertussis
cugcgaggacaggg

SEQ ID NO: 386033 - RNA, 20 nt, Bordetella pertussis
cugcgcuugaccgccucgau

SEQ ID NO: 386034 - RNA, 21 nt, Bordetella pertussis
cugcggacccaguucggccgc

SEQ ID NO: 386035 - RNA, 16 nt, Bordetella pertussis
cugcggcaccucggcc

SEQ ID NO: 386036 - RNA, 21 nt, Bordetella pertussis
cugcggcacgaucggcgccug

SEQ ID NO: 386037 - RNA, 15 nt, Bordetella pertussis
cugcgggcggccugg

SEQ ID NO: 386038 - RNA, 14 nt, Bordetella pertussis
cugcggggacaggc

SEQ ID NO: 386039 - RNA, 20 nt, Bordetella pertussis
cugcggggacaggcacccgg

SEQ ID NO: 386040 - RNA, 15 nt, Bordetella pertussis
cugcgggggcaggca

SEQ ID NO: 386041 - RNA, 17 nt, Bordetella pertussis
cugcgggggcaggcacg

SEQ ID NO: 386042 - RNA, 17 nt, Bordetella pertussis
cugcgucgccuggucga

SEQ ID NO: 386043 - RNA, 18 nt, Bordetella pertussis
cugcgucugcgugccgga

SEQ ID NO: 386044 - RNA, 17 nt, Bordetella pertussis
cugcgucuugagcaggu

SEQ ID NO: 386045 - RNA, 17 nt, Bordetella pertussis
cugcguggcgggccgcg

SEQ ID NO: 386046 - RNA, 21 nt, Bordetella pertussis
cugcucccacgaacgccacgc

SEQ ID NO: 386047 - RNA, 14 nt, Bordetella pertussis
cugcucgccgcgcg

SEQ ID NO: 386048 - RNA, 17 nt, Bordetella pertussis
cugcucgccggccagcg

SEQ ID NO: 386049 - RNA, 17 nt, Bordetella pertussis
cugcucgcggcacugau

SEQ ID NO: 386050 - RNA, 21 nt, Bordetella pertussis
cugcucggcgaugcgccauac

SEQ ID NO: 386051 - RNA, 12 nt, Bordetella pertussis
cugcucgggcgc

SEQ ID NO: 386052 - RNA, 19 nt, Bordetella pertussis
cugcucgggcgccucgucc

SEQ ID NO: 386053 - RNA, 15 nt, Bordetella pertussis
cugcuggcugcccug

SEQ ID NO: 386054 - RNA, 21 nt, Bordetella pertussis
cugcuggggguuggccuugcc

SEQ ID NO: 386055 - RNA, 18 nt, Bordetella pertussis
cugcugggguggagcgcg

SEQ ID NO: 386056 - RNA, 19 nt, Bordetella pertussis
cugcugggguggagcgcgg

SEQ ID NO: 386057 - RNA, 12 nt, Bordetella pertussis
cugcuggcugcc

SEQ ID NO: 386058 - RNA, 17 nt, Bordetella pertussis
cugcugguacagcccca

SEQ ID NO: 386059 - RNA, 21 nt, Bordetella pertussis
cugcugguacagccccagcgc

SEQ ID NO: 386060 - RNA, 16 nt, Bordetella pertussis
cugcugucgcgcgacu

SEQ ID NO: 386061 - RNA, 16 nt, Bordetella pertussis
cugcugugccugccaa

SEQ ID NO: 386062 - RNA, 21 nt, Bordetella pertussis
cugcugugcgauggcacggca

SEQ ID NO: 386063 - RNA, 16 nt, Bordetella pertussis
cugcuguucaccuuca

SEQ ID NO: 386064 - RNA, 15 nt, Bordetella pertussis
cugcuguugcgcgug

SEQ ID NO: 386065 - RNA, 16 nt, Bordetella pertussis
cugcuguuggcguggc

SEQ ID NO: 386066 - RNA, 22 nt, Bordetella pertussis
cugcuugaagacgcccaggucc

SEQ ID NO: 386067 - RNA, 13 nt, Bordetella pertussis
cugcuugagcacc

SEQ ID NO: 386068 - RNA, 21 nt, Bordetella pertussis
cugcuugagcgaaauggcggc

SEQ ID NO: 386069 - RNA, 23 nt, Bordetella pertussis
cugcuugaggccgcgcgccucga

SEQ ID NO: 386070 - RNA, 14 nt, Bordetella pertussis
cugcuuggcagccu

SEQ ID NO: 386071 - RNA, 16 nt, Bordetella pertussis
cugcuuggcagccuug

SEQ ID NO: 386072 - RNA, 13 nt, Bordetella pertussis
cuggaacauggcc

SEQ ID NO: 386073 - RNA, 14 nt, Bordetella pertussis
cuggaacgcgccgc

SEQ ID NO: 386074 - RNA, 21 nt, Bordetella pertussis
cuggaacggugcgagaucucg

SEQ ID NO: 386075 - RNA, 22 nt, Bordetella pertussis
cuggaacguuugcggacgggcc

SEQ ID NO: 386076 - RNA, 22 nt, Bordetella pertussis
cuggaagaacaccguuuccaag

SEQ ID NO: 386077 - RNA, 22 nt, Bordetella pertussis
cuggaagauguaccagcccagc

SEQ ID NO: 386078 - RNA, 16 nt, Bordetella pertussis
cuggaagcugcggccg

SEQ ID NO: 386079 - RNA, 16 nt, Bordetella pertussis
cuggaagugaugccgc

SEQ ID NO: 386080 - RNA, 22 nt, Bordetella pertussis
cuggaagugaugccgccggcgg

SEQ ID NO: 386081 - RNA, 16 nt, Bordetella pertussis
cuggagaagcgccgcg

SEQ ID NO: 386082 - RNA, 20 nt, Bordetella pertussis
cuggagaucgccgagcggca

SEQ ID NO: 386083 - RNA, 14 nt, Bordetella pertussis
cuggagaucgccgc

SEQ ID NO: 386084 - RNA, 16 nt, Bordetella pertussis
cuggagcggccuggcc

SEQ ID NO: 386085 - RNA, 17 nt, Bordetella pertussis
cuggagcggccuggccc

SEQ ID NO: 386086 - RNA, 17 nt, Bordetella pertussis
cuggagcucgggugggc

SEQ ID NO: 386087 - RNA, 23 nt, Bordetella pertussis
cuggagcucuaugucgccggcca

SEQ ID NO: 386088 - RNA, 16 nt, Bordetella pertussis
cuggagcuuggccggu

SEQ ID NO: 386089 - RNA, 20 nt, Bordetella pertussis
cuggauauccacgccuucgg

SEQ ID NO: 386090 - RNA, 20 nt, Bordetella pertussis
cuggaugccaugccgggcaa

SEQ ID NO: 386091 - RNA, 15 nt, Bordetella pertussis
cuggauggccugcuc

SEQ ID NO: 386092 - RNA, 20 nt, Bordetella pertussis
cuggauggccugcucgccca

SEQ ID NO: 386093 - RNA, 15 nt, Bordetella pertussis
cuggauggcggccgc

SEQ ID NO: 386094 - RNA, 19 nt, Bordetella pertussis
cuggauggucacgcccagg

SEQ ID NO: 386095 - RNA, 22 nt, Bordetella pertussis
cuggauguacgucagcaugcac

SEQ ID NO: 386096 - RNA, 19 nt, Bordetella pertussis
cuggcaaucgggguggcgc

SEQ ID NO: 386097 - RNA, 17 nt, Bordetella pertussis
cuggcacaccagcgcca

SEQ ID NO: 386098 - RNA, 19 nt, Bordetella pertussis
cuggcacaccagcgccagg

SEQ ID NO: 386099 - RNA, 15 nt, Bordetella pertussis
cuggcacaucggccc

SEQ ID NO: 386100 - RNA, 22 nt, Bordetella pertussis
cuggcacaucggcccuggcaag

SEQ ID NO: 386101 - RNA, 18 nt, Bordetella pertussis
cuggcaccaauccccccc

SEQ ID NO: 386102 - RNA, 16 nt, Bordetella pertussis
cuggcaccugccgacu

SEQ ID NO: 386103 - RNA, 19 nt, Bordetella pertussis
cuggcagaccgagcgcgcc

SEQ ID NO: 386104 - RNA, 23 nt, Bordetella pertussis
cuggcagaccgagcgcgcccgcu

SEQ ID NO: 386105 - RNA, 16 nt, Bordetella pertussis
cuggcagaugcgcgcc

SEQ ID NO: 386106 - RNA, 17 nt, Bordetella pertussis
cuggcagcuggcgcggg

SEQ ID NO: 386107 - RNA, 23 nt, Bordetella pertussis
cuggcagguguuguugcacgacg

SEQ ID NO: 386108 - RNA, 19 nt, Bordetella pertussis
cuggccgaucugcugggcc

SEQ ID NO: 386109 - RNA, 15 nt, Bordetella pertussis
cuggccgauggccuc

SEQ ID NO: 386110 - RNA, 18 nt, Bordetella pertussis
cuggccgauuucgcgcgc

SEQ ID NO: 386111 - RNA, 22 nt, Bordetella pertussis
cuggccgauuucgcgcgccagc

SEQ ID NO: 386112 - RNA, 13 nt, Bordetella pertussis
cuggccgccggcg

SEQ ID NO: 386113 - RNA, 14 nt, Bordetella pertussis
cuggccgccugcug

SEQ ID NO: 386114 - RNA, 13 nt, Bordetella pertussis
cuggccgcgcgcc

SEQ ID NO: 386115 - RNA, 14 nt, Bordetella pertussis
cuggccgcgcucag

SEQ ID NO: 386116 - RNA, 16 nt, Bordetella pertussis
cuggccgcgcucaggc

SEQ ID NO: 386117 - RNA, 23 nt, Bordetella pertussis
cuggccgcgcuggcggcgcaggc

SEQ ID NO: 386118 - RNA, 22 nt, Bordetella pertussis
cuggccggcgcugggcaggcug

SEQ ID NO: 386119 - RNA, 19 nt, Bordetella pertussis
cuggccggcguggccugcc

SEQ ID NO: 386120 - RNA, 18 nt, Bordetella pertussis
cuggccgucgccgcccug

SEQ ID NO: 386121 - RNA, 19 nt, Bordetella pertussis
cuggccgucgccgcccugc

SEQ ID NO: 386122 - RNA, 16 nt, Bordetella pertussis
cuggccugccgcgccg

SEQ ID NO: 386123 - RNA, 20 nt, Bordetella pertussis
cuggcgaagaacaccgccgc

SEQ ID NO: 386124 - RNA, 17 nt, Bordetella pertussis
cuggcgaucacggccaa

SEQ ID NO: 386125 - RNA, 20 nt, Bordetella pertussis
cuggcgaucaggccgcccca

SEQ ID NO: 386126 - RNA, 14 nt, Bordetella pertussis
cuggcgaugcccac

SEQ ID NO: 386127 - RNA, 18 nt, Bordetella pertussis
cuggcgaugcccaccagc

SEQ ID NO: 386128 - RNA, 18 nt, Bordetella pertussis
cuggcgaugcgggccacg

SEQ ID NO: 386129 - RNA, 14 nt, Bordetella pertussis
cuggcgauggugga

SEQ ID NO: 386130 - RNA, 16 nt, Bordetella pertussis
cuggcgcagcacgccg

SEQ ID NO: 386131 - RNA, 20 nt, Bordetella pertussis
cuggcgcagcacgccgcgcc

SEQ ID NO: 386132 - RNA, 12 nt, Bordetella pertussis
cuggcgcagcag

SEQ ID NO: 386133 - RNA, 13 nt, Bordetella pertussis
cuggcgcagcaag

SEQ ID NO: 386134 - RNA, 17 nt, Bordetella pertussis
cuggcgcagcaggcgcg

SEQ ID NO: 386135 - RNA, 18 nt, Bordetella pertussis
cuggcgcagcauuucuuc

SEQ ID NO: 386136 - RNA, 16 nt, Bordetella pertussis
cuggcgcaugacggcg

SEQ ID NO: 386137 - RNA, 16 nt, Bordetella pertussis
cuggcgcauggcuggu

SEQ ID NO: 386138 - RNA, 13 nt, Bordetella pertussis
cuggcgcccggcg

SEQ ID NO: 386139 - RNA, 16 nt, Bordetella pertussis
cuggcgcccggcggcg

SEQ ID NO: 386140 - RNA, 17 nt, Bordetella pertussis
cuggcgcccggcggcgc

SEQ ID NO: 386141 - RNA, 20 nt, Bordetella pertussis
cuggcgcccggcggcgcgcu

SEQ ID NO: 386142 - RNA, 17 nt, Bordetella pertussis
cuggcgcccgccugcgc

SEQ ID NO: 386143 - RNA, 15 nt, Bordetella pertussis
cuggcgccgcgcgcc

SEQ ID NO: 386144 - RNA, 18 nt, Bordetella pertussis
cuggcgccggucugggcg

SEQ ID NO: 386145 - RNA, 19 nt, Bordetella pertussis
cuggcgccguucgucgcgc

SEQ ID NO: 386146 - RNA, 22 nt, Bordetella pertussis
cuggcgcgauagcgcuugccug

SEQ ID NO: 386147 - RNA, 16 nt, Bordetella pertussis
cuggcgcgcaucggcg

SEQ ID NO: 386148 - RNA, 15 nt, Bordetella pertussis
cuggcgcgccagcuc

SEQ ID NO: 386149 - RNA, 15 nt, Bordetella pertussis
cuggcgcgagaacca

SEQ ID NO: 386150 - RNA, 22 nt, Bordetella pertussis
cuggcgcgagaaccaggccacg

SEQ ID NO: 386151 - RNA, 15 nt, Bordetella pertussis
cuggcgcgccgccuc

SEQ ID NO: 386152 - RNA, 17 nt, Bordetella pertussis
cuggcgcgcgacggcgc

SEQ ID NO: 386153 - RNA, 13 nt, Bordetella pertussis
cuggcgcgcggcc

SEQ ID NO: 386154 - RNA, 18 nt, Bordetella pertussis
cuggcgcgcggcuggcug

SEQ ID NO: 386155 - RNA, 19 nt, Bordetella pertussis
cuggcgcgcggcuggcugu

SEQ ID NO: 386156 - RNA, 19 nt, Bordetella pertussis
cuggcgcggcgccugcgcg

SEQ ID NO: 386157 - RNA, 18 nt, Bordetella pertussis
cuggcgcggcggccaggc

SEQ ID NO: 386158 - RNA, 15 nt, Bordetella pertussis
cuggcgcgucggcgc

SEQ ID NO: 386159 - RNA, 20 nt, Bordetella pertussis
cuggcgcgucggcgcgcgcg

SEQ ID NO: 386160 - RNA, 16 nt, Bordetella pertussis
cuggcgcguggccgcc

SEQ ID NO: 386161 - RNA, 18 nt, Bordetella pertussis
cuggcgcguggccgccac

SEQ ID NO: 386162 - RNA, 14 nt, Bordetella pertussis
cuggcgcuuggcca

SEQ ID NO: 386163 - RNA, 23 nt, Bordetella pertussis
cuggcggccgcccagcagauggc

SEQ ID NO: 386164 - RNA, 15 nt, Bordetella pertussis
cuggcggccgugccu

SEQ ID NO: 386165 - RNA, 20 nt, Bordetella pertussis
cuggcggcgcgcggcugggu

SEQ ID NO: 386166 - RNA, 13 nt, Bordetella pertussis
cuggcggcugcgc

SEQ ID NO: 386167 - RNA, 15 nt, Bordetella pertussis
cuggcgggccugggc

SEQ ID NO: 386168 - RNA, 16 nt, Bordetella pertussis
cuggcgggccugggcg

SEQ ID NO: 386169 - RNA, 17 nt, Bordetella pertussis
cuggcgguaugcggcgc

SEQ ID NO: 386170 - RNA, 23 nt, Bordetella pertussis
cuggcgguggccgcgcaugccag

SEQ ID NO: 386171 - RNA, 18 nt, Bordetella pertussis
cuggcguagggcugcacg

SEQ ID NO: 386172 - RNA, 18 nt, Bordetella pertussis
cuggcguccagguugggc

SEQ ID NO: 386173 - RNA, 17 nt, Bordetella pertussis
cuggcguggccguucgg

SEQ ID NO: 386174 - RNA, 15 nt, Bordetella pertussis
cuggcguggcgcgcg

SEQ ID NO: 386175 - RNA, 17 nt, Bordetella pertussis
cuggcguggcgcgcgcc

SEQ ID NO: 386176 - RNA, 21 nt, Bordetella pertussis
cuggcguucaaucgcgcuucu

SEQ ID NO: 386177 - RNA, 16 nt, Bordetella pertussis
cuggcguucggcaccg

SEQ ID NO: 386178 - RNA, 18 nt, Bordetella pertussis
cuggcguuugcgcgcgcg

SEQ ID NO: 386179 - RNA, 18 nt, Bordetella pertussis
cuggcguuuuuccaggaa

SEQ ID NO: 386180 - RNA, 19 nt, Bordetella pertussis
cuggcguuuuuccaggaaa

SEQ ID NO: 386181 - RNA, 14 nt, Bordetella pertussis
cuggcucaggccug

SEQ ID NO: 386182 - RNA, 15 nt, Bordetella pertussis
cuggcucaggccugc

SEQ ID NO: 386183 - RNA, 17 nt, Bordetella pertussis
cuggcucaggccugcac

SEQ ID NO: 386184 - RNA, 20 nt, Bordetella pertussis
cuggcucagucggccuggcg

SEQ ID NO: 386185 - RNA, 18 nt, Bordetella pertussis
cuggcucccaccggugcg

SEQ ID NO: 386186 - RNA, 17 nt, Bordetella pertussis
cuggcuccgaagggcug

SEQ ID NO: 386187 - RNA, 13 nt, Bordetella pertussis
cuggcucguucgc

SEQ ID NO: 386188 - RNA, 19 nt, Bordetella pertussis
cuggcucguucgcucggcg

SEQ ID NO: 386189 - RNA, 16 nt, Bordetella pertussis
cuggcugagcaggccg

SEQ ID NO: 386190 - RNA, 23 nt, Bordetella pertussis
cuggcugagcgacaugucgccgc

SEQ ID NO: 386191 - RNA, 14 nt, Bordetella pertussis
cuggcugcgcgccu

SEQ ID NO: 386192 - RNA, 17 nt, Bordetella pertussis
cuggcuggacgcgcgcg

SEQ ID NO: 386193 - RNA, 16 nt, Bordetella pertussis
cuggcuggccagccgg

SEQ ID NO: 386194 - RNA, 18 nt, Bordetella pertussis
cuggcuggccagccggcc

SEQ ID NO: 386195 - RNA, 13 nt, Bordetella pertussis
cuggcuggucagg

SEQ ID NO: 386196 - RNA, 18 nt, Bordetella pertussis
cuggcugugcccgcccca

SEQ ID NO: 386197 - RNA, 22 nt, Bordetella pertussis
cuggcuguucgccauguucagc

SEQ ID NO: 386198 - RNA, 19 nt, Bordetella pertussis
cuggcuucccgguccaggc

SEQ ID NO: 386199 - RNA, 12 nt, Bordetella pertussis
cuggcuuggccg

SEQ ID NO: 386200 - RNA, 16 nt, Bordetella pertussis
cuggcuuucgccgcgg

SEQ ID NO: 386201 - RNA, 18 nt, Bordetella pertussis
cuggcuuucgccgcgggc

SEQ ID NO: 386202 - RNA, 15 nt, Bordetella pertussis
cugggacaggcacac

SEQ ID NO: 386203 - RNA, 17 nt, Bordetella pertussis
cugggacaggcacaccg

SEQ ID NO: 386204 - RNA, 16 nt, Bordetella pertussis
cugggacaggcacauu

SEQ ID NO: 386205 - RNA, 19 nt, Bordetella pertussis
cugggagcgcgggccgccg

SEQ ID NO: 386206 - RNA, 19 nt, Bordetella pertussis
cugggaggcgugcugcacc

SEQ ID NO: 386207 - RNA, 17 nt, Bordetella pertussis
cugggauuccugggugc

SEQ ID NO: 386208 - RNA, 15 nt, Bordetella pertussis
cugggcaugcacgau

SEQ ID NO: 386209 - RNA, 14 nt, Bordetella pertussis
cugggccagcagcu

SEQ ID NO: 386210 - RNA, 16 nt, Bordetella pertussis
cugggccagcaggcuc

SEQ ID NO: 386211 - RNA, 19 nt, Bordetella pertussis
cugggccagcaggcucagc

SEQ ID NO: 386212 - RNA, 14 nt, Bordetella pertussis
cugggccagccagc

SEQ ID NO: 386213 - RNA, 16 nt, Bordetella pertussis
cugggccagccagcgc

SEQ ID NO: 386214 - RNA, 14 nt, Bordetella pertussis
cugggccaggaccg

SEQ ID NO: 386215 - RNA, 13 nt, Bordetella pertussis
cugggccaggccg

SEQ ID NO: 386216 - RNA, 17 nt, Bordetella pertussis
cugggccaggccggccu

SEQ ID NO: 386217 - RNA, 22 nt, Bordetella pertussis
cugggccaugcguaucggcagc

SEQ ID NO: 386218 - RNA, 15 nt, Bordetella pertussis
cugggccauggccuc

SEQ ID NO: 386219 - RNA, 17 nt, Bordetella pertussis
cugggccauggccucgu

SEQ ID NO: 386220 - RNA, 16 nt, Bordetella pertussis
cugggccgagcgcgcc

SEQ ID NO: 386221 - RNA, 19 nt, Bordetella pertussis
cugggccgaguuggcagag

SEQ ID NO: 386222 - RNA, 18 nt, Bordetella pertussis
cugggccgccugcugggc

SEQ ID NO: 386223 - RNA, 21 nt, Bordetella pertussis
cugggccgccugcugggccgc

SEQ ID NO: 386224 - RNA, 15 nt, Bordetella pertussis
cugggccggcgcgcg

SEQ ID NO: 386225 - RNA, 17 nt, Bordetella pertussis
cugggccggcgcgcgca

SEQ ID NO: 386226 - RNA, 17 nt, Bordetella pertussis
cugggccugcggcguca

SEQ ID NO: 386227 - RNA, 17 nt, Bordetella pertussis
cugggccugcugucgcu

SEQ ID NO: 386228 - RNA, 18 nt, Bordetella pertussis
cugggccuucuugucgcu

SEQ ID NO: 386229 - RNA, 23 nt, Bordetella pertussis
cugggcgaauccaccggcgcgcg

SEQ ID NO: 386230 - RNA, 21 nt, Bordetella pertussis
cugggcgccagcagcacgucg

SEQ ID NO: 386231 - RNA, 23 nt, Bordetella pertussis
cugggcgccaugcgcccggccac

SEQ ID NO: 386232 - RNA, 23 nt, Bordetella pertussis
cugggcgaucuucagcaccagcu

SEQ ID NO: 386233 - RNA, 17 nt, Bordetella pertussis
cugggcgccggccagga

SEQ ID NO: 386234 - RNA, 18 nt, Bordetella pertussis
cugggcgccggccaggau

SEQ ID NO: 386235 - RNA, 14 nt, Bordetella pertussis
cugggcgccuggcu

SEQ ID NO: 386236 - RNA, 17 nt, Bordetella pertussis
cugggcgccuggcugca

SEQ ID NO: 386237 - RNA, 19 nt, Bordetella pertussis
cugggcgccuggcugcaag

SEQ ID NO: 386238 - RNA, 14 nt, Bordetella pertussis
cugggcgcgccgcu

SEQ ID NO: 386239 - RNA, 22 nt, Bordetella pertussis
cugggcgcgccgcugcagcgcu

SEQ ID NO: 386240 - RNA, 16 nt, Bordetella pertussis
cugggcgcggaacagc

SEQ ID NO: 386241 - RNA, 22 nt, Bordetella pertussis
cugggcgcgguccagcaaggcg

SEQ ID NO: 386242 - RNA, 19 nt, Bordetella pertussis
cugggcggauuggacagca

SEQ ID NO: 386243 - RNA, 15 nt, Bordetella pertussis
cugggcgcugcugcu

SEQ ID NO: 386244 - RNA, 14 nt, Bordetella pertussis
cugggcggccaggc

SEQ ID NO: 386245 - RNA, 14 nt, Bordetella pertussis
cugggcggccuugg

SEQ ID NO: 386246 - RNA, 12 nt, Bordetella pertussis
cugggcggcgca

SEQ ID NO: 386247 - RNA, 17 nt, Bordetella pertussis
cugggcgucccaggcca

SEQ ID NO: 386248 - RNA, 15 nt, Bordetella pertussis
cuggggcaggacgcc

SEQ ID NO: 386249 - RNA, 17 nt, Bordetella pertussis
cuggggcaggacgccgg

SEQ ID NO: 386250 - RNA, 13 nt, Bordetella pertussis
cuggggcaggcac

SEQ ID NO: 386251 - RNA, 15 nt, Bordetella pertussis
cuggggcaggcacug

SEQ ID NO: 386252 - RNA, 19 nt, Bordetella pertussis
cuggggccgcggcgcgcgc

SEQ ID NO: 386253 - RNA, 18 nt, Bordetella pertussis
cuggggcgggcgggcgca

SEQ ID NO: 386254 - RNA, 13 nt, Bordetella pertussis
cuggggcuggcau

SEQ ID NO: 386255 - RNA, 17 nt, Bordetella pertussis
cugggggacuggcaccc

SEQ ID NO: 386256 - RNA, 21 nt, Bordetella pertussis
cugggggacuggcacccgcaa

SEQ ID NO: 386257 - RNA, 15 nt, Bordetella pertussis
cugggggcuggaggc

SEQ ID NO: 386258 - RNA, 18 nt, Bordetella pertussis
cugggggcuggaggcgca

SEQ ID NO: 386259 - RNA, 19 nt, Bordetella pertussis
cuggggguucgugggcgag

SEQ ID NO: 386260 - RNA, 19 nt, Bordetella pertussis
cugggguuguauugcauga

SEQ ID NO: 386261 - RNA, 16 nt, Bordetella pertussis
cugggucaucagcacg

SEQ ID NO: 386262 - RNA, 18 nt, Bordetella pertussis
cugggucugccccauggc

SEQ ID NO: 386263 - RNA, 13 nt, Bordetella pertussis
cuggguggccagc

SEQ ID NO: 386264 - RNA, 15 nt, Bordetella pertussis
cuggguggccagcgc

SEQ ID NO: 386265 - RNA, 12 nt, Bordetella pertussis
cugggugcuggc

SEQ ID NO: 386266 - RNA, 17 nt, Bordetella pertussis
cuggguggcggggcgca

SEQ ID NO: 386267 - RNA, 16 nt, Bordetella pertussis
cugguacgacagcucg

SEQ ID NO: 386268 - RNA, 20 nt, Bordetella pertussis
cugguacgacagcucgggga

SEQ ID NO: 386269 - RNA, 18 nt, Bordetella pertussis
cugguagacaugcucgau

SEQ ID NO: 386270 - RNA, 19 nt, Bordetella pertussis
cugguaguaaucgcgcgcc

SEQ ID NO: 386271 - RNA, 21 nt, Bordetella pertussis
cugguauccggcgcacgcccc

SEQ ID NO: 386272 - RNA, 22 nt, Bordetella pertussis
cugguaugcacgaugccgucgc

SEQ ID NO: 386273 - RNA, 16 nt, Bordetella pertussis
cuggucaagggcggcc

SEQ ID NO: 386274 - RNA, 14 nt, Bordetella pertussis
cuggucaccgcccc

SEQ ID NO: 386275 - RNA, 15 nt, Bordetella pertussis
cuggucaccgccccg

SEQ ID NO: 386276 - RNA, 18 nt, Bordetella pertussis
cuggucaccgccccgacc

SEQ ID NO: 386277 - RNA, 23 nt, Bordetella pertussis
cuggucaccgccccgacccugua

SEQ ID NO: 386278 - RNA, 13 nt, Bordetella pertussis
cuggucagccugg

SEQ ID NO: 386279 - RNA, 15 nt, Bordetella pertussis
cuggucagccugggg

SEQ ID NO: 386280 - RNA, 19 nt, Bordetella pertussis
cuggucauugaccugcuug

SEQ ID NO: 386281 - RNA, 15 nt, Bordetella pertussis
cugguccgccgccgc

SEQ ID NO: 386282 - RNA, 23 nt, Bordetella pertussis
cuggucgaacgcuuccugggccu

SEQ ID NO: 386283 - RNA, 14 nt, Bordetella pertussis
cuggucgaccaggc

SEQ ID NO: 386284 - RNA, 16 nt, Bordetella pertussis
cuggucgacgccggcg

SEQ ID NO: 386285 - RNA, 15 nt, Bordetella pertussis
cuggucgagagccug

SEQ ID NO: 386286 - RNA, 19 nt, Bordetella pertussis
cuggucgagagccugggcg

SEQ ID NO: 386287 - RNA, 20 nt, Bordetella pertussis
cuggucgagagccugggcgc

SEQ ID NO: 386288 - RNA, 18 nt, Bordetella pertussis
cuggucgagcgggcgcca

SEQ ID NO: 386289 - RNA, 22 nt, Bordetella pertussis
cuggucgaucagccccugccau

SEQ ID NO: 386290 - RNA, 14 nt, Bordetella pertussis
cuggucgaucgaga

SEQ ID NO: 386291 - RNA, 19 nt, Bordetella pertussis
cuggucgccgucaggauca

SEQ ID NO: 386292 - RNA, 16 nt, Bordetella pertussis
cuggucgcgggccagg

SEQ ID NO: 386293 - RNA, 19 nt, Bordetella pertussis
cuggucgcgggccaggccg

SEQ ID NO: 386294 - RNA, 15 nt, Bordetella pertussis
cuggucgcgcagcac

SEQ ID NO: 386295 - RNA, 18 nt, Bordetella pertussis
cuggucgcuggcgccggu

SEQ ID NO: 386296 - RNA, 18 nt, Bordetella pertussis
cuggucggccucguagug

SEQ ID NO: 386297 - RNA, 15 nt, Bordetella pertussis
cuggucggcgcggca

SEQ ID NO: 386298 - RNA, 22 nt, Bordetella pertussis
cuggucgggaugccccgcccgc

SEQ ID NO: 386299 - RNA, 18 nt, Bordetella pertussis
cuggucgggcgugagcgc

SEQ ID NO: 386300 - RNA, 22 nt, Bordetella pertussis
cuggucuuccgguacgcgcagu

SEQ ID NO: 386301 - RNA, 22 nt, Bordetella pertussis
cuggugaccgcguaggccuuca

SEQ ID NO: 386302 - RNA, 16 nt, Bordetella pertussis
cuggugaucugcugcg

SEQ ID NO: 386303 - RNA, 20 nt, Bordetella pertussis
cuggugcacgaugcccaggg

SEQ ID NO: 386304 - RNA, 21 nt, Bordetella pertussis
cuggugcacgccgauguccac

SEQ ID NO: 386305 - RNA, 13 nt, Bordetella pertussis
cuggugcaccacg

SEQ ID NO: 386306 - RNA, 17 nt, Bordetella pertussis
cuggugcaccacgcgcu

SEQ ID NO: 386307 - RNA, 17 nt, Bordetella pertussis
cuggugcccgacgccgc

SEQ ID NO: 386308 - RNA, 20 nt, Bordetella pertussis
cuggugcgccgugcccggcg

SEQ ID NO: 386309 - RNA, 15 nt, Bordetella pertussis
cuggugcgcguccug

SEQ ID NO: 386310 - RNA, 17 nt, Bordetella pertussis
cuggugcuggugccgcu

SEQ ID NO: 386311 - RNA, 14 nt, Bordetella pertussis
cuggugcuggugcu

SEQ ID NO: 386312 - RNA, 18 nt, Bordetella pertussis
cugguggcgauccaugug

SEQ ID NO: 386313 - RNA, 22 nt, Bordetella pertussis
cugguggcgauccauguggcca

SEQ ID NO: 386314 - RNA, 16 nt, Bordetella pertussis
cugguggugccgcgca

SEQ ID NO: 386315 - RNA, 17 nt, Bordetella pertussis
cugguggugggcgugcc

SEQ ID NO: 386316 - RNA, 16 nt, Bordetella pertussis
cugguugaccgagccc

SEQ ID NO: 386317 - RNA, 16 nt, Bordetella pertussis
cugguugagcagcacc

SEQ ID NO: 386318 - RNA, 22 nt, Bordetella pertussis
cugguuggccgccuggcuuucg

SEQ ID NO: 386319 - RNA, 22 nt, Bordetella pertussis
cugguuguccaccacccaggcc

SEQ ID NO: 386320 - RNA, 22 nt, Bordetella pertussis
cugguuuucggacgcagcuucu

SEQ ID NO: 386321 - RNA, 17 nt, Bordetella pertussis
cugguuuuucgaagagc

SEQ ID NO: 386322 - RNA, 12 nt, Bordetella pertussis
cuguaacaacac

SEQ ID NO: 386323 - RNA, 20 nt, Bordetella pertussis
cuguaacaacacguacgacc

SEQ ID NO: 386324 - RNA, 21 nt, Bordetella pertussis
cuguacaagcgcacgcugggc

SEQ ID NO: 386325 - RNA, 17 nt, Bordetella pertussis
cuguaccgcgcgauguc

SEQ ID NO: 386326 - RNA, 23 nt, Bordetella pertussis
cuguaccgcgcgaugucgaauuc

SEQ ID NO: 386327 - RNA, 16 nt, Bordetella pertussis
cuguaccgguagcccg

SEQ ID NO: 386328 - RNA, 18 nt, Bordetella pertussis
cuguaccgguagcccgcg

SEQ ID NO: 386329 - RNA, 18 nt, Bordetella pertussis
cuguacugguaccaggcg

SEQ ID NO: 386330 - RNA, 22 nt, Bordetella pertussis
cuguaggcgccggcgccgggca

SEQ ID NO: 386331 - RNA, 14 nt, Bordetella pertussis
cuguaucagcgccu

SEQ ID NO: 386332 - RNA, 14 nt, Bordetella pertussis
cuguaucuggccug

SEQ ID NO: 386333 - RNA, 13 nt, Bordetella pertussis
aaacugcaaaauu

SEQ ID NO: 386334 - RNA, 18 nt, Bordetella pertussis
cugucaauagguuguauu

SEQ ID NO: 386335 - RNA, 17 nt, Bordetella pertussis
cuguccaagcgcguggc

SEQ ID NO: 386336 - RNA, 17 nt, Bordetella pertussis
cuguccaggccggggcc

SEQ ID NO: 386337 - RNA, 23 nt, Bordetella pertussis
cugucccaaccgggacaggcacc

SEQ ID NO: 386338 - RNA, 17 nt, Bordetella pertussis
cugucccagcggggaca

SEQ ID NO: 386339 - RNA, 16 nt, Bordetella pertussis
cuguccccacaggggg

SEQ ID NO: 386340 - RNA, 22 nt, Bordetella pertussis
cuguccccacggggacaggcac

SEQ ID NO: 386341 - RNA, 23 nt, Bordetella pertussis
cuguccccacggggacaggcacc

SEQ ID NO: 386342 - RNA, 20 nt, Bordetella pertussis
cuguccccacguggacaggc

SEQ ID NO: 386343 - RNA, 14 nt, Bordetella pertussis
cuguccccacuggg

SEQ ID NO: 386344 - RNA, 18 nt, Bordetella pertussis
cuguccccgaaggggacu

SEQ ID NO: 386345 - RNA, 18 nt, Bordetella pertussis
cuguccccgcaaggggga

SEQ ID NO: 386346 - RNA, 21 nt, Bordetella pertussis
cuguccccgcacggggacagg

SEQ ID NO: 386347 - RNA, 23 nt, Bordetella pertussis
cuguccccgcagggacaggcacc

SEQ ID NO: 386348 - RNA, 22 nt, Bordetella pertussis
cuguccccgccgggacaggcac

SEQ ID NO: 386349 - RNA, 23 nt, Bordetella pertussis
cuguccccgcggggacagauacc

SEQ ID NO: 386350 - RNA, 19 nt, Bordetella pertussis
cuguccccgcggggacagg

SEQ ID NO: 386351 - RNA, 23 nt, Bordetella pertussis
cuguccccgcggggacaggcacc

SEQ ID NO: 386352 - RNA, 19 nt, Bordetella pertussis
cuguccccgcugggacagg

SEQ ID NO: 386353 - RNA, 19 nt, Bordetella pertussis
cuguccccgucgggacagg

SEQ ID NO: 386354 - RNA, 14 nt, Bordetella pertussis
cuguccccgugggg

SEQ ID NO: 386355 - RNA, 16 nt, Bordetella pertussis
cuguccccguggggac

SEQ ID NO: 386356 - RNA, 20 nt, Bordetella pertussis
cuguccccguggggacaggc

SEQ ID NO: 386357 - RNA, 23 nt, Bordetella pertussis
cuguccccguggggacaggcacc

SEQ ID NO: 386358 - RNA, 17 nt, Bordetella pertussis
cugucccgacggggaca

SEQ ID NO: 386359 - RNA, 19 nt, Bordetella pertussis
cugucccgacggggacagg

SEQ ID NO: 386360 - RNA, 20 nt, Bordetella pertussis
cugucccgacggggacaggc

SEQ ID NO: 386361 - RNA, 17 nt, Bordetella pertussis
cugucccggcggggaca

SEQ ID NO: 386362 - RNA, 19 nt, Bordetella pertussis
cugucccggcggggacagg

SEQ ID NO: 386363 - RNA, 23 nt, Bordetella pertussis
cugucccggcggggacaggcgcc

SEQ ID NO: 386364 - RNA, 23 nt, Bordetella pertussis
cugucccggcugggacaggcacc

SEQ ID NO: 386365 - RNA, 23 nt, Bordetella pertussis
cugucccugccgggacaggcacc

SEQ ID NO: 386366 - RNA, 20 nt, Bordetella pertussis
cugucccugcgggggcaggc

SEQ ID NO: 386367 - RNA, 17 nt, Bordetella pertussis
cuguccggcgcuggcuu

SEQ ID NO: 386368 - RNA, 20 nt, Bordetella pertussis
cuguccgucucgguggagga

SEQ ID NO: 386369 - RNA, 15 nt, Bordetella pertussis
cuguccuccccgcug

SEQ ID NO: 386370 - RNA, 15 nt, Bordetella pertussis
cugucgaccucgucg

SEQ ID NO: 386371 - RNA, 19 nt, Bordetella pertussis
cugucgcagucggggccgc

SEQ ID NO: 386372 - RNA, 17 nt, Bordetella pertussis
cugucgcgcuacagcgu

SEQ ID NO: 386373 - RNA, 14 nt, Bordetella pertussis
cugucgcgcugcuu

SEQ ID NO: 386374 - RNA, 16 nt, Bordetella pertussis
cugucgcgcugcuuuc

SEQ ID NO: 386375 - RNA, 15 nt, Bordetella pertussis
cugucgcgggagauc

SEQ ID NO: 386376 - RNA, 17 nt, Bordetella pertussis
cugucggcguuccuggc

SEQ ID NO: 386377 - RNA, 20 nt, Bordetella pertussis
cugucggcguuccuggcgcu

SEQ ID NO: 386378 - RNA, 23 nt, Bordetella pertussis
cugucggugauccacugcagcag

SEQ ID NO: 386379 - RNA, 20 nt, Bordetella pertussis
cugucggugaugauccugcu

SEQ ID NO: 386380 - RNA, 18 nt, Bordetella pertussis
cugugcagccacgccugg

SEQ ID NO: 386381 - RNA, 19 nt, Bordetella pertussis
cugugccagcuggcccagu

SEQ ID NO: 386382 - RNA, 13 nt, Bordetella pertussis
cugugcccgcccc

SEQ ID NO: 386383 - RNA, 14 nt, Bordetella pertussis
cugugcccgcccca

SEQ ID NO: 386384 - RNA, 22 nt, Bordetella pertussis
cuguggacgccgccggcccagg

SEQ ID NO: 386385 - RNA, 18 nt, Bordetella pertussis
cuguggccgcggcccagc

SEQ ID NO: 386386 - RNA, 22 nt, Bordetella pertussis
cugugggcgguaaggucgggua

SEQ ID NO: 386387 - RNA, 21 nt, Bordetella pertussis
cuguguugauccgccaauggc

SEQ ID NO: 386388 - RNA, 19 nt, Bordetella pertussis
cuguucaucaacaugucca

SEQ ID NO: 386389 - RNA, 14 nt, Bordetella pertussis
cuguuccagccagu

SEQ ID NO: 386390 - RNA, 19 nt, Bordetella pertussis
cuguugaggaugugcagcg

SEQ ID NO: 386391 - RNA, 12 nt, Bordetella pertussis
cuguugcagcgg

SEQ ID NO: 386392 - RNA, 23 nt, Bordetella pertussis
cuguugcuggccacccgacagcu

SEQ ID NO: 386393 - RNA, 17 nt, Bordetella pertussis
cuguuggcguggcuggc

SEQ ID NO: 386394 - RNA, 14 nt, Bordetella pertussis
cuguuggucagguc

SEQ ID NO: 386395 - RNA, 22 nt, Bordetella pertussis
cuuacgcgguccgcagcgcucg

SEQ ID NO: 386396 - RNA, 17 nt, Bordetella pertussis
cuucacauccacugucu

SEQ ID NO: 386397 - RNA, 20 nt, Bordetella pertussis
cuucaccuugccgcugguga

SEQ ID NO: 386398 - RNA, 16 nt, Bordetella pertussis
cuucacgacacgccca

SEQ ID NO: 386399 - RNA, 17 nt, Bordetella pertussis
cuuccagcagggcggcg

SEQ ID NO: 386400 - RNA, 12 nt, Bordetella pertussis
cuuccagcgcau

SEQ ID NO: 386401 - RNA, 22 nt, Bordetella pertussis
cuuccagcgcauuggugagcac

SEQ ID NO: 386402 - RNA, 12 nt, Bordetella pertussis
cuuccagcgccu

SEQ ID NO: 386403 - RNA, 14 nt, Bordetella pertussis
cuuccagcgccugc

SEQ ID NO: 386404 - RNA, 16 nt, Bordetella pertussis
cuuccagcgccugcuc

SEQ ID NO: 386405 - RNA, 16 nt, Bordetella pertussis
cuuccaucuacgugcu

SEQ ID NO: 386406 - RNA, 20 nt, Bordetella pertussis
cuuccaugaggaacggcacc

SEQ ID NO: 386407 - RNA, 20 nt, Bordetella pertussis
cuuccgcacgccgaccuggc

SEQ ID NO: 386408 - RNA, 19 nt, Bordetella pertussis
cuuccuccgacaggcgccg

SEQ ID NO: 386409 - RNA, 17 nt, Bordetella pertussis
cuuccucgaccagcccg

SEQ ID NO: 386410 - RNA, 18 nt, Bordetella pertussis
cuuccucgacccgcgccu

SEQ ID NO: 386411 - RNA, 17 nt, Bordetella pertussis
cuuccucggcgcgcgcg

SEQ ID NO: 386412 - RNA, 20 nt, Bordetella pertussis
cuuccuugaccaccuugccc

SEQ ID NO: 386413 - RNA, 21 nt, Bordetella pertussis
cuuccuugccauccagccagg

SEQ ID NO: 386414 - RNA, 22 nt, Bordetella pertussis
cuucgaaguauuucaggaugcc

SEQ ID NO: 386415 - RNA, 14 nt, Bordetella pertussis
cuucgaugaugagc

SEQ ID NO: 386416 - RNA, 17 nt, Bordetella pertussis
cuucgcgguacgcccag

SEQ ID NO: 386417 - RNA, 17 nt, Bordetella pertussis
cuucggcaaccgcgccu

SEQ ID NO: 386418 - RNA, 20 nt, Bordetella pertussis
cuucggcaaccgcgccucgu

SEQ ID NO: 386419 - RNA, 19 nt, Bordetella pertussis
cuucggcaggcgccggcug

SEQ ID NO: 386420 - RNA, 15 nt, Bordetella pertussis
cuucggcaucugcca

SEQ ID NO: 386421 - RNA, 24 nt, Bordetella pertussis
cuucggcauguaggccucgggcca

SEQ ID NO: 386422 - RNA, 23 nt, Bordetella pertussis
cuucggccgccagccggcccagc

SEQ ID NO: 386423 - RNA, 20 nt, Bordetella pertussis
cuucggccggcugcgcgccg

SEQ ID NO: 386424 - RNA, 15 nt, Bordetella pertussis
cuucggccugcgcca

SEQ ID NO: 386425 - RNA, 17 nt, Bordetella pertussis
cuucggccugcgccacc

SEQ ID NO: 386426 - RNA, 22 nt, Bordetella pertussis
cuucggcgcggcgggcucagcc

SEQ ID NO: 386427 - RNA, 13 nt, Bordetella pertussis
cuucggcggccgc

SEQ ID NO: 386428 - RNA, 16 nt, Bordetella pertussis
cuucggcgcgcacgcu

SEQ ID NO: 386429 - RNA, 24 nt, Bordetella pertussis
cuuucagcacauccgacagauggc

SEQ ID NO: 386430 - RNA, 21 nt, Bordetella pertussis
cuuucaucaaacgcggcgccg

SEQ ID NO: 386431 - RNA, 18 nt, Bordetella pertussis
cuuucaugggccugggcg

SEQ ID NO: 386432 - RNA, 15 nt, Bordetella pertussis
cuuucucccgccgcu

SEQ ID NO: 386433 - RNA, 14 nt, Bordetella pertussis
cuuugacgccggcu

SEQ ID NO: 386434 - RNA, 20 nt, Bordetella pertussis
cuuugcauaagccgcaagca

SEQ ID NO: 386435 - RNA, 19 nt, Bordetella pertussis
cuuugcauugcggcugggu

SEQ ID NO: 386436 - RNA, 13 nt, Bordetella pertussis
cuuuuuccuugcg

SEQ ID NO: 386437 - RNA, 16 nt, Bordetella pertussis
gaaaaagcccugcgug

SEQ ID NO: 386438 - RNA, 18 nt, Bordetella pertussis
gaaaaagcccugcguggc

SEQ ID NO: 386439 - RNA, 23 nt, Bordetella pertussis
gaaaaccgcucguaucgcccuga

SEQ ID NO: 386440 - RNA, 18 nt, Bordetella pertussis
gaaaaccggcgccuggcc

SEQ ID NO: 386441 - RNA, 13 nt, Bordetella pertussis
gaaacugccaucc

SEQ ID NO: 386442 - RNA, 17 nt, Bordetella pertussis
gaaagcgcgucgagcag

SEQ ID NO: 386443 - RNA, 20 nt, Bordetella pertussis
gaaagcgcugcgccgcggcg

SEQ ID NO: 386444 - RNA, 16 nt, Bordetella pertussis
gaaagcuguccacgcc

SEQ ID NO: 386445 - RNA, 16 nt, Bordetella pertussis
gaaauugacggcgcuc

SEQ ID NO: 386446 - RNA, 23 nt, Bordetella pertussis
gaaauugacggcgcucuuggugg

SEQ ID NO: 386447 - RNA, 23 nt, Bordetella pertussis
gaacaagguccaggcccggcaga

SEQ ID NO: 386448 - RNA, 14 nt, Bordetella pertussis
gaacaccggcaggc

SEQ ID NO: 386449 - RNA, 13 nt, Bordetella pertussis
gaacacgaugaag

SEQ ID NO: 386450 - RNA, 19 nt, Bordetella pertussis
gaacacgaugaagaugccg

SEQ ID NO: 386451 - RNA, 14 nt, Bordetella pertussis
gaacacgcgcgccg

SEQ ID NO: 386452 - RNA, 24 nt, Bordetella pertussis
gaacagcagcgugaugcggucggc

SEQ ID NO: 386453 - RNA, 17 nt, Bordetella pertussis
gaacagcauggcggcgc

SEQ ID NO: 386454 - RNA, 19 nt, Bordetella pertussis
gaacagcauggcggcgccc

SEQ ID NO: 386455 - RNA, 22 nt, Bordetella pertussis
gaacagcucggcccauugcggc

SEQ ID NO: 386456 - RNA, 14 nt, Bordetella pertussis
gaacagcugcagcg

SEQ ID NO: 386457 - RNA, 19 nt, Bordetella pertussis
gaacagcuggaagcgcgcc

SEQ ID NO: 386458 - RNA, 13 nt, Bordetella pertussis
gaacaggccggcc

SEQ ID NO: 386459 - RNA, 17 nt, Bordetella pertussis
gaacaggcgcgccagcc

SEQ ID NO: 386460 - RNA, 21 nt, Bordetella pertussis
gaacaggcgcuugcgcucggu

SEQ ID NO: 386461 - RNA, 14 nt, Bordetella pertussis
gaaccaggccaccg

SEQ ID NO: 386462 - RNA, 20 nt, Bordetella pertussis
gaaccaggccacgaugaugg

SEQ ID NO: 386463 - RNA, 14 nt, Bordetella pertussis
gaaccaggccgcca

SEQ ID NO: 386464 - RNA, 23 nt, Bordetella pertussis
gaaccagugcaggggguggcggc

SEQ ID NO: 386465 - RNA, 20 nt, Bordetella pertussis
gaaccccgccuucgucgagg

SEQ ID NO: 386466 - RNA, 19 nt, Bordetella pertussis
gaacccgauaugccaagga

SEQ ID NO: 386467 - RNA, 19 nt, Bordetella pertussis
gaacccgcccgaaccggca

SEQ ID NO: 386468 - RNA, 14 nt, Bordetella pertussis
gaacccggccggcg

SEQ ID NO: 386469 - RNA, 17 nt, Bordetella pertussis
gaaccgaaaugccgcag

SEQ ID NO: 386470 - RNA, 21 nt, Bordetella pertussis
gaaccgaaaugccgcagcacc

SEQ ID NO: 386471 - RNA, 17 nt, Bordetella pertussis
gaaccgcagaagcagcc

SEQ ID NO: 386472 - RNA, 17 nt, Bordetella pertussis
gaaccgguggccaugga

SEQ ID NO: 386473 - RNA, 15 nt, Bordetella pertussis
gaaccgguuggccag

SEQ ID NO: 386474 - RNA, 19 nt, Bordetella pertussis
gaaccugcuggccgccggc

SEQ ID NO: 386475 - RNA, 14 nt, Bordetella pertussis
gaacgacagcgaca

SEQ ID NO: 386476 - RNA, 19 nt, Bordetella pertussis
gaacgacuuggcgcaaacc

SEQ ID NO: 386477 - RNA, 23 nt, Bordetella pertussis
gaacgauucuuuccuggccggcg

SEQ ID NO: 386478 - RNA, 17 nt, Bordetella pertussis
gaacgcaauugcguggu

SEQ ID NO: 386479 - RNA, 16 nt, Bordetella pertussis
gaacgccagcagcacc

SEQ ID NO: 386480 - RNA, 13 nt, Bordetella pertussis
gaacgccgcgcuc

SEQ ID NO: 386481 - RNA, 22 nt, Bordetella pertussis
gaacgccgcgcucagcaccagg

SEQ ID NO: 386482 - RNA, 12 nt, Bordetella pertussis
gaacgccgggcc

SEQ ID NO: 386483 - RNA, 23 nt, Bordetella pertussis
gaacgccugccagaacagccgcg

SEQ ID NO: 386484 - RNA, 15 nt, Bordetella pertussis
gaacgcgacagcgcu

SEQ ID NO: 386485 - RNA, 15 nt, Bordetella pertussis
gaacgcgcgccggcc

SEQ ID NO: 386486 - RNA, 15 nt, Bordetella pertussis
gaacgcguccaggcc

SEQ ID NO: 386487 - RNA, 19 nt, Bordetella pertussis
gaacggauugcugauggga

SEQ ID NO: 386488 - RNA, 17 nt, Bordetella pertussis
gaacggcccauccaucu

SEQ ID NO: 386489 - RNA, 18 nt, Bordetella pertussis
gaacggccccgccagggc

SEQ ID NO: 386490 - RNA, 13 nt, Bordetella pertussis
gaacggcgcggcc

SEQ ID NO: 386491 - RNA, 17 nt, Bordetella pertussis
gaacggcgcggccugcu

SEQ ID NO: 386492 - RNA, 13 nt, Bordetella pertussis
gaacgggcagccg

SEQ ID NO: 386493 - RNA, 13 nt, Bordetella pertussis
gaacgggcggguc

SEQ ID NO: 386494 - RNA, 18 nt, Bordetella pertussis
gaacgggcguggcgcagg

SEQ ID NO: 386495 - RNA, 15 nt, Bordetella pertussis
gaacgggguggccgg

SEQ ID NO: 386496 - RNA, 17 nt, Bordetella pertussis
gaacgggguggccggcg

SEQ ID NO: 386497 - RNA, 20 nt, Bordetella pertussis
gaacgucaccccgcccugcc

SEQ ID NO: 386498 - RNA, 22 nt, Bordetella pertussis
gaacgucaccccgcccugcccg

SEQ ID NO: 386499 - RNA, 17 nt, Bordetella pertussis
gaacguguaggucagcg

SEQ ID NO: 386500 - RNA, 21 nt, Bordetella pertussis
gaacuccugcagcacgcuggc

SEQ ID NO: 386501 - RNA, 16 nt, Bordetella pertussis
gaacucgcgcucggcc

SEQ ID NO: 386502 - RNA, 22 nt, Bordetella pertussis
gaacucgcgcucggccagcgcg

SEQ ID NO: 386503 - RNA, 19 nt, Bordetella pertussis
gaacucggccgcauggcgg

SEQ ID NO: 386504 - RNA, 14 nt, Bordetella pertussis
gaacucgguggcgg

SEQ ID NO: 386505 - RNA, 16 nt, Bordetella pertussis
gaacucguuggccagc

SEQ ID NO: 386506 - RNA, 15 nt, Bordetella pertussis
gaacugcgcggucuu

SEQ ID NO: 386507 - RNA, 19 nt, Bordetella pertussis
gaacugcuccacgugcggc

SEQ ID NO: 386508 - RNA, 22 nt, Bordetella pertussis
gaacugcuccacgugcggcagg

SEQ ID NO: 386509 - RNA, 15 nt, Bordetella pertussis
gaacugggucugcac

SEQ ID NO: 386510 - RNA, 14 nt, Bordetella pertussis
aaagaggccaggcc

SEQ ID NO: 386511 - RNA, 20 nt, Bordetella pertussis
gaagaucacauaggccggca

SEQ ID NO: 386512 - RNA, 21 nt, Bordetella pertussis
gaagaucacauaggccggcac

SEQ ID NO: 386513 - RNA, 11 nt, Bordetella pertussis
gaagcaaugca

SEQ ID NO: 386514 - RNA, 15 nt, Bordetella pertussis
gaagcacugcaggcc

SEQ ID NO: 386515 - RNA, 20 nt, Bordetella pertussis
gaagcagccgcgcggccggg

SEQ ID NO: 386516 - RNA, 16 nt, Bordetella pertussis
gaagcagccgcgcucg

SEQ ID NO: 386517 - RNA, 16 nt, Bordetella pertussis
gaagccaucgacaagc

SEQ ID NO: 386518 - RNA, 21 nt, Bordetella pertussis
gaagcccccgcgcugcgcccg

SEQ ID NO: 386519 - RNA, 18 nt, Bordetella pertussis
gaagcgcagcaccgcgcg

SEQ ID NO: 386520 - RNA, 16 nt, Bordetella pertussis
gaagcgcaggccuucg

SEQ ID NO: 386521 - RNA, 15 nt, Bordetella pertussis
gaagcgccgccacag

SEQ ID NO: 386522 - RNA, 15 nt, Bordetella pertussis
gaagcgcgccaggcg

SEQ ID NO: 386523 - RNA, 18 nt, Bordetella pertussis
gaagcgcgccaggcgcau

SEQ ID NO: 386524 - RNA, 15 nt, Bordetella pertussis
gaagcgcgccgcgcg

SEQ ID NO: 386525 - RNA, 19 nt, Bordetella pertussis
gaagcggauguccggcgcg

SEQ ID NO: 386526 - RNA, 17 nt, Bordetella pertussis
gaagcggcccggguggg

SEQ ID NO: 386527 - RNA, 15 nt, Bordetella pertussis
gaagcggcucaggcg

SEQ ID NO: 386528 - RNA, 17 nt, Bordetella pertussis
gaagcggcucaggcgcg

SEQ ID NO: 386529 - RNA, 19 nt, Bordetella pertussis
gaagcgggccugccgcgcg

SEQ ID NO: 386530 - RNA, 19 nt, Bordetella pertussis
gaaggcagcgcggccggca

SEQ ID NO: 386531 - RNA, 10 nt, Bordetella pertussis
gaaggccacg

SEQ ID NO: 386532 - RNA, 19 nt, Bordetella pertussis
gaaggccgaggccagguug

SEQ ID NO: 386533 - RNA, 23 nt, Bordetella pertussis
gaaggccgccgcgcccagcagcg

SEQ ID NO: 386534 - RNA, 23 nt, Bordetella pertussis
gaaggcccgcgucuuggcgggca

SEQ ID NO: 386535 - RNA, 20 nt, Bordetella pertussis
gaaggcgaccggcaccuggg

SEQ ID NO: 386536 - RNA, 19 nt, Bordetella pertussis
gaaggcgcccgggcugccg

SEQ ID NO: 386537 - RNA, 20 nt, Bordetella pertussis
gaaggcgccggccaggcccu

SEQ ID NO: 386538 - RNA, 15 nt, Bordetella pertussis
gaaggcgcggcugcg

SEQ ID NO: 386539 - RNA, 15 nt, Bordetella pertussis
gaaggcggcgccggu

SEQ ID NO: 386540 - RNA, 12 nt, Bordetella pertussis
gaagggcggcgc

SEQ ID NO: 386541 - RNA, 12 nt, Bordetella pertussis
gaagggugcggc

SEQ ID NO: 386542 - RNA, 18 nt, Bordetella pertussis
gaagguuucgcugcgcac

SEQ ID NO: 386543 - RNA, 15 nt, Bordetella pertussis
gaaguaaucgcccgg

SEQ ID NO: 386544 - RNA, 16 nt, Bordetella pertussis
gaaguacacggccagc

SEQ ID NO: 386545 - RNA, 18 nt, Bordetella pertussis
gaaguacacggccagcac

SEQ ID NO: 386546 - RNA, 23 nt, Bordetella pertussis
gaaguccuucagccgcugacugg

SEQ ID NO: 386547 - RNA, 19 nt, Bordetella pertussis
gaagucgcaauagcucgca

SEQ ID NO: 386548 - RNA, 23 nt, Bordetella pertussis
gaagucggccggcaaggucagca

SEQ ID NO: 386549 - RNA, 22 nt, Bordetella pertussis
gaagucggcgcgcgcuucaccc

SEQ ID NO: 386550 - RNA, 18 nt, Bordetella pertussis
gaagucgggcaccagcac

SEQ ID NO: 386551 - RNA, 16 nt, Bordetella pertussis
gaauaccgcgcacagg

SEQ ID NO: 386552 - RNA, 22 nt, Bordetella pertussis
gaaucaauacgaaaaccaggcu

SEQ ID NO: 386553 - RNA, 17 nt, Bordetella pertussis
gaauccuggcgacggcc

SEQ ID NO: 386554 - RNA, 20 nt, Bordetella pertussis
gaaucgcccgggcgccggca

SEQ ID NO: 386555 - RNA, 21 nt, Bordetella pertussis
gaaucgcccgggcgccggcac

SEQ ID NO: 386556 - RNA, 22 nt, Bordetella pertussis
gaaugaacagcuugcuguccag

SEQ ID NO: 386557 - RNA, 18 nt, Bordetella pertussis
gaaugccauacguccuuu

SEQ ID NO: 386558 - RNA, 21 nt, Bordetella pertussis
gaaugccugguaggcgagcag

SEQ ID NO: 386559 - RNA, 19 nt, Bordetella pertussis
gaaugcguguuccagcgcc

SEQ ID NO: 386560 - RNA, 19 nt, Bordetella pertussis
gaaugucccacaggcgcgc

SEQ ID NO: 386561 - RNA, 23 nt, Bordetella pertussis
gaaugucccacaggcgcgcggcg

SEQ ID NO: 386562 - RNA, 15 nt, Bordetella pertussis
gaauugcgccacgcc

SEQ ID NO: 386563 - RNA, 16 nt, Bordetella pertussis
gaauugcgggccggcg

SEQ ID NO: 386564 - RNA, 13 nt, Bordetella pertussis
gaauugcuggagc

SEQ ID NO: 386565 - RNA, 14 nt, Bordetella pertussis
gaauugcuggagcg

SEQ ID NO: 386566 - RNA, 16 nt, Bordetella pertussis
gaauuuuucuuccagu

SEQ ID NO: 386567 - RNA, 15 nt, Bordetella pertussis
gacaacgcgcgccac

SEQ ID NO: 386568 - RNA, 14 nt, Bordetella pertussis
gacaaggcgcgcgc

SEQ ID NO: 386569 - RNA, 18 nt, Bordetella pertussis
gacaccaaggggcggauc

SEQ ID NO: 386570 - RNA, 20 nt, Bordetella pertussis
gacaccgcaggugccugucc

SEQ ID NO: 386571 - RNA, 17 nt, Bordetella pertussis
gacagaguuauuuuccg

SEQ ID NO: 386572 - RNA, 18 nt, Bordetella pertussis
gacagauccagcgcggcc

SEQ ID NO: 386573 - RNA, 18 nt, Bordetella pertussis
gacagcaguuucugcacc

SEQ ID NO: 386574 - RNA, 16 nt, Bordetella pertussis
gacagcccgcgcuggc

SEQ ID NO: 386575 - RNA, 15 nt, Bordetella pertussis
gacagccgcgccagc

SEQ ID NO: 386576 - RNA, 18 nt, Bordetella pertussis
gacagccgcgccagcgcc

SEQ ID NO: 386577 - RNA, 21 nt, Bordetella pertussis
gacagccgcgccagcgccucc

SEQ ID NO: 386578 - RNA, 23 nt, Bordetella pertussis
gacaggcaccuuggcccggcggg

SEQ ID NO: 386579 - RNA, 12 nt, Bordetella pertussis
gacaggcacucu

SEQ ID NO: 386580 - RNA, 16 nt, Bordetella pertussis
gacaggccagugccug

SEQ ID NO: 386581 - RNA, 19 nt, Bordetella pertussis
gacaggccgaugcuggucg

SEQ ID NO: 386582 - RNA, 14 nt, Bordetella pertussis
gacaggcgcagcuc

SEQ ID NO: 386583 - RNA, 15 nt, Bordetella pertussis
gacaggcgccacagg

SEQ ID NO: 386584 - RNA, 21 nt, Bordetella pertussis
gacaggcgcccgugcgcggcg

SEQ ID NO: 386585 - RNA, 14 nt, Bordetella pertussis
gacaggcgccgcaa

SEQ ID NO: 386586 - RNA, 23 nt, Bordetella pertussis
gacaggcgccucgcgacggccuc

SEQ ID NO: 386587 - RNA, 21 nt, Bordetella pertussis
gacaggcgcgcaggcgggccu

SEQ ID NO: 386588 - RNA, 13 nt, Bordetella pertussis
gacaggcgcgcca

SEQ ID NO: 386589 - RNA, 15 nt, Bordetella pertussis
gacaggcgcgcccgc

SEQ ID NO: 386590 - RNA, 22 nt, Bordetella pertussis
gacaggcucccgcuggcggcac

SEQ ID NO: 386591 - RNA, 23 nt, Bordetella pertussis
gacagggccgcgagcaugcgcag

SEQ ID NO: 386592 - RNA, 16 nt, Bordetella pertussis
gacaggguccaggugg

SEQ ID NO: 386593 - RNA, 17 nt, Bordetella pertussis
gacagggugccuguccc

SEQ ID NO: 386594 - RNA, 21 nt, Bordetella pertussis
gacagguagcggucgccgcgg

SEQ ID NO: 386595 - RNA, 15 nt, Bordetella pertussis
gacaucagccauugc

SEQ ID NO: 386596 - RNA, 22 nt, Bordetella pertussis
gacaucgccgcugcgcagcagc

SEQ ID NO: 386597 - RNA, 18 nt, Bordetella pertussis
gacaugcugcgacagcag

SEQ ID NO: 386598 - RNA, 20 nt, Bordetella pertussis
gacaugcuggcccagcuggg

SEQ ID NO: 386599 - RNA, 21 nt, Bordetella pertussis
gacaugcuggcccagcugggc

SEQ ID NO: 386600 - RNA, 17 nt, Bordetella pertussis
gacauggccacggcccu

SEQ ID NO: 386601 - RNA, 15 nt, Bordetella pertussis
gaccaccagcaccga

SEQ ID NO: 386602 - RNA, 15 nt, Bordetella pertussis
gaccaccagcgcacu

SEQ ID NO: 386603 - RNA, 21 nt, Bordetella pertussis
gaccaccagcgucaccagcag

SEQ ID NO: 386604 - RNA, 13 nt, Bordetella pertussis
gaccaccugcacc

SEQ ID NO: 386605 - RNA, 23 nt, Bordetella pertussis
gaccacgacggucugggccaugc

SEQ ID NO: 386606 - RNA, 17 nt, Bordetella pertussis
gaccacgauggccggcg

SEQ ID NO: 386607 - RNA, 14 nt, Bordetella pertussis
gaccacgcggcggu

SEQ ID NO: 386608 - RNA, 18 nt, Bordetella pertussis
gaccacgcugggccagac

SEQ ID NO: 386609 - RNA, 15 nt, Bordetella pertussis
gaccagcgcgcgccg

SEQ ID NO: 386610 - RNA, 18 nt, Bordetella pertussis
gaccagcgcgcgccggcc

SEQ ID NO: 386611 - RNA, 22 nt, Bordetella pertussis
gaccagcgcggccgucaccgcc

SEQ ID NO: 386612 - RNA, 17 nt, Bordetella pertussis
gaccagcucgacgccau

SEQ ID NO: 386613 - RNA, 12 nt, Bordetella pertussis
gaccagcugcac

SEQ ID NO: 386614 - RNA, 22 nt, Bordetella pertussis
gaccagcuucugcgccugcugg

SEQ ID NO: 386615 - RNA, 13 nt, Bordetella pertussis
gaccaucgcgcac

SEQ ID NO: 386616 - RNA, 22 nt, Bordetella pertussis
gaccaucuuguccuucagcacg

SEQ ID NO: 386617 - RNA, 21 nt, Bordetella pertussis
gaccaugcgcugggcaugggc

SEQ ID NO: 386618 - RNA, 16 nt, Bordetella pertussis
gacccaggccggcgcc

SEQ ID NO: 386619 - RNA, 17 nt, Bordetella pertussis
gacccaguucggccgcc

SEQ ID NO: 386620 - RNA, 17 nt, Bordetella pertussis
gacccccggcccgcgcc

SEQ ID NO: 386621 - RNA, 23 nt, Bordetella pertussis
gaccccgaagcacagaugcacca

SEQ ID NO: 386622 - RNA, 22 nt, Bordetella pertussis
gaccccgccgugccgggccugg

SEQ ID NO: 386623 - RNA, 14 nt, Bordetella pertussis
gaccgaagcgggcg

SEQ ID NO: 386624 - RNA, 19 nt, Bordetella pertussis
gaccgacagcacauggcgc

SEQ ID NO: 386625 - RNA, 18 nt, Bordetella pertussis
gaccgacggccuggaggc

SEQ ID NO: 386626 - RNA, 20 nt, Bordetella pertussis
gaccgagcccggcaccaugc

SEQ ID NO: 386627 - RNA, 17 nt, Bordetella pertussis
gaccgagccggccagcg

SEQ ID NO: 386628 - RNA, 23 nt, Bordetella pertussis
gaccgagccggccagcgccuggg

SEQ ID NO: 386629 - RNA, 15 nt, Bordetella pertussis
gaccgcaugcggcac

SEQ ID NO: 386630 - RNA, 20 nt, Bordetella pertussis
gaccgccagcaggcccuggg

SEQ ID NO: 386631 - RNA, 23 nt, Bordetella pertussis
gaccgccagcaggcccugggcca

SEQ ID NO: 386632 - RNA, 22 nt, Bordetella pertussis
gaccgccagcaggcgcucggcu

SEQ ID NO: 386633 - RNA, 17 nt, Bordetella pertussis
gaccgccgccagcagcg

SEQ ID NO: 386634 - RNA, 14 nt, Bordetella pertussis
gaccgccgccgucg

SEQ ID NO: 386635 - RNA, 17 nt, Bordetella pertussis
gaccgccuccagcgcgg

SEQ ID NO: 386636 - RNA, 19 nt, Bordetella pertussis
gaccgccuccagcgcggcg

SEQ ID NO: 386637 - RNA, 23 nt, Bordetella pertussis
gaccgccuccagcgcggcgggcg

SEQ ID NO: 386638 - RNA, 15 nt, Bordetella pertussis
gaccgccuccaggau

SEQ ID NO: 386639 - RNA, 23 nt, Bordetella pertussis
gaccgccuccaggaugagcgccu

SEQ ID NO: 386640 - RNA, 22 nt, Bordetella pertussis
gaccgcgaaccggugcuggugc

SEQ ID NO: 386641 - RNA, 16 nt, Bordetella pertussis
gaccgcgaagccgccc

SEQ ID NO: 386642 - RNA, 15 nt, Bordetella pertussis
gaccgccuucuuucg

SEQ ID NO: 386643 - RNA, 16 nt, Bordetella pertussis
gaccgcgccgccgcgc

SEQ ID NO: 386644 - RNA, 23 nt, Bordetella pertussis
gaccgcgccugggggcuggaggc

SEQ ID NO: 386645 - RNA, 16 nt, Bordetella pertussis
gaccgcgcggcgcugc

SEQ ID NO: 386646 - RNA, 19 nt, Bordetella pertussis
gaccgcgcugcggucagcu

SEQ ID NO: 386647 - RNA, 13 nt, Bordetella pertussis
gaccgcggccgcg

SEQ ID NO: 386648 - RNA, 20 nt, Bordetella pertussis
gaccgcggcgguccugcuga

SEQ ID NO: 386649 - RNA, 21 nt, Bordetella pertussis
gaccgcgggcgcgcgccccgc

SEQ ID NO: 386650 - RNA, 24 nt, Bordetella pertussis
gaccgcguaggccuucaccuugcc

SEQ ID NO: 386651 - RNA, 21 nt, Bordetella pertussis
gaccgcuuccgccaccgcgcc

SEQ ID NO: 386652 - RNA, 16 nt, Bordetella pertussis
gaccggcacccgcuac

SEQ ID NO: 386653 - RNA, 17 nt, Bordetella pertussis
gaccggccccaccuggc

SEQ ID NO: 386654 - RNA, 21 nt, Bordetella pertussis
gaccggcgcgaacaccggcag

SEQ ID NO: 386655 - RNA, 14 nt, Bordetella pertussis
gaccggcgcggccu

SEQ ID NO: 386656 - RNA, 15 nt, Bordetella pertussis
gaccugagccaggcg

SEQ ID NO: 386657 - RNA, 15 nt, Bordetella pertussis
gaccugcaaccccac

SEQ ID NO: 386658 - RNA, 21 nt, Bordetella pertussis
gaccugcacgauggcgccggc

SEQ ID NO: 386659 - RNA, 18 nt, Bordetella pertussis
gaccugccgcccgagcug

SEQ ID NO: 386660 - RNA, 15 nt, Bordetella pertussis
gaccugcgacagcac

SEQ ID NO: 386661 - RNA, 22 nt, Bordetella pertussis
gaccugcgccaggugcuugcgg

SEQ ID NO: 386662 - RNA, 10 nt, Bordetella pertussis
gaccugcugg

SEQ ID NO: 386663 - RNA, 17 nt, Bordetella pertussis
gaccugcuguucaccuu

SEQ ID NO: 386664 - RNA, 20 nt, Bordetella pertussis
gaccugcuugaagcggucga

SEQ ID NO: 386665 - RNA, 14 nt, Bordetella pertussis
gaccugggccuggu

SEQ ID NO: 386666 - RNA, 16 nt, Bordetella pertussis
gaccugggccugguac

SEQ ID NO: 386667 - RNA, 21 nt, Bordetella pertussis
gaccuguggcgcacccugcag

SEQ ID NO: 386668 - RNA, 15 nt, Bordetella pertussis
gaccuugcgaggccc

SEQ ID NO: 386669 - RNA, 17 nt, Bordetella pertussis
gaccuugcggccgcgca

SEQ ID NO: 386670 - RNA, 20 nt, Bordetella pertussis
gaccuuggcuugcagcgccu

SEQ ID NO: 386671 - RNA, 18 nt, Bordetella pertussis
gacgaaagcggcaaagcc

SEQ ID NO: 386672 - RNA, 18 nt, Bordetella pertussis
gacgaacaacacgaugau

SEQ ID NO: 386673 - RNA, 22 nt, Bordetella pertussis
gacgaagguuucguagccgccg

SEQ ID NO: 386674 - RNA, 14 nt, Bordetella pertussis
gacgaggugccugu

SEQ ID NO: 386675 - RNA, 19 nt, Bordetella pertussis
gacgauaucgcgaaagcgg

SEQ ID NO: 386676 - RNA, 13 nt, Bordetella pertussis
gacgaucaggagg

SEQ ID NO: 386677 - RNA, 15 nt, Bordetella pertussis
gacgcagcagccgcu

SEQ ID NO: 386678 - RNA, 14 nt, Bordetella pertussis
gacgcagccgcagu

SEQ ID NO: 386679 - RNA, 13 nt, Bordetella pertussis
gacgcagccuucg

SEQ ID NO: 386680 - RNA, 18 nt, Bordetella pertussis
gacgcaggcccagccagc

SEQ ID NO: 386681 - RNA, 19 nt, Bordetella pertussis
gacgcaggcccagccagcc

SEQ ID NO: 386682 - RNA, 20 nt, Bordetella pertussis
gacgcauauccaggcggcgc

SEQ ID NO: 386683 - RNA, 23 nt, Bordetella pertussis
gacgcccuggccuucgaccugcc

SEQ ID NO: 386684 - RNA, 16 nt, Bordetella pertussis
gacgccgccgaagggc

SEQ ID NO: 386685 - RNA, 16 nt, Bordetella pertussis
gacgccgcgcgguucg

SEQ ID NO: 386686 - RNA, 22 nt, Bordetella pertussis
gacgccgcgccgcuacagcguc

SEQ ID NO: 386687 - RNA, 12 nt, Bordetella pertussis
gacgccggcggc

SEQ ID NO: 386688 - RNA, 18 nt, Bordetella pertussis
gacgccggcgggcaggcg

SEQ ID NO: 386689 - RNA, 15 nt, Bordetella pertussis
gacgccggcucaggc

SEQ ID NO: 386690 - RNA, 20 nt, Bordetella pertussis
gacgccggcuucagccgcaa

SEQ ID NO: 386691 - RNA, 15 nt, Bordetella pertussis
gacgccggcuuucag

SEQ ID NO: 386692 - RNA, 17 nt, Bordetella pertussis
gacgccguacugggcac

SEQ ID NO: 386693 - RNA, 16 nt, Bordetella pertussis
gacgccgucgcggacc

SEQ ID NO: 386694 - RNA, 14 nt, Bordetella pertussis
gacgccgugguggu

SEQ ID NO: 386695 - RNA, 18 nt, Bordetella pertussis
gacggacuggcuggucag

SEQ ID NO: 386696 - RNA, 19 nt, Bordetella pertussis
gacggacuggugcaacucc

SEQ ID NO: 386697 - RNA, 18 nt, Bordetella pertussis
gacggcauggcggccagc

SEQ ID NO: 386698 - RNA, 19 nt, Bordetella pertussis
gacggccaagacgcgggga

SEQ ID NO: 386699 - RNA, 23 nt, Bordetella pertussis
gacggcccagcucugguccaggc

SEQ ID NO: 386700 - RNA, 19 nt, Bordetella pertussis
gacggccccagcgccgcga

SEQ ID NO: 386701 - RNA, 19 nt, Bordetella pertussis
gacggccgccgacgccgcc

SEQ ID NO: 386702 - RNA, 17 nt, Bordetella pertussis
gacggccucggccagga

SEQ ID NO: 386703 - RNA, 20 nt, Bordetella pertussis
gacggcgccgauccggcgca

SEQ ID NO: 386704 - RNA, 14 nt, Bordetella pertussis
gacggcgccguccg

SEQ ID NO: 386705 - RNA, 16 nt, Bordetella pertussis
gacggcgccgugcugg

SEQ ID NO: 386706 - RNA, 19 nt, Bordetella pertussis
gacggcgccgugcuggagg

SEQ ID NO: 386707 - RNA, 14 nt, Bordetella pertussis
gacggcgcgcccgc

SEQ ID NO: 386708 - RNA, 21 nt, Bordetella pertussis
gacggcgcucuugguggugcc

SEQ ID NO: 386709 - RNA, 13 nt, Bordetella pertussis
gacggcgggcgcc

SEQ ID NO: 386710 - RNA, 13 nt, Bordetella pertussis
gacggcggcugga

SEQ ID NO: 386711 - RNA, 15 nt, Bordetella pertussis
gacggcgucgggcag

SEQ ID NO: 386712 - RNA, 21 nt, Bordetella pertussis
gacgguaucugucccggcggg

SEQ ID NO: 386713 - RNA, 17 nt, Bordetella pertussis
gacggucaggggcaggc

SEQ ID NO: 386714 - RNA, 16 nt, Bordetella pertussis
gacggugccggccagc

SEQ ID NO: 386715 - RNA, 18 nt, Bordetella pertussis
gacguaccaagccugcuu

SEQ ID NO: 386716 - RNA, 15 nt, Bordetella pertussis
gacguacuugaucug

SEQ ID NO: 386717 - RNA, 19 nt, Bordetella pertussis
gacguagccgcugccguug

SEQ ID NO: 386718 - RNA, 15 nt, Bordetella pertussis
gacguagucggcgcc

SEQ ID NO: 386719 - RNA, 12 nt, Bordetella pertussis
gacguggcuggu

SEQ ID NO: 386720 - RNA, 19 nt, Bordetella pertussis
gacuauggccuggaugugc

SEQ ID NO: 386721 - RNA, 15 nt, Bordetella pertussis
gagaggaucaccgca

SEQ ID NO: 386722 - RNA, 22 nt, Bordetella pertussis
gagaggcugaaggggcuccccu

SEQ ID NO: 386723 - RNA, 14 nt, Bordetella pertussis
gagauccggccuuc

SEQ ID NO: 386724 - RNA, 14 nt, Bordetella pertussis
gagcaagcgcugga

SEQ ID NO: 386725 - RNA, 15 nt, Bordetella pertussis
gagcaagggccagac

SEQ ID NO: 386726 - RNA, 17 nt, Bordetella pertussis
gagcaaucaagggccuu

SEQ ID NO: 386727 - RNA, 23 nt, Bordetella pertussis
gagcaaucaagggccuuuuucuu

SEQ ID NO: 386728 - RNA, 16 nt, Bordetella pertussis
gagcaauccgaggccc

SEQ ID NO: 386729 - RNA, 21 nt, Bordetella pertussis
gagcagaugcgacuggcggcu

SEQ ID NO: 386730 - RNA, 11 nt, Bordetella pertussis
gagcagcagcg

SEQ ID NO: 386731 - RNA, 17 nt, Bordetella pertussis
gagcagcaugugcucgg

SEQ ID NO: 386732 - RNA, 22 nt, Bordetella pertussis
gagcagcaugugcucgggacgc

SEQ ID NO: 386733 - RNA, 22 nt, Bordetella pertussis
gagcagcucacuuguaaugaga

SEQ ID NO: 386734 - RNA, 12 nt, Bordetella pertussis
gagcaggccgcc

SEQ ID NO: 386735 - RNA, 16 nt, Bordetella pertussis
gagcaggccgcccagc

SEQ ID NO: 386736 - RNA, 13 nt, Bordetella pertussis
gagcaggccgccg

SEQ ID NO: 386737 - RNA, 14 nt, Bordetella pertussis
gagcaggccgccgg

SEQ ID NO: 386738 - RNA, 20 nt, Bordetella pertussis
gagcaggccgccggggaggc

SEQ ID NO: 386739 - RNA, 13 nt, Bordetella pertussis
gagcaggccgggu

SEQ ID NO: 386740 - RNA, 21 nt, Bordetella pertussis
gagcauugccgcggcaaaugg

SEQ ID NO: 386741 - RNA, 22 nt, Bordetella pertussis
gagccgaaguacacggccagca

SEQ ID NO: 386742 - RNA, 17 nt, Bordetella pertussis
gagccgcagaacagcag

SEQ ID NO: 386743 - RNA, 17 nt, Bordetella pertussis
gagccgcagguccaggc

SEQ ID NO: 386744 - RNA, 21 nt, Bordetella pertussis
gagccgcagguccaggccugg

SEQ ID NO: 386745 - RNA, 19 nt, Bordetella pertussis
gagccgccccggcgcggcg

SEQ ID NO: 386746 - RNA, 14 nt, Bordetella pertussis
gagccugggcgcgc

SEQ ID NO: 386747 - RNA, 19 nt, Bordetella pertussis
gagccugucccgacgggga

SEQ ID NO: 386748 - RNA, 23 nt, Bordetella pertussis
gagccugucccgacggggacagg

SEQ ID NO: 386749 - RNA, 16 nt, Bordetella pertussis
gagcgcaagcaccgcc

SEQ ID NO: 386750 - RNA, 14 nt, Bordetella pertussis
gagcgcacaggcgg

SEQ ID NO: 386751 - RNA, 17 nt, Bordetella pertussis
gagcgcacaggcggcgc

SEQ ID NO: 386752 - RNA, 23 nt, Bordetella pertussis
gagcgcaccauggcgcccacggc

SEQ ID NO: 386753 - RNA, 22 nt, Bordetella pertussis
gagcgcagccgcuccagccacc

SEQ ID NO: 386754 - RNA, 19 nt, Bordetella pertussis
gagcgccacgccagcggcg

SEQ ID NO: 386755 - RNA, 15 nt, Bordetella pertussis
gagcgccgacgggcc

SEQ ID NO: 386756 - RNA, 17 nt, Bordetella pertussis
gagcgccgccaggccgu

SEQ ID NO: 386757 - RNA, 19 nt, Bordetella pertussis
gagcgccgccaggccgucg

SEQ ID NO: 386758 - RNA, 22 nt, Bordetella pertussis
gagcgccgggcgccgcgcccca

SEQ ID NO: 386759 - RNA, 15 nt, Bordetella pertussis
gagcgccggggcgug

SEQ ID NO: 386760 - RNA, 14 nt, Bordetella pertussis
gagcgccggggugg

SEQ ID NO: 386761 - RNA, 19 nt, Bordetella pertussis
gagcgcgaaauccagcgcg

SEQ ID NO: 386762 - RNA, 21 nt, Bordetella pertussis
gagcgcgaaauccagcgcgcc

SEQ ID NO: 386763 - RNA, 13 nt, Bordetella pertussis
gagcgcgccagca

SEQ ID NO: 386764 - RNA, 14 nt, Bordetella pertussis
gagcgcgccagcac

SEQ ID NO: 386765 - RNA, 22 nt, Bordetella pertussis
gagcgcgccgccguaggacagc

SEQ ID NO: 386766 - RNA, 12 nt, Bordetella pertussis
gagcgcggccuc

SEQ ID NO: 386767 - RNA, 13 nt, Bordetella pertussis
gagcgcggccucg

SEQ ID NO: 386768 - RNA, 15 nt, Bordetella pertussis
gagcgcggcgcuggc

SEQ ID NO: 386769 - RNA, 12 nt, Bordetella pertussis
gagcgcggcggc

SEQ ID NO: 386770 - RNA, 13 nt, Bordetella pertussis
gagcggcagcagc

SEQ ID NO: 386771 - RNA, 16 nt, Bordetella pertussis
gagcggccagccugcc

SEQ ID NO: 386772 - RNA, 19 nt, Bordetella pertussis
gagcggccuggccccgcgc

SEQ ID NO: 386773 - RNA, 20 nt, Bordetella pertussis
gagcggcguggcgccgaccc

SEQ ID NO: 386774 - RNA, 23 nt, Bordetella pertussis
gagcggcgugugauagcacugca

SEQ ID NO: 386775 - RNA, 18 nt, Bordetella pertussis
gagcgggccagcgcggcc

SEQ ID NO: 386776 - RNA, 17 nt, Bordetella pertussis
gagcgguugaaauccuu

SEQ ID NO: 386777 - RNA, 17 nt, Bordetella pertussis
gagcuccucgagcgugg

SEQ ID NO: 386778 - RNA, 18 nt, Bordetella pertussis
gagcucgggugggccggc

SEQ ID NO: 386779 - RNA, 19 nt, Bordetella pertussis
gagcucgggugggccggcu

SEQ ID NO: 386780 - RNA, 12 nt, Bordetella pertussis
gagcucgucccc

SEQ ID NO: 386781 - RNA, 20 nt, Bordetella pertussis
gagcucguguagggccuggc

SEQ ID NO: 386782 - RNA, 21 nt, Bordetella pertussis
gagcugagcaccagcagcccc

SEQ ID NO: 386783 - RNA, 16 nt, Bordetella pertussis
gagcugaugcucgccc

SEQ ID NO: 386784 - RNA, 15 nt, Bordetella pertussis
gagcugcacaagguc

SEQ ID NO: 386785 - RNA, 13 nt, Bordetella pertussis
gagcugccaggcu

SEQ ID NO: 386786 - RNA, 16 nt, Bordetella pertussis
gagcugcagcccggcc

SEQ ID NO: 386787 - RNA, 17 nt, Bordetella pertussis
gaggaaccagccgucgg

SEQ ID NO: 386788 - RNA, 14 nt, Bordetella pertussis
gaggagccggcggg

SEQ ID NO: 386789 - RNA, 21 nt, Bordetella pertussis
gaggagcugcugugcgccggg

SEQ ID NO: 386790 - RNA, 16 nt, Bordetella pertussis
gaggaggugcgccgcu

SEQ ID NO: 386791 - RNA, 16 nt, Bordetella pertussis
gaggcauuggcggcgg

SEQ ID NO: 386792 - RNA, 17 nt, Bordetella pertussis
gaggcauuggcggcggc

SEQ ID NO: 386793 - RNA, 14 nt, Bordetella pertussis
gaggccagcacgcc

SEQ ID NO: 386794 - RNA, 21 nt, Bordetella pertussis
gaggccagcacgccggccagg

SEQ ID NO: 386795 - RNA, 11 nt, Bordetella pertussis
gaggccaggcu

SEQ ID NO: 386796 - RNA, 14 nt, Bordetella pertussis
gaggccagguuggg

SEQ ID NO: 386797 - RNA, 16 nt, Bordetella pertussis
gaggcccagccgcucg

SEQ ID NO: 386798 - RNA, 21 nt, Bordetella pertussis
gaggccccuguccucgcagga

SEQ ID NO: 386799 - RNA, 14 nt, Bordetella pertussis
gaggcccguuuugu

SEQ ID NO: 386800 - RNA, 16 nt, Bordetella pertussis
gaggcccguuuuguuu

SEQ ID NO: 386801 - RNA, 18 nt, Bordetella pertussis
gaggccgaguagcggcgc

SEQ ID NO: 386802 - RNA, 19 nt, Bordetella pertussis
gaggccgaguagcggcgca

SEQ ID NO: 386803 - RNA, 20 nt, Bordetella pertussis
gaggccgaucucacgggcga

SEQ ID NO: 386804 - RNA, 23 nt, Bordetella pertussis
gaggccgcgcgccucgaugaugg

SEQ ID NO: 386805 - RNA, 17 nt, Bordetella pertussis
gaggccucgugcugcug

SEQ ID NO: 386806 - RNA, 15 nt, Bordetella pertussis
gaggcgaacaggcac

SEQ ID NO: 386807 - RNA, 18 nt, Bordetella pertussis
gaggcgacgguggcuggg

SEQ ID NO: 386808 - RNA, 17 nt, Bordetella pertussis
gaggcgcgcagcacgcc

SEQ ID NO: 386809 - RNA, 18 nt, Bordetella pertussis
gaggcgcggcucgccggc

SEQ ID NO: 386810 - RNA, 23 nt, Bordetella pertussis
gaggcgcggcucgccggccgcgc

SEQ ID NO: 386811 - RNA, 22 nt, Bordetella pertussis
gaggcgcucggccuugccguug

SEQ ID NO: 386812 - RNA, 16 nt, Bordetella pertussis
gaggcgcuggccggcg

SEQ ID NO: 386813 - RNA, 23 nt, Bordetella pertussis
gaggcgcuggcguccagccugcc

SEQ ID NO: 386814 - RNA, 13 nt, Bordetella pertussis
gaggcgggcagca

SEQ ID NO: 386815 - RNA, 16 nt, Bordetella pertussis
gaggcggggcuggcgc

SEQ ID NO: 386816 - RNA, 13 nt, Bordetella pertussis
gaggggccagccu

SEQ ID NO: 386817 - RNA, 15 nt, Bordetella pertussis
gaggggccagccugg

SEQ ID NO: 386818 - RNA, 13 nt, Bordetella pertussis
gaggggcgcaggc

SEQ ID NO: 386819 - RNA, 15 nt, Bordetella pertussis
gagggucuggcggcc

SEQ ID NO: 386820 - RNA, 22 nt, Bordetella pertussis
gagggugaccaugucgccguug

SEQ ID NO: 386821 - RNA, 22 nt, Bordetella pertussis
gagguaccacaguucggccagc

SEQ ID NO: 386822 - RNA, 19 nt, Bordetella pertussis
gagguacucgggggcgggc

SEQ ID NO: 386823 - RNA, 21 nt, Bordetella pertussis
gagucgaccaguucggccagc

SEQ ID NO: 386824 - RNA, 17 nt, Bordetella pertussis
gagucgccccgacgcgc

SEQ ID NO: 386825 - RNA, 18 nt, Bordetella pertussis
gagucgcuccccgugcgg

SEQ ID NO: 386826 - RNA, 21 nt, Bordetella pertussis
gagucgcuccccgugcgggga

SEQ ID NO: 386827 - RNA, 14 nt, Bordetella pertussis
gagugcaggcccga

SEQ ID NO: 386828 - RNA, 16 nt, Bordetella pertussis
gaguggccgcuguucg

SEQ ID NO: 386829 - RNA, 21 nt, Bordetella pertussis
gaguucgucgucgccaccgcc

SEQ ID NO: 386830 - RNA, 15 nt, Bordetella pertussis
gaguucuggcaucag

SEQ ID NO: 386831 - RNA, 23 nt, Bordetella pertussis
gauacgccgggcgcguggcccgc

SEQ ID NO: 386832 - RNA, 18 nt, Bordetella pertussis
gauacgcgccgccuggcc

SEQ ID NO: 386833 - RNA, 17 nt, Bordetella pertussis
gauacgcgugcgcggcc

SEQ ID NO: 386834 - RNA, 20 nt, Bordetella pertussis
gauacugcgcaugggcgcag

SEQ ID NO: 386835 - RNA, 15 nt, Bordetella pertussis
gauaguccagcaccg

SEQ ID NO: 386836 - RNA, 16 nt, Bordetella pertussis
gauauagaccagcagc

SEQ ID NO: 386837 - RNA, 14 nt, Bordetella pertussis
gauauggccggcgc

SEQ ID NO: 386838 - RNA, 18 nt, Bordetella pertussis
gauaugggcgagcaggcc

SEQ ID NO: 386839 - RNA, 13 nt, Bordetella pertussis
gauaugggcggcc

SEQ ID NO: 386840 - RNA, 15 nt, Bordetella pertussis
gauaugggcggccuc

SEQ ID NO: 386841 - RNA, 19 nt, Bordetella pertussis
gaucaacgugcgccaggca

SEQ ID NO: 386842 - RNA, 20 nt, Bordetella pertussis
gaucaacgugcgccaggcaa

SEQ ID NO: 386843 - RNA, 15 nt, Bordetella pertussis
gaucaagagccugga

SEQ ID NO: 386844 - RNA, 14 nt, Bordetella pertussis
gaucaaggcccgga

SEQ ID NO: 386845 - RNA, 18 nt, Bordetella pertussis
gaucacauggaaauccuu

SEQ ID NO: 386846 - RNA, 18 nt, Bordetella pertussis
gaucaccacgcccgcgcc

SEQ ID NO: 386847 - RNA, 12 nt, Bordetella pertussis
gaucaccacggg

SEQ ID NO: 386848 - RNA, 12 nt, Bordetella pertussis
gaucacccagcg

SEQ ID NO: 386849 - RNA, 20 nt, Bordetella pertussis
gaucaccguuuggccugccc

SEQ ID NO: 386850 - RNA, 18 nt, Bordetella pertussis
gaucagcaccacggcggc

SEQ ID NO: 386851 - RNA, 20 nt, Bordetella pertussis
gaucagcaccgcgaccaugc

SEQ ID NO: 386852 - RNA, 18 nt, Bordetella pertussis
gaucagcaggcccaccag

SEQ ID NO: 386853 - RNA, 12 nt, Bordetella pertussis
gaucagccaccg

SEQ ID NO: 386854 - RNA, 19 nt, Bordetella pertussis
gaucagcgaaugcgacagc

SEQ ID NO: 386855 - RNA, 22 nt, Bordetella pertussis
gaucagcgcgccgucgggggcc

SEQ ID NO: 386856 - RNA, 13 nt, Bordetella pertussis
gaucagcggcggc

SEQ ID NO: 386857 - RNA, 18 nt, Bordetella pertussis
gaucagcgggcuggccag

SEQ ID NO: 386858 - RNA, 20 nt, Bordetella pertussis
gaucagcgggcuggccagcg

SEQ ID NO: 386859 - RNA, 14 nt, Bordetella pertussis
gaucagcugcggcc

SEQ ID NO: 386860 - RNA, 19 nt, Bordetella pertussis
gaucaggaugggcgcggcg

SEQ ID NO: 386861 - RNA, 16 nt, Bordetella pertussis
gaucaggcccuggggc

SEQ ID NO: 386862 - RNA, 13 nt, Bordetella pertussis
gaucaggccggcg

SEQ ID NO: 386863 - RNA, 16 nt, Bordetella pertussis
gaucagggccacggcg

SEQ ID NO: 386864 - RNA, 17 nt, Bordetella pertussis
gaucagggccgccaggg

SEQ ID NO: 386865 - RNA, 20 nt, Bordetella pertussis
gaucagggccgugcccgagg

SEQ ID NO: 386866 - RNA, 15 nt, Bordetella pertussis
gaucagggugggcac

SEQ ID NO: 386867 - RNA, 18 nt, Bordetella pertussis
gaucaguaucucggcgcc

SEQ ID NO: 386868 - RNA, 17 nt, Bordetella pertussis
gaucaucgagcaccgcc

SEQ ID NO: 386869 - RNA, 20 nt, Bordetella pertussis
gaucaugccgcugaccagca

SEQ ID NO: 386870 - RNA, 23 nt, Bordetella pertussis
gaucauggcgccgauggcgccgc

SEQ ID NO: 386871 - RNA, 16 nt, Bordetella pertussis
gaucaugggccugccc

SEQ ID NO: 386872 - RNA, 20 nt, Bordetella pertussis
gauccacagucggucgccgc

SEQ ID NO: 386873 - RNA, 16 nt, Bordetella pertussis
gauccacgcccgcgcc

SEQ ID NO: 386874 - RNA, 18 nt, Bordetella pertussis
gauccacgcccgcgccga

SEQ ID NO: 386875 - RNA, 14 nt, Bordetella pertussis
gauccauguggcca

SEQ ID NO: 386876 - RNA, 19 nt, Bordetella pertussis
gauccgaugaugcccagga

SEQ ID NO: 386877 - RNA, 15 nt, Bordetella pertussis
gauccgcgccaggcg

SEQ ID NO: 386878 - RNA, 15 nt, Bordetella pertussis
gauccggcagcagca

SEQ ID NO: 386879 - RNA, 19 nt, Bordetella pertussis
gauccgguaugccugccag

SEQ ID NO: 386880 - RNA, 15 nt, Bordetella pertussis
gauccggucgcccgc

SEQ ID NO: 386881 - RNA, 16 nt, Bordetella pertussis
gauccgguugacgauc

SEQ ID NO: 386882 - RNA, 13 nt, Bordetella pertussis
gauccucgccagc

SEQ ID NO: 386883 - RNA, 16 nt, Bordetella pertussis
gauccucgccagcggc

SEQ ID NO: 386884 - RNA, 16 nt, Bordetella pertussis
gauccugcccaccgcc

SEQ ID NO: 386885 - RNA, 19 nt, Bordetella pertussis
aaagcccgcgccaccaccg

SEQ ID NO: 386886 - RNA, 12 nt, Bordetella pertussis
aaagccgcccgg

SEQ ID NO: 386887 - RNA, 22 nt, Bordetella pertussis
gaucgacgcgauguccagcucc

SEQ ID NO: 386888 - RNA, 20 nt, Bordetella pertussis
gaucgagaaguuggcgggcg

SEQ ID NO: 386889 - RNA, 16 nt, Bordetella pertussis
gaucgaucagccagcc

SEQ ID NO: 386890 - RNA, 20 nt, Bordetella pertussis
gaucgaucagccagccggcg

SEQ ID NO: 386891 - RNA, 19 nt, Bordetella pertussis
gaucgcacacaccgcguca

SEQ ID NO: 386892 - RNA, 21 nt, Bordetella pertussis
gaucgcauuucucggccuggg

SEQ ID NO: 386893 - RNA, 12 nt, Bordetella pertussis
gaucgccagcag

SEQ ID NO: 386894 - RNA, 20 nt, Bordetella pertussis
gaucgccagcaggcgcuggu

SEQ ID NO: 386895 - RNA, 23 nt, Bordetella pertussis
gaucgccggcgcccccagcagcg

SEQ ID NO: 386896 - RNA, 16 nt, Bordetella pertussis
gaucgccgggcaggca

SEQ ID NO: 386897 - RNA, 14 nt, Bordetella pertussis
gaucgcgcagcacc

SEQ ID NO: 386898 - RNA, 13 nt, Bordetella pertussis
gaucgcgcgggcu

SEQ ID NO: 386899 - RNA, 23 nt, Bordetella pertussis
gaucgcgucggccaaggccggcg

SEQ ID NO: 386900 - RNA, 22 nt, Bordetella pertussis
gaucggcacgauuuuucgcugu

SEQ ID NO: 386901 - RNA, 17 nt, Bordetella pertussis
gaucggccaggccggcc

SEQ ID NO: 386902 - RNA, 22 nt, Bordetella pertussis
gaucggggccaagauccagcuu

SEQ ID NO: 386903 - RNA, 13 nt, Bordetella pertussis
gaucgucagcagc

SEQ ID NO: 386904 - RNA, 12 nt, Bordetella pertussis
gaucgucccagg

SEQ ID NO: 386905 - RNA, 19 nt, Bordetella pertussis
gaucgucgacguccuggug

SEQ ID NO: 386906 - RNA, 23 nt, Bordetella pertussis
gaucguucccuacccgccgggcg

SEQ ID NO: 386907 - RNA, 17 nt, Bordetella pertussis
gaucuacgacgccugga

SEQ ID NO: 386908 - RNA, 22 nt, Bordetella pertussis
gaucuaggccguuuccucugga

SEQ ID NO: 386909 - RNA, 13 nt, Bordetella pertussis
gaucucacgggcg

SEQ ID NO: 386910 - RNA, 22 nt, Bordetella pertussis
gaucucagccaucaucaucguc

SEQ ID NO: 386911 - RNA, 16 nt, Bordetella pertussis
gaucuccgggagccug

SEQ ID NO: 386912 - RNA, 17 nt, Bordetella pertussis
gaucuccgggagccugu

SEQ ID NO: 386913 - RNA, 22 nt, Bordetella pertussis
gaucuccgggagccuguccccg

SEQ ID NO: 386914 - RNA, 22 nt, Bordetella pertussis
gaucuccgcccaggugcgggag

SEQ ID NO: 386915 - RNA, 14 nt, Bordetella pertussis
gaucucgcccugcu

SEQ ID NO: 386916 - RNA, 17 nt, Bordetella pertussis
gaucucgcccugcucgc

SEQ ID NO: 386917 - RNA, 22 nt, Bordetella pertussis
gaucucgcccugcucgcgcagc

SEQ ID NO: 386918 - RNA, 15 nt, Bordetella pertussis
gaucucguccugcag

SEQ ID NO: 386919 - RNA, 17 nt, Bordetella pertussis
gaucucgucgaccgccu

SEQ ID NO: 386920 - RNA, 15 nt, Bordetella pertussis
gaucugcgcggcggu

SEQ ID NO: 386921 - RNA, 14 nt, Bordetella pertussis
gaucugcuuccagu

SEQ ID NO: 386922 - RNA, 15 nt, Bordetella pertussis
gaucugcuuccagua

SEQ ID NO: 386923 - RNA, 17 nt, Bordetella pertussis
gaucuggcaaucggggu

SEQ ID NO: 386924 - RNA, 17 nt, Bordetella pertussis
gaucuggccgaccagcg

SEQ ID NO: 386925 - RNA, 14 nt, Bordetella pertussis
gaucuggccgucga

SEQ ID NO: 386926 - RNA, 14 nt, Bordetella pertussis
gaucuggcgcguca

SEQ ID NO: 386927 - RNA, 14 nt, Bordetella pertussis
gaucugggccucgg

SEQ ID NO: 386928 - RNA, 15 nt, Bordetella pertussis
gaucuggugaaacag

SEQ ID NO: 386929 - RNA, 13 nt, Bordetella pertussis
gaucugguuggcc

SEQ ID NO: 386930 - RNA, 23 nt, Bordetella pertussis
gaucuugaugcggccguugcucc

SEQ ID NO: 386931 - RNA, 17 nt, Bordetella pertussis
gaucuugauccaggaau

SEQ ID NO: 386932 - RNA, 11 nt, Bordetella pertussis
gaucuuggccu

SEQ ID NO: 386933 - RNA, 19 nt, Bordetella pertussis
gaucuugugcaucucgaag

SEQ ID NO: 386934 - RNA, 17 nt, Bordetella pertussis
gaugaaauauugggcug

SEQ ID NO: 386935 - RNA, 14 nt, Bordetella pertussis
gaugaacagcgaga

SEQ ID NO: 386936 - RNA, 14 nt, Bordetella pertussis
gaugaacagcggca

SEQ ID NO: 386937 - RNA, 20 nt, Bordetella pertussis
gaugaacaucggcagcgagg

SEQ ID NO: 386938 - RNA, 21 nt, Bordetella pertussis
gaugaacaucggcagcgaggc

SEQ ID NO: 386939 - RNA, 22 nt, Bordetella pertussis
gaugaacaucggcagcgaggcg

SEQ ID NO: 386940 - RNA, 14 nt, Bordetella pertussis
gaugaacgacaggg

SEQ ID NO: 386941 - RNA, 16 nt, Bordetella pertussis
gaugaacgaccagcac

SEQ ID NO: 386942 - RNA, 20 nt, Bordetella pertussis
gaugaacgacccggucgugu

SEQ ID NO: 386943 - RNA, 20 nt, Bordetella pertussis
gaugaacgcgcgcaacaggu

SEQ ID NO: 386944 - RNA, 19 nt, Bordetella pertussis
gaugaagcccgagcggcgc

SEQ ID NO: 386945 - RNA, 20 nt, Bordetella pertussis
gaugaagcccgagcggcgcc

SEQ ID NO: 386946 - RNA, 18 nt, Bordetella pertussis
gaugaccagccagccgcc

SEQ ID NO: 386947 - RNA, 13 nt, Bordetella pertussis
gaugaccagcgcc

SEQ ID NO: 386948 - RNA, 15 nt, Bordetella pertussis
gaugaccagggcgcc

SEQ ID NO: 386949 - RNA, 16 nt, Bordetella pertussis
gaugaccagggcgccg

SEQ ID NO: 386950 - RNA, 18 nt, Bordetella pertussis
gaugaccggccaggcgcg

SEQ ID NO: 386951 - RNA, 20 nt, Bordetella pertussis
gaugaccucgcgcugcagca

SEQ ID NO: 386952 - RNA, 14 nt, Bordetella pertussis
gaugaccugggccu

SEQ ID NO: 386953 - RNA, 17 nt, Bordetella pertussis
gaugagaucgcccgcgu

SEQ ID NO: 386954 - RNA, 23 nt, Bordetella pertussis
gaugagaucgcccgcgugcgugc

SEQ ID NO: 386955 - RNA, 18 nt, Bordetella pertussis
gaugagcaugauuuccug

SEQ ID NO: 386956 - RNA, 20 nt, Bordetella pertussis
gaugagcuacccccugaccg

SEQ ID NO: 386957 - RNA, 14 nt, Bordetella pertussis
gaugaugcagcaca

SEQ ID NO: 386958 - RNA, 16 nt, Bordetella pertussis
gaugaugcccaggauc

SEQ ID NO: 386959 - RNA, 20 nt, Bordetella pertussis
gaugaugcgguugaucaggg

SEQ ID NO: 386960 - RNA, 14 nt, Bordetella pertussis
gaugauggccaggu

SEQ ID NO: 386961 - RNA, 15 nt, Bordetella pertussis
gaugauggccagguc

SEQ ID NO: 386962 - RNA, 15 nt, Bordetella pertussis
gaugauucauagccc

SEQ ID NO: 386963 - RNA, 22 nt, Bordetella pertussis
gaugcacagguagaucagccgc

SEQ ID NO: 386964 - RNA, 16 nt, Bordetella pertussis
gaugcacccaggcgcc

SEQ ID NO: 386965 - RNA, 15 nt, Bordetella pertussis
gaugcaccggccagu

SEQ ID NO: 386966 - RNA, 18 nt, Bordetella pertussis
gaugcacguagcgcagca

SEQ ID NO: 386967 - RNA, 12 nt, Bordetella pertussis
gaugcagcagcg

SEQ ID NO: 386968 - RNA, 15 nt, Bordetella pertussis
gaugcaggccugcac

SEQ ID NO: 386969 - RNA, 21 nt, Bordetella pertussis
gaugcaggcggucgaggcgca

SEQ ID NO: 386970 - RNA, 19 nt, Bordetella pertussis
gaugcaggucggggcgcuc

SEQ ID NO: 386971 - RNA, 15 nt, Bordetella pertussis
gaugcaugaaccgca

SEQ ID NO: 386972 - RNA, 18 nt, Bordetella pertussis
gaugcaugaaccgcagcg

SEQ ID NO: 386973 - RNA, 20 nt, Bordetella pertussis
gaugcaugaaccgcagcgcc

SEQ ID NO: 386974 - RNA, 13 nt, Bordetella pertussis
gaugccagcggcg

SEQ ID NO: 386975 - RNA, 17 nt, Bordetella pertussis
gaugcccaccagccgcc

SEQ ID NO: 386976 - RNA, 12 nt, Bordetella pertussis
gaugcccgcgca

SEQ ID NO: 386977 - RNA, 15 nt, Bordetella pertussis
gaugcccgcgggcau

SEQ ID NO: 386978 - RNA, 22 nt, Bordetella pertussis
gaugcccucgcgcacggugcgc

SEQ ID NO: 386979 - RNA, 21 nt, Bordetella pertussis
gaugcccugcgccagcgccuc

SEQ ID NO: 386980 - RNA, 15 nt, Bordetella pertussis
gaugccgaccaggcc

SEQ ID NO: 386981 - RNA, 15 nt, Bordetella pertussis
gaugccgaccaggcu

SEQ ID NO: 386982 - RNA, 23 nt, Bordetella pertussis
gaugccgaccgaagaggagcugc

SEQ ID NO: 386983 - RNA, 15 nt, Bordetella pertussis
gaugccgcccacgcc

SEQ ID NO: 386984 - RNA, 14 nt, Bordetella pertussis
gaugccgcccagca

SEQ ID NO: 386985 - RNA, 16 nt, Bordetella pertussis
gaugccgccaucaucc

SEQ ID NO: 386986 - RNA, 15 nt, Bordetella pertussis
gaugccgccaugcgc

SEQ ID NO: 386987 - RNA, 22 nt, Bordetella pertussis
gaugccgcccgugcagaagcug

SEQ ID NO: 386988 - RNA, 18 nt, Bordetella pertussis
gaugccgccggcgggcaa

SEQ ID NO: 386989 - RNA, 15 nt, Bordetella pertussis
gaugccggccagcag

SEQ ID NO: 386990 - RNA, 19 nt, Bordetella pertussis
gaugccggucuccagcgcg

SEQ ID NO: 386991 - RNA, 20 nt, Bordetella pertussis
gaugccgucgaaggccgcaa

SEQ ID NO: 386992 - RNA, 22 nt, Bordetella pertussis
gaugccgucgagcgcggccagg

SEQ ID NO: 386993 - RNA, 23 nt, Bordetella pertussis
gaugcgacuggcggcugcgggcg

SEQ ID NO: 386994 - RNA, 23 nt, Bordetella pertussis
gaugcgagcaaaggacacgcgcg

SEQ ID NO: 386995 - RNA, 20 nt, Bordetella pertussis
gaugcgcaccaugcgcagca

SEQ ID NO: 386996 - RNA, 22 nt, Bordetella pertussis
gaugcgcaugggaaauccgccg

SEQ ID NO: 386997 - RNA, 13 nt, Bordetella pertussis
gaugcgccaggcc

SEQ ID NO: 386998 - RNA, 19 nt, Bordetella pertussis
gaugcgccaguccagcgcg

SEQ ID NO: 386999 - RNA, 14 nt, Bordetella pertussis
gaugcgccgcacca

SEQ ID NO: 387000 - RNA, 13 nt, Bordetella pertussis
gaugcgccgcccc

SEQ ID NO: 387001 - RNA, 14 nt, Bordetella pertussis
gaugcgccggccug

SEQ ID NO: 387002 - RNA, 16 nt, Bordetella pertussis
gaugcgccggccuggc

SEQ ID NO: 387003 - RNA, 20 nt, Bordetella pertussis
gaugcgccggccuggcgcga

SEQ ID NO: 387004 - RNA, 22 nt, Bordetella pertussis
gaugcgcgcgcgggccagcaga

SEQ ID NO: 387005 - RNA, 19 nt, Bordetella pertussis
gaugcgcgcggccagcgcg

SEQ ID NO: 387006 - RNA, 16 nt, Bordetella pertussis
gaugcgcgcggccaug

SEQ ID NO: 387007 - RNA, 18 nt, Bordetella pertussis
gaugcgcggggccaggcg

SEQ ID NO: 387008 - RNA, 14 nt, Bordetella pertussis
gaugcgggccugga

SEQ ID NO: 387009 - RNA, 18 nt, Bordetella pertussis
gaugcgguaggcccagca

SEQ ID NO: 387010 - RNA, 16 nt, Bordetella pertussis
gaugcggucggccgcg

SEQ ID NO: 387011 - RNA, 11 nt, Bordetella pertussis
gaugcgguggg

SEQ ID NO: 387012 - RNA, 13 nt, Bordetella pertussis
gaugcgucagggg

SEQ ID NO: 387013 - RNA, 16 nt, Bordetella pertussis
gaugcugcagggccug

SEQ ID NO: 387014 - RNA, 14 nt, Bordetella pertussis
gaugcuggucagcc

SEQ ID NO: 387015 - RNA, 13 nt, Bordetella pertussis
gaugcuggcggca

SEQ ID NO: 387016 - RNA, 14 nt, Bordetella pertussis
gauggaggccagga

SEQ ID NO: 387017 - RNA, 21 nt, Bordetella pertussis
gauggaugccgucggccugga

SEQ ID NO: 387018 - RNA, 19 nt, Bordetella pertussis
gauggccacgaccaccagc

SEQ ID NO: 387019 - RNA, 14 nt, Bordetella pertussis
gauggccauggcca

SEQ ID NO: 387020 - RNA, 19 nt, Bordetella pertussis
gauggcccgcagguggggc

SEQ ID NO: 387021 - RNA, 23 nt, Bordetella pertussis
gauggcccgcagguggggcagca

SEQ ID NO: 387022 - RNA, 17 nt, Bordetella pertussis
gauggcccgguuggggu

SEQ ID NO: 387023 - RNA, 20 nt, Bordetella pertussis
gauggccgaaugcccgcccu

SEQ ID NO: 387024 - RNA, 23 nt, Bordetella pertussis
gauggccggaucguagugcgugg

SEQ ID NO: 387025 - RNA, 15 nt, Bordetella pertussis
gauggccggccugcc

SEQ ID NO: 387026 - RNA, 21 nt, Bordetella pertussis
gauggccgggagcggccagca

SEQ ID NO: 387027 - RNA, 22 nt, Bordetella pertussis
gauggccuuggaguagccgcuc

SEQ ID NO: 387028 - RNA, 19 nt, Bordetella pertussis
gauggcgauguaggccagg

SEQ ID NO: 387029 - RNA, 21 nt, Bordetella pertussis
gauggcgauguccagcgagcg

SEQ ID NO: 387030 - RNA, 20 nt, Bordetella pertussis
gauggcgaucuucugggcgg

SEQ ID NO: 387031 - RNA, 17 nt, Bordetella pertussis
gauggcgccagcccgcc

SEQ ID NO: 387032 - RNA, 21 nt, Bordetella pertussis
gauggcgccggccagcgcgcc

SEQ ID NO: 387033 - RNA, 13 nt, Bordetella pertussis
gauggcgccuucg

SEQ ID NO: 387034 - RNA, 18 nt, Bordetella pertussis
gauggcgcgcggcugggg

SEQ ID NO: 387035 - RNA, 15 nt, Bordetella pertussis
gauggcguacagcag

SEQ ID NO: 387036 - RNA, 23 nt, Bordetella pertussis
gauggcguacagcagggugccug

SEQ ID NO: 387037 - RNA, 17 nt, Bordetella pertussis
gauggcguccagcagca

SEQ ID NO: 387038 - RNA, 18 nt, Bordetella pertussis
gauggcguccagcagcag

SEQ ID NO: 387039 - RNA, 15 nt, Bordetella pertussis
gauggcggugguggg

SEQ ID NO: 387040 - RNA, 16 nt, Bordetella pertussis
gauggcgucugcccgu

SEQ ID NO: 387041 - RNA, 19 nt, Bordetella pertussis
gauggcuucgcgcacaucc

SEQ ID NO: 387042 - RNA, 14 nt, Bordetella pertussis
gauggcuuuggcga

SEQ ID NO: 387043 - RNA, 23 nt, Bordetella pertussis
gaugggauacgccgugcuguacc

SEQ ID NO: 387044 - RNA, 19 nt, Bordetella pertussis
gaugggcagcucgccuucg

SEQ ID NO: 387045 - RNA, 13 nt, Bordetella pertussis
gaugggcaggccc

SEQ ID NO: 387046 - RNA, 22 nt, Bordetella pertussis
gaugggcccgggcaggcucagc

SEQ ID NO: 387047 - RNA, 13 nt, Bordetella pertussis
gaugggcggccua

SEQ ID NO: 387048 - RNA, 13 nt, Bordetella pertussis
gauggggccgucg

SEQ ID NO: 387049 - RNA, 17 nt, Bordetella pertussis
gauggguacagcgcgcc

SEQ ID NO: 387050 - RNA, 20 nt, Bordetella pertussis
gauggguacagcgcgcccga

SEQ ID NO: 387051 - RNA, 19 nt, Bordetella pertussis
gauggguacgccggccuga

SEQ ID NO: 387052 - RNA, 16 nt, Bordetella pertussis
gaugguaucggccggg

SEQ ID NO: 387053 - RNA, 13 nt, Bordetella pertussis
gauggucaccacc

SEQ ID NO: 387054 - RNA, 19 nt, Bordetella pertussis
gauggucaccacccgcacg

SEQ ID NO: 387055 - RNA, 22 nt, Bordetella pertussis
gauggucgcggccgaggccagc

SEQ ID NO: 387056 - RNA, 17 nt, Bordetella pertussis
gauggucuugccgccgu

SEQ ID NO: 387057 - RNA, 16 nt, Bordetella pertussis
gaugguggauccgccg

SEQ ID NO: 387058 - RNA, 16 nt, Bordetella pertussis
gauguagcccauguuc

SEQ ID NO: 387059 - RNA, 16 nt, Bordetella pertussis
gauguaggccagguuc

SEQ ID NO: 387060 - RNA, 14 nt, Bordetella pertussis
gauguagggcagcu

SEQ ID NO: 387061 - RNA, 11 nt, Bordetella pertussis
gauguaugacu

SEQ ID NO: 387062 - RNA, 18 nt, Bordetella pertussis
gauguccagcgccagcag

SEQ ID NO: 387063 - RNA, 15 nt, Bordetella pertussis
gauguccauggccug

SEQ ID NO: 387064 - RNA, 14 nt, Bordetella pertussis
gauguccugcaggc

SEQ ID NO: 387065 - RNA, 16 nt, Bordetella pertussis
gauguccugcaggccc

SEQ ID NO: 387066 - RNA, 17 nt, Bordetella pertussis
gaugucgaacagcugca

SEQ ID NO: 387067 - RNA, 17 nt, Bordetella pertussis
gaugucgugaucgccag

SEQ ID NO: 387068 - RNA, 20 nt, Bordetella pertussis
gaugucgugaucgccagcgc

SEQ ID NO: 387069 - RNA, 13 nt, Bordetella pertussis
gaugugcagcgca

SEQ ID NO: 387070 - RNA, 16 nt, Bordetella pertussis
gaugugcaugccgucg

SEQ ID NO: 387071 - RNA, 15 nt, Bordetella pertussis
gauguugaacagcug

SEQ ID NO: 387072 - RNA, 20 nt, Bordetella pertussis
gauuccaggacgacaggcau

SEQ ID NO: 387073 - RNA, 22 nt, Bordetella pertussis
gauuccaggacgacaggcaugc

SEQ ID NO: 387074 - RNA, 13 nt, Bordetella pertussis
gauucccagcucc

SEQ ID NO: 387075 - RNA, 12 nt, Bordetella pertussis
gauucccccgca

SEQ ID NO: 387076 - RNA, 22 nt, Bordetella pertussis
gauucccuggcgcgccagcucg

SEQ ID NO: 387077 - RNA, 19 nt, Bordetella pertussis
gauucggagucgugcagga

SEQ ID NO: 387078 - RNA, 14 nt, Bordetella pertussis
gauugaacugcugg

SEQ ID NO: 387079 - RNA, 14 nt, Bordetella pertussis
gauugcgccagcgc

SEQ ID NO: 387080 - RNA, 15 nt, Bordetella pertussis
gauugcgccagcgcu

SEQ ID NO: 387081 - RNA, 19 nt, Bordetella pertussis
gauugcggcccgcggccuu

SEQ ID NO: 387082 - RNA, 22 nt, Bordetella pertussis
gauugcggcccgcggccuuggu

SEQ ID NO: 387083 - RNA, 23 nt, Bordetella pertussis
gauugcggugcccuugcucccag

SEQ ID NO: 387084 - RNA, 13 nt, Bordetella pertussis
gauuggacagcag

SEQ ID NO: 387085 - RNA, 22 nt, Bordetella pertussis
gauuggcgaaaggcaccgagca

SEQ ID NO: 387086 - RNA, 18 nt, Bordetella pertussis
gauuguccugcacgaagc

SEQ ID NO: 387087 - RNA, 15 nt, Bordetella pertussis
gauuucggggcgcga

SEQ ID NO: 387088 - RNA, 22 nt, Bordetella pertussis
gauuucgggugaggggccagcc

SEQ ID NO: 387089 - RNA, 14 nt, Bordetella pertussis
gauuuucaccaucc

SEQ ID NO: 387090 - RNA, 14 nt, Bordetella pertussis
gcaaaaaaagaggc

SEQ ID NO: 387091 - RNA, 19 nt, Bordetella pertussis
gcaaaagcguuccagcaga

SEQ ID NO: 387092 - RNA, 14 nt, Bordetella pertussis
gcaaacaggcugcu

SEQ ID NO: 387093 - RNA, 18 nt, Bordetella pertussis
gcaaaccgacgcggccag

SEQ ID NO: 387094 - RNA, 20 nt, Bordetella pertussis
gcaaaccgacgcggccagcg

SEQ ID NO: 387095 - RNA, 12 nt, Bordetella pertussis
gcaaaccugccg

SEQ ID NO: 387096 - RNA, 16 nt, Bordetella pertussis
gcaaacggcggcaggc

SEQ ID NO: 387097 - RNA, 18 nt, Bordetella pertussis
gcaaacggcggcaggccg

SEQ ID NO: 387098 - RNA, 17 nt, Bordetella pertussis
gcaaacuguccguggcc

SEQ ID NO: 387099 - RNA, 18 nt, Bordetella pertussis
gcaaacuguccguggcca

SEQ ID NO: 387100 - RNA, 12 nt, Bordetella pertussis
gcaaagaucacc

SEQ ID NO: 387101 - RNA, 13 nt, Bordetella pertussis
gcaaagcccagca

SEQ ID NO: 387102 - RNA, 14 nt, Bordetella pertussis
gcaaagcccagcaa

SEQ ID NO: 387103 - RNA, 15 nt, Bordetella pertussis
gcaaagcgcgcgucc

SEQ ID NO: 387104 - RNA, 13 nt, Bordetella pertussis
gcaaagcgcggcu

SEQ ID NO: 387105 - RNA, 15 nt, Bordetella pertussis
gcaaaucaaugaaaa

SEQ ID NO: 387106 - RNA, 22 nt, Bordetella pertussis
gcaacaaaggaaaucgcggcgc

SEQ ID NO: 387107 - RNA, 16 nt, Bordetella pertussis
gcaacacgaccagcag

SEQ ID NO: 387108 - RNA, 17 nt, Bordetella pertussis
gcaacacgaccagcagg

SEQ ID NO: 387109 - RNA, 15 nt, Bordetella pertussis
gcaacagacccgggc

SEQ ID NO: 387110 - RNA, 16 nt, Bordetella pertussis
gcaacagacccgggcc

SEQ ID NO: 387111 - RNA, 16 nt, Bordetella pertussis
gcaacccacccccagc

SEQ ID NO: 387112 - RNA, 20 nt, Bordetella pertussis
gcaacccacccccagcagca

SEQ ID NO: 387113 - RNA, 15 nt, Bordetella pertussis
gcaaccccagcagcg

SEQ ID NO: 387114 - RNA, 17 nt, Bordetella pertussis
gcaaccccagcagcgcc

SEQ ID NO: 387115 - RNA, 18 nt, Bordetella pertussis
gcaacccgcccacgcggc

SEQ ID NO: 387116 - RNA, 13 nt, Bordetella pertussis
gcaacccgcccgg

SEQ ID NO: 387117 - RNA, 17 nt, Bordetella pertussis
gcagcggguugcgcgcc

SEQ ID NO: 387118 - RNA, 18 nt, Bordetella pertussis
gcagcguaucgcccgcgc

SEQ ID NO: 387119 - RNA, 21 nt, Bordetella pertussis
gcagcguaucgcccgcgcggu

SEQ ID NO: 387120 - RNA, 19 nt, Bordetella pertussis
gcagcguuucaccgcugga

SEQ ID NO: 387121 - RNA, 21 nt, Bordetella pertussis
gcagcuccgggucgagcgccg

SEQ ID NO: 387122 - RNA, 21 nt, Bordetella pertussis
gcagcugcuugcccaggccgg

SEQ ID NO: 387123 - RNA, 15 nt, Bordetella pertussis
gcagcuggcgcagca

SEQ ID NO: 387124 - RNA, 16 nt, Bordetella pertussis
gcagcuggcgcgggcg

SEQ ID NO: 387125 - RNA, 21 nt, Bordetella pertussis
gcagcuggcgcgggcggccua

SEQ ID NO: 387126 - RNA, 20 nt, Bordetella pertussis
gcagcuguagcccuggcgcu

SEQ ID NO: 387127 - RNA, 20 nt, Bordetella pertussis
gcagcuguucagacugcugc

SEQ ID NO: 387128 - RNA, 15 nt, Bordetella pertussis
gcagcuucuaucugc

SEQ ID NO: 387129 - RNA, 22 nt, Bordetella pertussis
gcagcuugaccgccuccaggau

SEQ ID NO: 387130 - RNA, 20 nt, Bordetella pertussis
gcagcuugaggguggcauug

SEQ ID NO: 387131 - RNA, 15 nt, Bordetella pertussis
gcagcuugcccgcgc

SEQ ID NO: 387132 - RNA, 20 nt, Bordetella pertussis
gcagcuugccgaccgcuucc

SEQ ID NO: 387133 - RNA, 17 nt, Bordetella pertussis
gcagcuuggcgcgccgg

SEQ ID NO: 387134 - RNA, 18 nt, Bordetella pertussis
gcaggaaggccgccgcgu

SEQ ID NO: 387135 - RNA, 13 nt, Bordetella pertussis
gcaggacaaggcg

SEQ ID NO: 387136 - RNA, 18 nt, Bordetella pertussis
gcaggacaaggcgcgcgc

SEQ ID NO: 387137 - RNA, 20 nt, Bordetella pertussis
gcaggaccgcgccgccgcgc

SEQ ID NO: 387138 - RNA, 13 nt, Bordetella pertussis
gcaggagcccgcu

SEQ ID NO: 387139 - RNA, 17 nt, Bordetella pertussis
gcaggagccuguccccg

SEQ ID NO: 387140 - RNA, 20 nt, Bordetella pertussis
gcaggauaccggagcggcuc

SEQ ID NO: 387141 - RNA, 20 nt, Bordetella pertussis
gcaggaucgcggccagcggc

SEQ ID NO: 387142 - RNA, 16 nt, Bordetella pertussis
gcaggccgccacuugc

SEQ ID NO: 387143 - RNA, 13 nt, Bordetella pertussis
gcaggccgccgcc

SEQ ID NO: 387144 - RNA, 14 nt, Bordetella pertussis
gcaggccgccgggg

SEQ ID NO: 387145 - RNA, 11 nt, Bordetella pertussis
gcaggccgcgc

SEQ ID NO: 387146 - RNA, 16 nt, Bordetella pertussis
gcaggccgcgccacag

SEQ ID NO: 387147 - RNA, 22 nt, Bordetella pertussis
gcaggccgcgcugccagccaug

SEQ ID NO: 387148 - RNA, 16 nt, Bordetella pertussis
gcaggccgcgcuggug

SEQ ID NO: 387149 - RNA, 12 nt, Bordetella pertussis
gcaggccgccgg

SEQ ID NO: 387150 - RNA, 16 nt, Bordetella pertussis
gcaggccggcggccag

SEQ ID NO: 387151 - RNA, 18 nt, Bordetella pertussis
gcaggccguuggccgcgc

SEQ ID NO: 387152 - RNA, 21 nt, Bordetella pertussis
gcaggccguuggccgcgcggu

SEQ ID NO: 387153 - RNA, 21 nt, Bordetella pertussis
gcaggccucgcccgaucggcc

SEQ ID NO: 387154 - RNA, 14 nt, Bordetella pertussis
gcaggccugcugca

SEQ ID NO: 387155 - RNA, 16 nt, Bordetella pertussis
gcaggccuggucgagc

SEQ ID NO: 387156 - RNA, 20 nt, Bordetella pertussis
gcaggccuggucgagcgggc

SEQ ID NO: 387157 - RNA, 21 nt, Bordetella pertussis
gcaggccuggucgagcgggcg

SEQ ID NO: 387158 - RNA, 19 nt, Bordetella pertussis
gcaggcgcaccagcgcgcc

SEQ ID NO: 387159 - RNA, 17 nt, Bordetella pertussis
gcaggcgcagcggcggc

SEQ ID NO: 387160 - RNA, 18 nt, Bordetella pertussis
gcaggcgcaggccgcgcg

SEQ ID NO: 387161 - RNA, 22 nt, Bordetella pertussis
gcaggcgcaucagcuuggccac

SEQ ID NO: 387162 - RNA, 14 nt, Bordetella pertussis
gcaggcgccgcccc

SEQ ID NO: 387163 - RNA, 12 nt, Bordetella pertussis
gcaggcgccggc

SEQ ID NO: 387164 - RNA, 23 nt, Bordetella pertussis
gcaggcgccugcucacgccccgc

SEQ ID NO: 387165 - RNA, 21 nt, Bordetella pertussis
gcaggcgccuucggcgcggcg

SEQ ID NO: 387166 - RNA, 19 nt, Bordetella pertussis
gcaggcgccuuucccgcgc

SEQ ID NO: 387167 - RNA, 14 nt, Bordetella pertussis
gcaggcgcgcggug

SEQ ID NO: 387168 - RNA, 17 nt, Bordetella pertussis
gcaggcgugcgcgggcg

SEQ ID NO: 387169 - RNA, 15 nt, Bordetella pertussis
gcaggcguucgcacc

SEQ ID NO: 387170 - RNA, 16 nt, Bordetella pertussis
gcaggcuaugcaggcu

SEQ ID NO: 387171 - RNA, 16 nt, Bordetella pertussis
gcaggcugccgccggc

SEQ ID NO: 387172 - RNA, 16 nt, Bordetella pertussis
gcagggcaugggcccg

SEQ ID NO: 387173 - RNA, 17 nt, Bordetella pertussis
gcagggcaugggcccgg

SEQ ID NO: 387174 - RNA, 20 nt, Bordetella pertussis
gcagggcaugggcccgggcg

SEQ ID NO: 387175 - RNA, 14 nt, Bordetella pertussis
gcagggccagcgcc

SEQ ID NO: 387176 - RNA, 22 nt, Bordetella pertussis
gcagggccggccgggcgcggcg

SEQ ID NO: 387177 - RNA, 18 nt, Bordetella pertussis
gcagggcgucggccgcgc

SEQ ID NO: 387178 - RNA, 17 nt, Bordetella pertussis
gcaggggccgcacgcgc

SEQ ID NO: 387179 - RNA, 20 nt, Bordetella pertussis
gcagggggucgaucauggcc

SEQ ID NO: 387180 - RNA, 22 nt, Bordetella pertussis
gcagggggucgaucauggccag

SEQ ID NO: 387181 - RNA, 15 nt, Bordetella pertussis
gcagggucgagacca

SEQ ID NO: 387182 - RNA, 22 nt, Bordetella pertussis
gcaguccaaggaaagcccggcc

SEQ ID NO: 387183 - RNA, 17 nt, Bordetella pertussis
gcaguccuucagcuuga

SEQ ID NO: 387184 - RNA, 18 nt, Bordetella pertussis
gcagucggggccgcagcu

SEQ ID NO: 387185 - RNA, 23 nt, Bordetella pertussis
gcagucggggccgcagcuggacu

SEQ ID NO: 387186 - RNA, 23 nt, Bordetella pertussis
gcagugccugcgaacgcccggcc

SEQ ID NO: 387187 - RNA, 15 nt, Bordetella pertussis
gcagugcgccggacg

SEQ ID NO: 387188 - RNA, 23 nt, Bordetella pertussis
gcagugggcggugaccaugcgca

SEQ ID NO: 387189 - RNA, 22 nt, Bordetella pertussis
gcagugugccugucccagcggg

SEQ ID NO: 387190 - RNA, 13 nt, Bordetella pertussis
gcaguuccaggca

SEQ ID NO: 387191 - RNA, 17 nt, Bordetella pertussis
gcaguuccggcgggccg

SEQ ID NO: 387192 - RNA, 18 nt, Bordetella pertussis
gcaguucggccgccaggu

SEQ ID NO: 387193 - RNA, 20 nt, Bordetella pertussis
gcaguucggucagcgcggcg

SEQ ID NO: 387194 - RNA, 15 nt, Bordetella pertussis
gcaguugaacacgcg

SEQ ID NO: 387195 - RNA, 23 nt, Bordetella pertussis
gcaguugcgucuccagcgcggcg

SEQ ID NO: 387196 - RNA, 21 nt, Bordetella pertussis
gcauagaugccgaacagccag

SEQ ID NO: 387197 - RNA, 16 nt, Bordetella pertussis
gcauagcccaggccgc

SEQ ID NO: 387198 - RNA, 19 nt, Bordetella pertussis
gcauagcguuuuguacucu

SEQ ID NO: 387199 - RNA, 15 nt, Bordetella pertussis
gcauauccgcgugcg

SEQ ID NO: 387200 - RNA, 17 nt, Bordetella pertussis
gcaucaacacgcuggac

SEQ ID NO: 387201 - RNA, 21 nt, Bordetella pertussis
gcauccagccgaucagccggc

SEQ ID NO: 387202 - RNA, 15 nt, Bordetella pertussis
gcaucgacagcgcgc

SEQ ID NO: 387203 - RNA, 17 nt, Bordetella pertussis
gcaucgacaugcccgcc

SEQ ID NO: 387204 - RNA, 19 nt, Bordetella pertussis
gcaucgagaaaccagccgc

SEQ ID NO: 387205 - RNA, 22 nt, Bordetella pertussis
gcaucgagaaaccagccgccgc

SEQ ID NO: 387206 - RNA, 19 nt, Bordetella pertussis
gcaucgagauugagcacgc

SEQ ID NO: 387207 - RNA, 16 nt, Bordetella pertussis
gcaucgaucagcgcgc

SEQ ID NO: 387208 - RNA, 16 nt, Bordetella pertussis
gcaucgaugcggccuu

SEQ ID NO: 387209 - RNA, 15 nt, Bordetella pertussis
gcaucgauuucucgc

SEQ ID NO: 387210 - RNA, 18 nt, Bordetella pertussis
gcaucgccaugccggccc

SEQ ID NO: 387211 - RNA, 22 nt, Bordetella pertussis
gcaucgcccaccaugagcacgc

SEQ ID NO: 387212 - RNA, 24 nt, Bordetella pertussis
gcaucgcccaccaugagcacgccc

SEQ ID NO: 387213 - RNA, 13 nt, Bordetella pertussis
gcaucgccccgga

SEQ ID NO: 387214 - RNA, 15 nt, Bordetella pertussis
gcaucgccgccagcu

SEQ ID NO: 387215 - RNA, 18 nt, Bordetella pertussis
gcaucgccgccagcuugg

SEQ ID NO: 387216 - RNA, 14 nt, Bordetella pertussis
gcaucgugacaugc

SEQ ID NO: 387217 - RNA, 18 nt, Bordetella pertussis
gcaucgugacaugcacga

SEQ ID NO: 387218 - RNA, 15 nt, Bordetella pertussis
gcaucucgcggcggu

SEQ ID NO: 387219 - RNA, 16 nt, Bordetella pertussis
gcaucugccccagcuu

SEQ ID NO: 387220 - RNA, 16 nt, Bordetella pertussis
gcaucuggcgcauggc

SEQ ID NO: 387221 - RNA, 17 nt, Bordetella pertussis
gcaucuugccuuggcga

SEQ ID NO: 387222 - RNA, 18 nt, Bordetella pertussis
gcaugaugcugccgggca

SEQ ID NO: 387223 - RNA, 17 nt, Bordetella pertussis
gcaugaugucgcgggcc

SEQ ID NO: 387224 - RNA, 12 nt, Bordetella pertussis
gcaugcaagaca

SEQ ID NO: 387225 - RNA, 14 nt, Bordetella pertussis
gcaugcaccgcgug

SEQ ID NO: 387226 - RNA, 15 nt, Bordetella pertussis
gcaugccagcuugca

SEQ ID NO: 387227 - RNA, 17 nt, Bordetella pertussis
gcaugccagcuugcagg

SEQ ID NO: 387228 - RNA, 20 nt, Bordetella pertussis
gcaugcugcgcgaggugggc

SEQ ID NO: 387229 - RNA, 14 nt, Bordetella pertussis
gcaugcuggagaug

SEQ ID NO: 387230 - RNA, 13 nt, Bordetella pertussis
gcaugcugguugg

SEQ ID NO: 387231 - RNA, 21 nt, Bordetella pertussis
gcaugcugguugggcucgguc

SEQ ID NO: 387232 - RNA, 22 nt, Bordetella pertussis
gcauggcagcagaucggcggcc

SEQ ID NO: 387233 - RNA, 20 nt, Bordetella pertussis
gcauggccagcgcgcaggug

SEQ ID NO: 387234 - RNA, 17 nt, Bordetella pertussis
gcauggcgaugaccucg

SEQ ID NO: 387235 - RNA, 19 nt, Bordetella pertussis
gcauggucggcauggccag

SEQ ID NO: 387236 - RNA, 18 nt, Bordetella pertussis
gcaugguggcgcaggcaa

SEQ ID NO: 387237 - RNA, 15 nt, Bordetella pertussis
gcaugucccagcgcu

SEQ ID NO: 387238 - RNA, 14 nt, Bordetella pertussis
gcaugucccgaggc

SEQ ID NO: 387239 - RNA, 13 nt, Bordetella pertussis
gcauguccgccac

SEQ ID NO: 387240 - RNA, 14 nt, Bordetella pertussis
gcaugucgaugccg

SEQ ID NO: 387241 - RNA, 16 nt, Bordetella pertussis
gcauucccgcccagcg

SEQ ID NO: 387242 - RNA, 22 nt, Bordetella pertussis
gcauuccgcgaaacggcgggcg

SEQ ID NO: 387243 - RNA, 23 nt, Bordetella pertussis
gcauucgaacaacagcgccugca

SEQ ID NO: 387244 - RNA, 18 nt, Bordetella pertussis
gcauugcgcguauccagc

SEQ ID NO: 387245 - RNA, 23 nt, Bordetella pertussis
gcauuuccauuuguugggccacc

SEQ ID NO: 387246 - RNA, 14 nt, Bordetella pertussis
gcauuucccagccg

SEQ ID NO: 387247 - RNA, 20 nt, Bordetella pertussis
gcauuuccucgaccagcgcg

SEQ ID NO: 387248 - RNA, 15 nt, Bordetella pertussis
gccaaagacaaugcc

SEQ ID NO: 387249 - RNA, 11 nt, Bordetella pertussis
gccaaagcgcu

SEQ ID NO: 387250 - RNA, 20 nt, Bordetella pertussis
gccacaggugcgcggcgcgc

SEQ ID NO: 387251 - RNA, 22 nt, Bordetella pertussis
gccacaucaucgaccaccagcg

SEQ ID NO: 387252 - RNA, 14 nt, Bordetella pertussis
gccaccaccaggcc

SEQ ID NO: 387253 - RNA, 15 nt, Bordetella pertussis
gccaccaccaggccc

SEQ ID NO: 387254 - RNA, 14 nt, Bordetella pertussis
gccaccaccgucuc

SEQ ID NO: 387255 - RNA, 23 nt, Bordetella pertussis
gccaccaccggcacgccggcggc

SEQ ID NO: 387256 - RNA, 20 nt, Bordetella pertussis
gccaccacugcaaggcccgc

SEQ ID NO: 387257 - RNA, 22 nt, Bordetella pertussis
gccaccacugcaaggcccgccc

SEQ ID NO: 387258 - RNA, 22 nt, Bordetella pertussis
gccaccagaucgauaccgucgc

SEQ ID NO: 387259 - RNA, 16 nt, Bordetella pertussis
gccaccagcagcgcca

SEQ ID NO: 387260 - RNA, 17 nt, Bordetella pertussis
gccaccagcgcgccagc

SEQ ID NO: 387261 - RNA, 19 nt, Bordetella pertussis
gccaccagcgcgucgccgc

SEQ ID NO: 387262 - RNA, 22 nt, Bordetella pertussis
gccaccagcgcgucgccgccau

SEQ ID NO: 387263 - RNA, 13 nt, Bordetella pertussis
gccaccagcggcg

SEQ ID NO: 387264 - RNA, 17 nt, Bordetella pertussis
gccaccagcggcguggc

SEQ ID NO: 387265 - RNA, 22 nt, Bordetella pertussis
gccaccagcguguagagcaggc

SEQ ID NO: 387266 - RNA, 20 nt, Bordetella pertussis
gccaccagcuugcgcgccgc

SEQ ID NO: 387267 - RNA, 21 nt, Bordetella pertussis
gccaccagcuugcgcgccgca

SEQ ID NO: 387268 - RNA, 13 nt, Bordetella pertussis
gccaccaggcgcg

SEQ ID NO: 387269 - RNA, 17 nt, Bordetella pertussis
gccaccaggcgcgcgcc

SEQ ID NO: 387270 - RNA, 18 nt, Bordetella pertussis
gccaccagcgucagcaca

SEQ ID NO: 387271 - RNA, 19 nt, Bordetella pertussis
gccaccagcgucagcacau

SEQ ID NO: 387272 - RNA, 17 nt, Bordetella pertussis
gccaccagugcgccggc

SEQ ID NO: 387273 - RNA, 15 nt, Bordetella pertussis
gccaccgcgccgccc

SEQ ID NO: 387274 - RNA, 18 nt, Bordetella pertussis
gccaccgcggugccgcgc

SEQ ID NO: 387275 - RNA, 13 nt, Bordetella pertussis
gccaccgucgcca

SEQ ID NO: 387276 - RNA, 18 nt, Bordetella pertussis
gccaccguggccacggcc

SEQ ID NO: 387277 - RNA, 12 nt, Bordetella pertussis
gccaccguggcg

SEQ ID NO: 387278 - RNA, 13 nt, Bordetella pertussis
gccaccuggcgcc

SEQ ID NO: 387279 - RNA, 16 nt, Bordetella pertussis
gccaccugggccgccu

SEQ ID NO: 387280 - RNA, 17 nt, Bordetella pertussis
gccaccugggccgccug

SEQ ID NO: 387281 - RNA, 18 nt, Bordetella pertussis
gccaccugggccgccugc

SEQ ID NO: 387282 - RNA, 23 nt, Bordetella pertussis
gccaccuggucgucggccacgcc

SEQ ID NO: 387283 - RNA, 16 nt, Bordetella pertussis
gccacgcaggcgggcg

SEQ ID NO: 387284 - RNA, 19 nt, Bordetella pertussis
gccacgcaggcgggcgccg

SEQ ID NO: 387285 - RNA, 18 nt, Bordetella pertussis
gccacgccagcggcgagc

SEQ ID NO: 387286 - RNA, 17 nt, Bordetella pertussis
gccacgcccacgcgccg

SEQ ID NO: 387287 - RNA, 14 nt, Bordetella pertussis
gccacgcccaggcc

SEQ ID NO: 387288 - RNA, 17 nt, Bordetella pertussis
gccacgcccaggccgcu

SEQ ID NO: 387289 - RNA, 20 nt, Bordetella pertussis
gccacgcccaggccguggcg

SEQ ID NO: 387290 - RNA, 22 nt, Bordetella pertussis
gccacgcccaggccguggcgca

SEQ ID NO: 387291 - RNA, 20 nt, Bordetella pertussis
gccacgcccgucucgcgcgc

SEQ ID NO: 387292 - RNA, 21 nt, Bordetella pertussis
gccacgcccgucucgcgcgcc

SEQ ID NO: 387293 - RNA, 14 nt, Bordetella pertussis
gccacgcccuggca

SEQ ID NO: 387294 - RNA, 12 nt, Bordetella pertussis
gccacgccggcc

SEQ ID NO: 387295 - RNA, 17 nt, Bordetella pertussis
gccacgccggccagcuu

SEQ ID NO: 387296 - RNA, 13 nt, Bordetella pertussis
gccacgccggccg

SEQ ID NO: 387297 - RNA, 17 nt, Bordetella pertussis
gccacgccggcgcgccg

SEQ ID NO: 387298 - RNA, 17 nt, Bordetella pertussis
gccacgccuggccgcgc

SEQ ID NO: 387299 - RNA, 19 nt, Bordetella pertussis
gccacgcgcaacgccgcca

SEQ ID NO: 387300 - RNA, 18 nt, Bordetella pertussis
gccacgcgcacggccagc

SEQ ID NO: 387301 - RNA, 14 nt, Bordetella pertussis
gccacgcgccgccc

SEQ ID NO: 387302 - RNA, 16 nt, Bordetella pertussis
gccacgcgccgcccgg

SEQ ID NO: 387303 - RNA, 19 nt, Bordetella pertussis
gccacgcgcugcagcagca

SEQ ID NO: 387304 - RNA, 20 nt, Bordetella pertussis
gccacgcgcugcagcagcau

SEQ ID NO: 387305 - RNA, 18 nt, Bordetella pertussis
gccacgcgcuguugcugg

SEQ ID NO: 387306 - RNA, 21 nt, Bordetella pertussis
gccacgcgguccagccccugc

SEQ ID NO: 387307 - RNA, 15 nt, Bordetella pertussis
gccacgcugcccugc

SEQ ID NO: 387308 - RNA, 16 nt, Bordetella pertussis
gccacgcuggccgcgc

SEQ ID NO: 387309 - RNA, 14 nt, Bordetella pertussis
gccacuugcaggcc

SEQ ID NO: 387310 - RNA, 19 nt, Bordetella pertussis
gccacuuucgcgcgcgccu

SEQ ID NO: 387311 - RNA, 20 nt, Bordetella pertussis
gccacuuucgcgcgcgccug

SEQ ID NO: 387312 - RNA, 22 nt, Bordetella pertussis
gccacuuucgcgcgcgccugcc

SEQ ID NO: 387313 - RNA, 14 nt, Bordetella pertussis
gccagacggccagc

SEQ ID NO: 387314 - RNA, 18 nt, Bordetella pertussis
gccagacggccagcgcgc

SEQ ID NO: 387315 - RNA, 18 nt, Bordetella pertussis
gccagauaaaggccgcaa

SEQ ID NO: 387316 - RNA, 20 nt, Bordetella pertussis
gccagauccgguaugccugc

SEQ ID NO: 387317 - RNA, 19 nt, Bordetella pertussis
gccagcaagcgcucggcca

SEQ ID NO: 387318 - RNA, 15 nt, Bordetella pertussis
gccagcaaggcggca

SEQ ID NO: 387319 - RNA, 18 nt, Bordetella pertussis
gccagcaaggcgucggcc

SEQ ID NO: 387320 - RNA, 20 nt, Bordetella pertussis
gccagcacauacgccgccga

SEQ ID NO: 387321 - RNA, 16 nt, Bordetella pertussis
gccagcaccggccgcc

SEQ ID NO: 387322 - RNA, 17 nt, Bordetella pertussis
gccagcaccggccgccg

SEQ ID NO: 387323 - RNA, 22 nt, Bordetella pertussis
gccagcacgccauucauccagc

SEQ ID NO: 387324 - RNA, 22 nt, Bordetella pertussis
gccagcacgaucacgaacagcg

SEQ ID NO: 387325 - RNA, 14 nt, Bordetella pertussis
gccagcacgccggc

SEQ ID NO: 387326 - RNA, 23 nt, Bordetella pertussis
gccagcacggcaugucccgaggc

SEQ ID NO: 387327 - RNA, 16 nt, Bordetella pertussis
gccagcacgguggcgc

SEQ ID NO: 387328 - RNA, 18 nt, Bordetella pertussis
gccagcacgguggcgccc

SEQ ID NO: 387329 - RNA, 23 nt, Bordetella pertussis
gccagcacgguggcgcccggcgg

SEQ ID NO: 387330 - RNA, 17 nt, Bordetella pertussis
gccagcacgucauccug

SEQ ID NO: 387331 - RNA, 22 nt, Bordetella pertussis
gccagcagcacgaucgcggcgc

SEQ ID NO: 387332 - RNA, 15 nt, Bordetella pertussis
gccagcagcaggccg

SEQ ID NO: 387333 - RNA, 18 nt, Bordetella pertussis
gccagcagcgacggcccc

SEQ ID NO: 387334 - RNA, 21 nt, Bordetella pertussis
gccagcagcgacggccccagc

SEQ ID NO: 387335 - RNA, 19 nt, Bordetella pertussis
gccagcagcgcaucgcgcg

SEQ ID NO: 387336 - RNA, 24 nt, Bordetella pertussis
gccagcagcgcaucgcgcgcgccg

SEQ ID NO: 387337 - RNA, 16 nt, Bordetella pertussis
gccagcagcgcgugca

SEQ ID NO: 387338 - RNA, 22 nt, Bordetella pertussis
gccagcagcgcgugcagccagc

SEQ ID NO: 387339 - RNA, 13 nt, Bordetella pertussis
gccagcagcgggc

SEQ ID NO: 387340 - RNA, 23 nt, Bordetella pertussis
gccagcagcgggcuggggcaggc

SEQ ID NO: 387341 - RNA, 19 nt, Bordetella pertussis
gccagcaggagcccgcugc

SEQ ID NO: 387342 - RNA, 15 nt, Bordetella pertussis
gccagcagcucggcg

SEQ ID NO: 387343 - RNA, 13 nt, Bordetella pertussis
gccagcaggcgcu

SEQ ID NO: 387344 - RNA, 15 nt, Bordetella pertussis
gccagcaggcucagc

SEQ ID NO: 387345 - RNA, 19 nt, Bordetella pertussis
gccagcaggcucagcgggc

SEQ ID NO: 387346 - RNA, 18 nt, Bordetella pertussis
gccagcagggucagcggc

SEQ ID NO: 387347 - RNA, 19 nt, Bordetella pertussis
gccagcagggucagcggcc

SEQ ID NO: 387348 - RNA, 20 nt, Bordetella pertussis
gccagcagggucagcggccg

SEQ ID NO: 387349 - RNA, 17 nt, Bordetella pertussis
gccagcaggucgcgcac

SEQ ID NO: 387350 - RNA, 21 nt, Bordetella pertussis
gccagcaguguuucggccugc

SEQ ID NO: 387351 - RNA, 22 nt, Bordetella pertussis
gccagcaguguuucggccugcu

SEQ ID NO: 387352 - RNA, 23 nt, Bordetella pertussis
gccagcaguguuucggccugcuc

SEQ ID NO: 387353 - RNA, 20 nt, Bordetella pertussis
gccagcauacccugcgcgcc

SEQ ID NO: 387354 - RNA, 21 nt, Bordetella pertussis
gccagcauacccugcgcgccg

SEQ ID NO: 387355 - RNA, 14 nt, Bordetella pertussis
gccagcaucggcac

SEQ ID NO: 387356 - RNA, 19 nt, Bordetella pertussis
gccagcaucggcacccagc

SEQ ID NO: 387357 - RNA, 13 nt, Bordetella pertussis
gccagcauggccg

SEQ ID NO: 387358 - RNA, 18 nt, Bordetella pertussis
gccagcauggccguggcg

SEQ ID NO: 387359 - RNA, 20 nt, Bordetella pertussis
gccagcauggcggccaggcg

SEQ ID NO: 387360 - RNA, 17 nt, Bordetella pertussis
gccagcaugcgcgcggc

SEQ ID NO: 387361 - RNA, 18 nt, Bordetella pertussis
gccagcaugcgcgcggcc

SEQ ID NO: 387362 - RNA, 15 nt, Bordetella pertussis
gccagccacgccggc

SEQ ID NO: 387363 - RNA, 20 nt, Bordetella pertussis
gccagccacgccggcgcgcc

SEQ ID NO: 387364 - RNA, 12 nt, Bordetella pertussis
gccagccaggcg

SEQ ID NO: 387365 - RNA, 14 nt, Bordetella pertussis
gccagcccaccagc

SEQ ID NO: 387366 - RNA, 21 nt, Bordetella pertussis
gccagcccaccagcgccacgc

SEQ ID NO: 387367 - RNA, 12 nt, Bordetella pertussis
gccagccccggc

SEQ ID NO: 387368 - RNA, 16 nt, Bordetella pertussis
gccagccccggcgcgc

SEQ ID NO: 387369 - RNA, 17 nt, Bordetella pertussis
gccagccccggcgcgcc

SEQ ID NO: 387370 - RNA, 13 nt, Bordetella pertussis
gccagcccgacgg

SEQ ID NO: 387371 - RNA, 13 nt, Bordetella pertussis
gccagcccgaggc

SEQ ID NO: 387372 - RNA, 18 nt, Bordetella pertussis
gccagcccgcccgcgagc

SEQ ID NO: 387373 - RNA, 20 nt, Bordetella pertussis
gccagcccgcccgcgagcgg

SEQ ID NO: 387374 - RNA, 14 nt, Bordetella pertussis
gccagcccgccggc

SEQ ID NO: 387375 - RNA, 15 nt, Bordetella pertussis
gccagcccgccggcg

SEQ ID NO: 387376 - RNA, 20 nt, Bordetella pertussis
gccagcccgccggcgcgcgc

SEQ ID NO: 387377 - RNA, 18 nt, Bordetella pertussis
gccagcccuugcuugccg

SEQ ID NO: 387378 - RNA, 20 nt, Bordetella pertussis
gccagccgccgcgcggcgga

SEQ ID NO: 387379 - RNA, 14 nt, Bordetella pertussis
gccagccgcuggcg

SEQ ID NO: 387380 - RNA, 22 nt, Bordetella pertussis
gccagccgcuggcgaucaggcc

SEQ ID NO: 387381 - RNA, 15 nt, Bordetella pertussis
gccagccgcuggcgc

SEQ ID NO: 387382 - RNA, 16 nt, Bordetella pertussis
gccagccgcuggcgcg

SEQ ID NO: 387383 - RNA, 15 nt, Bordetella pertussis
gccagccggcccagc

SEQ ID NO: 387384 - RNA, 20 nt, Bordetella pertussis
gccagccggcccagcaugcc

SEQ ID NO: 387385 - RNA, 14 nt, Bordetella pertussis
gccagccgcuccag

SEQ ID NO: 387386 - RNA, 15 nt, Bordetella pertussis
gccagccgcucgcgc

SEQ ID NO: 387387 - RNA, 14 nt, Bordetella pertussis
gccagccggcgcgc

SEQ ID NO: 387388 - RNA, 13 nt, Bordetella pertussis
gccagccggcggc

SEQ ID NO: 387389 - RNA, 17 nt, Bordetella pertussis
gccagccggcggccagc

SEQ ID NO: 387390 - RNA, 18 nt, Bordetella pertussis
gccagccguugcgccagc

SEQ ID NO: 387391 - RNA, 12 nt, Bordetella pertussis
gccagccugccg

SEQ ID NO: 387392 - RNA, 14 nt, Bordetella pertussis
gccagccugccgcg

SEQ ID NO: 387393 - RNA, 14 nt, Bordetella pertussis
gccagccugccaca

SEQ ID NO: 387394 - RNA, 13 nt, Bordetella pertussis
gccagccuggccu

SEQ ID NO: 387395 - RNA, 16 nt, Bordetella pertussis
gccagccuggccuugc

SEQ ID NO: 387396 - RNA, 19 nt, Bordetella pertussis
gccagccuggccuugcgcu

SEQ ID NO: 387397 - RNA, 16 nt, Bordetella pertussis
gccagcgaggccgcuu

SEQ ID NO: 387398 - RNA, 12 nt, Bordetella pertussis
gccagcgccacg

SEQ ID NO: 387399 - RNA, 19 nt, Bordetella pertussis
gccagcgccacgcccuggc

SEQ ID NO: 387400 - RNA, 17 nt, Bordetella pertussis
gccagcgccacgcgagc

SEQ ID NO: 387401 - RNA, 15 nt, Bordetella pertussis
gccagcgccagcacg

SEQ ID NO: 387402 - RNA, 16 nt, Bordetella pertussis
gccagcgccagccgcu

SEQ ID NO: 387403 - RNA, 22 nt, Bordetella pertussis
gccagcgccaugaugucgcgcg

SEQ ID NO: 387404 - RNA, 14 nt, Bordetella pertussis
gccagcgccccggc

SEQ ID NO: 387405 - RNA, 14 nt, Bordetella pertussis
gccagcgccgcagc

SEQ ID NO: 387406 - RNA, 13 nt, Bordetella pertussis
gccagcgccgcca

SEQ ID NO: 387407 - RNA, 15 nt, Bordetella pertussis
gccagcgccgccagc

SEQ ID NO: 387408 - RNA, 16 nt, Bordetella pertussis
gccagcgccgccagcc

SEQ ID NO: 387409 - RNA, 17 nt, Bordetella pertussis
gccagcgccgcgcgcgu

SEQ ID NO: 387410 - RNA, 20 nt, Bordetella pertussis
gccagcgccgcgcgcgugcc

SEQ ID NO: 387411 - RNA, 13 nt, Bordetella pertussis
gccagcgccgcgg

SEQ ID NO: 387412 - RNA, 14 nt, Bordetella pertussis
gccagcgccgcggc

SEQ ID NO: 387413 - RNA, 16 nt, Bordetella pertussis
gccagcgccgcggccg

SEQ ID NO: 387414 - RNA, 19 nt, Bordetella pertussis
gccagcgccgcggccggcg

SEQ ID NO: 387415 - RNA, 16 nt, Bordetella pertussis
gccagcgccgcgguga

SEQ ID NO: 387416 - RNA, 19 nt, Bordetella pertussis
gccagcgccggcgcgucca

SEQ ID NO: 387417 - RNA, 12 nt, Bordetella pertussis
gccagcgccggc

SEQ ID NO: 387418 - RNA, 21 nt, Bordetella pertussis
gccagcgccuccaucagcagc

SEQ ID NO: 387419 - RNA, 21 nt, Bordetella pertussis
gccagcgccucgcgcucgagc

SEQ ID NO: 387420 - RNA, 14 nt, Bordetella pertussis
gccagcgccugcgc

SEQ ID NO: 387421 - RNA, 21 nt, Bordetella pertussis
gccagcgcgaaaacccgcggc

SEQ ID NO: 387422 - RNA, 22 nt, Bordetella pertussis
gccagcgcgaaaacccgcggca

SEQ ID NO: 387423 - RNA, 23 nt, Bordetella pertussis
gccagcgcgaaaacccgcggcag

SEQ ID NO: 387424 - RNA, 18 nt, Bordetella pertussis
gccagcgcgacggccucg

SEQ ID NO: 387425 - RNA, 13 nt, Bordetella pertussis
gccagcgccugga

SEQ ID NO: 387426 - RNA, 15 nt, Bordetella pertussis
gccagcgccuggacc

SEQ ID NO: 387427 - RNA, 22 nt, Bordetella pertussis
gccagcgcgccauggccggccg

SEQ ID NO: 387428 - RNA, 14 nt, Bordetella pertussis
gccagcgcgccgcc

SEQ ID NO: 387429 - RNA, 14 nt, Bordetella pertussis
gccagcgcgcgcca

SEQ ID NO: 387430 - RNA, 15 nt, Bordetella pertussis
gccagcgcgcggccg

SEQ ID NO: 387431 - RNA, 14 nt, Bordetella pertussis
gccagcgcgcggcg

SEQ ID NO: 387432 - RNA, 15 nt, Bordetella pertussis
gccagcgcgcggcgc

SEQ ID NO: 387433 - RNA, 13 nt, Bordetella pertussis
gccagcgcggcca

SEQ ID NO: 387434 - RNA, 15 nt, Bordetella pertussis
gccagcgcggccagc

SEQ ID NO: 387435 - RNA, 12 nt, Bordetella pertussis
gccagcgcggca

SEQ ID NO: 387436 - RNA, 14 nt, Bordetella pertussis
gccagcgcggcggc

SEQ ID NO: 387437 - RNA, 16 nt, Bordetella pertussis
gccagcgcuucgggca

SEQ ID NO: 387438 - RNA, 19 nt, Bordetella pertussis
gccagcgcuucgggcagcu

SEQ ID NO: 387439 - RNA, 21 nt, Bordetella pertussis
gccagcggauggugcucggcg

SEQ ID NO: 387440 - RNA, 10 nt, Bordetella pertussis
gccagcggca

SEQ ID NO: 387441 - RNA, 18 nt, Bordetella pertussis
gccagcggcaggcccagc

SEQ ID NO: 387442 - RNA, 14 nt, Bordetella pertussis
gccagcggcagggg

SEQ ID NO: 387443 - RNA, 21 nt, Bordetella pertussis
gccagcggcauugcccagguu

SEQ ID NO: 387444 - RNA, 17 nt, Bordetella pertussis
gccagcggcgacugccc

SEQ ID NO: 387445 - RNA, 21 nt, Bordetella pertussis
gccagcggcgacugccccagc

SEQ ID NO: 387446 - RNA, 16 nt, Bordetella pertussis
gccagcggcgcagccg

SEQ ID NO: 387447 - RNA, 18 nt, Bordetella pertussis
gccagcggcgcagccggc

SEQ ID NO: 387448 - RNA, 19 nt, Bordetella pertussis
gccagcggcgcagccggcc

SEQ ID NO: 387449 - RNA, 15 nt, Bordetella pertussis
gccagcggccgucgc

SEQ ID NO: 387450 - RNA, 16 nt, Bordetella pertussis
gccagcggcgcggcgc

SEQ ID NO: 387451 - RNA, 22 nt, Bordetella pertussis
gccagcggcgcggcgcgcugga

SEQ ID NO: 387452 - RNA, 18 nt, Bordetella pertussis
gccagcgggagccugucc

SEQ ID NO: 387453 - RNA, 13 nt, Bordetella pertussis
gccagcggggccg

SEQ ID NO: 387454 - RNA, 18 nt, Bordetella pertussis
gccagcggugcgcggcgc

SEQ ID NO: 387455 - RNA, 19 nt, Bordetella pertussis
gccagcggugcgcggcgca

SEQ ID NO: 387456 - RNA, 21 nt, Bordetella pertussis
gccagcggugcgcggcgcagc

SEQ ID NO: 387457 - RNA, 23 nt, Bordetella pertussis
gccagcggugcgcggcgcagccc

SEQ ID NO: 387458 - RNA, 18 nt, Bordetella pertussis
gccagcgguucgucggcg

SEQ ID NO: 387459 - RNA, 20 nt, Bordetella pertussis
gccagcgguucgucggcgcu

SEQ ID NO: 387460 - RNA, 21 nt, Bordetella pertussis
gccagcgguucgucggcgcuc

SEQ ID NO: 387461 - RNA, 19 nt, Bordetella pertussis
gccagcguaucgccgccgc

SEQ ID NO: 387462 - RNA, 20 nt, Bordetella pertussis
gccagcgucaggcugggaga

SEQ ID NO: 387463 - RNA, 15 nt, Bordetella pertussis
gccagcgugcccagc

SEQ ID NO: 387464 - RNA, 13 nt, Bordetella pertussis
gccagcgugccgg

SEQ ID NO: 387465 - RNA, 17 nt, Bordetella pertussis
gccagcguucggccacc

SEQ ID NO: 387466 - RNA, 15 nt, Bordetella pertussis
gccagcucgacgcgc

SEQ ID NO: 387467 - RNA, 22 nt, Bordetella pertussis
gccagcucgcguugcaccgcgu

SEQ ID NO: 387468 - RNA, 12 nt, Bordetella pertussis
gccagcucggcc

SEQ ID NO: 387469 - RNA, 18 nt, Bordetella pertussis
gccagcucggccugcggc

SEQ ID NO: 387470 - RNA, 13 nt, Bordetella pertussis
gccagcucuuccg

SEQ ID NO: 387471 - RNA, 22 nt, Bordetella pertussis
gccagcucuucgagcgcggcgc

SEQ ID NO: 387472 - RNA, 23 nt, Bordetella pertussis
gccagcucggcggccgccugcgc

SEQ ID NO: 387473 - RNA, 17 nt, Bordetella pertussis
gccagcugcgcccccuc

SEQ ID NO: 387474 - RNA, 22 nt, Bordetella pertussis
gccagcugcgcccccucuucuc

SEQ ID NO: 387475 - RNA, 22 nt, Bordetella pertussis
gccagcugcguggcgacgcgcu

SEQ ID NO: 387476 - RNA, 15 nt, Bordetella pertussis
gccagcuggcccagu

SEQ ID NO: 387477 - RNA, 13 nt, Bordetella pertussis
gccagcuggcgcg

SEQ ID NO: 387478 - RNA, 19 nt, Bordetella pertussis
gccagcuggcgcguggccg

SEQ ID NO: 387479 - RNA, 22 nt, Bordetella pertussis
gccagcuggcggcgcagcacca

SEQ ID NO: 387480 - RNA, 18 nt, Bordetella pertussis
gccagcuugaccgccagc

SEQ ID NO: 387481 - RNA, 18 nt, Bordetella pertussis
gccagcuugacguccagc

SEQ ID NO: 387482 - RNA, 20 nt, Bordetella pertussis
gccagcuugacguccagcca

SEQ ID NO: 387483 - RNA, 15 nt, Bordetella pertussis
gccagcuugcaggcg

SEQ ID NO: 387484 - RNA, 15 nt, Bordetella pertussis
gccagcuugcgcgcc

SEQ ID NO: 387485 - RNA, 16 nt, Bordetella pertussis
gccagcuugcgcgccu

SEQ ID NO: 387486 - RNA, 19 nt, Bordetella pertussis
gccagcuugcgcgccuugg

SEQ ID NO: 387487 - RNA, 17 nt, Bordetella pertussis
gccagcuuggccaggcu

SEQ ID NO: 387488 - RNA, 18 nt, Bordetella pertussis
gccagcuuggugcucagu

SEQ ID NO: 387489 - RNA, 16 nt, Bordetella pertussis
gccaggaaagccggcg

SEQ ID NO: 387490 - RNA, 18 nt, Bordetella pertussis
gccaggaacagcgccggc

SEQ ID NO: 387491 - RNA, 17 nt, Bordetella pertussis
gccaggaagcgcgccgc

SEQ ID NO: 387492 - RNA, 19 nt, Bordetella pertussis
gccaggaagcgcgccgcgc

SEQ ID NO: 387493 - RNA, 16 nt, Bordetella pertussis
gccaggaagcggcgca

SEQ ID NO: 387494 - RNA, 21 nt, Bordetella pertussis
gccaggaagaucggcccggcg

SEQ ID NO: 387495 - RNA, 18 nt, Bordetella pertussis
gccaggaucgcggccagc

SEQ ID NO: 387496 - RNA, 15 nt, Bordetella pertussis
gccaggaugaugagg

SEQ ID NO: 387497 - RNA, 22 nt, Bordetella pertussis
gccaggauggcguugccggccu

SEQ ID NO: 387498 - RNA, 12 nt, Bordetella pertussis
gccaggccagca

SEQ ID NO: 387499 - RNA, 19 nt, Bordetella pertussis
gccaggccagcagcucggc

SEQ ID NO: 387500 - RNA, 12 nt, Bordetella pertussis
gccaggccagcg

SEQ ID NO: 387501 - RNA, 15 nt, Bordetella pertussis
gccaggccauggcgc

SEQ ID NO: 387502 - RNA, 14 nt, Bordetella pertussis
gccaggcccagggc

SEQ ID NO: 387503 - RNA, 17 nt, Bordetella pertussis
gccaggccccgccgggc

SEQ ID NO: 387504 - RNA, 18 nt, Bordetella pertussis
gccaggccccgccgggcc

SEQ ID NO: 387505 - RNA, 14 nt, Bordetella pertussis
gccaggcccuugau

SEQ ID NO: 387506 - RNA, 23 nt, Bordetella pertussis
gccaggccgauuucggccgccgg

SEQ ID NO: 387507 - RNA, 14 nt, Bordetella pertussis
gccaggccgccgcc

SEQ ID NO: 387508 - RNA, 15 nt, Bordetella pertussis
gccaggccgccgccg

SEQ ID NO: 387509 - RNA, 16 nt, Bordetella pertussis
gccaggccgccgccgg

SEQ ID NO: 387510 - RNA, 13 nt, Bordetella pertussis
gccaggccggccc

SEQ ID NO: 387511 - RNA, 13 nt, Bordetella pertussis
gccaggccggccu

SEQ ID NO: 387512 - RNA, 16 nt, Bordetella pertussis
gccaggccggccuugg

SEQ ID NO: 387513 - RNA, 15 nt, Bordetella pertussis
gccaggccggcgcgc

SEQ ID NO: 387514 - RNA, 16 nt, Bordetella pertussis
gccaggccggcgcgcc

SEQ ID NO: 387515 - RNA, 17 nt, Bordetella pertussis
gccaggccggcgcgccg

SEQ ID NO: 387516 - RNA, 21 nt, Bordetella pertussis
gccaggccgucgagcacgggg

SEQ ID NO: 387517 - RNA, 15 nt, Bordetella pertussis
gccaggccggggccg

SEQ ID NO: 387518 - RNA, 18 nt, Bordetella pertussis
gccaggcgagcgccgcgc

SEQ ID NO: 387519 - RNA, 23 nt, Bordetella pertussis
gccaggcgagcgccgcgcuccag

SEQ ID NO: 387520 - RNA, 14 nt, Bordetella pertussis
gccaggcgccgcuc

SEQ ID NO: 387521 - RNA, 13 nt, Bordetella pertussis
gccaggcgccggc

SEQ ID NO: 387522 - RNA, 15 nt, Bordetella pertussis
gccaggcgccgggcc

SEQ ID NO: 387523 - RNA, 21 nt, Bordetella pertussis
gccaggcgcgcaucgcgcggc

SEQ ID NO: 387524 - RNA, 22 nt, Bordetella pertussis
gccaggcgcgcaucgcgcggca

SEQ ID NO: 387525 - RNA, 16 nt, Bordetella pertussis
gccaggcgcgccgcga

SEQ ID NO: 387526 - RNA, 13 nt, Bordetella pertussis
gccaggcgcggau

SEQ ID NO: 387527 - RNA, 21 nt, Bordetella pertussis
gccaggcgccagaugcgccgc

SEQ ID NO: 387528 - RNA, 16 nt, Bordetella pertussis
gccaggcgccagcggc

SEQ ID NO: 387529 - RNA, 21 nt, Bordetella pertussis
gccaggcgcuccagcaccugc

SEQ ID NO: 387530 - RNA, 15 nt, Bordetella pertussis
gccaggcgcucggcg

SEQ ID NO: 387531 - RNA, 14 nt, Bordetella pertussis
gccaggcgcgugcg

SEQ ID NO: 387532 - RNA, 20 nt, Bordetella pertussis
gccaggcgggguggcacagc

SEQ ID NO: 387533 - RNA, 14 nt, Bordetella pertussis
gccaggcgguggcc

SEQ ID NO: 387534 - RNA, 20 nt, Bordetella pertussis
gccaggcguagaccaccugc

SEQ ID NO: 387535 - RNA, 13 nt, Bordetella pertussis
gccaggcucagca

SEQ ID NO: 387536 - RNA, 15 nt, Bordetella pertussis
gccaggcucagcagg

SEQ ID NO: 387537 - RNA, 16 nt, Bordetella pertussis
gccaggcucagcaggg

SEQ ID NO: 387538 - RNA, 22 nt, Bordetella pertussis
gccaggcuaucguggcuggcga

SEQ ID NO: 387539 - RNA, 23 nt, Bordetella pertussis
gccaggcucuuuuucgagccgca

SEQ ID NO: 387540 - RNA, 15 nt, Bordetella pertussis
gccaggcugaccagc

SEQ ID NO: 387541 - RNA, 23 nt, Bordetella pertussis
gccaggcugaccagcgcgucgca

SEQ ID NO: 387542 - RNA, 17 nt, Bordetella pertussis
gccaucaggugcagggu

SEQ ID NO: 387543 - RNA, 19 nt, Bordetella pertussis
gccaucagguuguccagcg

SEQ ID NO: 387544 - RNA, 22 nt, Bordetella pertussis
gccaucagguuguccagcgcgc

SEQ ID NO: 387545 - RNA, 18 nt, Bordetella pertussis
gccauccguccgccagga

SEQ ID NO: 387546 - RNA, 19 nt, Bordetella pertussis
gccauccucgcccagcggc

SEQ ID NO: 387547 - RNA, 19 nt, Bordetella pertussis
gccauccugaacgccgcgc

SEQ ID NO: 387548 - RNA, 13 nt, Bordetella pertussis
gccauccuggccg

SEQ ID NO: 387549 - RNA, 17 nt, Bordetella pertussis
gccauccuggccgccgc

SEQ ID NO: 387550 - RNA, 16 nt, Bordetella pertussis
gccaucgacaagcgcu

SEQ ID NO: 387551 - RNA, 19 nt, Bordetella pertussis
gccaucgauaugggcggcc

SEQ ID NO: 387552 - RNA, 16 nt, Bordetella pertussis
gccaugccccauccag

SEQ ID NO: 387553 - RNA, 18 nt, Bordetella pertussis
gccaugccgcgcccgccu

SEQ ID NO: 387554 - RNA, 19 nt, Bordetella pertussis
gccaugccgcgcccgccuu

SEQ ID NO: 387555 - RNA, 23 nt, Bordetella pertussis
gccaugccgcgcccgccuucagc

SEQ ID NO: 387556 - RNA, 17 nt, Bordetella pertussis
gccaugccgcgcgccuu

SEQ ID NO: 387557 - RNA, 14 nt, Bordetella pertussis
gccaugccguccug

SEQ ID NO: 387558 - RNA, 14 nt, Bordetella pertussis
gccaugccgucugg

SEQ ID NO: 387559 - RNA, 15 nt, Bordetella pertussis
gccaugcgaugcugc

SEQ ID NO: 387560 - RNA, 23 nt, Bordetella pertussis
gccaugcgaugcugcagggccug

SEQ ID NO: 387561 - RNA, 14 nt, Bordetella pertussis
gccaugcgcauggc

SEQ ID NO: 387562 - RNA, 18 nt, Bordetella pertussis
gccaugcgcauggccagc

SEQ ID NO: 387563 - RNA, 16 nt, Bordetella pertussis
gccaugcgccagcagg

SEQ ID NO: 387564 - RNA, 17 nt, Bordetella pertussis
gccaugcgccagcagga

SEQ ID NO: 387565 - RNA, 17 nt, Bordetella pertussis
gccaugcggacgccagc

SEQ ID NO: 387566 - RNA, 18 nt, Bordetella pertussis
gccaugcggacgccagcc

SEQ ID NO: 387567 - RNA, 21 nt, Bordetella pertussis
gccaugcggaugaacgaccag

SEQ ID NO: 387568 - RNA, 19 nt, Bordetella pertussis
gccaugcgggucaggccgc

SEQ ID NO: 387569 - RNA, 13 nt, Bordetella pertussis
gccaugcgcgcca

SEQ ID NO: 387570 - RNA, 12 nt, Bordetella pertussis
gccaugcucagc

SEQ ID NO: 387571 - RNA, 16 nt, Bordetella pertussis
gccaugugcgccgcgc

SEQ ID NO: 387572 - RNA, 23 nt, Bordetella pertussis
gccauguggcgacgcccagccug

SEQ ID NO: 387573 - RNA, 16 nt, Bordetella pertussis
gccauguucgaccagg

SEQ ID NO: 387574 - RNA, 16 nt, Bordetella pertussis
gccauugccgcacgau

SEQ ID NO: 387575 - RNA, 16 nt, Bordetella pertussis
gccauugcgcggccug

SEQ ID NO: 387576 - RNA, 15 nt, Bordetella pertussis
gcccaacccggcgag

SEQ ID NO: 387577 - RNA, 22 nt, Bordetella pertussis
gcccaacccggcgaggccgccc

SEQ ID NO: 387578 - RNA, 13 nt, Bordetella pertussis
gcccaacgaggac

SEQ ID NO: 387579 - RNA, 15 nt, Bordetella pertussis
gcccaacgcggcguc

SEQ ID NO: 387580 - RNA, 17 nt, Bordetella pertussis
gcccaaucgggcagcac

SEQ ID NO: 387581 - RNA, 24 nt, Bordetella pertussis
gcccaaugucaccgacgccagcga

SEQ ID NO: 387582 - RNA, 19 nt, Bordetella pertussis
gcccacaaugccccacggg

SEQ ID NO: 387583 - RNA, 16 nt, Bordetella pertussis
gcccacagcacggaau

SEQ ID NO: 387584 - RNA, 14 nt, Bordetella pertussis
gcccacagcgcccc

SEQ ID NO: 387585 - RNA, 16 nt, Bordetella pertussis
gcccacagcgccccca

SEQ ID NO: 387586 - RNA, 20 nt, Bordetella pertussis
gcccacagcgcccccagcac

SEQ ID NO: 387587 - RNA, 19 nt, Bordetella pertussis
gcccacauagcggccggcg

SEQ ID NO: 387588 - RNA, 20 nt, Bordetella pertussis
gcccacauagcggccggcgc

SEQ ID NO: 387589 - RNA, 18 nt, Bordetella pertussis
gcccaccaccagcgcggc

SEQ ID NO: 387590 - RNA, 20 nt, Bordetella pertussis
gcccaccaccagcgcggcca

SEQ ID NO: 387591 - RNA, 23 nt, Bordetella pertussis
gcccaccaccagcgcggccagca

SEQ ID NO: 387592 - RNA, 16 nt, Bordetella pertussis
gcccaccacgccgccc

SEQ ID NO: 387593 - RNA, 13 nt, Bordetella pertussis
gcccaccagccgc

SEQ ID NO: 387594 - RNA, 15 nt, Bordetella pertussis
gcccaccagccgccc

SEQ ID NO: 387595 - RNA, 14 nt, Bordetella pertussis
gcccaccagccggg

SEQ ID NO: 387596 - RNA, 14 nt, Bordetella pertussis
gcccaccagcgcca

SEQ ID NO: 387597 - RNA, 21 nt, Bordetella pertussis
gcccaccagcgccacgccggc

SEQ ID NO: 387598 - RNA, 14 nt, Bordetella pertussis
gcccaccagggacc

SEQ ID NO: 387599 - RNA, 17 nt, Bordetella pertussis
gcccaccagggccagcu

SEQ ID NO: 387600 - RNA, 18 nt, Bordetella pertussis
gcccaccagggccagcuu

SEQ ID NO: 387601 - RNA, 12 nt, Bordetella pertussis
gcccaccagggu

SEQ ID NO: 387602 - RNA, 19 nt, Bordetella pertussis
gcccaccgcaucgcgcagc

SEQ ID NO: 387603 - RNA, 17 nt, Bordetella pertussis
gcccaccgagacgcugu

SEQ ID NO: 387604 - RNA, 19 nt, Bordetella pertussis
gcccaccgccguggccggc

SEQ ID NO: 387605 - RNA, 24 nt, Bordetella pertussis
gcccaccggcaugccguccacgcc

SEQ ID NO: 387606 - RNA, 13 nt, Bordetella pertussis
gcccaccgggccg

SEQ ID NO: 387607 - RNA, 15 nt, Bordetella pertussis
gcccaccgggccggc

SEQ ID NO: 387608 - RNA, 19 nt, Bordetella pertussis
gcccaccgugaccagcgag

SEQ ID NO: 387609 - RNA, 20 nt, Bordetella pertussis
gcccaccgugaccagcgagu

SEQ ID NO: 387610 - RNA, 17 nt, Bordetella pertussis
gcccaccuuccugcugg

SEQ ID NO: 387611 - RNA, 16 nt, Bordetella pertussis
gcccacgaugcgggca

SEQ ID NO: 387612 - RNA, 22 nt, Bordetella pertussis
gcccacgccaucgaacuccugc

SEQ ID NO: 387613 - RNA, 16 nt, Bordetella pertussis
gcccacgccgccuggc

SEQ ID NO: 387614 - RNA, 13 nt, Bordetella pertussis
gcccacgcgccgc

SEQ ID NO: 387615 - RNA, 18 nt, Bordetella pertussis
gcccacgcgccgccaggc

SEQ ID NO: 387616 - RNA, 19 nt, Bordetella pertussis
gcccacgcugucggggugc

SEQ ID NO: 387617 - RNA, 21 nt, Bordetella pertussis
gcccacgcugucggggugccg

SEQ ID NO: 387618 - RNA, 16 nt, Bordetella pertussis
gcccacggcaaaagcc

SEQ ID NO: 387619 - RNA, 19 nt, Bordetella pertussis
gcccacggcaucgccgcgg

SEQ ID NO: 387620 - RNA, 15 nt, Bordetella pertussis
gcccacggccagcac

SEQ ID NO: 387621 - RNA, 22 nt, Bordetella pertussis
gcccacggcgacuuccagcaga

SEQ ID NO: 387622 - RNA, 20 nt, Bordetella pertussis
gcccacguaggcaaagcgcg

SEQ ID NO: 387623 - RNA, 22 nt, Bordetella pertussis
gcccacguaggcaaagcgcggc

SEQ ID NO: 387624 - RNA, 16 nt, Bordetella pertussis
gcccacguaggugguc

SEQ ID NO: 387625 - RNA, 18 nt, Bordetella pertussis
gcccacucacgcaaggcc

SEQ ID NO: 387626 - RNA, 18 nt, Bordetella pertussis
gcccacucagggcggggu

SEQ ID NO: 387627 - RNA, 19 nt, Bordetella pertussis
gcccacucggugcgcgcgc

SEQ ID NO: 387628 - RNA, 22 nt, Bordetella pertussis
gcccacucggugcgcgcgccca

SEQ ID NO: 387629 - RNA, 15 nt, Bordetella pertussis
gcccacugccaggcg

SEQ ID NO: 387630 - RNA, 18 nt, Bordetella pertussis
gcccacugccaggcgagc

SEQ ID NO: 387631 - RNA, 22 nt, Bordetella pertussis
gcccagcaggcuuucgcacagc

SEQ ID NO: 387632 - RNA, 11 nt, Bordetella pertussis
gcccagcaggu

SEQ ID NO: 387633 - RNA, 19 nt, Bordetella pertussis
gcccagcagguccugcacg

SEQ ID NO: 387634 - RNA, 13 nt, Bordetella pertussis
gcccagcaugggg

SEQ ID NO: 387635 - RNA, 12 nt, Bordetella pertussis
gcccagcauggu

SEQ ID NO: 387636 - RNA, 23 nt, Bordetella pertussis
gcccagcauggucggcauggcca

SEQ ID NO: 387637 - RNA, 21 nt, Bordetella pertussis
gcccagcaucaggcccgacuu

SEQ ID NO: 387638 - RNA, 17 nt, Bordetella pertussis
gcccagcaugcgcgcga

SEQ ID NO: 387639 - RNA, 15 nt, Bordetella pertussis
gcccagccacaccag

SEQ ID NO: 387640 - RNA, 18 nt, Bordetella pertussis
gcccagccacaccagguu

SEQ ID NO: 387641 - RNA, 17 nt, Bordetella pertussis
gcccagccagcccuggc

SEQ ID NO: 387642 - RNA, 19 nt, Bordetella pertussis
gcccagccagcccuggccc

SEQ ID NO: 387643 - RNA, 13 nt, Bordetella pertussis
gcccagccaggcg

SEQ ID NO: 387644 - RNA, 16 nt, Bordetella pertussis
gcccagccaggcgcca

SEQ ID NO: 387645 - RNA, 21 nt, Bordetella pertussis
gcccagccaggcgccagcggc

SEQ ID NO: 387646 - RNA, 14 nt, Bordetella pertussis
gcccagccagcggu

SEQ ID NO: 387647 - RNA, 20 nt, Bordetella pertussis
gcccagcuccagcuggcgca

SEQ ID NO: 387648 - RNA, 15 nt, Bordetella pertussis
gcccagcuggcgccc

SEQ ID NO: 387649 - RNA, 23 nt, Bordetella pertussis
gcccagcuggcgccccuuccacc

SEQ ID NO: 387650 - RNA, 18 nt, Bordetella pertussis
gcccagcuugaacaggca

SEQ ID NO: 387651 - RNA, 15 nt, Bordetella pertussis
gcccaggagcaacug

SEQ ID NO: 387652 - RNA, 14 nt, Bordetella pertussis
gcccaggaugcccu

SEQ ID NO: 387653 - RNA, 19 nt, Bordetella pertussis
gcccaggauggcgccagcc

SEQ ID NO: 387654 - RNA, 21 nt, Bordetella pertussis
gcccaggcaaugcgcaggccc

SEQ ID NO: 387655 - RNA, 16 nt, Bordetella pertussis
gcccaggcguccaggc

SEQ ID NO: 387656 - RNA, 19 nt, Bordetella pertussis
gcccaggcguccaggcugc

SEQ ID NO: 387657 - RNA, 10 nt, Bordetella pertussis
gcccaggcaa

SEQ ID NO: 387658 - RNA, 23 nt, Bordetella pertussis
gcccagggcagcggccagaucgg

SEQ ID NO: 387659 - RNA, 14 nt, Bordetella pertussis
gcccagggccgcgc

SEQ ID NO: 387660 - RNA, 17 nt, Bordetella pertussis
gcccagggccgcgccgg

SEQ ID NO: 387661 - RNA, 18 nt, Bordetella pertussis
gcccaggggccggcgcgc

SEQ ID NO: 387662 - RNA, 19 nt, Bordetella pertussis
gcccaggggccggcgcgcc

SEQ ID NO: 387663 - RNA, 23 nt, Bordetella pertussis
gcccaggggccggcgcgccgcgc

SEQ ID NO: 387664 - RNA, 15 nt, Bordetella pertussis
gcccagggugguggc

SEQ ID NO: 387665 - RNA, 17 nt, Bordetella pertussis
gcccagguacaucaucc

SEQ ID NO: 387666 - RNA, 16 nt, Bordetella pertussis
gcccaguugcuggccc

SEQ ID NO: 387667 - RNA, 20 nt, Bordetella pertussis
gcccaguugcuggcccagga

SEQ ID NO: 387668 - RNA, 22 nt, Bordetella pertussis
gcccaguuuuuccuucagcagc

SEQ ID NO: 387669 - RNA, 23 nt, Bordetella pertussis
gcccaucaggugaaacagcagcg

SEQ ID NO: 387670 - RNA, 20 nt, Bordetella pertussis
gcccauccaucugguggugc

SEQ ID NO: 387671 - RNA, 11 nt, Bordetella pertussis
gcccauggcgu

SEQ ID NO: 387672 - RNA, 20 nt, Bordetella pertussis
gcccauggccugcaaccugg

SEQ ID NO: 387673 - RNA, 20 nt, Bordetella pertussis
gcccauguugaacugcaggc

SEQ ID NO: 387674 - RNA, 15 nt, Bordetella pertussis
gcccauuccgagcgg

SEQ ID NO: 387675 - RNA, 24 nt, Bordetella pertussis
gcccauuccgagcgggcccgacag

SEQ ID NO: 387676 - RNA, 16 nt, Bordetella pertussis
gcccauucgcgcaccg

SEQ ID NO: 387677 - RNA, 20 nt, Bordetella pertussis
gcccauugcggcaccugcug

SEQ ID NO: 387678 - RNA, 16 nt, Bordetella pertussis
gcccauugcggcgggc

SEQ ID NO: 387679 - RNA, 14 nt, Bordetella pertussis
gccccauggcaugc

SEQ ID NO: 387680 - RNA, 13 nt, Bordetella pertussis
gccccaugcgcgg

SEQ ID NO: 387681 - RNA, 20 nt, Bordetella pertussis
gccccauugccucgcggcag

SEQ ID NO: 387682 - RNA, 20 nt, Bordetella pertussis
gccccauugggacgccagcc

SEQ ID NO: 387683 - RNA, 22 nt, Bordetella pertussis
gccccauugggacgccagcccg

SEQ ID NO: 387684 - RNA, 16 nt, Bordetella pertussis
gccccauugcgggugg

SEQ ID NO: 387685 - RNA, 23 nt, Bordetella pertussis
gccccauugcgggugggcaucca

SEQ ID NO: 387686 - RNA, 15 nt, Bordetella pertussis
gcccccagcccauag

SEQ ID NO: 387687 - RNA, 15 nt, Bordetella pertussis
gcccccgcgccgcgc

SEQ ID NO: 387688 - RNA, 12 nt, Bordetella pertussis
gcccccgcggcg

SEQ ID NO: 387689 - RNA, 20 nt, Bordetella pertussis
gccccgccagggcggggccg

SEQ ID NO: 387690 - RNA, 20 nt, Bordetella pertussis
gccccgccggaggcacuccg

SEQ ID NO: 387691 - RNA, 17 nt, Bordetella pertussis
gccccgccgggacacac

SEQ ID NO: 387692 - RNA, 19 nt, Bordetella pertussis
gccccgccgggccgcgccc

SEQ ID NO: 387693 - RNA, 20 nt, Bordetella pertussis
gccccgccucgacgaugccc

SEQ ID NO: 387694 - RNA, 22 nt, Bordetella pertussis
gccccgccucgacgaugcccug

SEQ ID NO: 387695 - RNA, 22 nt, Bordetella pertussis
gccccgccugcgccaggugggc

SEQ ID NO: 387696 - RNA, 13 nt, Bordetella pertussis
gccccggcccggc

SEQ ID NO: 387697 - RNA, 16 nt, Bordetella pertussis
gccccggcccggcggg

SEQ ID NO: 387698 - RNA, 18 nt, Bordetella pertussis
gccccggccgcccccgac

SEQ ID NO: 387699 - RNA, 11 nt, Bordetella pertussis
gccccggccgg

SEQ ID NO: 387700 - RNA, 19 nt, Bordetella pertussis
gccccggccgguuccugca

SEQ ID NO: 387701 - RNA, 16 nt, Bordetella pertussis
gccccggccucccgga

SEQ ID NO: 387702 - RNA, 17 nt, Bordetella pertussis
gccccggccucgcggcg

SEQ ID NO: 387703 - RNA, 12 nt, Bordetella pertussis
gccccggcgcgc

SEQ ID NO: 387704 - RNA, 20 nt, Bordetella pertussis
gccccggcgcgcagcgccug

SEQ ID NO: 387705 - RNA, 14 nt, Bordetella pertussis
gccccggcgcgccg

SEQ ID NO: 387706 - RNA, 20 nt, Bordetella pertussis
gccccgguagucgccggcuu

SEQ ID NO: 387707 - RNA, 22 nt, Bordetella pertussis
gccccgucaucgggugcggcgc

SEQ ID NO: 387708 - RNA, 22 nt, Bordetella pertussis
gccccgugccgcggcgcggccc

SEQ ID NO: 387709 - RNA, 16 nt, Bordetella pertussis
gccccguugucgccgc

SEQ ID NO: 387710 - RNA, 20 nt, Bordetella pertussis
gccccguugucgccgcggcc

SEQ ID NO: 387711 - RNA, 16 nt, Bordetella pertussis
gcccgaacggcccauc

SEQ ID NO: 387712 - RNA, 14 nt, Bordetella pertussis
gcccgacgccgcgc

SEQ ID NO: 387713 - RNA, 14 nt, Bordetella pertussis
gcccgacggccagc

SEQ ID NO: 387714 - RNA, 22 nt, Bordetella pertussis
gcccgacggcgccgauccggcg

SEQ ID NO: 387715 - RNA, 14 nt, Bordetella pertussis
gcccgacggcgcgc

SEQ ID NO: 387716 - RNA, 16 nt, Bordetella pertussis
gcccgacuuggugggc

SEQ ID NO: 387717 - RNA, 21 nt, Bordetella pertussis
gcccgacuuggugggcaccuc

SEQ ID NO: 387718 - RNA, 23 nt, Bordetella pertussis
gcccgagaagggcuugaccaggg

SEQ ID NO: 387719 - RNA, 18 nt, Bordetella pertussis
gcccgagagcugcgucuu

SEQ ID NO: 387720 - RNA, 18 nt, Bordetella pertussis
gcccgagauggcgcaggc

SEQ ID NO: 387721 - RNA, 20 nt, Bordetella pertussis
gcccgagcuggccggcgacu

SEQ ID NO: 387722 - RNA, 17 nt, Bordetella pertussis
gcccgaggcacaaggcc

SEQ ID NO: 387723 - RNA, 18 nt, Bordetella pertussis
gcccgaggcacaaggccg

SEQ ID NO: 387724 - RNA, 18 nt, Bordetella pertussis
gcccgaggcgcgcagcac

SEQ ID NO: 387725 - RNA, 14 nt, Bordetella pertussis
gcccgaggcggcgc

SEQ ID NO: 387726 - RNA, 16 nt, Bordetella pertussis
gcccgaucggccggcc

SEQ ID NO: 387727 - RNA, 23 nt, Bordetella pertussis
gcccgaugccgauacgucgcagc

SEQ ID NO: 387728 - RNA, 16 nt, Bordetella pertussis
gcccgccccacggcga

SEQ ID NO: 387729 - RNA, 23 nt, Bordetella pertussis
gcccgccccacggcgagucugaa

SEQ ID NO: 387730 - RNA, 15 nt, Bordetella pertussis
gcccgccccgggcag

SEQ ID NO: 387731 - RNA, 22 nt, Bordetella pertussis
gcccgcccgacgaggagccggc

SEQ ID NO: 387732 - RNA, 14 nt, Bordetella pertussis
gcccgcccgcgagc

SEQ ID NO: 387733 - RNA, 21 nt, Bordetella pertussis
gcccgcccgcgagcggccagc

SEQ ID NO: 387734 - RNA, 22 nt, Bordetella pertussis
gcccgcccgcgagcggccagcc

SEQ ID NO: 387735 - RNA, 18 nt, Bordetella pertussis
gcccgcccuuggucaccg

SEQ ID NO: 387736 - RNA, 22 nt, Bordetella pertussis
gcccgccgccgggcgcgcgccg

SEQ ID NO: 387737 - RNA, 17 nt, Bordetella pertussis
gcccgcgacgcuggcga

SEQ ID NO: 387738 - RNA, 22 nt, Bordetella pertussis
gcccgcgacgcuggcgaugccc

SEQ ID NO: 387739 - RNA, 15 nt, Bordetella pertussis
gcccgcgagcggcca

SEQ ID NO: 387740 - RNA, 18 nt, Bordetella pertussis
gcccgcgagcggccagcc

SEQ ID NO: 387741 - RNA, 14 nt, Bordetella pertussis
gcccgcgccagcgc

SEQ ID NO: 387742 - RNA, 16 nt, Bordetella pertussis
gcccgcgccagcgcca

SEQ ID NO: 387743 - RNA, 14 nt, Bordetella pertussis
gcccgcgcccugcu

SEQ ID NO: 387744 - RNA, 22 nt, Bordetella pertussis
gcccgcgccgaaguugcggccg

SEQ ID NO: 387745 - RNA, 13 nt, Bordetella pertussis
gcccgcgccgcaa

SEQ ID NO: 387746 - RNA, 19 nt, Bordetella pertussis
gcccgcgccguaccugcag

SEQ ID NO: 387747 - RNA, 23 nt, Bordetella pertussis
gcccgcgccguaccugcagcagg

SEQ ID NO: 387748 - RNA, 15 nt, Bordetella pertussis
gcccgcgcgccugca

SEQ ID NO: 387749 - RNA, 16 nt, Bordetella pertussis
gcccgcgcgcgagcug

SEQ ID NO: 387750 - RNA, 17 nt, Bordetella pertussis
gcccgcgcgcguucagg

SEQ ID NO: 387751 - RNA, 18 nt, Bordetella pertussis
gcccgcgcggccagcgcc

SEQ ID NO: 387752 - RNA, 21 nt, Bordetella pertussis
gcccgcgcggccagcgccggc

SEQ ID NO: 387753 - RNA, 17 nt, Bordetella pertussis
gcccgcgcuggcgcagc

SEQ ID NO: 387754 - RNA, 21 nt, Bordetella pertussis
gcccgcgcuggcgcagcaggc

SEQ ID NO: 387755 - RNA, 14 nt, Bordetella pertussis
gcccgcgcuguugc

SEQ ID NO: 387756 - RNA, 13 nt, Bordetella pertussis
gcccgcggccagc

SEQ ID NO: 387757 - RNA, 14 nt, Bordetella pertussis
gcccgcggccagcc

SEQ ID NO: 387758 - RNA, 15 nt, Bordetella pertussis
gcccgcggccagcca

SEQ ID NO: 387759 - RNA, 16 nt, Bordetella pertussis
gcccgcggccagccac

SEQ ID NO: 387760 - RNA, 18 nt, Bordetella pertussis
gcccgcggcgccagcgcu

SEQ ID NO: 387761 - RNA, 16 nt, Bordetella pertussis
gcccgcggcgcccagc

SEQ ID NO: 387762 - RNA, 20 nt, Bordetella pertussis
gcccgcggcgcccagcuggc

SEQ ID NO: 387763 - RNA, 13 nt, Bordetella pertussis
gcccgcggcggcc

SEQ ID NO: 387764 - RNA, 17 nt, Bordetella pertussis
gcccgcgggcgcccggc

SEQ ID NO: 387765 - RNA, 19 nt, Bordetella pertussis
gcccgcgggcgcccggccg

SEQ ID NO: 387766 - RNA, 21 nt, Bordetella pertussis
gcccgcgggcgcccggccggc

SEQ ID NO: 387767 - RNA, 16 nt, Bordetella pertussis
gcccgcgguccagcac

SEQ ID NO: 387768 - RNA, 13 nt, Bordetella pertussis
gcccgcguccacc

SEQ ID NO: 387769 - RNA, 14 nt, Bordetella pertussis
gcccgcguccacca

SEQ ID NO: 387770 - RNA, 19 nt, Bordetella pertussis
gcccgcgugacggccgcca

SEQ ID NO: 387771 - RNA, 19 nt, Bordetella pertussis
gcccgcguucaggcgcggc

SEQ ID NO: 387772 - RNA, 22 nt, Bordetella pertussis
gcccgcuacgcgggcuugcugc

SEQ ID NO: 387773 - RNA, 15 nt, Bordetella pertussis
gcccgcuccaccagc

SEQ ID NO: 387774 - RNA, 18 nt, Bordetella pertussis
gcccgcuccaccagcacc

SEQ ID NO: 387775 - RNA, 16 nt, Bordetella pertussis
gcccgcuccaggcggc

SEQ ID NO: 387776 - RNA, 20 nt, Bordetella pertussis
gcccgcuccaggcggccagu

SEQ ID NO: 387777 - RNA, 15 nt, Bordetella pertussis
gcccgcucggccagc

SEQ ID NO: 387778 - RNA, 18 nt, Bordetella pertussis
gcccgcucggccagcagu

SEQ ID NO: 387779 - RNA, 22 nt, Bordetella pertussis
gcccgcugccgagacggccgcc

SEQ ID NO: 387780 - RNA, 12 nt, Bordetella pertussis
gcccgcuggcca

SEQ ID NO: 387781 - RNA, 14 nt, Bordetella pertussis
gcccgcuggccaug

SEQ ID NO: 387782 - RNA, 13 nt, Bordetella pertussis
gcccgcuggccga

SEQ ID NO: 387783 - RNA, 17 nt, Bordetella pertussis
gcccgcugcguccacca

SEQ ID NO: 387784 - RNA, 22 nt, Bordetella pertussis
gcccgcuugggccgcgccugca

SEQ ID NO: 387785 - RNA, 19 nt, Bordetella pertussis
gcccggauauggccggcgc

SEQ ID NO: 387786 - RNA, 21 nt, Bordetella pertussis
gcccggauauggccggcgcgc

SEQ ID NO: 387787 - RNA, 22 nt, Bordetella pertussis
gcccggauauggccggcgcgcu

SEQ ID NO: 387788 - RNA, 23 nt, Bordetella pertussis
gcccggaucauccgggcccgguu

SEQ ID NO: 387789 - RNA, 23 nt, Bordetella pertussis
gcccggaucgcacccgucccugg

SEQ ID NO: 387790 - RNA, 14 nt, Bordetella pertussis
gcccggcaacccgc

SEQ ID NO: 387791 - RNA, 14 nt, Bordetella pertussis
gcccggcacggagg

SEQ ID NO: 387792 - RNA, 21 nt, Bordetella pertussis
gcccggcaggucgaugcccuc

SEQ ID NO: 387793 - RNA, 15 nt, Bordetella pertussis
gcccggccacggccg

SEQ ID NO: 387794 - RNA, 20 nt, Bordetella pertussis
gcccggccacggccgggccu

SEQ ID NO: 387795 - RNA, 17 nt, Bordetella pertussis
gcccggcccccagccca

SEQ ID NO: 387796 - RNA, 15 nt, Bordetella pertussis
gcccggccgcagggc

SEQ ID NO: 387797 - RNA, 14 nt, Bordetella pertussis
gcccggccgccagc

SEQ ID NO: 387798 - RNA, 20 nt, Bordetella pertussis
gcccggccgccucaccgcgc

SEQ ID NO: 387799 - RNA, 22 nt, Bordetella pertussis
gcccggccggcaaggggccagc

SEQ ID NO: 387800 - RNA, 23 nt, Bordetella pertussis
gcccggccggcaaggggccagcc

SEQ ID NO: 387801 - RNA, 14 nt, Bordetella pertussis
gcccggccggcccu

SEQ ID NO: 387802 - RNA, 21 nt, Bordetella pertussis
gcccggcgagguugcaggcca

SEQ ID NO: 387803 - RNA, 18 nt, Bordetella pertussis
gcccggcgcgacaggcgg

SEQ ID NO: 387804 - RNA, 13 nt, Bordetella pertussis
gcccggcgcgcca

SEQ ID NO: 387805 - RNA, 16 nt, Bordetella pertussis
gcccggcggccaggcc

SEQ ID NO: 387806 - RNA, 20 nt, Bordetella pertussis
gcccggcggccaggccggcg

SEQ ID NO: 387807 - RNA, 16 nt, Bordetella pertussis
gcccggcggcgcgccg

SEQ ID NO: 387808 - RNA, 17 nt, Bordetella pertussis
gcccggcggcgcgccgc

SEQ ID NO: 387809 - RNA, 19 nt, Bordetella pertussis
gcccggcggcgcgccgccg

SEQ ID NO: 387810 - RNA, 18 nt, Bordetella pertussis
gcccggcggcgcggcgag

SEQ ID NO: 387811 - RNA, 19 nt, Bordetella pertussis
gcccggcgggaacaggcac

SEQ ID NO: 387812 - RNA, 20 nt, Bordetella pertussis
gcccggcgggaacaggcacc

SEQ ID NO: 387813 - RNA, 13 nt, Bordetella pertussis
gcccggcgggccg

SEQ ID NO: 387814 - RNA, 19 nt, Bordetella pertussis
gcccggcgucgggucagcc

SEQ ID NO: 387815 - RNA, 23 nt, Bordetella pertussis
gcccggcgucgggucagccuugc

SEQ ID NO: 387816 - RNA, 13 nt, Bordetella pertussis
gcccggcggcgcg

SEQ ID NO: 387817 - RNA, 16 nt, Bordetella pertussis
gcccggcucgccgagc

SEQ ID NO: 387818 - RNA, 22 nt, Bordetella pertussis
gcccggcuucgaucaugcccgc

SEQ ID NO: 387819 - RNA, 18 nt, Bordetella pertussis
gcccgggaaacucgcgca

SEQ ID NO: 387820 - RNA, 12 nt, Bordetella pertussis
gcccgggcacca

SEQ ID NO: 387821 - RNA, 22 nt, Bordetella pertussis
gcccgggcaccagguccuggcg

SEQ ID NO: 387822 - RNA, 13 nt, Bordetella pertussis
gcccgggcagcac

SEQ ID NO: 387823 - RNA, 14 nt, Bordetella pertussis
gcccgggcaugcga

SEQ ID NO: 387824 - RNA, 19 nt, Bordetella pertussis
gcccgggcaggcucagccc

SEQ ID NO: 387825 - RNA, 13 nt, Bordetella pertussis
gcccgggccggcu

SEQ ID NO: 387826 - RNA, 21 nt, Bordetella pertussis
gcccgggcgagauggcgugca

SEQ ID NO: 387827 - RNA, 21 nt, Bordetella pertussis
gcccugccgccaagggcgcgc

SEQ ID NO: 387828 - RNA, 16 nt, Bordetella pertussis
gcccugccgcccuggc

SEQ ID NO: 387829 - RNA, 20 nt, Bordetella pertussis
gcccugccgcccuggcgcag

SEQ ID NO: 387830 - RNA, 16 nt, Bordetella pertussis
gcccugccgccucagc

SEQ ID NO: 387831 - RNA, 21 nt, Bordetella pertussis
gcccugcggcgcggccagcac

SEQ ID NO: 387832 - RNA, 17 nt, Bordetella pertussis
gcccugcguggcgcagu

SEQ ID NO: 387833 - RNA, 18 nt, Bordetella pertussis
gcccugcgugugccuguc

SEQ ID NO: 387834 - RNA, 20 nt, Bordetella pertussis
gcccugcucgaucugguugg

SEQ ID NO: 387835 - RNA, 16 nt, Bordetella pertussis
gcccugcugcugcagc

SEQ ID NO: 387836 - RNA, 18 nt, Bordetella pertussis
gcccugcugcugcagcca

SEQ ID NO: 387837 - RNA, 17 nt, Bordetella pertussis
gcccugcugcccgccgc

SEQ ID NO: 387838 - RNA, 14 nt, Bordetella pertussis
gcccugcuggcgca

SEQ ID NO: 387839 - RNA, 19 nt, Bordetella pertussis
gcccuggagaucgccgccg

SEQ ID NO: 387840 - RNA, 15 nt, Bordetella pertussis
gcccuggauggccug

SEQ ID NO: 387841 - RNA, 15 nt, Bordetella pertussis
gcccuggauggcggc

SEQ ID NO: 387842 - RNA, 18 nt, Bordetella pertussis
gcccuggauggcggccgc

SEQ ID NO: 387843 - RNA, 12 nt, Bordetella pertussis
gcccuggggcgc

SEQ ID NO: 387844 - RNA, 20 nt, Bordetella pertussis
gcccuggaucaggaugggcg

SEQ ID NO: 387845 - RNA, 14 nt, Bordetella pertussis
gcccuggguggcgg

SEQ ID NO: 387846 - RNA, 23 nt, Bordetella pertussis
gcccuggucaucgccaugcugcc

SEQ ID NO: 387847 - RNA, 18 nt, Bordetella pertussis
gcccugguggcagagggc

SEQ ID NO: 387848 - RNA, 23 nt, Bordetella pertussis
gcccugugugcauuuuccucggc

SEQ ID NO: 387849 - RNA, 16 nt, Bordetella pertussis
gcccuguucgcgcggc

SEQ ID NO: 387850 - RNA, 20 nt, Bordetella pertussis
gcccuugagcacggcgcggc

SEQ ID NO: 387851 - RNA, 21 nt, Bordetella pertussis
gcccuugccagggccuggcac

SEQ ID NO: 387852 - RNA, 19 nt, Bordetella pertussis
gcccuugcgcgaacggcag

SEQ ID NO: 387853 - RNA, 21 nt, Bordetella pertussis
gcccuugcgcgaaggccgccc

SEQ ID NO: 387854 - RNA, 15 nt, Bordetella pertussis
gccgaaauggcggcg

SEQ ID NO: 387855 - RNA, 18 nt, Bordetella pertussis
gccgaacaagguccaggc

SEQ ID NO: 387856 - RNA, 22 nt, Bordetella pertussis
gccgaacaccagcucggcggcg

SEQ ID NO: 387857 - RNA, 21 nt, Bordetella pertussis
gccgaacagccagggcagggc

SEQ ID NO: 387858 - RNA, 16 nt, Bordetella pertussis
gccgaaccagaucagg

SEQ ID NO: 387859 - RNA, 20 nt, Bordetella pertussis
gccgaacggcagcagcgcgc

SEQ ID NO: 387860 - RNA, 13 nt, Bordetella pertussis
gccgaacgccgcc

SEQ ID NO: 387861 - RNA, 23 nt, Bordetella pertussis
gccgaacucgcgcucggccagcg

SEQ ID NO: 387862 - RNA, 15 nt, Bordetella pertussis
gccgaaucggccccu

SEQ ID NO: 387863 - RNA, 17 nt, Bordetella pertussis
gccgaaugcccgcccuu

SEQ ID NO: 387864 - RNA, 23 nt, Bordetella pertussis
gccgaauucguuggugcccagcg

SEQ ID NO: 387865 - RNA, 14 nt, Bordetella pertussis
gccgaauugccgcc

SEQ ID NO: 387866 - RNA, 17 nt, Bordetella pertussis
gccgaauugcuggagcg

SEQ ID NO: 387867 - RNA, 20 nt, Bordetella pertussis
gccgaauugcuggagcgcca

SEQ ID NO: 387868 - RNA, 15 nt, Bordetella pertussis
gccgaccaccugcac

SEQ ID NO: 387869 - RNA, 22 nt, Bordetella pertussis
gccgaccacgcugggccagacc

SEQ ID NO: 387870 - RNA, 13 nt, Bordetella pertussis
gccgaccagcacg

SEQ ID NO: 387871 - RNA, 20 nt, Bordetella pertussis
gccgaccagcacgauccagc

SEQ ID NO: 387872 - RNA, 15 nt, Bordetella pertussis
gccgaccaggccggc

SEQ ID NO: 387873 - RNA, 18 nt, Bordetella pertussis
gccgaccaggccggcggc

SEQ ID NO: 387874 - RNA, 14 nt, Bordetella pertussis
gccgaccaggcugc

SEQ ID NO: 387875 - RNA, 20 nt, Bordetella pertussis
gccgaccaggcugcgcgccg

SEQ ID NO: 387876 - RNA, 19 nt, Bordetella pertussis
gccgaccagcucgacgcca

SEQ ID NO: 387877 - RNA, 21 nt, Bordetella pertussis
gccgaccauguggcagauggc

SEQ ID NO: 387878 - RNA, 19 nt, Bordetella pertussis
gccgacccgagcccuggcu

SEQ ID NO: 387879 - RNA, 12 nt, Bordetella pertussis
gccgacccgggc

SEQ ID NO: 387880 - RNA, 23 nt, Bordetella pertussis
gccgaccgcuuccgccaccgcgc

SEQ ID NO: 387881 - RNA, 20 nt, Bordetella pertussis
gccgaccgggccgaccaggc

SEQ ID NO: 387882 - RNA, 21 nt, Bordetella pertussis
gccgaccgggccgaccaggcc

SEQ ID NO: 387883 - RNA, 20 nt, Bordetella pertussis
gccgacguagucgcgccagc

SEQ ID NO: 387884 - RNA, 15 nt, Bordetella pertussis
gccgacuaugcuuua

SEQ ID NO: 387885 - RNA, 21 nt, Bordetella pertussis
gccgacucgaaacgggcggcg

SEQ ID NO: 387886 - RNA, 17 nt, Bordetella pertussis
gccgacuucagacagac

SEQ ID NO: 387887 - RNA, 21 nt, Bordetella pertussis
gccgagaagauuucccagagc

SEQ ID NO: 387888 - RNA, 16 nt, Bordetella pertussis
gccgagaugccguucu

SEQ ID NO: 387889 - RNA, 19 nt, Bordetella pertussis
gccgagccuggcguagggc

SEQ ID NO: 387890 - RNA, 15 nt, Bordetella pertussis
gccgagcgcgccagc

SEQ ID NO: 387891 - RNA, 13 nt, Bordetella pertussis
gccgagcgcggca

SEQ ID NO: 387892 - RNA, 15 nt, Bordetella pertussis
gccgagcgggccagc

SEQ ID NO: 387893 - RNA, 17 nt, Bordetella pertussis
gccgagcgggccagcgc

SEQ ID NO: 387894 - RNA, 15 nt, Bordetella pertussis
gccgagcuccucgag

SEQ ID NO: 387895 - RNA, 14 nt, Bordetella pertussis
gccgaggccagguu

SEQ ID NO: 387896 - RNA, 13 nt, Bordetella pertussis
gccgaggcgccgc

SEQ ID NO: 387897 - RNA, 16 nt, Bordetella pertussis
gccgaggcgccgccgu

SEQ ID NO: 387898 - RNA, 15 nt, Bordetella pertussis
gccgaggcgggcagc

SEQ ID NO: 387899 - RNA, 15 nt, Bordetella pertussis
gccgauacaggcgcu

SEQ ID NO: 387900 - RNA, 18 nt, Bordetella pertussis
gccgauaccacgcgcggc

SEQ ID NO: 387901 - RNA, 22 nt, Bordetella pertussis
gccgauaccacgcgcggcggcg

SEQ ID NO: 387902 - RNA, 23 nt, Bordetella pertussis
gccgauaccacgcgcggcggcgg

SEQ ID NO: 387903 - RNA, 15 nt, Bordetella pertussis
gccgauacgcgugcg

SEQ ID NO: 387904 - RNA, 15 nt, Bordetella pertussis
gccgauacgggcgcg

SEQ ID NO: 387905 - RNA, 17 nt, Bordetella pertussis
gccgauagccgcggcgc

SEQ ID NO: 387906 - RNA, 21 nt, Bordetella pertussis
gccgaucgagcaggccgccgg

SEQ ID NO: 387907 - RNA, 19 nt, Bordetella pertussis
gccgaucggcuugccgcgc

SEQ ID NO: 387908 - RNA, 17 nt, Bordetella pertussis
gccgaucugcugggccg

SEQ ID NO: 387909 - RNA, 18 nt, Bordetella pertussis
gccgaugacaucgccgcu

SEQ ID NO: 387910 - RNA, 16 nt, Bordetella pertussis
gccgauuucgccgccg

SEQ ID NO: 387911 - RNA, 15 nt, Bordetella pertussis
gccgauuucgcgcgc

SEQ ID NO: 387912 - RNA, 15 nt, Bordetella pertussis
gccgcaacccacccc

SEQ ID NO: 387913 - RNA, 23 nt, Bordetella pertussis
gccgcaacccgcuuuuuccugcu

SEQ ID NO: 387914 - RNA, 15 nt, Bordetella pertussis
gccgcaacgccgccg

SEQ ID NO: 387915 - RNA, 17 nt, Bordetella pertussis
gccgcaacgccgggccg

SEQ ID NO: 387916 - RNA, 15 nt, Bordetella pertussis
gccgcaagcuggccg

SEQ ID NO: 387917 - RNA, 14 nt, Bordetella pertussis
gccgcaagcuggcg

SEQ ID NO: 387918 - RNA, 13 nt, Bordetella pertussis
gccgcacgcgcgg

SEQ ID NO: 387919 - RNA, 13 nt, Bordetella pertussis
gccgcacgcggcc

SEQ ID NO: 387920 - RNA, 17 nt, Bordetella pertussis
gccgcacgguggcgccg

SEQ ID NO: 387921 - RNA, 15 nt, Bordetella pertussis
gccgcacgggcgccu

SEQ ID NO: 387922 - RNA, 16 nt, Bordetella pertussis
gccgcagaacagcagc

SEQ ID NO: 387923 - RNA, 15 nt, Bordetella pertussis
gccgcagauggccag

SEQ ID NO: 387924 - RNA, 16 nt, Bordetella pertussis
gccgcagauggccagc

SEQ ID NO: 387925 - RNA, 22 nt, Bordetella pertussis
gccgcagauggcguaggcggcc

SEQ ID NO: 387926 - RNA, 23 nt, Bordetella pertussis
gccgcagauggcguaggcggccu

SEQ ID NO: 387927 - RNA, 23 nt, Bordetella pertussis
gccgcagcaggcgcucggccagc

SEQ ID NO: 387928 - RNA, 15 nt, Bordetella pertussis
gccgcagcauggcgc

SEQ ID NO: 387929 - RNA, 14 nt, Bordetella pertussis
gccgcagcccgcgc

SEQ ID NO: 387930 - RNA, 18 nt, Bordetella pertussis
gccgcagcccgcgcgccu

SEQ ID NO: 387931 - RNA, 19 nt, Bordetella pertussis
gccgcagcccgcgcgccug

SEQ ID NO: 387932 - RNA, 22 nt, Bordetella pertussis
gccgcagccgccagcgccugga

SEQ ID NO: 387933 - RNA, 18 nt, Bordetella pertussis
gccgcagcgaggugguga

SEQ ID NO: 387934 - RNA, 13 nt, Bordetella pertussis
gccgcagcggcca

SEQ ID NO: 387935 - RNA, 14 nt, Bordetella pertussis
gccgcagcgggccc

SEQ ID NO: 387936 - RNA, 17 nt, Bordetella pertussis
gccgcagcgucgcggcg

SEQ ID NO: 387937 - RNA, 19 nt, Bordetella pertussis
gccgcauaccuuggcgccc

SEQ ID NO: 387938 - RNA, 23 nt, Bordetella pertussis
gccgcauaccuuggcgcccagcu

SEQ ID NO: 387939 - RNA, 22 nt, Bordetella pertussis
gccgcaucccgcccccgccgca

SEQ ID NO: 387940 - RNA, 15 nt, Bordetella pertussis
gccgcaugccggcga

SEQ ID NO: 387941 - RNA, 15 nt, Bordetella pertussis
gccgcaugccgggcu

SEQ ID NO: 387942 - RNA, 18 nt, Bordetella pertussis
gccgcaugccgggcugca

SEQ ID NO: 387943 - RNA, 15 nt, Bordetella pertussis
gccgcaugcggcggc

SEQ ID NO: 387944 - RNA, 15 nt, Bordetella pertussis
gccgcauggcggccc

SEQ ID NO: 387945 - RNA, 17 nt, Bordetella pertussis
gccgcauggcggcccug

SEQ ID NO: 387946 - RNA, 14 nt, Bordetella pertussis
gccgcaugggcgcg

SEQ ID NO: 387947 - RNA, 19 nt, Bordetella pertussis
gccgcauugggacgcggcc

SEQ ID NO: 387948 - RNA, 20 nt, Bordetella pertussis
gccgcauugggacgcggccu

SEQ ID NO: 387949 - RNA, 18 nt, Bordetella pertussis
gccgcauuuccucgacca

SEQ ID NO: 387950 - RNA, 12 nt, Bordetella pertussis
gccgccaccucg

SEQ ID NO: 387951 - RNA, 16 nt, Bordetella pertussis
gccgccaccugggccg

SEQ ID NO: 387952 - RNA, 19 nt, Bordetella pertussis
gccgccaccugggccgccu

SEQ ID NO: 387953 - RNA, 14 nt, Bordetella pertussis
gccgccacgcuggc

SEQ ID NO: 387954 - RNA, 15 nt, Bordetella pertussis
gccgccacgcuggcc

SEQ ID NO: 387955 - RNA, 15 nt, Bordetella pertussis
gccgccacgggcccg

SEQ ID NO: 387956 - RNA, 12 nt, Bordetella pertussis
gccgccagcagc

SEQ ID NO: 387957 - RNA, 15 nt, Bordetella pertussis
gccgccagcaccugc

SEQ ID NO: 387958 - RNA, 19 nt, Bordetella pertussis
gccgcccgacagcacgccc

SEQ ID NO: 387959 - RNA, 16 nt, Bordetella pertussis
gccgcccgagcuggcc

SEQ ID NO: 387960 - RNA, 13 nt, Bordetella pertussis
gccgcccgcaagg

SEQ ID NO: 387961 - RNA, 14 nt, Bordetella pertussis
gccgcccgcaagga

SEQ ID NO: 387962 - RNA, 14 nt, Bordetella pertussis
gccgcccgcaggca

SEQ ID NO: 387963 - RNA, 14 nt, Bordetella pertussis
gccgcccgcaugca

SEQ ID NO: 387964 - RNA, 20 nt, Bordetella pertussis
gccgcccgcaugcagguccu

SEQ ID NO: 387965 - RNA, 14 nt, Bordetella pertussis
gccgcccgccaggc

SEQ ID NO: 387966 - RNA, 15 nt, Bordetella pertussis
gccgcccgccaggcc

SEQ ID NO: 387967 - RNA, 16 nt, Bordetella pertussis
gccgcccgcccgccgc

SEQ ID NO: 387968 - RNA, 17 nt, Bordetella pertussis
gccgcccgccucaggcc

SEQ ID NO: 387969 - RNA, 13 nt, Bordetella pertussis
gccgcccgcggcc

SEQ ID NO: 387970 - RNA, 14 nt, Bordetella pertussis
gccgcccgcggcca

SEQ ID NO: 387971 - RNA, 16 nt, Bordetella pertussis
gccgcccgcggccagc

SEQ ID NO: 387972 - RNA, 17 nt, Bordetella pertussis
gccgcccgcggccagcc

SEQ ID NO: 387973 - RNA, 20 nt, Bordetella pertussis
gccgcccggaugggcggccu

SEQ ID NO: 387974 - RNA, 15 nt, Bordetella pertussis
gccgcccggcagcug

SEQ ID NO: 387975 - RNA, 16 nt, Bordetella pertussis
gccgccgcagccgcca

SEQ ID NO: 387976 - RNA, 19 nt, Bordetella pertussis
gccgccgccaccagcggcg

SEQ ID NO: 387977 - RNA, 19 nt, Bordetella pertussis
gccgccgccagcgcgccgc

SEQ ID NO: 387978 - RNA, 21 nt, Bordetella pertussis
gccgccgccauagcugcgcca

SEQ ID NO: 387979 - RNA, 14 nt, Bordetella pertussis
gccgccgccauggu

SEQ ID NO: 387980 - RNA, 12 nt, Bordetella pertussis
gccgccgcccgc

SEQ ID NO: 387981 - RNA, 18 nt, Bordetella pertussis
gccgccgcccgcccgccg

SEQ ID NO: 387982 - RNA, 13 nt, Bordetella pertussis
gccgccgcccugc

SEQ ID NO: 387983 - RNA, 15 nt, Bordetella pertussis
gccgccgccgcgcgc

SEQ ID NO: 387984 - RNA, 13 nt, Bordetella pertussis
gccgccgccgcgg

SEQ ID NO: 387985 - RNA, 15 nt, Bordetella pertussis
gccgccgccgcggcc

SEQ ID NO: 387986 - RNA, 17 nt, Bordetella pertussis
gccgccgccgcggccug

SEQ ID NO: 387987 - RNA, 16 nt, Bordetella pertussis
gccgccgccggcccgc

SEQ ID NO: 387988 - RNA, 15 nt, Bordetella pertussis
gccgccgccggcgcg

SEQ ID NO: 387989 - RNA, 16 nt, Bordetella pertussis
gccgccgcgcccagca

SEQ ID NO: 387990 - RNA, 12 nt, Bordetella pertussis
gccgccgcgccg

SEQ ID NO: 387991 - RNA, 13 nt, Bordetella pertussis
gccgccgcgcgcc

SEQ ID NO: 387992 - RNA, 14 nt, Bordetella pertussis
gccgccgcgcgccg

SEQ ID NO: 387993 - RNA, 21 nt, Bordetella pertussis
gccgccgcgcucaccgagggc

SEQ ID NO: 387994 - RNA, 22 nt, Bordetella pertussis
gccgccgcgcucaccgagggcc

SEQ ID NO: 387995 - RNA, 12 nt, Bordetella pertussis
gccgccgcggcc

SEQ ID NO: 387996 - RNA, 17 nt, Bordetella pertussis
gccgccgcggccucggc

SEQ ID NO: 387997 - RNA, 18 nt, Bordetella pertussis
gccgccgcggccucggcc

SEQ ID NO: 387998 - RNA, 16 nt, Bordetella pertussis
gccgccgcggccuggc

SEQ ID NO: 387999 - RNA, 17 nt, Bordetella pertussis
gccgccgcggccuggcc

SEQ ID NO: 388000 - RNA, 11 nt, Bordetella pertussis
gccgccggccu

SEQ ID NO: 388001 - RNA, 13 nt, Bordetella pertussis
gccgccggccucu

SEQ ID NO: 388002 - RNA, 13 nt, Bordetella pertussis
gccgccggccugc

SEQ ID NO: 388003 - RNA, 16 nt, Bordetella pertussis
gccgccggccugcugc

SEQ ID NO: 388004 - RNA, 20 nt, Bordetella pertussis
gccgccggcgaugaucgccu

SEQ ID NO: 388005 - RNA, 17 nt, Bordetella pertussis
gccgccggcgcacccgg

SEQ ID NO: 388006 - RNA, 16 nt, Bordetella pertussis
gccgccggcggcgcac

SEQ ID NO: 388007 - RNA, 12 nt, Bordetella pertussis
gccgccggcggg

SEQ ID NO: 388008 - RNA, 15 nt, Bordetella pertussis
gccgccggcgugccc

SEQ ID NO: 388009 - RNA, 15 nt, Bordetella pertussis
gccgccgggccugcc

SEQ ID NO: 388010 - RNA, 20 nt, Bordetella pertussis
gccgccgugaugccgcccgc

SEQ ID NO: 388011 - RNA, 17 nt, Bordetella pertussis
gccgccgugcgcgggcg

SEQ ID NO: 388012 - RNA, 20 nt, Bordetella pertussis
gccgccguuuucgcccgccc

SEQ ID NO: 388013 - RNA, 22 nt, Bordetella pertussis
gccgccguuuucgcccgcccac

SEQ ID NO: 388014 - RNA, 15 nt, Bordetella pertussis
gccgccuggccagau

SEQ ID NO: 388015 - RNA, 16 nt, Bordetella pertussis
gccgccuggcgcggcg

SEQ ID NO: 388016 - RNA, 18 nt, Bordetella pertussis
gccgccuggcgcggcgcc

SEQ ID NO: 388017 - RNA, 20 nt, Bordetella pertussis
gccgccuucaccggccccau

SEQ ID NO: 388018 - RNA, 15 nt, Bordetella pertussis
gccgccuucccaggc

SEQ ID NO: 388019 - RNA, 23 nt, Bordetella pertussis
gccgcgaacagauccacgcccgc

SEQ ID NO: 388020 - RNA, 15 nt, Bordetella pertussis
gccgcgaacgcgccg

SEQ ID NO: 388021 - RNA, 21 nt, Bordetella pertussis
gccgcgacacaaggcggccgc

SEQ ID NO: 388022 - RNA, 16 nt, Bordetella pertussis
gccgcgaucagcgcgg

SEQ ID NO: 388023 - RNA, 18 nt, Bordetella pertussis
gccgcgaucagcgcggcc

SEQ ID NO: 388024 - RNA, 19 nt, Bordetella pertussis
gccgcgaucagcgcggccg

SEQ ID NO: 388025 - RNA, 20 nt, Bordetella pertussis
gccgcgaucagcgcggccgc

SEQ ID NO: 388026 - RNA, 22 nt, Bordetella pertussis
gccgcgauauccuugcgcucgc

SEQ ID NO: 388027 - RNA, 18 nt, Bordetella pertussis
gccgcgaugucgcgcgcg

SEQ ID NO: 388028 - RNA, 19 nt, Bordetella pertussis
gccgcgaugucgcgcgcgc

SEQ ID NO: 388029 - RNA, 16 nt, Bordetella pertussis
gccgcgcaaggccugc

SEQ ID NO: 388030 - RNA, 18 nt, Bordetella pertussis
gccgcgcaaggcggcccg

SEQ ID NO: 388031 - RNA, 21 nt, Bordetella pertussis
gccgcgcaaggcggcccggcc

SEQ ID NO: 388032 - RNA, 19 nt, Bordetella pertussis
gccgcgcacacauggcgca

SEQ ID NO: 388033 - RNA, 17 nt, Bordetella pertussis
gccgcgcacgggcgccu

SEQ ID NO: 388034 - RNA, 18 nt, Bordetella pertussis
gccgcgcacgggcgccug

SEQ ID NO: 388035 - RNA, 20 nt, Bordetella pertussis
gccgcgcacgauggggcagc

SEQ ID NO: 388036 - RNA, 21 nt, Bordetella pertussis
gccgcgccccuagcgccgcgc

SEQ ID NO: 388037 - RNA, 11 nt, Bordetella pertussis
gccgcgcccgc

SEQ ID NO: 388038 - RNA, 14 nt, Bordetella pertussis
gccgcgcccgcccc

SEQ ID NO: 388039 - RNA, 16 nt, Bordetella pertussis
gccgcgcccgccgcgc

SEQ ID NO: 388040 - RNA, 23 nt, Bordetella pertussis
gccgcgcccgcuugcggccggcg

SEQ ID NO: 388041 - RNA, 18 nt, Bordetella pertussis
gccgcgcagcacgcccgc

SEQ ID NO: 388042 - RNA, 15 nt, Bordetella pertussis
gccgcgcccggcggc

SEQ ID NO: 388043 - RNA, 16 nt, Bordetella pertussis
gccgcgcccggcggcc

SEQ ID NO: 388044 - RNA, 18 nt, Bordetella pertussis
gccgcgcccggcggccag

SEQ ID NO: 388045 - RNA, 14 nt, Bordetella pertussis
gccgcgcccggccg

SEQ ID NO: 388046 - RNA, 16 nt, Bordetella pertussis
gccgcgcccuggcgcg

SEQ ID NO: 388047 - RNA, 18 nt, Bordetella pertussis
gccgcgcccuggcgcggc

SEQ ID NO: 388048 - RNA, 19 nt, Bordetella pertussis
gccgcgcccuggcgcggcg

SEQ ID NO: 388049 - RNA, 17 nt, Bordetella pertussis
gccgcgccgaacgcgca

SEQ ID NO: 388050 - RNA, 14 nt, Bordetella pertussis
gccgcgccgaaggc

SEQ ID NO: 388051 - RNA, 12 nt, Bordetella pertussis
gccgcgccgccc

SEQ ID NO: 388052 - RNA, 13 nt, Bordetella pertussis
gccgcgccgcccc

SEQ ID NO: 388053 - RNA, 16 nt, Bordetella pertussis
gccgcgccgccgcccu

SEQ ID NO: 388054 - RNA, 16 nt, Bordetella pertussis
gccgcgccgccgccug

SEQ ID NO: 388055 - RNA, 14 nt, Bordetella pertussis
gccgcgccgcggca

SEQ ID NO: 388056 - RNA, 13 nt, Bordetella pertussis
gccgcgccgcggc

SEQ ID NO: 388057 - RNA, 22 nt, Bordetella pertussis
gccgcgcgcuuccucgaccagg

SEQ ID NO: 388058 - RNA, 22 nt, Bordetella pertussis
gccgcgcgguacgcaccgccgc

SEQ ID NO: 388059 - RNA, 17 nt, Bordetella pertussis
gccgcgcguaugcaccg

SEQ ID NO: 388060 - RNA, 20 nt, Bordetella pertussis
gccgcgcgugcggggcggca

SEQ ID NO: 388061 - RNA, 13 nt, Bordetella pertussis
gccgcgcucagcc

SEQ ID NO: 388062 - RNA, 16 nt, Bordetella pertussis
gccgcgcucaggccgc

SEQ ID NO: 388063 - RNA, 19 nt, Bordetella pertussis
gccgcgcuccagggcgucg

SEQ ID NO: 388064 - RNA, 19 nt, Bordetella pertussis
gccgcgcucgcgccaggcc

SEQ ID NO: 388065 - RNA, 17 nt, Bordetella pertussis
gccgcgcucggcgcugc

SEQ ID NO: 388066 - RNA, 19 nt, Bordetella pertussis
gccgcgcucggcgcugccg

SEQ ID NO: 388067 - RNA, 18 nt, Bordetella pertussis
gccgcgcugauccuggcu

SEQ ID NO: 388068 - RNA, 22 nt, Bordetella pertussis
gccgcgcugcugcaggccggcg

SEQ ID NO: 388069 - RNA, 13 nt, Bordetella pertussis
gccgcgcuggugc

SEQ ID NO: 388070 - RNA, 16 nt, Bordetella pertussis
gccgcgcugggcgcug

SEQ ID NO: 388071 - RNA, 14 nt, Bordetella pertussis
gccgcggccgcccc

SEQ ID NO: 388072 - RNA, 13 nt, Bordetella pertussis
gccgcggccgccg

SEQ ID NO: 388073 - RNA, 14 nt, Bordetella pertussis
gccgcggccgccgu

SEQ ID NO: 388074 - RNA, 16 nt, Bordetella pertussis
gccgcggccggcggcg

SEQ ID NO: 388075 - RNA, 13 nt, Bordetella pertussis
gccgcggccucgg

SEQ ID NO: 388076 - RNA, 15 nt, Bordetella pertussis
gccgcggccuggccg

SEQ ID NO: 388077 - RNA, 21 nt, Bordetella pertussis
gccgcggcgaugccggccagc

SEQ ID NO: 388078 - RNA, 13 nt, Bordetella pertussis
gccgcggcgccgc

SEQ ID NO: 388079 - RNA, 15 nt, Bordetella pertussis
gccgcggcgcgcgcg

SEQ ID NO: 388080 - RNA, 17 nt, Bordetella pertussis
gccgcggcgcggcccgc

SEQ ID NO: 388081 - RNA, 16 nt, Bordetella pertussis
gccgcggcgcggccuu

SEQ ID NO: 388082 - RNA, 11 nt, Bordetella pertussis
gccgcggcggg

SEQ ID NO: 388083 - RNA, 13 nt, Bordetella pertussis
gccgcggcgggcu

SEQ ID NO: 388084 - RNA, 16 nt, Bordetella pertussis
gccgcggcguccgcgc

SEQ ID NO: 388085 - RNA, 20 nt, Bordetella pertussis
gccgcggcguugcggcagcg

SEQ ID NO: 388086 - RNA, 14 nt, Bordetella pertussis
gccgcggcuugccg

SEQ ID NO: 388087 - RNA, 16 nt, Bordetella pertussis
gccgcggcuugccgcg

SEQ ID NO: 388088 - RNA, 19 nt, Bordetella pertussis
gccgcggcuugccgcggcg

SEQ ID NO: 388089 - RNA, 19 nt, Bordetella pertussis
gccgcgggcaaagcccagc

SEQ ID NO: 388090 - RNA, 23 nt, Bordetella pertussis
gccgcgggccuacuugccggcgc

SEQ ID NO: 388091 - RNA, 16 nt, Bordetella pertussis
gccgcgggcgccgcgc

SEQ ID NO: 388092 - RNA, 21 nt, Bordetella pertussis
gccgcgggcggccacgcgccg

SEQ ID NO: 388093 - RNA, 18 nt, Bordetella pertussis
gccgcgggcggcgccggc

SEQ ID NO: 388094 - RNA, 15 nt, Bordetella pertussis
gccgcgggcggcgcg

SEQ ID NO: 388095 - RNA, 16 nt, Bordetella pertussis
gccgcgggcggcgcgc

SEQ ID NO: 388096 - RNA, 16 nt, Bordetella pertussis
gccgcgggcgugcugg

SEQ ID NO: 388097 - RNA, 18 nt, Bordetella pertussis
gccgcggggcuggccagc

SEQ ID NO: 388098 - RNA, 21 nt, Bordetella pertussis
gccgcggggcuggccagcugg

SEQ ID NO: 388099 - RNA, 20 nt, Bordetella pertussis
gccgcggguggccgcuccag

SEQ ID NO: 388100 - RNA, 19 nt, Bordetella pertussis
gccgcgguaaugacgcagc

SEQ ID NO: 388101 - RNA, 21 nt, Bordetella pertussis
gccgcgguaaugacgcagccg

SEQ ID NO: 388102 - RNA, 16 nt, Bordetella pertussis
gccgcgguggcgggcg

SEQ ID NO: 388103 - RNA, 17 nt, Bordetella pertussis
gccgcggugguccagau

SEQ ID NO: 388104 - RNA, 13 nt, Bordetella pertussis
gccgcguccagcg

SEQ ID NO: 388105 - RNA, 20 nt, Bordetella pertussis
gccgcgucccgugccggccg

SEQ ID NO: 388106 - RNA, 19 nt, Bordetella pertussis
gccgcguccggcgcccgcc

SEQ ID NO: 388107 - RNA, 15 nt, Bordetella pertussis
gccgcgucgcuggcc

SEQ ID NO: 388108 - RNA, 16 nt, Bordetella pertussis
gccgcgucgcuggccg

SEQ ID NO: 388109 - RNA, 19 nt, Bordetella pertussis
gccgcgucgguggccagcc

SEQ ID NO: 388110 - RNA, 19 nt, Bordetella pertussis
gccgcgucuucggcgcggc

SEQ ID NO: 388111 - RNA, 20 nt, Bordetella pertussis
gccgcgucuucggcgcggcg

SEQ ID NO: 388112 - RNA, 15 nt, Bordetella pertussis
gccgcguggccgcgc

SEQ ID NO: 388113 - RNA, 14 nt, Bordetella pertussis
gccgcguggcggcg

SEQ ID NO: 388114 - RNA, 18 nt, Bordetella pertussis
gccgcgugguggcgcaga

SEQ ID NO: 388115 - RNA, 22 nt, Bordetella pertussis
gccgcguucacgccggcgcgcc

SEQ ID NO: 388116 - RNA, 23 nt, Bordetella pertussis
gccgcguucacgccggcgcgccg

SEQ ID NO: 388117 - RNA, 16 nt, Bordetella pertussis
gccgcguugcgcgacu

SEQ ID NO: 388118 - RNA, 22 nt, Bordetella pertussis
gccgcguuucccucggugcugc

SEQ ID NO: 388119 - RNA, 20 nt, Bordetella pertussis
gccgcuacgcggcgucagga

SEQ ID NO: 388120 - RNA, 20 nt, Bordetella pertussis
gccgcuaggccuugccgccg

SEQ ID NO: 388121 - RNA, 21 nt, Bordetella pertussis
gccgcuaggccuugccgccgc

SEQ ID NO: 388122 - RNA, 18 nt, Bordetella pertussis
gccgcucaauucggccug

SEQ ID NO: 388123 - RNA, 16 nt, Bordetella pertussis
gccgcucagcgcggcg

SEQ ID NO: 388124 - RNA, 21 nt, Bordetella pertussis
gccgcucagcgcggcgcggcc

SEQ ID NO: 388125 - RNA, 23 nt, Bordetella pertussis
gccgcucagguagaccacgcgcu

SEQ ID NO: 388126 - RNA, 19 nt, Bordetella pertussis
gccgcuccagagcgcgcac

SEQ ID NO: 388127 - RNA, 20 nt, Bordetella pertussis
gccgcuccagagcgcgcaca

SEQ ID NO: 388128 - RNA, 14 nt, Bordetella pertussis
gccgcuccgccaug

SEQ ID NO: 388129 - RNA, 16 nt, Bordetella pertussis
gccgcuccgccaugga

SEQ ID NO: 388130 - RNA, 14 nt, Bordetella pertussis
gccgcuccggcaug

SEQ ID NO: 388131 - RNA, 23 nt, Bordetella pertussis
gccgcucgcgcgaccacuggcag

SEQ ID NO: 388132 - RNA, 18 nt, Bordetella pertussis
gccgcucggccacgcgcu

SEQ ID NO: 388133 - RNA, 23 nt, Bordetella pertussis
gccgcucguaguguuccugguag

SEQ ID NO: 388134 - RNA, 22 nt, Bordetella pertussis
gccgcugaacguguaggucagc

SEQ ID NO: 388135 - RNA, 17 nt, Bordetella pertussis
gccgcugaucuuccugg

SEQ ID NO: 388136 - RNA, 22 nt, Bordetella pertussis
gccgcugcagcacgcaccaggc

SEQ ID NO: 388137 - RNA, 19 nt, Bordetella pertussis
gccgcugcagcgcugguuc

SEQ ID NO: 388138 - RNA, 21 nt, Bordetella pertussis
gccgcugcaugggcggcccgc

SEQ ID NO: 388139 - RNA, 16 nt, Bordetella pertussis
gccgcugcccaccuuc

SEQ ID NO: 388140 - RNA, 13 nt, Bordetella pertussis
gccgcugcccagc

SEQ ID NO: 388141 - RNA, 14 nt, Bordetella pertussis
gccgcugccgggcu

SEQ ID NO: 388142 - RNA, 17 nt, Bordetella pertussis
gccgcugcgcgcggccu

SEQ ID NO: 388143 - RNA, 16 nt, Bordetella pertussis
gccgcugcgcuggccg

SEQ ID NO: 388144 - RNA, 12 nt, Bordetella pertussis
gccgcuggccag

SEQ ID NO: 388145 - RNA, 13 nt, Bordetella pertussis
gccgcuggccagc

SEQ ID NO: 388146 - RNA, 14 nt, Bordetella pertussis
gccgcuggccagcc

SEQ ID NO: 388147 - RNA, 14 nt, Bordetella pertussis
gccgcuggcccggg

SEQ ID NO: 388148 - RNA, 22 nt, Bordetella pertussis
gccgcuggcgaucaggccgccc

SEQ ID NO: 388149 - RNA, 14 nt, Bordetella pertussis
gccgcuggcggccc

SEQ ID NO: 388150 - RNA, 15 nt, Bordetella pertussis
gccgcuggcggcccu

SEQ ID NO: 388151 - RNA, 16 nt, Bordetella pertussis
gccgcuggcggcccug

SEQ ID NO: 388152 - RNA, 16 nt, Bordetella pertussis
gccgcuggcggccgcg

SEQ ID NO: 388153 - RNA, 18 nt, Bordetella pertussis
gccgcuggcgauggccug

SEQ ID NO: 388154 - RNA, 21 nt, Bordetella pertussis
gccgcuggcgucgcgcuucuu

SEQ ID NO: 388155 - RNA, 18 nt, Bordetella pertussis
gccgcugggcacauccag

SEQ ID NO: 388156 - RNA, 18 nt, Bordetella pertussis
gccgcuggugaucugcug

SEQ ID NO: 388157 - RNA, 19 nt, Bordetella pertussis
gccgcuggugaucugcugc

SEQ ID NO: 388158 - RNA, 23 nt, Bordetella pertussis
gccgcugucgcugaucugcuuga

SEQ ID NO: 388159 - RNA, 19 nt, Bordetella pertussis
gccgcuguggacgccgccg

SEQ ID NO: 388160 - RNA, 17 nt, Bordetella pertussis
gccgcuguggcgcgcca

SEQ ID NO: 388161 - RNA, 17 nt, Bordetella pertussis
gccgcuguucggcgagc

SEQ ID NO: 388162 - RNA, 16 nt, Bordetella pertussis
gccgcuuccggcauga

SEQ ID NO: 388163 - RNA, 16 nt, Bordetella pertussis
gccgcuucggcggcca

SEQ ID NO: 388164 - RNA, 17 nt, Bordetella pertussis
gccgcuucgugcggccg

SEQ ID NO: 388165 - RNA, 17 nt, Bordetella pertussis
gccgcuugcccgucaug

SEQ ID NO: 388166 - RNA, 23 nt, Bordetella pertussis
gccgcuuggccugcgccaccgca

SEQ ID NO: 388167 - RNA, 19 nt, Bordetella pertussis
gccgcuuucgaccagcgac

SEQ ID NO: 388168 - RNA, 20 nt, Bordetella pertussis
gccgcuuucgaccagcgaca

SEQ ID NO: 388169 - RNA, 24 nt, Bordetella pertussis
gccggaaacgcggucaccgagcug

SEQ ID NO: 388170 - RNA, 18 nt, Bordetella pertussis
gccggaacagcguccagc

SEQ ID NO: 388171 - RNA, 20 nt, Bordetella pertussis
gccgucaacagcauggacga

SEQ ID NO: 388172 - RNA, 20 nt, Bordetella pertussis
gccgucaacggcuugggggg

SEQ ID NO: 388173 - RNA, 15 nt, Bordetella pertussis
gccgucaagcguuca

SEQ ID NO: 388174 - RNA, 13 nt, Bordetella pertussis
gccguccggccgu

SEQ ID NO: 388175 - RNA, 20 nt, Bordetella pertussis
gccguccggccgugccgccc

SEQ ID NO: 388176 - RNA, 14 nt, Bordetella pertussis
gccguccucaggcc

SEQ ID NO: 388177 - RNA, 15 nt, Bordetella pertussis
gccguccucgcgggc

SEQ ID NO: 388178 - RNA, 21 nt, Bordetella pertussis
gccguccuggcgaccggcggc

SEQ ID NO: 388179 - RNA, 18 nt, Bordetella pertussis
gccguccuugagggcgcg

SEQ ID NO: 388180 - RNA, 24 nt, Bordetella pertussis
gccguccuugagggcgcgggccag

SEQ ID NO: 388181 - RNA, 19 nt, Bordetella pertussis
gccgucgccgcccaugcgc

SEQ ID NO: 388182 - RNA, 17 nt, Bordetella pertussis
gccgucgccgcgcggcg

SEQ ID NO: 388183 - RNA, 23 nt, Bordetella pertussis
gccgucgcgcucggacgccgcgc

SEQ ID NO: 388184 - RNA, 20 nt, Bordetella pertussis
gccgucgcgcuguuccagcc

SEQ ID NO: 388185 - RNA, 14 nt, Bordetella pertussis
gccgucggccgcgc

SEQ ID NO: 388186 - RNA, 15 nt, Bordetella pertussis
gccgucggccuggaa

SEQ ID NO: 388187 - RNA, 17 nt, Bordetella pertussis
gccgucggccuggaaca

SEQ ID NO: 388188 - RNA, 19 nt, Bordetella pertussis
gccgucggcgcuggcgcgc

SEQ ID NO: 388189 - RNA, 23 nt, Bordetella pertussis
gccgucggcguugugccggcgca

SEQ ID NO: 388190 - RNA, 14 nt, Bordetella pertussis
gccgucgggcgccg

SEQ ID NO: 388191 - RNA, 19 nt, Bordetella pertussis
gccgucgggcgccgcaacg

SEQ ID NO: 388192 - RNA, 14 nt, Bordetella pertussis
gccgucgggggccg

SEQ ID NO: 388193 - RNA, 18 nt, Bordetella pertussis
gccgucgggggccggcuc

SEQ ID NO: 388194 - RNA, 19 nt, Bordetella pertussis
gccgucugcgccgccgcgu

SEQ ID NO: 388195 - RNA, 16 nt, Bordetella pertussis
gccgugaaugcgccug

SEQ ID NO: 388196 - RNA, 23 nt, Bordetella pertussis
gccgugaccugcucgucgccaug

SEQ ID NO: 388197 - RNA, 15 nt, Bordetella pertussis
gccgugagcgccgcc

SEQ ID NO: 388198 - RNA, 17 nt, Bordetella pertussis
gccgugagcgccgccgc

SEQ ID NO: 388199 - RNA, 21 nt, Bordetella pertussis
gccgugagcgccgccgccaug

SEQ ID NO: 388200 - RNA, 18 nt, Bordetella pertussis
gccgugaggcagccucuu

SEQ ID NO: 388201 - RNA, 16 nt, Bordetella pertussis
gccgugcgccagcgcc

SEQ ID NO: 388202 - RNA, 18 nt, Bordetella pertussis
gccgugcgguucgucagg

SEQ ID NO: 388203 - RNA, 22 nt, Bordetella pertussis
gccgugcuggaggugccguccg

SEQ ID NO: 388204 - RNA, 18 nt, Bordetella pertussis
gccgugcuguaccucagc

SEQ ID NO: 388205 - RNA, 19 nt, Bordetella pertussis
gccgugcuguaccucagcc

SEQ ID NO: 388206 - RNA, 16 nt, Bordetella pertussis
gccguuaugcggacgc

SEQ ID NO: 388207 - RNA, 13 nt, Bordetella pertussis
gccguuccagcug

SEQ ID NO: 388208 - RNA, 14 nt, Bordetella pertussis
gccguuccagucca

SEQ ID NO: 388209 - RNA, 13 nt, Bordetella pertussis
gccguugcuccag

SEQ ID NO: 388210 - RNA, 16 nt, Bordetella pertussis
gccguugcucgcgcgc

SEQ ID NO: 388211 - RNA, 17 nt, Bordetella pertussis
gccguugcucgcgcgca

SEQ ID NO: 388212 - RNA, 18 nt, Bordetella pertussis
gccguuggagccggagca

SEQ ID NO: 388213 - RNA, 17 nt, Bordetella pertussis
gccguuggccagcgccg

SEQ ID NO: 388214 - RNA, 18 nt, Bordetella pertussis
gccguuggccagcgccgc

SEQ ID NO: 388215 - RNA, 16 nt, Bordetella pertussis
gccguuggcgcccagc

SEQ ID NO: 388216 - RNA, 21 nt, Bordetella pertussis
gccguuguccgccugcggacg

SEQ ID NO: 388217 - RNA, 18 nt, Bordetella pertussis
gccguuucucaacccgcc

SEQ ID NO: 388218 - RNA, 18 nt, Bordetella pertussis
gccuacuucggcagcuug

SEQ ID NO: 388219 - RNA, 15 nt, Bordetella pertussis
gccuagcccggcgcc

SEQ ID NO: 388220 - RNA, 14 nt, Bordetella pertussis
gccucagcggccgc

SEQ ID NO: 388221 - RNA, 19 nt, Bordetella pertussis
gccucagcggccgcugccg

SEQ ID NO: 388222 - RNA, 23 nt, Bordetella pertussis
gccucagcguuuccagggcgcgc

SEQ ID NO: 388223 - RNA, 16 nt, Bordetella pertussis
gccucaugacggggcc

SEQ ID NO: 388224 - RNA, 16 nt, Bordetella pertussis
gccuccagcaucgccg

SEQ ID NO: 388225 - RNA, 14 nt, Bordetella pertussis
gccuccagcgcggc

SEQ ID NO: 388226 - RNA, 17 nt, Bordetella pertussis
gccuccagcgcggcggg

SEQ ID NO: 388227 - RNA, 22 nt, Bordetella pertussis
gccuccagcgcggcgggcggcg

SEQ ID NO: 388228 - RNA, 20 nt, Bordetella pertussis
gccuccaggaugagcgccug

SEQ ID NO: 388229 - RNA, 22 nt, Bordetella pertussis
gccuccaggaugagcgccugca

SEQ ID NO: 388230 - RNA, 12 nt, Bordetella pertussis
gccuccaucagc

SEQ ID NO: 388231 - RNA, 20 nt, Bordetella pertussis
gccuccaucagcagcaccuu

SEQ ID NO: 388232 - RNA, 19 nt, Bordetella pertussis
gccucccauugcgcggcca

SEQ ID NO: 388233 - RNA, 12 nt, Bordetella pertussis
gccuccugcagc

SEQ ID NO: 388234 - RNA, 21 nt, Bordetella pertussis
gccucgaacguccgccccauc

SEQ ID NO: 388235 - RNA, 16 nt, Bordetella pertussis
gccucgaagcccggca

SEQ ID NO: 388236 - RNA, 20 nt, Bordetella pertussis
gccucgaagcccggcagggu

SEQ ID NO: 388237 - RNA, 19 nt, Bordetella pertussis
gccucgaaccagugcaggg

SEQ ID NO: 388238 - RNA, 18 nt, Bordetella pertussis
gccucgacgaugcccugc

SEQ ID NO: 388239 - RNA, 21 nt, Bordetella pertussis
gccucgacgauggccggggcg

SEQ ID NO: 388240 - RNA, 23 nt, Bordetella pertussis
gccucgaccggcgaagagccgua

SEQ ID NO: 388241 - RNA, 22 nt, Bordetella pertussis
gccucgaccucuccacuggccu

SEQ ID NO: 388242 - RNA, 15 nt, Bordetella pertussis
gccucgagguggcgc

SEQ ID NO: 388243 - RNA, 16 nt, Bordetella pertussis
gccucgagguggcgca

SEQ ID NO: 388244 - RNA, 16 nt, Bordetella pertussis
gccucgaucgccaggu

SEQ ID NO: 388245 - RNA, 19 nt, Bordetella pertussis
gccucgauugaccagcacc

SEQ ID NO: 388246 - RNA, 22 nt, Bordetella pertussis
gccucgauugaccagcaccagc

SEQ ID NO: 388247 - RNA, 20 nt, Bordetella pertussis
gccucgcccgaucggccggc

SEQ ID NO: 388248 - RNA, 21 nt, Bordetella pertussis
gccucgcccgaucggccggcc

SEQ ID NO: 388249 - RNA, 13 nt, Bordetella pertussis
gccucgccggccu

SEQ ID NO: 388250 - RNA, 21 nt, Bordetella pertussis
gccucgcgacggccucccgcc

SEQ ID NO: 388251 - RNA, 23 nt, Bordetella pertussis
gccucgcgacggccucccgccgc

SEQ ID NO: 388252 - RNA, 19 nt, Bordetella pertussis
gccucgcgcagggcggccu

SEQ ID NO: 388253 - RNA, 13 nt, Bordetella pertussis
gccucgcgcucca

SEQ ID NO: 388254 - RNA, 14 nt, Bordetella pertussis
gccucgcgcuccag

SEQ ID NO: 388255 - RNA, 15 nt, Bordetella pertussis
gccucgcgcuccagc

SEQ ID NO: 388256 - RNA, 18 nt, Bordetella pertussis
gccucgcgcuccaugggc

SEQ ID NO: 388257 - RNA, 19 nt, Bordetella pertussis
gccucgcgcucgagcgcgg

SEQ ID NO: 388258 - RNA, 22 nt, Bordetella pertussis
gccucgcgcucgcgcucggcca

SEQ ID NO: 388259 - RNA, 15 nt, Bordetella pertussis
gccucgcggcgcagc

SEQ ID NO: 388260 - RNA, 19 nt, Bordetella pertussis
gccucgcgggccuuggcca

SEQ ID NO: 388261 - RNA, 16 nt, Bordetella pertussis
gccucgcugccagggu

SEQ ID NO: 388262 - RNA, 13 nt, Bordetella pertussis
gccucgcuggcga

SEQ ID NO: 388263 - RNA, 12 nt, Bordetella pertussis
gccucgcuggcg

SEQ ID NO: 388264 - RNA, 21 nt, Bordetella pertussis
gccucggacgccuggcgcggc

SEQ ID NO: 388265 - RNA, 23 nt, Bordetella pertussis
gccucggacgccuggcgcggccc

SEQ ID NO: 388266 - RNA, 15 nt, Bordetella pertussis
gccucggcauggcgc

SEQ ID NO: 388267 - RNA, 17 nt, Bordetella pertussis
gccucggcauggcgcgc

SEQ ID NO: 388268 - RNA, 19 nt, Bordetella pertussis
gccucggcauggcgcgcgc

SEQ ID NO: 388269 - RNA, 13 nt, Bordetella pertussis
gccucggccaccu

SEQ ID NO: 388270 - RNA, 19 nt, Bordetella pertussis
gccucggccaccuggcgca

SEQ ID NO: 388271 - RNA, 22 nt, Bordetella pertussis
gccucggccaccuggcgcaagg

SEQ ID NO: 388272 - RNA, 20 nt, Bordetella pertussis
gccucggcauccagcucggc

SEQ ID NO: 388273 - RNA, 19 nt, Bordetella pertussis
gccucggcgaagugcccgc

SEQ ID NO: 388274 - RNA, 22 nt, Bordetella pertussis
gccucggcgcgcgcggcgccgc

SEQ ID NO: 388275 - RNA, 15 nt, Bordetella pertussis
gccucggcggccagc

SEQ ID NO: 388276 - RNA, 23 nt, Bordetella pertussis
gccucggcggccagcgcgcccuc

SEQ ID NO: 388277 - RNA, 21 nt, Bordetella pertussis
gccucggcgggcggcgccagc

SEQ ID NO: 388278 - RNA, 21 nt, Bordetella pertussis
gccucggcgguugcccgcccc

SEQ ID NO: 388279 - RNA, 22 nt, Bordetella pertussis
gccucgguacuccuugacgcgc

SEQ ID NO: 388280 - RNA, 14 nt, Bordetella pertussis
gccucgguccagcg

SEQ ID NO: 388281 - RNA, 14 nt, Bordetella pertussis
gccucguccugcag

SEQ ID NO: 388282 - RNA, 15 nt, Bordetella pertussis
gccucguccugcagg

SEQ ID NO: 388283 - RNA, 17 nt, Bordetella pertussis
gccucguccugcaggcg

SEQ ID NO: 388284 - RNA, 17 nt, Bordetella pertussis
gccucgugcgaggccac

SEQ ID NO: 388285 - RNA, 21 nt, Bordetella pertussis
gccucguuccuguuccugcag

SEQ ID NO: 388286 - RNA, 20 nt, Bordetella pertussis
gccucguuggucagcaccuc

SEQ ID NO: 388287 - RNA, 17 nt, Bordetella pertussis
gccucuucgaugaugag

SEQ ID NO: 388288 - RNA, 16 nt, Bordetella pertussis
gccugcccgggcggga

SEQ ID NO: 388289 - RNA, 13 nt, Bordetella pertussis
gccugcccgucgg

SEQ ID NO: 388290 - RNA, 12 nt, Bordetella pertussis
gccugcccuggu

SEQ ID NO: 388291 - RNA, 15 nt, Bordetella pertussis
gccugcccgggcacc

SEQ ID NO: 388292 - RNA, 16 nt, Bordetella pertussis
gccugccgagcgcugc

SEQ ID NO: 388293 - RNA, 19 nt, Bordetella pertussis
gccugccgcaucccgcccc

SEQ ID NO: 388294 - RNA, 14 nt, Bordetella pertussis
gccugccgcgcccg

SEQ ID NO: 388295 - RNA, 17 nt, Bordetella pertussis
gccugccgcgcccggcg

SEQ ID NO: 388296 - RNA, 13 nt, Bordetella pertussis
gccugccgcgccg

SEQ ID NO: 388297 - RNA, 14 nt, Bordetella pertussis
gccugccgcgugcc

SEQ ID NO: 388298 - RNA, 15 nt, Bordetella pertussis
gccugccgcgugccc

SEQ ID NO: 388299 - RNA, 13 nt, Bordetella pertussis
gccugccggccug

SEQ ID NO: 388300 - RNA, 14 nt, Bordetella pertussis
gccugccggcggcc

SEQ ID NO: 388301 - RNA, 16 nt, Bordetella pertussis
gccugcgcgccgacca

SEQ ID NO: 388302 - RNA, 16 nt, Bordetella pertussis
gccugcgcgccgccuc

SEQ ID NO: 388303 - RNA, 13 nt, Bordetella pertussis
gccugcgcgccgg

SEQ ID NO: 388304 - RNA, 21 nt, Bordetella pertussis
gccugcgcgcgcuggggcagc

SEQ ID NO: 388305 - RNA, 19 nt, Bordetella pertussis
gccugcgcgaugcgcgcgc

SEQ ID NO: 388306 - RNA, 19 nt, Bordetella pertussis
gccugcggcaggccgcagc

SEQ ID NO: 388307 - RNA, 23 nt, Bordetella pertussis
gccugcggcaggccgcagcgggc

SEQ ID NO: 388308 - RNA, 18 nt, Bordetella pertussis
gccugcggcauggugugc

SEQ ID NO: 388309 - RNA, 15 nt, Bordetella pertussis
gccugcggcgccagc

SEQ ID NO: 388310 - RNA, 17 nt, Bordetella pertussis
gccugcggcgccagcgc

SEQ ID NO: 388311 - RNA, 18 nt, Bordetella pertussis
gccugcggcgccagcgcc

SEQ ID NO: 388312 - RNA, 17 nt, Bordetella pertussis
gccugcggcgucaggcc

SEQ ID NO: 388313 - RNA, 16 nt, Bordetella pertussis
gccugcgggccgggca

SEQ ID NO: 388314 - RNA, 20 nt, Bordetella pertussis
gccugcgggccgggcaggcc

SEQ ID NO: 388315 - RNA, 22 nt, Bordetella pertussis
gccugcgggccgggcaggccgc

SEQ ID NO: 388316 - RNA, 19 nt, Bordetella pertussis
gccugcgggcugaugcagg

SEQ ID NO: 388317 - RNA, 21 nt, Bordetella pertussis
gccugcgggcugaugcaggcc

SEQ ID NO: 388318 - RNA, 22 nt, Bordetella pertussis
gccugcucguugcgcaagccgc

SEQ ID NO: 388319 - RNA, 13 nt, Bordetella pertussis
gccugcugcagcg

SEQ ID NO: 388320 - RNA, 16 nt, Bordetella pertussis
gccugcugcgccuggc

SEQ ID NO: 388321 - RNA, 12 nt, Bordetella pertussis
gccugcuggugc

SEQ ID NO: 388322 - RNA, 18 nt, Bordetella pertussis
gccugcuggugcuggugc

SEQ ID NO: 388323 - RNA, 20 nt, Bordetella pertussis
gccugcuggugcuggugcug

SEQ ID NO: 388324 - RNA, 15 nt, Bordetella pertussis
gccugcuuggcagcc

SEQ ID NO: 388325 - RNA, 19 nt, Bordetella pertussis
gccugcuuggcgcgcagca

SEQ ID NO: 388326 - RNA, 21 nt, Bordetella pertussis
gccugcuuggcgcgcagcagc

SEQ ID NO: 388327 - RNA, 14 nt, Bordetella pertussis
gccuggcccagcuc

SEQ ID NO: 388328 - RNA, 20 nt, Bordetella pertussis
gccuggcccagcuccagcug

SEQ ID NO: 388329 - RNA, 22 nt, Bordetella pertussis
gccuggcccgaacggcccaucc

SEQ ID NO: 388330 - RNA, 14 nt, Bordetella pertussis
gccuggccgagcgc

SEQ ID NO: 388331 - RNA, 18 nt, Bordetella pertussis
gccuggccgagcgcggca

SEQ ID NO: 388332 - RNA, 19 nt, Bordetella pertussis
gccuggccggcuugcaugg

SEQ ID NO: 388333 - RNA, 22 nt, Bordetella pertussis
gccuggccguagcguuggcggc

SEQ ID NO: 388334 - RNA, 14 nt, Bordetella pertussis
gccuggcgccgcgc

SEQ ID NO: 388335 - RNA, 21 nt, Bordetella pertussis
gccuggcgcggccccaugcgc

SEQ ID NO: 388336 - RNA, 14 nt, Bordetella pertussis
gccuggcgcggcgc

SEQ ID NO: 388337 - RNA, 20 nt, Bordetella pertussis
gccuggcgcggcgccugcgc

SEQ ID NO: 388338 - RNA, 20 nt, Bordetella pertussis
gccuggcgcuccucgcgcgc

SEQ ID NO: 388339 - RNA, 20 nt, Bordetella pertussis
gccuggcggacgauggccug

SEQ ID NO: 388340 - RNA, 17 nt, Bordetella pertussis
gccuggcgggccugggc

SEQ ID NO: 388341 - RNA, 17 nt, Bordetella pertussis
gccuggcucaggccugc

SEQ ID NO: 388342 - RNA, 20 nt, Bordetella pertussis
gccuggcuuacaggcccagu

SEQ ID NO: 388343 - RNA, 16 nt, Bordetella pertussis
gccugggccauggccu

SEQ ID NO: 388344 - RNA, 19 nt, Bordetella pertussis
gccugggccauggccucgu

SEQ ID NO: 388345 - RNA, 12 nt, Bordetella pertussis
gccugggccugu

SEQ ID NO: 388346 - RNA, 13 nt, Bordetella pertussis
gccugggcgccug

SEQ ID NO: 388347 - RNA, 15 nt, Bordetella pertussis
gccugggcgccuggc

SEQ ID NO: 388348 - RNA, 18 nt, Bordetella pertussis
gccugggcgccuggcugc

SEQ ID NO: 388349 - RNA, 14 nt, Bordetella pertussis
gccugggcgcgcgc

SEQ ID NO: 388350 - RNA, 16 nt, Bordetella pertussis
gccugggcggccacgu

SEQ ID NO: 388351 - RNA, 16 nt, Bordetella pertussis
gccugggcggcgcagu

SEQ ID NO: 388352 - RNA, 18 nt, Bordetella pertussis
gccugggcggcgcgcucu

SEQ ID NO: 388353 - RNA, 13 nt, Bordetella pertussis
gccugggcggcgg

SEQ ID NO: 388354 - RNA, 21 nt, Bordetella pertussis
gccuggggacgggcgcacagu

SEQ ID NO: 388355 - RNA, 21 nt, Bordetella pertussis
gccuggggcaguuuccagggc

SEQ ID NO: 388356 - RNA, 10 nt, Bordetella pertussis
gccuggggcg

SEQ ID NO: 388357 - RNA, 18 nt, Bordetella pertussis
gccuggggcgggcgcugc

SEQ ID NO: 388358 - RNA, 17 nt, Bordetella pertussis
gccugggggcuggaggc

SEQ ID NO: 388359 - RNA, 23 nt, Bordetella pertussis
gccugggugcgguaggcgcccga

SEQ ID NO: 388360 - RNA, 14 nt, Bordetella pertussis
gccugggugcuggu

SEQ ID NO: 388361 - RNA, 17 nt, Bordetella pertussis
gccugguacgacagcuc

SEQ ID NO: 388362 - RNA, 15 nt, Bordetella pertussis
gccugguaggcgagc

SEQ ID NO: 388363 - RNA, 20 nt, Bordetella pertussis
gccugguaguaaucgcgcgc

SEQ ID NO: 388364 - RNA, 21 nt, Bordetella pertussis
gccuggucagguugcgccggc

SEQ ID NO: 388365 - RNA, 22 nt, Bordetella pertussis
gccuggucaugacgggcggcgg

SEQ ID NO: 388366 - RNA, 18 nt, Bordetella pertussis
gccuggucgcgcgccugc

SEQ ID NO: 388367 - RNA, 19 nt, Bordetella pertussis
gccuggucgcgcgccugca

SEQ ID NO: 388368 - RNA, 15 nt, Bordetella pertussis
gccuggucgcuggcg

SEQ ID NO: 388369 - RNA, 19 nt, Bordetella pertussis
gccugucccaaccgggaca

SEQ ID NO: 388370 - RNA, 13 nt, Bordetella pertussis
gccugucccagcg

SEQ ID NO: 388371 - RNA, 19 nt, Bordetella pertussis
gccugucccagcggggaca

SEQ ID NO: 388372 - RNA, 15 nt, Bordetella pertussis
gccuguccccaccgg

SEQ ID NO: 388373 - RNA, 19 nt, Bordetella pertussis
gccuguccccaccgggaca

SEQ ID NO: 388374 - RNA, 24 nt, Bordetella pertussis
gccuguccccaccgggacaggcac

SEQ ID NO: 388375 - RNA, 19 nt, Bordetella pertussis
gccuguccccacggggaca

SEQ ID NO: 388376 - RNA, 20 nt, Bordetella pertussis
gccuguccccacugggggac

SEQ ID NO: 388377 - RNA, 19 nt, Bordetella pertussis
gccuguccccccaugggga

SEQ ID NO: 388378 - RNA, 11 nt, Bordetella pertussis
gccuguccccg

SEQ ID NO: 388379 - RNA, 16 nt, Bordetella pertussis
gccuguccccgcacgg

SEQ ID NO: 388380 - RNA, 21 nt, Bordetella pertussis
gccuguccccgcacggggaca

SEQ ID NO: 388381 - RNA, 15 nt, Bordetella pertussis
gccuguccccgcagg

SEQ ID NO: 388382 - RNA, 18 nt, Bordetella pertussis
gccuguccccgcaggagc

SEQ ID NO: 388383 - RNA, 17 nt, Bordetella pertussis
gccuguccccgcaggga

SEQ ID NO: 388384 - RNA, 19 nt, Bordetella pertussis
gccuguccccgcagggaca

SEQ ID NO: 388385 - RNA, 24 nt, Bordetella pertussis
gccuguccccgcagggacaggcac

SEQ ID NO: 388386 - RNA, 23 nt, Bordetella pertussis
gccuguccccgccggggcaggcu

SEQ ID NO: 388387 - RNA, 15 nt, Bordetella pertussis
gccuguccccgcggg

SEQ ID NO: 388388 - RNA, 19 nt, Bordetella pertussis
gccuguccccgcggggaca

SEQ ID NO: 388389 - RNA, 15 nt, Bordetella pertussis
gccuguccccgcugc

SEQ ID NO: 388390 - RNA, 15 nt, Bordetella pertussis
gccuguccccgucgg

SEQ ID NO: 388391 - RNA, 17 nt, Bordetella pertussis
gccuguccccgugggga

SEQ ID NO: 388392 - RNA, 19 nt, Bordetella pertussis
gccuguaucagcgccugca

SEQ ID NO: 388393 - RNA, 21 nt, Bordetella pertussis
gccuguaucagcgccugcagg

SEQ ID NO: 388394 - RNA, 22 nt, Bordetella pertussis
gccuguaucagcgccugcaggu

SEQ ID NO: 388395 - RNA, 21 nt, Bordetella pertussis
gccugucccgcacgcagcccu

SEQ ID NO: 388396 - RNA, 17 nt, Bordetella pertussis
gccugucccggcuggga

SEQ ID NO: 388397 - RNA, 24 nt, Bordetella pertussis
gccugucccggcugggacaggcac

SEQ ID NO: 388398 - RNA, 23 nt, Bordetella pertussis
gccugucccugaacguggcgucc

SEQ ID NO: 388399 - RNA, 15 nt, Bordetella pertussis
gccugucccugccgg

SEQ ID NO: 388400 - RNA, 17 nt, Bordetella pertussis
gccuguccuccccgcug

SEQ ID NO: 388401 - RNA, 14 nt, Bordetella pertussis
gccuguucccgccg

SEQ ID NO: 388402 - RNA, 21 nt, Bordetella pertussis
gccuguuuuggcgcacgccgg

SEQ ID NO: 388403 - RNA, 22 nt, Bordetella pertussis
gccuucaccuugccgcugguga

SEQ ID NO: 388404 - RNA, 12 nt, Bordetella pertussis
gccuucgcugac

SEQ ID NO: 388405 - RNA, 22 nt, Bordetella pertussis
gccuucgcugacgcguucuuca

SEQ ID NO: 388406 - RNA, 13 nt, Bordetella pertussis
gccuucgcugccc

SEQ ID NO: 388407 - RNA, 16 nt, Bordetella pertussis
gccuucggcgaucugg

SEQ ID NO: 388408 - RNA, 19 nt, Bordetella pertussis
gccuucggcgcggcgggcg

SEQ ID NO: 388409 - RNA, 16 nt, Bordetella pertussis
gccuucggcggcgcgc

SEQ ID NO: 388410 - RNA, 14 nt, Bordetella pertussis
gccuucuacccgcu

SEQ ID NO: 388411 - RNA, 14 nt, Bordetella pertussis
gccuuggccgcagc

SEQ ID NO: 388412 - RNA, 12 nt, Bordetella pertussis
gccuuggcggcc

SEQ ID NO: 388413 - RNA, 16 nt, Bordetella pertussis
gccuuggcggccccgc

SEQ ID NO: 388414 - RNA, 14 nt, Bordetella pertussis
gccuuggggcggcc

SEQ ID NO: 388415 - RNA, 15 nt, Bordetella pertussis
gccuuggggcggccc

SEQ ID NO: 388416 - RNA, 15 nt, Bordetella pertussis
gcgaaaugcccagcg

SEQ ID NO: 388417 - RNA, 17 nt, Bordetella pertussis
gcgaaauggcggccucg

SEQ ID NO: 388418 - RNA, 19 nt, Bordetella pertussis
gcgaaauggcggccucggg

SEQ ID NO: 388419 - RNA, 21 nt, Bordetella pertussis
gcgaaauggugcggccaugau

SEQ ID NO: 388420 - RNA, 14 nt, Bordetella pertussis
gcgaacaccggcag

SEQ ID NO: 388421 - RNA, 21 nt, Bordetella pertussis
gcgaacagggcgcgacgccag

SEQ ID NO: 388422 - RNA, 17 nt, Bordetella pertussis
gcgaacauggccgagau

SEQ ID NO: 388423 - RNA, 15 nt, Bordetella pertussis
gcgaaccaggccugc

SEQ ID NO: 388424 - RNA, 16 nt, Bordetella pertussis
gcgaaccggugcuggu

SEQ ID NO: 388425 - RNA, 18 nt, Bordetella pertussis
gcgaaccggugcuggugc

SEQ ID NO: 388426 - RNA, 13 nt, Bordetella pertussis
gcgaacgcgcgcc

SEQ ID NO: 388427 - RNA, 23 nt, Bordetella pertussis
gcgaacgcgcgccggccagcggc

SEQ ID NO: 388428 - RNA, 22 nt, Bordetella pertussis
gcgaacggauggucgugcggca

SEQ ID NO: 388429 - RNA, 14 nt, Bordetella pertussis
gcgaacggccgccc

SEQ ID NO: 388430 - RNA, 16 nt, Bordetella pertussis
gcgaacggccgcccgg

SEQ ID NO: 388431 - RNA, 16 nt, Bordetella pertussis
gcgaacgggcagccga

SEQ ID NO: 388432 - RNA, 19 nt, Bordetella pertussis
gcgaacgggguggccggcg

SEQ ID NO: 388433 - RNA, 14 nt, Bordetella pertussis
gcgaagcagccggc

SEQ ID NO: 388434 - RNA, 18 nt, Bordetella pertussis
gcgaagccuugcgcggcc

SEQ ID NO: 388435 - RNA, 13 nt, Bordetella pertussis
gcgaagcgcgcca

SEQ ID NO: 388436 - RNA, 13 nt, Bordetella pertussis
gcgaagcgcgccu

SEQ ID NO: 388437 - RNA, 14 nt, Bordetella pertussis
gcgaagcgcgccuc

SEQ ID NO: 388438 - RNA, 13 nt, Bordetella pertussis
gcgaagcgcuggg

SEQ ID NO: 388439 - RNA, 19 nt, Bordetella pertussis
gcgaagcggaaacgcgcgc

SEQ ID NO: 388440 - RNA, 23 nt, Bordetella pertussis
gcgaagcggaaacgcgcgcgccc

SEQ ID NO: 388441 - RNA, 16 nt, Bordetella pertussis
gcgaaggccgccgcgc

SEQ ID NO: 388442 - RNA, 14 nt, Bordetella pertussis
gcgaaggggcgcau

SEQ ID NO: 388443 - RNA, 21 nt, Bordetella pertussis
gcgacggccccagcgccgcga

SEQ ID NO: 388444 - RNA, 18 nt, Bordetella pertussis
gcgacggccucccgccgc

SEQ ID NO: 388445 - RNA, 20 nt, Bordetella pertussis
gcgacggccucccgccgccc

SEQ ID NO: 388446 - RNA, 22 nt, Bordetella pertussis
gcgacggccucccgccgcccgg

SEQ ID NO: 388447 - RNA, 14 nt, Bordetella pertussis
gcgacggcgccggc

SEQ ID NO: 388448 - RNA, 18 nt, Bordetella pertussis
gcgacggcgccuggcgca

SEQ ID NO: 388449 - RNA, 17 nt, Bordetella pertussis
gcgagacgcgcucgcgc

SEQ ID NO: 388450 - RNA, 24 nt, Bordetella pertussis
gcgagacgcgcucgcgcgcgugcu

SEQ ID NO: 388451 - RNA, 15 nt, Bordetella pertussis
gcgagagcgccacgc

SEQ ID NO: 388452 - RNA, 21 nt, Bordetella pertussis
gcgagagcuccagccgggucg

SEQ ID NO: 388453 - RNA, 18 nt, Bordetella pertussis
gcgagcagguccauggcc

SEQ ID NO: 388454 - RNA, 22 nt, Bordetella pertussis
gcgagcaugagugauuguccug

SEQ ID NO: 388455 - RNA, 15 nt, Bordetella pertussis
gcgagcaugcgcagc

SEQ ID NO: 388456 - RNA, 17 nt, Bordetella pertussis
gcgagcaugcgcagcgc

SEQ ID NO: 388457 - RNA, 17 nt, Bordetella pertussis
gcgagcccaucaggugg

SEQ ID NO: 388458 - RNA, 19 nt, Bordetella pertussis
gcgagcccaucaggugggc

SEQ ID NO: 388459 - RNA, 20 nt, Bordetella pertussis
gcgagcccgccaucgccagg

SEQ ID NO: 388460 - RNA, 13 nt, Bordetella pertussis
gcgagccgccgcc

SEQ ID NO: 388461 - RNA, 15 nt, Bordetella pertussis
gcgagccggccagcg

SEQ ID NO: 388462 - RNA, 17 nt, Bordetella pertussis
gcgagcugcgcgaccuc

SEQ ID NO: 388463 - RNA, 20 nt, Bordetella pertussis
gcgagcugcgcgaccuccag

SEQ ID NO: 388464 - RNA, 15 nt, Bordetella pertussis
gcgagcugcgcggcu

SEQ ID NO: 388465 - RNA, 15 nt, Bordetella pertussis
gcgagcugcgcugcu

SEQ ID NO: 388466 - RNA, 18 nt, Bordetella pertussis
gcgaggacaggggccuca

SEQ ID NO: 388467 - RNA, 12 nt, Bordetella pertussis
gcgaggaccuga

SEQ ID NO: 388468 - RNA, 19 nt, Bordetella pertussis
gcgaguuguccuggccggg

SEQ ID NO: 388469 - RNA, 23 nt, Bordetella pertussis
gcgauauccaucggcgcgcgcug

SEQ ID NO: 388470 - RNA, 15 nt, Bordetella pertussis
gcgauauuuugccgu

SEQ ID NO: 388471 - RNA, 21 nt, Bordetella pertussis
gcgaucaacgugcgccaggca

SEQ ID NO: 388472 - RNA, 18 nt, Bordetella pertussis
gcgaucaccugcguggcc

SEQ ID NO: 388473 - RNA, 20 nt, Bordetella pertussis
gcgaucagcaccgcggcggg

SEQ ID NO: 388474 - RNA, 19 nt, Bordetella pertussis
gcgaucggagaaaucgccg

SEQ ID NO: 388475 - RNA, 20 nt, Bordetella pertussis
gcgaucgucaccaucgccgc

SEQ ID NO: 388476 - RNA, 22 nt, Bordetella pertussis
gcgaucgucaccaucgccgcgu

SEQ ID NO: 388477 - RNA, 17 nt, Bordetella pertussis
gcgaucgucgcugcgcg

SEQ ID NO: 388478 - RNA, 19 nt, Bordetella pertussis
gcgaucucagccaucauca

SEQ ID NO: 388479 - RNA, 21 nt, Bordetella pertussis
gcgaucucagccaucaucauc

SEQ ID NO: 388480 - RNA, 19 nt, Bordetella pertussis
gcgaucucgcgcagggugg

SEQ ID NO: 388481 - RNA, 16 nt, Bordetella pertussis
gcgaucucgcgcgcgc

SEQ ID NO: 388482 - RNA, 20 nt, Bordetella pertussis
gcgaucucgucgaccgccuc

SEQ ID NO: 388483 - RNA, 16 nt, Bordetella pertussis
gcgaucugcgcggcgg

SEQ ID NO: 388484 - RNA, 17 nt, Bordetella pertussis
gcgaucugcgcggcggu

SEQ ID NO: 388485 - RNA, 17 nt, Bordetella pertussis
gcgaucugggccucggc

SEQ ID NO: 388486 - RNA, 18 nt, Bordetella pertussis
gcgaucugggccucggcc

SEQ ID NO: 388487 - RNA, 20 nt, Bordetella pertussis
gcgaucuugccggccuggcg

SEQ ID NO: 388488 - RNA, 22 nt, Bordetella pertussis
gcgaugaacagcggcacgccgg

SEQ ID NO: 388489 - RNA, 23 nt, Bordetella pertussis
gcgaugaagucgcggcccgccag

SEQ ID NO: 388490 - RNA, 16 nt, Bordetella pertussis
gcgaugagcuggcgca

SEQ ID NO: 388491 - RNA, 22 nt, Bordetella pertussis
gcgaugauggggucgccgggca

SEQ ID NO: 388492 - RNA, 21 nt, Bordetella pertussis
gcgaugcaugaaccgcagcgc

SEQ ID NO: 388493 - RNA, 23 nt, Bordetella pertussis
gcgaugcccaccagccgcccggc

SEQ ID NO: 388494 - RNA, 13 nt, Bordetella pertussis
gcgaugcccagcg

SEQ ID NO: 388495 - RNA, 23 nt, Bordetella pertussis
gcgaugcccgcgcaccaggcgcg

SEQ ID NO: 388496 - RNA, 15 nt, Bordetella pertussis
gcgaugccgcuggcg

SEQ ID NO: 388497 - RNA, 16 nt, Bordetella pertussis
gcgaugccggcguggc

SEQ ID NO: 388498 - RNA, 20 nt, Bordetella pertussis
gcgaugccggcguggcgcgc

SEQ ID NO: 388499 - RNA, 16 nt, Bordetella pertussis
gcgaugcgcagcagca

SEQ ID NO: 388500 - RNA, 13 nt, Bordetella pertussis
gcgaugcgcaggc

SEQ ID NO: 388501 - RNA, 14 nt, Bordetella pertussis
gcgaugcgccaggc

SEQ ID NO: 388502 - RNA, 18 nt, Bordetella pertussis
gcgaugcgccaggcgcuc

SEQ ID NO: 388503 - RNA, 20 nt, Bordetella pertussis
gcgaugcgcgagcgcgugga

SEQ ID NO: 388504 - RNA, 13 nt, Bordetella pertussis
gcgaugcgcgcgc

SEQ ID NO: 388505 - RNA, 13 nt, Bordetella pertussis
gcgaugcgggcgg

SEQ ID NO: 388506 - RNA, 15 nt, Bordetella pertussis
gcgaugcgggcggcg

SEQ ID NO: 388507 - RNA, 18 nt, Bordetella pertussis
gcgaugcucgauaugcag

SEQ ID NO: 388508 - RNA, 20 nt, Bordetella pertussis
gcgaugcugcagggccugga

SEQ ID NO: 388509 - RNA, 13 nt, Bordetella pertussis
gcgauggccacgc

SEQ ID NO: 388510 - RNA, 13 nt, Bordetella pertussis
gcgauggcccggu

SEQ ID NO: 388511 - RNA, 21 nt, Bordetella pertussis
gcgauggccgggagcggccag

SEQ ID NO: 388512 - RNA, 14 nt, Bordetella pertussis
gcgauggcgcgcgc

SEQ ID NO: 388513 - RNA, 16 nt, Bordetella pertussis
gcgauggcgcgcgcca

SEQ ID NO: 388514 - RNA, 20 nt, Bordetella pertussis
gcgauggcgcgucgccgcgc

SEQ ID NO: 388515 - RNA, 18 nt, Bordetella pertussis
gcgaugggcaccugcuug

SEQ ID NO: 388516 - RNA, 14 nt, Bordetella pertussis
gcgaugggccugcc

SEQ ID NO: 388517 - RNA, 16 nt, Bordetella pertussis
gcgauuccuuccauga

SEQ ID NO: 388518 - RNA, 14 nt, Bordetella pertussis
gcgauucgcgcuug

SEQ ID NO: 388519 - RNA, 15 nt, Bordetella pertussis
gcgauucgcgcuuga

SEQ ID NO: 388520 - RNA, 22 nt, Bordetella pertussis
gcgauugaguucgcgcgccggc

SEQ ID NO: 388521 - RNA, 15 nt, Bordetella pertussis
gcgcaaccaggggcg

SEQ ID NO: 388522 - RNA, 23 nt, Bordetella pertussis
gcgcaacgccggccgccauggcc

SEQ ID NO: 388523 - RNA, 15 nt, Bordetella pertussis
gcgcaacgcgcgcgc

SEQ ID NO: 388524 - RNA, 14 nt, Bordetella pertussis
gcgcaacuccagca

SEQ ID NO: 388525 - RNA, 17 nt, Bordetella pertussis
gcgcaagacgcggcagg

SEQ ID NO: 388526 - RNA, 20 nt, Bordetella pertussis
gcgcaagcaccgccugcugc

SEQ ID NO: 388527 - RNA, 12 nt, Bordetella pertussis
gcgcaagccagc

SEQ ID NO: 388528 - RNA, 14 nt, Bordetella pertussis
gcgcaagccagcac

SEQ ID NO: 388529 - RNA, 19 nt, Bordetella pertussis
gcgcaagcccaggcggccc

SEQ ID NO: 388530 - RNA, 17 nt, Bordetella pertussis
gcgcaagccgccgcccu

SEQ ID NO: 388531 - RNA, 20 nt, Bordetella pertussis
gcgcaagcgcgccgacagga

SEQ ID NO: 388532 - RNA, 14 nt, Bordetella pertussis
gcgcaagcggcccc

SEQ ID NO: 388533 - RNA, 21 nt, Bordetella pertussis
gcgcaaggcaugcgccagcgc

SEQ ID NO: 388534 - RNA, 14 nt, Bordetella pertussis
gcgcaaggcggccc

SEQ ID NO: 388535 - RNA, 13 nt, Bordetella pertussis
gcgcaagguggcg

SEQ ID NO: 388536 - RNA, 20 nt, Bordetella pertussis
gcgcaaguguggcgcaccgc

SEQ ID NO: 388537 - RNA, 17 nt, Bordetella pertussis
gcgcaaguucaucaucg

SEQ ID NO: 388538 - RNA, 17 nt, Bordetella pertussis
gcgcaauacgccgccgg

SEQ ID NO: 388539 - RNA, 21 nt, Bordetella pertussis
gcgcaauggacacagcggcgc

SEQ ID NO: 388540 - RNA, 15 nt, Bordetella pertussis
gcgcacacauggcgc

SEQ ID NO: 388541 - RNA, 22 nt, Bordetella pertussis
gcgcacagcauggccaccaggu

SEQ ID NO: 388542 - RNA, 13 nt, Bordetella pertussis
gcgcacagcgcgc

SEQ ID NO: 388543 - RNA, 15 nt, Bordetella pertussis
gcgcacagcgcggcg

SEQ ID NO: 388544 - RNA, 18 nt, Bordetella pertussis
gcgcacaguugcaggcca

SEQ ID NO: 388545 - RNA, 14 nt, Bordetella pertussis
gcgcaccaccagca

SEQ ID NO: 388546 - RNA, 19 nt, Bordetella pertussis
gcgcaccaccagcaccgcc

SEQ ID NO: 388547 - RNA, 15 nt, Bordetella pertussis
gcgcaccagcccgcc

SEQ ID NO: 388548 - RNA, 17 nt, Bordetella pertussis
gcgcaccagcccgcccg

SEQ ID NO: 388549 - RNA, 13 nt, Bordetella pertussis
gcgcaccagcgag

SEQ ID NO: 388550 - RNA, 18 nt, Bordetella pertussis
gcgcaccagcgaggcggc

SEQ ID NO: 388551 - RNA, 14 nt, Bordetella pertussis
gcgcaccagcgcgc

SEQ ID NO: 388552 - RNA, 15 nt, Bordetella pertussis
gcgcaccagcgcgcc

SEQ ID NO: 388553 - RNA, 19 nt, Bordetella pertussis
gcgcaccagcuuggccugc

SEQ ID NO: 388554 - RNA, 14 nt, Bordetella pertussis
gcgcaccaggcugg

SEQ ID NO: 388555 - RNA, 19 nt, Bordetella pertussis
gcgcaccaggcuggggccg

SEQ ID NO: 388556 - RNA, 16 nt, Bordetella pertussis
gcgcaccaggucgcgg

SEQ ID NO: 388557 - RNA, 12 nt, Bordetella pertussis
gcgcaccagguu

SEQ ID NO: 388558 - RNA, 18 nt, Bordetella pertussis
gcgcaccaucgccgagcc

SEQ ID NO: 388559 - RNA, 16 nt, Bordetella pertussis
gcgcaccaugcgcagc

SEQ ID NO: 388560 - RNA, 17 nt, Bordetella pertussis
gcgcaccaugcgcagca

SEQ ID NO: 388561 - RNA, 19 nt, Bordetella pertussis
gcgcaccccggugucgccg

SEQ ID NO: 388562 - RNA, 13 nt, Bordetella pertussis
gcgcacccgcagg

SEQ ID NO: 388563 - RNA, 12 nt, Bordetella pertussis
gcgcacccgccu

SEQ ID NO: 388564 - RNA, 23 nt, Bordetella pertussis
gcgcacccgccuggacggcgagg

SEQ ID NO: 388565 - RNA, 19 nt, Bordetella pertussis
gcgcacccugcaggccggg

SEQ ID NO: 388566 - RNA, 19 nt, Bordetella pertussis
gcgcaccgacggcagcccc

SEQ ID NO: 388567 - RNA, 15 nt, Bordetella pertussis
gcgcaccgaggugcc

SEQ ID NO: 388568 - RNA, 20 nt, Bordetella pertussis
gcgcaccgcaugggccaggc

SEQ ID NO: 388569 - RNA, 21 nt, Bordetella pertussis
gcgcaccgcaugggccaggcg

SEQ ID NO: 388570 - RNA, 13 nt, Bordetella pertussis
gcgcaccgcgcug

SEQ ID NO: 388571 - RNA, 16 nt, Bordetella pertussis
gcgcaccgcgcuggga

SEQ ID NO: 388572 - RNA, 21 nt, Bordetella pertussis
gcgcaccucguaaguggcggc

SEQ ID NO: 388573 - RNA, 18 nt, Bordetella pertussis
gcgcaccuugcccacgcc

SEQ ID NO: 388574 - RNA, 19 nt, Bordetella pertussis
gcgcacgaaguacucgccg

SEQ ID NO: 388575 - RNA, 23 nt, Bordetella pertussis
gcgcacgaaguacucgccggcgc

SEQ ID NO: 388576 - RNA, 22 nt, Bordetella pertussis
gcgcacgaccaccagcgcacug

SEQ ID NO: 388577 - RNA, 22 nt, Bordetella pertussis
gcgcacgauggggccgucgccg

SEQ ID NO: 388578 - RNA, 22 nt, Bordetella pertussis
gcgcacgauugucgucgcgcga

SEQ ID NO: 388579 - RNA, 14 nt, Bordetella pertussis
gcgcacgcccagac

SEQ ID NO: 388580 - RNA, 15 nt, Bordetella pertussis
gcgcacgccgcgccg

SEQ ID NO: 388581 - RNA, 17 nt, Bordetella pertussis
gcgcacgccgcgccggc

SEQ ID NO: 388582 - RNA, 21 nt, Bordetella pertussis
gcgcacgccgcgccggcgcgc

SEQ ID NO: 388583 - RNA, 23 nt, Bordetella pertussis
gcgcacgccgcgccggcgcgcga

SEQ ID NO: 388584 - RNA, 16 nt, Bordetella pertussis
gcgcacgccgggcgcg

SEQ ID NO: 388585 - RNA, 19 nt, Bordetella pertussis
gcgcacgccgggcgcggcc

SEQ ID NO: 388586 - RNA, 13 nt, Bordetella pertussis
gcgcacgcgcagc

SEQ ID NO: 388587 - RNA, 14 nt, Bordetella pertussis
gcgcacgcgcucgg

SEQ ID NO: 388588 - RNA, 22 nt, Bordetella pertussis
gcgcacgcguucgggcggcagg

SEQ ID NO: 388589 - RNA, 16 nt, Bordetella pertussis
gcgcacgcuggcgccc

SEQ ID NO: 388590 - RNA, 13 nt, Bordetella pertussis
gcgcacggccagc

SEQ ID NO: 388591 - RNA, 14 nt, Bordetella pertussis
gcgcacggcggcga

SEQ ID NO: 388592 - RNA, 14 nt, Bordetella pertussis
gcgcacgggcgagg

SEQ ID NO: 388593 - RNA, 19 nt, Bordetella pertussis
gcgcacgggcgccuguccc

SEQ ID NO: 388594 - RNA, 23 nt, Bordetella pertussis
gcgcacucgaccgccgggacagg

SEQ ID NO: 388595 - RNA, 15 nt, Bordetella pertussis
gcgcacugaucgccg

SEQ ID NO: 388596 - RNA, 15 nt, Bordetella pertussis
gcgcagaaaccgcca

SEQ ID NO: 388597 - RNA, 12 nt, Bordetella pertussis
gcgcacuugugg

SEQ ID NO: 388598 - RNA, 20 nt, Bordetella pertussis
gcgcagacgacgcagcgugc

SEQ ID NO: 388599 - RNA, 17 nt, Bordetella pertussis
gcgcagacgcgcucagg

SEQ ID NO: 388600 - RNA, 19 nt, Bordetella pertussis
gcgcagacgcgcucaggcg

SEQ ID NO: 388601 - RNA, 17 nt, Bordetella pertussis
gcgcagacgggcccguu

SEQ ID NO: 388602 - RNA, 19 nt, Bordetella pertussis
gcgcagaucccaggcgcuc

SEQ ID NO: 388603 - RNA, 24 nt, Bordetella pertussis
gcgcagaucccaggcgcucagccg

SEQ ID NO: 388604 - RNA, 16 nt, Bordetella pertussis
gcgcagauggcggcga

SEQ ID NO: 388605 - RNA, 15 nt, Bordetella pertussis
gcgcagcaccagguc

SEQ ID NO: 388606 - RNA, 18 nt, Bordetella pertussis
gcgcagcaccgccagcgc

SEQ ID NO: 388607 - RNA, 21 nt, Bordetella pertussis
gcgcagcaccgccagcgcguc

SEQ ID NO: 388608 - RNA, 18 nt, Bordetella pertussis
gcgcagcaccgcgcgcac

SEQ ID NO: 388609 - RNA, 23 nt, Bordetella pertussis
gcgcagcaccggcgugagcgcca

SEQ ID NO: 388610 - RNA, 18 nt, Bordetella pertussis
gcgcagcaccucggggcg

SEQ ID NO: 388611 - RNA, 19 nt, Bordetella pertussis
gcgcagcacgauggggcca

SEQ ID NO: 388612 - RNA, 17 nt, Bordetella pertussis
gcgcagcacgccgaucg

SEQ ID NO: 388613 - RNA, 23 nt, Bordetella pertussis
gcgcagcagauugccgcgcggcg

SEQ ID NO: 388614 - RNA, 18 nt, Bordetella pertussis
gcgcagcagcgcgguggc

SEQ ID NO: 388615 - RNA, 16 nt, Bordetella pertussis
gcgcagcagcuugccg

SEQ ID NO: 388616 - RNA, 20 nt, Bordetella pertussis
gcgcagcagcuugccgaccg

SEQ ID NO: 388617 - RNA, 12 nt, Bordetella pertussis
gcgcagcaggcc

SEQ ID NO: 388618 - RNA, 13 nt, Bordetella pertussis
gcgcagcaggccc

SEQ ID NO: 388619 - RNA, 13 nt, Bordetella pertussis
gcgcagcaggccg

SEQ ID NO: 388620 - RNA, 15 nt, Bordetella pertussis
gcgcagcaggccgcg

SEQ ID NO: 388621 - RNA, 15 nt, Bordetella pertussis
gcgcagcaggcgcgc

SEQ ID NO: 388622 - RNA, 11 nt, Bordetella pertussis
gcgcagcaggg

SEQ ID NO: 388623 - RNA, 17 nt, Bordetella pertussis
gcgcagcagggcggcgg

SEQ ID NO: 388624 - RNA, 22 nt, Bordetella pertussis
gcgcagcauuucggcgccgccg

SEQ ID NO: 388625 - RNA, 13 nt, Bordetella pertussis
gcgcagccacagc

SEQ ID NO: 388626 - RNA, 15 nt, Bordetella pertussis
gcgcagccgcgcgcc

SEQ ID NO: 388627 - RNA, 16 nt, Bordetella pertussis
gcgcagccgcgcgccu

SEQ ID NO: 388628 - RNA, 13 nt, Bordetella pertussis
gcgcagccggccg

SEQ ID NO: 388629 - RNA, 17 nt, Bordetella pertussis
gcgcagccgggcugccg

SEQ ID NO: 388630 - RNA, 15 nt, Bordetella pertussis
gcgcagcgcccaggc

SEQ ID NO: 388631 - RNA, 20 nt, Bordetella pertussis
gcgcagcgccuggccgagcg

SEQ ID NO: 388632 - RNA, 23 nt, Bordetella pertussis
gcgcagcgccuggccgagcgcgg

SEQ ID NO: 388633 - RNA, 13 nt, Bordetella pertussis
gcgcagcgcggca

SEQ ID NO: 388634 - RNA, 13 nt, Bordetella pertussis
gcgcagcgcggcg

SEQ ID NO: 388635 - RNA, 12 nt, Bordetella pertussis
gcgcagcgcggc

SEQ ID NO: 388636 - RNA, 13 nt, Bordetella pertussis
gcgcagcgcgucc

SEQ ID NO: 388637 - RNA, 16 nt, Bordetella pertussis
gcgcagcgcgucggcg

SEQ ID NO: 388638 - RNA, 16 nt, Bordetella pertussis
gcgcagcggcaggccc

SEQ ID NO: 388639 - RNA, 20 nt, Bordetella pertussis
gcgcagcggcaggcccugcc

SEQ ID NO: 388640 - RNA, 15 nt, Bordetella pertussis
gcgcagcggcaggcg

SEQ ID NO: 388641 - RNA, 16 nt, Bordetella pertussis
gcgcagcggcaggcgg

SEQ ID NO: 388642 - RNA, 14 nt, Bordetella pertussis
gcgcagcggcgcgc

SEQ ID NO: 388643 - RNA, 23 nt, Bordetella pertussis
gcgcagcgugaccggacugucca

SEQ ID NO: 388644 - RNA, 15 nt, Bordetella pertussis
gcgcagcucccccac

SEQ ID NO: 388645 - RNA, 22 nt, Bordetella pertussis
gcgcagcucccccacgccgccg

SEQ ID NO: 388646 - RNA, 16 nt, Bordetella pertussis
gcgcagcuccgggucg

SEQ ID NO: 388647 - RNA, 22 nt, Bordetella pertussis
gcgcagcuccgggucgagcgcc

SEQ ID NO: 388648 - RNA, 19 nt, Bordetella pertussis
gcgcagcucguggcgcgcc

SEQ ID NO: 388649 - RNA, 20 nt, Bordetella pertussis
gcgcagcucguggcgcgccu

SEQ ID NO: 388650 - RNA, 20 nt, Bordetella pertussis
gcgcagcugccugagcaccg

SEQ ID NO: 388651 - RNA, 21 nt, Bordetella pertussis
gcgcagcuugcccgcgcgcac

SEQ ID NO: 388652 - RNA, 21 nt, Bordetella pertussis
gcgcaggaauuccucgcggcu

SEQ ID NO: 388653 - RNA, 22 nt, Bordetella pertussis
gcgcaggaauuccucgcggcug

SEQ ID NO: 388654 - RNA, 18 nt, Bordetella pertussis
gcgcaggacaaggcgcgc

SEQ ID NO: 388655 - RNA, 20 nt, Bordetella pertussis
gcgcaggacaaggcgcgcgc

SEQ ID NO: 388656 - RNA, 16 nt, Bordetella pertussis
gcgcaggacggcgccg

SEQ ID NO: 388657 - RNA, 16 nt, Bordetella pertussis
gcgcaggaugggcagc

SEQ ID NO: 388658 - RNA, 21 nt, Bordetella pertussis
gcgcaggcaaagccugacggc

SEQ ID NO: 388659 - RNA, 12 nt, Bordetella pertussis
gcgcaggccagc

SEQ ID NO: 388660 - RNA, 14 nt, Bordetella pertussis
gcgcaggccagcgc

SEQ ID NO: 388661 - RNA, 18 nt, Bordetella pertussis
gcgcaggcccgacaggau

SEQ ID NO: 388662 - RNA, 16 nt, Bordetella pertussis
gcgcaggccgcgccgg

SEQ ID NO: 388663 - RNA, 15 nt, Bordetella pertussis
gcgcaggccggcggc

SEQ ID NO: 388664 - RNA, 17 nt, Bordetella pertussis
gcgcaggccggcggcca

SEQ ID NO: 388665 - RNA, 23 nt, Bordetella pertussis
gcgcaggccggcggccagcgcgc

SEQ ID NO: 388666 - RNA, 20 nt, Bordetella pertussis
gcgcaggcgcgagacgaagg

SEQ ID NO: 388667 - RNA, 13 nt, Bordetella pertussis
gcgcaggcgcgcc

SEQ ID NO: 388668 - RNA, 16 nt, Bordetella pertussis
gcgcaggcgcgcgccu

SEQ ID NO: 388669 - RNA, 17 nt, Bordetella pertussis
gcgcaggcgcgcgccuu

SEQ ID NO: 388670 - RNA, 17 nt, Bordetella pertussis
gcgcaggcgcgcggggg

SEQ ID NO: 388671 - RNA, 19 nt, Bordetella pertussis
gcgcaggcgcucgaggcgc

SEQ ID NO: 388672 - RNA, 22 nt, Bordetella pertussis
gcgcaggcgcucgaggcgcugg

SEQ ID NO: 388673 - RNA, 14 nt, Bordetella pertussis
gcgcaggcgggccu

SEQ ID NO: 388674 - RNA, 15 nt, Bordetella pertussis
gcgcaggcgggccuc

SEQ ID NO: 388675 - RNA, 11 nt, Bordetella pertussis
gcgcaggcuga

SEQ ID NO: 388676 - RNA, 12 nt, Bordetella pertussis
gcgcagggcggc

SEQ ID NO: 388677 - RNA, 14 nt, Bordetella pertussis
gcgcagggcggccg

SEQ ID NO: 388678 - RNA, 15 nt, Bordetella pertussis
gcgcagggcggccuc

SEQ ID NO: 388679 - RNA, 16 nt, Bordetella pertussis
gcgcaggucggccagg

SEQ ID NO: 388680 - RNA, 21 nt, Bordetella pertussis
gcgcaguaucccggccaggcg

SEQ ID NO: 388681 - RNA, 14 nt, Bordetella pertussis
gcgcaguccgcaca

SEQ ID NO: 388682 - RNA, 18 nt, Bordetella pertussis
gcgcaguugcgucuccag

SEQ ID NO: 388683 - RNA, 20 nt, Bordetella pertussis
gcgcaguugcgucuccagcg

SEQ ID NO: 388684 - RNA, 21 nt, Bordetella pertussis
gcgcaguugcgucuccagcgc

SEQ ID NO: 388685 - RNA, 21 nt, Bordetella pertussis
gcgcauacgcggguucgacgc

SEQ ID NO: 388686 - RNA, 14 nt, Bordetella pertussis
gcgcauaggacgcc

SEQ ID NO: 388687 - RNA, 17 nt, Bordetella pertussis
gcgcaucacgcuggccg

SEQ ID NO: 388688 - RNA, 22 nt, Bordetella pertussis
gcgcaucacgcuggccgcgccc

SEQ ID NO: 388689 - RNA, 14 nt, Bordetella pertussis
gcgcaucagcgcgc

SEQ ID NO: 388690 - RNA, 15 nt, Bordetella pertussis
gcgcaucagcgcgcc

SEQ ID NO: 388691 - RNA, 16 nt, Bordetella pertussis
gcgcaucagcgcgccc

SEQ ID NO: 388692 - RNA, 20 nt, Bordetella pertussis
gcgcauccgguggugcuggg

SEQ ID NO: 388693 - RNA, 18 nt, Bordetella pertussis
gcgcaucgaucagcgcgc

SEQ ID NO: 388694 - RNA, 20 nt, Bordetella pertussis
gcgcaucgaucagcgcgccg

SEQ ID NO: 388695 - RNA, 16 nt, Bordetella pertussis
gcgcaucgccgcaggc

SEQ ID NO: 388696 - RNA, 22 nt, Bordetella pertussis
gcgcaucgccgcaggcgugccc

SEQ ID NO: 388697 - RNA, 15 nt, Bordetella pertussis
gcgcaucgcgcgcgc

SEQ ID NO: 388698 - RNA, 18 nt, Bordetella pertussis
gcgcaucgcgcgcgccgg

SEQ ID NO: 388699 - RNA, 22 nt, Bordetella pertussis
gcgcaucgcgaugcgcagcagc

SEQ ID NO: 388700 - RNA, 13 nt, Bordetella pertussis
gcgcaucgcgcac

SEQ ID NO: 388701 - RNA, 22 nt, Bordetella pertussis
gcgcaugacggcgucgagcacg

SEQ ID NO: 388702 - RNA, 16 nt, Bordetella pertussis
gcgcaugaugcugccg

SEQ ID NO: 388703 - RNA, 17 nt, Bordetella pertussis
gcgcaugauggccggcc

SEQ ID NO: 388704 - RNA, 23 nt, Bordetella pertussis
gcgcaugauggccggccugccgg

SEQ ID NO: 388705 - RNA, 20 nt, Bordetella pertussis
gcgcaugccgucgagcgcga

SEQ ID NO: 388706 - RNA, 14 nt, Bordetella pertussis
gcgcaugcgcacgc

SEQ ID NO: 388707 - RNA, 23 nt, Bordetella pertussis
gcgcaugccagcuugcaggcgcc

SEQ ID NO: 388708 - RNA, 17 nt, Bordetella pertussis
gcgcauggacgccgccg

SEQ ID NO: 388709 - RNA, 11 nt, Bordetella pertussis
gcgcauggcca

SEQ ID NO: 388710 - RNA, 15 nt, Bordetella pertussis
gcgcauggccagcac

SEQ ID NO: 388711 - RNA, 11 nt, Bordetella pertussis
gcgcauggccg

SEQ ID NO: 388712 - RNA, 15 nt, Bordetella pertussis
gcgcauggccggcgu

SEQ ID NO: 388713 - RNA, 20 nt, Bordetella pertussis
gcgcaugggaaauccgccgg

SEQ ID NO: 388714 - RNA, 15 nt, Bordetella pertussis
gcgcaugggcgcagg

SEQ ID NO: 388715 - RNA, 16 nt, Bordetella pertussis
gcgcaugggcgcaggc

SEQ ID NO: 388716 - RNA, 20 nt, Bordetella pertussis
gcgcauguccgccacgccgg

SEQ ID NO: 388717 - RNA, 17 nt, Bordetella pertussis
gcgcauuaucgcuagga

SEQ ID NO: 388718 - RNA, 18 nt, Bordetella pertussis
gcgcauucgucgcugccg

SEQ ID NO: 388719 - RNA, 13 nt, Bordetella pertussis
gcgcauugccgcc

SEQ ID NO: 388720 - RNA, 14 nt, Bordetella pertussis
gcgcauugccgccg

SEQ ID NO: 388721 - RNA, 23 nt, Bordetella pertussis
gcgcauugccgucggccgcgccc

SEQ ID NO: 388722 - RNA, 18 nt, Bordetella pertussis
gcgcauuggugagcacgc

SEQ ID NO: 388723 - RNA, 16 nt, Bordetella pertussis
gcgcauuugccgcggc

SEQ ID NO: 388724 - RNA, 15 nt, Bordetella pertussis
gcgccaaaaggcagc

SEQ ID NO: 388725 - RNA, 15 nt, Bordetella pertussis
gcgccaacccgccau

SEQ ID NO: 388726 - RNA, 23 nt, Bordetella pertussis
gcgccaacccgccauccuggccg

SEQ ID NO: 388727 - RNA, 16 nt, Bordetella pertussis
gcgccaacccggccuc

SEQ ID NO: 388728 - RNA, 21 nt, Bordetella pertussis
gcgccaacccggccucagcgg

SEQ ID NO: 388729 - RNA, 20 nt, Bordetella pertussis
gcgccaacggugccaguccc

SEQ ID NO: 388730 - RNA, 13 nt, Bordetella pertussis
gcgccaagcggca

SEQ ID NO: 388731 - RNA, 13 nt, Bordetella pertussis
gcgccaaucggcg

SEQ ID NO: 388732 - RNA, 22 nt, Bordetella pertussis
gcgccacaaagggcgugucucu

SEQ ID NO: 388733 - RNA, 20 nt, Bordetella pertussis
gcgccacaauugccagccuu

SEQ ID NO: 388734 - RNA, 21 nt, Bordetella pertussis
gcgccacacgggcgccugccg

SEQ ID NO: 388735 - RNA, 14 nt, Bordetella pertussis
gcgccacagcgcca

SEQ ID NO: 388736 - RNA, 18 nt, Bordetella pertussis
gcgccacaggugcgcggc

SEQ ID NO: 388737 - RNA, 19 nt, Bordetella pertussis
gcgccacauccugcacggc

SEQ ID NO: 388738 - RNA, 15 nt, Bordetella pertussis
gcgccaccagcagcg

SEQ ID NO: 388739 - RNA, 18 nt, Bordetella pertussis
gcgccaccagcagcgcca

SEQ ID NO: 388740 - RNA, 22 nt, Bordetella pertussis
gcgccaccagcuugcgcgccgc

SEQ ID NO: 388741 - RNA, 21 nt, Bordetella pertussis
gcgccaccgcauggggcgagg

SEQ ID NO: 388742 - RNA, 16 nt, Bordetella pertussis
gcgccacgcccaggcc

SEQ ID NO: 388743 - RNA, 17 nt, Bordetella pertussis
gcgccacgcccaggccg

SEQ ID NO: 388744 - RNA, 15 nt, Bordetella pertussis
gcgccacgcccuggc

SEQ ID NO: 388745 - RNA, 23 nt, Bordetella pertussis
gcgccacggcgucgccggccagg

SEQ ID NO: 388746 - RNA, 19 nt, Bordetella pertussis
gcgccacggcuugcgcgua

SEQ ID NO: 388747 - RNA, 22 nt, Bordetella pertussis
gcgccagaaagcgcggccgggc

SEQ ID NO: 388748 - RNA, 18 nt, Bordetella pertussis
gcgccagaugcgccgcac

SEQ ID NO: 388749 - RNA, 22 nt, Bordetella pertussis
gcgccagcaccggcacgcgcca

SEQ ID NO: 388750 - RNA, 16 nt, Bordetella pertussis
gcgccagcacgguggc

SEQ ID NO: 388751 - RNA, 24 nt, Bordetella pertussis
gcgccagcagggucagcggccggc

SEQ ID NO: 388752 - RNA, 12 nt, Bordetella pertussis
gcgccagcaggg

SEQ ID NO: 388753 - RNA, 12 nt, Bordetella pertussis
gcgccagccagc

SEQ ID NO: 388754 - RNA, 14 nt, Bordetella pertussis
gcgccagccagcgc

SEQ ID NO: 388755 - RNA, 14 nt, Bordetella pertussis
gcgccagcccgccc

SEQ ID NO: 388756 - RNA, 15 nt, Bordetella pertussis
gcgccagcccgccgc

SEQ ID NO: 388757 - RNA, 16 nt, Bordetella pertussis
gcgccagccgcgccug

SEQ ID NO: 388758 - RNA, 20 nt, Bordetella pertussis
gcgccagccgcgccugcagc

SEQ ID NO: 388759 - RNA, 21 nt, Bordetella pertussis
gcgccagccgcgcgaccuugu

SEQ ID NO: 388760 - RNA, 23 nt, Bordetella pertussis
gcgccagccguugcgccagcggc

SEQ ID NO: 388761 - RNA, 14 nt, Bordetella pertussis
gcgccagcgccggc

SEQ ID NO: 388762 - RNA, 13 nt, Bordetella pertussis
gcgccagcgccuc

SEQ ID NO: 388763 - RNA, 20 nt, Bordetella pertussis
gcgccagcgccuccaucagc

SEQ ID NO: 388764 - RNA, 17 nt, Bordetella pertussis
gcgccagcgcggccagc

SEQ ID NO: 388765 - RNA, 14 nt, Bordetella pertussis
gcgccagcgccagc

SEQ ID NO: 388766 - RNA, 18 nt, Bordetella pertussis
gcgccagcgcuguccagg

SEQ ID NO: 388767 - RNA, 19 nt, Bordetella pertussis
gcgccagcgcuguccaggc

SEQ ID NO: 388768 - RNA, 17 nt, Bordetella pertussis
gcgccagcuccagccgc

SEQ ID NO: 388769 - RNA, 18 nt, Bordetella pertussis
gcgccagcuccagccgca

SEQ ID NO: 388770 - RNA, 21 nt, Bordetella pertussis
gcgccagcuccagccgcaggc

SEQ ID NO: 388771 - RNA, 17 nt, Bordetella pertussis
gcgccagcucgcgcagc

SEQ ID NO: 388772 - RNA, 19 nt, Bordetella pertussis
gcgccagcucggccaaggc

SEQ ID NO: 388773 - RNA, 22 nt, Bordetella pertussis
gcgccagcucuucgagcgcggc

SEQ ID NO: 388774 - RNA, 21 nt, Bordetella pertussis
gcgccagcuggaccgccuggc

SEQ ID NO: 388775 - RNA, 19 nt, Bordetella pertussis
gcgccagcuugcgcgccuu

SEQ ID NO: 388776 - RNA, 20 nt, Bordetella pertussis
gcgccaggaacagcgccggc

SEQ ID NO: 388777 - RNA, 23 nt, Bordetella pertussis
gcgccaggaacagcgccggcagc

SEQ ID NO: 388778 - RNA, 16 nt, Bordetella pertussis
gcgccaggaagcgcgc

SEQ ID NO: 388779 - RNA, 19 nt, Bordetella pertussis
gcgccaggaagcgcgccgc

SEQ ID NO: 388780 - RNA, 18 nt, Bordetella pertussis
gcgccaggcaaaggccca

SEQ ID NO: 388781 - RNA, 14 nt, Bordetella pertussis
gcgccaggccgcgc

SEQ ID NO: 388782 - RNA, 19 nt, Bordetella pertussis
gcgccaggccgcgcagggc

SEQ ID NO: 388783 - RNA, 13 nt, Bordetella pertussis
gcgccaggccggc

SEQ ID NO: 388784 - RNA, 16 nt, Bordetella pertussis
gcgccaggcgcgcauc

SEQ ID NO: 388785 - RNA, 19 nt, Bordetella pertussis
gcgccaggcguagaccacc

SEQ ID NO: 388786 - RNA, 21 nt, Bordetella pertussis
gcgccaggcguagaccaccug

SEQ ID NO: 388787 - RNA, 14 nt, Bordetella pertussis
gcgccaggcuccau

SEQ ID NO: 388788 - RNA, 14 nt, Bordetella pertussis
gcgccagggccucc

SEQ ID NO: 388789 - RNA, 17 nt, Bordetella pertussis
gcgccagggccuccucg

SEQ ID NO: 388790 - RNA, 14 nt, Bordetella pertussis
gcgccagggcgccg

SEQ ID NO: 388791 - RNA, 15 nt, Bordetella pertussis
gcgccagggcgccgc

SEQ ID NO: 388792 - RNA, 13 nt, Bordetella pertussis
gcgccagggcgcg

SEQ ID NO: 388793 - RNA, 22 nt, Bordetella pertussis
gcgccagggcgcggaucauggg

SEQ ID NO: 388794 - RNA, 17 nt, Bordetella pertussis
gcgccagggccaggccg

SEQ ID NO: 388795 - RNA, 20 nt, Bordetella pertussis
gcgccagggccaggccgccg

SEQ ID NO: 388796 - RNA, 12 nt, Bordetella pertussis
gcgccagggccc

SEQ ID NO: 388797 - RNA, 22 nt, Bordetella pertussis
gcgccaggugcuugcggcuguc

SEQ ID NO: 388798 - RNA, 17 nt, Bordetella pertussis
gcgccaguagcgccggc

SEQ ID NO: 388799 - RNA, 13 nt, Bordetella pertussis
gcgccaguccagc

SEQ ID NO: 388800 - RNA, 15 nt, Bordetella pertussis
gcgccaguccagcgc

SEQ ID NO: 388801 - RNA, 18 nt, Bordetella pertussis
gcgccaguccccaugcgg

SEQ ID NO: 388802 - RNA, 16 nt, Bordetella pertussis
gcgccagucgcgcagc

SEQ ID NO: 388803 - RNA, 20 nt, Bordetella pertussis
gcgccaguugcggggcgccc

SEQ ID NO: 388804 - RNA, 22 nt, Bordetella pertussis
gcgccaguugcggggcgcccag

SEQ ID NO: 388805 - RNA, 19 nt, Bordetella pertussis
gcgccauauugaugcagca

SEQ ID NO: 388806 - RNA, 18 nt, Bordetella pertussis
gcgccaucaagagcaccg

SEQ ID NO: 388807 - RNA, 18 nt, Bordetella pertussis
gcgccauccggcgcauga

SEQ ID NO: 388808 - RNA, 20 nt, Bordetella pertussis
gcgccaucgacgggcggcug

SEQ ID NO: 388809 - RNA, 22 nt, Bordetella pertussis
gcgccaucgacgggcggcugcc

SEQ ID NO: 388810 - RNA, 13 nt, Bordetella pertussis
gcgccaucggcau

SEQ ID NO: 388811 - RNA, 14 nt, Bordetella pertussis
gcgccaugagccac

SEQ ID NO: 388812 - RNA, 17 nt, Bordetella pertussis
gcgccaugagccacaau

SEQ ID NO: 388813 - RNA, 22 nt, Bordetella pertussis
gcgccaugaugucgcgcgccug

SEQ ID NO: 388814 - RNA, 20 nt, Bordetella pertussis
gcgccaugccgcgcccgccu

SEQ ID NO: 388815 - RNA, 18 nt, Bordetella pertussis
gcgccaugcgcaccaccg

SEQ ID NO: 388816 - RNA, 20 nt, Bordetella pertussis
gcgccaugcucgcgcacagc

SEQ ID NO: 388817 - RNA, 18 nt, Bordetella pertussis
gcgccaugcuggccgccg

SEQ ID NO: 388818 - RNA, 15 nt, Bordetella pertussis
gcgccauggccggcc

SEQ ID NO: 388819 - RNA, 20 nt, Bordetella pertussis
gcgccaugugcguugccagc

SEQ ID NO: 388820 - RNA, 19 nt, Bordetella pertussis
gcgccauguggcgacgccc

SEQ ID NO: 388821 - RNA, 20 nt, Bordetella pertussis
gcgcccaauccgaucagcac

SEQ ID NO: 388822 - RNA, 17 nt, Bordetella pertussis
gcgcccaaucgggcagc

SEQ ID NO: 388823 - RNA, 20 nt, Bordetella pertussis
gcgcccaaucgggcagcacg

SEQ ID NO: 388824 - RNA, 13 nt, Bordetella pertussis
gcgcccacaggaa

SEQ ID NO: 388825 - RNA, 17 nt, Bordetella pertussis
gcgcccaccagggugcc

SEQ ID NO: 388826 - RNA, 20 nt, Bordetella pertussis
gcgcccacgcacaugaugcc

SEQ ID NO: 388827 - RNA, 21 nt, Bordetella pertussis
gcgcccagaucgauccagaag

SEQ ID NO: 388828 - RNA, 13 nt, Bordetella pertussis
gcgcccagcagcg

SEQ ID NO: 388829 - RNA, 12 nt, Bordetella pertussis
gcgcccagcaug

SEQ ID NO: 388830 - RNA, 14 nt, Bordetella pertussis
gcgcccagccccgc

SEQ ID NO: 388831 - RNA, 16 nt, Bordetella pertussis
gcgcccagccccgcgg

SEQ ID NO: 388832 - RNA, 20 nt, Bordetella pertussis
gcgcccagccccgcggccgc

SEQ ID NO: 388833 - RNA, 13 nt, Bordetella pertussis
gcgcccagcgagc

SEQ ID NO: 388834 - RNA, 16 nt, Bordetella pertussis
gcgcccagcgagcugc

SEQ ID NO: 388835 - RNA, 15 nt, Bordetella pertussis
gcgcccagcgcgccg

SEQ ID NO: 388836 - RNA, 14 nt, Bordetella pertussis
gcgcccagcgcggc

SEQ ID NO: 388837 - RNA, 15 nt, Bordetella pertussis
gcgcccagcgcggcc

SEQ ID NO: 388838 - RNA, 13 nt, Bordetella pertussis
gcgcccagcugcu

SEQ ID NO: 388839 - RNA, 16 nt, Bordetella pertussis
gcgcccagcggcaggc

SEQ ID NO: 388840 - RNA, 19 nt, Bordetella pertussis
gcgcccaggcgaugcccag

SEQ ID NO: 388841 - RNA, 16 nt, Bordetella pertussis
gcgcccaggggccggc

SEQ ID NO: 388842 - RNA, 17 nt, Bordetella pertussis
gcgcccagggugguggc

SEQ ID NO: 388843 - RNA, 23 nt, Bordetella pertussis
gcgcccagguacaucauccccag

SEQ ID NO: 388844 - RNA, 16 nt, Bordetella pertussis
gcgcccaugcgcuggc

SEQ ID NO: 388845 - RNA, 14 nt, Bordetella pertussis
gcgcccauuccgag

SEQ ID NO: 388846 - RNA, 20 nt, Bordetella pertussis
gcgcccauuccgagcgggcc

SEQ ID NO: 388847 - RNA, 20 nt, Bordetella pertussis
gcgcccaucucggccgcggc

SEQ ID NO: 388848 - RNA, 19 nt, Bordetella pertussis
gcgccccaucaccauggcc

SEQ ID NO: 388849 - RNA, 14 nt, Bordetella pertussis
gcgcccccagcagc

SEQ ID NO: 388850 - RNA, 13 nt, Bordetella pertussis
gcgcccccgcggc

SEQ ID NO: 388851 - RNA, 16 nt, Bordetella pertussis
gcgcccccgcggcgcc

SEQ ID NO: 388852 - RNA, 17 nt, Bordetella pertussis
gcgcccccgcggcgccc

SEQ ID NO: 388853 - RNA, 16 nt, Bordetella pertussis
gcgccccuugcggggc

SEQ ID NO: 388854 - RNA, 12 nt, Bordetella pertussis
gcgcccgacggc

SEQ ID NO: 388855 - RNA, 14 nt, Bordetella pertussis
gcgcccgagcgcca

SEQ ID NO: 388856 - RNA, 23 nt, Bordetella pertussis
gcgcccgacggcgcgcccgccgc

SEQ ID NO: 388857 - RNA, 21 nt, Bordetella pertussis
gcgcccgaugcucgccggcgc

SEQ ID NO: 388858 - RNA, 15 nt, Bordetella pertussis
gcgcccgcaggcggc

SEQ ID NO: 388859 - RNA, 14 nt, Bordetella pertussis
gcgcccgccgccgg

SEQ ID NO: 388860 - RNA, 17 nt, Bordetella pertussis
gcgcccgccgccgggcg

SEQ ID NO: 388861 - RNA, 17 nt, Bordetella pertussis
gcgcccgccgcgucggc

SEQ ID NO: 388862 - RNA, 18 nt, Bordetella pertussis
gcgcccgccuucggcggc

SEQ ID NO: 388863 - RNA, 20 nt, Bordetella pertussis
gcgcccgccuucggcggcgg

SEQ ID NO: 388864 - RNA, 18 nt, Bordetella pertussis
gcgcccgcggaaagcugg

SEQ ID NO: 388865 - RNA, 20 nt, Bordetella pertussis
gcgcccgcggaaagcuggcg

SEQ ID NO: 388866 - RNA, 13 nt, Bordetella pertussis
gcgcccgcggccu

SEQ ID NO: 388867 - RNA, 23 nt, Bordetella pertussis
gcgcccgcuacgcgggcuugcug

SEQ ID NO: 388868 - RNA, 18 nt, Bordetella pertussis
gcgcccgcuugcggccgg

SEQ ID NO: 388869 - RNA, 19 nt, Bordetella pertussis
gcgcccgcuugggccgcgc

SEQ ID NO: 388870 - RNA, 13 nt, Bordetella pertussis
gcgcccggccggc

SEQ ID NO: 388871 - RNA, 13 nt, Bordetella pertussis
gcgcccggcgccg

SEQ ID NO: 388872 - RNA, 16 nt, Bordetella pertussis
gcgcccggcggccagg

SEQ ID NO: 388873 - RNA, 23 nt, Bordetella pertussis
gcgcccggcggccaggccggcgc

SEQ ID NO: 388874 - RNA, 24 nt, Bordetella pertussis
gcgcccgggcugauccgcaccggc

SEQ ID NO: 388875 - RNA, 15 nt, Bordetella pertussis
gcgcccgggcugccg

SEQ ID NO: 388876 - RNA, 23 nt, Bordetella pertussis
gcgcccgggccgucuacaggccc

SEQ ID NO: 388877 - RNA, 16 nt, Bordetella pertussis
gcgcccggucugccac

SEQ ID NO: 388878 - RNA, 20 nt, Bordetella pertussis
gcgcccggugcgcgcagggc

SEQ ID NO: 388879 - RNA, 16 nt, Bordetella pertussis
gcgcccguccacggcc

SEQ ID NO: 388880 - RNA, 13 nt, Bordetella pertussis
gcgcccucagucc

SEQ ID NO: 388881 - RNA, 18 nt, Bordetella pertussis
gcgcccuggcgccgcggc

SEQ ID NO: 388882 - RNA, 18 nt, Bordetella pertussis
gcgcccuggcgcggcggc

SEQ ID NO: 388883 - RNA, 16 nt, Bordetella pertussis
gcgccgaagcgcaggc

SEQ ID NO: 388884 - RNA, 17 nt, Bordetella pertussis
gcgccgaagcgcaggcc

SEQ ID NO: 388885 - RNA, 18 nt, Bordetella pertussis
gcgccgaagcgcaggccu

SEQ ID NO: 388886 - RNA, 22 nt, Bordetella pertussis
gcgccgaaguugcggccgugcg

SEQ ID NO: 388887 - RNA, 21 nt, Bordetella pertussis
gcgccgacagguaggcgccgg

SEQ ID NO: 388888 - RNA, 20 nt, Bordetella pertussis
gcgccgacccgagcccuggc

SEQ ID NO: 388889 - RNA, 14 nt, Bordetella pertussis
gcgccgacccugcc

SEQ ID NO: 388890 - RNA, 23 nt, Bordetella pertussis
gcgccgacccugcccggcagggu

SEQ ID NO: 388891 - RNA, 18 nt, Bordetella pertussis
gcgccgacgaugccgccc

SEQ ID NO: 388892 - RNA, 20 nt, Bordetella pertussis
gcgccgacgaugccgcccac

SEQ ID NO: 388893 - RNA, 15 nt, Bordetella pertussis
gcgccgacggcgccc

SEQ ID NO: 388894 - RNA, 18 nt, Bordetella pertussis
gcgccgacggcgcccugc

SEQ ID NO: 388895 - RNA, 14 nt, Bordetella pertussis
gcgccgacgggccg

SEQ ID NO: 388896 - RNA, 18 nt, Bordetella pertussis
gcgccgagcagaucgcca

SEQ ID NO: 388897 - RNA, 13 nt, Bordetella pertussis
gcgccgagcgcca

SEQ ID NO: 388898 - RNA, 14 nt, Bordetella pertussis
gcgccgaggccugc

SEQ ID NO: 388899 - RNA, 17 nt, Bordetella pertussis
gcgccgaggcgggcagc

SEQ ID NO: 388900 - RNA, 16 nt, Bordetella pertussis
gcgccgauccagggcc

SEQ ID NO: 388901 - RNA, 15 nt, Bordetella pertussis
gcgccgauggcgccg

SEQ ID NO: 388902 - RNA, 16 nt, Bordetella pertussis
gcgccgauggcgccgc

SEQ ID NO: 388903 - RNA, 17 nt, Bordetella pertussis
gcgccgauggugcgggc

SEQ ID NO: 388904 - RNA, 19 nt, Bordetella pertussis
gcgccgauuucgccgccgc

SEQ ID NO: 388905 - RNA, 22 nt, Bordetella pertussis
gcgccgauuucgccgccgccau

SEQ ID NO: 388906 - RNA, 16 nt, Bordetella pertussis
gcgccgcaacccgcuu

SEQ ID NO: 388907 - RNA, 19 nt, Bordetella pertussis
gcgccgcaacgccgccggc

SEQ ID NO: 388908 - RNA, 22 nt, Bordetella pertussis
gcgccgcaccagcgccgacggc

SEQ ID NO: 388909 - RNA, 14 nt, Bordetella pertussis
gcgccgcacgccgg

SEQ ID NO: 388910 - RNA, 13 nt, Bordetella pertussis
gcgccgcagcacc

SEQ ID NO: 388911 - RNA, 21 nt, Bordetella pertussis
gcgccgcagcgucgcggcguc

SEQ ID NO: 388912 - RNA, 17 nt, Bordetella pertussis
gcgccgcaugcggcggc

SEQ ID NO: 388913 - RNA, 18 nt, Bordetella pertussis
gcgccgcaugcggcggcu

SEQ ID NO: 388914 - RNA, 15 nt, Bordetella pertussis
gcgccgccacaggcu

SEQ ID NO: 388915 - RNA, 17 nt, Bordetella pertussis
gcgccgccacaggcuga

SEQ ID NO: 388916 - RNA, 18 nt, Bordetella pertussis
gcgccgccacaggcugac

SEQ ID NO: 388917 - RNA, 14 nt, Bordetella pertussis
gcgccgccagccgc

SEQ ID NO: 388918 - RNA, 23 nt, Bordetella pertussis
gcgccgccaggaaaagccgccuu

SEQ ID NO: 388919 - RNA, 14 nt, Bordetella pertussis
gcgccgccaggccg

SEQ ID NO: 388920 - RNA, 15 nt, Bordetella pertussis
gcgccgccaggcgcg

SEQ ID NO: 388921 - RNA, 20 nt, Bordetella pertussis
gcgccgccauggcggcgccc

SEQ ID NO: 388922 - RNA, 19 nt, Bordetella pertussis
gcgccgcccaccaccagcg

SEQ ID NO: 388923 - RNA, 13 nt, Bordetella pertussis
gcgccgcccgcgg

SEQ ID NO: 388924 - RNA, 18 nt, Bordetella pertussis
gcgccgcccgggccggcu

SEQ ID NO: 388925 - RNA, 13 nt, Bordetella pertussis
gcgccgccgcccu

SEQ ID NO: 388926 - RNA, 16 nt, Bordetella pertussis
gcgccgccgccgcggc

SEQ ID NO: 388927 - RNA, 13 nt, Bordetella pertussis
gcgccgccgccgg

SEQ ID NO: 388928 - RNA, 10 nt, Bordetella pertussis
gcgccgccgg

SEQ ID NO: 388929 - RNA, 18 nt, Bordetella pertussis
gcgccgccggcggccugg

SEQ ID NO: 388930 - RNA, 15 nt, Bordetella pertussis
gcgccgccgggccug

SEQ ID NO: 388931 - RNA, 20 nt, Bordetella pertussis
gcgccgccggugcaccaggc

SEQ ID NO: 388932 - RNA, 19 nt, Bordetella pertussis
gcgccgccucagcccgcgu

SEQ ID NO: 388933 - RNA, 19 nt, Bordetella pertussis
gcgccgccucaggccggcg

SEQ ID NO: 388934 - RNA, 20 nt, Bordetella pertussis
gcgccgccuaccaggugggc

SEQ ID NO: 388935 - RNA, 22 nt, Bordetella pertussis
gcgccgccuucaccggccccau

SEQ ID NO: 388936 - RNA, 19 nt, Bordetella pertussis
gcgccgcgagcgccgaacc

SEQ ID NO: 388937 - RNA, 13 nt, Bordetella pertussis
gcgccgcgcagca

SEQ ID NO: 388938 - RNA, 13 nt, Bordetella pertussis
gcgccgcgccaac

SEQ ID NO: 388939 - RNA, 14 nt, Bordetella pertussis
gcgccgcgcccggc

SEQ ID NO: 388940 - RNA, 15 nt, Bordetella pertussis
gcgccgcgcccggcc

SEQ ID NO: 388941 - RNA, 14 nt, Bordetella pertussis
gcgccgcgccgccc

SEQ ID NO: 388942 - RNA, 21 nt, Bordetella pertussis
gcgccgcgccguacagggccg

SEQ ID NO: 388943 - RNA, 12 nt, Bordetella pertussis
gcgccgcgccuu

SEQ ID NO: 388944 - RNA, 15 nt, Bordetella pertussis
gcgccgcgccuugcc

SEQ ID NO: 388945 - RNA, 15 nt, Bordetella pertussis
gcgccgcgccgccgc

SEQ ID NO: 388946 - RNA, 13 nt, Bordetella pertussis
gcgccgcgcgccg

SEQ ID NO: 388947 - RNA, 15 nt, Bordetella pertussis
gcgccgcgcgcggcc

SEQ ID NO: 388948 - RNA, 20 nt, Bordetella pertussis
gcgccgcgcgcggcggccuu

SEQ ID NO: 388949 - RNA, 21 nt, Bordetella pertussis
gcgccgcgcucgcgccaggcc

SEQ ID NO: 388950 - RNA, 14 nt, Bordetella pertussis
gcgccgcggccggc

SEQ ID NO: 388951 - RNA, 13 nt, Bordetella pertussis
gcgccgcggcggc

SEQ ID NO: 388952 - RNA, 19 nt, Bordetella pertussis
gcgccgcggcggcgagggc

SEQ ID NO: 388953 - RNA, 14 nt, Bordetella pertussis
gcgccgcggcgggc

SEQ ID NO: 388954 - RNA, 12 nt, Bordetella pertussis
gcgccgcggggc

SEQ ID NO: 388955 - RNA, 22 nt, Bordetella pertussis
gcgccgcguccggcgcccgccg

SEQ ID NO: 388956 - RNA, 22 nt, Bordetella pertussis
gcgccgcguugcagccacaggc

SEQ ID NO: 388957 - RNA, 22 nt, Bordetella pertussis
gcgccgcuacagcgucacggca

SEQ ID NO: 388958 - RNA, 16 nt, Bordetella pertussis
gcgccgcuacgcggcg

SEQ ID NO: 388959 - RNA, 17 nt, Bordetella pertussis
gcgccgcgugguggcgc

SEQ ID NO: 388960 - RNA, 14 nt, Bordetella pertussis
gcgccgcuggcggc

SEQ ID NO: 388961 - RNA, 22 nt, Bordetella pertussis
gcgccgcuguugcccaccagcc

SEQ ID NO: 388962 - RNA, 17 nt, Bordetella pertussis
gcgccgcuuucucccgc

SEQ ID NO: 388963 - RNA, 20 nt, Bordetella pertussis
gcgccgcuuucucccgccgc

SEQ ID NO: 388964 - RNA, 21 nt, Bordetella pertussis
gcgccggacguagucgcacgc

SEQ ID NO: 388965 - RNA, 15 nt, Bordetella pertussis
gcgccggaucggccg

SEQ ID NO: 388966 - RNA, 16 nt, Bordetella pertussis
gcgccggcaggcgcgc

SEQ ID NO: 388967 - RNA, 13 nt, Bordetella pertussis
gcgccggcagggc

SEQ ID NO: 388968 - RNA, 14 nt, Bordetella pertussis
gcgccggcagggcg

SEQ ID NO: 388969 - RNA, 16 nt, Bordetella pertussis
gcgccggcagggcggc

SEQ ID NO: 388970 - RNA, 17 nt, Bordetella pertussis
gcgccggcagggcggcc

SEQ ID NO: 388971 - RNA, 23 nt, Bordetella pertussis
gcgccggcagggcggccaggccg

SEQ ID NO: 388972 - RNA, 13 nt, Bordetella pertussis
gcgccggcagggu

SEQ ID NO: 388973 - RNA, 20 nt, Bordetella pertussis
gcgccggcaucggcggcuug

SEQ ID NO: 388974 - RNA, 20 nt, Bordetella pertussis
gcgccggcaugaagcgcagc

SEQ ID NO: 388975 - RNA, 13 nt, Bordetella pertussis
gcgccggccaccg

SEQ ID NO: 388976 - RNA, 16 nt, Bordetella pertussis
gcgccggccagcgcgc

SEQ ID NO: 388977 - RNA, 15 nt, Bordetella pertussis
gcgccggccagcggc

SEQ ID NO: 388978 - RNA, 22 nt, Bordetella pertussis
gcgccggccagcggcaggacgg

SEQ ID NO: 388979 - RNA, 15 nt, Bordetella pertussis
gcgccggcccaaggc

SEQ ID NO: 388980 - RNA, 14 nt, Bordetella pertussis
gcgccggcccaggc

SEQ ID NO: 388981 - RNA, 13 nt, Bordetella pertussis
gcgccggcccgcc

SEQ ID NO: 388982 - RNA, 14 nt, Bordetella pertussis
gcgccggcccgccu

SEQ ID NO: 388983 - RNA, 16 nt, Bordetella pertussis
gcgccggccgcccgcc

SEQ ID NO: 388984 - RNA, 17 nt, Bordetella pertussis
gcgccggccgcccgccu

SEQ ID NO: 388985 - RNA, 12 nt, Bordetella pertussis
gcgccggccgcg

SEQ ID NO: 388986 - RNA, 13 nt, Bordetella pertussis
gcgccggccgcgc

SEQ ID NO: 388987 - RNA, 11 nt, Bordetella pertussis
gcgccggccgc

SEQ ID NO: 388988 - RNA, 18 nt, Bordetella pertussis
gcgccggccuccagcauc

SEQ ID NO: 388989 - RNA, 13 nt, Bordetella pertussis
gcgccggccuggc

SEQ ID NO: 388990 - RNA, 14 nt, Bordetella pertussis
gcgccggccuggcg

SEQ ID NO: 388991 - RNA, 19 nt, Bordetella pertussis
gcgccggcgcaugagccgg

SEQ ID NO: 388992 - RNA, 15 nt, Bordetella pertussis
gcgccggcgcccggc

SEQ ID NO: 388993 - RNA, 18 nt, Bordetella pertussis
gcgccggcgcccggcagc

SEQ ID NO: 388994 - RNA, 18 nt, Bordetella pertussis
gcgccggcgccgggcagc

SEQ ID NO: 388995 - RNA, 15 nt, Bordetella pertussis
gcgccggcgcgccgc

SEQ ID NO: 388996 - RNA, 21 nt, Bordetella pertussis
gcgccggcgcgccgcccgcuu

SEQ ID NO: 388997 - RNA, 15 nt, Bordetella pertussis
gcgccggcgcggcgg

SEQ ID NO: 388998 - RNA, 21 nt, Bordetella pertussis
gcgccggcggcaccgcgcagc

SEQ ID NO: 388999 - RNA, 14 nt, Bordetella pertussis
gcgccggcggccuc

SEQ ID NO: 389000 - RNA, 13 nt, Bordetella pertussis
gcgccggcggcgc

SEQ ID NO: 389001 - RNA, 16 nt, Bordetella pertussis
gcgccggcgggcgcug

SEQ ID NO: 389002 - RNA, 20 nt, Bordetella pertussis
gcgccggcgggcgcugccug

SEQ ID NO: 389003 - RNA, 17 nt, Bordetella pertussis
gcgccggcucguacggc

SEQ ID NO: 389004 - RNA, 15 nt, Bordetella pertussis
gcgccgggaucggcg

SEQ ID NO: 389005 - RNA, 15 nt, Bordetella pertussis
gcgccgggcagcccg

SEQ ID NO: 389006 - RNA, 14 nt, Bordetella pertussis
gcgccgggcgcggc

SEQ ID NO: 389007 - RNA, 14 nt, Bordetella pertussis
gcgccgggccacga

SEQ ID NO: 389008 - RNA, 20 nt, Bordetella pertussis
gcgccgggccuagcccggcg

SEQ ID NO: 389009 - RNA, 18 nt, Bordetella pertussis
gcgccgggcgccgcgccc

SEQ ID NO: 389010 - RNA, 14 nt, Bordetella pertussis
gcgccggggcgccg

SEQ ID NO: 389011 - RNA, 19 nt, Bordetella pertussis
gcgccggggcggcgcagca

SEQ ID NO: 389012 - RNA, 14 nt, Bordetella pertussis
gcgccggggcggcu

SEQ ID NO: 389013 - RNA, 17 nt, Bordetella pertussis
gcgccggggcggcucgg

SEQ ID NO: 389014 - RNA, 14 nt, Bordetella pertussis
gcgccggggggcgc

SEQ ID NO: 389015 - RNA, 17 nt, Bordetella pertussis
gcgccggggggcgcacg

SEQ ID NO: 389016 - RNA, 20 nt, Bordetella pertussis
gcgccggggucagcgccggc

SEQ ID NO: 389017 - RNA, 14 nt, Bordetella pertussis
gcgccgggguggga

SEQ ID NO: 389018 - RNA, 19 nt, Bordetella pertussis
gcgccggguggguucgggc

SEQ ID NO: 389019 - RNA, 21 nt, Bordetella pertussis
gcgccggguguuccggcgcgc

SEQ ID NO: 389020 - RNA, 13 nt, Bordetella pertussis
gcgccggucaggc

SEQ ID NO: 389021 - RNA, 20 nt, Bordetella pertussis
gcgccggucaugcaccugca

SEQ ID NO: 389022 - RNA, 15 nt, Bordetella pertussis
gcgccgguccagcgc

SEQ ID NO: 389023 - RNA, 16 nt, Bordetella pertussis
gcgccggugaccgcca

SEQ ID NO: 389024 - RNA, 19 nt, Bordetella pertussis
gcgccggugaccgccagca

SEQ ID NO: 389025 - RNA, 14 nt, Bordetella pertussis
gcgccggucugggc

SEQ ID NO: 389026 - RNA, 18 nt, Bordetella pertussis
gcgccggucugggcgcgg

SEQ ID NO: 389027 - RNA, 15 nt, Bordetella pertussis
gcgccggugcgcggc

SEQ ID NO: 389028 - RNA, 15 nt, Bordetella pertussis
gcgccgguggccagc

SEQ ID NO: 389029 - RNA, 18 nt, Bordetella pertussis
gcgccgguggccagcagc

SEQ ID NO: 389030 - RNA, 12 nt, Bordetella pertussis
gcgccggugggc

SEQ ID NO: 389031 - RNA, 18 nt, Bordetella pertussis
gcgccguacagccgcggc

SEQ ID NO: 389032 - RNA, 17 nt, Bordetella pertussis
gcgccguaccagcgcga

SEQ ID NO: 389033 - RNA, 14 nt, Bordetella pertussis
gcgccguaccccag

SEQ ID NO: 389034 - RNA, 20 nt, Bordetella pertussis
gcgccgucagcagcgcggcg

SEQ ID NO: 389035 - RNA, 14 nt, Bordetella pertussis
gcgccguccagcgc

SEQ ID NO: 389036 - RNA, 20 nt, Bordetella pertussis
gcgccguccagcgcggcaug

SEQ ID NO: 389037 - RNA, 24 nt, Bordetella pertussis
gcgccguccgcaucgcgcaagggc

SEQ ID NO: 389038 - RNA, 15 nt, Bordetella pertussis
gcgccguccgggccg

SEQ ID NO: 389039 - RNA, 20 nt, Bordetella pertussis
gcgccguccgugagugcagc

SEQ ID NO: 389040 - RNA, 23 nt, Bordetella pertussis
gcgccguccucaggcccgcggcg

SEQ ID NO: 389041 - RNA, 19 nt, Bordetella pertussis
gcgccgucgaacuccugca

SEQ ID NO: 389042 - RNA, 20 nt, Bordetella pertussis
gcgccgucugugcgccccgc

SEQ ID NO: 389043 - RNA, 23 nt, Bordetella pertussis
gcgccgucugugcgccccgcugg

SEQ ID NO: 389044 - RNA, 15 nt, Bordetella pertussis
gcgccgugcagacgg

SEQ ID NO: 389045 - RNA, 20 nt, Bordetella pertussis
gcgccgugcagacggcggcu

SEQ ID NO: 389046 - RNA, 15 nt, Bordetella pertussis
gcgccgugcccggcg

SEQ ID NO: 389047 - RNA, 16 nt, Bordetella pertussis
gcgccgugcccggcgg

SEQ ID NO: 389048 - RNA, 17 nt, Bordetella pertussis
gcgccgugcccggcggg

SEQ ID NO: 389049 - RNA, 18 nt, Bordetella pertussis
gcgccgugcccggcgggc

SEQ ID NO: 389050 - RNA, 20 nt, Bordetella pertussis
gcgccgucuucgguggcccg

SEQ ID NO: 389051 - RNA, 13 nt, Bordetella pertussis
gcgccgugcugga

SEQ ID NO: 389052 - RNA, 17 nt, Bordetella pertussis
gcgccgugcuggaggug

SEQ ID NO: 389053 - RNA, 23 nt, Bordetella pertussis
gcgccguucaugcgucgaacggc

SEQ ID NO: 389054 - RNA, 16 nt, Bordetella pertussis
gcgccguucucaggcc

SEQ ID NO: 389055 - RNA, 16 nt, Bordetella pertussis
gcgccguugcgggcug

SEQ ID NO: 389056 - RNA, 16 nt, Bordetella pertussis
gcgccuaccggcgccg

SEQ ID NO: 389057 - RNA, 17 nt, Bordetella pertussis
gcgccuacggcggcggc

SEQ ID NO: 389058 - RNA, 22 nt, Bordetella pertussis
gcgccuauugcgacgccgccga

SEQ ID NO: 389059 - RNA, 18 nt, Bordetella pertussis
gcgccuccagcuccagcg

SEQ ID NO: 389060 - RNA, 14 nt, Bordetella pertussis
gcgccucgcgacgg

SEQ ID NO: 389061 - RNA, 15 nt, Bordetella pertussis
gcgccucgcgacggc

SEQ ID NO: 389062 - RNA, 18 nt, Bordetella pertussis
gcgccucgcgacggccuc

SEQ ID NO: 389063 - RNA, 16 nt, Bordetella pertussis
gcgccucgcgcuccau

SEQ ID NO: 389064 - RNA, 17 nt, Bordetella pertussis
gcgccucguccugcagg

SEQ ID NO: 389065 - RNA, 19 nt, Bordetella pertussis
gcgccugagcugccaggcu

SEQ ID NO: 389066 - RNA, 16 nt, Bordetella pertussis
gcgccugcagcacggc

SEQ ID NO: 389067 - RNA, 17 nt, Bordetella pertussis
gcgccugcagcagcggc

SEQ ID NO: 389068 - RNA, 20 nt, Bordetella pertussis
gcgccugcauccggcccagc

SEQ ID NO: 389069 - RNA, 21 nt, Bordetella pertussis
gcgccugcauccggcccagcg

SEQ ID NO: 389070 - RNA, 23 nt, Bordetella pertussis
gcgccugcauccggcccagcgcc

SEQ ID NO: 389071 - RNA, 20 nt, Bordetella pertussis
gcgccugcauguccagcggc

SEQ ID NO: 389072 - RNA, 18 nt, Bordetella pertussis
gcgccugccccgccggga

SEQ ID NO: 389073 - RNA, 16 nt, Bordetella pertussis
gcgccugccccgccug

SEQ ID NO: 389074 - RNA, 21 nt, Bordetella pertussis
gcgccugccccggcagagaca

SEQ ID NO: 389075 - RNA, 22 nt, Bordetella pertussis
gcgccugcgagagauagcccag

SEQ ID NO: 389076 - RNA, 14 nt, Bordetella pertussis
gcgccugcgcggcc

SEQ ID NO: 389077 - RNA, 14 nt, Bordetella pertussis
gcgccugcggcagg

SEQ ID NO: 389078 - RNA, 13 nt, Bordetella pertussis
gcgccugcggggc

SEQ ID NO: 389079 - RNA, 19 nt, Bordetella pertussis
gcgccugcucacgccccgc

SEQ ID NO: 389080 - RNA, 21 nt, Bordetella pertussis
gcgccugcucgaccugcucgg

SEQ ID NO: 389081 - RNA, 14 nt, Bordetella pertussis
gcgccuggaccugg

SEQ ID NO: 389082 - RNA, 23 nt, Bordetella pertussis
gcgccuggaccuggacgagggcc

SEQ ID NO: 389083 - RNA, 18 nt, Bordetella pertussis
gcgccuggcccagaucug

SEQ ID NO: 389084 - RNA, 14 nt, Bordetella pertussis
gcgccuggccgccc

SEQ ID NO: 389085 - RNA, 19 nt, Bordetella pertussis
gcgccuggccgcccagcgc

SEQ ID NO: 389086 - RNA, 14 nt, Bordetella pertussis
gcgccuggcggacg

SEQ ID NO: 389087 - RNA, 13 nt, Bordetella pertussis
gcgccugggcggc

SEQ ID NO: 389088 - RNA, 15 nt, Bordetella pertussis
gcgccugggcggcgc

SEQ ID NO: 389089 - RNA, 17 nt, Bordetella pertussis
gcgccugggggucgguc

SEQ ID NO: 389090 - RNA, 19 nt, Bordetella pertussis
gcgccugggggucggucug

SEQ ID NO: 389091 - RNA, 22 nt, Bordetella pertussis
gcgccugggguaggcgcggucc

SEQ ID NO: 389092 - RNA, 14 nt, Bordetella pertussis
gcgccuggcggcug

SEQ ID NO: 389093 - RNA, 16 nt, Bordetella pertussis
gcgccuggcggcuggu

SEQ ID NO: 389094 - RNA, 15 nt, Bordetella pertussis
gcgccuggcggcugu

SEQ ID NO: 389095 - RNA, 17 nt, Bordetella pertussis
gcgccuggcgggccugg

SEQ ID NO: 389096 - RNA, 21 nt, Bordetella pertussis
gcgccugucccaggcgcucgc

SEQ ID NO: 389097 - RNA, 17 nt, Bordetella pertussis
gcgccuguccccgcagg

SEQ ID NO: 389098 - RNA, 18 nt, Bordetella pertussis
gcgccuguccccgcagga

SEQ ID NO: 389099 - RNA, 20 nt, Bordetella pertussis
gcgccuguccccgcugcggc

SEQ ID NO: 389100 - RNA, 21 nt, Bordetella pertussis
gcgccuguccccgcugcggca

SEQ ID NO: 389101 - RNA, 20 nt, Bordetella pertussis
gcgccuuacuccggcugcuu

SEQ ID NO: 389102 - RNA, 23 nt, Bordetella pertussis
gcgccuuacuuguacgacgucuu

SEQ ID NO: 389103 - RNA, 21 nt, Bordetella pertussis
gcgccuucggcaggcgccggc

SEQ ID NO: 389104 - RNA, 14 nt, Bordetella pertussis
gcgccuugcgcggc

SEQ ID NO: 389105 - RNA, 22 nt, Bordetella pertussis
gcgccuugcgcggcgagcgccg

SEQ ID NO: 389106 - RNA, 23 nt, Bordetella pertussis
gcgccuugcggcgaugcacccag

SEQ ID NO: 389107 - RNA, 14 nt, Bordetella pertussis
gcgccuugcggcgc

SEQ ID NO: 389108 - RNA, 15 nt, Bordetella pertussis
gcgccuugccgccgc

SEQ ID NO: 389109 - RNA, 18 nt, Bordetella pertussis
gcgccuugccgccgcgca

SEQ ID NO: 389110 - RNA, 19 nt, Bordetella pertussis
gcgccuuggccugggcgcg

SEQ ID NO: 389111 - RNA, 23 nt, Bordetella pertussis
gcgccuuggccugggcgcggucc

SEQ ID NO: 389112 - RNA, 21 nt, Bordetella pertussis
gcgccuuucccgcgccgagcg

SEQ ID NO: 389113 - RNA, 20 nt, Bordetella pertussis
gcgcgaaauccagcgcgccc

SEQ ID NO: 389114 - RNA, 20 nt, Bordetella pertussis
gcgcgaaaugcccagcgagc

SEQ ID NO: 389115 - RNA, 18 nt, Bordetella pertussis
gcgcgaacaccggcaggc

SEQ ID NO: 389116 - RNA, 24 nt, Bordetella pertussis
gcgcgacaggcggugcgcgcggcc

SEQ ID NO: 389117 - RNA, 15 nt, Bordetella pertussis
gcgcgaccgcgcggc

SEQ ID NO: 389118 - RNA, 16 nt, Bordetella pertussis
gcgcgaccgcgcggcg

SEQ ID NO: 389119 - RNA, 18 nt, Bordetella pertussis
gcgcgaccgcgcggcgcu

SEQ ID NO: 389120 - RNA, 19 nt, Bordetella pertussis
gcgcgaccgcgcggcgcug

SEQ ID NO: 389121 - RNA, 14 nt, Bordetella pertussis
gcgcgaccuccggc

SEQ ID NO: 389122 - RNA, 17 nt, Bordetella pertussis
gcgcgacgacagcggcg

SEQ ID NO: 389123 - RNA, 17 nt, Bordetella pertussis
gcgcgacggcgccggcc

SEQ ID NO: 389124 - RNA, 21 nt, Bordetella pertussis
gcgcgacgccagcgcgccaug

SEQ ID NO: 389125 - RNA, 22 nt, Bordetella pertussis
gcgcgacuggcccaggcgggcc

SEQ ID NO: 389126 - RNA, 23 nt, Bordetella pertussis
gcgcgacuucgccgaucgagcag

SEQ ID NO: 389127 - RNA, 22 nt, Bordetella pertussis
gcgcgaucucguggcccagcac

SEQ ID NO: 389128 - RNA, 19 nt, Bordetella pertussis
gcgcgaugccaucgcuggu

SEQ ID NO: 389129 - RNA, 16 nt, Bordetella pertussis
gcgcgaugcgcaggcu

SEQ ID NO: 389130 - RNA, 15 nt, Bordetella pertussis
gcgcgaugcgcgcgc

SEQ ID NO: 389131 - RNA, 17 nt, Bordetella pertussis
gcgcgaugcgcgcgugc

SEQ ID NO: 389132 - RNA, 15 nt, Bordetella pertussis
gcgcgaugcgcggcc

SEQ ID NO: 389133 - RNA, 13 nt, Bordetella pertussis
gcgcgaugggccu

SEQ ID NO: 389134 - RNA, 14 nt, Bordetella pertussis
gcgcgaugggccug

SEQ ID NO: 389135 - RNA, 21 nt, Bordetella pertussis
gcgcgauggucaccacccgca

SEQ ID NO: 389136 - RNA, 23 nt, Bordetella pertussis
gcgcgaugucgaauuccgggacg

SEQ ID NO: 389137 - RNA, 18 nt, Bordetella pertussis
gcgcgcaaccaggggcgg

SEQ ID NO: 389138 - RNA, 17 nt, Bordetella pertussis
gcgcgcaacccacggcg

SEQ ID NO: 389139 - RNA, 20 nt, Bordetella pertussis
gcgcgcaaaccgacgcggcc

SEQ ID NO: 389140 - RNA, 17 nt, Bordetella pertussis
gcgcgcaacacgcgcga

SEQ ID NO: 389141 - RNA, 16 nt, Bordetella pertussis
gcgcgcaaugcgcggc

SEQ ID NO: 389142 - RNA, 14 nt, Bordetella pertussis
gcgcgcaucacgcu

SEQ ID NO: 389143 - RNA, 18 nt, Bordetella pertussis
gcgcgcaucacgcuggcc

SEQ ID NO: 389144 - RNA, 18 nt, Bordetella pertussis
gcgcgcauccgguggugc

SEQ ID NO: 389145 - RNA, 16 nt, Bordetella pertussis
gcgcgcaucgcgcggc

SEQ ID NO: 389146 - RNA, 19 nt, Bordetella pertussis
gcgcgcaucgcgcggcaug

SEQ ID NO: 389147 - RNA, 16 nt, Bordetella pertussis
gcgcgcaucggcgccg

SEQ ID NO: 389148 - RNA, 15 nt, Bordetella pertussis
gcgcgccaccaccuc

SEQ ID NO: 389149 - RNA, 22 nt, Bordetella pertussis
gcgcgccacggcgucgccggcc

SEQ ID NO: 389150 - RNA, 12 nt, Bordetella pertussis
gcgcgccagcac

SEQ ID NO: 389151 - RNA, 22 nt, Bordetella pertussis
gcgcgccagcagcgccgguucg

SEQ ID NO: 389152 - RNA, 13 nt, Bordetella pertussis
gcgcgccagcagu

SEQ ID NO: 389153 - RNA, 16 nt, Bordetella pertussis
gcgcgccagcaguucg

SEQ ID NO: 389154 - RNA, 12 nt, Bordetella pertussis
gcgcgccagccc

SEQ ID NO: 389155 - RNA, 13 nt, Bordetella pertussis
gcgcgccagccgc

SEQ ID NO: 389156 - RNA, 14 nt, Bordetella pertussis
gcgcgccagccgcu

SEQ ID NO: 389157 - RNA, 13 nt, Bordetella pertussis
gcgcgccagcgcc

SEQ ID NO: 389158 - RNA, 22 nt, Bordetella pertussis
gcgcgccagcgccacgcgagcc

SEQ ID NO: 389159 - RNA, 14 nt, Bordetella pertussis
gcgcgccagcgcgc

SEQ ID NO: 389160 - RNA, 17 nt, Bordetella pertussis
gcgcgccagcgcggcca

SEQ ID NO: 389161 - RNA, 16 nt, Bordetella pertussis
gcgcgccagcgcggcg

SEQ ID NO: 389162 - RNA, 17 nt, Bordetella pertussis
gcgcgccagcggcugcu

SEQ ID NO: 389163 - RNA, 15 nt, Bordetella pertussis
gcgcgccagcucgcg

SEQ ID NO: 389164 - RNA, 23 nt, Bordetella pertussis
gcgcgccagcucgcgcagcaggc

SEQ ID NO: 389165 - RNA, 14 nt, Bordetella pertussis
gcgcgccagcagcg

SEQ ID NO: 389166 - RNA, 16 nt, Bordetella pertussis
gcgcgccagcugggcg

SEQ ID NO: 389167 - RNA, 13 nt, Bordetella pertussis
gcgcgccaggccc

SEQ ID NO: 389168 - RNA, 16 nt, Bordetella pertussis
gcgcgccaggcccagg

SEQ ID NO: 389169 - RNA, 12 nt, Bordetella pertussis
gcgcgccaggcg

SEQ ID NO: 389170 - RNA, 19 nt, Bordetella pertussis
gcgcgccaggaagcgcgcc

SEQ ID NO: 389171 - RNA, 22 nt, Bordetella pertussis
gcgcgccgaggaucuggccggc

SEQ ID NO: 389172 - RNA, 22 nt, Bordetella pertussis
gcgcgccgaggugaucuggucc

SEQ ID NO: 389173 - RNA, 13 nt, Bordetella pertussis
gcgcgccgcagcg

SEQ ID NO: 389174 - RNA, 13 nt, Bordetella pertussis
gcgcgccgccggc

SEQ ID NO: 389175 - RNA, 15 nt, Bordetella pertussis
gcgcgccgccgggcc

SEQ ID NO: 389176 - RNA, 18 nt, Bordetella pertussis
gcgcgccgccgggccugc

SEQ ID NO: 389177 - RNA, 13 nt, Bordetella pertussis
gcgcgccgcgccg

SEQ ID NO: 389178 - RNA, 15 nt, Bordetella pertussis
gcgcgccgcgccggg

SEQ ID NO: 389179 - RNA, 13 nt, Bordetella pertussis
gcgcgccgcggcc

SEQ ID NO: 389180 - RNA, 17 nt, Bordetella pertussis
gcgcgccgcggccuguc

SEQ ID NO: 389181 - RNA, 16 nt, Bordetella pertussis
gcgcgccgcggcgggc

SEQ ID NO: 389182 - RNA, 21 nt, Bordetella pertussis
gcgcgccgcggcgggcuuggc

SEQ ID NO: 389183 - RNA, 13 nt, Bordetella pertussis
gcgcgccgcgggc

SEQ ID NO: 389184 - RNA, 23 nt, Bordetella pertussis
gcgcgccggcagggcggccaggc

SEQ ID NO: 389185 - RNA, 22 nt, Bordetella pertussis
gcgcgccggcauuucgcugggc

SEQ ID NO: 389186 - RNA, 17 nt, Bordetella pertussis
gcgcgccggccagcggc

SEQ ID NO: 389187 - RNA, 18 nt, Bordetella pertussis
gcgcgccggccgcggggc

SEQ ID NO: 389188 - RNA, 22 nt, Bordetella pertussis
gcgcgccggccgcggggcuggc

SEQ ID NO: 389189 - RNA, 16 nt, Bordetella pertussis
gcgcgccggcgccggc

SEQ ID NO: 389190 - RNA, 23 nt, Bordetella pertussis
gcgcgccggcgccuuggccuggg

SEQ ID NO: 389191 - RNA, 17 nt, Bordetella pertussis
gcgcgccggcggccugc

SEQ ID NO: 389192 - RNA, 13 nt, Bordetella pertussis
gcgcgccggccug

SEQ ID NO: 389193 - RNA, 14 nt, Bordetella pertussis
gcgcgccggcgggc

SEQ ID NO: 389194 - RNA, 22 nt, Bordetella pertussis
gcgcgccggcucgaacaggcug

SEQ ID NO: 389195 - RNA, 15 nt, Bordetella pertussis
gcgcgccgggccaga

SEQ ID NO: 389196 - RNA, 21 nt, Bordetella pertussis
gcgcgcgaauuuuucuuccag

SEQ ID NO: 389197 - RNA, 14 nt, Bordetella pertussis
gcgcgcgaccaggc

SEQ ID NO: 389198 - RNA, 15 nt, Bordetella pertussis
gcgcgcgaccaggcu

SEQ ID NO: 389199 - RNA, 21 nt, Bordetella pertussis
gcgcgcgacgacagcggcgag

SEQ ID NO: 389200 - RNA, 16 nt, Bordetella pertussis
gcgcgcgacggcgccg

SEQ ID NO: 389201 - RNA, 16 nt, Bordetella pertussis
gcgcgcgacuccaccg

SEQ ID NO: 389202 - RNA, 13 nt, Bordetella pertussis
gcgcgcgagcggc

SEQ ID NO: 389203 - RNA, 14 nt, Bordetella pertussis
gcgcgcgagcggcg

SEQ ID NO: 389204 - RNA, 14 nt, Bordetella pertussis
gcgcgcgcagccgc

SEQ ID NO: 389205 - RNA, 16 nt, Bordetella pertussis
gcgcgcgcagccgcgc

SEQ ID NO: 389206 - RNA, 12 nt, Bordetella pertussis
gcgcgcgcaggc

SEQ ID NO: 389207 - RNA, 14 nt, Bordetella pertussis
gcgcgcgcaucggc

SEQ ID NO: 389208 - RNA, 13 nt, Bordetella pertussis
gcgcgcgccaggg

SEQ ID NO: 389209 - RNA, 13 nt, Bordetella pertussis
gcgcgcgccaggu

SEQ ID NO: 389210 - RNA, 19 nt, Bordetella pertussis
gcgcgcgcaagccgccgcc

SEQ ID NO: 389211 - RNA, 17 nt, Bordetella pertussis
gcgcgcgcacaggcgcu

SEQ ID NO: 389212 - RNA, 15 nt, Bordetella pertussis
gcgcgcgcagcaauu

SEQ ID NO: 389213 - RNA, 17 nt, Bordetella pertussis
gcgcgcgaugcgcaggc

SEQ ID NO: 389214 - RNA, 13 nt, Bordetella pertussis
gcgcgcgccgcgc

SEQ ID NO: 389215 - RNA, 14 nt, Bordetella pertussis
gcgcgcgccggacg

SEQ ID NO: 389216 - RNA, 14 nt, Bordetella pertussis
gcgcgcgccggccg

SEQ ID NO: 389217 - RNA, 15 nt, Bordetella pertussis
gcgcgcgccggcggc

SEQ ID NO: 389218 - RNA, 11 nt, Bordetella pertussis
gcgcgcgccug

SEQ ID NO: 389219 - RNA, 17 nt, Bordetella pertussis
gcgcgcgccugccccgc

SEQ ID NO: 389220 - RNA, 13 nt, Bordetella pertussis
gcgcgcgccugcu

SEQ ID NO: 389221 - RNA, 15 nt, Bordetella pertussis
gcgcgcgcgcgccgc

SEQ ID NO: 389222 - RNA, 17 nt, Bordetella pertussis
gcgcgcgcgcgcgggcg

SEQ ID NO: 389223 - RNA, 14 nt, Bordetella pertussis
gcgcgcgcgcgggc

SEQ ID NO: 389224 - RNA, 15 nt, Bordetella pertussis
gcgcgcgcgcgggcg

SEQ ID NO: 389225 - RNA, 13 nt, Bordetella pertussis
gcgcgcgcggcca

SEQ ID NO: 389226 - RNA, 16 nt, Bordetella pertussis
gcgcgcgcggcgccug

SEQ ID NO: 389227 - RNA, 12 nt, Bordetella pertussis
gcgcgcgcgggc

SEQ ID NO: 389228 - RNA, 13 nt, Bordetella pertussis
gcgcgcgcgggcc

SEQ ID NO: 389229 - RNA, 13 nt, Bordetella pertussis
gcgcgcgcggucc

SEQ ID NO: 389230 - RNA, 14 nt, Bordetella pertussis
gcgcgcgcggucgg

SEQ ID NO: 389231 - RNA, 16 nt, Bordetella pertussis
gcgcgcggauccagcc

SEQ ID NO: 389232 - RNA, 20 nt, Bordetella pertussis
gcgcgcggaugaucgcgcag

SEQ ID NO: 389233 - RNA, 15 nt, Bordetella pertussis
gcgcgcggcagggcg

SEQ ID NO: 389234 - RNA, 18 nt, Bordetella pertussis
gcgcgcggcagggcgucg

SEQ ID NO: 389235 - RNA, 14 nt, Bordetella pertussis
gcgcgcgcuggggc

SEQ ID NO: 389236 - RNA, 14 nt, Bordetella pertussis
gcgcgcugcacggc

SEQ ID NO: 389237 - RNA, 14 nt, Bordetella pertussis
gcgcgcuggcgccc

SEQ ID NO: 389238 - RNA, 19 nt, Bordetella pertussis
gcgcgcuggcgcucgggcg

SEQ ID NO: 389239 - RNA, 17 nt, Bordetella pertussis
gcgcgcuucacccugga

SEQ ID NO: 389240 - RNA, 19 nt, Bordetella pertussis
gcgcgcuucagugcucggg

SEQ ID NO: 389241 - RNA, 20 nt, Bordetella pertussis
gcgcgcuucagugcucgggc

SEQ ID NO: 389242 - RNA, 20 nt, Bordetella pertussis
gcgcgcuuccucgaccaggu

SEQ ID NO: 389243 - RNA, 23 nt, Bordetella pertussis
gcgcgcuugaacuccgcggcguc

SEQ ID NO: 389244 - RNA, 18 nt, Bordetella pertussis
gcgcgcuuucaggugggc

SEQ ID NO: 389245 - RNA, 23 nt, Bordetella pertussis
gcgcgcuuggucagcaucagcag

SEQ ID NO: 389246 - RNA, 18 nt, Bordetella pertussis
gcgcggcaaugcgcgcgc

SEQ ID NO: 389247 - RNA, 16 nt, Bordetella pertussis
gcgcggcacgcugcug

SEQ ID NO: 389248 - RNA, 13 nt, Bordetella pertussis
gcgcggcagccug

SEQ ID NO: 389249 - RNA, 16 nt, Bordetella pertussis
gcgcggcaggcggugc

SEQ ID NO: 389250 - RNA, 19 nt, Bordetella pertussis
gcgcggcagugggcgguga

SEQ ID NO: 389251 - RNA, 18 nt, Bordetella pertussis
gcgcggcauagcccaggc

SEQ ID NO: 389252 - RNA, 22 nt, Bordetella pertussis
gcgcggcagguucugcgcgucc

SEQ ID NO: 389253 - RNA, 19 nt, Bordetella pertussis
gcgcggcaugcgcaugcug

SEQ ID NO: 389254 - RNA, 19 nt, Bordetella pertussis
gcgcggcauggcgccgcgc

SEQ ID NO: 389255 - RNA, 15 nt, Bordetella pertussis
gcgcggccugggcgg

SEQ ID NO: 389256 - RNA, 20 nt, Bordetella pertussis
gcgcggccugggcggcgcgc

SEQ ID NO: 389257 - RNA, 23 nt, Bordetella pertussis
gcgcggccuugcaugcgccgcac

SEQ ID NO: 389258 - RNA, 20 nt, Bordetella pertussis
gcgcggcgagcacggccugc

SEQ ID NO: 389259 - RNA, 14 nt, Bordetella pertussis
gcgcggcgagccgc

SEQ ID NO: 389260 - RNA, 13 nt, Bordetella pertussis
gcgcggcgagcgc

SEQ ID NO: 389261 - RNA, 14 nt, Bordetella pertussis
gcgcggcgagcgcc

SEQ ID NO: 389262 - RNA, 15 nt, Bordetella pertussis
gcgcggcgagcgccg

SEQ ID NO: 389263 - RNA, 20 nt, Bordetella pertussis
gcgcggcgauacgcgccgcc

SEQ ID NO: 389264 - RNA, 20 nt, Bordetella pertussis
gcgcggcgaaggcgcggcug

SEQ ID NO: 389265 - RNA, 22 nt, Bordetella pertussis
gcgcggcgaaggcgcggcugcg

SEQ ID NO: 389266 - RNA, 13 nt, Bordetella pertussis
gcgcggcgcagcg

SEQ ID NO: 389267 - RNA, 15 nt, Bordetella pertussis
gcgcggcgccagcgc

SEQ ID NO: 389268 - RNA, 19 nt, Bordetella pertussis
gcgcggcgccaugccgcgc

SEQ ID NO: 389269 - RNA, 17 nt, Bordetella pertussis
gcgcggcgccgcuggcc

SEQ ID NO: 389270 - RNA, 19 nt, Bordetella pertussis
gcgcggcgccugcgcgcgc

SEQ ID NO: 389271 - RNA, 22 nt, Bordetella pertussis
gcgcggcgccuggggcgugccc

SEQ ID NO: 389272 - RNA, 17 nt, Bordetella pertussis
gcgcggcgcccccgcgg

SEQ ID NO: 389273 - RNA, 14 nt, Bordetella pertussis
gcgcggcgcccgcc

SEQ ID NO: 389274 - RNA, 12 nt, Bordetella pertussis
gcgcggcgcgcc

SEQ ID NO: 389275 - RNA, 15 nt, Bordetella pertussis
gcgcggcgcgcgcgc

SEQ ID NO: 389276 - RNA, 20 nt, Bordetella pertussis
gcgcggcgcgcgcgcgcagc

SEQ ID NO: 389277 - RNA, 15 nt, Bordetella pertussis
gcgcggcgcggccag

SEQ ID NO: 389278 - RNA, 19 nt, Bordetella pertussis
gcgcggcgcgucgcgcgcc

SEQ ID NO: 389279 - RNA, 14 nt, Bordetella pertussis
gcgcggcgcgugcc

SEQ ID NO: 389280 - RNA, 14 nt, Bordetella pertussis
gcgcggcgcuggcg

SEQ ID NO: 389281 - RNA, 18 nt, Bordetella pertussis
gcgcggcgcuggcgccgc

SEQ ID NO: 389282 - RNA, 16 nt, Bordetella pertussis
gcgcucgaaggcgccg

SEQ ID NO: 389283 - RNA, 20 nt, Bordetella pertussis
gcgcucgaaggcgccgacgg

SEQ ID NO: 389284 - RNA, 13 nt, Bordetella pertussis
gcgcucgcacggc

SEQ ID NO: 389285 - RNA, 12 nt, Bordetella pertussis
gcgcucgccggc

SEQ ID NO: 389286 - RNA, 20 nt, Bordetella pertussis
gcgcucgccggcgcgcaggc

SEQ ID NO: 389287 - RNA, 13 nt, Bordetella pertussis
gcgcucgcgcagg

SEQ ID NO: 389288 - RNA, 14 nt, Bordetella pertussis
gcgcucgcgcaggc

SEQ ID NO: 389289 - RNA, 16 nt, Bordetella pertussis
gcgcucgcgccaggcc

SEQ ID NO: 389290 - RNA, 15 nt, Bordetella pertussis
gcgcucgcgcucggc

SEQ ID NO: 389291 - RNA, 16 nt, Bordetella pertussis
gcgcucgcgcucggcc

SEQ ID NO: 389292 - RNA, 19 nt, Bordetella pertussis
gcgcucgcgcucggccagc

SEQ ID NO: 389293 - RNA, 14 nt, Bordetella pertussis
gcgcucgcccggcc

SEQ ID NO: 389294 - RNA, 12 nt, Bordetella pertussis
gcgcucgcccuc

SEQ ID NO: 389295 - RNA, 22 nt, Bordetella pertussis
gcgcucgcgggugcgcagcaca

SEQ ID NO: 389296 - RNA, 14 nt, Bordetella pertussis
gcgcucggacgccg

SEQ ID NO: 389297 - RNA, 15 nt, Bordetella pertussis
gcgcucggacgccgc

SEQ ID NO: 389298 - RNA, 18 nt, Bordetella pertussis
gcgcucggacgccgcgcg

SEQ ID NO: 389299 - RNA, 17 nt, Bordetella pertussis
gcgcucggccagcaugc

SEQ ID NO: 389300 - RNA, 15 nt, Bordetella pertussis
gcgcucggccagcgc

SEQ ID NO: 389301 - RNA, 16 nt, Bordetella pertussis
gcgcucggccacgcuc

SEQ ID NO: 389302 - RNA, 15 nt, Bordetella pertussis
gcgcucggccagcau

SEQ ID NO: 389303 - RNA, 12 nt, Bordetella pertussis
gcgcucggccuc

SEQ ID NO: 389304 - RNA, 17 nt, Bordetella pertussis
gcgcucggcgccgggcu

SEQ ID NO: 389305 - RNA, 22 nt, Bordetella pertussis
gcgcucggcgccgggcuggugc

SEQ ID NO: 389306 - RNA, 23 nt, Bordetella pertussis
gcgcucggcuuccugccgcacuu

SEQ ID NO: 389307 - RNA, 15 nt, Bordetella pertussis
gcgcucgggcgcggc

SEQ ID NO: 389308 - RNA, 13 nt, Bordetella pertussis
gcgcucgucgggg

SEQ ID NO: 389309 - RNA, 18 nt, Bordetella pertussis
gcgcugauccuggcucug

SEQ ID NO: 389310 - RNA, 17 nt, Bordetella pertussis
gcgcugaugcgcggcgg

SEQ ID NO: 389311 - RNA, 18 nt, Bordetella pertussis
gcgcugaugcgcggcggg

SEQ ID NO: 389312 - RNA, 18 nt, Bordetella pertussis
gcgcugcaauugcgcggc

SEQ ID NO: 389313 - RNA, 22 nt, Bordetella pertussis
gcgcugcaauugcgcggccaug

SEQ ID NO: 389314 - RNA, 19 nt, Bordetella pertussis
gcgcugcacgcagcgcagg

SEQ ID NO: 389315 - RNA, 10 nt, Bordetella pertussis
gcgcugcaga

SEQ ID NO: 389316 - RNA, 23 nt, Bordetella pertussis
gcgcugcagaucaucgagcaccg

SEQ ID NO: 389317 - RNA, 16 nt, Bordetella pertussis
gcgcugcacagggacc

SEQ ID NO: 389318 - RNA, 17 nt, Bordetella pertussis
gcgcugcagcgucugcu

SEQ ID NO: 389319 - RNA, 12 nt, Bordetella pertussis
gcgcugcaggcg

SEQ ID NO: 389320 - RNA, 15 nt, Bordetella pertussis
gcgcugcaugcccca

SEQ ID NO: 389321 - RNA, 9 nt, Bordetella pertussis
gcgcugccg

SEQ ID NO: 389322 - RNA, 14 nt, Bordetella pertussis
gcgcugccugccgg

SEQ ID NO: 389323 - RNA, 15 nt, Bordetella pertussis
gcgcugcgacagcag

SEQ ID NO: 389324 - RNA, 11 nt, Bordetella pertussis
gcgcugcgcag

SEQ ID NO: 389325 - RNA, 22 nt, Bordetella pertussis
gcgcugcgcagcagggcggcgg

SEQ ID NO: 389326 - RNA, 15 nt, Bordetella pertussis
gcgcugcgcccgcua

SEQ ID NO: 389327 - RNA, 16 nt, Bordetella pertussis
gcgcugcgccgcggcg

SEQ ID NO: 389328 - RNA, 15 nt, Bordetella pertussis
gcgcugcggucagcu

SEQ ID NO: 389329 - RNA, 17 nt, Bordetella pertussis
gcgcugcggucagcugu

SEQ ID NO: 389330 - RNA, 18 nt, Bordetella pertussis
gcgcugcucguccacggc

SEQ ID NO: 389331 - RNA, 17 nt, Bordetella pertussis
gcgcugcugcaggccgg

SEQ ID NO: 389332 - RNA, 23 nt, Bordetella pertussis
gcgcugcugcuggcugcccuggc

SEQ ID NO: 389333 - RNA, 14 nt, Bordetella pertussis
gcgcugcuggaggc

SEQ ID NO: 389334 - RNA, 18 nt, Bordetella pertussis
gcgcugcuggaggccggc

SEQ ID NO: 389335 - RNA, 15 nt, Bordetella pertussis
gcgcugcuggccaag

SEQ ID NO: 389336 - RNA, 21 nt, Bordetella pertussis
gcgcugcuggccaagcgcgcc

SEQ ID NO: 389337 - RNA, 15 nt, Bordetella pertussis
gcgcugcuggccggc

SEQ ID NO: 389338 - RNA, 16 nt, Bordetella pertussis
gcgcugcuggccggcc

SEQ ID NO: 389339 - RNA, 20 nt, Bordetella pertussis
gcgcuggaagacguggcccg

SEQ ID NO: 389340 - RNA, 14 nt, Bordetella pertussis
gcgcuggaggccuu

SEQ ID NO: 389341 - RNA, 23 nt, Bordetella pertussis
gcgcuggcccaguucgcgcagca

SEQ ID NO: 389342 - RNA, 18 nt, Bordetella pertussis
gcgcuggccgccauggcg

SEQ ID NO: 389343 - RNA, 21 nt, Bordetella pertussis
gcgcuggccgccauggcgcug

SEQ ID NO: 389344 - RNA, 21 nt, Bordetella pertussis
gcgcuggccgcccgcggccug

SEQ ID NO: 389345 - RNA, 14 nt, Bordetella pertussis
gcgcuggccugccg

SEQ ID NO: 389346 - RNA, 15 nt, Bordetella pertussis
gcgcuggccuggccg

SEQ ID NO: 389347 - RNA, 17 nt, Bordetella pertussis
gcgcuggccuggccgcc

SEQ ID NO: 389348 - RNA, 19 nt, Bordetella pertussis
gcgcuggccuggccgccgg

SEQ ID NO: 389349 - RNA, 12 nt, Bordetella pertussis
gcgcuggccggc

SEQ ID NO: 389350 - RNA, 16 nt, Bordetella pertussis
gcgcuggccggccgcg

SEQ ID NO: 389351 - RNA, 20 nt, Bordetella pertussis
gcgcuggccggccgcguggc

SEQ ID NO: 389352 - RNA, 15 nt, Bordetella pertussis
gcgcuggcgcgcggc

SEQ ID NO: 389353 - RNA, 17 nt, Bordetella pertussis
gcgcuggcgcgcggccg

SEQ ID NO: 389354 - RNA, 17 nt, Bordetella pertussis
gcgcuggcgcgcggcug

SEQ ID NO: 389355 - RNA, 18 nt, Bordetella pertussis
gcgcuggcgcgcggcugg

SEQ ID NO: 389356 - RNA, 20 nt, Bordetella pertussis
gcgcuggcgcgcggcuggcu

SEQ ID NO: 389357 - RNA, 21 nt, Bordetella pertussis
gcgcuggcgcgcggcuggcug

SEQ ID NO: 389358 - RNA, 13 nt, Bordetella pertussis
gcgcuggcgcgcu

SEQ ID NO: 389359 - RNA, 14 nt, Bordetella pertussis
gcgcuggcgcccgg

SEQ ID NO: 389360 - RNA, 15 nt, Bordetella pertussis
gcgcuggcgcccggc

SEQ ID NO: 389361 - RNA, 16 nt, Bordetella pertussis
gcgcuggcgcccggcc

SEQ ID NO: 389362 - RNA, 15 nt, Bordetella pertussis
gcgcuggcgcauggc

SEQ ID NO: 389363 - RNA, 22 nt, Bordetella pertussis
gcgcuggcgcucgggcgcggca

SEQ ID NO: 389364 - RNA, 14 nt, Bordetella pertussis
gcgcuggcgcuggc

SEQ ID NO: 389365 - RNA, 16 nt, Bordetella pertussis
gcgcuggcggcgcagg

SEQ ID NO: 389366 - RNA, 13 nt, Bordetella pertussis
gcgcuggcggcug

SEQ ID NO: 389367 - RNA, 23 nt, Bordetella pertussis
gcgcuggcguccagccugcccgg

SEQ ID NO: 389368 - RNA, 15 nt, Bordetella pertussis
gcgcuggcugggccu

SEQ ID NO: 389369 - RNA, 15 nt, Bordetella pertussis
gcgcuggcugugccc

SEQ ID NO: 389370 - RNA, 23 nt, Bordetella pertussis
gcgcuggcuggacgcgcgcggcg

SEQ ID NO: 389371 - RNA, 20 nt, Bordetella pertussis
gcgcugggcaugggcggccc

SEQ ID NO: 389372 - RNA, 14 nt, Bordetella pertussis
gcgcugggccaggc

SEQ ID NO: 389373 - RNA, 21 nt, Bordetella pertussis
gcgcugggccaggccggccuu

SEQ ID NO: 389374 - RNA, 21 nt, Bordetella pertussis
gcgcugggcgguugcgcugcu

SEQ ID NO: 389375 - RNA, 14 nt, Bordetella pertussis
gcgcugggcguggc

SEQ ID NO: 389376 - RNA, 14 nt, Bordetella pertussis
gcgcuggggcagga

SEQ ID NO: 389377 - RNA, 22 nt, Bordetella pertussis
gcgcuggggcaggacgccggcg

SEQ ID NO: 389378 - RNA, 18 nt, Bordetella pertussis
gcgcugggucaggucgcu

SEQ ID NO: 389379 - RNA, 23 nt, Bordetella pertussis
gcgcuggucgcgcagcacgaugg

SEQ ID NO: 389380 - RNA, 13 nt, Bordetella pertussis
gcgcuggugcugg

SEQ ID NO: 389381 - RNA, 18 nt, Bordetella pertussis
gcgcuguaggcgccggcg

SEQ ID NO: 389382 - RNA, 19 nt, Bordetella pertussis
gcgcuguccaggccggggc

SEQ ID NO: 389383 - RNA, 20 nt, Bordetella pertussis
gcgcuguccaggccggggcc

SEQ ID NO: 389384 - RNA, 20 nt, Bordetella pertussis
gcgcuguccgaugcgcugcu

SEQ ID NO: 389385 - RNA, 20 nt, Bordetella pertussis
gcgcuguccggcgcucgccc

SEQ ID NO: 389386 - RNA, 22 nt, Bordetella pertussis
gcgcuguugcuccaggccggca

SEQ ID NO: 389387 - RNA, 20 nt, Bordetella pertussis
gcgcuguuggccggcgcgcc

SEQ ID NO: 389388 - RNA, 23 nt, Bordetella pertussis
gcgcuguuggccggcgcgcccuu

SEQ ID NO: 389389 - RNA, 18 nt, Bordetella pertussis
gcgcuguuucccuuccug

SEQ ID NO: 389390 - RNA, 19 nt, Bordetella pertussis
gcgcuguuucccuuccugg

SEQ ID NO: 389391 - RNA, 18 nt, Bordetella pertussis
gcgcuguuuccgggccug

SEQ ID NO: 389392 - RNA, 18 nt, Bordetella pertussis
gcgcuucagugcucgggc

SEQ ID NO: 389393 - RNA, 20 nt, Bordetella pertussis
gcgcuuuuuucuccagcgcc

SEQ ID NO: 389394 - RNA, 21 nt, Bordetella pertussis
gcggaaaacagcaccagcaug

SEQ ID NO: 389395 - RNA, 16 nt, Bordetella pertussis
gcggaaacgcgcgcgc

SEQ ID NO: 389396 - RNA, 20 nt, Bordetella pertussis
gcggaaguauucgcgcggcg

SEQ ID NO: 389397 - RNA, 18 nt, Bordetella pertussis
gcggacccaggccucggc

SEQ ID NO: 389398 - RNA, 19 nt, Bordetella pertussis
gcggaccugcucgagcggc

SEQ ID NO: 389399 - RNA, 13 nt, Bordetella pertussis
gcggacgccagcc

SEQ ID NO: 389400 - RNA, 14 nt, Bordetella pertussis
gcggacgggccagg

SEQ ID NO: 389401 - RNA, 13 nt, Bordetella pertussis
gcggacggcgggc

SEQ ID NO: 389402 - RNA, 16 nt, Bordetella pertussis
gcggacggcgggcgcc

SEQ ID NO: 389403 - RNA, 23 nt, Bordetella pertussis
gcggaucgaacgccucgggcgca

SEQ ID NO: 389404 - RNA, 19 nt, Bordetella pertussis
gcggaucgccgguagcgcu

SEQ ID NO: 389405 - RNA, 22 nt, Bordetella pertussis
gcggaucgccgguagcgcuggg

SEQ ID NO: 389406 - RNA, 19 nt, Bordetella pertussis
gcggaucucggccagcagc

SEQ ID NO: 389407 - RNA, 16 nt, Bordetella pertussis
gcggauuggacagcag

SEQ ID NO: 389408 - RNA, 19 nt, Bordetella pertussis
gcggauuugcuucaggucg

SEQ ID NO: 389409 - RNA, 22 nt, Bordetella pertussis
gcggcaaaaaaaaccgcgcgcc

SEQ ID NO: 389410 - RNA, 23 nt, Bordetella pertussis
gcggcaaaaaaaaccgcgcgccg

SEQ ID NO: 389411 - RNA, 20 nt, Bordetella pertussis
gcggcaaagucggggcgccg

SEQ ID NO: 389412 - RNA, 16 nt, Bordetella pertussis
gcggcaccgcgcagcc

SEQ ID NO: 389413 - RNA, 17 nt, Bordetella pertussis
gcggcaccucggccggg

SEQ ID NO: 389414 - RNA, 18 nt, Bordetella pertussis
gcggcaccucggccgggg

SEQ ID NO: 389415 - RNA, 21 nt, Bordetella pertussis
gcggcaccucggccggggcgg

SEQ ID NO: 389416 - RNA, 19 nt, Bordetella pertussis
gcggcacgaaaagccgcgg

SEQ ID NO: 389417 - RNA, 18 nt, Bordetella pertussis
gcggcacgaucggcgccu

SEQ ID NO: 389418 - RNA, 16 nt, Bordetella pertussis
gcggcacgccggcggc

SEQ ID NO: 389419 - RNA, 22 nt, Bordetella pertussis
gcggcacgcgcgccggcagggu

SEQ ID NO: 389420 - RNA, 17 nt, Bordetella pertussis
gcggcacggccagcggc

SEQ ID NO: 389421 - RNA, 16 nt, Bordetella pertussis
gcggcacggccggccu

SEQ ID NO: 389422 - RNA, 19 nt, Bordetella pertussis
gcggcacugaugcugguca

SEQ ID NO: 389423 - RNA, 23 nt, Bordetella pertussis
gcggcagcucggcgaagccgcag

SEQ ID NO: 389424 - RNA, 15 nt, Bordetella pertussis
gcggcaggccccggc

SEQ ID NO: 389425 - RNA, 18 nt, Bordetella pertussis
gcggcaggcccugccgcc

SEQ ID NO: 389426 - RNA, 13 nt, Bordetella pertussis
gcggcaggccgca

SEQ ID NO: 389427 - RNA, 15 nt, Bordetella pertussis
gcggcaggccgcagc

SEQ ID NO: 389428 - RNA, 14 nt, Bordetella pertussis
gcggcaggcggcug

SEQ ID NO: 389429 - RNA, 23 nt, Bordetella pertussis
gcggcaggcggugcggaggcggc

SEQ ID NO: 389430 - RNA, 20 nt, Bordetella pertussis
gcggcagggccuccugcagc

SEQ ID NO: 389431 - RNA, 20 nt, Bordetella pertussis
gcggcaucgacaugcccgcc

SEQ ID NO: 389432 - RNA, 22 nt, Bordetella pertussis
gcggcaucgagaaaccagccgc

SEQ ID NO: 389433 - RNA, 19 nt, Bordetella pertussis
gcggcaucguucaggcgca

SEQ ID NO: 389434 - RNA, 18 nt, Bordetella pertussis
gcggcaucucgcggcggu

SEQ ID NO: 389435 - RNA, 18 nt, Bordetella pertussis
gcggcaugcgcaugcugg

SEQ ID NO: 389436 - RNA, 16 nt, Bordetella pertussis
gcggcaugcuggucau

SEQ ID NO: 389437 - RNA, 20 nt, Bordetella pertussis
gcggcauggcgccgcgccgc

SEQ ID NO: 389438 - RNA, 19 nt, Bordetella pertussis
gcggccaaccccgagggcg

SEQ ID NO: 389439 - RNA, 20 nt, Bordetella pertussis
gcggccaaccccgagggcgc

SEQ ID NO: 389440 - RNA, 21 nt, Bordetella pertussis
gcggccaaccccgagggcgcg

SEQ ID NO: 389441 - RNA, 15 nt, Bordetella pertussis
gcggccaccaccagg

SEQ ID NO: 389442 - RNA, 16 nt, Bordetella pertussis
gcggccaccaggcuga

SEQ ID NO: 389443 - RNA, 17 nt, Bordetella pertussis
gcggccacggccugccc

SEQ ID NO: 389444 - RNA, 22 nt, Bordetella pertussis
gcggccagaccuugcgcgacgg

SEQ ID NO: 389445 - RNA, 14 nt, Bordetella pertussis
gcggccagcaccgg

SEQ ID NO: 389446 - RNA, 19 nt, Bordetella pertussis
gcggccagcaccggccgcc

SEQ ID NO: 389447 - RNA, 15 nt, Bordetella pertussis
gcggccagcagcggc

SEQ ID NO: 389448 - RNA, 16 nt, Bordetella pertussis
gcggccagcaugcugg

SEQ ID NO: 389449 - RNA, 15 nt, Bordetella pertussis
gcggcccacggccag

SEQ ID NO: 389450 - RNA, 16 nt, Bordetella pertussis
gcggcccacggccagc

SEQ ID NO: 389451 - RNA, 14 nt, Bordetella pertussis
gcggcccagccgcu

SEQ ID NO: 389452 - RNA, 16 nt, Bordetella pertussis
gcggcccagccgcucg

SEQ ID NO: 389453 - RNA, 22 nt, Bordetella pertussis
gcggcccagccgcucggccacg

SEQ ID NO: 389454 - RNA, 14 nt, Bordetella pertussis
gcggcccagcgcgg

SEQ ID NO: 389455 - RNA, 19 nt, Bordetella pertussis
gcggcccagcggcaaagua

SEQ ID NO: 389456 - RNA, 14 nt, Bordetella pertussis
gcggcccgccacgc

SEQ ID NO: 389457 - RNA, 15 nt, Bordetella pertussis
gcggcccgccagggc

SEQ ID NO: 389458 - RNA, 20 nt, Bordetella pertussis
gcggcccgcccgcggaucgg

SEQ ID NO: 389459 - RNA, 12 nt, Bordetella pertussis
gcggcccgccga

SEQ ID NO: 389460 - RNA, 19 nt, Bordetella pertussis
gcggcccgccgacugggcu

SEQ ID NO: 389461 - RNA, 13 nt, Bordetella pertussis
gcggcccgcgccc

SEQ ID NO: 389462 - RNA, 14 nt, Bordetella pertussis
gcggcccgcggccu

SEQ ID NO: 389463 - RNA, 17 nt, Bordetella pertussis
gcggcccgcuccaggcg

SEQ ID NO: 389464 - RNA, 23 nt, Bordetella pertussis
gcggcccgcuccaggcggccagu

SEQ ID NO: 389465 - RNA, 15 nt, Bordetella pertussis
gcggcccggccgccg

SEQ ID NO: 389466 - RNA, 18 nt, Bordetella pertussis
gcggcccggcggcaaaaa

SEQ ID NO: 389467 - RNA, 18 nt, Bordetella pertussis
gcggcccggcgucggguc

SEQ ID NO: 389468 - RNA, 13 nt, Bordetella pertussis
gcggcccuguucg

SEQ ID NO: 389469 - RNA, 17 nt, Bordetella pertussis
gcggcccuguucgcgcg

SEQ ID NO: 389470 - RNA, 16 nt, Bordetella pertussis
gcggcccugggccagc

SEQ ID NO: 389471 - RNA, 17 nt, Bordetella pertussis
gcggccgacgggcggcu

SEQ ID NO: 389472 - RNA, 15 nt, Bordetella pertussis
gcggccgagcgggcc

SEQ ID NO: 389473 - RNA, 18 nt, Bordetella pertussis
gcggccgagcgggccagc

SEQ ID NO: 389474 - RNA, 11 nt, Bordetella pertussis
gcggccgagcu

SEQ ID NO: 389475 - RNA, 15 nt, Bordetella pertussis
gcggccgagcuccuc

SEQ ID NO: 389476 - RNA, 15 nt, Bordetella pertussis
gcggccgaggccagc

SEQ ID NO: 389477 - RNA, 17 nt, Bordetella pertussis
gcggccgaggccagcgu

SEQ ID NO: 389478 - RNA, 21 nt, Bordetella pertussis
gcggccgaggccagcgugccc

SEQ ID NO: 389479 - RNA, 14 nt, Bordetella pertussis
gcggccgcagcagu

SEQ ID NO: 389480 - RNA, 13 nt, Bordetella pertussis
gcggccgcagcgg

SEQ ID NO: 389481 - RNA, 15 nt, Bordetella pertussis
gcggccgccacccag

SEQ ID NO: 389482 - RNA, 14 nt, Bordetella pertussis
gcggccgcccagca

SEQ ID NO: 389483 - RNA, 13 nt, Bordetella pertussis
gcggcgcaccagc

SEQ ID NO: 389484 - RNA, 15 nt, Bordetella pertussis
gcggcgcagccgcca

SEQ ID NO: 389485 - RNA, 13 nt, Bordetella pertussis
gcggcgcagccgg

SEQ ID NO: 389486 - RNA, 14 nt, Bordetella pertussis
gcggcgcagcgccc

SEQ ID NO: 389487 - RNA, 23 nt, Bordetella pertussis
gcggcgcaggccagcgccgcggu

SEQ ID NO: 389488 - RNA, 20 nt, Bordetella pertussis
gcggcgcaggccgcgccggc

SEQ ID NO: 389489 - RNA, 15 nt, Bordetella pertussis
gcggcgcaggcgggc

SEQ ID NO: 389490 - RNA, 17 nt, Bordetella pertussis
gcggcgcaugcagccgc

SEQ ID NO: 389491 - RNA, 13 nt, Bordetella pertussis
gcggcgcaucagc

SEQ ID NO: 389492 - RNA, 18 nt, Bordetella pertussis
gcggcgcaucagcgcgcc

SEQ ID NO: 389493 - RNA, 13 nt, Bordetella pertussis
gcggcgccagcgc

SEQ ID NO: 389494 - RNA, 16 nt, Bordetella pertussis
gcggcgcccagcuggc

SEQ ID NO: 389495 - RNA, 20 nt, Bordetella pertussis
gcggcgcccgcgcaugcaag

SEQ ID NO: 389496 - RNA, 17 nt, Bordetella pertussis
gcggcgcgcacgggcga

SEQ ID NO: 389497 - RNA, 14 nt, Bordetella pertussis
gcggcgcgcccagc

SEQ ID NO: 389498 - RNA, 13 nt, Bordetella pertussis
gcggcgcgcccgc

SEQ ID NO: 389499 - RNA, 15 nt, Bordetella pertussis
gcggcgcgcccgccu

SEQ ID NO: 389500 - RNA, 21 nt, Bordetella pertussis
gcggcgcgcgccagggcgccg

SEQ ID NO: 389501 - RNA, 15 nt, Bordetella pertussis
gcggcgcgcgccugc

SEQ ID NO: 389502 - RNA, 15 nt, Bordetella pertussis
gcggcgcgcgcgccg

SEQ ID NO: 389503 - RNA, 14 nt, Bordetella pertussis
gcggcgcgcgcggc

SEQ ID NO: 389504 - RNA, 12 nt, Bordetella pertussis
gcggcgcgggcg

SEQ ID NO: 389505 - RNA, 21 nt, Bordetella pertussis
gcggcgcgcuggacgucggug

SEQ ID NO: 389506 - RNA, 18 nt, Bordetella pertussis
gcggcgcgcuggaggccu

SEQ ID NO: 389507 - RNA, 13 nt, Bordetella pertussis
gcggcgcgggcgg

SEQ ID NO: 389508 - RNA, 15 nt, Bordetella pertussis
gcggcgcgggcggcu

SEQ ID NO: 389509 - RNA, 18 nt, Bordetella pertussis
gcggcgcgggcggcuagg

SEQ ID NO: 389510 - RNA, 15 nt, Bordetella pertussis
gcggcgcggucagca

SEQ ID NO: 389511 - RNA, 14 nt, Bordetella pertussis
gcggcgcggucggc

SEQ ID NO: 389512 - RNA, 20 nt, Bordetella pertussis
gcggcgcgucgcgcgccagg

SEQ ID NO: 389513 - RNA, 22 nt, Bordetella pertussis
gcggcgcgucgcgcgccaggcg

SEQ ID NO: 389514 - RNA, 19 nt, Bordetella pertussis
gcggcgcgugccagcaggu

SEQ ID NO: 389515 - RNA, 20 nt, Bordetella pertussis
gcggcgcguucgccgcagcc

SEQ ID NO: 389516 - RNA, 23 nt, Bordetella pertussis
gcggcgcguucucagccgcccgc

SEQ ID NO: 389517 - RNA, 21 nt, Bordetella pertussis
gcggcgcguucagggcgccgc

SEQ ID NO: 389518 - RNA, 18 nt, Bordetella pertussis
gcggcgcuacgccgccga

SEQ ID NO: 389519 - RNA, 22 nt, Bordetella pertussis
gcggcgcucgaaggcgccgacg

SEQ ID NO: 389520 - RNA, 23 nt, Bordetella pertussis
gcggcgcucgaaggcgccgacgg

SEQ ID NO: 389521 - RNA, 20 nt, Bordetella pertussis
gcggcgcugcacgcggccgc

SEQ ID NO: 389522 - RNA, 16 nt, Bordetella pertussis
gcggcgcuggcgccgc

SEQ ID NO: 389523 - RNA, 19 nt, Bordetella pertussis
gcggcgcuggcgccgcgcg

SEQ ID NO: 389524 - RNA, 13 nt, Bordetella pertussis
gcggcgcuggcug

SEQ ID NO: 389525 - RNA, 20 nt, Bordetella pertussis
gcggcgcuggcuggacgcgc

SEQ ID NO: 389526 - RNA, 22 nt, Bordetella pertussis
gcggcgcuggcuggacgcgcgc

SEQ ID NO: 389527 - RNA, 11 nt, Bordetella pertussis
gcggcgcuggc

SEQ ID NO: 389528 - RNA, 20 nt, Bordetella pertussis
gcggcgcuuaccgcgccggc

SEQ ID NO: 389529 - RNA, 20 nt, Bordetella pertussis
gcggcggcacgcgcgccggc

SEQ ID NO: 389530 - RNA, 14 nt, Bordetella pertussis
gcggcggcaugcug

SEQ ID NO: 389531 - RNA, 13 nt, Bordetella pertussis
gcggcggccaggc

SEQ ID NO: 389532 - RNA, 14 nt, Bordetella pertussis
gcggcggccaugcc

SEQ ID NO: 389533 - RNA, 13 nt, Bordetella pertussis
gcggcggccgggg

SEQ ID NO: 389534 - RNA, 16 nt, Bordetella pertussis
gcggcggccggggccg

SEQ ID NO: 389535 - RNA, 15 nt, Bordetella pertussis
gcggcggccuccagc

SEQ ID NO: 389536 - RNA, 18 nt, Bordetella pertussis
gcggcggccuccagcagg

SEQ ID NO: 389537 - RNA, 13 nt, Bordetella pertussis
gcggcggccuggg

SEQ ID NO: 389538 - RNA, 16 nt, Bordetella pertussis
gcggcggccugggcgg

SEQ ID NO: 389539 - RNA, 13 nt, Bordetella pertussis
gcggcggccuugu

SEQ ID NO: 389540 - RNA, 21 nt, Bordetella pertussis
gcggcggcgaccggcgccggc

SEQ ID NO: 389541 - RNA, 14 nt, Bordetella pertussis
gcggcggcgcgcgc

SEQ ID NO: 389542 - RNA, 12 nt, Bordetella pertussis
gcggcggcgcug

SEQ ID NO: 389543 - RNA, 23 nt, Bordetella pertussis
gcggcggcgcuggccugccgcgc

SEQ ID NO: 389544 - RNA, 15 nt, Bordetella pertussis
gcggcggcggccaug

SEQ ID NO: 389545 - RNA, 15 nt, Bordetella pertussis
gcggcggcgucgcgc

SEQ ID NO: 389546 - RNA, 13 nt, Bordetella pertussis
gcggcggcgggcg

SEQ ID NO: 389547 - RNA, 17 nt, Bordetella pertussis
gcggcggcugugggccu

SEQ ID NO: 389548 - RNA, 18 nt, Bordetella pertussis
gcggcggcuucgcgcagc

SEQ ID NO: 389549 - RNA, 23 nt, Bordetella pertussis
gcggcgggcacgagaucgccugg

SEQ ID NO: 389550 - RNA, 14 nt, Bordetella pertussis
gcggcgggccccgc

SEQ ID NO: 389551 - RNA, 23 nt, Bordetella pertussis
gcggcgggccccgcagggcccgc

SEQ ID NO: 389552 - RNA, 13 nt, Bordetella pertussis
gcggcgggcgcug

SEQ ID NO: 389553 - RNA, 16 nt, Bordetella pertussis
gcggcgggcgcuggcg

SEQ ID NO: 389554 - RNA, 19 nt, Bordetella pertussis
gcggcgggcgcuggcgcgc

SEQ ID NO: 389555 - RNA, 14 nt, Bordetella pertussis
gcggcgggcggccg

SEQ ID NO: 389556 - RNA, 15 nt, Bordetella pertussis
gcggcgggcggccgg

SEQ ID NO: 389557 - RNA, 17 nt, Bordetella pertussis
gcggcgggcggcgcggc

SEQ ID NO: 389558 - RNA, 14 nt, Bordetella pertussis
gcggcgggcucagc

SEQ ID NO: 389559 - RNA, 16 nt, Bordetella pertussis
gcggcgggcucagccc

SEQ ID NO: 389560 - RNA, 20 nt, Bordetella pertussis
gcggcgggcucggcgccggc

SEQ ID NO: 389561 - RNA, 21 nt, Bordetella pertussis
gcggcgggcucggcgccggcg

SEQ ID NO: 389562 - RNA, 14 nt, Bordetella pertussis
gcggcggguggccu

SEQ ID NO: 389563 - RNA, 16 nt, Bordetella pertussis
gcggcggugccagcgc

SEQ ID NO: 389564 - RNA, 23 nt, Bordetella pertussis
gcggcgguuucggccgggaaggc

SEQ ID NO: 389565 - RNA, 21 nt, Bordetella pertussis
gcggcgguuucuuccagcagg

SEQ ID NO: 389566 - RNA, 17 nt, Bordetella pertussis
gcggcguacaggugcug

SEQ ID NO: 389567 - RNA, 19 nt, Bordetella pertussis
gcggcguacuggcgcggcg

SEQ ID NO: 389568 - RNA, 20 nt, Bordetella pertussis
gcggcguacuggcgcggcgg

SEQ ID NO: 389569 - RNA, 23 nt, Bordetella pertussis
gcggcguacuggcgcggcggcca

SEQ ID NO: 389570 - RNA, 15 nt, Bordetella pertussis
gcggcguaucggggu

SEQ ID NO: 389571 - RNA, 19 nt, Bordetella pertussis
gcggcguccgcgccgaacg

SEQ ID NO: 389572 - RNA, 23 nt, Bordetella pertussis
gcggcgucgaaggccgccggacg

SEQ ID NO: 389573 - RNA, 19 nt, Bordetella pertussis
gcggcgucgaccgcgggcg

SEQ ID NO: 389574 - RNA, 21 nt, Bordetella pertussis
gcggcgucgaucggcgcgccc

SEQ ID NO: 389575 - RNA, 18 nt, Bordetella pertussis
gcggcgucgcgcuguucg

SEQ ID NO: 389576 - RNA, 21 nt, Bordetella pertussis
gcggcgucgcgcuguucgggc

SEQ ID NO: 389577 - RNA, 15 nt, Bordetella pertussis
gcggcgucggcgccc

SEQ ID NO: 389578 - RNA, 16 nt, Bordetella pertussis
gcggcgugaacgcgca

SEQ ID NO: 389579 - RNA, 15 nt, Bordetella pertussis
gcggcgugaccgcga

SEQ ID NO: 389580 - RNA, 17 nt, Bordetella pertussis
gcggcgugcgccugcug

SEQ ID NO: 389581 - RNA, 14 nt, Bordetella pertussis
gcggcguggggccg

SEQ ID NO: 389582 - RNA, 16 nt, Bordetella pertussis
gcggcgugugcccagc

SEQ ID NO: 389583 - RNA, 18 nt, Bordetella pertussis
gcggcgugugcccagcac

SEQ ID NO: 389584 - RNA, 19 nt, Bordetella pertussis
gcggcguucugcagcgcgg

SEQ ID NO: 389585 - RNA, 20 nt, Bordetella pertussis
gcggcguucugcagcgcggu

SEQ ID NO: 389586 - RNA, 22 nt, Bordetella pertussis
gcggcguugaccuggucgggcg

SEQ ID NO: 389587 - RNA, 20 nt, Bordetella pertussis
gcggcuauugccaggggucg

SEQ ID NO: 389588 - RNA, 18 nt, Bordetella pertussis
gcggcucgagcggcagca

SEQ ID NO: 389589 - RNA, 13 nt, Bordetella pertussis
gcggcucgaggaa

SEQ ID NO: 389590 - RNA, 15 nt, Bordetella pertussis
gcggcucgccgcgca

SEQ ID NO: 389591 - RNA, 21 nt, Bordetella pertussis
gcggcucgccgcgcacgggcg

SEQ ID NO: 389592 - RNA, 13 nt, Bordetella pertussis
gcggcucgccggc

SEQ ID NO: 389593 - RNA, 23 nt, Bordetella pertussis
gcggcugaagaagcccggcugcu

SEQ ID NO: 389594 - RNA, 18 nt, Bordetella pertussis
gcggcugcgggccggcgc

SEQ ID NO: 389595 - RNA, 16 nt, Bordetella pertussis
gcggcugcgggcgcaa

SEQ ID NO: 389596 - RNA, 22 nt, Bordetella pertussis
gcggcugcuggaacggugcgag

SEQ ID NO: 389597 - RNA, 21 nt, Bordetella pertussis
gcggcuggccacuggccgcgc

SEQ ID NO: 389598 - RNA, 16 nt, Bordetella pertussis
gcggcuggcgcggccg

SEQ ID NO: 389599 - RNA, 14 nt, Bordetella pertussis
gcggcuugccgucg

SEQ ID NO: 389600 - RNA, 21 nt, Bordetella pertussis
gcggcuugccgucgaccgcga

SEQ ID NO: 389601 - RNA, 19 nt, Bordetella pertussis
gcggcuuucaugggccugg

SEQ ID NO: 389602 - RNA, 23 nt, Bordetella pertussis
gcggcuuucgauuugcagcagca

SEQ ID NO: 389603 - RNA, 17 nt, Bordetella pertussis
gcgggaagcgcucgcgc

SEQ ID NO: 389604 - RNA, 13 nt, Bordetella pertussis
gcgggaagcuguc

SEQ ID NO: 389605 - RNA, 20 nt, Bordetella pertussis
gcgggaauucugaacaaggg

SEQ ID NO: 389606 - RNA, 17 nt, Bordetella pertussis
gcgggaauugggcgagc

SEQ ID NO: 389607 - RNA, 15 nt, Bordetella pertussis
gcgggacggccaggg

SEQ ID NO: 389608 - RNA, 20 nt, Bordetella pertussis
gcgggaggcuuugggggggc

SEQ ID NO: 389609 - RNA, 17 nt, Bordetella pertussis
gcgggcauugggcagcg

SEQ ID NO: 389610 - RNA, 21 nt, Bordetella pertussis
gcgggcauugggcagcggacg

SEQ ID NO: 389611 - RNA, 23 nt, Bordetella pertussis
gcgggcauugggcagcggacggu

SEQ ID NO: 389612 - RNA, 21 nt, Bordetella pertussis
gcgggccacugcgccugggcg

SEQ ID NO: 389613 - RNA, 12 nt, Bordetella pertussis
gcgggccaggcc

SEQ ID NO: 389614 - RNA, 15 nt, Bordetella pertussis
gcgggccaggccggc

SEQ ID NO: 389615 - RNA, 21 nt, Bordetella pertussis
gcgggccagguauucggcggu

SEQ ID NO: 389616 - RNA, 19 nt, Bordetella pertussis
gcgggcccgacagcgcccc

SEQ ID NO: 389617 - RNA, 19 nt, Bordetella pertussis
gcgggcccgcaucgcgcgc

SEQ ID NO: 389618 - RNA, 20 nt, Bordetella pertussis
gcgggcccgcaucgcgcgcc

SEQ ID NO: 389619 - RNA, 16 nt, Bordetella pertussis
gcgggccuuggccagc

SEQ ID NO: 389620 - RNA, 19 nt, Bordetella pertussis
gcgggcgagaucagccacc

SEQ ID NO: 389621 - RNA, 13 nt, Bordetella pertussis
gcgggcgaggacu

SEQ ID NO: 389622 - RNA, 23 nt, Bordetella pertussis
gcgggcgauuugccgcagcccgc

SEQ ID NO: 389623 - RNA, 24 nt, Bordetella pertussis
gcgggcgcaaguguggcgcaccgc

SEQ ID NO: 389624 - RNA, 13 nt, Bordetella pertussis
gcgggcgcagcgc

SEQ ID NO: 389625 - RNA, 14 nt, Bordetella pertussis
gcgggcgccgcgca

SEQ ID NO: 389626 - RNA, 17 nt, Bordetella pertussis
gcgggcgccgcgcccgg

SEQ ID NO: 389627 - RNA, 13 nt, Bordetella pertussis
gcgggcgccgcgg

SEQ ID NO: 389628 - RNA, 16 nt, Bordetella pertussis
gcgggcgccugcggca

SEQ ID NO: 389629 - RNA, 15 nt, Bordetella pertussis
gcgggcgcgcaggcc

SEQ ID NO: 389630 - RNA, 19 nt, Bordetella pertussis
gcgggcgugaugccgacca

SEQ ID NO: 389631 - RNA, 21 nt, Bordetella pertussis
gcgggcucagcccgccuggcg

SEQ ID NO: 389632 - RNA, 20 nt, Bordetella pertussis
gcgggcugcgcggguccggc

SEQ ID NO: 389633 - RNA, 13 nt, Bordetella pertussis
gcgggcugguggu

SEQ ID NO: 389634 - RNA, 19 nt, Bordetella pertussis
gcgggcuugcugccccccg

SEQ ID NO: 389635 - RNA, 23 nt, Bordetella pertussis
gcgggcuugucgcugcgcauggc

SEQ ID NO: 389636 - RNA, 21 nt, Bordetella pertussis
gcgggcuuguuuuccaucagc

SEQ ID NO: 389637 - RNA, 12 nt, Bordetella pertussis
gcggggacaggc

SEQ ID NO: 389638 - RNA, 23 nt, Bordetella pertussis
gcggggacaggcaccccgucaug

SEQ ID NO: 389639 - RNA, 17 nt, Bordetella pertussis
gcggggacaggcacccg

SEQ ID NO: 389640 - RNA, 18 nt, Bordetella pertussis
gcggggacaggcacccug

SEQ ID NO: 389641 - RNA, 22 nt, Bordetella pertussis
gcggggacaggcaccgccgcac

SEQ ID NO: 389642 - RNA, 17 nt, Bordetella pertussis
gcggggacaggcaccuu

SEQ ID NO: 389643 - RNA, 19 nt, Bordetella pertussis
gcggggacaggcgccucgc

SEQ ID NO: 389644 - RNA, 18 nt, Bordetella pertussis
gcggggacaggcucccgc

SEQ ID NO: 389645 - RNA, 18 nt, Bordetella pertussis
gcggggaccggcacccgc

SEQ ID NO: 389646 - RNA, 17 nt, Bordetella pertussis
gcggggacuggcaccag

SEQ ID NO: 389647 - RNA, 18 nt, Bordetella pertussis
gcggggacuggcaccagg

SEQ ID NO: 389648 - RNA, 19 nt, Bordetella pertussis
gcggggauguuccggcugg

SEQ ID NO: 389649 - RNA, 17 nt, Bordetella pertussis
gcggguacuggccgacg

SEQ ID NO: 389650 - RNA, 21 nt, Bordetella pertussis
gcggguaggcaaagcgcagca

SEQ ID NO: 389651 - RNA, 21 nt, Bordetella pertussis
gcgggucaaguccggcgccgc

SEQ ID NO: 389652 - RNA, 22 nt, Bordetella pertussis
gcgggucaaguccggcgccgcc

SEQ ID NO: 389653 - RNA, 20 nt, Bordetella pertussis
gcggguccuugccgggcucg

SEQ ID NO: 389654 - RNA, 14 nt, Bordetella pertussis
gcgggucggcgcca

SEQ ID NO: 389655 - RNA, 16 nt, Bordetella pertussis
gcgggucggcgccaug

SEQ ID NO: 389656 - RNA, 18 nt, Bordetella pertussis
gcgggucggcgccaugac

SEQ ID NO: 389657 - RNA, 21 nt, Bordetella pertussis
gcgggucgucccagcgcacgc

SEQ ID NO: 389658 - RNA, 19 nt, Bordetella pertussis
gcgggucgugaagccuucg

SEQ ID NO: 389659 - RNA, 17 nt, Bordetella pertussis
gcgggugaugcugcagc

SEQ ID NO: 389660 - RNA, 21 nt, Bordetella pertussis
gcgguauggccgcccagcauu

SEQ ID NO: 389661 - RNA, 18 nt, Bordetella pertussis
gcgguauucgcgcuggcg

SEQ ID NO: 389662 - RNA, 16 nt, Bordetella pertussis
gcgguauucgcugcug

SEQ ID NO: 389663 - RNA, 20 nt, Bordetella pertussis
gcggucaaugaagggcugca

SEQ ID NO: 389664 - RNA, 20 nt, Bordetella pertussis
gcggucaaugcggcggcgcu

SEQ ID NO: 389665 - RNA, 23 nt, Bordetella pertussis
gcggucaaugcggcggcgcuggc

SEQ ID NO: 389666 - RNA, 18 nt, Bordetella pertussis
gcggucacaucuguccug

SEQ ID NO: 389667 - RNA, 19 nt, Bordetella pertussis
gcggucaccgagcugagca

SEQ ID NO: 389668 - RNA, 16 nt, Bordetella pertussis
gcucaucaccagcagg

SEQ ID NO: 389669 - RNA, 19 nt, Bordetella pertussis
gcucaucaucgcgcuggcg

SEQ ID NO: 389670 - RNA, 16 nt, Bordetella pertussis
gcucaucggcaggccg

SEQ ID NO: 389671 - RNA, 16 nt, Bordetella pertussis
gcuccagccgcaggcu

SEQ ID NO: 389672 - RNA, 15 nt, Bordetella pertussis
gcuccagcgcgccga

SEQ ID NO: 389673 - RNA, 22 nt, Bordetella pertussis
gcuccagcgucauggccuggcc

SEQ ID NO: 389674 - RNA, 15 nt, Bordetella pertussis
gcuccaugcggcggc

SEQ ID NO: 389675 - RNA, 16 nt, Bordetella pertussis
gcuccauggcgccggc

SEQ ID NO: 389676 - RNA, 20 nt, Bordetella pertussis
gcucccacgaacgccacgcc

SEQ ID NO: 389677 - RNA, 15 nt, Bordetella pertussis
gcuccgacggcugga

SEQ ID NO: 389678 - RNA, 16 nt, Bordetella pertussis
gcuccgauagcggcgc

SEQ ID NO: 389679 - RNA, 19 nt, Bordetella pertussis
gcuccgauagcggcgccgc

SEQ ID NO: 389680 - RNA, 21 nt, Bordetella pertussis
gcuccgauagcggcgccgcuu

SEQ ID NO: 389681 - RNA, 13 nt, Bordetella pertussis
gcuccgccaugga

SEQ ID NO: 389682 - RNA, 13 nt, Bordetella pertussis
gcuccggcaugaa

SEQ ID NO: 389683 - RNA, 19 nt, Bordetella pertussis
gcuccggcgugacguggcc

SEQ ID NO: 389684 - RNA, 23 nt, Bordetella pertussis
gcuccggcggcagcgcgaacggc

SEQ ID NO: 389685 - RNA, 16 nt, Bordetella pertussis
gcuccguuccgaugcu

SEQ ID NO: 389686 - RNA, 13 nt, Bordetella pertussis
gcuccuccccaac

SEQ ID NO: 389687 - RNA, 12 nt, Bordetella pertussis
gcuccucgagcg

SEQ ID NO: 389688 - RNA, 20 nt, Bordetella pertussis
gcuccucgcccgaccugcug

SEQ ID NO: 389689 - RNA, 21 nt, Bordetella pertussis
gcuccucgcccgaccugcugg

SEQ ID NO: 389690 - RNA, 22 nt, Bordetella pertussis
gcuccucgcgcgcggacugcca

SEQ ID NO: 389691 - RNA, 12 nt, Bordetella pertussis
gcuccucggccu

SEQ ID NO: 389692 - RNA, 20 nt, Bordetella pertussis
gcuccucggccugccggcgc

SEQ ID NO: 389693 - RNA, 17 nt, Bordetella pertussis
gcuccugcaggaugggg

SEQ ID NO: 389694 - RNA, 18 nt, Bordetella pertussis
gcuccugccaggcgccgc

SEQ ID NO: 389695 - RNA, 11 nt, Bordetella pertussis
gcuccugcugg

SEQ ID NO: 389696 - RNA, 20 nt, Bordetella pertussis
gcuccugugggggcgcggcg

SEQ ID NO: 389697 - RNA, 21 nt, Bordetella pertussis
gcuccugugggggcgcggcgg

SEQ ID NO: 389698 - RNA, 22 nt, Bordetella pertussis
gcuccugugggggcgcggcggc

SEQ ID NO: 389699 - RNA, 17 nt, Bordetella pertussis
gcucgaaaaagcccugc

SEQ ID NO: 389700 - RNA, 12 nt, Bordetella pertussis
gcucgaacaggc

SEQ ID NO: 389701 - RNA, 16 nt, Bordetella pertussis
gcucgacgaagcccgu

SEQ ID NO: 389702 - RNA, 17 nt, Bordetella pertussis
gcucgacgccguacugg

SEQ ID NO: 389703 - RNA, 19 nt, Bordetella pertussis
gcucgagcuggcuggccag

SEQ ID NO: 389704 - RNA, 14 nt, Bordetella pertussis
gcucgaggccaggc

SEQ ID NO: 389705 - RNA, 15 nt, Bordetella pertussis
gcucgaggccaggcu

SEQ ID NO: 389706 - RNA, 17 nt, Bordetella pertussis
gcucgaggccaggcuga

SEQ ID NO: 389707 - RNA, 15 nt, Bordetella pertussis
gcucgaggcgcuggc

SEQ ID NO: 389708 - RNA, 13 nt, Bordetella pertussis
gcucgagcgccug

SEQ ID NO: 389709 - RNA, 19 nt, Bordetella pertussis
gcucgaucaggcgcuccau

SEQ ID NO: 389710 - RNA, 15 nt, Bordetella pertussis
gcucgaucgccgccg

SEQ ID NO: 389711 - RNA, 16 nt, Bordetella pertussis
gcucgaucgccgccgg

SEQ ID NO: 389712 - RNA, 16 nt, Bordetella pertussis
gcucgaugaccagcag

SEQ ID NO: 389713 - RNA, 21 nt, Bordetella pertussis
gcucgaugaccagcagcgaau

SEQ ID NO: 389714 - RNA, 21 nt, Bordetella pertussis
gcucgaugcaauagcgcccgc

SEQ ID NO: 389715 - RNA, 22 nt, Bordetella pertussis
gcucgaugccggccucggccau

SEQ ID NO: 389716 - RNA, 12 nt, Bordetella pertussis
gcucgcaggccu

SEQ ID NO: 389717 - RNA, 17 nt, Bordetella pertussis
gcucgcccagccgccug

SEQ ID NO: 389718 - RNA, 20 nt, Bordetella pertussis
gcucgcccccgcgccgcgca

SEQ ID NO: 389719 - RNA, 14 nt, Bordetella pertussis
gcucgccccggcgc

SEQ ID NO: 389720 - RNA, 16 nt, Bordetella pertussis
gcucgccccggcgcgc

SEQ ID NO: 389721 - RNA, 14 nt, Bordetella pertussis
gcucgcccauggca

SEQ ID NO: 389722 - RNA, 16 nt, Bordetella pertussis
gcucgcccuugagcac

SEQ ID NO: 389723 - RNA, 17 nt, Bordetella pertussis
gcucgccgagccgggcc

SEQ ID NO: 389724 - RNA, 18 nt, Bordetella pertussis
gcucgccgcgcacgggcg

SEQ ID NO: 389725 - RNA, 20 nt, Bordetella pertussis
gcucgccgcgcgacagccgc

SEQ ID NO: 389726 - RNA, 17 nt, Bordetella pertussis
gcucgccggcgccgccc

SEQ ID NO: 389727 - RNA, 15 nt, Bordetella pertussis
gcucgccggccgcgc

SEQ ID NO: 389728 - RNA, 17 nt, Bordetella pertussis
gcucgccuccccaggcc

SEQ ID NO: 389729 - RNA, 17 nt, Bordetella pertussis
gcucgccucgaugaagg

SEQ ID NO: 389730 - RNA, 23 nt, Bordetella pertussis
gcucgcguugcaccgcgucggcc

SEQ ID NO: 389731 - RNA, 16 nt, Bordetella pertussis
gcucgggcucgcgcgc

SEQ ID NO: 389732 - RNA, 18 nt, Bordetella pertussis
gcucgggcucgcgcgcgc

SEQ ID NO: 389733 - RNA, 14 nt, Bordetella pertussis
gcucgggcgcggca

SEQ ID NO: 389734 - RNA, 16 nt, Bordetella pertussis
gcucgggcugcggcuc

SEQ ID NO: 389735 - RNA, 22 nt, Bordetella pertussis
gcucggggaaauugacggcgcu

SEQ ID NO: 389736 - RNA, 14 nt, Bordetella pertussis
gcucgggugggccg

SEQ ID NO: 389737 - RNA, 16 nt, Bordetella pertussis
gcucgggugggccggc

SEQ ID NO: 389738 - RNA, 18 nt, Bordetella pertussis
gcucggucauguccagcg

SEQ ID NO: 389739 - RNA, 20 nt, Bordetella pertussis
gcucggucauguccagcgcc

SEQ ID NO: 389740 - RNA, 20 nt, Bordetella pertussis
gcucgguccagacgggcugg

SEQ ID NO: 389741 - RNA, 20 nt, Bordetella pertussis
gcucggucucgcccauggga

SEQ ID NO: 389742 - RNA, 19 nt, Bordetella pertussis
gcucggugaugauggccag

SEQ ID NO: 389743 - RNA, 20 nt, Bordetella pertussis
gcucggugaugauggccagg

SEQ ID NO: 389744 - RNA, 14 nt, Bordetella pertussis
gcucggugcagccc

SEQ ID NO: 389745 - RNA, 16 nt, Bordetella pertussis
gcucgucgaacagcau

SEQ ID NO: 389746 - RNA, 16 nt, Bordetella pertussis
gcucgucgacgcggcc

SEQ ID NO: 389747 - RNA, 22 nt, Bordetella pertussis
gcucgucgccaugcggcuggcc

SEQ ID NO: 389748 - RNA, 15 nt, Bordetella pertussis
gcucgugcaucaucu

SEQ ID NO: 389749 - RNA, 19 nt, Bordetella pertussis
gcucuaccaacccugccuc

SEQ ID NO: 389750 - RNA, 14 nt, Bordetella pertussis
gcucuacaccauca

SEQ ID NO: 389751 - RNA, 14 nt, Bordetella pertussis
gcucucgaagaagc

SEQ ID NO: 389752 - RNA, 14 nt, Bordetella pertussis
gcugaagcgccgcc

SEQ ID NO: 389753 - RNA, 23 nt, Bordetella pertussis
gcugaagcgccgccacaggcuga

SEQ ID NO: 389754 - RNA, 22 nt, Bordetella pertussis
gcugaccugcacgauggcgccg

SEQ ID NO: 389755 - RNA, 18 nt, Bordetella pertussis
gcugacgaaacgcgcguc

SEQ ID NO: 389756 - RNA, 19 nt, Bordetella pertussis
gcugagaucguccagcgac

SEQ ID NO: 389757 - RNA, 20 nt, Bordetella pertussis
gcugagaucguccagcgacu

SEQ ID NO: 389758 - RNA, 13 nt, Bordetella pertussis
gcugagcaccagc

SEQ ID NO: 389759 - RNA, 12 nt, Bordetella pertussis
gcugagcaggcc

SEQ ID NO: 389760 - RNA, 17 nt, Bordetella pertussis
gcugagccauuccggcu

SEQ ID NO: 389761 - RNA, 18 nt, Bordetella pertussis
gcugaucacccacagcag

SEQ ID NO: 389762 - RNA, 23 nt, Bordetella pertussis
gcugaucacccacagcagcgcgc

SEQ ID NO: 389763 - RNA, 14 nt, Bordetella pertussis
gcugaucaggucca

SEQ ID NO: 389764 - RNA, 19 nt, Bordetella pertussis
gcugaucgccggcgccccc

SEQ ID NO: 389765 - RNA, 20 nt, Bordetella pertussis
gcugcaagacgcccaggccc

SEQ ID NO: 389766 - RNA, 19 nt, Bordetella pertussis
gcugcacgugaugcaggcg

SEQ ID NO: 389767 - RNA, 17 nt, Bordetella pertussis
gcugcagaucaucgagc

SEQ ID NO: 389768 - RNA, 19 nt, Bordetella pertussis
gcugcagaucaucggcgcc

SEQ ID NO: 389769 - RNA, 21 nt, Bordetella pertussis
gcugcagccaguugggccagg

SEQ ID NO: 389770 - RNA, 13 nt, Bordetella pertussis
gcugcagcccggc

SEQ ID NO: 389771 - RNA, 14 nt, Bordetella pertussis
gcugcagcccggcc

SEQ ID NO: 389772 - RNA, 12 nt, Bordetella pertussis
gcugcagcgacu

SEQ ID NO: 389773 - RNA, 14 nt, Bordetella pertussis
gcugcagcgcuggu

SEQ ID NO: 389774 - RNA, 23 nt, Bordetella pertussis
gcugcagcgcaggaugggcagcu

SEQ ID NO: 389775 - RNA, 14 nt, Bordetella pertussis
gcugcagcgucugg

SEQ ID NO: 389776 - RNA, 17 nt, Bordetella pertussis
gcugcagcuugcgcgcc

SEQ ID NO: 389777 - RNA, 14 nt, Bordetella pertussis
gcugccaaccgcga

SEQ ID NO: 389778 - RNA, 19 nt, Bordetella pertussis
gcugccgaauucguuggug

SEQ ID NO: 389779 - RNA, 15 nt, Bordetella pertussis
gcugccgaccagcac

SEQ ID NO: 389780 - RNA, 16 nt, Bordetella pertussis
gcugccgaccagcacg

SEQ ID NO: 389781 - RNA, 20 nt, Bordetella pertussis
gcugccgagacggccgccga

SEQ ID NO: 389782 - RNA, 18 nt, Bordetella pertussis
gcugccgauacgggcgcg

SEQ ID NO: 389783 - RNA, 22 nt, Bordetella pertussis
gcugccgccgaugugcggcgug

SEQ ID NO: 389784 - RNA, 16 nt, Bordetella pertussis
gcugccgcgcgccggc

SEQ ID NO: 389785 - RNA, 16 nt, Bordetella pertussis
gcugccgcugcaggcc

SEQ ID NO: 389786 - RNA, 17 nt, Bordetella pertussis
gcugccgcugcaggccc

SEQ ID NO: 389787 - RNA, 20 nt, Bordetella pertussis
gcugccgcugcccaccuucc

SEQ ID NO: 389788 - RNA, 16 nt, Bordetella pertussis
gcugccgggcucggcc

SEQ ID NO: 389789 - RNA, 20 nt, Bordetella pertussis
gcugccgggcucggccacca

SEQ ID NO: 389790 - RNA, 15 nt, Bordetella pertussis
gcugccgggcaugaa

SEQ ID NO: 389791 - RNA, 18 nt, Bordetella pertussis
gcugccgucgccaaagcg

SEQ ID NO: 389792 - RNA, 16 nt, Bordetella pertussis
gcugccgucggccagc

SEQ ID NO: 389793 - RNA, 17 nt, Bordetella pertussis
gcugccgugaggcagcc

SEQ ID NO: 389794 - RNA, 23 nt, Bordetella pertussis
gcugccguuucucaacccgccgg

SEQ ID NO: 389795 - RNA, 21 nt, Bordetella pertussis
gcugccguuuucgaucagggc

SEQ ID NO: 389796 - RNA, 13 nt, Bordetella pertussis
gcugcgaaagcgc

SEQ ID NO: 389797 - RNA, 12 nt, Bordetella pertussis
gcugcgacagca

SEQ ID NO: 389798 - RNA, 14 nt, Bordetella pertussis
gcugcgacagcagc

SEQ ID NO: 389799 - RNA, 19 nt, Bordetella pertussis
gcugcgacagcagggccag

SEQ ID NO: 389800 - RNA, 19 nt, Bordetella pertussis
gcugcgacaggcgcagcuc

SEQ ID NO: 389801 - RNA, 21 nt, Bordetella pertussis
gcugcgcagcagcgcgguggc

SEQ ID NO: 389802 - RNA, 22 nt, Bordetella pertussis
gcugcgcagcagcgcgguggcc

SEQ ID NO: 389803 - RNA, 21 nt, Bordetella pertussis
gcugcgcagcagggcggcggu

SEQ ID NO: 389804 - RNA, 13 nt, Bordetella pertussis
gcugcgcagcgac

SEQ ID NO: 389805 - RNA, 15 nt, Bordetella pertussis
gcugcgcagcgacuc

SEQ ID NO: 389806 - RNA, 13 nt, Bordetella pertussis
gcugcgcagcagc

SEQ ID NO: 389807 - RNA, 23 nt, Bordetella pertussis
gcugcgccaacggugccaguccc

SEQ ID NO: 389808 - RNA, 21 nt, Bordetella pertussis
gcugcgcccgcuaugcgggcu

SEQ ID NO: 389809 - RNA, 16 nt, Bordetella pertussis
gcugcgccgaggccug

SEQ ID NO: 389810 - RNA, 18 nt, Bordetella pertussis
gcugcgccggcggcaccg

SEQ ID NO: 389811 - RNA, 22 nt, Bordetella pertussis
gcugcgccggcggcaccgcgca

SEQ ID NO: 389812 - RNA, 23 nt, Bordetella pertussis
gcugcgccgucugugcgccccgc

SEQ ID NO: 389813 - RNA, 23 nt, Bordetella pertussis
gcugcgccuggcggacgauggcc

SEQ ID NO: 389814 - RNA, 21 nt, Bordetella pertussis
gcugcgcgccgccgcgcugug

SEQ ID NO: 389815 - RNA, 16 nt, Bordetella pertussis
gcugcgcgccguggug

SEQ ID NO: 389816 - RNA, 15 nt, Bordetella pertussis
gcugcgcgcggccug

SEQ ID NO: 389817 - RNA, 12 nt, Bordetella pertussis
gcugcgcggccg

SEQ ID NO: 389818 - RNA, 17 nt, Bordetella pertussis
gcugcgcggcgggaccg

SEQ ID NO: 389819 - RNA, 16 nt, Bordetella pertussis
gcugcgcgucggcagg

SEQ ID NO: 389820 - RNA, 15 nt, Bordetella pertussis
gcugcgugcgggaca

SEQ ID NO: 389821 - RNA, 23 nt, Bordetella pertussis
gcugcucgacagcagcccgcugg

SEQ ID NO: 389822 - RNA, 14 nt, Bordetella pertussis
gcugcuggccggcc

SEQ ID NO: 389823 - RNA, 22 nt, Bordetella pertussis
gcugcuggccggccccauccuc

SEQ ID NO: 389824 - RNA, 16 nt, Bordetella pertussis
gcugcuggcggcgcug

SEQ ID NO: 389825 - RNA, 19 nt, Bordetella pertussis
gcugcuggcggcgcugguc

SEQ ID NO: 389826 - RNA, 19 nt, Bordetella pertussis
gcugcuggcgcgccaggcg

SEQ ID NO: 389827 - RNA, 20 nt, Bordetella pertussis
gcuggaagacguggcccgcg

SEQ ID NO: 389828 - RNA, 21 nt, Bordetella pertussis
gcuggaagcgcgccaggcgca

SEQ ID NO: 389829 - RNA, 14 nt, Bordetella pertussis
gcuggaagucagcc

SEQ ID NO: 389830 - RNA, 12 nt, Bordetella pertussis
gcuggacagauc

SEQ ID NO: 389831 - RNA, 16 nt, Bordetella pertussis
gcuggaucccggcgau

SEQ ID NO: 389832 - RNA, 22 nt, Bordetella pertussis
gcuggauggcucgggcagcagc

SEQ ID NO: 389833 - RNA, 18 nt, Bordetella pertussis
gcuggauggugccgccgc

SEQ ID NO: 389834 - RNA, 21 nt, Bordetella pertussis
gcuggcaaagcgcgcguccug

SEQ ID NO: 389835 - RNA, 13 nt, Bordetella pertussis
gcuggcaccgcga

SEQ ID NO: 389836 - RNA, 19 nt, Bordetella pertussis
gcuggcaccgcgacgaccc

SEQ ID NO: 389837 - RNA, 15 nt, Bordetella pertussis
gcuggucagccuggg

SEQ ID NO: 389838 - RNA, 20 nt, Bordetella pertussis
gcuggucagccuggggcagg

SEQ ID NO: 389839 - RNA, 14 nt, Bordetella pertussis
gcuggucgaugccg

SEQ ID NO: 389840 - RNA, 12 nt, Bordetella pertussis
gcuggucgccgu

SEQ ID NO: 389841 - RNA, 17 nt, Bordetella pertussis
gcuggucgcgcaccugu

SEQ ID NO: 389842 - RNA, 15 nt, Bordetella pertussis
gcuggucgcgcagca

SEQ ID NO: 389843 - RNA, 22 nt, Bordetella pertussis
gcuggucgggguggucuuccag

SEQ ID NO: 389844 - RNA, 21 nt, Bordetella pertussis
gcuggugaagucggcccuguc

SEQ ID NO: 389845 - RNA, 15 nt, Bordetella pertussis
gcuggugaucugcug

SEQ ID NO: 389846 - RNA, 18 nt, Bordetella pertussis
gcuggugaucugcugcgu

SEQ ID NO: 389847 - RNA, 18 nt, Bordetella pertussis
gcuggugauguccugcag

SEQ ID NO: 389848 - RNA, 19 nt, Bordetella pertussis
gcuggugauguccugcagg

SEQ ID NO: 389849 - RNA, 15 nt, Bordetella pertussis
gcuggugcagcuuuu

SEQ ID NO: 389850 - RNA, 19 nt, Bordetella pertussis
aaaggaaaucgcggcgcug

SEQ ID NO: 389851 - RNA, 16 nt, Bordetella pertussis
gcuggugccgcuggcg

SEQ ID NO: 389852 - RNA, 18 nt, Bordetella pertussis
gcuggugccgcuggcggc

SEQ ID NO: 389853 - RNA, 16 nt, Bordetella pertussis
gcuggugcgccgugcc

SEQ ID NO: 389854 - RNA, 14 nt, Bordetella pertussis
gcuguagcccuggc

SEQ ID NO: 389855 - RNA, 15 nt, Bordetella pertussis
gcuguaggcgccggc

SEQ ID NO: 389856 - RNA, 12 nt, Bordetella pertussis
gcuguccaagcg

SEQ ID NO: 389857 - RNA, 19 nt, Bordetella pertussis
gcuguccgaugcgcugcug

SEQ ID NO: 389858 - RNA, 17 nt, Bordetella pertussis
gcuguuccagccaguac

SEQ ID NO: 389859 - RNA, 19 nt, Bordetella pertussis
gcuguucgccacgcuguug

SEQ ID NO: 389860 - RNA, 23 nt, Bordetella pertussis
gcuguucgcgcagcaggccgcgc

SEQ ID NO: 389861 - RNA, 21 nt, Bordetella pertussis
gcuguucggcgaccgccggcc

SEQ ID NO: 389862 - RNA, 20 nt, Bordetella pertussis
gcuguucggcgagccgggca

SEQ ID NO: 389863 - RNA, 21 nt, Bordetella pertussis
gcuguucgggcgcggugcgca

SEQ ID NO: 389864 - RNA, 22 nt, Bordetella pertussis
gcuguucggggcagggcgccug

SEQ ID NO: 389865 - RNA, 23 nt, Bordetella pertussis
gcuguucuucggcaaccgcgccu

SEQ ID NO: 389866 - RNA, 16 nt, Bordetella pertussis
gcuguugaggaugugc

SEQ ID NO: 389867 - RNA, 15 nt, Bordetella pertussis
gcuguugcccaccag

SEQ ID NO: 389868 - RNA, 22 nt, Bordetella pertussis
gcuguugcuccaggccggcaug

SEQ ID NO: 389869 - RNA, 19 nt, Bordetella pertussis
gcuuacuggaucuuggccu

SEQ ID NO: 389870 - RNA, 19 nt, Bordetella pertussis
gcuuagcgcagcagcgaca

SEQ ID NO: 389871 - RNA, 19 nt, Bordetella pertussis
gcuucaggaacauguccac

SEQ ID NO: 389872 - RNA, 23 nt, Bordetella pertussis
gcuucaggaacauguccaccagc

SEQ ID NO: 389873 - RNA, 15 nt, Bordetella pertussis
gcuucaggcgccgca

SEQ ID NO: 389874 - RNA, 14 nt, Bordetella pertussis
gcuucaggcuggcc

SEQ ID NO: 389875 - RNA, 20 nt, Bordetella pertussis
gcuucaggcuggccugcagg

SEQ ID NO: 389876 - RNA, 19 nt, Bordetella pertussis
gcuucaucaccuucccgcu

SEQ ID NO: 389877 - RNA, 21 nt, Bordetella pertussis
gcuuccagcagcaugccgcgg

SEQ ID NO: 389878 - RNA, 23 nt, Bordetella pertussis
gcuuccaggaguucccagcgcgc

SEQ ID NO: 389879 - RNA, 23 nt, Bordetella pertussis
gcuuccaucaggaacggcauggc

SEQ ID NO: 389880 - RNA, 17 nt, Bordetella pertussis
gcuucccgguccaggcc

SEQ ID NO: 389881 - RNA, 22 nt, Bordetella pertussis
gcuuccggcaugaccgcggacg

SEQ ID NO: 389882 - RNA, 14 nt, Bordetella pertussis
gcuuccggccgggc

SEQ ID NO: 389883 - RNA, 13 nt, Bordetella pertussis
gcuuccugcaccu

SEQ ID NO: 389884 - RNA, 12 nt, Bordetella pertussis
gcuuccugcugc

SEQ ID NO: 389885 - RNA, 15 nt, Bordetella pertussis
gcuuccugggccugc

SEQ ID NO: 389886 - RNA, 15 nt, Bordetella pertussis
gcuucgacggcuugc

SEQ ID NO: 389887 - RNA, 14 nt, Bordetella pertussis
gcuucgacucccuc

SEQ ID NO: 389888 - RNA, 20 nt, Bordetella pertussis
gcuucgaugcuggcggcauc

SEQ ID NO: 389889 - RNA, 18 nt, Bordetella pertussis
gcuucgcgcacauccagc

SEQ ID NO: 389890 - RNA, 14 nt, Bordetella pertussis
gcuucgcgcagcaa

SEQ ID NO: 389891 - RNA, 16 nt, Bordetella pertussis
gcuucgcgcagcaagu

SEQ ID NO: 389892 - RNA, 17 nt, Bordetella pertussis
gcuucggacagcaguuu

SEQ ID NO: 389893 - RNA, 18 nt, Bordetella pertussis
gcuucggcgcugggcgca

SEQ ID NO: 389894 - RNA, 17 nt, Bordetella pertussis
gcuucggcggccauggc

SEQ ID NO: 389895 - RNA, 18 nt, Bordetella pertussis
gcuucggcggccauggca

SEQ ID NO: 389896 - RNA, 19 nt, Bordetella pertussis
gcuucggcguacugcugca

SEQ ID NO: 389897 - RNA, 21 nt, Bordetella pertussis
gcuucgugcggccgcagcagu

SEQ ID NO: 389898 - RNA, 20 nt, Bordetella pertussis
gcuucucgcaagugcuggcc

SEQ ID NO: 389899 - RNA, 21 nt, Bordetella pertussis
gcuucucgcaagugcuggccc

SEQ ID NO: 389900 - RNA, 20 nt, Bordetella pertussis
gcuucuggaucaccgccggc

SEQ ID NO: 389901 - RNA, 20 nt, Bordetella pertussis
gcuucugguaguuggccagg

SEQ ID NO: 389902 - RNA, 22 nt, Bordetella pertussis
gcuugaccacggccagcagcac

SEQ ID NO: 389903 - RNA, 23 nt, Bordetella pertussis
gcuugaccagggcggugggcagc

SEQ ID NO: 389904 - RNA, 21 nt, Bordetella pertussis
gcuugaccgccagcauccagc

SEQ ID NO: 389905 - RNA, 17 nt, Bordetella pertussis
gcuugaccgccuccagg

SEQ ID NO: 389906 - RNA, 22 nt, Bordetella pertussis
gcuugaccuugagcacgcuggc

SEQ ID NO: 389907 - RNA, 17 nt, Bordetella pertussis
gcuugacguccagcgac

SEQ ID NO: 389908 - RNA, 16 nt, Bordetella pertussis
gcuugaggccgcgcgc

SEQ ID NO: 389909 - RNA, 15 nt, Bordetella pertussis
gcuugaguuuggcga

SEQ ID NO: 389910 - RNA, 20 nt, Bordetella pertussis
gcuugaugccggcguucugg

SEQ ID NO: 389911 - RNA, 18 nt, Bordetella pertussis
gcuugauggccagcgcgc

SEQ ID NO: 389912 - RNA, 17 nt, Bordetella pertussis
gcuugccauaggccagc

SEQ ID NO: 389913 - RNA, 20 nt, Bordetella pertussis
gcuugccauaggccagcgcc

SEQ ID NO: 389914 - RNA, 22 nt, Bordetella pertussis
gcuugcccggcgugcugaggcu

SEQ ID NO: 389915 - RNA, 13 nt, Bordetella pertussis
gcuugccgcagcg

SEQ ID NO: 389916 - RNA, 18 nt, Bordetella pertussis
gcuugccgcagcggccau

SEQ ID NO: 389917 - RNA, 19 nt, Bordetella pertussis
gcuugccgcagcggccaug

SEQ ID NO: 389918 - RNA, 22 nt, Bordetella pertussis
gcuugcgauaggugcgcagccg

SEQ ID NO: 389919 - RNA, 18 nt, Bordetella pertussis
gcuugcgcagggcgggcg

SEQ ID NO: 389920 - RNA, 14 nt, Bordetella pertussis
gcuugcgccagcca

SEQ ID NO: 389921 - RNA, 23 nt, Bordetella pertussis
gcuugcgccagccacgcgcgcug

SEQ ID NO: 389922 - RNA, 18 nt, Bordetella pertussis
gcuugcgucccaccugca

SEQ ID NO: 389923 - RNA, 15 nt, Bordetella pertussis
gcuugcugccccccg

SEQ ID NO: 389924 - RNA, 14 nt, Bordetella pertussis
gcuuggcagccuug

SEQ ID NO: 389925 - RNA, 13 nt, Bordetella pertussis
gcuuggccaccac

SEQ ID NO: 389926 - RNA, 13 nt, Bordetella pertussis
gcuuggcggccag

SEQ ID NO: 389927 - RNA, 18 nt, Bordetella pertussis
gcuuggcguacggcugca

SEQ ID NO: 389928 - RNA, 13 nt, Bordetella pertussis
gcuugggccgcgc

SEQ ID NO: 389929 - RNA, 14 nt, Bordetella pertussis
gcuuggggcgcgcc

SEQ ID NO: 389930 - RNA, 11 nt, Bordetella pertussis
aaaggcccagg

SEQ ID NO: 389931 - RNA, 17 nt, Bordetella pertussis
gcuugggggcguggcag

SEQ ID NO: 389932 - RNA, 17 nt, Bordetella pertussis
gcuuguagcccucgguc

SEQ ID NO: 389933 - RNA, 16 nt, Bordetella pertussis
gcuuguagcggccauc

SEQ ID NO: 389934 - RNA, 14 nt, Bordetella pertussis
gcuuuaccagcugu

SEQ ID NO: 389935 - RNA, 17 nt, Bordetella pertussis
gcuuuaccagcuguacc

SEQ ID NO: 389936 - RNA, 14 nt, Bordetella pertussis
gcuuuccgccgaga

SEQ ID NO: 389937 - RNA, 19 nt, Bordetella pertussis
gcuuucgaagccgccccac

SEQ ID NO: 389938 - RNA, 14 nt, Bordetella pertussis
ggaacaccagcaag

SEQ ID NO: 389939 - RNA, 12 nt, Bordetella pertussis
ggaacagccugc

SEQ ID NO: 389940 - RNA, 19 nt, Bordetella pertussis
ggaacagcuugggcauuuc

SEQ ID NO: 389941 - RNA, 18 nt, Bordetella pertussis
ggaacaggccggccuggg

SEQ ID NO: 389942 - RNA, 21 nt, Bordetella pertussis
ggaacauguucacgcccagga

SEQ ID NO: 389943 - RNA, 17 nt, Bordetella pertussis
ggaaccagcggcuggcg

SEQ ID NO: 389944 - RNA, 18 nt, Bordetella pertussis
ggaacgugccgucgggcg

SEQ ID NO: 389945 - RNA, 21 nt, Bordetella pertussis
ggaacguuugcggacgggcca

SEQ ID NO: 389946 - RNA, 18 nt, Bordetella pertussis
ggaacucguuggccagcg

SEQ ID NO: 389947 - RNA, 23 nt, Bordetella pertussis
ggaacucguuggccagcgcgccu

SEQ ID NO: 389948 - RNA, 22 nt, Bordetella pertussis
ggaagccgccggcgugcccagu

SEQ ID NO: 389949 - RNA, 14 nt, Bordetella pertussis
ggaagccgugcgca

SEQ ID NO: 389950 - RNA, 17 nt, Bordetella pertussis
ggaagcgcgccgcgcgc

SEQ ID NO: 389951 - RNA, 12 nt, Bordetella pertussis
ggaagcgcuggc

SEQ ID NO: 389952 - RNA, 19 nt, Bordetella pertussis
ggaaguccuucagccgcug

SEQ ID NO: 389953 - RNA, 18 nt, Bordetella pertussis
ggaagugaugccgccggc

SEQ ID NO: 389954 - RNA, 15 nt, Bordetella pertussis
ggaaguggccgagcg

SEQ ID NO: 389955 - RNA, 14 nt, Bordetella pertussis
ggaauaccgccagc

SEQ ID NO: 389956 - RNA, 19 nt, Bordetella pertussis
ggaauacgccguugcggcc

SEQ ID NO: 389957 - RNA, 18 nt, Bordetella pertussis
ggaaugaugcgcauuauc

SEQ ID NO: 389958 - RNA, 22 nt, Bordetella pertussis
ggaaugggagguugcccgcccg

SEQ ID NO: 389959 - RNA, 18 nt, Bordetella pertussis
ggaauggucaagcggcug

SEQ ID NO: 389960 - RNA, 19 nt, Bordetella pertussis
ggacaacgcgcgccacuau

SEQ ID NO: 389961 - RNA, 19 nt, Bordetella pertussis
ggacacgaugaacgcgcgc

SEQ ID NO: 389962 - RNA, 14 nt, Bordetella pertussis
ggacacgcagcuga

SEQ ID NO: 389963 - RNA, 19 nt, Bordetella pertussis
ggacagauacuguucgccg

SEQ ID NO: 389964 - RNA, 13 nt, Bordetella pertussis
ggacagauccagc

SEQ ID NO: 389965 - RNA, 15 nt, Bordetella pertussis
ggacagauccagcgc

SEQ ID NO: 389966 - RNA, 16 nt, Bordetella pertussis
ggacagaugccguccu

SEQ ID NO: 389967 - RNA, 16 nt, Bordetella pertussis
ggacagccccagcagc

SEQ ID NO: 389968 - RNA, 17 nt, Bordetella pertussis
ggacagccccagcagca

SEQ ID NO: 389969 - RNA, 14 nt, Bordetella pertussis
ggacaggcacaccg

SEQ ID NO: 389970 - RNA, 15 nt, Bordetella pertussis
ggacaggcacccaug

SEQ ID NO: 389971 - RNA, 18 nt, Bordetella pertussis
ggacaggcaccccagcac

SEQ ID NO: 389972 - RNA, 22 nt, Bordetella pertussis
ggacaggcacccccgaccgagc

SEQ ID NO: 389973 - RNA, 14 nt, Bordetella pertussis
ggacaggcacccgg

SEQ ID NO: 389974 - RNA, 15 nt, Bordetella pertussis
ggacaggcacccugu

SEQ ID NO: 389975 - RNA, 22 nt, Bordetella pertussis
ggacaggcacccuugccgcagc

SEQ ID NO: 389976 - RNA, 14 nt, Bordetella pertussis
ggacaggcacgccg

SEQ ID NO: 389977 - RNA, 13 nt, Bordetella pertussis
ggacaggcccagc

SEQ ID NO: 389978 - RNA, 13 nt, Bordetella pertussis
ggacaggcucccg

SEQ ID NO: 389979 - RNA, 16 nt, Bordetella pertussis
ggaccgcgaugcugcg

SEQ ID NO: 389980 - RNA, 18 nt, Bordetella pertussis
ggaccgcgccgccgcgcc

SEQ ID NO: 389981 - RNA, 24 nt, Bordetella pertussis
ggaccgcgccugggggcuggaggc

SEQ ID NO: 389982 - RNA, 17 nt, Bordetella pertussis
ggaccgcgcugcgguca

SEQ ID NO: 389983 - RNA, 15 nt, Bordetella pertussis
ggaccuguacuggcu

SEQ ID NO: 389984 - RNA, 18 nt, Bordetella pertussis
ggaccuguggcgcacccu

SEQ ID NO: 389985 - RNA, 21 nt, Bordetella pertussis
ggaccuucguucgaaguccgc

SEQ ID NO: 389986 - RNA, 22 nt, Bordetella pertussis
ggacgaagccuaggcugcagcc

SEQ ID NO: 389987 - RNA, 22 nt, Bordetella pertussis
ggacgaccaacucgaggcggcg

SEQ ID NO: 389988 - RNA, 22 nt, Bordetella pertussis
ggacgaccuugcuggaccgcgc

SEQ ID NO: 389989 - RNA, 16 nt, Bordetella pertussis
ggacgagcgcagcaag

SEQ ID NO: 389990 - RNA, 21 nt, Bordetella pertussis
ggacgagcgggugaugcugca

SEQ ID NO: 389991 - RNA, 14 nt, Bordetella pertussis
ggacgcgccgggcg

SEQ ID NO: 389992 - RNA, 12 nt, Bordetella pertussis
ggacgcgcgccg

SEQ ID NO: 389993 - RNA, 17 nt, Bordetella pertussis
ggacgcgcgccgcauca

SEQ ID NO: 389994 - RNA, 19 nt, Bordetella pertussis
ggacgcguccucggccagc

SEQ ID NO: 389995 - RNA, 14 nt, Bordetella pertussis
ggacgcggccggca

SEQ ID NO: 389996 - RNA, 15 nt, Bordetella pertussis
aaagguccuggagac

SEQ ID NO: 389997 - RNA, 17 nt, Bordetella pertussis
ggacugaacgcguccag

SEQ ID NO: 389998 - RNA, 22 nt, Bordetella pertussis
ggacugaacgcguccaggcccu

SEQ ID NO: 389999 - RNA, 17 nt, Bordetella pertussis
ggacuggcuggucaggc

SEQ ID NO: 390000 - RNA, 13 nt, Bordetella pertussis
ggagaccggcaug

SEQ ID NO: 390001 - RNA, 20 nt, Bordetella pertussis
ggagagccggccacgcgcug

SEQ ID NO: 390002 - RNA, 14 nt, Bordetella pertussis
ggagagggccuggu

SEQ ID NO: 390003 - RNA, 20 nt, Bordetella pertussis
ggagcauggcaugagcgccu

SEQ ID NO: 390004 - RNA, 14 nt, Bordetella pertussis
ggagccaggcggcg

SEQ ID NO: 390005 - RNA, 15 nt, Bordetella pertussis
ggagccaguccccgc

SEQ ID NO: 390006 - RNA, 14 nt, Bordetella pertussis
ggagcccagugucu

SEQ ID NO: 390007 - RNA, 17 nt, Bordetella pertussis
ggagccggcgggcggcu

SEQ ID NO: 390008 - RNA, 23 nt, Bordetella pertussis
ggaguuccgcgucuaccuggacg

SEQ ID NO: 390009 - RNA, 16 nt, Bordetella pertussis
ggauagacccuccucg

SEQ ID NO: 390010 - RNA, 20 nt, Bordetella pertussis
ggauagaguucggcgcggcc

SEQ ID NO: 390011 - RNA, 19 nt, Bordetella pertussis
ggaucaagcggcccgcgcc

SEQ ID NO: 390012 - RNA, 14 nt, Bordetella pertussis
ggauccagccgcuc

SEQ ID NO: 390013 - RNA, 16 nt, Bordetella pertussis
ggaucggccaggccgg

SEQ ID NO: 390014 - RNA, 13 nt, Bordetella pertussis
ggaucggccggca

SEQ ID NO: 390015 - RNA, 21 nt, Bordetella pertussis
ggaucggggggugcgaggcga

SEQ ID NO: 390016 - RNA, 14 nt, Bordetella pertussis
ggaucgugcccagc

SEQ ID NO: 390017 - RNA, 14 nt, Bordetella pertussis
ggaucucggccagc

SEQ ID NO: 390018 - RNA, 20 nt, Bordetella pertussis
ggaucugcaccuuguacugg

SEQ ID NO: 390019 - RNA, 14 nt, Bordetella pertussis
ggaucuggccggcg

SEQ ID NO: 390020 - RNA, 19 nt, Bordetella pertussis
ggaugaacagcgagaagca

SEQ ID NO: 390021 - RNA, 21 nt, Bordetella pertussis
ggaugaacagcgagaagcaac

SEQ ID NO: 390022 - RNA, 15 nt, Bordetella pertussis
ggaugagcaggccgg

SEQ ID NO: 390023 - RNA, 20 nt, Bordetella pertussis
ggaugauggucugccacauc

SEQ ID NO: 390024 - RNA, 19 nt, Bordetella pertussis
ggaugcacguagcgcagca

SEQ ID NO: 390025 - RNA, 21 nt, Bordetella pertussis
ggaugcacguagcgcagcacc

SEQ ID NO: 390026 - RNA, 13 nt, Bordetella pertussis
ggaugccccgccc

SEQ ID NO: 390027 - RNA, 15 nt, Bordetella pertussis
ggaugccccgcccgc

SEQ ID NO: 390028 - RNA, 17 nt, Bordetella pertussis
ggaugcccuggguggcg

SEQ ID NO: 390029 - RNA, 21 nt, Bordetella pertussis
ggaugcccuggguggcggggc

SEQ ID NO: 390030 - RNA, 19 nt, Bordetella pertussis
ggaugccgguucgggcggg

SEQ ID NO: 390031 - RNA, 23 nt, Bordetella pertussis
ggaugcgagcaaaggacacgcgc

SEQ ID NO: 390032 - RNA, 18 nt, Bordetella pertussis
ggaugcgcaggacggcgc

SEQ ID NO: 390033 - RNA, 14 nt, Bordetella pertussis
ggaugcgcggcacg

SEQ ID NO: 390034 - RNA, 18 nt, Bordetella pertussis
ggaugcgcuggccggccg

SEQ ID NO: 390035 - RNA, 23 nt, Bordetella pertussis
ggaugcguucgaaagccagcgcc

SEQ ID NO: 390036 - RNA, 14 nt, Bordetella pertussis
ggauggacuggccg

SEQ ID NO: 390037 - RNA, 14 nt, Bordetella pertussis
ggauggcggccgcc

SEQ ID NO: 390038 - RNA, 13 nt, Bordetella pertussis
ggauggcguaugg

SEQ ID NO: 390039 - RNA, 21 nt, Bordetella pertussis
ggauggucgagcgccugcgcc

SEQ ID NO: 390040 - RNA, 14 nt, Bordetella pertussis
ggauggucgugcgg

SEQ ID NO: 390041 - RNA, 17 nt, Bordetella pertussis
ggaugugcgcgggcgcg

SEQ ID NO: 390042 - RNA, 21 nt, Bordetella pertussis
ggauguucaugaccgccgcgc

SEQ ID NO: 390043 - RNA, 20 nt, Bordetella pertussis
ggauucaggcgauccugccc

SEQ ID NO: 390044 - RNA, 21 nt, Bordetella pertussis
ggauuuuugggcaggccucuu

SEQ ID NO: 390045 - RNA, 23 nt, Bordetella pertussis
ggcaaccgccacgugcugcugga

SEQ ID NO: 390046 - RNA, 20 nt, Bordetella pertussis
ggcaaccgucgccagcgcgu

SEQ ID NO: 390047 - RNA, 21 nt, Bordetella pertussis
ggcaaccucgccgcgccagcu

SEQ ID NO: 390048 - RNA, 14 nt, Bordetella pertussis
ggcaaccugcacgc

SEQ ID NO: 390049 - RNA, 18 nt, Bordetella pertussis
ggcaacuucaccgucgac

SEQ ID NO: 390050 - RNA, 15 nt, Bordetella pertussis
ggcaagaagauccgc

SEQ ID NO: 390051 - RNA, 14 nt, Bordetella pertussis
ggcaagaagaucgu

SEQ ID NO: 390052 - RNA, 20 nt, Bordetella pertussis
ggcaagacggcgcucggccu

SEQ ID NO: 390053 - RNA, 23 nt, Bordetella pertussis
ggcaagcagccggaaacggaaac

SEQ ID NO: 390054 - RNA, 22 nt, Bordetella pertussis
ggcaagccgauccgcgacgccc

SEQ ID NO: 390055 - RNA, 18 nt, Bordetella pertussis
ggcaagccuugcggcccu

SEQ ID NO: 390056 - RNA, 17 nt, Bordetella pertussis
ggcaagccuugcggcuu

SEQ ID NO: 390057 - RNA, 13 nt, Bordetella pertussis
ggcaagcgcucgc

SEQ ID NO: 390058 - RNA, 18 nt, Bordetella pertussis
ggcaagcgcucgccggcg

SEQ ID NO: 390059 - RNA, 15 nt, Bordetella pertussis
ggcaagcggcguggg

SEQ ID NO: 390060 - RNA, 20 nt, Bordetella pertussis
ggcaagcugcuggcgcgcca

SEQ ID NO: 390061 - RNA, 14 nt, Bordetella pertussis
ggcaaggcccgccg

SEQ ID NO: 390062 - RNA, 13 nt, Bordetella pertussis
ggcaaggggccag

SEQ ID NO: 390063 - RNA, 18 nt, Bordetella pertussis
ggcaaggggccagccugg

SEQ ID NO: 390064 - RNA, 22 nt, Bordetella pertussis
ggcaaggggccagccuggcgcc

SEQ ID NO: 390065 - RNA, 15 nt, Bordetella pertussis
ggcaaggucagcagc

SEQ ID NO: 390066 - RNA, 17 nt, Bordetella pertussis
ggcaaguucgcugccgg

SEQ ID NO: 390067 - RNA, 17 nt, Bordetella pertussis
ggcagaaguggucgcgc

SEQ ID NO: 390068 - RNA, 20 nt, Bordetella pertussis
ggcagaccgagcgcgcccgc

SEQ ID NO: 390069 - RNA, 18 nt, Bordetella pertussis
ggcagacgaugcccaggc

SEQ ID NO: 390070 - RNA, 15 nt, Bordetella pertussis
ggcagagggcgacgg

SEQ ID NO: 390071 - RNA, 17 nt, Bordetella pertussis
ggcagagggcgacggcg

SEQ ID NO: 390072 - RNA, 17 nt, Bordetella pertussis
ggcagaguggcaggagg

SEQ ID NO: 390073 - RNA, 23 nt, Bordetella pertussis
ggcagaucuccggauccagccgc

SEQ ID NO: 390074 - RNA, 14 nt, Bordetella pertussis
ggcagaugcgcgcc

SEQ ID NO: 390075 - RNA, 19 nt, Bordetella pertussis
ggcagaugcgcgccaggcg

SEQ ID NO: 390076 - RNA, 10 nt, Bordetella pertussis
ggcagcccca

SEQ ID NO: 390077 - RNA, 20 nt, Bordetella pertussis
ggcagccccagcgcccaggc

SEQ ID NO: 390078 - RNA, 19 nt, Bordetella pertussis
ggcagccccgggugcaggu

SEQ ID NO: 390079 - RNA, 18 nt, Bordetella pertussis
ggcagcccgcgcacgccc

SEQ ID NO: 390080 - RNA, 20 nt, Bordetella pertussis
ggcagcccgcgcacgcccgc

SEQ ID NO: 390081 - RNA, 17 nt, Bordetella pertussis
ggcagccuggggcgagg

SEQ ID NO: 390082 - RNA, 16 nt, Bordetella pertussis
ggcagcgaccgcggcg

SEQ ID NO: 390083 - RNA, 22 nt, Bordetella pertussis
ggcagcgaccgcggcgguccug

SEQ ID NO: 390084 - RNA, 20 nt, Bordetella pertussis
ggcagcgacucgccgugcug

SEQ ID NO: 390085 - RNA, 22 nt, Bordetella pertussis
ggcagcgacucgccgugcuggg

SEQ ID NO: 390086 - RNA, 14 nt, Bordetella pertussis
ggcagcgaggcgca

SEQ ID NO: 390087 - RNA, 22 nt, Bordetella pertussis
ggcagcgcccgcgccaucgcgu

SEQ ID NO: 390088 - RNA, 12 nt, Bordetella pertussis
ggcagcucgccu

SEQ ID NO: 390089 - RNA, 23 nt, Bordetella pertussis
ggcagcucggcgaagccgcagcg

SEQ ID NO: 390090 - RNA, 13 nt, Bordetella pertussis
ggcagcugcgcgu

SEQ ID NO: 390091 - RNA, 21 nt, Bordetella pertussis
ggcagcugcgcgucgacagca

SEQ ID NO: 390092 - RNA, 23 nt, Bordetella pertussis
ggcagcugcgcgucgacagcaug

SEQ ID NO: 390093 - RNA, 17 nt, Bordetella pertussis
ggcagcuuguagcgcuc

SEQ ID NO: 390094 - RNA, 15 nt, Bordetella pertussis
ggcaggacgccggcg

SEQ ID NO: 390095 - RNA, 17 nt, Bordetella pertussis
ggcaggacgccggcgcc

SEQ ID NO: 390096 - RNA, 14 nt, Bordetella pertussis
ggcaggaucugcac

SEQ ID NO: 390097 - RNA, 20 nt, Bordetella pertussis
ggcaggcacacgaccggcuu

SEQ ID NO: 390098 - RNA, 16 nt, Bordetella pertussis
ggcaggccagcauggc

SEQ ID NO: 390099 - RNA, 17 nt, Bordetella pertussis
ggcaggcccagccagcg

SEQ ID NO: 390100 - RNA, 23 nt, Bordetella pertussis
ggcaggcccagccagcggugcgc

SEQ ID NO: 390101 - RNA, 14 nt, Bordetella pertussis
ggcaggccgcgcug

SEQ ID NO: 390102 - RNA, 15 nt, Bordetella pertussis
ggcaggccggccagc

SEQ ID NO: 390103 - RNA, 13 nt, Bordetella pertussis
ggcaggcgcgccg

SEQ ID NO: 390104 - RNA, 14 nt, Bordetella pertussis
ggcaggcgcgccgg

SEQ ID NO: 390105 - RNA, 19 nt, Bordetella pertussis
ggcaggcgcgccgggccgg

SEQ ID NO: 390106 - RNA, 19 nt, Bordetella pertussis
ggcaggcggcugacggucg

SEQ ID NO: 390107 - RNA, 12 nt, Bordetella pertussis
ggcaggcggcuu

SEQ ID NO: 390108 - RNA, 22 nt, Bordetella pertussis
ggcaggcggugcggaggcggcc

SEQ ID NO: 390109 - RNA, 13 nt, Bordetella pertussis
ggcaggcuccaca

SEQ ID NO: 390110 - RNA, 11 nt, Bordetella pertussis
ggcaggcuggc

SEQ ID NO: 390111 - RNA, 12 nt, Bordetella pertussis
ggcagggccagc

SEQ ID NO: 390112 - RNA, 15 nt, Bordetella pertussis
ggcagggccagcgcc

SEQ ID NO: 390113 - RNA, 18 nt, Bordetella pertussis
ggcagggccagcgccagc

SEQ ID NO: 390114 - RNA, 23 nt, Bordetella pertussis
ggcagggccauucucaauagcgg

SEQ ID NO: 390115 - RNA, 22 nt, Bordetella pertussis
ggcagggccuccugcagcaggu

SEQ ID NO: 390116 - RNA, 14 nt, Bordetella pertussis
ggcagggcgacguc

SEQ ID NO: 390117 - RNA, 15 nt, Bordetella pertussis
ggcagggcggccagg

SEQ ID NO: 390118 - RNA, 14 nt, Bordetella pertussis
ggcagggcggggga

SEQ ID NO: 390119 - RNA, 23 nt, Bordetella pertussis
ggcagggcgggggacgcccgccc

SEQ ID NO: 390120 - RNA, 15 nt, Bordetella pertussis
ggcagggcgucggcc

SEQ ID NO: 390121 - RNA, 16 nt, Bordetella pertussis
ggcagggcgccgcgcg

SEQ ID NO: 390122 - RNA, 18 nt, Bordetella pertussis
ggcaggggcuccaggaac

SEQ ID NO: 390123 - RNA, 17 nt, Bordetella pertussis
ggcagggugccuguccc

SEQ ID NO: 390124 - RNA, 15 nt, Bordetella pertussis
ggcaggucgccagca

SEQ ID NO: 390125 - RNA, 16 nt, Bordetella pertussis
ggcaggucggccagcg

SEQ ID NO: 390126 - RNA, 16 nt, Bordetella pertussis
ggcaggucggcgcggg

SEQ ID NO: 390127 - RNA, 15 nt, Bordetella pertussis
ggcaggucgggcagg

SEQ ID NO: 390128 - RNA, 14 nt, Bordetella pertussis
ggcaggugccccac

SEQ ID NO: 390129 - RNA, 12 nt, Bordetella pertussis
ggcaggugcuug

SEQ ID NO: 390130 - RNA, 13 nt, Bordetella pertussis
ggcaggugcggcc

SEQ ID NO: 390131 - RNA, 18 nt, Bordetella pertussis
ggcaggugcggccgcagc

SEQ ID NO: 390132 - RNA, 20 nt, Bordetella pertussis
ggcagguguuguugcacgac

SEQ ID NO: 390133 - RNA, 20 nt, Bordetella pertussis
ggcagguugaaguugcucgg

SEQ ID NO: 390134 - RNA, 21 nt, Bordetella pertussis
ggcaucaauagcccgugcggg

SEQ ID NO: 390135 - RNA, 23 nt, Bordetella pertussis
ggcaucagggcgaugccgcagau

SEQ ID NO: 390136 - RNA, 14 nt, Bordetella pertussis
ggcaucaggggcuc

SEQ ID NO: 390137 - RNA, 22 nt, Bordetella pertussis
ggcaucaggggcucggccaggu

SEQ ID NO: 390138 - RNA, 18 nt, Bordetella pertussis
ggcaucgcgcugacagcg

SEQ ID NO: 390139 - RNA, 20 nt, Bordetella pertussis
ggcaucgugugccagccccc

SEQ ID NO: 390140 - RNA, 23 nt, Bordetella pertussis
ggcaugccggcauaggcggcgca

SEQ ID NO: 390141 - RNA, 16 nt, Bordetella pertussis
ggcaugcgaaagccgg

SEQ ID NO: 390142 - RNA, 13 nt, Bordetella pertussis
ggcaugcgccggc

SEQ ID NO: 390143 - RNA, 13 nt, Bordetella pertussis
ggcauggcagcag

SEQ ID NO: 390144 - RNA, 20 nt, Bordetella pertussis
ggcauucgaacaacagcgcc

SEQ ID NO: 390145 - RNA, 15 nt, Bordetella pertussis
ggccaagcagcgccu

SEQ ID NO: 390146 - RNA, 16 nt, Bordetella pertussis
ggccaagcagcgccug

SEQ ID NO: 390147 - RNA, 16 nt, Bordetella pertussis
ggccaagcgcgccggc

SEQ ID NO: 390148 - RNA, 14 nt, Bordetella pertussis
ggccaagcuccagg

SEQ ID NO: 390149 - RNA, 21 nt, Bordetella pertussis
ggccaagggcgccgcgccggg

SEQ ID NO: 390150 - RNA, 16 nt, Bordetella pertussis
ggccaaucggccugcu

SEQ ID NO: 390151 - RNA, 15 nt, Bordetella pertussis
ggccaauggccgcgg

SEQ ID NO: 390152 - RNA, 16 nt, Bordetella pertussis
ggccaauggccgcggc

SEQ ID NO: 390153 - RNA, 16 nt, Bordetella pertussis
ggccaauggccgguga

SEQ ID NO: 390154 - RNA, 22 nt, Bordetella pertussis
ggccaaugccuauuggcuguau

SEQ ID NO: 390155 - RNA, 24 nt, Bordetella pertussis
ggccaccgcggugccgcgcgcggc

SEQ ID NO: 390156 - RNA, 20 nt, Bordetella pertussis
ggccaccgcguugagcgccg

SEQ ID NO: 390157 - RNA, 19 nt, Bordetella pertussis
ggccaccuggucgucggcc

SEQ ID NO: 390158 - RNA, 22 nt, Bordetella pertussis
ggccaccuggucgucggccacg

SEQ ID NO: 390159 - RNA, 19 nt, Bordetella pertussis
ggccacgaagcgcagcacc

SEQ ID NO: 390160 - RNA, 15 nt, Bordetella pertussis
ggccacgaauuccuc

SEQ ID NO: 390161 - RNA, 23 nt, Bordetella pertussis
ggccacgaccggcucgaucgccg

SEQ ID NO: 390162 - RNA, 20 nt, Bordetella pertussis
ggccacgaugauggaggcca

SEQ ID NO: 390163 - RNA, 14 nt, Bordetella pertussis
ggccacgagcagua

SEQ ID NO: 390164 - RNA, 13 nt, Bordetella pertussis
ggccacgccggcc

SEQ ID NO: 390165 - RNA, 17 nt, Bordetella pertussis
ggccacgccggccgggg

SEQ ID NO: 390166 - RNA, 19 nt, Bordetella pertussis
ggccacgcgcugcagcagc

SEQ ID NO: 390167 - RNA, 16 nt, Bordetella pertussis
ggccacgcgggcgugg

SEQ ID NO: 390168 - RNA, 17 nt, Bordetella pertussis
ggccacuuccagcgccu

SEQ ID NO: 390169 - RNA, 21 nt, Bordetella pertussis
ggccacuuccuggugggcggc

SEQ ID NO: 390170 - RNA, 21 nt, Bordetella pertussis
ggccagacauugucaagcagc

SEQ ID NO: 390171 - RNA, 15 nt, Bordetella pertussis
ggccagaccgcgcgc

SEQ ID NO: 390172 - RNA, 17 nt, Bordetella pertussis
ggccagauagcccaggc

SEQ ID NO: 390173 - RNA, 20 nt, Bordetella pertussis
ggccagaucgucgaacuugu

SEQ ID NO: 390174 - RNA, 17 nt, Bordetella pertussis
ggccagcaagcgcucgg

SEQ ID NO: 390175 - RNA, 20 nt, Bordetella pertussis
ggccagcacauacgccgccg

SEQ ID NO: 390176 - RNA, 16 nt, Bordetella pertussis
ggccagcaccggccgc

SEQ ID NO: 390177 - RNA, 18 nt, Bordetella pertussis
ggccagcaccggccgccg

SEQ ID NO: 390178 - RNA, 13 nt, Bordetella pertussis
ggccagcacgccg

SEQ ID NO: 390179 - RNA, 20 nt, Bordetella pertussis
ggccagcacgucauccuggg

SEQ ID NO: 390180 - RNA, 19 nt, Bordetella pertussis
ggccagcagaaugccgccc

SEQ ID NO: 390181 - RNA, 22 nt, Bordetella pertussis
ggccagcagaaugccgcccacg

SEQ ID NO: 390182 - RNA, 16 nt, Bordetella pertussis
ggccagcacgccggcg

SEQ ID NO: 390183 - RNA, 19 nt, Bordetella pertussis
ggccagcucggcggccgcc

SEQ ID NO: 390184 - RNA, 14 nt, Bordetella pertussis
ggccagcugcaugc

SEQ ID NO: 390185 - RNA, 15 nt, Bordetella pertussis
ggccagcugcgcccc

SEQ ID NO: 390186 - RNA, 15 nt, Bordetella pertussis
ggccagcuggcggcg

SEQ ID NO: 390187 - RNA, 17 nt, Bordetella pertussis
ggccagcuugaccgcca

SEQ ID NO: 390188 - RNA, 22 nt, Bordetella pertussis
ggccagcuugaccgccagcauc

SEQ ID NO: 390189 - RNA, 13 nt, Bordetella pertussis
ggccagcuugagc

SEQ ID NO: 390190 - RNA, 17 nt, Bordetella pertussis
ggccaggaaagccggcg

SEQ ID NO: 390191 - RNA, 14 nt, Bordetella pertussis
ggccaggcgcgugc

SEQ ID NO: 390192 - RNA, 24 nt, Bordetella pertussis
ggccaggcgcgugcgcaggcgcgu

SEQ ID NO: 390193 - RNA, 13 nt, Bordetella pertussis
ggccaggcucagc

SEQ ID NO: 390194 - RNA, 19 nt, Bordetella pertussis
ggccagggccacgccggcc

SEQ ID NO: 390195 - RNA, 21 nt, Bordetella pertussis
ggccagggccucgcgggccuu

SEQ ID NO: 390196 - RNA, 20 nt, Bordetella pertussis
ggccagggccugcgggccgg

SEQ ID NO: 390197 - RNA, 23 nt, Bordetella pertussis
ggccagggccugcgggccgggca

SEQ ID NO: 390198 - RNA, 17 nt, Bordetella pertussis
ggccagggcaagcgcgu

SEQ ID NO: 390199 - RNA, 20 nt, Bordetella pertussis
ggccagggcgaugcggcggc

SEQ ID NO: 390200 - RNA, 21 nt, Bordetella pertussis
ggccagggcgaugcggcggcc

SEQ ID NO: 390201 - RNA, 12 nt, Bordetella pertussis
ggccagggcggc

SEQ ID NO: 390202 - RNA, 15 nt, Bordetella pertussis
ggccagggcugcggc

SEQ ID NO: 390203 - RNA, 17 nt, Bordetella pertussis
ggccagguauugcgggg

SEQ ID NO: 390204 - RNA, 18 nt, Bordetella pertussis
ggccagguauugcggggc

SEQ ID NO: 390205 - RNA, 16 nt, Bordetella pertussis
ggccaguucgcggcgc

SEQ ID NO: 390206 - RNA, 23 nt, Bordetella pertussis
ggccaguucgcggcgcagcgcgu

SEQ ID NO: 390207 - RNA, 21 nt, Bordetella pertussis
ggccaucaagaaggucgacga

SEQ ID NO: 390208 - RNA, 14 nt, Bordetella pertussis
ggccaugcccaggc

SEQ ID NO: 390209 - RNA, 16 nt, Bordetella pertussis
ggccaugccguccugc

SEQ ID NO: 390210 - RNA, 21 nt, Bordetella pertussis
ggccaugccguccugcugcgg

SEQ ID NO: 390211 - RNA, 22 nt, Bordetella pertussis
ggccaugcgauaggcgaagcgc

SEQ ID NO: 390212 - RNA, 19 nt, Bordetella pertussis
ggccaugcgcgccagcaug

SEQ ID NO: 390213 - RNA, 14 nt, Bordetella pertussis
ggccaugcucagca

SEQ ID NO: 390214 - RNA, 14 nt, Bordetella pertussis
ggccauggacagca

SEQ ID NO: 390215 - RNA, 17 nt, Bordetella pertussis
ggccauggacagcaccg

SEQ ID NO: 390216 - RNA, 18 nt, Bordetella pertussis
ggccauggcacaggccau

SEQ ID NO: 390217 - RNA, 21 nt, Bordetella pertussis
ggccauggccgccacacgagg

SEQ ID NO: 390218 - RNA, 13 nt, Bordetella pertussis
ggccauggcggcc

SEQ ID NO: 390219 - RNA, 17 nt, Bordetella pertussis
ggcccacagcgccccca

SEQ ID NO: 390220 - RNA, 20 nt, Bordetella pertussis
ggcccaccgcaucgcgcagc

SEQ ID NO: 390221 - RNA, 14 nt, Bordetella pertussis
ggcccacgccgccg

SEQ ID NO: 390222 - RNA, 20 nt, Bordetella pertussis
ggcccacggcaucgccgcgg

SEQ ID NO: 390223 - RNA, 22 nt, Bordetella pertussis
ggcccacggcaucgccgcgggc

SEQ ID NO: 390224 - RNA, 20 nt, Bordetella pertussis
ggcccacucggugcgcgcgc

SEQ ID NO: 390225 - RNA, 21 nt, Bordetella pertussis
ggcccacucggugcgcgcgcc

SEQ ID NO: 390226 - RNA, 17 nt, Bordetella pertussis
ggcccacuggaucgccg

SEQ ID NO: 390227 - RNA, 12 nt, Bordetella pertussis
ggcccagcaccg

SEQ ID NO: 390228 - RNA, 14 nt, Bordetella pertussis
ggcccagcaccgcc

SEQ ID NO: 390229 - RNA, 16 nt, Bordetella pertussis
ggcccagcacgcgcgc

SEQ ID NO: 390230 - RNA, 18 nt, Bordetella pertussis
ggcccagcacgcgcgcca

SEQ ID NO: 390231 - RNA, 22 nt, Bordetella pertussis
ggcccagcacgcgcgccagcug

SEQ ID NO: 390232 - RNA, 15 nt, Bordetella pertussis
ggcccagccagcccu

SEQ ID NO: 390233 - RNA, 22 nt, Bordetella pertussis
ggcccagccagcggugcgcggc

SEQ ID NO: 390234 - RNA, 12 nt, Bordetella pertussis
ggcccagcauca

SEQ ID NO: 390235 - RNA, 14 nt, Bordetella pertussis
ggcccagcccgccg

SEQ ID NO: 390236 - RNA, 20 nt, Bordetella pertussis
ggcccagcccgccgauccac

SEQ ID NO: 390237 - RNA, 20 nt, Bordetella pertussis
ggcccagccgcaugccggcg

SEQ ID NO: 390238 - RNA, 13 nt, Bordetella pertussis
ggcccagccgcuc

SEQ ID NO: 390239 - RNA, 14 nt, Bordetella pertussis
ggcccagcgcgcca

SEQ ID NO: 390240 - RNA, 14 nt, Bordetella pertussis
ggcccagcgccagc

SEQ ID NO: 390241 - RNA, 18 nt, Bordetella pertussis
ggcccagcgccagcagca

SEQ ID NO: 390242 - RNA, 16 nt, Bordetella pertussis
ggcccagcgcggcggc

SEQ ID NO: 390243 - RNA, 12 nt, Bordetella pertussis
ggcccagcuggg

SEQ ID NO: 390244 - RNA, 16 nt, Bordetella pertussis
ggcccagcugggcggc

SEQ ID NO: 390245 - RNA, 21 nt, Bordetella pertussis
ggcccagcuugaacaggcagu

SEQ ID NO: 390246 - RNA, 17 nt, Bordetella pertussis
ggcccaggauggcgcca

SEQ ID NO: 390247 - RNA, 20 nt, Bordetella pertussis
ggcccaggcaaugcgcaggc

SEQ ID NO: 390248 - RNA, 15 nt, Bordetella pertussis
ggcccaggccgggcg

SEQ ID NO: 390249 - RNA, 17 nt, Bordetella pertussis
ggcccaggcgacccagc

SEQ ID NO: 390250 - RNA, 20 nt, Bordetella pertussis
ggcccaggcgacccagcacc

SEQ ID NO: 390251 - RNA, 16 nt, Bordetella pertussis
ggcccaggcgcgcugg

SEQ ID NO: 390252 - RNA, 15 nt, Bordetella pertussis
ggcccaggcguccag

SEQ ID NO: 390253 - RNA, 16 nt, Bordetella pertussis
ggcccaggcguccagg

SEQ ID NO: 390254 - RNA, 20 nt, Bordetella pertussis
ggcccaggcguccaggcugc

SEQ ID NO: 390255 - RNA, 15 nt, Bordetella pertussis
ggcccagggccaggu

SEQ ID NO: 390256 - RNA, 17 nt, Bordetella pertussis
ggcccaguucgcgcagc

SEQ ID NO: 390257 - RNA, 24 nt, Bordetella pertussis
ggcccaguugaaucggcgcgagcg

SEQ ID NO: 390258 - RNA, 23 nt, Bordetella pertussis
ggcccaguugacgaugcccaggu

SEQ ID NO: 390259 - RNA, 16 nt, Bordetella pertussis
ggcccaguucggcgcg

SEQ ID NO: 390260 - RNA, 22 nt, Bordetella pertussis
ggcccaguucggcgcgcgugcc

SEQ ID NO: 390261 - RNA, 17 nt, Bordetella pertussis
ggcccauccaucuggug

SEQ ID NO: 390262 - RNA, 20 nt, Bordetella pertussis
ggcccaucuguacggccggc

SEQ ID NO: 390263 - RNA, 20 nt, Bordetella pertussis
ggcccaugacgaccuugcgg

SEQ ID NO: 390264 - RNA, 14 nt, Bordetella pertussis
ggcccaugccgccc

SEQ ID NO: 390265 - RNA, 20 nt, Bordetella pertussis
ggcccauugcggcaccugcu

SEQ ID NO: 390266 - RNA, 21 nt, Bordetella pertussis
ggcccauugcggcaccugcug

SEQ ID NO: 390267 - RNA, 20 nt, Bordetella pertussis
ggccccagcaucugccccag

SEQ ID NO: 390268 - RNA, 13 nt, Bordetella pertussis
ggcccccagccca

SEQ ID NO: 390269 - RNA, 23 nt, Bordetella pertussis
ggccccgcaaggggccggcgccg

SEQ ID NO: 390270 - RNA, 15 nt, Bordetella pertussis
ggccccgcgaggggc

SEQ ID NO: 390271 - RNA, 14 nt, Bordetella pertussis
ggccccgcgcgagc

SEQ ID NO: 390272 - RNA, 18 nt, Bordetella pertussis
ggccccggcucccgcgcc

SEQ ID NO: 390273 - RNA, 21 nt, Bordetella pertussis
ggccccguugucgccgcggcc

SEQ ID NO: 390274 - RNA, 15 nt, Bordetella pertussis
ggccccucgcggggc

SEQ ID NO: 390275 - RNA, 12 nt, Bordetella pertussis
ggccccuguccu

SEQ ID NO: 390276 - RNA, 21 nt, Bordetella pertussis
ggccccuguccucgcaggaau

SEQ ID NO: 390277 - RNA, 18 nt, Bordetella pertussis
ggcccgaaacgcgcagca

SEQ ID NO: 390278 - RNA, 23 nt, Bordetella pertussis
ggcccgaaacgcgcagcaccggc

SEQ ID NO: 390279 - RNA, 20 nt, Bordetella pertussis
ggcccgacaccuggacccgc

SEQ ID NO: 390280 - RNA, 19 nt, Bordetella pertussis
ggcccgauggcggggaugg

SEQ ID NO: 390281 - RNA, 21 nt, Bordetella pertussis
ggcccgauggcggggauggag

SEQ ID NO: 390282 - RNA, 22 nt, Bordetella pertussis
ggcccgcaccgggcggcccggc

SEQ ID NO: 390283 - RNA, 16 nt, Bordetella pertussis
ggcccgcauguccgag

SEQ ID NO: 390284 - RNA, 19 nt, Bordetella pertussis
ggcccgccaccacggcgcg

SEQ ID NO: 390285 - RNA, 19 nt, Bordetella pertussis
ggcccgcaucgcgcgccgc

SEQ ID NO: 390286 - RNA, 16 nt, Bordetella pertussis
ggcccgccaggaagcg

SEQ ID NO: 390287 - RNA, 14 nt, Bordetella pertussis
ggcccgccagggcc

SEQ ID NO: 390288 - RNA, 17 nt, Bordetella pertussis
ggcccgcccgcccuggg

SEQ ID NO: 390289 - RNA, 22 nt, Bordetella pertussis
ggcccgccgacugggcuugccg

SEQ ID NO: 390290 - RNA, 18 nt, Bordetella pertussis
ggcccgccgcggcaggcc

SEQ ID NO: 390291 - RNA, 19 nt, Bordetella pertussis
ggcccgccgcggcaggccc

SEQ ID NO: 390292 - RNA, 16 nt, Bordetella pertussis
ggcccgcgccagcgcc

SEQ ID NO: 390293 - RNA, 17 nt, Bordetella pertussis
ggcccgcgccgacggcg

SEQ ID NO: 390294 - RNA, 14 nt, Bordetella pertussis
ggcccgcgcgccuu

SEQ ID NO: 390295 - RNA, 12 nt, Bordetella pertussis
ggcccgcgcggc

SEQ ID NO: 390296 - RNA, 16 nt, Bordetella pertussis
ggcccgcgcggccagc

SEQ ID NO: 390297 - RNA, 18 nt, Bordetella pertussis
ggcccgcgcggccagcgc

SEQ ID NO: 390298 - RNA, 19 nt, Bordetella pertussis
ggcccgcgcggccagcgcc

SEQ ID NO: 390299 - RNA, 12 nt, Bordetella pertussis
ggcccgcggcgc

SEQ ID NO: 390300 - RNA, 15 nt, Bordetella pertussis
ggcccgcggcgccag

SEQ ID NO: 390301 - RNA, 16 nt, Bordetella pertussis
ggcccgcggcgccagc

SEQ ID NO: 390302 - RNA, 18 nt, Bordetella pertussis
ggcccgcgggcgcccggc

SEQ ID NO: 390303 - RNA, 22 nt, Bordetella pertussis
ggcccgcgcuguugcuccaggc

SEQ ID NO: 390304 - RNA, 14 nt, Bordetella pertussis
ggcccgcggccgcg

SEQ ID NO: 390305 - RNA, 21 nt, Bordetella pertussis
ggcccgcgugacggccgccac

SEQ ID NO: 390306 - RNA, 14 nt, Bordetella pertussis
ggcccgcuccaggc

SEQ ID NO: 390307 - RNA, 18 nt, Bordetella pertussis
ggcccgcuccaggcggcc

SEQ ID NO: 390308 - RNA, 21 nt, Bordetella pertussis
ggcccgcuccaggcggccagu

SEQ ID NO: 390309 - RNA, 17 nt, Bordetella pertussis
ggcccgcucggccagca

SEQ ID NO: 390310 - RNA, 19 nt, Bordetella pertussis
ggcccgcucggccagcagu

SEQ ID NO: 390311 - RNA, 18 nt, Bordetella pertussis
ggcccggacgcggccggc

SEQ ID NO: 390312 - RNA, 18 nt, Bordetella pertussis
ggcccggauauggccggc

SEQ ID NO: 390313 - RNA, 19 nt, Bordetella pertussis
ggcccggaucauccgggcc

SEQ ID NO: 390314 - RNA, 16 nt, Bordetella pertussis
ggcccggccaagcugg

SEQ ID NO: 390315 - RNA, 19 nt, Bordetella pertussis
ggcccggccacggccgggc

SEQ ID NO: 390316 - RNA, 13 nt, Bordetella pertussis
ggcccggcgccgg

SEQ ID NO: 390317 - RNA, 15 nt, Bordetella pertussis
ggcccggcgcgcauc

SEQ ID NO: 390318 - RNA, 15 nt, Bordetella pertussis
ggcccggcgcgccuu

SEQ ID NO: 390319 - RNA, 17 nt, Bordetella pertussis
ggcccggcggcaaaaaa

SEQ ID NO: 390320 - RNA, 21 nt, Bordetella pertussis
ggcccggcgggaacaggcacc

SEQ ID NO: 390321 - RNA, 15 nt, Bordetella pertussis
ggcccggcguagcug

SEQ ID NO: 390322 - RNA, 14 nt, Bordetella pertussis
ggcccggcucgccg

SEQ ID NO: 390323 - RNA, 15 nt, Bordetella pertussis
ggcccgggcgcgcug

SEQ ID NO: 390324 - RNA, 14 nt, Bordetella pertussis
ggcccgggcguggc

SEQ ID NO: 390325 - RNA, 23 nt, Bordetella pertussis
ggcccggugcagccgccgcaggc

SEQ ID NO: 390326 - RNA, 21 nt, Bordetella pertussis
ggcccgguuggggucgcgcug

SEQ ID NO: 390327 - RNA, 20 nt, Bordetella pertussis
ggcccgucgcgccaggccgg

SEQ ID NO: 390328 - RNA, 17 nt, Bordetella pertussis
ggcccguuggcaggcca

SEQ ID NO: 390329 - RNA, 18 nt, Bordetella pertussis
ggcccguuggcaggccag

SEQ ID NO: 390330 - RNA, 21 nt, Bordetella pertussis
ggcccugccgaucaagagccu

SEQ ID NO: 390331 - RNA, 14 nt, Bordetella pertussis
ggcccugccgcccu

SEQ ID NO: 390332 - RNA, 17 nt, Bordetella pertussis
ggcccugccgcccuggc

SEQ ID NO: 390333 - RNA, 14 nt, Bordetella pertussis
ggcccugccgccuc

SEQ ID NO: 390334 - RNA, 15 nt, Bordetella pertussis
ggcccugcagcggcc

SEQ ID NO: 390335 - RNA, 21 nt, Bordetella pertussis
ggcccugcgcguugagcagca

SEQ ID NO: 390336 - RNA, 17 nt, Bordetella pertussis
ggcccuggagaucgccg

SEQ ID NO: 390337 - RNA, 13 nt, Bordetella pertussis
ggcccuggcuggc

SEQ ID NO: 390338 - RNA, 12 nt, Bordetella pertussis
ggcccuggggcc

SEQ ID NO: 390339 - RNA, 13 nt, Bordetella pertussis
ggcccuggggccg

SEQ ID NO: 390340 - RNA, 17 nt, Bordetella pertussis
ggcccuggggccgcggc

SEQ ID NO: 390341 - RNA, 19 nt, Bordetella pertussis
ggcccuggggccgcggcgc

SEQ ID NO: 390342 - RNA, 15 nt, Bordetella pertussis
ggcccugggccagca

SEQ ID NO: 390343 - RNA, 22 nt, Bordetella pertussis
ggcccuugauaaaaaggggggc

SEQ ID NO: 390344 - RNA, 19 nt, Bordetella pertussis
ggcccuugauggccgggcc

SEQ ID NO: 390345 - RNA, 18 nt, Bordetella pertussis
ggccgaaaccgccgcggc

SEQ ID NO: 390346 - RNA, 18 nt, Bordetella pertussis
ggccgaaauggcggcggu

SEQ ID NO: 390347 - RNA, 14 nt, Bordetella pertussis
ggccgaaccgcgca

SEQ ID NO: 390348 - RNA, 23 nt, Bordetella pertussis
ggccgaacuucagcccgggcaug

SEQ ID NO: 390349 - RNA, 16 nt, Bordetella pertussis
ggccgaauugccgccg

SEQ ID NO: 390350 - RNA, 19 nt, Bordetella pertussis
ggccgaauugccgccgcug

SEQ ID NO: 390351 - RNA, 23 nt, Bordetella pertussis
ggccgaauugccgccgcugccgg

SEQ ID NO: 390352 - RNA, 18 nt, Bordetella pertussis
ggccgacagcgucgagcu

SEQ ID NO: 390353 - RNA, 14 nt, Bordetella pertussis
ggccgaccacugga

SEQ ID NO: 390354 - RNA, 19 nt, Bordetella pertussis
ggccgaccauguggcagau

SEQ ID NO: 390355 - RNA, 21 nt, Bordetella pertussis
ggccgaccauguggcagaugg

SEQ ID NO: 390356 - RNA, 15 nt, Bordetella pertussis
ggccgacccgcggcc

SEQ ID NO: 390357 - RNA, 20 nt, Bordetella pertussis
ggccgacccgcggcccuugc

SEQ ID NO: 390358 - RNA, 19 nt, Bordetella pertussis
ggccgaccggcgcgcgcgu

SEQ ID NO: 390359 - RNA, 22 nt, Bordetella pertussis
ggccgacggcaagaucgccggc

SEQ ID NO: 390360 - RNA, 14 nt, Bordetella pertussis
ggccgacgggcggc

SEQ ID NO: 390361 - RNA, 22 nt, Bordetella pertussis
ggccgacugcuguacgacagca

SEQ ID NO: 390362 - RNA, 21 nt, Bordetella pertussis
ggccuuuuuuugcggcacggc

SEQ ID NO: 390363 - RNA, 23 nt, Bordetella pertussis
ggcgaaaccggugaucagcaggc

SEQ ID NO: 390364 - RNA, 17 nt, Bordetella pertussis
ggcgaaauggugcggcc

SEQ ID NO: 390365 - RNA, 19 nt, Bordetella pertussis
ggcgaacaccaggguggcg

SEQ ID NO: 390366 - RNA, 14 nt, Bordetella pertussis
ggcgaacagcgcgu

SEQ ID NO: 390367 - RNA, 22 nt, Bordetella pertussis
ggcgacacccccagggcgcgcc

SEQ ID NO: 390368 - RNA, 23 nt, Bordetella pertussis
ggcgacacccccagggcgcgccg

SEQ ID NO: 390369 - RNA, 17 nt, Bordetella pertussis
ggcgacaccgcggccuu

SEQ ID NO: 390370 - RNA, 18 nt, Bordetella pertussis
ggcgaaccgcggcgcagg

SEQ ID NO: 390371 - RNA, 17 nt, Bordetella pertussis
ggcgacagggcgucguc

SEQ ID NO: 390372 - RNA, 21 nt, Bordetella pertussis
ggcgaccaggugcgggccgcu

SEQ ID NO: 390373 - RNA, 13 nt, Bordetella pertussis
ggcgaccgccggc

SEQ ID NO: 390374 - RNA, 16 nt, Bordetella pertussis
ggcgaccgccggccgg

SEQ ID NO: 390375 - RNA, 17 nt, Bordetella pertussis
ggcgaccggcaccuggg

SEQ ID NO: 390376 - RNA, 22 nt, Bordetella pertussis
ggcgacgcccagccugccggcg

SEQ ID NO: 390377 - RNA, 22 nt, Bordetella pertussis
ggcgacggcgucggccuggucc

SEQ ID NO: 390378 - RNA, 16 nt, Bordetella pertussis
ggcgacugcagcaggc

SEQ ID NO: 390379 - RNA, 19 nt, Bordetella pertussis
ggcgacugccccagcggcu

SEQ ID NO: 390380 - RNA, 23 nt, Bordetella pertussis
ggcgacugccccagcggcuggcg

SEQ ID NO: 390381 - RNA, 16 nt, Bordetella pertussis
ggcgacuucggcggcc

SEQ ID NO: 390382 - RNA, 17 nt, Bordetella pertussis
ggcgacuucggcggccu

SEQ ID NO: 390383 - RNA, 20 nt, Bordetella pertussis
ggcgacuucggcggccugcu

SEQ ID NO: 390384 - RNA, 22 nt, Bordetella pertussis
ggcgagcagguccauggccagu

SEQ ID NO: 390385 - RNA, 12 nt, Bordetella pertussis
ggcgagcaguuc

SEQ ID NO: 390386 - RNA, 19 nt, Bordetella pertussis
ggcgagcauggcgguggcc

SEQ ID NO: 390387 - RNA, 23 nt, Bordetella pertussis
ggcgagcauggcgguggccagcg

SEQ ID NO: 390388 - RNA, 17 nt, Bordetella pertussis
ggcgagcgcagccgcuc

SEQ ID NO: 390389 - RNA, 14 nt, Bordetella pertussis
ggcgagcggcgucg

SEQ ID NO: 390390 - RNA, 14 nt, Bordetella pertussis
ggcgagcgggccgg

SEQ ID NO: 390391 - RNA, 16 nt, Bordetella pertussis
ggcgagcuggcccugg

SEQ ID NO: 390392 - RNA, 15 nt, Bordetella pertussis
ggcgauauggccagg

SEQ ID NO: 390393 - RNA, 22 nt, Bordetella pertussis
ggcgaucaacgugcgccaggca

SEQ ID NO: 390394 - RNA, 22 nt, Bordetella pertussis
ggcgaucagcaccgcggcgggc

SEQ ID NO: 390395 - RNA, 18 nt, Bordetella pertussis
ggcgaucugcgcggcggu

SEQ ID NO: 390396 - RNA, 16 nt, Bordetella pertussis
ggcgaucuugccggcc

SEQ ID NO: 390397 - RNA, 18 nt, Bordetella pertussis
ggcgaucuugccggccug

SEQ ID NO: 390398 - RNA, 21 nt, Bordetella pertussis
ggcgaugcccaccagccgccc

SEQ ID NO: 390399 - RNA, 12 nt, Bordetella pertussis
ggcgaugcccag

SEQ ID NO: 390400 - RNA, 13 nt, Bordetella pertussis
ggcgaugcccagc

SEQ ID NO: 390401 - RNA, 14 nt, Bordetella pertussis
ggcgaugcccagcg

SEQ ID NO: 390402 - RNA, 14 nt, Bordetella pertussis
ggcgaugccccggu

SEQ ID NO: 390403 - RNA, 22 nt, Bordetella pertussis
ggcgaugccccgguagucgccg

SEQ ID NO: 390404 - RNA, 14 nt, Bordetella pertussis
ggcgaugccgcaga

SEQ ID NO: 390405 - RNA, 16 nt, Bordetella pertussis
ggcgaugccggccagc

SEQ ID NO: 390406 - RNA, 18 nt, Bordetella pertussis
ggcgaugccggccagcag

SEQ ID NO: 390407 - RNA, 15 nt, Bordetella pertussis
ggcgaugcgcgagcg

SEQ ID NO: 390408 - RNA, 16 nt, Bordetella pertussis
ggcgauguugaagccg

SEQ ID NO: 390409 - RNA, 21 nt, Bordetella pertussis
ggcgauugcggcccgcggccu

SEQ ID NO: 390410 - RNA, 21 nt, Bordetella pertussis
ggcgauugcucgacauagaga

SEQ ID NO: 390411 - RNA, 17 nt, Bordetella pertussis
ggcgauuugccgcagcc

SEQ ID NO: 390412 - RNA, 22 nt, Bordetella pertussis
ggcgcaccaaucuugccaggcc

SEQ ID NO: 390413 - RNA, 12 nt, Bordetella pertussis
ggcgcaccagcg

SEQ ID NO: 390414 - RNA, 20 nt, Bordetella pertussis
ggcgcaccagcgaggcggca

SEQ ID NO: 390415 - RNA, 16 nt, Bordetella pertussis
ggcgcaccaggcuggg

SEQ ID NO: 390416 - RNA, 23 nt, Bordetella pertussis
ggcgcacccgcggcgcaugcagc

SEQ ID NO: 390417 - RNA, 20 nt, Bordetella pertussis
ggcgcaccgacagcaagggc

SEQ ID NO: 390418 - RNA, 16 nt, Bordetella pertussis
ggcgcaccgcgcuggg

SEQ ID NO: 390419 - RNA, 22 nt, Bordetella pertussis
ggcgcaccggcacgcgccagcu

SEQ ID NO: 390420 - RNA, 19 nt, Bordetella pertussis
ggcgcacgccgcgccggcg

SEQ ID NO: 390421 - RNA, 14 nt, Bordetella pertussis
ggcgcacggcggca

SEQ ID NO: 390422 - RNA, 15 nt, Bordetella pertussis
ggcgcagcgcccagg

SEQ ID NO: 390423 - RNA, 16 nt, Bordetella pertussis
ggcgcagcgcccaggc

SEQ ID NO: 390424 - RNA, 20 nt, Bordetella pertussis
ggcgcagcgcggcacgcugc

SEQ ID NO: 390425 - RNA, 18 nt, Bordetella pertussis
ggcgcagcggcggcgcgg

SEQ ID NO: 390426 - RNA, 14 nt, Bordetella pertussis
ggcgcagcuccggg

SEQ ID NO: 390427 - RNA, 15 nt, Bordetella pertussis
ggcgcagcucgaccg

SEQ ID NO: 390428 - RNA, 12 nt, Bordetella pertussis
ggcgcaggcauu

SEQ ID NO: 390429 - RNA, 13 nt, Bordetella pertussis
ggcgcaggccagc

SEQ ID NO: 390430 - RNA, 14 nt, Bordetella pertussis
ggcgcaggccagcg

SEQ ID NO: 390431 - RNA, 11 nt, Bordetella pertussis
ggcgcaggccg

SEQ ID NO: 390432 - RNA, 17 nt, Bordetella pertussis
ggcgcaggccgccacuu

SEQ ID NO: 390433 - RNA, 17 nt, Bordetella pertussis
ggcgcaggccgcgccgg

SEQ ID NO: 390434 - RNA, 16 nt, Bordetella pertussis
ggcgcaggccgcgcgc

SEQ ID NO: 390435 - RNA, 16 nt, Bordetella pertussis
ggcgcaggccggcggc

SEQ ID NO: 390436 - RNA, 17 nt, Bordetella pertussis
ggcgcaggccggcggcc

SEQ ID NO: 390437 - RNA, 16 nt, Bordetella pertussis
ggcgcaggccugcggc

SEQ ID NO: 390438 - RNA, 19 nt, Bordetella pertussis
ggcgcaggcgcgccagggg

SEQ ID NO: 390439 - RNA, 17 nt, Bordetella pertussis
ggcgccacgcagaaggc

SEQ ID NO: 390440 - RNA, 14 nt, Bordetella pertussis
ggcgccagcagcgg

SEQ ID NO: 390441 - RNA, 20 nt, Bordetella pertussis
ggcgccagcagcgggcuggg

SEQ ID NO: 390442 - RNA, 22 nt, Bordetella pertussis
ggcgccagcagcgggcuggggc

SEQ ID NO: 390443 - RNA, 12 nt, Bordetella pertussis
ggcgccagcccg

SEQ ID NO: 390444 - RNA, 17 nt, Bordetella pertussis
ggcgccagcccgcccgc

SEQ ID NO: 390445 - RNA, 19 nt, Bordetella pertussis
ggcgccagcccgcccgcga

SEQ ID NO: 390446 - RNA, 23 nt, Bordetella pertussis
ggcgccagcggcauugcccaggu

SEQ ID NO: 390447 - RNA, 12 nt, Bordetella pertussis
ggcgccagcugg

SEQ ID NO: 390448 - RNA, 13 nt, Bordetella pertussis
ggcgccagcugga

SEQ ID NO: 390449 - RNA, 22 nt, Bordetella pertussis
ggcgccagcgccgcgucgagcg

SEQ ID NO: 390450 - RNA, 11 nt, Bordetella pertussis
ggcgccaggcu

SEQ ID NO: 390451 - RNA, 22 nt, Bordetella pertussis
ggcgccaggcugaaugccgccg

SEQ ID NO: 390452 - RNA, 17 nt, Bordetella pertussis
ggcgccaguagcgccgg

SEQ ID NO: 390453 - RNA, 12 nt, Bordetella pertussis
ggcgccaguccc

SEQ ID NO: 390454 - RNA, 22 nt, Bordetella pertussis
ggcgccagucgcgcagcaccuc

SEQ ID NO: 390455 - RNA, 18 nt, Bordetella pertussis
ggcgccaucaaugccaau

SEQ ID NO: 390456 - RNA, 13 nt, Bordetella pertussis
ggcgccgccggcc

SEQ ID NO: 390457 - RNA, 15 nt, Bordetella pertussis
ggcgccgccggcggc

SEQ ID NO: 390458 - RNA, 17 nt, Bordetella pertussis
ggcgccgccggcggccu

SEQ ID NO: 390459 - RNA, 18 nt, Bordetella pertussis
ggcgccgccggguuucuc

SEQ ID NO: 390460 - RNA, 19 nt, Bordetella pertussis
ggcgccgccggguuucucg

SEQ ID NO: 390461 - RNA, 18 nt, Bordetella pertussis
ggcgccgccgugcgcggg

SEQ ID NO: 390462 - RNA, 20 nt, Bordetella pertussis
ggcgccgccgugcgcgggcg

SEQ ID NO: 390463 - RNA, 16 nt, Bordetella pertussis
ggcgccgccucaggcc

SEQ ID NO: 390464 - RNA, 16 nt, Bordetella pertussis
ggcgccgcgcccggcc

SEQ ID NO: 390465 - RNA, 20 nt, Bordetella pertussis
ggcgccgcgcccggccggcc

SEQ ID NO: 390466 - RNA, 18 nt, Bordetella pertussis
ggcgccgcgcacgcacug

SEQ ID NO: 390467 - RNA, 15 nt, Bordetella pertussis
ggcgccgcgccgccg

SEQ ID NO: 390468 - RNA, 13 nt, Bordetella pertussis
ggcgccgcgccgg

SEQ ID NO: 390469 - RNA, 17 nt, Bordetella pertussis
ggcgccgcgcgccgcgg

SEQ ID NO: 390470 - RNA, 19 nt, Bordetella pertussis
ggcgccgcgcgccgcggcc

SEQ ID NO: 390471 - RNA, 16 nt, Bordetella pertussis
ggcgccgcgcgcuggu

SEQ ID NO: 390472 - RNA, 23 nt, Bordetella pertussis
ggcgccgcgcgcuuucagguggg

SEQ ID NO: 390473 - RNA, 20 nt, Bordetella pertussis
ggcgccgcgcguaugcaccg

SEQ ID NO: 390474 - RNA, 15 nt, Bordetella pertussis
ggcgccgcgcucgcg

SEQ ID NO: 390475 - RNA, 20 nt, Bordetella pertussis
ggcgccgcgcucgcgccagg

SEQ ID NO: 390476 - RNA, 15 nt, Bordetella pertussis
ggcgccgcggaggcg

SEQ ID NO: 390477 - RNA, 22 nt, Bordetella pertussis
ggcgccgcggaggcgaaauaca

SEQ ID NO: 390478 - RNA, 14 nt, Bordetella pertussis
ggcgccgcggccgg

SEQ ID NO: 390479 - RNA, 14 nt, Bordetella pertussis
ggcgccgcggcggc

SEQ ID NO: 390480 - RNA, 15 nt, Bordetella pertussis
ggcgccgcggcggcg

SEQ ID NO: 390481 - RNA, 12 nt, Bordetella pertussis
ggcgccgcgggc

SEQ ID NO: 390482 - RNA, 13 nt, Bordetella pertussis
ggcgccgcggggg

SEQ ID NO: 390483 - RNA, 18 nt, Bordetella pertussis
ggcgccgcguccggcgcc

SEQ ID NO: 390484 - RNA, 23 nt, Bordetella pertussis
ggcgccgcguccggcgcccgccg

SEQ ID NO: 390485 - RNA, 17 nt, Bordetella pertussis
ggcgccgcucagcgcgg

SEQ ID NO: 390486 - RNA, 19 nt, Bordetella pertussis
ggcgccgcucagcgcggcg

SEQ ID NO: 390487 - RNA, 20 nt, Bordetella pertussis
ggcgccggcgucacgcggcc

SEQ ID NO: 390488 - RNA, 13 nt, Bordetella pertussis
ggcgccggcggcg

SEQ ID NO: 390489 - RNA, 23 nt, Bordetella pertussis
ggcgccggcuggcaugcggcgga

SEQ ID NO: 390490 - RNA, 14 nt, Bordetella pertussis
ggcgccgggccgcu

SEQ ID NO: 390491 - RNA, 14 nt, Bordetella pertussis
ggcgccgggcgacg

SEQ ID NO: 390492 - RNA, 19 nt, Bordetella pertussis
ggcgccgggcggaucgccg

SEQ ID NO: 390493 - RNA, 17 nt, Bordetella pertussis
ggcgccggugcgcggcg

SEQ ID NO: 390494 - RNA, 19 nt, Bordetella pertussis
ggcgccggugcgcggcgcc

SEQ ID NO: 390495 - RNA, 20 nt, Bordetella pertussis
ggcgccggucugggcgcgga

SEQ ID NO: 390496 - RNA, 17 nt, Bordetella pertussis
ggcgccgucgaagccgg

SEQ ID NO: 390497 - RNA, 15 nt, Bordetella pertussis
ggcgccgucgcgcug

SEQ ID NO: 390498 - RNA, 22 nt, Bordetella pertussis
ggcgccuuucccgcgccgagcg

SEQ ID NO: 390499 - RNA, 20 nt, Bordetella pertussis
ggcgcgaacaccggcaggcc

SEQ ID NO: 390500 - RNA, 14 nt, Bordetella pertussis
ggcgcgacaggcgg

SEQ ID NO: 390501 - RNA, 13 nt, Bordetella pertussis
ggcgcgacgcgcu

SEQ ID NO: 390502 - RNA, 15 nt, Bordetella pertussis
ggcgcgacgcgcuug

SEQ ID NO: 390503 - RNA, 17 nt, Bordetella pertussis
ggcgcgagcgaugcccu

SEQ ID NO: 390504 - RNA, 20 nt, Bordetella pertussis
ggcgcgagcgaugcccugga

SEQ ID NO: 390505 - RNA, 18 nt, Bordetella pertussis
ggcgcgcaucgucaggca

SEQ ID NO: 390506 - RNA, 16 nt, Bordetella pertussis
ggcgcgcaucggcgcc

SEQ ID NO: 390507 - RNA, 20 nt, Bordetella pertussis
ggcgcgccagcccgccgcug

SEQ ID NO: 390508 - RNA, 15 nt, Bordetella pertussis
ggcgcgccagccgcg

SEQ ID NO: 390509 - RNA, 15 nt, Bordetella pertussis
ggcgcgccagccgcu

SEQ ID NO: 390510 - RNA, 14 nt, Bordetella pertussis
ggcgcgccagcgcg

SEQ ID NO: 390511 - RNA, 15 nt, Bordetella pertussis
ggcgcgccagcgcgg

SEQ ID NO: 390512 - RNA, 20 nt, Bordetella pertussis
ggcgcgccagcgcggccagc

SEQ ID NO: 390513 - RNA, 21 nt, Bordetella pertussis
ggcgcgccagcgcggccagcg

SEQ ID NO: 390514 - RNA, 21 nt, Bordetella pertussis
ggcgcgccaggaagcgcgccg

SEQ ID NO: 390515 - RNA, 16 nt, Bordetella pertussis
ggcgcgcccagccccg

SEQ ID NO: 390516 - RNA, 22 nt, Bordetella pertussis
ggcgcgcccagcggcaggcugg

SEQ ID NO: 390517 - RNA, 19 nt, Bordetella pertussis
ggcgcgcccgcaggcggcg

SEQ ID NO: 390518 - RNA, 21 nt, Bordetella pertussis
ggcgcgcccgcaggcggcggc

SEQ ID NO: 390519 - RNA, 22 nt, Bordetella pertussis
ggcgcgcccgcaggcggcggcc

SEQ ID NO: 390520 - RNA, 16 nt, Bordetella pertussis
ggcgcgcccgccccgc

SEQ ID NO: 390521 - RNA, 22 nt, Bordetella pertussis
ggcgcgcccgccuucggcggcg

SEQ ID NO: 390522 - RNA, 17 nt, Bordetella pertussis
ggcgcgcccaccagggu

SEQ ID NO: 390523 - RNA, 15 nt, Bordetella pertussis
ggcgcgcccggcgcg

SEQ ID NO: 390524 - RNA, 17 nt, Bordetella pertussis
ggcgcgcccggcgcgcc

SEQ ID NO: 390525 - RNA, 22 nt, Bordetella pertussis
ggcgcgccgcccgcuucuuccu

SEQ ID NO: 390526 - RNA, 19 nt, Bordetella pertussis
ggcgcgccgcugcagcgcu

SEQ ID NO: 390527 - RNA, 21 nt, Bordetella pertussis
ggcgcgcggcguugcggcgcc

SEQ ID NO: 390528 - RNA, 13 nt, Bordetella pertussis
ggcgcgcggcugg

SEQ ID NO: 390529 - RNA, 14 nt, Bordetella pertussis
ggcgcgcgggggug

SEQ ID NO: 390530 - RNA, 18 nt, Bordetella pertussis
ggcgcgcucaggccgccg

SEQ ID NO: 390531 - RNA, 17 nt, Bordetella pertussis
ggcgcgcucgcugccgg

SEQ ID NO: 390532 - RNA, 19 nt, Bordetella pertussis
ggcgcgcucgcugccggcg

SEQ ID NO: 390533 - RNA, 22 nt, Bordetella pertussis
ggcgcgcucgcugccggcgucc

SEQ ID NO: 390534 - RNA, 17 nt, Bordetella pertussis
ggcgcgcucggcgccgg

SEQ ID NO: 390535 - RNA, 21 nt, Bordetella pertussis
ggcgcgcucggcgccgggcug

SEQ ID NO: 390536 - RNA, 16 nt, Bordetella pertussis
ggcgcgcuggaggccu

SEQ ID NO: 390537 - RNA, 16 nt, Bordetella pertussis
ggcgcgcugcccagcc

SEQ ID NO: 390538 - RNA, 19 nt, Bordetella pertussis
ggcgcggaccugcucgagc

SEQ ID NO: 390539 - RNA, 22 nt, Bordetella pertussis
ggcgcggauugaugucgcgcac

SEQ ID NO: 390540 - RNA, 15 nt, Bordetella pertussis
ggcgcggcagccugg

SEQ ID NO: 390541 - RNA, 21 nt, Bordetella pertussis
ggcgcggccaaccccgagggc

SEQ ID NO: 390542 - RNA, 23 nt, Bordetella pertussis
ggcgcggccaaccccgagggcgc

SEQ ID NO: 390543 - RNA, 13 nt, Bordetella pertussis
ggcgcggccagca

SEQ ID NO: 390544 - RNA, 15 nt, Bordetella pertussis
ggcgcggccagcagc

SEQ ID NO: 390545 - RNA, 16 nt, Bordetella pertussis
ggcgcggccagcagcg

SEQ ID NO: 390546 - RNA, 13 nt, Bordetella pertussis
ggcgcggccgacg

SEQ ID NO: 390547 - RNA, 12 nt, Bordetella pertussis
ggcgcggccggg

SEQ ID NO: 390548 - RNA, 13 nt, Bordetella pertussis
ggcgcggcgagca

SEQ ID NO: 390549 - RNA, 19 nt, Bordetella pertussis
ggcgcggcgauugcggccc

SEQ ID NO: 390550 - RNA, 16 nt, Bordetella pertussis
ggcgcggcgcaggccu

SEQ ID NO: 390551 - RNA, 20 nt, Bordetella pertussis
ggcgcggcgcaggccugcgg

SEQ ID NO: 390552 - RNA, 16 nt, Bordetella pertussis
ggcgcggcgcgcgccg

SEQ ID NO: 390553 - RNA, 12 nt, Bordetella pertussis
ggcgcggcggcc

SEQ ID NO: 390554 - RNA, 15 nt, Bordetella pertussis
ggcgcggcggcggcc

SEQ ID NO: 390555 - RNA, 15 nt, Bordetella pertussis
ggcgcggucggcggg

SEQ ID NO: 390556 - RNA, 16 nt, Bordetella pertussis
ggcgcggucggcgggc

SEQ ID NO: 390557 - RNA, 20 nt, Bordetella pertussis
ggcgcgguggccaugcuggg

SEQ ID NO: 390558 - RNA, 21 nt, Bordetella pertussis
ggcgcgguugguuugcggcgc

SEQ ID NO: 390559 - RNA, 21 nt, Bordetella pertussis
ggcgcguaguagucgguggcc

SEQ ID NO: 390560 - RNA, 18 nt, Bordetella pertussis
ggcgcguaugacgcgcug

SEQ ID NO: 390561 - RNA, 19 nt, Bordetella pertussis
ggcgcguaugacgcgcuga

SEQ ID NO: 390562 - RNA, 15 nt, Bordetella pertussis
ggcgcgucaggccgg

SEQ ID NO: 390563 - RNA, 16 nt, Bordetella pertussis
ggcgcgucaggccggg

SEQ ID NO: 390564 - RNA, 15 nt, Bordetella pertussis
ggcgcgucgccggcg

SEQ ID NO: 390565 - RNA, 20 nt, Bordetella pertussis
ggcgcgucgcgcgccaggcg

SEQ ID NO: 390566 - RNA, 21 nt, Bordetella pertussis
ggcgcgucgcgcgccaggcgg

SEQ ID NO: 390567 - RNA, 18 nt, Bordetella pertussis
ggcgcgucgcgcggcggc

SEQ ID NO: 390568 - RNA, 19 nt, Bordetella pertussis
ggcgcgucgcgcggcggca

SEQ ID NO: 390569 - RNA, 20 nt, Bordetella pertussis
ggcgcgucgcgguacaggcu

SEQ ID NO: 390570 - RNA, 17 nt, Bordetella pertussis
ggcgcgucggcgcgcgc

SEQ ID NO: 390571 - RNA, 15 nt, Bordetella pertussis
ggcgcugcacgcagc

SEQ ID NO: 390572 - RNA, 16 nt, Bordetella pertussis
ggcgcugcacgcagcg

SEQ ID NO: 390573 - RNA, 12 nt, Bordetella pertussis
ggcgcugcagcg

SEQ ID NO: 390574 - RNA, 15 nt, Bordetella pertussis
ggcgcugccgaccag

SEQ ID NO: 390575 - RNA, 19 nt, Bordetella pertussis
ggcgcugccgaccagcacg

SEQ ID NO: 390576 - RNA, 14 nt, Bordetella pertussis
ggcgcugcgcagca

SEQ ID NO: 390577 - RNA, 16 nt, Bordetella pertussis
ggcgcugcgcagcagg

SEQ ID NO: 390578 - RNA, 15 nt, Bordetella pertussis
ggcgcugcgccggcg

SEQ ID NO: 390579 - RNA, 17 nt, Bordetella pertussis
ggcgcugcgccggcggc

SEQ ID NO: 390580 - RNA, 23 nt, Bordetella pertussis
ggcgcugcgcgaaacggccgggu

SEQ ID NO: 390581 - RNA, 17 nt, Bordetella pertussis
ggcggacgauggccugu

SEQ ID NO: 390582 - RNA, 18 nt, Bordetella pertussis
ggcggaucacccagcggc

SEQ ID NO: 390583 - RNA, 20 nt, Bordetella pertussis
ggcggaucgaacgccucggg

SEQ ID NO: 390584 - RNA, 19 nt, Bordetella pertussis
ggcggaucucggccagcag

SEQ ID NO: 390585 - RNA, 21 nt, Bordetella pertussis
ggcggaugcgcacgggcgagg

SEQ ID NO: 390586 - RNA, 15 nt, Bordetella pertussis
ggcggauggcuuccu

SEQ ID NO: 390587 - RNA, 17 nt, Bordetella pertussis
ggcggcaacgugcaggc

SEQ ID NO: 390588 - RNA, 12 nt, Bordetella pertussis
ggcggcaagcag

SEQ ID NO: 390589 - RNA, 18 nt, Bordetella pertussis
ggcggcaccagcaggccg

SEQ ID NO: 390590 - RNA, 19 nt, Bordetella pertussis
ggcggcaccagcaggccgg

SEQ ID NO: 390591 - RNA, 16 nt, Bordetella pertussis
ggcggcacgcgcgccg

SEQ ID NO: 390592 - RNA, 21 nt, Bordetella pertussis
ggcggcacgcugcgcaggcgc

SEQ ID NO: 390593 - RNA, 15 nt, Bordetella pertussis
ggcggcacgguggcg

SEQ ID NO: 390594 - RNA, 13 nt, Bordetella pertussis
ggcggcagccggc

SEQ ID NO: 390595 - RNA, 17 nt, Bordetella pertussis
ggcggcaggcgccgccg

SEQ ID NO: 390596 - RNA, 19 nt, Bordetella pertussis
ggcggcaucucgcggcggu

SEQ ID NO: 390597 - RNA, 23 nt, Bordetella pertussis
ggcggcaucuugccuuggcgaau

SEQ ID NO: 390598 - RNA, 21 nt, Bordetella pertussis
ggcggcaugcgccagccagcg

SEQ ID NO: 390599 - RNA, 13 nt, Bordetella pertussis
ggcggcaugcugg

SEQ ID NO: 390600 - RNA, 19 nt, Bordetella pertussis
ggcggcauucagcgcugca

SEQ ID NO: 390601 - RNA, 17 nt, Bordetella pertussis
ggcggccacgaccggcu

SEQ ID NO: 390602 - RNA, 13 nt, Bordetella pertussis
ggcggccagcagc

SEQ ID NO: 390603 - RNA, 20 nt, Bordetella pertussis
ggcggccagcagcggcaggu

SEQ ID NO: 390604 - RNA, 23 nt, Bordetella pertussis
ggcggccagcaugcuggguugcc

SEQ ID NO: 390605 - RNA, 14 nt, Bordetella pertussis
ggcggccagccggc

SEQ ID NO: 390606 - RNA, 21 nt, Bordetella pertussis
ggcggccagcuuguagcggcc

SEQ ID NO: 390607 - RNA, 12 nt, Bordetella pertussis
ggcggccaggcc

SEQ ID NO: 390608 - RNA, 14 nt, Bordetella pertussis
ggcggccaggccgg

SEQ ID NO: 390609 - RNA, 19 nt, Bordetella pertussis
ggcggccaggccggggccg

SEQ ID NO: 390610 - RNA, 23 nt, Bordetella pertussis
ggcggccaucuuggugcgcgcca

SEQ ID NO: 390611 - RNA, 15 nt, Bordetella pertussis
ggcggcccacagcgc

SEQ ID NO: 390612 - RNA, 16 nt, Bordetella pertussis
ggcggccggcaggccg

SEQ ID NO: 390613 - RNA, 23 nt, Bordetella pertussis
ggcggccggcaggccggccagca

SEQ ID NO: 390614 - RNA, 14 nt, Bordetella pertussis
ggcggccggggccg

SEQ ID NO: 390615 - RNA, 16 nt, Bordetella pertussis
ggcggccggggccgcc

SEQ ID NO: 390616 - RNA, 12 nt, Bordetella pertussis
ggcggccgucgg

SEQ ID NO: 390617 - RNA, 17 nt, Bordetella pertussis
ggcggccgucggggccg

SEQ ID NO: 390618 - RNA, 18 nt, Bordetella pertussis
ggcggccuaucaccuggg

SEQ ID NO: 390619 - RNA, 17 nt, Bordetella pertussis
ggcggccuccagcaggg

SEQ ID NO: 390620 - RNA, 22 nt, Bordetella pertussis
ggcggccugcacggugggcagc

SEQ ID NO: 390621 - RNA, 23 nt, Bordetella pertussis
ggcggccugcacggugggcagca

SEQ ID NO: 390622 - RNA, 19 nt, Bordetella pertussis
ggcggccugcgccggcaug

SEQ ID NO: 390623 - RNA, 14 nt, Bordetella pertussis
ggcggccugcuugg

SEQ ID NO: 390624 - RNA, 18 nt, Bordetella pertussis
ggcggccugggaggcgcu

SEQ ID NO: 390625 - RNA, 16 nt, Bordetella pertussis
ggcggccuugcgggcc

SEQ ID NO: 390626 - RNA, 17 nt, Bordetella pertussis
ggcggccuugcgggccg

SEQ ID NO: 390627 - RNA, 20 nt, Bordetella pertussis
ggcggccuugcgggccggcu

SEQ ID NO: 390628 - RNA, 22 nt, Bordetella pertussis
ggcggccuuggccgcagccggc

SEQ ID NO: 390629 - RNA, 17 nt, Bordetella pertussis
ggcggccuugugcgcca

SEQ ID NO: 390630 - RNA, 15 nt, Bordetella pertussis
ggcggcgcgcggcug

SEQ ID NO: 390631 - RNA, 13 nt, Bordetella pertussis
ggcggcgcggcga

SEQ ID NO: 390632 - RNA, 14 nt, Bordetella pertussis
ggcggcgcggcgcu

SEQ ID NO: 390633 - RNA, 16 nt, Bordetella pertussis
ggcggcgcggcgcugg

SEQ ID NO: 390634 - RNA, 14 nt, Bordetella pertussis
ggcggcgcggcgau

SEQ ID NO: 390635 - RNA, 13 nt, Bordetella pertussis
ggcggcgcgggcg

SEQ ID NO: 390636 - RNA, 16 nt, Bordetella pertussis
ggcggcgcucgaaggc

SEQ ID NO: 390637 - RNA, 14 nt, Bordetella pertussis
ggcggcgcuggcgu

SEQ ID NO: 390638 - RNA, 12 nt, Bordetella pertussis
ggcggcgcuggu

SEQ ID NO: 390639 - RNA, 21 nt, Bordetella pertussis
ggcggcuuucgauuugcagca

SEQ ID NO: 390640 - RNA, 20 nt, Bordetella pertussis
ggcgggaaugucccacaggc

SEQ ID NO: 390641 - RNA, 22 nt, Bordetella pertussis
ggcgggaaugucccacaggcgc

SEQ ID NO: 390642 - RNA, 22 nt, Bordetella pertussis
ggcgggacuuagaaguccaugc

SEQ ID NO: 390643 - RNA, 22 nt, Bordetella pertussis
ggcgggcacgagaucgccuggg

SEQ ID NO: 390644 - RNA, 13 nt, Bordetella pertussis
ggcgggcaggcgg

SEQ ID NO: 390645 - RNA, 15 nt, Bordetella pertussis
ggcgggccagcuccc

SEQ ID NO: 390646 - RNA, 12 nt, Bordetella pertussis
ggcgggccgagg

SEQ ID NO: 390647 - RNA, 20 nt, Bordetella pertussis
ggcgggccguugcgccugcc

SEQ ID NO: 390648 - RNA, 12 nt, Bordetella pertussis
ggcgggccuggg

SEQ ID NO: 390649 - RNA, 20 nt, Bordetella pertussis
ggcgggcgccugcggcaggc

SEQ ID NO: 390650 - RNA, 23 nt, Bordetella pertussis
ggcgggcgccccgaucggcgccg

SEQ ID NO: 390651 - RNA, 23 nt, Bordetella pertussis
ggcgggcgugaugccgaccaggc

SEQ ID NO: 390652 - RNA, 17 nt, Bordetella pertussis
ggcgggcgugcggaugg

SEQ ID NO: 390653 - RNA, 18 nt, Bordetella pertussis
ggcgggcuagcugugaac

SEQ ID NO: 390654 - RNA, 12 nt, Bordetella pertussis
ggcgggcucagc

SEQ ID NO: 390655 - RNA, 15 nt, Bordetella pertussis
ggcgggcucgagcug

SEQ ID NO: 390656 - RNA, 13 nt, Bordetella pertussis
ggcgggcucggcg

SEQ ID NO: 390657 - RNA, 19 nt, Bordetella pertussis
ggcgggcugguggugggcg

SEQ ID NO: 390658 - RNA, 22 nt, Bordetella pertussis
ggcggguucgcuggggcugccg

SEQ ID NO: 390659 - RNA, 20 nt, Bordetella pertussis
ggcgguacaggccggcggcg

SEQ ID NO: 390660 - RNA, 17 nt, Bordetella pertussis
ggcgguaugcggcgccc

SEQ ID NO: 390661 - RNA, 14 nt, Bordetella pertussis
ggcggugggcagcg

SEQ ID NO: 390662 - RNA, 15 nt, Bordetella pertussis
ggcgguuccagccug

SEQ ID NO: 390663 - RNA, 21 nt, Bordetella pertussis
ggcgguucaggccccggccgg

SEQ ID NO: 390664 - RNA, 18 nt, Bordetella pertussis
ggcguagagcagugugcc

SEQ ID NO: 390665 - RNA, 15 nt, Bordetella pertussis
ggcguagcugcgccg

SEQ ID NO: 390666 - RNA, 19 nt, Bordetella pertussis
ggcguaguagcccaggccc

SEQ ID NO: 390667 - RNA, 20 nt, Bordetella pertussis
ggcgucaaugccagucgccg

SEQ ID NO: 390668 - RNA, 22 nt, Bordetella pertussis
ggcuccagcucagcagcgccag

SEQ ID NO: 390669 - RNA, 13 nt, Bordetella pertussis
ggcuccucgccac

SEQ ID NO: 390670 - RNA, 13 nt, Bordetella pertussis
ggcucgagcggca

SEQ ID NO: 390671 - RNA, 22 nt, Bordetella pertussis
ggcucgagcuggcuggccagcg

SEQ ID NO: 390672 - RNA, 21 nt, Bordetella pertussis
ggcucgaucgccgccggcacg

SEQ ID NO: 390673 - RNA, 17 nt, Bordetella pertussis
ggcucgaugaccagcag

SEQ ID NO: 390674 - RNA, 17 nt, Bordetella pertussis
ggcucgccggccgcgcc

SEQ ID NO: 390675 - RNA, 20 nt, Bordetella pertussis
ggcucgccuccccaggccag

SEQ ID NO: 390676 - RNA, 16 nt, Bordetella pertussis
ggcucgugcagcaggg

SEQ ID NO: 390677 - RNA, 18 nt, Bordetella pertussis
ggcucgugcgccuaaaca

SEQ ID NO: 390678 - RNA, 16 nt, Bordetella pertussis
ggcucugaucgcgcug

SEQ ID NO: 390679 - RNA, 18 nt, Bordetella pertussis
ggcucugaucgcgcugga

SEQ ID NO: 390680 - RNA, 22 nt, Bordetella pertussis
ggcucuggaucgugcccagcug

SEQ ID NO: 390681 - RNA, 14 nt, Bordetella pertussis
ggcucugggcggag

SEQ ID NO: 390682 - RNA, 15 nt, Bordetella pertussis
ggcugaagaagcccg

SEQ ID NO: 390683 - RNA, 14 nt, Bordetella pertussis
ggcugaaggggcuc

SEQ ID NO: 390684 - RNA, 15 nt, Bordetella pertussis
ggcugaaggggcucc

SEQ ID NO: 390685 - RNA, 22 nt, Bordetella pertussis
ggcugacaccguuuuggcaggc

SEQ ID NO: 390686 - RNA, 13 nt, Bordetella pertussis
ggcugaccagcag

SEQ ID NO: 390687 - RNA, 14 nt, Bordetella pertussis
ggcugacgcccggc

SEQ ID NO: 390688 - RNA, 22 nt, Bordetella pertussis
ggcugagaucguccagcgacuc

SEQ ID NO: 390689 - RNA, 20 nt, Bordetella pertussis
ggcugagcgacaugucgccg

SEQ ID NO: 390690 - RNA, 15 nt, Bordetella pertussis
ggcugagcucgugua

SEQ ID NO: 390691 - RNA, 19 nt, Bordetella pertussis
ggcugaucuugaugcggcc

SEQ ID NO: 390692 - RNA, 19 nt, Bordetella pertussis
ggcugcaagacgcccaggc

SEQ ID NO: 390693 - RNA, 15 nt, Bordetella pertussis
ggcugcaccagcgcg

SEQ ID NO: 390694 - RNA, 21 nt, Bordetella pertussis
ggcugcacgauguugccgccg

SEQ ID NO: 390695 - RNA, 18 nt, Bordetella pertussis
ggcugccauuccagcucc

SEQ ID NO: 390696 - RNA, 13 nt, Bordetella pertussis
ggcugcccaccuu

SEQ ID NO: 390697 - RNA, 17 nt, Bordetella pertussis
ggcugcccuggcccagg

SEQ ID NO: 390698 - RNA, 18 nt, Bordetella pertussis
ggcugcccuggcccaggc

SEQ ID NO: 390699 - RNA, 11 nt, Bordetella pertussis
ggcugcccuug

SEQ ID NO: 390700 - RNA, 23 nt, Bordetella pertussis
ggcugcccucggucagcgccagg

SEQ ID NO: 390701 - RNA, 19 nt, Bordetella pertussis
ggcugccgauacgggcgcg

SEQ ID NO: 390702 - RNA, 20 nt, Bordetella pertussis
ggcugccgucggccagcuug

SEQ ID NO: 390703 - RNA, 16 nt, Bordetella pertussis
ggcugcgcgccuggca

SEQ ID NO: 390704 - RNA, 21 nt, Bordetella pertussis
ggcugcgcgcgcagccaggua

SEQ ID NO: 390705 - RNA, 14 nt, Bordetella pertussis
ggcugcgcgcgcca

SEQ ID NO: 390706 - RNA, 23 nt, Bordetella pertussis
ggcugcgcgcgccagcgccuggg

SEQ ID NO: 390707 - RNA, 17 nt, Bordetella pertussis
ggcugcgcgccggcgcc

SEQ ID NO: 390708 - RNA, 22 nt, Bordetella pertussis
ggcugcgcgccggcgccuuggc

SEQ ID NO: 390709 - RNA, 14 nt, Bordetella pertussis
ggcugcgggccggc

SEQ ID NO: 390710 - RNA, 17 nt, Bordetella pertussis
ggcugcgggccggcgcc

SEQ ID NO: 390711 - RNA, 21 nt, Bordetella pertussis
ggcugcgggcgcaagccagca

SEQ ID NO: 390712 - RNA, 18 nt, Bordetella pertussis
ggcugcgugcgggacagg

SEQ ID NO: 390713 - RNA, 21 nt, Bordetella pertussis
ggcugcucguucugcgcgccc

SEQ ID NO: 390714 - RNA, 13 nt, Bordetella pertussis
ggcugcugcacgc

SEQ ID NO: 390715 - RNA, 19 nt, Bordetella pertussis
ggcugcugcccgaagcgca

SEQ ID NO: 390716 - RNA, 16 nt, Bordetella pertussis
ggcugcuggaacggug

SEQ ID NO: 390717 - RNA, 15 nt, Bordetella pertussis
ggcugcugggccggc

SEQ ID NO: 390718 - RNA, 16 nt, Bordetella pertussis
ggcugcugugccugcc

SEQ ID NO: 390719 - RNA, 21 nt, Bordetella pertussis
ggcuggagcucuaugucgccg

SEQ ID NO: 390720 - RNA, 15 nt, Bordetella pertussis
ggcuggccagccggc

SEQ ID NO: 390721 - RNA, 19 nt, Bordetella pertussis
ggcuggccagccggcccag

SEQ ID NO: 390722 - RNA, 13 nt, Bordetella pertussis
ggcuggccagcug

SEQ ID NO: 390723 - RNA, 14 nt, Bordetella pertussis
ggcuggccagcugg

SEQ ID NO: 390724 - RNA, 13 nt, Bordetella pertussis
ggcuggccgccug

SEQ ID NO: 390725 - RNA, 13 nt, Bordetella pertussis
ggcuggcgcggcc

SEQ ID NO: 390726 - RNA, 14 nt, Bordetella pertussis
ggcuggcgcggcug

SEQ ID NO: 390727 - RNA, 14 nt, Bordetella pertussis
ggcuggcggugcgu

SEQ ID NO: 390728 - RNA, 13 nt, Bordetella pertussis
ggcugggagagcc

SEQ ID NO: 390729 - RNA, 14 nt, Bordetella pertussis
ggcugggcgcgccg

SEQ ID NO: 390730 - RNA, 14 nt, Bordetella pertussis
ggcugggcggccuu

SEQ ID NO: 390731 - RNA, 16 nt, Bordetella pertussis
ggcuggggcugcuggg

SEQ ID NO: 390732 - RNA, 21 nt, Bordetella pertussis
ggcuggggcugcugggccggc

SEQ ID NO: 390733 - RNA, 14 nt, Bordetella pertussis
ggcugguaggggau

SEQ ID NO: 390734 - RNA, 15 nt, Bordetella pertussis
ggcuggucgcgccgg

SEQ ID NO: 390735 - RNA, 14 nt, Bordetella pertussis
ggcuggugccgacg

SEQ ID NO: 390736 - RNA, 17 nt, Bordetella pertussis
ggcuggugccgacggcg

SEQ ID NO: 390737 - RNA, 12 nt, Bordetella pertussis
ggcuguauagau

SEQ ID NO: 390738 - RNA, 22 nt, Bordetella pertussis
ggcuguauagaugcgcggggcc

SEQ ID NO: 390739 - RNA, 14 nt, Bordetella pertussis
ggcugucccagaug

SEQ ID NO: 390740 - RNA, 15 nt, Bordetella pertussis
ggcuguccccgcaug

SEQ ID NO: 390741 - RNA, 19 nt, Bordetella pertussis
ggcuguccccgcgcggggg

SEQ ID NO: 390742 - RNA, 20 nt, Bordetella pertussis
ggcuguccccgcgcgggggg

SEQ ID NO: 390743 - RNA, 20 nt, Bordetella pertussis
ggcugucgcagucggggccg

SEQ ID NO: 390744 - RNA, 17 nt, Bordetella pertussis
ggcugugcccgccccau

SEQ ID NO: 390745 - RNA, 18 nt, Bordetella pertussis
ggcugugggccucgcugg

SEQ ID NO: 390746 - RNA, 16 nt, Bordetella pertussis
ggcuguucgcgcagca

SEQ ID NO: 390747 - RNA, 16 nt, Bordetella pertussis
ggcuguugggcaaggu

SEQ ID NO: 390748 - RNA, 19 nt, Bordetella pertussis
ggcuuccaguucgcgcaga

SEQ ID NO: 390749 - RNA, 20 nt, Bordetella pertussis
ggcuucgaccacgcggcggu

SEQ ID NO: 390750 - RNA, 22 nt, Bordetella pertussis
ggcuucgcccagcgcuugcacg

SEQ ID NO: 390751 - RNA, 18 nt, Bordetella pertussis
ggcuucgcccgccaccac

SEQ ID NO: 390752 - RNA, 15 nt, Bordetella pertussis
ggcuucggcgcuggg

SEQ ID NO: 390753 - RNA, 22 nt, Bordetella pertussis
ggcuucuccucuuuccccuccc

SEQ ID NO: 390754 - RNA, 16 nt, Bordetella pertussis
ggcuucucgaccaggc

SEQ ID NO: 390755 - RNA, 14 nt, Bordetella pertussis
ggcuugaccacggc

SEQ ID NO: 390756 - RNA, 20 nt, Bordetella pertussis
ggcuugaccacggccagcag

SEQ ID NO: 390757 - RNA, 14 nt, Bordetella pertussis
ggcuugcacgccgg

SEQ ID NO: 390758 - RNA, 15 nt, Bordetella pertussis
ggcuugccgcgcggc

SEQ ID NO: 390759 - RNA, 17 nt, Bordetella pertussis
ggcuugcugccccccga

SEQ ID NO: 390760 - RNA, 16 nt, Bordetella pertussis
ggcuuggccucggccg

SEQ ID NO: 390761 - RNA, 21 nt, Bordetella pertussis
ggcuuucgauuugcagcagca

SEQ ID NO: 390762 - RNA, 18 nt, Bordetella pertussis
ggcuuucgccgcgggccu

SEQ ID NO: 390763 - RNA, 12 nt, Bordetella pertussis
ggcuuucugcuu

SEQ ID NO: 390764 - RNA, 16 nt, Bordetella pertussis
ggcuuuuucucggccu

SEQ ID NO: 390765 - RNA, 12 nt, Bordetella pertussis
ggcuuuuuugcc

SEQ ID NO: 390766 - RNA, 18 nt, Bordetella pertussis
gggaaaacagcgcgggcg

SEQ ID NO: 390767 - RNA, 22 nt, Bordetella pertussis
gggaaacggccaagcagcgccu

SEQ ID NO: 390768 - RNA, 12 nt, Bordetella pertussis
gggaacaggcgc

SEQ ID NO: 390769 - RNA, 21 nt, Bordetella pertussis
gggaaccgcaccggaggcgcc

SEQ ID NO: 390770 - RNA, 14 nt, Bordetella pertussis
gggaagcgcucgcg

SEQ ID NO: 390771 - RNA, 19 nt, Bordetella pertussis
gggaagcgcucgcgcaggc

SEQ ID NO: 390772 - RNA, 13 nt, Bordetella pertussis
gggaagcugucgg

SEQ ID NO: 390773 - RNA, 16 nt, Bordetella pertussis
gggaagcugucggcgc

SEQ ID NO: 390774 - RNA, 20 nt, Bordetella pertussis
gggaagcugucggcgcuggc

SEQ ID NO: 390775 - RNA, 19 nt, Bordetella pertussis
gggaaugaugcagcuguag

SEQ ID NO: 390776 - RNA, 20 nt, Bordetella pertussis
gggaaugucccacaggcgcg

SEQ ID NO: 390777 - RNA, 23 nt, Bordetella pertussis
gggaaugucccacaggcgcgcgg

SEQ ID NO: 390778 - RNA, 20 nt, Bordetella pertussis
gggacaggcaccccggcgcc

SEQ ID NO: 390779 - RNA, 15 nt, Bordetella pertussis
gggacaggcaccccu

SEQ ID NO: 390780 - RNA, 16 nt, Bordetella pertussis
gggacaggcacccgca

SEQ ID NO: 390781 - RNA, 15 nt, Bordetella pertussis
gggacaggcacccgg

SEQ ID NO: 390782 - RNA, 15 nt, Bordetella pertussis
gggacaggcaccgcc

SEQ ID NO: 390783 - RNA, 16 nt, Bordetella pertussis
gggacaggcacgccgg

SEQ ID NO: 390784 - RNA, 23 nt, Bordetella pertussis
gggacaggcucccgcuggcggca

SEQ ID NO: 390785 - RNA, 20 nt, Bordetella pertussis
gggacaggcuccgagggaca

SEQ ID NO: 390786 - RNA, 22 nt, Bordetella pertussis
gggaccgugccgccgaggauca

SEQ ID NO: 390787 - RNA, 15 nt, Bordetella pertussis
gggacgaagccgggu

SEQ ID NO: 390788 - RNA, 13 nt, Bordetella pertussis
gggacgcaggccc

SEQ ID NO: 390789 - RNA, 16 nt, Bordetella pertussis
gggacgcaggcccagc

SEQ ID NO: 390790 - RNA, 15 nt, Bordetella pertussis
gggacgccggcgggc

SEQ ID NO: 390791 - RNA, 14 nt, Bordetella pertussis
gggacggccagggg

SEQ ID NO: 390792 - RNA, 16 nt, Bordetella pertussis
gggacggcccugcagg

SEQ ID NO: 390793 - RNA, 16 nt, Bordetella pertussis
gggacuggcacccgca

SEQ ID NO: 390794 - RNA, 17 nt, Bordetella pertussis
gggacuggcacccgcca

SEQ ID NO: 390795 - RNA, 16 nt, Bordetella pertussis
gggacuggcaccugca

SEQ ID NO: 390796 - RNA, 15 nt, Bordetella pertussis
gggacuugguuggcc

SEQ ID NO: 390797 - RNA, 15 nt, Bordetella pertussis
gggagccucuggaag

SEQ ID NO: 390798 - RNA, 22 nt, Bordetella pertussis
gggagcggccagcaagcgcgcc

SEQ ID NO: 390799 - RNA, 21 nt, Bordetella pertussis
gggaggccucgacgcuguaga

SEQ ID NO: 390800 - RNA, 22 nt, Bordetella pertussis
gggauaucccgcucggcuggag

SEQ ID NO: 390801 - RNA, 16 nt, Bordetella pertussis
gggauccgugcggcgc

SEQ ID NO: 390802 - RNA, 16 nt, Bordetella pertussis
gggaucgcgccaggcg

SEQ ID NO: 390803 - RNA, 15 nt, Bordetella pertussis
gggaugacgggcgag

SEQ ID NO: 390804 - RNA, 23 nt, Bordetella pertussis
gggauuagccucguuggucagca

SEQ ID NO: 390805 - RNA, 16 nt, Bordetella pertussis
gggauuccugggugcu

SEQ ID NO: 390806 - RNA, 20 nt, Bordetella pertussis
gggcaaacggcggcaggccg

SEQ ID NO: 390807 - RNA, 21 nt, Bordetella pertussis
gggcaaagaaauugggcgugg

SEQ ID NO: 390808 - RNA, 15 nt, Bordetella pertussis
gggcacaacccgccc

SEQ ID NO: 390809 - RNA, 19 nt, Bordetella pertussis
gggcacaccgucacgcgca

SEQ ID NO: 390810 - RNA, 22 nt, Bordetella pertussis
gggcacauacagcggagccgcg

SEQ ID NO: 390811 - RNA, 22 nt, Bordetella pertussis
gggcaccagguccuggcggccg

SEQ ID NO: 390812 - RNA, 23 nt, Bordetella pertussis
gggcaccagguccuggcggccgc

SEQ ID NO: 390813 - RNA, 17 nt, Bordetella pertussis
gggcaccaucucccgca

SEQ ID NO: 390814 - RNA, 17 nt, Bordetella pertussis
gggcaccgacacgcugg

SEQ ID NO: 390815 - RNA, 17 nt, Bordetella pertussis
gggcacucggccauggu

SEQ ID NO: 390816 - RNA, 22 nt, Bordetella pertussis
gggcagaacggaaacgcccagc

SEQ ID NO: 390817 - RNA, 22 nt, Bordetella pertussis
gggcagcaauucgaccggcagg

SEQ ID NO: 390818 - RNA, 20 nt, Bordetella pertussis
gggcagcaccggggcagggc

SEQ ID NO: 390819 - RNA, 14 nt, Bordetella pertussis
gggcagcacgcgca

SEQ ID NO: 390820 - RNA, 19 nt, Bordetella pertussis
gggcagcacgcgcaccagg

SEQ ID NO: 390821 - RNA, 20 nt, Bordetella pertussis
gggcagcacgcgcaccaggc

SEQ ID NO: 390822 - RNA, 22 nt, Bordetella pertussis
gggcagcacgcgcaccaggccu

SEQ ID NO: 390823 - RNA, 15 nt, Bordetella pertussis
gggcagcauggcgcc

SEQ ID NO: 390824 - RNA, 22 nt, Bordetella pertussis
gggcagcauucuggugcagcgg

SEQ ID NO: 390825 - RNA, 21 nt, Bordetella pertussis
gggcagccauccucgcccagc

SEQ ID NO: 390826 - RNA, 14 nt, Bordetella pertussis
gggcagcgcggcgg

SEQ ID NO: 390827 - RNA, 15 nt, Bordetella pertussis
gggcagcgcggcggc

SEQ ID NO: 390828 - RNA, 21 nt, Bordetella pertussis
gggcagcucggugcagcccag

SEQ ID NO: 390829 - RNA, 22 nt, Bordetella pertussis
gggcagcucggugcagcccagc

SEQ ID NO: 390830 - RNA, 14 nt, Bordetella pertussis
gggcaggagcgccg

SEQ ID NO: 390831 - RNA, 15 nt, Bordetella pertussis
gggcaggaggcgcgg

SEQ ID NO: 390832 - RNA, 18 nt, Bordetella pertussis
gggcaggaggcgcgggca

SEQ ID NO: 390833 - RNA, 13 nt, Bordetella pertussis
gggcaggcccagc

SEQ ID NO: 390834 - RNA, 14 nt, Bordetella pertussis
gggcaggcccagcc

SEQ ID NO: 390835 - RNA, 19 nt, Bordetella pertussis
gggcaggcccagccagcgg

SEQ ID NO: 390836 - RNA, 17 nt, Bordetella pertussis
gggcaggcacgcggagg

SEQ ID NO: 390837 - RNA, 12 nt, Bordetella pertussis
gggcaggcgccu

SEQ ID NO: 390838 - RNA, 21 nt, Bordetella pertussis
gggcaggcggcuuucaugggc

SEQ ID NO: 390839 - RNA, 18 nt, Bordetella pertussis
gggcaggcgggccaggcc

SEQ ID NO: 390840 - RNA, 14 nt, Bordetella pertussis
gggcaggcucagcc

SEQ ID NO: 390841 - RNA, 22 nt, Bordetella pertussis
gggcaggcucagcccggcgagg

SEQ ID NO: 390842 - RNA, 12 nt, Bordetella pertussis
gggcagggcggg

SEQ ID NO: 390843 - RNA, 16 nt, Bordetella pertussis
gggcaggucgccagca

SEQ ID NO: 390844 - RNA, 21 nt, Bordetella pertussis
gggcaggucgccagcaggccc

SEQ ID NO: 390845 - RNA, 15 nt, Bordetella pertussis
gggcaggucggccag

SEQ ID NO: 390846 - RNA, 16 nt, Bordetella pertussis
gggcaggucggcgcgg

SEQ ID NO: 390847 - RNA, 19 nt, Bordetella pertussis
gggcaggucggcgcggggc

SEQ ID NO: 390848 - RNA, 16 nt, Bordetella pertussis
gggcaggucgggcagg

SEQ ID NO: 390849 - RNA, 20 nt, Bordetella pertussis
gggcaggucgucgagccggg

SEQ ID NO: 390850 - RNA, 14 nt, Bordetella pertussis
gggcagugcgccgg

SEQ ID NO: 390851 - RNA, 16 nt, Bordetella pertussis
gggcaguucgcccggc

SEQ ID NO: 390852 - RNA, 18 nt, Bordetella pertussis
gggcaguugcuggcggcc

SEQ ID NO: 390853 - RNA, 16 nt, Bordetella pertussis
gggcaguuuccagggc

SEQ ID NO: 390854 - RNA, 21 nt, Bordetella pertussis
gggcauagcgcgccacaauug

SEQ ID NO: 390855 - RNA, 23 nt, Bordetella pertussis
gggcaucgcuuccuuggucagcg

SEQ ID NO: 390856 - RNA, 19 nt, Bordetella pertussis
gggcaucguuggaccccag

SEQ ID NO: 390857 - RNA, 20 nt, Bordetella pertussis
gggcaugcgaaagccggccu

SEQ ID NO: 390858 - RNA, 14 nt, Bordetella pertussis
gggcaugcaccagg

SEQ ID NO: 390859 - RNA, 13 nt, Bordetella pertussis
gggcaugggcccc

SEQ ID NO: 390860 - RNA, 15 nt, Bordetella pertussis
gggcaugucgcggcc

SEQ ID NO: 390861 - RNA, 20 nt, Bordetella pertussis
gggcauugccggagcagcag

SEQ ID NO: 390862 - RNA, 23 nt, Bordetella pertussis
gggcauugccggagcagcagcgg

SEQ ID NO: 390863 - RNA, 20 nt, Bordetella pertussis
gggccacauggucgcccagc

SEQ ID NO: 390864 - RNA, 23 nt, Bordetella pertussis
gggccacauggucgcccagcaga

SEQ ID NO: 390865 - RNA, 15 nt, Bordetella pertussis
gggccacccgccgcc

SEQ ID NO: 390866 - RNA, 17 nt, Bordetella pertussis
gggccaccuggcagccg

SEQ ID NO: 390867 - RNA, 17 nt, Bordetella pertussis
gggccacgaaacccagg

SEQ ID NO: 390868 - RNA, 15 nt, Bordetella pertussis
gggccacgcccacgc

SEQ ID NO: 390869 - RNA, 19 nt, Bordetella pertussis
gggccacgccggccgccug

SEQ ID NO: 390870 - RNA, 19 nt, Bordetella pertussis
gggccacgccggccggggu

SEQ ID NO: 390871 - RNA, 19 nt, Bordetella pertussis
gggccacucgaugggcgcg

SEQ ID NO: 390872 - RNA, 22 nt, Bordetella pertussis
gggccacucgaugggcgcgcgc

SEQ ID NO: 390873 - RNA, 22 nt, Bordetella pertussis
gggccacugcgccugggcggcg

SEQ ID NO: 390874 - RNA, 19 nt, Bordetella pertussis
gggccagaccgcgcgcacc

SEQ ID NO: 390875 - RNA, 13 nt, Bordetella pertussis
gggccagaccugg

SEQ ID NO: 390876 - RNA, 17 nt, Bordetella pertussis
gggccagauagucgcgg

SEQ ID NO: 390877 - RNA, 17 nt, Bordetella pertussis
gggccagcagcuggcgc

SEQ ID NO: 390878 - RNA, 20 nt, Bordetella pertussis
gggccagcagcuggcgcagc

SEQ ID NO: 390879 - RNA, 21 nt, Bordetella pertussis
gggccagcaggcucagcgggc

SEQ ID NO: 390880 - RNA, 20 nt, Bordetella pertussis
gggccagccagcgccgcagc

SEQ ID NO: 390881 - RNA, 20 nt, Bordetella pertussis
gggccagcaucggcacccag

SEQ ID NO: 390882 - RNA, 17 nt, Bordetella pertussis
gggccagccuggcgcca

SEQ ID NO: 390883 - RNA, 18 nt, Bordetella pertussis
gggccagcgcggccaggu

SEQ ID NO: 390884 - RNA, 23 nt, Bordetella pertussis
gggccagcgcggccaggucggcg

SEQ ID NO: 390885 - RNA, 15 nt, Bordetella pertussis
gggccaggaccgagg

SEQ ID NO: 390886 - RNA, 18 nt, Bordetella pertussis
gggccaggaccgaggugc

SEQ ID NO: 390887 - RNA, 21 nt, Bordetella pertussis
gggccagcuugacguccagcc

SEQ ID NO: 390888 - RNA, 16 nt, Bordetella pertussis
gggccaggcccacggc

SEQ ID NO: 390889 - RNA, 23 nt, Bordetella pertussis
gggccaggccgauuucggccgcc

SEQ ID NO: 390890 - RNA, 21 nt, Bordetella pertussis
gggccaggcgcaguaucuggu

SEQ ID NO: 390891 - RNA, 18 nt, Bordetella pertussis
gggccaggcgcuccagca

SEQ ID NO: 390892 - RNA, 12 nt, Bordetella pertussis
gggccagggccu

SEQ ID NO: 390893 - RNA, 20 nt, Bordetella pertussis
gggccaguucgcggcgcagc

SEQ ID NO: 390894 - RNA, 23 nt, Bordetella pertussis
gggccaucgggauaccgcuggcc

SEQ ID NO: 390895 - RNA, 21 nt, Bordetella pertussis
gggccaugccguccugcugcg

SEQ ID NO: 390896 - RNA, 15 nt, Bordetella pertussis
gggccauggcagggc

SEQ ID NO: 390897 - RNA, 17 nt, Bordetella pertussis
gggccauguggcgcagc

SEQ ID NO: 390898 - RNA, 13 nt, Bordetella pertussis
gggcccgcgggcg

SEQ ID NO: 390899 - RNA, 17 nt, Bordetella pertussis
gggcccgcucggccagc

SEQ ID NO: 390900 - RNA, 16 nt, Bordetella pertussis
gggcccggccacggcc

SEQ ID NO: 390901 - RNA, 14 nt, Bordetella pertussis
gggcccgggcaggc

SEQ ID NO: 390902 - RNA, 13 nt, Bordetella pertussis
gggcccgggcgcg

SEQ ID NO: 390903 - RNA, 17 nt, Bordetella pertussis
gggcccgucgcgccagg

SEQ ID NO: 390904 - RNA, 22 nt, Bordetella pertussis
gggcccuugugcguuggcgcgg

SEQ ID NO: 390905 - RNA, 20 nt, Bordetella pertussis
gggccgacggccucggccag

SEQ ID NO: 390906 - RNA, 13 nt, Bordetella pertussis
gggccgaccaggc

SEQ ID NO: 390907 - RNA, 16 nt, Bordetella pertussis
gggccgaccaggccgg

SEQ ID NO: 390908 - RNA, 23 nt, Bordetella pertussis
gggccgagcccgcgucggcgcgg

SEQ ID NO: 390909 - RNA, 13 nt, Bordetella pertussis
gggccgagccgga

SEQ ID NO: 390910 - RNA, 14 nt, Bordetella pertussis
gggccgaucccuug

SEQ ID NO: 390911 - RNA, 12 nt, Bordetella pertussis
gggccgaggcgc

SEQ ID NO: 390912 - RNA, 16 nt, Bordetella pertussis
gggccgcacgcgcggc

SEQ ID NO: 390913 - RNA, 14 nt, Bordetella pertussis
gggccgcagcaccu

SEQ ID NO: 390914 - RNA, 22 nt, Bordetella pertussis
gggccgcaagcaagccccaggc

SEQ ID NO: 390915 - RNA, 23 nt, Bordetella pertussis
gggccgcaagcaagccccaggca

SEQ ID NO: 390916 - RNA, 13 nt, Bordetella pertussis
gggccgcagcugg

SEQ ID NO: 390917 - RNA, 13 nt, Bordetella pertussis
gggccgcccaguc

SEQ ID NO: 390918 - RNA, 17 nt, Bordetella pertussis
gggccgccgcgcccagc

SEQ ID NO: 390919 - RNA, 14 nt, Bordetella pertussis
gggccgccugcugg

SEQ ID NO: 390920 - RNA, 16 nt, Bordetella pertussis
gggccgccugcugggc

SEQ ID NO: 390921 - RNA, 20 nt, Bordetella pertussis
gggccgccugcugggccgcg

SEQ ID NO: 390922 - RNA, 17 nt, Bordetella pertussis
gggccgcgcccacagga

SEQ ID NO: 390923 - RNA, 14 nt, Bordetella pertussis
gggccgcgccgcgg

SEQ ID NO: 390924 - RNA, 16 nt, Bordetella pertussis
gggccgcgccugcagg

SEQ ID NO: 390925 - RNA, 20 nt, Bordetella pertussis
gggccgcgcgauccuggggc

SEQ ID NO: 390926 - RNA, 22 nt, Bordetella pertussis
gggccgcgcucgaauggcugcg

SEQ ID NO: 390927 - RNA, 21 nt, Bordetella pertussis
gggccgcggacgaagccuagg

SEQ ID NO: 390928 - RNA, 15 nt, Bordetella pertussis
gggccgcggcgagcu

SEQ ID NO: 390929 - RNA, 21 nt, Bordetella pertussis
gggccgcggcgagcucggcau

SEQ ID NO: 390930 - RNA, 15 nt, Bordetella pertussis
gggccggccgcgcgc

SEQ ID NO: 390931 - RNA, 16 nt, Bordetella pertussis
gggccggccgggcgcg

SEQ ID NO: 390932 - RNA, 18 nt, Bordetella pertussis
gggccggcgaugaagucg

SEQ ID NO: 390933 - RNA, 21 nt, Bordetella pertussis
gggccggcgaugaagucgcgg

SEQ ID NO: 390934 - RNA, 12 nt, Bordetella pertussis
gggccggcggca

SEQ ID NO: 390935 - RNA, 16 nt, Bordetella pertussis
gggccggcggcagccg

SEQ ID NO: 390936 - RNA, 14 nt, Bordetella pertussis
gggccggcgggcau

SEQ ID NO: 390937 - RNA, 13 nt, Bordetella pertussis
gggccggcugggc

SEQ ID NO: 390938 - RNA, 17 nt, Bordetella pertussis
gggccggcugggcggcc

SEQ ID NO: 390939 - RNA, 19 nt, Bordetella pertussis
gggccggcuuuggacaggc

SEQ ID NO: 390940 - RNA, 13 nt, Bordetella pertussis
gggccgggcgcca

SEQ ID NO: 390941 - RNA, 14 nt, Bordetella pertussis
gggccgggcgccag

SEQ ID NO: 390942 - RNA, 16 nt, Bordetella pertussis
gggccgggcgccaggc

SEQ ID NO: 390943 - RNA, 14 nt, Bordetella pertussis
gggccgggccggcg

SEQ ID NO: 390944 - RNA, 15 nt, Bordetella pertussis
gggccguccggccgu

SEQ ID NO: 390945 - RNA, 19 nt, Bordetella pertussis
gggccgucgccgcgcggcg

SEQ ID NO: 390946 - RNA, 19 nt, Bordetella pertussis
gggccgucuacaggcccag

SEQ ID NO: 390947 - RNA, 14 nt, Bordetella pertussis
gggccuagcccggc

SEQ ID NO: 390948 - RNA, 18 nt, Bordetella pertussis
gggccuccucggucgggg

SEQ ID NO: 390949 - RNA, 14 nt, Bordetella pertussis
gggccuccugcagc

SEQ ID NO: 390950 - RNA, 23 nt, Bordetella pertussis
gggccuccugcagcaggucgguc

SEQ ID NO: 390951 - RNA, 16 nt, Bordetella pertussis
gggccucgaagcccgg

SEQ ID NO: 390952 - RNA, 22 nt, Bordetella pertussis
gggccucgaagcccggcagggu

SEQ ID NO: 390953 - RNA, 18 nt, Bordetella pertussis
gggccucaugacggggcc

SEQ ID NO: 390954 - RNA, 18 nt, Bordetella pertussis
gggccucgaugaccgggu

SEQ ID NO: 390955 - RNA, 14 nt, Bordetella pertussis
gggccucgcgggcc

SEQ ID NO: 390956 - RNA, 22 nt, Bordetella pertussis
gggccucggccagcugggccag

SEQ ID NO: 390957 - RNA, 16 nt, Bordetella pertussis
gggccugccgcgcgua

SEQ ID NO: 390958 - RNA, 18 nt, Bordetella pertussis
gggccugcugucgcuggg

SEQ ID NO: 390959 - RNA, 20 nt, Bordetella pertussis
gggccugcugucgcugggau

SEQ ID NO: 390960 - RNA, 24 nt, Bordetella pertussis
gggccuggcagaugcgcgccaggc

SEQ ID NO: 390961 - RNA, 21 nt, Bordetella pertussis
gggcgaagucauguagcggcc

SEQ ID NO: 390962 - RNA, 15 nt, Bordetella pertussis
gggcgaagcggaccu

SEQ ID NO: 390963 - RNA, 19 nt, Bordetella pertussis
gggcgaaggccagcgccuc

SEQ ID NO: 390964 - RNA, 12 nt, Bordetella pertussis
gggcgacaggcg

SEQ ID NO: 390965 - RNA, 13 nt, Bordetella pertussis
gggcgacaggcgc

SEQ ID NO: 390966 - RNA, 14 nt, Bordetella pertussis
gggcgacaggcgcg

SEQ ID NO: 390967 - RNA, 16 nt, Bordetella pertussis
gggcgacugcagcagg

SEQ ID NO: 390968 - RNA, 22 nt, Bordetella pertussis
gggcgacugcagcaggcugggc

SEQ ID NO: 390969 - RNA, 16 nt, Bordetella pertussis
gggcgacgucccaggc

SEQ ID NO: 390970 - RNA, 17 nt, Bordetella pertussis
gggcgagcgcagccgcu

SEQ ID NO: 390971 - RNA, 20 nt, Bordetella pertussis
gggcgagcgcagccgcucca

SEQ ID NO: 390972 - RNA, 14 nt, Bordetella pertussis
gggcgaggcggggc

SEQ ID NO: 390973 - RNA, 16 nt, Bordetella pertussis
gggcgaggcggggcug

SEQ ID NO: 390974 - RNA, 14 nt, Bordetella pertussis
gggcgagguagggc

SEQ ID NO: 390975 - RNA, 18 nt, Bordetella pertussis
gggcgaggucagcccggc

SEQ ID NO: 390976 - RNA, 21 nt, Bordetella pertussis
gggcgaucagcaccgcggcgg

SEQ ID NO: 390977 - RNA, 20 nt, Bordetella pertussis
gggcgauauccaucggcgcg

SEQ ID NO: 390978 - RNA, 15 nt, Bordetella pertussis
gggcgaugcggcggc

SEQ ID NO: 390979 - RNA, 21 nt, Bordetella pertussis
gggcgaugucgucaucccuug

SEQ ID NO: 390980 - RNA, 18 nt, Bordetella pertussis
gggcgauuugccgcagcc

SEQ ID NO: 390981 - RNA, 20 nt, Bordetella pertussis
gggcgauuugccgcagcccg

SEQ ID NO: 390982 - RNA, 20 nt, Bordetella pertussis
gggcgcaccggcacgcgcca

SEQ ID NO: 390983 - RNA, 16 nt, Bordetella pertussis
gggcgcaggccgccac

SEQ ID NO: 390984 - RNA, 21 nt, Bordetella pertussis
gggcgcaucaugaggcggcgg

SEQ ID NO: 390985 - RNA, 14 nt, Bordetella pertussis
gggcgccagcagcg

SEQ ID NO: 390986 - RNA, 20 nt, Bordetella pertussis
gggcgccagcagcgggcugg

SEQ ID NO: 390987 - RNA, 20 nt, Bordetella pertussis
gggcgccgacgaugccgccc

SEQ ID NO: 390988 - RNA, 20 nt, Bordetella pertussis
gggcgccgagggccgcgcga

SEQ ID NO: 390989 - RNA, 14 nt, Bordetella pertussis
gggcgccgcggcgg

SEQ ID NO: 390990 - RNA, 15 nt, Bordetella pertussis
gggcgccgcggcggc

SEQ ID NO: 390991 - RNA, 14 nt, Bordetella pertussis
gggcgccggccagg

SEQ ID NO: 390992 - RNA, 22 nt, Bordetella pertussis
gggcgccucguccugcaggcgg

SEQ ID NO: 390993 - RNA, 22 nt, Bordetella pertussis
gggcgccugcagacgcagugga

SEQ ID NO: 390994 - RNA, 16 nt, Bordetella pertussis
gggcgcgaugggccug

SEQ ID NO: 390995 - RNA, 18 nt, Bordetella pertussis
gggcgcgaugggccugcc

SEQ ID NO: 390996 - RNA, 24 nt, Bordetella pertussis
gggcgcgaugggccugcccauggc

SEQ ID NO: 390997 - RNA, 17 nt, Bordetella pertussis
gggcgccuugccgccgc

SEQ ID NO: 390998 - RNA, 21 nt, Bordetella pertussis
gggcgcgcagcaggcccaugc

SEQ ID NO: 390999 - RNA, 14 nt, Bordetella pertussis
gggcgcgcccggcg

SEQ ID NO: 391000 - RNA, 17 nt, Bordetella pertussis
gggcgcgccgcggcggg

SEQ ID NO: 391001 - RNA, 18 nt, Bordetella pertussis
gggcgcgccgcugcagcg

SEQ ID NO: 391002 - RNA, 20 nt, Bordetella pertussis
gggcgcgccgcugcagcgcu

SEQ ID NO: 391003 - RNA, 18 nt, Bordetella pertussis
gggcgcggaacagccugg

SEQ ID NO: 391004 - RNA, 20 nt, Bordetella pertussis
gggcgcggaucaugggcucg

SEQ ID NO: 391005 - RNA, 16 nt, Bordetella pertussis
gggcgcggcgcccgcc

SEQ ID NO: 391006 - RNA, 13 nt, Bordetella pertussis
gggcgcggcgccg

SEQ ID NO: 391007 - RNA, 12 nt, Bordetella pertussis
gggcgcggcgcg

SEQ ID NO: 391008 - RNA, 12 nt, Bordetella pertussis
gggcgcggcggc

SEQ ID NO: 391009 - RNA, 13 nt, Bordetella pertussis
gggcgcggcggcc

SEQ ID NO: 391010 - RNA, 16 nt, Bordetella pertussis
gggcgcggcggccugg

SEQ ID NO: 391011 - RNA, 14 nt, Bordetella pertussis
gggcgcggcggcgu

SEQ ID NO: 391012 - RNA, 12 nt, Bordetella pertussis
gggcgcggcggu

SEQ ID NO: 391013 - RNA, 15 nt, Bordetella pertussis
gggcgcggcgguggc

SEQ ID NO: 391014 - RNA, 23 nt, Bordetella pertussis
gggcgcggcgucgauguccuucu

SEQ ID NO: 391015 - RNA, 13 nt, Bordetella pertussis
gggcgcggcaggc

SEQ ID NO: 391016 - RNA, 13 nt, Bordetella pertussis
gggcgcggccagg

SEQ ID NO: 391017 - RNA, 20 nt, Bordetella pertussis
gggcgcggccagggucaggg

SEQ ID NO: 391018 - RNA, 14 nt, Bordetella pertussis
gggcgcggcccggc

SEQ ID NO: 391019 - RNA, 16 nt, Bordetella pertussis
gggcgcggccggugga

SEQ ID NO: 391020 - RNA, 16 nt, Bordetella pertussis
gggcgcguccaagcag

SEQ ID NO: 391021 - RNA, 14 nt, Bordetella pertussis
gggcgcgggcuguc

SEQ ID NO: 391022 - RNA, 14 nt, Bordetella pertussis
gggcgcugcccagg

SEQ ID NO: 391023 - RNA, 18 nt, Bordetella pertussis
gggcgcugcccaggaugg

SEQ ID NO: 391024 - RNA, 20 nt, Bordetella pertussis
gggcgcuggcgcgcggcugg

SEQ ID NO: 391025 - RNA, 16 nt, Bordetella pertussis
gggcggccaggccggu

SEQ ID NO: 391026 - RNA, 14 nt, Bordetella pertussis
gggcggccaggcgg

SEQ ID NO: 391027 - RNA, 12 nt, Bordetella pertussis
gggcggcccagc

SEQ ID NO: 391028 - RNA, 12 nt, Bordetella pertussis
gggcggcccggc

SEQ ID NO: 391029 - RNA, 13 nt, Bordetella pertussis
gggcggccgggag

SEQ ID NO: 391030 - RNA, 14 nt, Bordetella pertussis
gggcggccgggagc

SEQ ID NO: 391031 - RNA, 12 nt, Bordetella pertussis
gggcggccuggg

SEQ ID NO: 391032 - RNA, 18 nt, Bordetella pertussis
gggcggccuuggccgcag

SEQ ID NO: 391033 - RNA, 20 nt, Bordetella pertussis
gggcggccucggccagcugg

SEQ ID NO: 391034 - RNA, 23 nt, Bordetella pertussis
gggcggcgcagucgcgcacgaag

SEQ ID NO: 391035 - RNA, 12 nt, Bordetella pertussis
gggcggcgccgg

SEQ ID NO: 391036 - RNA, 21 nt, Bordetella pertussis
gggcggcggcguggcggcggg

SEQ ID NO: 391037 - RNA, 20 nt, Bordetella pertussis
gggcggcgucgaucggcgcg

SEQ ID NO: 391038 - RNA, 17 nt, Bordetella pertussis
gggcggcugccaguggu

SEQ ID NO: 391039 - RNA, 12 nt, Bordetella pertussis
gggcggcugccg

SEQ ID NO: 391040 - RNA, 13 nt, Bordetella pertussis
gggcgggcgggcg

SEQ ID NO: 391041 - RNA, 14 nt, Bordetella pertussis
gggcguagcucagc

SEQ ID NO: 391042 - RNA, 18 nt, Bordetella pertussis
gggcguagcucagccugg

SEQ ID NO: 391043 - RNA, 20 nt, Bordetella pertussis
gggcgucaccggcgagccga

SEQ ID NO: 391044 - RNA, 16 nt, Bordetella pertussis
gggcgucccaggccac

SEQ ID NO: 391045 - RNA, 21 nt, Bordetella pertussis
gggcgucgaaggcggccggca

SEQ ID NO: 391046 - RNA, 13 nt, Bordetella pertussis
gggcgucgcggcg

SEQ ID NO: 391047 - RNA, 14 nt, Bordetella pertussis
gggcgucgucgccg

SEQ ID NO: 391048 - RNA, 16 nt, Bordetella pertussis
gggcgucugcucgccg

SEQ ID NO: 391049 - RNA, 23 nt, Bordetella pertussis
gggcgugaccagcugcaccaggc

SEQ ID NO: 391050 - RNA, 13 nt, Bordetella pertussis
gggcgugcccuug

SEQ ID NO: 391051 - RNA, 15 nt, Bordetella pertussis
gggcgugcgggacgg

SEQ ID NO: 391052 - RNA, 17 nt, Bordetella pertussis
gggcguggcgcgcgugc

SEQ ID NO: 391053 - RNA, 23 nt, Bordetella pertussis
gggcguggcgucguggggcgcgg

SEQ ID NO: 391054 - RNA, 22 nt, Bordetella pertussis
gggcguggugcugacggacugg

SEQ ID NO: 391055 - RNA, 14 nt, Bordetella pertussis
gggcucagcccgcc

SEQ ID NO: 391056 - RNA, 17 nt, Bordetella pertussis
gggcuccaggcugagcg

SEQ ID NO: 391057 - RNA, 20 nt, Bordetella pertussis
gggcuccaggcugagcguga

SEQ ID NO: 391058 - RNA, 18 nt, Bordetella pertussis
gggcuccguuccgaugcu

SEQ ID NO: 391059 - RNA, 21 nt, Bordetella pertussis
gggcuccucgcccgaccugcu

SEQ ID NO: 391060 - RNA, 20 nt, Bordetella pertussis
gggcucgcgcccgagcgcca

SEQ ID NO: 391061 - RNA, 17 nt, Bordetella pertussis
gggcucgcgcgagccca

SEQ ID NO: 391062 - RNA, 22 nt, Bordetella pertussis
gggcucgcgcgcgcgggcgcgc

SEQ ID NO: 391063 - RNA, 14 nt, Bordetella pertussis
gggcucggcgccgg

SEQ ID NO: 391064 - RNA, 18 nt, Bordetella pertussis
gggcucgucgacgcggcc

SEQ ID NO: 391065 - RNA, 14 nt, Bordetella pertussis
gggcucgugcagca

SEQ ID NO: 391066 - RNA, 16 nt, Bordetella pertussis
gggcucgugcagcagg

SEQ ID NO: 391067 - RNA, 21 nt, Bordetella pertussis
gggcugaugcaggccugcacg

SEQ ID NO: 391068 - RNA, 14 nt, Bordetella pertussis
gggcugauccgcac

SEQ ID NO: 391069 - RNA, 19 nt, Bordetella pertussis
gggcugccauuccagcucc

SEQ ID NO: 391070 - RNA, 17 nt, Bordetella pertussis
gggcugcgacaggcgca

SEQ ID NO: 391071 - RNA, 21 nt, Bordetella pertussis
gggcugcggauacgaaaccag

SEQ ID NO: 391072 - RNA, 14 nt, Bordetella pertussis
gggcugcuggacgg

SEQ ID NO: 391073 - RNA, 13 nt, Bordetella pertussis
gggcugcugggcc

SEQ ID NO: 391074 - RNA, 21 nt, Bordetella pertussis
gggcugcgugcgggacaggca

SEQ ID NO: 391075 - RNA, 15 nt, Bordetella pertussis
gggcuggccagcugg

SEQ ID NO: 391076 - RNA, 19 nt, Bordetella pertussis
gggcuggccgccugcugcg

SEQ ID NO: 391077 - RNA, 16 nt, Bordetella pertussis
gggcuggucgcgccgg

SEQ ID NO: 391078 - RNA, 22 nt, Bordetella pertussis
gggcuguauagaugcgcggggc

SEQ ID NO: 391079 - RNA, 18 nt, Bordetella pertussis
gggcugucgcagucgggg

SEQ ID NO: 391080 - RNA, 17 nt, Bordetella pertussis
gggcuguucgcgcagca

SEQ ID NO: 391081 - RNA, 23 nt, Bordetella pertussis
gggcuguucguagucgagccagg

SEQ ID NO: 391082 - RNA, 24 nt, Bordetella pertussis
gggcuugauggccagcgcgcgggc

SEQ ID NO: 391083 - RNA, 23 nt, Bordetella pertussis
gggcuugccguucaugccgacca

SEQ ID NO: 391084 - RNA, 15 nt, Bordetella pertussis
gggcuuuuugccuug

SEQ ID NO: 391085 - RNA, 20 nt, Bordetella pertussis
ggggaaaagccggcggccgg

SEQ ID NO: 391086 - RNA, 16 nt, Bordetella pertussis
gggcuuuuuugccuug

SEQ ID NO: 391087 - RNA, 15 nt, Bordetella pertussis
ggggaaacggccaag

SEQ ID NO: 391088 - RNA, 22 nt, Bordetella pertussis
ggggaaacggccaagcagcgcc

SEQ ID NO: 391089 - RNA, 20 nt, Bordetella pertussis
ggggaacaggcgcgccagcc

SEQ ID NO: 391090 - RNA, 13 nt, Bordetella pertussis
ggggaagccgccg

SEQ ID NO: 391091 - RNA, 19 nt, Bordetella pertussis
ggggacaggcacccugccc

SEQ ID NO: 391092 - RNA, 22 nt, Bordetella pertussis
ggggacaggcacgccgggguug

SEQ ID NO: 391093 - RNA, 12 nt, Bordetella pertussis
ggggacaggcgc

SEQ ID NO: 391094 - RNA, 22 nt, Bordetella pertussis
ggggacgccggcgggcaggcgg

SEQ ID NO: 391095 - RNA, 13 nt, Bordetella pertussis
ggggacgggcgca

SEQ ID NO: 391096 - RNA, 17 nt, Bordetella pertussis
ggggacuggcacccgca

SEQ ID NO: 391097 - RNA, 17 nt, Bordetella pertussis
ggggacuggcaccggca

SEQ ID NO: 391098 - RNA, 11 nt, Bordetella pertussis
ggggagccugc

SEQ ID NO: 391099 - RNA, 14 nt, Bordetella pertussis
ggggagcgcggccc

SEQ ID NO: 391100 - RNA, 12 nt, Bordetella pertussis
ggggaugacggg

SEQ ID NO: 391101 - RNA, 19 nt, Bordetella pertussis
ggggcaacgacgcaggcgc

SEQ ID NO: 391102 - RNA, 23 nt, Bordetella pertussis
ggggcaccuagcauaucggugcc

SEQ ID NO: 391103 - RNA, 22 nt, Bordetella pertussis
ggggcagccauccucgcccagc

SEQ ID NO: 391104 - RNA, 15 nt, Bordetella pertussis
ggggcaggaagccgg

SEQ ID NO: 391105 - RNA, 13 nt, Bordetella pertussis
ggggcaggcacug

SEQ ID NO: 391106 - RNA, 23 nt, Bordetella pertussis
ggggcaggcacuggcgcggcgcu

SEQ ID NO: 391107 - RNA, 17 nt, Bordetella pertussis
ggggcaggccuggucga

SEQ ID NO: 391108 - RNA, 22 nt, Bordetella pertussis
ggggcaggccuggucgagcggg

SEQ ID NO: 391109 - RNA, 12 nt, Bordetella pertussis
ggggcaggcgca

SEQ ID NO: 391110 - RNA, 19 nt, Bordetella pertussis
ggggcaggcgcagcggcgg

SEQ ID NO: 391111 - RNA, 21 nt, Bordetella pertussis
ggggcaggcuggaagucagcc

SEQ ID NO: 391112 - RNA, 22 nt, Bordetella pertussis
ggggccacauggucgcccagca

SEQ ID NO: 391113 - RNA, 13 nt, Bordetella pertussis
ggggccagccugg

SEQ ID NO: 391114 - RNA, 14 nt, Bordetella pertussis
ggggccagccuggc

SEQ ID NO: 391115 - RNA, 11 nt, Bordetella pertussis
ggggccaggcg

SEQ ID NO: 391116 - RNA, 21 nt, Bordetella pertussis
ggggcccgcgggcgcccggcc

SEQ ID NO: 391117 - RNA, 20 nt, Bordetella pertussis
ggggcccuugugcguuggcg

SEQ ID NO: 391118 - RNA, 22 nt, Bordetella pertussis
ggggcccuugugcugccaugcc

SEQ ID NO: 391119 - RNA, 14 nt, Bordetella pertussis
ggggccgagcgugc

SEQ ID NO: 391120 - RNA, 14 nt, Bordetella pertussis
ggggccgcccagca

SEQ ID NO: 391121 - RNA, 16 nt, Bordetella pertussis
ggggccgcccagcacc

SEQ ID NO: 391122 - RNA, 20 nt, Bordetella pertussis
ggggccgccucggcggccag

SEQ ID NO: 391123 - RNA, 18 nt, Bordetella pertussis
ggggccgccuggaccuga

SEQ ID NO: 391124 - RNA, 16 nt, Bordetella pertussis
ggggccgcgccguucu

SEQ ID NO: 391125 - RNA, 19 nt, Bordetella pertussis
ggggccgggccggcgggcg

SEQ ID NO: 391126 - RNA, 12 nt, Bordetella pertussis
ggggcgagcgca

SEQ ID NO: 391127 - RNA, 19 nt, Bordetella pertussis
ggggcgaugucgucauccc

SEQ ID NO: 391128 - RNA, 20 nt, Bordetella pertussis
ggggcgcaucaugaggcggc

SEQ ID NO: 391129 - RNA, 12 nt, Bordetella pertussis
ggggcgcccagc

SEQ ID NO: 391130 - RNA, 13 nt, Bordetella pertussis
ggggcgcccagcg

SEQ ID NO: 391131 - RNA, 22 nt, Bordetella pertussis
ggggcgccccaacgcggccagc

SEQ ID NO: 391132 - RNA, 12 nt, Bordetella pertussis
ggggcgcaccgg

SEQ ID NO: 391133 - RNA, 14 nt, Bordetella pertussis
ggggcgcaccggca

SEQ ID NO: 391134 - RNA, 13 nt, Bordetella pertussis
ggggcgcggccgg

SEQ ID NO: 391135 - RNA, 20 nt, Bordetella pertussis
ggggcggaugagcaggccgg

SEQ ID NO: 391136 - RNA, 22 nt, Bordetella pertussis
ggggcggaugagcaggccgggu

SEQ ID NO: 391137 - RNA, 17 nt, Bordetella pertussis
ggggcggcggcgcccgc

SEQ ID NO: 391138 - RNA, 14 nt, Bordetella pertussis
ggggcggcucggcc

SEQ ID NO: 391139 - RNA, 20 nt, Bordetella pertussis
ggggcggucaaugcggcggc

SEQ ID NO: 391140 - RNA, 19 nt, Bordetella pertussis
ggggcguucgacgggcagg

SEQ ID NO: 391141 - RNA, 17 nt, Bordetella pertussis
ggggcuccaggaacacc

SEQ ID NO: 391142 - RNA, 14 nt, Bordetella pertussis
ggggcucguggugg

SEQ ID NO: 391143 - RNA, 20 nt, Bordetella pertussis
ggggcucuucgacagcgcgc

SEQ ID NO: 391144 - RNA, 19 nt, Bordetella pertussis
ggggcugccgugaggcagc

SEQ ID NO: 391145 - RNA, 20 nt, Bordetella pertussis
ggggcuggccgccgcggccu

SEQ ID NO: 391146 - RNA, 12 nt, Bordetella pertussis
gggggacuggca

SEQ ID NO: 391147 - RNA, 11 nt, Bordetella pertussis
gggggacaggc

SEQ ID NO: 391148 - RNA, 19 nt, Bordetella pertussis
gggggcauggcgccgcgcg

SEQ ID NO: 391149 - RNA, 16 nt, Bordetella pertussis
gggggcaggccgcggu

SEQ ID NO: 391150 - RNA, 15 nt, Bordetella pertussis
gggggcgccccaacg

SEQ ID NO: 391151 - RNA, 23 nt, Bordetella pertussis
gggggcgccccaacgcggccagc

SEQ ID NO: 391152 - RNA, 14 nt, Bordetella pertussis
gggggcgcgguauu

SEQ ID NO: 391153 - RNA, 17 nt, Bordetella pertussis
gggggcgcggcggcggc

SEQ ID NO: 391154 - RNA, 15 nt, Bordetella pertussis
gggggcguugcggug

SEQ ID NO: 391155 - RNA, 20 nt, Bordetella pertussis
gggggucgaucauggccagc

SEQ ID NO: 391156 - RNA, 18 nt, Bordetella pertussis
ggggucagcgccggcacg

SEQ ID NO: 391157 - RNA, 22 nt, Bordetella pertussis
gggguccagcaaaugggccgca

SEQ ID NO: 391158 - RNA, 17 nt, Bordetella pertussis
ggggucggggcaggccu

SEQ ID NO: 391159 - RNA, 20 nt, Bordetella pertussis
ggggucugcaggugccuguc

SEQ ID NO: 391160 - RNA, 23 nt, Bordetella pertussis
ggggugccaucgauaugggcggc

SEQ ID NO: 391161 - RNA, 22 nt, Bordetella pertussis
ggggugccuguccccgcggagg

SEQ ID NO: 391162 - RNA, 21 nt, Bordetella pertussis
ggggugccuguccccgcuggg

SEQ ID NO: 391163 - RNA, 18 nt, Bordetella pertussis
gggguggaaaugccggcg

SEQ ID NO: 391164 - RNA, 22 nt, Bordetella pertussis
gggguuccugcccauggcaagc

SEQ ID NO: 391165 - RNA, 15 nt, Bordetella pertussis
gggguucgugggcga

SEQ ID NO: 391166 - RNA, 21 nt, Bordetella pertussis
gggguucuguccggcgcuggc

SEQ ID NO: 391167 - RNA, 16 nt, Bordetella pertussis
gggguugacguugucc

SEQ ID NO: 391168 - RNA, 13 nt, Bordetella pertussis
gggguuggccgcc

SEQ ID NO: 391169 - RNA, 14 nt, Bordetella pertussis
gggguuggccgcca

SEQ ID NO: 391170 - RNA, 22 nt, Bordetella pertussis
gggguugggaucgcgccaggcg

SEQ ID NO: 391171 - RNA, 19 nt, Bordetella pertussis
ggguagcggaugcggggga

SEQ ID NO: 391172 - RNA, 21 nt, Bordetella pertussis
ggguagcggaugcgggggaug

SEQ ID NO: 391173 - RNA, 17 nt, Bordetella pertussis
ggguaucgucgaccugg

SEQ ID NO: 391174 - RNA, 14 nt, Bordetella pertussis
gggucaaggcgcgg

SEQ ID NO: 391175 - RNA, 13 nt, Bordetella pertussis
gggucagcccgcc

SEQ ID NO: 391176 - RNA, 21 nt, Bordetella pertussis
gggucaggggcaggugcccca

SEQ ID NO: 391177 - RNA, 21 nt, Bordetella pertussis
gggucaggucgcugcccagca

SEQ ID NO: 391178 - RNA, 19 nt, Bordetella pertussis
gggucagguuagccagugc

SEQ ID NO: 391179 - RNA, 20 nt, Bordetella pertussis
gggucaucgagguggcgggc

SEQ ID NO: 391180 - RNA, 19 nt, Bordetella pertussis
ggguccagcaaaugggccg

SEQ ID NO: 391181 - RNA, 17 nt, Bordetella pertussis
ggguccagccccacgcc

SEQ ID NO: 391182 - RNA, 18 nt, Bordetella pertussis
gggucccaaccagggccg

SEQ ID NO: 391183 - RNA, 18 nt, Bordetella pertussis
gggucgaguugcgcgcca

SEQ ID NO: 391184 - RNA, 21 nt, Bordetella pertussis
gggucgaugucgugaucgcca

SEQ ID NO: 391185 - RNA, 16 nt, Bordetella pertussis
gggucgccgggcagcg

SEQ ID NO: 391186 - RNA, 18 nt, Bordetella pertussis
gggucggaugcgggugga

SEQ ID NO: 391187 - RNA, 16 nt, Bordetella pertussis
gggucggccugccacc

SEQ ID NO: 391188 - RNA, 12 nt, Bordetella pertussis
gggucgcugugc

SEQ ID NO: 391189 - RNA, 15 nt, Bordetella pertussis
gggucgggccgcgcg

SEQ ID NO: 391190 - RNA, 17 nt, Bordetella pertussis
gggucgggcgucugccc

SEQ ID NO: 391191 - RNA, 18 nt, Bordetella pertussis
gggucggggcaggccugg

SEQ ID NO: 391192 - RNA, 20 nt, Bordetella pertussis
gggucgucggcgcugcagcg

SEQ ID NO: 391193 - RNA, 15 nt, Bordetella pertussis
gggucugcaggccga

SEQ ID NO: 391194 - RNA, 12 nt, Bordetella pertussis
gggucugcccca

SEQ ID NO: 391195 - RNA, 22 nt, Bordetella pertussis
gggucugccccauggccugggu

SEQ ID NO: 391196 - RNA, 13 nt, Bordetella pertussis
gggucuggcggcc

SEQ ID NO: 391197 - RNA, 15 nt, Bordetella pertussis
gggucuggcggccgg

SEQ ID NO: 391198 - RNA, 15 nt, Bordetella pertussis
gggucuugccgcgca

SEQ ID NO: 391199 - RNA, 16 nt, Bordetella pertussis
gggugaccuggcgcgc

SEQ ID NO: 391200 - RNA, 15 nt, Bordetella pertussis
gggugacgcuggagc

SEQ ID NO: 391201 - RNA, 14 nt, Bordetella pertussis
gggugaggcgacgg

SEQ ID NO: 391202 - RNA, 22 nt, Bordetella pertussis
gggugccaguccccugcgggga

SEQ ID NO: 391203 - RNA, 23 nt, Bordetella pertussis
gggugccaucgauaugggcggcc

SEQ ID NO: 391204 - RNA, 21 nt, Bordetella pertussis
gggugcccaguucgcggccgg

SEQ ID NO: 391205 - RNA, 12 nt, Bordetella pertussis
gggugccccgcc

SEQ ID NO: 391206 - RNA, 23 nt, Bordetella pertussis
gggugcggcgccacugccaggcg

SEQ ID NO: 391207 - RNA, 15 nt, Bordetella pertussis
gggugcuguucaggc

SEQ ID NO: 391208 - RNA, 15 nt, Bordetella pertussis
ggguggagcgcggcg

SEQ ID NO: 391209 - RNA, 21 nt, Bordetella pertussis
ggguggcauugacgcccacgc

SEQ ID NO: 391210 - RNA, 13 nt, Bordetella pertussis
ggguggccggcgc

SEQ ID NO: 391211 - RNA, 20 nt, Bordetella pertussis
ggguggcgccggccaccgcc

SEQ ID NO: 391212 - RNA, 13 nt, Bordetella pertussis
ggguggcggggcg

SEQ ID NO: 391213 - RNA, 22 nt, Bordetella pertussis
ggguggucuuccaggcgcaggc

SEQ ID NO: 391214 - RNA, 18 nt, Bordetella pertussis
ggguguccuggucggcgc

SEQ ID NO: 391215 - RNA, 17 nt, Bordetella pertussis
gggugucgccggggcgc

SEQ ID NO: 391216 - RNA, 21 nt, Bordetella pertussis
gggugucggccagggcggcga

SEQ ID NO: 391217 - RNA, 22 nt, Bordetella pertussis
ggguucagucgucgccgaagca

SEQ ID NO: 391218 - RNA, 20 nt, Bordetella pertussis
ggguucgcuggggcugccgg

SEQ ID NO: 391219 - RNA, 14 nt, Bordetella pertussis
ggguucgcagggcg

SEQ ID NO: 391220 - RNA, 22 nt, Bordetella pertussis
ggguugccaagauggcccaggg

SEQ ID NO: 391221 - RNA, 15 nt, Bordetella pertussis
ggguugucgcccacc

SEQ ID NO: 391222 - RNA, 20 nt, Bordetella pertussis
ggguuguggccguggcggcc

SEQ ID NO: 391223 - RNA, 21 nt, Bordetella pertussis
ggguuuuuuuuugggaaggcc

SEQ ID NO: 391224 - RNA, 14 nt, Bordetella pertussis
gguaaagggcgcgg

SEQ ID NO: 391225 - RNA, 24 nt, Bordetella pertussis
gguacaacaucaaugacauggcca

SEQ ID NO: 391226 - RNA, 19 nt, Bordetella pertussis
gguacagccaggccagcag

SEQ ID NO: 391227 - RNA, 17 nt, Bordetella pertussis
gguacagccccagcgcc

SEQ ID NO: 391228 - RNA, 14 nt, Bordetella pertussis
gguacagcgcgccc

SEQ ID NO: 391229 - RNA, 14 nt, Bordetella pertussis
gguacaggcugccg

SEQ ID NO: 391230 - RNA, 23 nt, Bordetella pertussis
gguaccacaguucggccagcggc

SEQ ID NO: 391231 - RNA, 11 nt, Bordetella pertussis
gguacccgcgc

SEQ ID NO: 391232 - RNA, 15 nt, Bordetella pertussis
gguacgcccagcugg

SEQ ID NO: 391233 - RNA, 15 nt, Bordetella pertussis
gguacgccugcaccg

SEQ ID NO: 391234 - RNA, 16 nt, Bordetella pertussis
gguagcaggcgcgcuc

SEQ ID NO: 391235 - RNA, 13 nt, Bordetella pertussis
gguagcaggcgcg

SEQ ID NO: 391236 - RNA, 14 nt, Bordetella pertussis
gguagggcgcggcc

SEQ ID NO: 391237 - RNA, 12 nt, Bordetella pertussis
gguaggggaugc

SEQ ID NO: 391238 - RNA, 15 nt, Bordetella pertussis
gguagggcagcaggu

SEQ ID NO: 391239 - RNA, 15 nt, Bordetella pertussis
gguagucggccacca

SEQ ID NO: 391240 - RNA, 14 nt, Bordetella pertussis
gguagugcggcgcc

SEQ ID NO: 391241 - RNA, 11 nt, Bordetella pertussis
gguauccgcgc

SEQ ID NO: 391242 - RNA, 14 nt, Bordetella pertussis
gguaucgggcaaca

SEQ ID NO: 391243 - RNA, 17 nt, Bordetella pertussis
gguaucucagcgcgccg

SEQ ID NO: 391244 - RNA, 23 nt, Bordetella pertussis
gguaucuguccccgcggggacag

SEQ ID NO: 391245 - RNA, 16 nt, Bordetella pertussis
gguaugaccggcgcgg

SEQ ID NO: 391246 - RNA, 22 nt, Bordetella pertussis
gguaugcggcgcccaggcccag

SEQ ID NO: 391247 - RNA, 22 nt, Bordetella pertussis
gguauggcggcaacgugcaggc

SEQ ID NO: 391248 - RNA, 18 nt, Bordetella pertussis
gguauguauggcggucgc

SEQ ID NO: 391249 - RNA, 18 nt, Bordetella pertussis
gguauugacccccgccgu

SEQ ID NO: 391250 - RNA, 15 nt, Bordetella pertussis
gguauucguugccga

SEQ ID NO: 391251 - RNA, 15 nt, Bordetella pertussis
ggucaagcggcugcc

SEQ ID NO: 391252 - RNA, 14 nt, Bordetella pertussis
ggucaagggcggcc

SEQ ID NO: 391253 - RNA, 15 nt, Bordetella pertussis
ggucaagggcggcca

SEQ ID NO: 391254 - RNA, 16 nt, Bordetella pertussis
ggucaaguccggcgcc

SEQ ID NO: 391255 - RNA, 14 nt, Bordetella pertussis
ggucaaugcggcgg

SEQ ID NO: 391256 - RNA, 16 nt, Bordetella pertussis
ggucaaugcggcggcg

SEQ ID NO: 391257 - RNA, 17 nt, Bordetella pertussis
ggucacacugggcggcg

SEQ ID NO: 391258 - RNA, 19 nt, Bordetella pertussis
ggucaccgagcugagcacc

SEQ ID NO: 391259 - RNA, 17 nt, Bordetella pertussis
ggucaccgccccgaccc

SEQ ID NO: 391260 - RNA, 20 nt, Bordetella pertussis
ggucaccgcgcccagggugg

SEQ ID NO: 391261 - RNA, 20 nt, Bordetella pertussis
ggucacgccgaugaccaggg

SEQ ID NO: 391262 - RNA, 16 nt, Bordetella pertussis
ggucacguucagcgcc

SEQ ID NO: 391263 - RNA, 19 nt, Bordetella pertussis
ggucagcaaccccagcagc

SEQ ID NO: 391264 - RNA, 22 nt, Bordetella pertussis
ggucagcaccucggcgcccagc

SEQ ID NO: 391265 - RNA, 17 nt, Bordetella pertussis
ggucagcagggcgccga

SEQ ID NO: 391266 - RNA, 15 nt, Bordetella pertussis
ggucagcccaggcgg

SEQ ID NO: 391267 - RNA, 16 nt, Bordetella pertussis
ggucagcccggcggcc

SEQ ID NO: 391268 - RNA, 20 nt, Bordetella pertussis
ggucagcccggcggccaucu

SEQ ID NO: 391269 - RNA, 14 nt, Bordetella pertussis
ggucagccgugucg

SEQ ID NO: 391270 - RNA, 20 nt, Bordetella pertussis
ggucagccugauucccaggc

SEQ ID NO: 391271 - RNA, 17 nt, Bordetella pertussis
ggucagcgccagggugc

SEQ ID NO: 391272 - RNA, 12 nt, Bordetella pertussis
ggucagcgccga

SEQ ID NO: 391273 - RNA, 12 nt, Bordetella pertussis
ggucagcgccuu

SEQ ID NO: 391274 - RNA, 19 nt, Bordetella pertussis
ggucagcgccuugccgccg

SEQ ID NO: 391275 - RNA, 17 nt, Bordetella pertussis
ggucagcgugucgccga

SEQ ID NO: 391276 - RNA, 16 nt, Bordetella pertussis
ggucagcucgucgccg

SEQ ID NO: 391277 - RNA, 19 nt, Bordetella pertussis
ggucagcuugccgcccagg

SEQ ID NO: 391278 - RNA, 20 nt, Bordetella pertussis
ggucagcuugccgcccaggu

SEQ ID NO: 391279 - RNA, 17 nt, Bordetella pertussis
ggucaggcugcggcgga

SEQ ID NO: 391280 - RNA, 18 nt, Bordetella pertussis
ggucagggcgaagcgcgc

SEQ ID NO: 391281 - RNA, 22 nt, Bordetella pertussis
ggucagguugcgccggcucagc

SEQ ID NO: 391282 - RNA, 13 nt, Bordetella pertussis
ggucaucacgcgg

SEQ ID NO: 391283 - RNA, 22 nt, Bordetella pertussis
ggucaucgcgcuggcgguggcc

SEQ ID NO: 391284 - RNA, 12 nt, Bordetella pertussis
ggucaucgccau

SEQ ID NO: 391285 - RNA, 17 nt, Bordetella pertussis
ggucaucgccaugcugc

SEQ ID NO: 391286 - RNA, 20 nt, Bordetella pertussis
ggucaugacgggcggcggcg

SEQ ID NO: 391287 - RNA, 22 nt, Bordetella pertussis
ggucaugcccuccucggccagg

SEQ ID NO: 391288 - RNA, 16 nt, Bordetella pertussis
ggucauguccagcgcc

SEQ ID NO: 391289 - RNA, 21 nt, Bordetella pertussis
gguccacauccgcgcugcugc

SEQ ID NO: 391290 - RNA, 23 nt, Bordetella pertussis
gguccacgccggguugcggcgga

SEQ ID NO: 391291 - RNA, 21 nt, Bordetella pertussis
gguccacggcauggccagcuu

SEQ ID NO: 391292 - RNA, 14 nt, Bordetella pertussis
gguccagcaccagg

SEQ ID NO: 391293 - RNA, 16 nt, Bordetella pertussis
gguccagcaccagggc

SEQ ID NO: 391294 - RNA, 19 nt, Bordetella pertussis
gguccagcaccagggcgcg

SEQ ID NO: 391295 - RNA, 23 nt, Bordetella pertussis
gguccagcaccagggcgcgcagc

SEQ ID NO: 391296 - RNA, 23 nt, Bordetella pertussis
gguccagcaaaugggccgcagcg

SEQ ID NO: 391297 - RNA, 22 nt, Bordetella pertussis
gguccagcugcgcgcgagcggc

SEQ ID NO: 391298 - RNA, 23 nt, Bordetella pertussis
gguccaggcccgaaacgcgcagc

SEQ ID NO: 391299 - RNA, 14 nt, Bordetella pertussis
gguccaggccuggg

SEQ ID NO: 391300 - RNA, 19 nt, Bordetella pertussis
gguccaugaacgccgcgcc

SEQ ID NO: 391301 - RNA, 22 nt, Bordetella pertussis
gguccaugcgaaagcggccagc

SEQ ID NO: 391302 - RNA, 16 nt, Bordetella pertussis
gguccaugucggccga

SEQ ID NO: 391303 - RNA, 13 nt, Bordetella pertussis
ggucccgcgucug

SEQ ID NO: 391304 - RNA, 16 nt, Bordetella pertussis
ggucccuggcccuggc

SEQ ID NO: 391305 - RNA, 23 nt, Bordetella pertussis
gguccgccgcgaccaccagcacc

SEQ ID NO: 391306 - RNA, 15 nt, Bordetella pertussis
gguccgcucgaggcc

SEQ ID NO: 391307 - RNA, 20 nt, Bordetella pertussis
gguccgcucgaggccaggcu

SEQ ID NO: 391308 - RNA, 13 nt, Bordetella pertussis
gguccggggcggg

SEQ ID NO: 391309 - RNA, 12 nt, Bordetella pertussis
gguccugcacgc

SEQ ID NO: 391310 - RNA, 19 nt, Bordetella pertussis
gguccugguaucccucgcc

SEQ ID NO: 391311 - RNA, 21 nt, Bordetella pertussis
ggucgacccacuugagcagcg

SEQ ID NO: 391312 - RNA, 13 nt, Bordetella pertussis
ggucgaccagcag

SEQ ID NO: 391313 - RNA, 17 nt, Bordetella pertussis
ggucgaccagcagccgg

SEQ ID NO: 391314 - RNA, 15 nt, Bordetella pertussis
ggucgagaccagcag

SEQ ID NO: 391315 - RNA, 14 nt, Bordetella pertussis
ggucgagagccugg

SEQ ID NO: 391316 - RNA, 20 nt, Bordetella pertussis
ggucgagagccugggcgcgc

SEQ ID NO: 391317 - RNA, 13 nt, Bordetella pertussis
ggucgagcgccug

SEQ ID NO: 391318 - RNA, 22 nt, Bordetella pertussis
ggucgaguagaaguaggcggcc

SEQ ID NO: 391319 - RNA, 17 nt, Bordetella pertussis
ggucgaucagggcgcgg

SEQ ID NO: 391320 - RNA, 23 nt, Bordetella pertussis
ggucgaucgucuugaccagcagg

SEQ ID NO: 391321 - RNA, 21 nt, Bordetella pertussis
ggucgaugaagcccgagcggc

SEQ ID NO: 391322 - RNA, 16 nt, Bordetella pertussis
ggucgccagcaggccc

SEQ ID NO: 391323 - RNA, 18 nt, Bordetella pertussis
ggucgccaucggccggcc

SEQ ID NO: 391324 - RNA, 23 nt, Bordetella pertussis
ggucgccgcgggcaaagcccagc

SEQ ID NO: 391325 - RNA, 13 nt, Bordetella pertussis
ggucgccguucug

SEQ ID NO: 391326 - RNA, 19 nt, Bordetella pertussis
ggucgccuguaucagcgcc

SEQ ID NO: 391327 - RNA, 15 nt, Bordetella pertussis
ggucgcgcagcugcc

SEQ ID NO: 391328 - RNA, 15 nt, Bordetella pertussis
ggucgcgcuggguca

SEQ ID NO: 391329 - RNA, 15 nt, Bordetella pertussis
ggucgcggccgaggc

SEQ ID NO: 391330 - RNA, 16 nt, Bordetella pertussis
ggucgcgggccaggcc

SEQ ID NO: 391331 - RNA, 15 nt, Bordetella pertussis
ggucgcggugcgcca

SEQ ID NO: 391332 - RNA, 21 nt, Bordetella pertussis
ggucgcugcccagcauggggu

SEQ ID NO: 391333 - RNA, 20 nt, Bordetella pertussis
ggucggcacgucgggcagga

SEQ ID NO: 391334 - RNA, 17 nt, Bordetella pertussis
ggucggccgcuccgcca

SEQ ID NO: 391335 - RNA, 22 nt, Bordetella pertussis
ggucggccugccaccagcgcgc

SEQ ID NO: 391336 - RNA, 19 nt, Bordetella pertussis
ggucggcgaccgugcgcca

SEQ ID NO: 391337 - RNA, 20 nt, Bordetella pertussis
ggucggcgaugcgcggggcc

SEQ ID NO: 391338 - RNA, 19 nt, Bordetella pertussis
ggucggcgcaauccccgcu

SEQ ID NO: 391339 - RNA, 15 nt, Bordetella pertussis
ggucggcgccgaggc

SEQ ID NO: 391340 - RNA, 13 nt, Bordetella pertussis
ggucggcgcggcc

SEQ ID NO: 391341 - RNA, 18 nt, Bordetella pertussis
ggucggcggccagcgcgc

SEQ ID NO: 391342 - RNA, 23 nt, Bordetella pertussis
ggucggcuugauaugggcgagca

SEQ ID NO: 391343 - RNA, 17 nt, Bordetella pertussis
ggucgggcgugagcgcc

SEQ ID NO: 391344 - RNA, 21 nt, Bordetella pertussis
ggucggucugcgugcgcggcg

SEQ ID NO: 391345 - RNA, 15 nt, Bordetella pertussis
ggucggugccgccga

SEQ ID NO: 391346 - RNA, 15 nt, Bordetella pertussis
ggucguacagcgccu

SEQ ID NO: 391347 - RNA, 15 nt, Bordetella pertussis
ggucgucccagcgca

SEQ ID NO: 391348 - RNA, 18 nt, Bordetella pertussis
ggucguggccagcguauu

SEQ ID NO: 391349 - RNA, 18 nt, Bordetella pertussis
ggucguguagcugugaac

SEQ ID NO: 391350 - RNA, 21 nt, Bordetella pertussis
ggucguguagcugugaacugu

SEQ ID NO: 391351 - RNA, 22 nt, Bordetella pertussis
ggucucccccucggccugcgcg

SEQ ID NO: 391352 - RNA, 21 nt, Bordetella pertussis
ggucuccgguucggcgcggcg

SEQ ID NO: 391353 - RNA, 18 nt, Bordetella pertussis
ggucugccguuccagcug

SEQ ID NO: 391354 - RNA, 21 nt, Bordetella pertussis
ggucuggcccacgcgcacgac

SEQ ID NO: 391355 - RNA, 22 nt, Bordetella pertussis
ggucugggccagcaggcucagc

SEQ ID NO: 391356 - RNA, 16 nt, Bordetella pertussis
ggucuggucgcacgac

SEQ ID NO: 391357 - RNA, 22 nt, Bordetella pertussis
ggugaaauagccaugcggacgc

SEQ ID NO: 391358 - RNA, 21 nt, Bordetella pertussis
ggugaagcccucgucgcggcc

SEQ ID NO: 391359 - RNA, 20 nt, Bordetella pertussis
gucaagcagcgccggcuggg

SEQ ID NO: 391360 - RNA, 24 nt, Bordetella pertussis
gucaaugcggcggcgcuggccugc

SEQ ID NO: 391361 - RNA, 19 nt, Bordetella pertussis
gucacccgccgcaccagcc

SEQ ID NO: 391362 - RNA, 19 nt, Bordetella pertussis
gucacccggcgcaugcugg

SEQ ID NO: 391363 - RNA, 19 nt, Bordetella pertussis
gucacgcccaggcgcuggu

SEQ ID NO: 391364 - RNA, 19 nt, Bordetella pertussis
gucacgccgaugaccaggg

SEQ ID NO: 391365 - RNA, 16 nt, Bordetella pertussis
gucacggucuggccca

SEQ ID NO: 391366 - RNA, 23 nt, Bordetella pertussis
gucacguucgaccugccgcccga

SEQ ID NO: 391367 - RNA, 18 nt, Bordetella pertussis
gucagcaccucggcgccc

SEQ ID NO: 391368 - RNA, 20 nt, Bordetella pertussis
gucagcacuugccggccgcc

SEQ ID NO: 391369 - RNA, 21 nt, Bordetella pertussis
gucagcacuugccggccgccc

SEQ ID NO: 391370 - RNA, 10 nt, Bordetella pertussis
gucagcagca

SEQ ID NO: 391371 - RNA, 12 nt, Bordetella pertussis
gucagcagcagg

SEQ ID NO: 391372 - RNA, 14 nt, Bordetella pertussis
gucagcagcaugcc

SEQ ID NO: 391373 - RNA, 17 nt, Bordetella pertussis
gucagcagcgcggcgcc

SEQ ID NO: 391374 - RNA, 14 nt, Bordetella pertussis
gucagccuggggca

SEQ ID NO: 391375 - RNA, 20 nt, Bordetella pertussis
gucagcgaaucguaggcgcu

SEQ ID NO: 391376 - RNA, 21 nt, Bordetella pertussis
gucagcgaaucguaggcgcug

SEQ ID NO: 391377 - RNA, 18 nt, Bordetella pertussis
gucagcgacaucgugcug

SEQ ID NO: 391378 - RNA, 13 nt, Bordetella pertussis
gucagcgccgcga

SEQ ID NO: 391379 - RNA, 14 nt, Bordetella pertussis
gucagcgcggcgca

SEQ ID NO: 391380 - RNA, 20 nt, Bordetella pertussis
gucaggccgucgagccgggc

SEQ ID NO: 391381 - RNA, 13 nt, Bordetella pertussis
gucaggcggaugc

SEQ ID NO: 391382 - RNA, 14 nt, Bordetella pertussis
gucagggccgcagc

SEQ ID NO: 391383 - RNA, 16 nt, Bordetella pertussis
gucaggggcaggcgca

SEQ ID NO: 391384 - RNA, 17 nt, Bordetella pertussis
gucaggggcaggcgcac

SEQ ID NO: 391385 - RNA, 16 nt, Bordetella pertussis
gucagggcugcagauu

SEQ ID NO: 391386 - RNA, 22 nt, Bordetella pertussis
gucaggugcagcgagaccgugg

SEQ ID NO: 391387 - RNA, 16 nt, Bordetella pertussis
gucagguugcgccggc

SEQ ID NO: 391388 - RNA, 21 nt, Bordetella pertussis
gucaucaccaagggcgccggg

SEQ ID NO: 391389 - RNA, 20 nt, Bordetella pertussis
gucaucaccaggguggcggg

SEQ ID NO: 391390 - RNA, 15 nt, Bordetella pertussis
gucaucgauggccag

SEQ ID NO: 391391 - RNA, 16 nt, Bordetella pertussis
gucaucgccaggcgcg

SEQ ID NO: 391392 - RNA, 14 nt, Bordetella pertussis
gucaucgcgcuggc

SEQ ID NO: 391393 - RNA, 17 nt, Bordetella pertussis
gucauggccuggcccag

SEQ ID NO: 391394 - RNA, 18 nt, Bordetella pertussis
gucauggucgaccagcag

SEQ ID NO: 391395 - RNA, 20 nt, Bordetella pertussis
gucaugugcugcggcagcca

SEQ ID NO: 391396 - RNA, 14 nt, Bordetella pertussis
guccaaaacagaca

SEQ ID NO: 391397 - RNA, 18 nt, Bordetella pertussis
guccaaaacagacaggcc

SEQ ID NO: 391398 - RNA, 17 nt, Bordetella pertussis
guccaauucgagcaggc

SEQ ID NO: 391399 - RNA, 18 nt, Bordetella pertussis
guccaauucgagcaggcg

SEQ ID NO: 391400 - RNA, 22 nt, Bordetella pertussis
guccaauucgagcaggcgcagg

SEQ ID NO: 391401 - RNA, 16 nt, Bordetella pertussis
guccacauccgcgcug

SEQ ID NO: 391402 - RNA, 16 nt, Bordetella pertussis
guccaccacccaggcc

SEQ ID NO: 391403 - RNA, 14 nt, Bordetella pertussis
guccaccagccggc

SEQ ID NO: 391404 - RNA, 15 nt, Bordetella pertussis
guccaccagccggcc

SEQ ID NO: 391405 - RNA, 20 nt, Bordetella pertussis
guccaccagccggccgccga

SEQ ID NO: 391406 - RNA, 14 nt, Bordetella pertussis
guccaccaccuuca

SEQ ID NO: 391407 - RNA, 20 nt, Bordetella pertussis
guccaccgccgaugccgcca

SEQ ID NO: 391408 - RNA, 15 nt, Bordetella pertussis
guccagccccugccc

SEQ ID NO: 391409 - RNA, 16 nt, Bordetella pertussis
guccagccccugcccg

SEQ ID NO: 391410 - RNA, 12 nt, Bordetella pertussis
guccagccgagc

SEQ ID NO: 391411 - RNA, 16 nt, Bordetella pertussis
guccagccugcccggg

SEQ ID NO: 391412 - RNA, 20 nt, Bordetella pertussis
guccagccugcccgggcagc

SEQ ID NO: 391413 - RNA, 16 nt, Bordetella pertussis
guccagcgccaccagc

SEQ ID NO: 391414 - RNA, 17 nt, Bordetella pertussis
guccagcgccaccagca

SEQ ID NO: 391415 - RNA, 20 nt, Bordetella pertussis
guccagcgccaccagcagcg

SEQ ID NO: 391416 - RNA, 22 nt, Bordetella pertussis
guccagcgccaccagcagcgcc

SEQ ID NO: 391417 - RNA, 16 nt, Bordetella pertussis
guccagcgccagcagg

SEQ ID NO: 391418 - RNA, 14 nt, Bordetella pertussis
guccagcgccaggc

SEQ ID NO: 391419 - RNA, 20 nt, Bordetella pertussis
guccagcgccaggccgcgca

SEQ ID NO: 391420 - RNA, 15 nt, Bordetella pertussis
guccagcgcggcgcc

SEQ ID NO: 391421 - RNA, 20 nt, Bordetella pertussis
guccagcggcgcgacgcgcu

SEQ ID NO: 391422 - RNA, 12 nt, Bordetella pertussis
guccagcguggc

SEQ ID NO: 391423 - RNA, 17 nt, Bordetella pertussis
guccagcguggcgcagu

SEQ ID NO: 391424 - RNA, 21 nt, Bordetella pertussis
guccagcguggcgcagucgag

SEQ ID NO: 391425 - RNA, 11 nt, Bordetella pertussis
guccagcucca

SEQ ID NO: 391426 - RNA, 15 nt, Bordetella pertussis
guccagcuccagcgc

SEQ ID NO: 391427 - RNA, 20 nt, Bordetella pertussis
guccagcugcgcgcgagcgg

SEQ ID NO: 391428 - RNA, 19 nt, Bordetella pertussis
guccagcuuggacagcgcg

SEQ ID NO: 391429 - RNA, 15 nt, Bordetella pertussis
guccaggaagcagcc

SEQ ID NO: 391430 - RNA, 20 nt, Bordetella pertussis
guccaggaagcagcccagca

SEQ ID NO: 391431 - RNA, 21 nt, Bordetella pertussis
guccaggaagcagcccagcac

SEQ ID NO: 391432 - RNA, 15 nt, Bordetella pertussis
guccaggccggggcc

SEQ ID NO: 391433 - RNA, 20 nt, Bordetella pertussis
guccaugcugauccuggcau

SEQ ID NO: 391434 - RNA, 12 nt, Bordetella pertussis
gucccagccggc

SEQ ID NO: 391435 - RNA, 21 nt, Bordetella pertussis
gucccagcggggacaggcacc

SEQ ID NO: 391436 - RNA, 16 nt, Bordetella pertussis
gucccaggcgcucgcg

SEQ ID NO: 391437 - RNA, 18 nt, Bordetella pertussis
gucccagggggucagggc

SEQ ID NO: 391438 - RNA, 15 nt, Bordetella pertussis
gucccaggugccggu

SEQ ID NO: 391439 - RNA, 16 nt, Bordetella pertussis
gucccagucgccgcgc

SEQ ID NO: 391440 - RNA, 19 nt, Bordetella pertussis
guccccgucgggacaggcu

SEQ ID NO: 391441 - RNA, 20 nt, Bordetella pertussis
guccccgucgggacaggcuc

SEQ ID NO: 391442 - RNA, 21 nt, Bordetella pertussis
guccccguggggacaggcacc

SEQ ID NO: 391443 - RNA, 16 nt, Bordetella pertussis
guccccguucggggac

SEQ ID NO: 391444 - RNA, 23 nt, Bordetella pertussis
guccccguucggggacaggcacc

SEQ ID NO: 391445 - RNA, 19 nt, Bordetella pertussis
gucccgacggggacaggcu

SEQ ID NO: 391446 - RNA, 22 nt, Bordetella pertussis
gucccgcaguacccggugcagc

SEQ ID NO: 391447 - RNA, 19 nt, Bordetella pertussis
guccgcucgaggccaggcu

SEQ ID NO: 391448 - RNA, 22 nt, Bordetella pertussis
guccggaugcacguagcgcagc

SEQ ID NO: 391449 - RNA, 16 nt, Bordetella pertussis
guccggcacggcggca

SEQ ID NO: 391450 - RNA, 14 nt, Bordetella pertussis
guccggccgcgcaa

SEQ ID NO: 391451 - RNA, 14 nt, Bordetella pertussis
guccggcgcuggcu

SEQ ID NO: 391452 - RNA, 17 nt, Bordetella pertussis
guccuaaauugccgcga

SEQ ID NO: 391453 - RNA, 16 nt, Bordetella pertussis
guccuccccgcugacc

SEQ ID NO: 391454 - RNA, 13 nt, Bordetella pertussis
guccuccgagacg

SEQ ID NO: 391455 - RNA, 15 nt, Bordetella pertussis
guccugaggccaggc

SEQ ID NO: 391456 - RNA, 21 nt, Bordetella pertussis
guccugcaggaaggccgccgc

SEQ ID NO: 391457 - RNA, 13 nt, Bordetella pertussis
guccugcaggccc

SEQ ID NO: 391458 - RNA, 19 nt, Bordetella pertussis
guccugcagguccugguag

SEQ ID NO: 391459 - RNA, 20 nt, Bordetella pertussis
guccugcaucgccaugccgg

SEQ ID NO: 391460 - RNA, 21 nt, Bordetella pertussis
guccugcaucgccaugccggc

SEQ ID NO: 391461 - RNA, 21 nt, Bordetella pertussis
guccugccauugcgcggccug

SEQ ID NO: 391462 - RNA, 14 nt, Bordetella pertussis
guccugcucggugc

SEQ ID NO: 391463 - RNA, 18 nt, Bordetella pertussis
guccuggacagugcccug

SEQ ID NO: 391464 - RNA, 21 nt, Bordetella pertussis
gucgacagguagcggucgccg

SEQ ID NO: 391465 - RNA, 14 nt, Bordetella pertussis
gucgaccaccagca

SEQ ID NO: 391466 - RNA, 20 nt, Bordetella pertussis
gucgacccacuugagcagcg

SEQ ID NO: 391467 - RNA, 21 nt, Bordetella pertussis
gucgaccccgucgaccgcggc

SEQ ID NO: 391468 - RNA, 16 nt, Bordetella pertussis
gucgaccgacagcaca

SEQ ID NO: 391469 - RNA, 22 nt, Bordetella pertussis
gucgacgaucucgcggcuggug

SEQ ID NO: 391470 - RNA, 22 nt, Bordetella pertussis
gucgacgaucaggcccuggggc

SEQ ID NO: 391471 - RNA, 17 nt, Bordetella pertussis
gucgacgcagcagccgc

SEQ ID NO: 391472 - RNA, 12 nt, Bordetella pertussis
gucgagcaggcc

SEQ ID NO: 391473 - RNA, 13 nt, Bordetella pertussis
gucgagcaggccg

SEQ ID NO: 391474 - RNA, 19 nt, Bordetella pertussis
gucgagcaucccggcgcuc

SEQ ID NO: 391475 - RNA, 16 nt, Bordetella pertussis
gucgagccgguccgcc

SEQ ID NO: 391476 - RNA, 15 nt, Bordetella pertussis
gucgagcgccugcgc

SEQ ID NO: 391477 - RNA, 16 nt, Bordetella pertussis
gucgagcgcgacgcgc

SEQ ID NO: 391478 - RNA, 12 nt, Bordetella pertussis
gucgagcgggcg

SEQ ID NO: 391479 - RNA, 14 nt, Bordetella pertussis
gucgagcgggcgcc

SEQ ID NO: 391480 - RNA, 20 nt, Bordetella pertussis
gucgaguucggcgcgcccgc

SEQ ID NO: 391481 - RNA, 16 nt, Bordetella pertussis
gucgaguugcgcgcca

SEQ ID NO: 391482 - RNA, 19 nt, Bordetella pertussis
gucgauaucgccauccagg

SEQ ID NO: 391483 - RNA, 15 nt, Bordetella pertussis
gucgaucagggcgcg

SEQ ID NO: 391484 - RNA, 17 nt, Bordetella pertussis
gucgaucaucaggucca

SEQ ID NO: 391485 - RNA, 16 nt, Bordetella pertussis
gucgaucauggccagc

SEQ ID NO: 391486 - RNA, 17 nt, Bordetella pertussis
gucgaucauggccagcc

SEQ ID NO: 391487 - RNA, 18 nt, Bordetella pertussis
gucgauccggcagcagca

SEQ ID NO: 391488 - RNA, 22 nt, Bordetella pertussis
gucgcacaucaggucgaccugc

SEQ ID NO: 391489 - RNA, 21 nt, Bordetella pertussis
gucgcacuggguggccagcgc

SEQ ID NO: 391490 - RNA, 20 nt, Bordetella pertussis
gucgccgacccgggcgggcg

SEQ ID NO: 391491 - RNA, 16 nt, Bordetella pertussis
gucgccgccugcggcg

SEQ ID NO: 391492 - RNA, 17 nt, Bordetella pertussis
gucgccgcggucgcaga

SEQ ID NO: 391493 - RNA, 13 nt, Bordetella pertussis
gucgccgcuggcc

SEQ ID NO: 391494 - RNA, 15 nt, Bordetella pertussis
gucgccggccaggca

SEQ ID NO: 391495 - RNA, 23 nt, Bordetella pertussis
gucgccgggcagcgggccgcagc

SEQ ID NO: 391496 - RNA, 15 nt, Bordetella pertussis
gucgccucccauugc

SEQ ID NO: 391497 - RNA, 12 nt, Bordetella pertussis
gucgccuggucg

SEQ ID NO: 391498 - RNA, 22 nt, Bordetella pertussis
gucgccuguaucagcgccugca

SEQ ID NO: 391499 - RNA, 13 nt, Bordetella pertussis
gucgcgcuggggc

SEQ ID NO: 391500 - RNA, 12 nt, Bordetella pertussis
gucgcgcuucuu

SEQ ID NO: 391501 - RNA, 20 nt, Bordetella pertussis
gucgcgcuucuuguccuuga

SEQ ID NO: 391502 - RNA, 20 nt, Bordetella pertussis
gucgcggcccgccagggcgu

SEQ ID NO: 391503 - RNA, 15 nt, Bordetella pertussis
gucgcgggccaggcc

SEQ ID NO: 391504 - RNA, 18 nt, Bordetella pertussis
gucgcugcccagcauggg

SEQ ID NO: 391505 - RNA, 13 nt, Bordetella pertussis
gucgcugcggccg

SEQ ID NO: 391506 - RNA, 17 nt, Bordetella pertussis
gucgcugcuggcggcgc

SEQ ID NO: 391507 - RNA, 22 nt, Bordetella pertussis
gucgcuggcccacucggugcgc

SEQ ID NO: 391508 - RNA, 21 nt, Bordetella pertussis
gucggccaccacgauggcgca

SEQ ID NO: 391509 - RNA, 19 nt, Bordetella pertussis
gucggccaccaggccgucg

SEQ ID NO: 391510 - RNA, 18 nt, Bordetella pertussis
gucggccacgucgcccac

SEQ ID NO: 391511 - RNA, 13 nt, Bordetella pertussis
gucggccagcgcg

SEQ ID NO: 391512 - RNA, 15 nt, Bordetella pertussis
gucggccagcuugcc

SEQ ID NO: 391513 - RNA, 20 nt, Bordetella pertussis
gucggcuaccacguggucug

SEQ ID NO: 391514 - RNA, 13 nt, Bordetella pertussis
gucggcucagucc

SEQ ID NO: 391515 - RNA, 19 nt, Bordetella pertussis
gucggcucaguccaagguc

SEQ ID NO: 391516 - RNA, 18 nt, Bordetella pertussis
gucggcugaugcccuucg

SEQ ID NO: 391517 - RNA, 19 nt, Bordetella pertussis
gucggcuuuuuugcguucg

SEQ ID NO: 391518 - RNA, 13 nt, Bordetella pertussis
gucgggacggcgc

SEQ ID NO: 391519 - RNA, 14 nt, Bordetella pertussis
gucgggacggcgcg

SEQ ID NO: 391520 - RNA, 15 nt, Bordetella pertussis
gucgggaugccccgc

SEQ ID NO: 391521 - RNA, 14 nt, Bordetella pertussis
gucgggcaagcggc

SEQ ID NO: 391522 - RNA, 23 nt, Bordetella pertussis
gucgggcacgaucaccgccgcgg

SEQ ID NO: 391523 - RNA, 22 nt, Bordetella pertussis
gucgggcagcgcccgcgccauc

SEQ ID NO: 391524 - RNA, 17 nt, Bordetella pertussis
gucgggcagggugggca

SEQ ID NO: 391525 - RNA, 17 nt, Bordetella pertussis
gucgggccgcgcgcggg

SEQ ID NO: 391526 - RNA, 14 nt, Bordetella pertussis
gucgggcgccgcaa

SEQ ID NO: 391527 - RNA, 13 nt, Bordetella pertussis
gucgggggcggcc

SEQ ID NO: 391528 - RNA, 14 nt, Bordetella pertussis
gucggugccgccga

SEQ ID NO: 391529 - RNA, 15 nt, Bordetella pertussis
gucgguugcaguccu

SEQ ID NO: 391530 - RNA, 19 nt, Bordetella pertussis
gucgugcccucgggaaaca

SEQ ID NO: 391531 - RNA, 15 nt, Bordetella pertussis
gucguggcugaccag

SEQ ID NO: 391532 - RNA, 20 nt, Bordetella pertussis
gucguggucgucccgcagua

SEQ ID NO: 391533 - RNA, 18 nt, Bordetella pertussis
gucguucugggagcgcgg

SEQ ID NO: 391534 - RNA, 19 nt, Bordetella pertussis
gucguugauggggccgcgc

SEQ ID NO: 391535 - RNA, 16 nt, Bordetella pertussis
gucuccacgccgccga

SEQ ID NO: 391536 - RNA, 15 nt, Bordetella pertussis
gucuccagcgccggc

SEQ ID NO: 391537 - RNA, 18 nt, Bordetella pertussis
gucuccagcgcggcggac

SEQ ID NO: 391538 - RNA, 21 nt, Bordetella pertussis
gucuccagcgcggcggacugc

SEQ ID NO: 391539 - RNA, 18 nt, Bordetella pertussis
gucuccagcgcgucggcc

SEQ ID NO: 391540 - RNA, 22 nt, Bordetella pertussis
gucuccagcgcgucggccaggc

SEQ ID NO: 391541 - RNA, 18 nt, Bordetella pertussis
gucucccccucggccugc

SEQ ID NO: 391542 - RNA, 17 nt, Bordetella pertussis
gucucggcuucuccucu

SEQ ID NO: 391543 - RNA, 14 nt, Bordetella pertussis
gucucgggcugggu

SEQ ID NO: 391544 - RNA, 18 nt, Bordetella pertussis
gucucguccacccccguc

SEQ ID NO: 391545 - RNA, 14 nt, Bordetella pertussis
gucugcaggcucug

SEQ ID NO: 391546 - RNA, 12 nt, Bordetella pertussis
gucugcaggugc

SEQ ID NO: 391547 - RNA, 20 nt, Bordetella pertussis
gucugcccgcgguccagcac

SEQ ID NO: 391548 - RNA, 15 nt, Bordetella pertussis
gucugcccgugcggg

SEQ ID NO: 391549 - RNA, 16 nt, Bordetella pertussis
gucugcccgugcgugc

SEQ ID NO: 391550 - RNA, 23 nt, Bordetella pertussis
gucugcgcgaugagcuggcgcag

SEQ ID NO: 391551 - RNA, 19 nt, Bordetella pertussis
gucugcgugugccgccagc

SEQ ID NO: 391552 - RNA, 22 nt, Bordetella pertussis
gucugcuggucgcgggccaggc

SEQ ID NO: 391553 - RNA, 23 nt, Bordetella pertussis
gucuggagauggguacagcgcgc

SEQ ID NO: 391554 - RNA, 15 nt, Bordetella pertussis
gucuggagcggccug

SEQ ID NO: 391555 - RNA, 16 nt, Bordetella pertussis
gucuggaggacgagcg

SEQ ID NO: 391556 - RNA, 20 nt, Bordetella pertussis
gucuggaggacgagcgggug

SEQ ID NO: 391557 - RNA, 13 nt, Bordetella pertussis
gucugggccaugc

SEQ ID NO: 391558 - RNA, 18 nt, Bordetella pertussis
gucugggccgaguuggca

SEQ ID NO: 391559 - RNA, 21 nt, Bordetella pertussis
gucugggcgugaaaggccagc

SEQ ID NO: 391560 - RNA, 11 nt, Bordetella pertussis
gucuguaucgu

SEQ ID NO: 391561 - RNA, 21 nt, Bordetella pertussis
gucugugcgccccgcuggccg

SEQ ID NO: 391562 - RNA, 11 nt, Bordetella pertussis
gucuuccaggc

SEQ ID NO: 391563 - RNA, 23 nt, Bordetella pertussis
gucuucggcgcggcgggcucagc

SEQ ID NO: 391564 - RNA, 13 nt, Bordetella pertussis
gucuugccgcgca

SEQ ID NO: 391565 - RNA, 19 nt, Bordetella pertussis
gucuugcugccguccuugu

SEQ ID NO: 391566 - RNA, 22 nt, Bordetella pertussis
gucuuggcgugcaggcuggacc

SEQ ID NO: 391567 - RNA, 20 nt, Bordetella pertussis
gucuuugaagggcggcgcgg

SEQ ID NO: 391568 - RNA, 14 nt, Bordetella pertussis
gugaaacagcagcg

SEQ ID NO: 391569 - RNA, 14 nt, Bordetella pertussis
gugaaacagcauca

SEQ ID NO: 391570 - RNA, 15 nt, Bordetella pertussis
gugaaaggccagcgg

SEQ ID NO: 391571 - RNA, 17 nt, Bordetella pertussis
aaauagccgaccgcgcg

SEQ ID NO: 391572 - RNA, 13 nt, Bordetella pertussis
gugaacgccccgg

SEQ ID NO: 391573 - RNA, 21 nt, Bordetella pertussis
gugaacggccccgccagggcg

SEQ ID NO: 391574 - RNA, 15 nt, Bordetella pertussis
gugaccacggcgcgc

SEQ ID NO: 391575 - RNA, 19 nt, Bordetella pertussis
gugacccggggcaggaagc

SEQ ID NO: 391576 - RNA, 18 nt, Bordetella pertussis
gugaccgacaggccuggc

SEQ ID NO: 391577 - RNA, 19 nt, Bordetella pertussis
gugaccgacaggccuggcu

SEQ ID NO: 391578 - RNA, 21 nt, Bordetella pertussis
gugaccgacaggccuggcuug

SEQ ID NO: 391579 - RNA, 14 nt, Bordetella pertussis
gugaccgccagcag

SEQ ID NO: 391580 - RNA, 17 nt, Bordetella pertussis
gugaccgccagcaggcg

SEQ ID NO: 391581 - RNA, 18 nt, Bordetella pertussis
gugaccggcgugacgcgc

SEQ ID NO: 391582 - RNA, 13 nt, Bordetella pertussis
gugaccugcucgu

SEQ ID NO: 391583 - RNA, 19 nt, Bordetella pertussis
gugacgcgcggguccaggc

SEQ ID NO: 391584 - RNA, 21 nt, Bordetella pertussis
gugacgcugauggccgccagc

SEQ ID NO: 391585 - RNA, 14 nt, Bordetella pertussis
gugacgggcugggc

SEQ ID NO: 391586 - RNA, 21 nt, Bordetella pertussis
gugacgggcugggccgaggcg

SEQ ID NO: 391587 - RNA, 18 nt, Bordetella pertussis
gugacguugagcgccggg

SEQ ID NO: 391588 - RNA, 19 nt, Bordetella pertussis
gugacguugagcgccgggg

SEQ ID NO: 391589 - RNA, 17 nt, Bordetella pertussis
gugaggcccagccgcuc

SEQ ID NO: 391590 - RNA, 16 nt, Bordetella pertussis
gugaucaucgugccgg

SEQ ID NO: 391591 - RNA, 16 nt, Bordetella pertussis
gugaucaugccgcuga

SEQ ID NO: 391592 - RNA, 15 nt, Bordetella pertussis
gugaucgaccgccag

SEQ ID NO: 391593 - RNA, 17 nt, Bordetella pertussis
gugaucgaccgccagca

SEQ ID NO: 391594 - RNA, 18 nt, Bordetella pertussis
gugaucgaccgccagcag

SEQ ID NO: 391595 - RNA, 19 nt, Bordetella pertussis
gugaucgaguaggccggca

SEQ ID NO: 391596 - RNA, 18 nt, Bordetella pertussis
gugaucgccagcgccggg

SEQ ID NO: 391597 - RNA, 20 nt, Bordetella pertussis
gugaucgccagcgccggggu

SEQ ID NO: 391598 - RNA, 16 nt, Bordetella pertussis
gugaucuugccgaugc

SEQ ID NO: 391599 - RNA, 14 nt, Bordetella pertussis
gugcacgcccgcgg

SEQ ID NO: 391600 - RNA, 22 nt, Bordetella pertussis
gugcacgcccgcggcgcccagc

SEQ ID NO: 391601 - RNA, 16 nt, Bordetella pertussis
gugcagacggcggcug

SEQ ID NO: 391602 - RNA, 13 nt, Bordetella pertussis
gugcagcgcgugg

SEQ ID NO: 391603 - RNA, 18 nt, Bordetella pertussis
gugcaggacgaacaggcc

SEQ ID NO: 391604 - RNA, 19 nt, Bordetella pertussis
gugcaggcccgggcgccug

SEQ ID NO: 391605 - RNA, 14 nt, Bordetella pertussis
gugcaggccgagga

SEQ ID NO: 391606 - RNA, 14 nt, Bordetella pertussis
gugcagggccaggu

SEQ ID NO: 391607 - RNA, 15 nt, Bordetella pertussis
gugcuggcccgccag

SEQ ID NO: 391608 - RNA, 17 nt, Bordetella pertussis
gugcuggcccgccagca

SEQ ID NO: 391609 - RNA, 23 nt, Bordetella pertussis
gugcuggccgacgcgcugguccg

SEQ ID NO: 391610 - RNA, 14 nt, Bordetella pertussis
gugcuggcgcagca

SEQ ID NO: 391611 - RNA, 21 nt, Bordetella pertussis
gugcuggcugagcaggccgau

SEQ ID NO: 391612 - RNA, 15 nt, Bordetella pertussis
gugcugggcggccag

SEQ ID NO: 391613 - RNA, 18 nt, Bordetella pertussis
gugcugggcggccaggcg

SEQ ID NO: 391614 - RNA, 14 nt, Bordetella pertussis
gugcugggccaugc

SEQ ID NO: 391615 - RNA, 13 nt, Bordetella pertussis
gugcuggugcugg

SEQ ID NO: 391616 - RNA, 14 nt, Bordetella pertussis
gugcuggugcuggu

SEQ ID NO: 391617 - RNA, 18 nt, Bordetella pertussis
gugcuggugcuggugcug

SEQ ID NO: 391618 - RNA, 18 nt, Bordetella pertussis
gugcuggucauugaccug

SEQ ID NO: 391619 - RNA, 23 nt, Bordetella pertussis
gugcuguaccucagccugcuggu

SEQ ID NO: 391620 - RNA, 22 nt, Bordetella pertussis
gugcuguucggcgaccgccggc

SEQ ID NO: 391621 - RNA, 22 nt, Bordetella pertussis
guggaaaucgugcuagaauccu

SEQ ID NO: 391622 - RNA, 14 nt, Bordetella pertussis
guggagcugcucac

SEQ ID NO: 391623 - RNA, 14 nt, Bordetella pertussis
guggaggacgccga

SEQ ID NO: 391624 - RNA, 13 nt, Bordetella pertussis
guggaggcggcgg

SEQ ID NO: 391625 - RNA, 20 nt, Bordetella pertussis
guggauccgccggugucggg

SEQ ID NO: 391626 - RNA, 15 nt, Bordetella pertussis
guggaugauggucug

SEQ ID NO: 391627 - RNA, 13 nt, Bordetella pertussis
guggcacaucagc

SEQ ID NO: 391628 - RNA, 16 nt, Bordetella pertussis
guggcaggccagcgcc

SEQ ID NO: 391629 - RNA, 17 nt, Bordetella pertussis
guggcaggcgcccaacc

SEQ ID NO: 391630 - RNA, 18 nt, Bordetella pertussis
guggcaggugcggccgca

SEQ ID NO: 391631 - RNA, 21 nt, Bordetella pertussis
guggcauagaaguagcugcgg

SEQ ID NO: 391632 - RNA, 22 nt, Bordetella pertussis
guggcauagaaguagcugcggu

SEQ ID NO: 391633 - RNA, 14 nt, Bordetella pertussis
guggccaagggcgc

SEQ ID NO: 391634 - RNA, 19 nt, Bordetella pertussis
guggccagcacggcgcaca

SEQ ID NO: 391635 - RNA, 15 nt, Bordetella pertussis
guggccagccaggcg

SEQ ID NO: 391636 - RNA, 13 nt, Bordetella pertussis
guggccagcccgg

SEQ ID NO: 391637 - RNA, 17 nt, Bordetella pertussis
guggccaugcaccagca

SEQ ID NO: 391638 - RNA, 19 nt, Bordetella pertussis
guggccaugcaccagcaca

SEQ ID NO: 391639 - RNA, 20 nt, Bordetella pertussis
guggccauggacagcaccga

SEQ ID NO: 391640 - RNA, 21 nt, Bordetella pertussis
guggcccaagcccguggcggg

SEQ ID NO: 391641 - RNA, 20 nt, Bordetella pertussis
guggcccagccgcaugccgg

SEQ ID NO: 391642 - RNA, 14 nt, Bordetella pertussis
guggcccgcaccgg

SEQ ID NO: 391643 - RNA, 23 nt, Bordetella pertussis
guggcccgcaccgggcggcccgg

SEQ ID NO: 391644 - RNA, 13 nt, Bordetella pertussis
guggcccgccauu

SEQ ID NO: 391645 - RNA, 21 nt, Bordetella pertussis
guggccugcccgucgggcagg

SEQ ID NO: 391646 - RNA, 19 nt, Bordetella pertussis
guggcgacgcccagccugc

SEQ ID NO: 391647 - RNA, 18 nt, Bordetella pertussis
guggcgacgcgcugccgg

SEQ ID NO: 391648 - RNA, 18 nt, Bordetella pertussis
guggcgacgucgggcagg

SEQ ID NO: 391649 - RNA, 17 nt, Bordetella pertussis
guggcgauagcgcucca

SEQ ID NO: 391650 - RNA, 19 nt, Bordetella pertussis
guggcgauuccuuccauga

SEQ ID NO: 391651 - RNA, 21 nt, Bordetella pertussis
guggcgcacccugcaggccgg

SEQ ID NO: 391652 - RNA, 18 nt, Bordetella pertussis
guggcgcaccgcgcuggg

SEQ ID NO: 391653 - RNA, 14 nt, Bordetella pertussis
guggcgcagauggg

SEQ ID NO: 391654 - RNA, 18 nt, Bordetella pertussis
guggcgcagaugggcggc

SEQ ID NO: 391655 - RNA, 14 nt, Bordetella pertussis
guggcgcagcuccg

SEQ ID NO: 391656 - RNA, 21 nt, Bordetella pertussis
guggcgguagacgccgggacg

SEQ ID NO: 391657 - RNA, 21 nt, Bordetella pertussis
guggcgguuggugucgcgcag

SEQ ID NO: 391658 - RNA, 20 nt, Bordetella pertussis
guggcguaauagcuggcggc

SEQ ID NO: 391659 - RNA, 23 nt, Bordetella pertussis
guggcgucgggggcggccggggc

SEQ ID NO: 391660 - RNA, 15 nt, Bordetella pertussis
guggcgucguggggc

SEQ ID NO: 391661 - RNA, 15 nt, Bordetella pertussis
guggcgugcagcagg

SEQ ID NO: 391662 - RNA, 15 nt, Bordetella pertussis
guggcguucgcggug

SEQ ID NO: 391663 - RNA, 12 nt, Bordetella pertussis
gugggacaggca

SEQ ID NO: 391664 - RNA, 15 nt, Bordetella pertussis
gugggacaggcacuc

SEQ ID NO: 391665 - RNA, 14 nt, Bordetella pertussis
gugggcacgcgcgc

SEQ ID NO: 391666 - RNA, 15 nt, Bordetella pertussis
gugggcagcagcacg

SEQ ID NO: 391667 - RNA, 12 nt, Bordetella pertussis
gugggccagcaa

SEQ ID NO: 391668 - RNA, 20 nt, Bordetella pertussis
gugggccagcaacuggugcc

SEQ ID NO: 391669 - RNA, 23 nt, Bordetella pertussis
gugggcauagcguuuuguacucu

SEQ ID NO: 391670 - RNA, 20 nt, Bordetella pertussis
gugggccaguucgcggcgca

SEQ ID NO: 391671 - RNA, 12 nt, Bordetella pertussis
guggggacaggc

SEQ ID NO: 391672 - RNA, 13 nt, Bordetella pertussis
guggggcaggucg

SEQ ID NO: 391673 - RNA, 20 nt, Bordetella pertussis
guggggccggccgcgcgcgc

SEQ ID NO: 391674 - RNA, 13 nt, Bordetella pertussis
guggggccgggcu

SEQ ID NO: 391675 - RNA, 13 nt, Bordetella pertussis
gugggggacaggc

SEQ ID NO: 391676 - RNA, 20 nt, Bordetella pertussis
gugggggauuuuugggcagg

SEQ ID NO: 391677 - RNA, 22 nt, Bordetella pertussis
guggggugauggcgaaacuggc

SEQ ID NO: 391678 - RNA, 12 nt, Bordetella pertussis
gugggucucggc

SEQ ID NO: 391679 - RNA, 13 nt, Bordetella pertussis
guggguggacagg

SEQ ID NO: 391680 - RNA, 16 nt, Bordetella pertussis
gugguggggccgggcu

SEQ ID NO: 391681 - RNA, 23 nt, Bordetella pertussis
gugguggucacguucgaccugcc

SEQ ID NO: 391682 - RNA, 15 nt, Bordetella pertussis
gugguggugacguug

SEQ ID NO: 391683 - RNA, 16 nt, Bordetella pertussis
guggugugcgaggacg

SEQ ID NO: 391684 - RNA, 12 nt, Bordetella pertussis
guguacagccgc

SEQ ID NO: 391685 - RNA, 21 nt, Bordetella pertussis
guguacagccgccuggcgcgg

SEQ ID NO: 391686 - RNA, 16 nt, Bordetella pertussis
guguagaccaccagca

SEQ ID NO: 391687 - RNA, 14 nt, Bordetella pertussis
guguccagcggcgc

SEQ ID NO: 391688 - RNA, 13 nt, Bordetella pertussis
gugucggcggcga

SEQ ID NO: 391689 - RNA, 23 nt, Bordetella pertussis
gugugcaggacgaacaggccgcc

SEQ ID NO: 391690 - RNA, 22 nt, Bordetella pertussis
gugugccagcccccugcggggu

SEQ ID NO: 391691 - RNA, 22 nt, Bordetella pertussis
gugugccuguccccgcugggac

SEQ ID NO: 391692 - RNA, 18 nt, Bordetella pertussis
guguggccaugcaccagc

SEQ ID NO: 391693 - RNA, 19 nt, Bordetella pertussis
guguucgauggcggccagg

SEQ ID NO: 391694 - RNA, 16 nt, Bordetella pertussis
guguucgcgcaccagc

SEQ ID NO: 391695 - RNA, 23 nt, Bordetella pertussis
guguugagauuggccgagcgcgg

SEQ ID NO: 391696 - RNA, 14 nt, Bordetella pertussis
guguugauccgcca

SEQ ID NO: 391697 - RNA, 18 nt, Bordetella pertussis
guuacucuguucuaccug

SEQ ID NO: 391698 - RNA, 18 nt, Bordetella pertussis
guucacgcccgagauggc

SEQ ID NO: 391699 - RNA, 20 nt, Bordetella pertussis
guucacgccggcgcgccggg

SEQ ID NO: 391700 - RNA, 18 nt, Bordetella pertussis
guucacguagaaauacgc

SEQ ID NO: 391701 - RNA, 19 nt, Bordetella pertussis
guucagcgucucgggcugg

SEQ ID NO: 391702 - RNA, 17 nt, Bordetella pertussis
guucagcuucagccugg

SEQ ID NO: 391703 - RNA, 17 nt, Bordetella pertussis
guucaggcgcggcugga

SEQ ID NO: 391704 - RNA, 20 nt, Bordetella pertussis
guucaggcgcggcuggauga

SEQ ID NO: 391705 - RNA, 21 nt, Bordetella pertussis
guucaugccgguguagcucag

SEQ ID NO: 391706 - RNA, 22 nt, Bordetella pertussis
guucaugcgucgaacggccggg

SEQ ID NO: 391707 - RNA, 11 nt, Bordetella pertussis
guuccaccugc

SEQ ID NO: 391708 - RNA, 20 nt, Bordetella pertussis
guuccaugacguccagcgcc

SEQ ID NO: 391709 - RNA, 22 nt, Bordetella pertussis
guuccaugacguccagcgccac

SEQ ID NO: 391710 - RNA, 20 nt, Bordetella pertussis
guuccugcaaggccggcggc

SEQ ID NO: 391711 - RNA, 14 nt, Bordetella pertussis
guuccugggcacgc

SEQ ID NO: 391712 - RNA, 13 nt, Bordetella pertussis
guucgcccaccac

SEQ ID NO: 391713 - RNA, 15 nt, Bordetella pertussis
guucgccgcaccagg

SEQ ID NO: 391714 - RNA, 15 nt, Bordetella pertussis
guucgccgugcaggg

SEQ ID NO: 391715 - RNA, 16 nt, Bordetella pertussis
guucgccgugcagggc

SEQ ID NO: 391716 - RNA, 13 nt, Bordetella pertussis
guucgcgcagcag

SEQ ID NO: 391717 - RNA, 17 nt, Bordetella pertussis
guucgcgcagcaggccg

SEQ ID NO: 391718 - RNA, 15 nt, Bordetella pertussis
guucgcgccugcccg

SEQ ID NO: 391719 - RNA, 18 nt, Bordetella pertussis
guucgggacgcaggaguc

SEQ ID NO: 391720 - RNA, 17 nt, Bordetella pertussis
guucgggcgcggugcgc

SEQ ID NO: 391721 - RNA, 16 nt, Bordetella pertussis
guucggggacaggcac

SEQ ID NO: 391722 - RNA, 17 nt, Bordetella pertussis
guucggggacaggcacc

SEQ ID NO: 391723 - RNA, 23 nt, Bordetella pertussis
guucucagccgcccgccgggccg

SEQ ID NO: 391724 - RNA, 22 nt, Bordetella pertussis
guucucgacccgcucggccacg

SEQ ID NO: 391725 - RNA, 13 nt, Bordetella pertussis
guugaggaugugc

SEQ ID NO: 391726 - RNA, 16 nt, Bordetella pertussis
guugcagccacaggcc

SEQ ID NO: 391727 - RNA, 17 nt, Bordetella pertussis
guugcagcgcgccaggc

SEQ ID NO: 391728 - RNA, 13 nt, Bordetella pertussis
guugcaggccagg

SEQ ID NO: 391729 - RNA, 21 nt, Bordetella pertussis
guugccgcugcaugggcggcc

SEQ ID NO: 391730 - RNA, 13 nt, Bordetella pertussis
guugccggccagg

SEQ ID NO: 391731 - RNA, 15 nt, Bordetella pertussis
guugccugggugcug

SEQ ID NO: 391732 - RNA, 16 nt, Bordetella pertussis
guugcgcaccaugugc

SEQ ID NO: 391733 - RNA, 15 nt, Bordetella pertussis
guugcgcuugcgcuu

SEQ ID NO: 391734 - RNA, 21 nt, Bordetella pertussis
guugcgcuugcgcuuggcagg

SEQ ID NO: 391735 - RNA, 20 nt, Bordetella pertussis
guugcgguagcgcaagcagg

SEQ ID NO: 391736 - RNA, 18 nt, Bordetella pertussis
guugcgguaguucagcag

SEQ ID NO: 391737 - RNA, 14 nt, Bordetella pertussis
guugcucggcggca

SEQ ID NO: 391738 - RNA, 12 nt, Bordetella pertussis
guugcuggccac

SEQ ID NO: 391739 - RNA, 14 nt, Bordetella pertussis
guugcuggcccagg

SEQ ID NO: 391740 - RNA, 14 nt, Bordetella pertussis
guugcuggcggccg

SEQ ID NO: 391741 - RNA, 15 nt, Bordetella pertussis
guuggccugaccgga

SEQ ID NO: 391742 - RNA, 19 nt, Bordetella pertussis
guuggccugccauccggcc

SEQ ID NO: 391743 - RNA, 23 nt, Bordetella pertussis
guuggcgaaugccugguaggcga

SEQ ID NO: 391744 - RNA, 14 nt, Bordetella pertussis
guuggcgaugcuca

SEQ ID NO: 391745 - RNA, 21 nt, Bordetella pertussis
guuggcgccggccgcgcgcgc

SEQ ID NO: 391746 - RNA, 16 nt, Bordetella pertussis
guuggcgcugcugcug

SEQ ID NO: 391747 - RNA, 19 nt, Bordetella pertussis
guuggcguccaggcgcgcc

SEQ ID NO: 391748 - RNA, 22 nt, Bordetella pertussis
guuggugacgauggugcgcagg

SEQ ID NO: 391749 - RNA, 20 nt, Bordetella pertussis
guuggugcccagcgagcggg

SEQ ID NO: 391750 - RNA, 20 nt, Bordetella pertussis
guuggugcgaaucacuucuu

SEQ ID NO: 391751 - RNA, 15 nt, Bordetella pertussis
guugucgaugugcug

SEQ ID NO: 391752 - RNA, 13 nt, Bordetella pertussis
guuuccagggcgc

SEQ ID NO: 391753 - RNA, 18 nt, Bordetella pertussis
aaauauugggcuggucgg

SEQ ID NO: 391754 - RNA, 18 nt, Bordetella pertussis
guuucccucggugcugcu

SEQ ID NO: 391755 - RNA, 12 nt, Bordetella pertussis
guuuccgccaug

SEQ ID NO: 391756 - RNA, 16 nt, Bordetella pertussis
aaaucaacgaucuagg

SEQ ID NO: 391757 - RNA, 18 nt, Bordetella pertussis
guuugaguacgacgccgu

SEQ ID NO: 391758 - RNA, 15 nt, Bordetella pertussis
uaaccggccaguccc

SEQ ID NO: 391759 - RNA, 23 nt, Bordetella pertussis
uaagacagauguccgugcuggcc

SEQ ID NO: 391760 - RNA, 22 nt, Bordetella pertussis
uaagcaggucugcacgaggcgc

SEQ ID NO: 391761 - RNA, 21 nt, Bordetella pertussis
uaagcccacucacgcaaggcc

SEQ ID NO: 391762 - RNA, 20 nt, Bordetella pertussis
uaaggcgcuugcgcagggcg

SEQ ID NO: 391763 - RNA, 19 nt, Bordetella pertussis
uaaggcuucucgaccaggc

SEQ ID NO: 391764 - RNA, 13 nt, Bordetella pertussis
uaagugggcugcg

SEQ ID NO: 391765 - RNA, 13 nt, Bordetella pertussis
uaagugcccaggc

SEQ ID NO: 391766 - RNA, 22 nt, Bordetella pertussis
uacaggugcugggucaucagca

SEQ ID NO: 391767 - RNA, 12 nt, Bordetella pertussis
uaccagcccagc

SEQ ID NO: 391768 - RNA, 19 nt, Bordetella pertussis
uaccagcgcacguugagau

SEQ ID NO: 391769 - RNA, 22 nt, Bordetella pertussis
uaccagcgcgaacgccugccag

SEQ ID NO: 391770 - RNA, 18 nt, Bordetella pertussis
uaccaguacaccggcgug

SEQ ID NO: 391771 - RNA, 14 nt, Bordetella pertussis
uacccaugcggggc

SEQ ID NO: 391772 - RNA, 20 nt, Bordetella pertussis
uaccccauaguccucuacug

SEQ ID NO: 391773 - RNA, 21 nt, Bordetella pertussis
uacccggcuucugggucagcu

SEQ ID NO: 391774 - RNA, 16 nt, Bordetella pertussis
uacccugaacucuuca

SEQ ID NO: 391775 - RNA, 19 nt, Bordetella pertussis
uacccugcccauucccgcc

SEQ ID NO: 391776 - RNA, 13 nt, Bordetella pertussis
uaccgccacaccg

SEQ ID NO: 391777 - RNA, 15 nt, Bordetella pertussis
uaccgcuggccaggc

SEQ ID NO: 391778 - RNA, 16 nt, Bordetella pertussis
uaccguccuggcaguc

SEQ ID NO: 391779 - RNA, 22 nt, Bordetella pertussis
uaccgucguccucggcacggcc

SEQ ID NO: 391780 - RNA, 16 nt, Bordetella pertussis
uaccgucuuggcaguc

SEQ ID NO: 391781 - RNA, 14 nt, Bordetella pertussis
uaccgucuuggccg

SEQ ID NO: 391782 - RNA, 16 nt, Bordetella pertussis
uacgacgagcgcacca

SEQ ID NO: 391783 - RNA, 12 nt, Bordetella pertussis
uacgcaccgccg

SEQ ID NO: 391784 - RNA, 14 nt, Bordetella pertussis
uacgccgccgaggc

SEQ ID NO: 391785 - RNA, 11 nt, Bordetella pertussis
uacgcggcgcg

SEQ ID NO: 391786 - RNA, 18 nt, Bordetella pertussis
uacgcgggcuugcugccc

SEQ ID NO: 391787 - RNA, 15 nt, Bordetella pertussis
uacgcgugcgcggcc

SEQ ID NO: 391788 - RNA, 12 nt, Bordetella pertussis
uacggcccuggu

SEQ ID NO: 391789 - RNA, 21 nt, Bordetella pertussis
uacggcggacuggccgcgccg

SEQ ID NO: 391790 - RNA, 18 nt, Bordetella pertussis
uacucgccggucgcggcg

SEQ ID NO: 391791 - RNA, 16 nt, Bordetella pertussis
uacucgggggcgggcc

SEQ ID NO: 391792 - RNA, 12 nt, Bordetella pertussis
uacugcugcaag

SEQ ID NO: 391793 - RNA, 15 nt, Bordetella pertussis
uacugcugcaaggac

SEQ ID NO: 391794 - RNA, 16 nt, Bordetella pertussis
uacuggaucuuggccu

SEQ ID NO: 391795 - RNA, 14 nt, Bordetella pertussis
uaguacagcagcag

SEQ ID NO: 391796 - RNA, 16 nt, Bordetella pertussis
uaguacagcagcagca

SEQ ID NO: 391797 - RNA, 16 nt, Bordetella pertussis
uaguccucuacuggcu

SEQ ID NO: 391798 - RNA, 21 nt, Bordetella pertussis
uaguccucuacuggcugauca

SEQ ID NO: 391799 - RNA, 22 nt, Bordetella pertussis
uagucgccggcuuccagcagca

SEQ ID NO: 391800 - RNA, 22 nt, Bordetella pertussis
uagucggaguagggcagcgaca

SEQ ID NO: 391801 - RNA, 19 nt, Bordetella pertussis
uagucgucgcuggcccacu

SEQ ID NO: 391802 - RNA, 14 nt, Bordetella pertussis
uaguucuauauagg

SEQ ID NO: 391803 - RNA, 17 nt, Bordetella pertussis
uaucaacuuccagcgcc

SEQ ID NO: 391804 - RNA, 18 nt, Bordetella pertussis
uaucagcgcgucacgcug

SEQ ID NO: 391805 - RNA, 23 nt, Bordetella pertussis
uaucccgcucggcuggagcucua

SEQ ID NO: 391806 - RNA, 21 nt, Bordetella pertussis
uauccuugaggaucaggaaga

SEQ ID NO: 391807 - RNA, 24 nt, Bordetella pertussis
uaucgacgcgcgucgugcccgcca

SEQ ID NO: 391808 - RNA, 19 nt, Bordetella pertussis
uaucgcggccgagcuccuc

SEQ ID NO: 391809 - RNA, 13 nt, Bordetella pertussis
uaucggccaggcg

SEQ ID NO: 391810 - RNA, 19 nt, Bordetella pertussis
uaugcaggcuuugcuggcc

SEQ ID NO: 391811 - RNA, 21 nt, Bordetella pertussis
uaugcaggcuuugcuggccau

SEQ ID NO: 391812 - RNA, 18 nt, Bordetella pertussis
uaugcgccaggcccuuga

SEQ ID NO: 391813 - RNA, 21 nt, Bordetella pertussis
uaugcggcgcccaggcccagc

SEQ ID NO: 391814 - RNA, 21 nt, Bordetella pertussis
uaugcgggcuugcugcccccc

SEQ ID NO: 391815 - RNA, 20 nt, Bordetella pertussis
uauggcccgccaccacggcg

SEQ ID NO: 391816 - RNA, 15 nt, Bordetella pertussis
uaugguuucaaaguc

SEQ ID NO: 391817 - RNA, 18 nt, Bordetella pertussis
uaugucggcuaccacgug

SEQ ID NO: 391818 - RNA, 22 nt, Bordetella pertussis
uaugugcaggccaccgacggcg

SEQ ID NO: 391819 - RNA, 22 nt, Bordetella pertussis
aaauccgggcgcugcgccggcg

SEQ ID NO: 391820 - RNA, 20 nt, Bordetella pertussis
uauuggcuguaucuggccug

SEQ ID NO: 391821 - RNA, 22 nt, Bordetella pertussis
ucaaccugaucguucccuaccc

SEQ ID NO: 391822 - RNA, 22 nt, Bordetella pertussis
ucaacgaagaacagccgcugca

SEQ ID NO: 391823 - RNA, 15 nt, Bordetella pertussis
ucaaugaagggcugc

SEQ ID NO: 391824 - RNA, 17 nt, Bordetella pertussis
ucaaugacauggccacg

SEQ ID NO: 391825 - RNA, 23 nt, Bordetella pertussis
ucacaggcccgcgcggccagcgc

SEQ ID NO: 391826 - RNA, 21 nt, Bordetella pertussis
ucacagggucaaggcgcggcc

SEQ ID NO: 391827 - RNA, 18 nt, Bordetella pertussis
ucacaucgcuaugcagcu

SEQ ID NO: 391828 - RNA, 16 nt, Bordetella pertussis
ucaccaccggcaaggc

SEQ ID NO: 391829 - RNA, 12 nt, Bordetella pertussis
ucaccacgcccg

SEQ ID NO: 391830 - RNA, 23 nt, Bordetella pertussis
ucaccacgggcacgauggccgcg

SEQ ID NO: 391831 - RNA, 18 nt, Bordetella pertussis
ucaccagcucgcggcccu

SEQ ID NO: 391832 - RNA, 17 nt, Bordetella pertussis
ucaccaggaagcgcgcc

SEQ ID NO: 391833 - RNA, 22 nt, Bordetella pertussis
ucaccaggguggcgggcgccug

SEQ ID NO: 391834 - RNA, 17 nt, Bordetella pertussis
ucaccauggccgacagc

SEQ ID NO: 391835 - RNA, 13 nt, Bordetella pertussis
ucacgcccaggaa

SEQ ID NO: 391836 - RNA, 17 nt, Bordetella pertussis
ucacgcccaggcgcugg

SEQ ID NO: 391837 - RNA, 16 nt, Bordetella pertussis
ucacgcccgugucgcc

SEQ ID NO: 391838 - RNA, 22 nt, Bordetella pertussis
ucacgccgaugaccagggcgcc

SEQ ID NO: 391839 - RNA, 20 nt, Bordetella pertussis
ucacgccggcgcgccgggcc

SEQ ID NO: 391840 - RNA, 22 nt, Bordetella pertussis
ucacgcugguggccaccagccc

SEQ ID NO: 391841 - RNA, 21 nt, Bordetella pertussis
ucacuuucccauccuggccga

SEQ ID NO: 391842 - RNA, 13 nt, Bordetella pertussis
ucagaaaggcagc

SEQ ID NO: 391843 - RNA, 16 nt, Bordetella pertussis
ucagaccaucuugucc

SEQ ID NO: 391844 - RNA, 18 nt, Bordetella pertussis
ucagcaaccccagcagcg

SEQ ID NO: 391845 - RNA, 22 nt, Bordetella pertussis
ucagcaccacggcggccaggcc

SEQ ID NO: 391846 - RNA, 15 nt, Bordetella pertussis
ucagcaccagcuccu

SEQ ID NO: 391847 - RNA, 24 nt, Bordetella pertussis
ucagcacgaucuggcgcgcgacca

SEQ ID NO: 391848 - RNA, 12 nt, Bordetella pertussis
ucagcacgcccu

SEQ ID NO: 391849 - RNA, 22 nt, Bordetella pertussis
ucagcagcaggcccuccggcgc

SEQ ID NO: 391850 - RNA, 19 nt, Bordetella pertussis
ucagcagcgccagggccag

SEQ ID NO: 391851 - RNA, 21 nt, Bordetella pertussis
ucagcagcgccagggccaggc

SEQ ID NO: 391852 - RNA, 20 nt, Bordetella pertussis
ucagcagggucgagaccagc

SEQ ID NO: 391853 - RNA, 19 nt, Bordetella pertussis
ucagcaggcccaccaggga

SEQ ID NO: 391854 - RNA, 21 nt, Bordetella pertussis
ucagcaggcccaccagggacc

SEQ ID NO: 391855 - RNA, 21 nt, Bordetella pertussis
ucagcaugaagcugcccagca

SEQ ID NO: 391856 - RNA, 22 nt, Bordetella pertussis
ucagccacacgaucagcgccca

SEQ ID NO: 391857 - RNA, 12 nt, Bordetella pertussis
ucagccaccggu

SEQ ID NO: 391858 - RNA, 22 nt, Bordetella pertussis
ucagccccugccaugccccauc

SEQ ID NO: 391859 - RNA, 11 nt, Bordetella pertussis
ucagcccgcgu

SEQ ID NO: 391860 - RNA, 17 nt, Bordetella pertussis
ucagcgcaggcugaucc

SEQ ID NO: 391861 - RNA, 15 nt, Bordetella pertussis
ucagcgccaucaucg

SEQ ID NO: 391862 - RNA, 17 nt, Bordetella pertussis
ucagcggauugaccagc

SEQ ID NO: 391863 - RNA, 12 nt, Bordetella pertussis
ucagcggcagca

SEQ ID NO: 391864 - RNA, 15 nt, Bordetella pertussis
ucagcggccgcugcc

SEQ ID NO: 391865 - RNA, 13 nt, Bordetella pertussis
ucagcggccggcc

SEQ ID NO: 391866 - RNA, 21 nt, Bordetella pertussis
ucagcggccggcccgugcgca

SEQ ID NO: 391867 - RNA, 11 nt, Bordetella pertussis
ucagcggcgcg

SEQ ID NO: 391868 - RNA, 14 nt, Bordetella pertussis
ucagcgggcugcug

SEQ ID NO: 391869 - RNA, 17 nt, Bordetella pertussis
ucagcgggcuggccagc

SEQ ID NO: 391870 - RNA, 17 nt, Bordetella pertussis
ucaggcccuggggccgc

SEQ ID NO: 391871 - RNA, 19 nt, Bordetella pertussis
ucaggcccuggggccgcgg

SEQ ID NO: 391872 - RNA, 16 nt, Bordetella pertussis
ucaggccgaggcugcg

SEQ ID NO: 391873 - RNA, 14 nt, Bordetella pertussis
ucaggccgccggcg

SEQ ID NO: 391874 - RNA, 14 nt, Bordetella pertussis
ucaggccucgaaga

SEQ ID NO: 391875 - RNA, 12 nt, Bordetella pertussis
ucaggccugcac

SEQ ID NO: 391876 - RNA, 16 nt, Bordetella pertussis
ucaggccugcggcgcc

SEQ ID NO: 391877 - RNA, 23 nt, Bordetella pertussis
ucaggcgauccugcccaccgccg

SEQ ID NO: 391878 - RNA, 23 nt, Bordetella pertussis
ucaggcgcauggugagggccacg

SEQ ID NO: 391879 - RNA, 15 nt, Bordetella pertussis
ucaggcggagucgcc

SEQ ID NO: 391880 - RNA, 13 nt, Bordetella pertussis
ucaggcggccagg

SEQ ID NO: 391881 - RNA, 20 nt, Bordetella pertussis
ucaggcugggagagccggcc

SEQ ID NO: 391882 - RNA, 13 nt, Bordetella pertussis
ucaggcuugcagc

SEQ ID NO: 391883 - RNA, 15 nt, Bordetella pertussis
ucagguccaugaacg

SEQ ID NO: 391884 - RNA, 21 nt, Bordetella pertussis
ucaggucgccguucuggcugc

SEQ ID NO: 391885 - RNA, 20 nt, Bordetella pertussis
ucaguugggcgcgcccagcc

SEQ ID NO: 391886 - RNA, 23 nt, Bordetella pertussis
ucaguugguagagcagcucacuu

SEQ ID NO: 391887 - RNA, 18 nt, Bordetella pertussis
uccaagcgcguggccauc

SEQ ID NO: 391888 - RNA, 17 nt, Bordetella pertussis
uccaccaucagccagcc

SEQ ID NO: 391889 - RNA, 18 nt, Bordetella pertussis
uccacgaaggcgccgaaa

SEQ ID NO: 391890 - RNA, 22 nt, Bordetella pertussis
uccacgaugucguccagcucca

SEQ ID NO: 391891 - RNA, 18 nt, Bordetella pertussis
uccacgcccugcaccguc

SEQ ID NO: 391892 - RNA, 15 nt, Bordetella pertussis
uccacgccgccggcc

SEQ ID NO: 391893 - RNA, 15 nt, Bordetella pertussis
uccacgcccgcgccg

SEQ ID NO: 391894 - RNA, 14 nt, Bordetella pertussis
uccacgccguggcg

SEQ ID NO: 391895 - RNA, 22 nt, Bordetella pertussis
uccacgcggccguggcggccug

SEQ ID NO: 391896 - RNA, 21 nt, Bordetella pertussis
uccacgcggguggugcugcuc

SEQ ID NO: 391897 - RNA, 17 nt, Bordetella pertussis
uccacggcauggccagc

SEQ ID NO: 391898 - RNA, 18 nt, Bordetella pertussis
uccacggcauggccagcu

SEQ ID NO: 391899 - RNA, 22 nt, Bordetella pertussis
uccagaagauauugggggucag

SEQ ID NO: 391900 - RNA, 13 nt, Bordetella pertussis
uccagcagggacu

SEQ ID NO: 391901 - RNA, 17 nt, Bordetella pertussis
uccagcaucagggcgau

SEQ ID NO: 391902 - RNA, 22 nt, Bordetella pertussis
uccagccaccaugucccuggcc

SEQ ID NO: 391903 - RNA, 16 nt, Bordetella pertussis
uccagcgccaccagca

SEQ ID NO: 391904 - RNA, 19 nt, Bordetella pertussis
uccagcgccaccagcagcg

SEQ ID NO: 391905 - RNA, 17 nt, Bordetella pertussis
uccagcgccagcaccgg

SEQ ID NO: 391906 - RNA, 16 nt, Bordetella pertussis
uccagcgccaggccgc

SEQ ID NO: 391907 - RNA, 13 nt, Bordetella pertussis
uccagcgccgccu

SEQ ID NO: 391908 - RNA, 22 nt, Bordetella pertussis
uccagcgccuggcgggccuggg

SEQ ID NO: 391909 - RNA, 16 nt, Bordetella pertussis
uccagcgcgcccagau

SEQ ID NO: 391910 - RNA, 21 nt, Bordetella pertussis
uccagcgcgcgaucgccagca

SEQ ID NO: 391911 - RNA, 14 nt, Bordetella pertussis
uccagcgcgcggcc

SEQ ID NO: 391912 - RNA, 15 nt, Bordetella pertussis
uccagcgcgcggccu

SEQ ID NO: 391913 - RNA, 14 nt, Bordetella pertussis
uccagcgcggcaug

SEQ ID NO: 391914 - RNA, 14 nt, Bordetella pertussis
uccagcgcggcgcc

SEQ ID NO: 391915 - RNA, 18 nt, Bordetella pertussis
uccagcgcuucgugcagc

SEQ ID NO: 391916 - RNA, 14 nt, Bordetella pertussis
uccagcggacgggc

SEQ ID NO: 391917 - RNA, 18 nt, Bordetella pertussis
uccagcggacgggccagg

SEQ ID NO: 391918 - RNA, 19 nt, Bordetella pertussis
uccagcggacgggccaggc

SEQ ID NO: 391919 - RNA, 12 nt, Bordetella pertussis
uccagcggcgcc

SEQ ID NO: 391920 - RNA, 15 nt, Bordetella pertussis
uccagcggcgccagc

SEQ ID NO: 391921 - RNA, 18 nt, Bordetella pertussis
uccagcgucauggccugg

SEQ ID NO: 391922 - RNA, 22 nt, Bordetella pertussis
uccagcgucggcguaaggccgc

SEQ ID NO: 391923 - RNA, 22 nt, Bordetella pertussis
uccaggacgcgaagaucccgcc

SEQ ID NO: 391924 - RNA, 20 nt, Bordetella pertussis
uccaggagcucguccccacg

SEQ ID NO: 391925 - RNA, 20 nt, Bordetella pertussis
uccaggaguucccagcgcgc

SEQ ID NO: 391926 - RNA, 14 nt, Bordetella pertussis
uccaggccggccug

SEQ ID NO: 391927 - RNA, 17 nt, Bordetella pertussis
uccaggccggccugcaa

SEQ ID NO: 391928 - RNA, 23 nt, Bordetella pertussis
uccaggccggccugcaaugcggc

SEQ ID NO: 391929 - RNA, 21 nt, Bordetella pertussis
uccaggccgugagcgccgccg

SEQ ID NO: 391930 - RNA, 13 nt, Bordetella pertussis
uccaggccuggga

SEQ ID NO: 391931 - RNA, 15 nt, Bordetella pertussis
uccaggccugggaac

SEQ ID NO: 391932 - RNA, 17 nt, Bordetella pertussis
uccaggcggccaccacc

SEQ ID NO: 391933 - RNA, 22 nt, Bordetella pertussis
uccaggcggccaccaccaggcc

SEQ ID NO: 391934 - RNA, 13 nt, Bordetella pertussis
uccaggcggccag

SEQ ID NO: 391935 - RNA, 21 nt, Bordetella pertussis
uccaggcggcggugccagcgc

SEQ ID NO: 391936 - RNA, 17 nt, Bordetella pertussis
uccagguaggcggcgcg

SEQ ID NO: 391937 - RNA, 17 nt, Bordetella pertussis
uccaggugcggcggcga

SEQ ID NO: 391938 - RNA, 17 nt, Bordetella pertussis
uccagguugagucugga

SEQ ID NO: 391939 - RNA, 20 nt, Bordetella pertussis
uccagguugagucuggagau

SEQ ID NO: 391940 - RNA, 15 nt, Bordetella pertussis
uccagucccguggcg

SEQ ID NO: 391941 - RNA, 18 nt, Bordetella pertussis
uccagucuggauggcgua

SEQ ID NO: 391942 - RNA, 23 nt, Bordetella pertussis
uccaguugagaaugcccaggaug

SEQ ID NO: 391943 - RNA, 15 nt, Bordetella pertussis
uccauccgcauacaa

SEQ ID NO: 391944 - RNA, 23 nt, Bordetella pertussis
uccaucuugccggccuguucuuu

SEQ ID NO: 391945 - RNA, 17 nt, Bordetella pertussis
uccaugacggugccgag

SEQ ID NO: 391946 - RNA, 13 nt, Bordetella pertussis
uccauggccaguc

SEQ ID NO: 391947 - RNA, 17 nt, Bordetella pertussis
uccauggccugcaggaa

SEQ ID NO: 391948 - RNA, 20 nt, Bordetella pertussis
uccauggcgccggcggccuc

SEQ ID NO: 391949 - RNA, 10 nt, Bordetella pertussis
uccaugguga

SEQ ID NO: 391950 - RNA, 18 nt, Bordetella pertussis
ucccaaccagggccgcca

SEQ ID NO: 391951 - RNA, 15 nt, Bordetella pertussis
ucccagacagccacg

SEQ ID NO: 391952 - RNA, 19 nt, Bordetella pertussis
ucccagcgcacgcagcgcu

SEQ ID NO: 391953 - RNA, 18 nt, Bordetella pertussis
ucccagcggggacaggca

SEQ ID NO: 391954 - RNA, 17 nt, Bordetella pertussis
ucccaggaucaccgccg

SEQ ID NO: 391955 - RNA, 13 nt, Bordetella pertussis
ucccaggcgaggc

SEQ ID NO: 391956 - RNA, 22 nt, Bordetella pertussis
ucccaggcgcucgcgggugcgc

SEQ ID NO: 391957 - RNA, 16 nt, Bordetella pertussis
ucccauugcgcggcca

SEQ ID NO: 391958 - RNA, 19 nt, Bordetella pertussis
ucccauugcgcggccaggg

SEQ ID NO: 391959 - RNA, 17 nt, Bordetella pertussis
uccccacggggacaggc

SEQ ID NO: 391960 - RNA, 18 nt, Bordetella pertussis
uccccacggggacaggca

SEQ ID NO: 391961 - RNA, 14 nt, Bordetella pertussis
uccccacuggggga

SEQ ID NO: 391962 - RNA, 21 nt, Bordetella pertussis
uccccagacgcagaccacgcc

SEQ ID NO: 391963 - RNA, 23 nt, Bordetella pertussis
uccccagcacauagcgcaagccc

SEQ ID NO: 391964 - RNA, 15 nt, Bordetella pertussis
uccccagcgccgcca

SEQ ID NO: 391965 - RNA, 15 nt, Bordetella pertussis
uccccauguggggac

SEQ ID NO: 391966 - RNA, 22 nt, Bordetella pertussis
uccccgaaggggacuggcuccc

SEQ ID NO: 391967 - RNA, 19 nt, Bordetella pertussis
uccccgcacggggacaggc

SEQ ID NO: 391968 - RNA, 17 nt, Bordetella pertussis
uccccgcagggacaggc

SEQ ID NO: 391969 - RNA, 17 nt, Bordetella pertussis
uccccgccgggacaggc

SEQ ID NO: 391970 - RNA, 19 nt, Bordetella pertussis
uccccgccgggacaggcac

SEQ ID NO: 391971 - RNA, 17 nt, Bordetella pertussis
uccccgcggggacaggc

SEQ ID NO: 391972 - RNA, 18 nt, Bordetella pertussis
uccccgcggggacaggca

SEQ ID NO: 391973 - RNA, 21 nt, Bordetella pertussis
uccccgcggggacaggcuccc

SEQ ID NO: 391974 - RNA, 18 nt, Bordetella pertussis
uccccgcugggacaggca

SEQ ID NO: 391975 - RNA, 14 nt, Bordetella pertussis
uccccgggcaccau

SEQ ID NO: 391976 - RNA, 22 nt, Bordetella pertussis
uccccgggcgugaccagcugca

SEQ ID NO: 391977 - RNA, 19 nt, Bordetella pertussis
uccccguucggggacaggc

SEQ ID NO: 391978 - RNA, 12 nt, Bordetella pertussis
uccccgugggga

SEQ ID NO: 391979 - RNA, 17 nt, Bordetella pertussis
uccccguggggacaggc

SEQ ID NO: 391980 - RNA, 22 nt, Bordetella pertussis
uccccuccggugccuggcuccc

SEQ ID NO: 391981 - RNA, 18 nt, Bordetella pertussis
uccccugcggggacaggc

SEQ ID NO: 391982 - RNA, 17 nt, Bordetella pertussis
ucccgacccccggcccg

SEQ ID NO: 391983 - RNA, 23 nt, Bordetella pertussis
ucccgacgaggccgaguagcggc

SEQ ID NO: 391984 - RNA, 16 nt, Bordetella pertussis
ucccgacgauccgcgg

SEQ ID NO: 391985 - RNA, 17 nt, Bordetella pertussis
ucccgacggggacaggc

SEQ ID NO: 391986 - RNA, 19 nt, Bordetella pertussis
ucccgacggggacaggcuc

SEQ ID NO: 391987 - RNA, 21 nt, Bordetella pertussis
ucccgagcgcucccgccaaca

SEQ ID NO: 391988 - RNA, 16 nt, Bordetella pertussis
ucccgcaggcccacaa

SEQ ID NO: 391989 - RNA, 16 nt, Bordetella pertussis
ucccgccgcccggccg

SEQ ID NO: 391990 - RNA, 18 nt, Bordetella pertussis
ucccgccgcccggccggc

SEQ ID NO: 391991 - RNA, 17 nt, Bordetella pertussis
ucccgcgccuaucaggc

SEQ ID NO: 391992 - RNA, 22 nt, Bordetella pertussis
ucccggaccagcaguugcgcca

SEQ ID NO: 391993 - RNA, 19 nt, Bordetella pertussis
ucccggaugcgauaucccg

SEQ ID NO: 391994 - RNA, 13 nt, Bordetella pertussis
ucccggccaggcg

SEQ ID NO: 391995 - RNA, 15 nt, Bordetella pertussis
ucccggcgcuggccg

SEQ ID NO: 391996 - RNA, 17 nt, Bordetella pertussis
ucccggcggggacaggc

SEQ ID NO: 391997 - RNA, 14 nt, Bordetella pertussis
ucccggcggggcag

SEQ ID NO: 391998 - RNA, 18 nt, Bordetella pertussis
ucccggcugggacaggca

SEQ ID NO: 391999 - RNA, 16 nt, Bordetella pertussis
ucccgguaggccuggu

SEQ ID NO: 392000 - RNA, 17 nt, Bordetella pertussis
ucccugaucccggcgcu

SEQ ID NO: 392001 - RNA, 17 nt, Bordetella pertussis
ucccugcgggggcaggc

SEQ ID NO: 392002 - RNA, 17 nt, Bordetella pertussis
ucccugguccagcagcg

SEQ ID NO: 392003 - RNA, 18 nt, Bordetella pertussis
ucccugugggggacaggc

SEQ ID NO: 392004 - RNA, 19 nt, Bordetella pertussis
ucccugugggggacaggca

SEQ ID NO: 392005 - RNA, 20 nt, Bordetella pertussis
ucccugugggggacaggcac

SEQ ID NO: 392006 - RNA, 14 nt, Bordetella pertussis
ucccuuccuggcca

SEQ ID NO: 392007 - RNA, 15 nt, Bordetella pertussis
ucccuuccuggccaa

SEQ ID NO: 392008 - RNA, 17 nt, Bordetella pertussis
uccgaacgcgacagcgc

SEQ ID NO: 392009 - RNA, 18 nt, Bordetella pertussis
uccgaacgcgacagcgcu

SEQ ID NO: 392010 - RNA, 18 nt, Bordetella pertussis
uccgacaccgucaggaag

SEQ ID NO: 392011 - RNA, 15 nt, Bordetella pertussis
uccgaucagcacgau

SEQ ID NO: 392012 - RNA, 11 nt, Bordetella pertussis
uccgaugaugc

SEQ ID NO: 392013 - RNA, 18 nt, Bordetella pertussis
uccgcaccggcgugcgcu

SEQ ID NO: 392014 - RNA, 22 nt, Bordetella pertussis
uccgcaccggugggagccaguc

SEQ ID NO: 392015 - RNA, 16 nt, Bordetella pertussis
uccgccaacucgcucc

SEQ ID NO: 392016 - RNA, 15 nt, Bordetella pertussis
uccgccaccgcgccg

SEQ ID NO: 392017 - RNA, 20 nt, Bordetella pertussis
uccgccaccgcgccgcccac

SEQ ID NO: 392018 - RNA, 16 nt, Bordetella pertussis
uccgccacccuggcac

SEQ ID NO: 392019 - RNA, 18 nt, Bordetella pertussis
uccgccacgccggccacg

SEQ ID NO: 392020 - RNA, 18 nt, Bordetella pertussis
uccgccauaugcgcgaag

SEQ ID NO: 392021 - RNA, 23 nt, Bordetella pertussis
uccgccauaugcgcgaaguggcc

SEQ ID NO: 392022 - RNA, 14 nt, Bordetella pertussis
uccgcccagccagg

SEQ ID NO: 392023 - RNA, 23 nt, Bordetella pertussis
uccgcccagccaggcgccagcgg

SEQ ID NO: 392024 - RNA, 16 nt, Bordetella pertussis
uccgccccccugcaua

SEQ ID NO: 392025 - RNA, 18 nt, Bordetella pertussis
uccgccccauccacggcg

SEQ ID NO: 392026 - RNA, 13 nt, Bordetella pertussis
uccgccgcggcca

SEQ ID NO: 392027 - RNA, 15 nt, Bordetella pertussis
uccgccgcggccagc

SEQ ID NO: 392028 - RNA, 17 nt, Bordetella pertussis
uccgcgaagugccuguc

SEQ ID NO: 392029 - RNA, 22 nt, Bordetella pertussis
uccgcgacgguccugcgcgccg

SEQ ID NO: 392030 - RNA, 13 nt, Bordetella pertussis
uccgcgccaggcg

SEQ ID NO: 392031 - RNA, 21 nt, Bordetella pertussis
uccgcggcccgcccgcggauc

SEQ ID NO: 392032 - RNA, 20 nt, Bordetella pertussis
uccgcgggcgggccgcggac

SEQ ID NO: 392033 - RNA, 11 nt, Bordetella pertussis
uccgcggggga

SEQ ID NO: 392034 - RNA, 12 nt, Bordetella pertussis
uccgcguccauc

SEQ ID NO: 392035 - RNA, 15 nt, Bordetella pertussis
uccgcgucgccgccg

SEQ ID NO: 392036 - RNA, 20 nt, Bordetella pertussis
uccgcuaccaggcgcgcgcg

SEQ ID NO: 392037 - RNA, 19 nt, Bordetella pertussis
uccgcucgaggccaggcug

SEQ ID NO: 392038 - RNA, 14 nt, Bordetella pertussis
uccgcuuccggccg

SEQ ID NO: 392039 - RNA, 23 nt, Bordetella pertussis
uccgcuucgucgggcagcgcggc

SEQ ID NO: 392040 - RNA, 22 nt, Bordetella pertussis
uccggaugcacguagcgcagca

SEQ ID NO: 392041 - RNA, 14 nt, Bordetella pertussis
uccggcacggcggc

SEQ ID NO: 392042 - RNA, 13 nt, Bordetella pertussis
uccggcagcagca

SEQ ID NO: 392043 - RNA, 15 nt, Bordetella pertussis
uccggcagcggccag

SEQ ID NO: 392044 - RNA, 21 nt, Bordetella pertussis
uccggcagcggccagcgcggc

SEQ ID NO: 392045 - RNA, 18 nt, Bordetella pertussis
uccggcaugaccgcggac

SEQ ID NO: 392046 - RNA, 20 nt, Bordetella pertussis
uccggcaugaccgcggacgc

SEQ ID NO: 392047 - RNA, 16 nt, Bordetella pertussis
uccggcccggugcagc

SEQ ID NO: 392048 - RNA, 14 nt, Bordetella pertussis
uccggccgcacgcg

SEQ ID NO: 392049 - RNA, 21 nt, Bordetella pertussis
uccggccgcacgcggccgcgg

SEQ ID NO: 392050 - RNA, 17 nt, Bordetella pertussis
uccggccgcgcaaggcg

SEQ ID NO: 392051 - RNA, 19 nt, Bordetella pertussis
uccggccgcgcaaggcggc

SEQ ID NO: 392052 - RNA, 18 nt, Bordetella pertussis
uccggccgcgccagcccu

SEQ ID NO: 392053 - RNA, 13 nt, Bordetella pertussis
uccggccgggcca

SEQ ID NO: 392054 - RNA, 13 nt, Bordetella pertussis
uccggcgcccgcc

SEQ ID NO: 392055 - RNA, 17 nt, Bordetella pertussis
uccggcgcccgccgccg

SEQ ID NO: 392056 - RNA, 22 nt, Bordetella pertussis
uccggcgccgccggguuucucg

SEQ ID NO: 392057 - RNA, 15 nt, Bordetella pertussis
uccggcgccuggccg

SEQ ID NO: 392058 - RNA, 22 nt, Bordetella pertussis
uccggcgcgcgguggcacgacg

SEQ ID NO: 392059 - RNA, 14 nt, Bordetella pertussis
uccggcgcuggcuu

SEQ ID NO: 392060 - RNA, 18 nt, Bordetella pertussis
uccggcggcagcgcgaac

SEQ ID NO: 392061 - RNA, 16 nt, Bordetella pertussis
uccggcgugccaugga

SEQ ID NO: 392062 - RNA, 17 nt, Bordetella pertussis
uccggcucggaccuggc

SEQ ID NO: 392063 - RNA, 21 nt, Bordetella pertussis
uccggcugcgcgcgcagccag

SEQ ID NO: 392064 - RNA, 22 nt, Bordetella pertussis
uccggcugcgcgcgcagccagg

SEQ ID NO: 392065 - RNA, 15 nt, Bordetella pertussis
uccggcuugccgaag

SEQ ID NO: 392066 - RNA, 16 nt, Bordetella pertussis
uccgggagccuguccc

SEQ ID NO: 392067 - RNA, 19 nt, Bordetella pertussis
uccgggcgcugcgccggcg

SEQ ID NO: 392068 - RNA, 20 nt, Bordetella pertussis
uccgggugaaguugucgucg

SEQ ID NO: 392069 - RNA, 19 nt, Bordetella pertussis
uccggguugcccacgccuu

SEQ ID NO: 392070 - RNA, 21 nt, Bordetella pertussis
uccggucgcgcgugcaggccg

SEQ ID NO: 392071 - RNA, 16 nt, Bordetella pertussis
uccggucguggccagc

SEQ ID NO: 392072 - RNA, 21 nt, Bordetella pertussis
uccggucguuccagaacggcg

SEQ ID NO: 392073 - RNA, 16 nt, Bordetella pertussis
uccggugccuggcucc

SEQ ID NO: 392074 - RNA, 19 nt, Bordetella pertussis
uccggugccuggcuccccg

SEQ ID NO: 392075 - RNA, 15 nt, Bordetella pertussis
uccgguggugcuggg

SEQ ID NO: 392076 - RNA, 14 nt, Bordetella pertussis
uccguaguccagca

SEQ ID NO: 392077 - RNA, 18 nt, Bordetella pertussis
uccguaguccagcagcag

SEQ ID NO: 392078 - RNA, 14 nt, Bordetella pertussis
uccguccuggccac

SEQ ID NO: 392079 - RNA, 17 nt, Bordetella pertussis
uccguccuggccacugc

SEQ ID NO: 392080 - RNA, 13 nt, Bordetella pertussis
uccgucugguucc

SEQ ID NO: 392081 - RNA, 15 nt, Bordetella pertussis
uccgugagugcagcg

SEQ ID NO: 392082 - RNA, 18 nt, Bordetella pertussis
uccgugcaucggcacggg

SEQ ID NO: 392083 - RNA, 15 nt, Bordetella pertussis
uccguggcgcggcca

SEQ ID NO: 392084 - RNA, 16 nt, Bordetella pertussis
uccguggcggccgcgg

SEQ ID NO: 392085 - RNA, 15 nt, Bordetella pertussis
uccuaaauugccgcg

SEQ ID NO: 392086 - RNA, 18 nt, Bordetella pertussis
uccuccugucaugguuuc

SEQ ID NO: 392087 - RNA, 18 nt, Bordetella pertussis
uccucgaccagcccggcc

SEQ ID NO: 392088 - RNA, 22 nt, Bordetella pertussis
uccucgaccagcccggccgcca

SEQ ID NO: 392089 - RNA, 23 nt, Bordetella pertussis
uccucgacguaagugcccaggcc

SEQ ID NO: 392090 - RNA, 22 nt, Bordetella pertussis
uccucgacccgcgccucggcau

SEQ ID NO: 392091 - RNA, 16 nt, Bordetella pertussis
uccucgccagcggcag

SEQ ID NO: 392092 - RNA, 23 nt, Bordetella pertussis
uccucgcccagcggcgccgacca

SEQ ID NO: 392093 - RNA, 17 nt, Bordetella pertussis
uccucgcgggccuggcg

SEQ ID NO: 392094 - RNA, 15 nt, Bordetella pertussis
uccucgcucuuggga

SEQ ID NO: 392095 - RNA, 13 nt, Bordetella pertussis
uccucggccagcc

SEQ ID NO: 392096 - RNA, 14 nt, Bordetella pertussis
uccucggccuggcc

SEQ ID NO: 392097 - RNA, 15 nt, Bordetella pertussis
uccucgucgcggaag

SEQ ID NO: 392098 - RNA, 13 nt, Bordetella pertussis
uccucgucggcca

SEQ ID NO: 392099 - RNA, 14 nt, Bordetella pertussis
uccugaggccaggc

SEQ ID NO: 392100 - RNA, 18 nt, Bordetella pertussis
uccugaucgaauaccugc

SEQ ID NO: 392101 - RNA, 14 nt, Bordetella pertussis
uccugcaaccagcu

SEQ ID NO: 392102 - RNA, 15 nt, Bordetella pertussis
uccugcaaggccggc

SEQ ID NO: 392103 - RNA, 16 nt, Bordetella pertussis
uccugcaaggccggcg

SEQ ID NO: 392104 - RNA, 15 nt, Bordetella pertussis
uccugcagcgugcug

SEQ ID NO: 392105 - RNA, 18 nt, Bordetella pertussis
uccugcagguccugguag

SEQ ID NO: 392106 - RNA, 15 nt, Bordetella pertussis
uccugccaguugccg

SEQ ID NO: 392107 - RNA, 21 nt, Bordetella pertussis
uccugccauugcgcggccugc

SEQ ID NO: 392108 - RNA, 18 nt, Bordetella pertussis
uccugccgcacuucgggc

SEQ ID NO: 392109 - RNA, 14 nt, Bordetella pertussis
uccugccgcgaccc

SEQ ID NO: 392110 - RNA, 19 nt, Bordetella pertussis
uccugcucggugcucuggc

SEQ ID NO: 392111 - RNA, 16 nt, Bordetella pertussis
uccugcugcgccuggc

SEQ ID NO: 392112 - RNA, 16 nt, Bordetella pertussis
uccuggaacuugggau

SEQ ID NO: 392113 - RNA, 23 nt, Bordetella pertussis
uccuggagcuuggccggugccag

SEQ ID NO: 392114 - RNA, 17 nt, Bordetella pertussis
uccuggcagucagccgu

SEQ ID NO: 392115 - RNA, 12 nt, Bordetella pertussis
uccuggcaggcc

SEQ ID NO: 392116 - RNA, 17 nt, Bordetella pertussis
uccugguaagaaaccug

SEQ ID NO: 392117 - RNA, 18 nt, Bordetella pertussis
uccugguaagaaaccugg

SEQ ID NO: 392118 - RNA, 15 nt, Bordetella pertussis
uccugguagccggcg

SEQ ID NO: 392119 - RNA, 16 nt, Bordetella pertussis
uccuggucgaccaggc

SEQ ID NO: 392120 - RNA, 21 nt, Bordetella pertussis
uccuggucgaucgagaaguug

SEQ ID NO: 392121 - RNA, 21 nt, Bordetella pertussis
uccuggugccaguccccgcau

SEQ ID NO: 392122 - RNA, 23 nt, Bordetella pertussis
uccugguugaccgagcccggcac

SEQ ID NO: 392123 - RNA, 15 nt, Bordetella pertussis
uccuguauuccugac

SEQ ID NO: 392124 - RNA, 15 nt, Bordetella pertussis
uccuuccaugaggaa

SEQ ID NO: 392125 - RNA, 14 nt, Bordetella pertussis
uccuugaacgccuu

SEQ ID NO: 392126 - RNA, 16 nt, Bordetella pertussis
uccuuggaguucuucu

SEQ ID NO: 392127 - RNA, 14 nt, Bordetella pertussis
ucgaacaaggcggu

SEQ ID NO: 392128 - RNA, 23 nt, Bordetella pertussis
ucgaacaaggcgguggccagcgu

SEQ ID NO: 392129 - RNA, 19 nt, Bordetella pertussis
ucgaacaccggcuuggccu

SEQ ID NO: 392130 - RNA, 16 nt, Bordetella pertussis
ucgaacagcaucagcu

SEQ ID NO: 392131 - RNA, 17 nt, Bordetella pertussis
ucgaacagcugcagcga

SEQ ID NO: 392132 - RNA, 17 nt, Bordetella pertussis
ucgaacaggcuggcaug

SEQ ID NO: 392133 - RNA, 15 nt, Bordetella pertussis
ucgaacccaugcagu

SEQ ID NO: 392134 - RNA, 15 nt, Bordetella pertussis
ucgaacucgccgaac

SEQ ID NO: 392135 - RNA, 22 nt, Bordetella pertussis
ucgaagaaggccuuggccuggg

SEQ ID NO: 392136 - RNA, 22 nt, Bordetella pertussis
ucgaagaccucggcgcucagga

SEQ ID NO: 392137 - RNA, 12 nt, Bordetella pertussis
ucgaagaucucg

SEQ ID NO: 392138 - RNA, 16 nt, Bordetella pertussis
ucgaagcacugcaggc

SEQ ID NO: 392139 - RNA, 20 nt, Bordetella pertussis
ucgaaggcgcgcuccagcau

SEQ ID NO: 392140 - RNA, 21 nt, Bordetella pertussis
ucgaaggcggccggcaggccg

SEQ ID NO: 392141 - RNA, 17 nt, Bordetella pertussis
ucgaauccucucgcccc

SEQ ID NO: 392142 - RNA, 20 nt, Bordetella pertussis
ucgaauuccaguugcgcgcc

SEQ ID NO: 392143 - RNA, 18 nt, Bordetella pertussis
ucgacaggaacagcacgu

SEQ ID NO: 392144 - RNA, 20 nt, Bordetella pertussis
ucgacagcagcccgcuggcc

SEQ ID NO: 392145 - RNA, 13 nt, Bordetella pertussis
ucgaccaccagca

SEQ ID NO: 392146 - RNA, 19 nt, Bordetella pertussis
ucgaccacgcguccccgca

SEQ ID NO: 392147 - RNA, 13 nt, Bordetella pertussis
ucgaccagcagcc

SEQ ID NO: 392148 - RNA, 14 nt, Bordetella pertussis
ucgaccagcauccu

SEQ ID NO: 392149 - RNA, 13 nt, Bordetella pertussis
ucgaccagcgcgc

SEQ ID NO: 392150 - RNA, 18 nt, Bordetella pertussis
ucgaccaucauggccagg

SEQ ID NO: 392151 - RNA, 19 nt, Bordetella pertussis
ucgaccaucauggccaggg

SEQ ID NO: 392152 - RNA, 21 nt, Bordetella pertussis
ucgaccaucauggccagggcc

SEQ ID NO: 392153 - RNA, 13 nt, Bordetella pertussis
ucgaccgcaugcg

SEQ ID NO: 392154 - RNA, 19 nt, Bordetella pertussis
ucgaccgcuucggucagcu

SEQ ID NO: 392155 - RNA, 19 nt, Bordetella pertussis
ucgaccggcagggugccca

SEQ ID NO: 392156 - RNA, 19 nt, Bordetella pertussis
ucgacgaaauagccgacca

SEQ ID NO: 392157 - RNA, 18 nt, Bordetella pertussis
ucgacgaacaaggccgga

SEQ ID NO: 392158 - RNA, 21 nt, Bordetella pertussis
ucgacgagaugccgaugaugg

SEQ ID NO: 392159 - RNA, 19 nt, Bordetella pertussis
ucgacgaucaggcccuggg

SEQ ID NO: 392160 - RNA, 19 nt, Bordetella pertussis
ucgacgcagcagccgcuag

SEQ ID NO: 392161 - RNA, 14 nt, Bordetella pertussis
ucgacgcccgggcg

SEQ ID NO: 392162 - RNA, 19 nt, Bordetella pertussis
ucgacgccguacugggcac

SEQ ID NO: 392163 - RNA, 13 nt, Bordetella pertussis
ucgacgcugaucg

SEQ ID NO: 392164 - RNA, 16 nt, Bordetella pertussis
ucgacggccgcaagcu

SEQ ID NO: 392165 - RNA, 18 nt, Bordetella pertussis
ucgacgggcaggcccagc

SEQ ID NO: 392166 - RNA, 15 nt, Bordetella pertussis
ucgacggugcgcgcc

SEQ ID NO: 392167 - RNA, 18 nt, Bordetella pertussis
ucgacguaagugcccagg

SEQ ID NO: 392168 - RNA, 13 nt, Bordetella pertussis
ucgagcaccgcgc

SEQ ID NO: 392169 - RNA, 16 nt, Bordetella pertussis
ucgagcacgcggcgcg

SEQ ID NO: 392170 - RNA, 17 nt, Bordetella pertussis
ucgagcacggggcuguc

SEQ ID NO: 392171 - RNA, 13 nt, Bordetella pertussis
ucgagcagcgcau

SEQ ID NO: 392172 - RNA, 21 nt, Bordetella pertussis
ucgagcaucauggcgcgcgcc

SEQ ID NO: 392173 - RNA, 22 nt, Bordetella pertussis
ucgagccgcagaacagcagcgu

SEQ ID NO: 392174 - RNA, 19 nt, Bordetella pertussis
ucgagccgggccacgcgca

SEQ ID NO: 392175 - RNA, 15 nt, Bordetella pertussis
ucgagccgguacagc

SEQ ID NO: 392176 - RNA, 21 nt, Bordetella pertussis
ucgagcgccugggcggccacg

SEQ ID NO: 392177 - RNA, 13 nt, Bordetella pertussis
ucgagcggcagca

SEQ ID NO: 392178 - RNA, 16 nt, Bordetella pertussis
ucgagcggcagcagcg

SEQ ID NO: 392179 - RNA, 15 nt, Bordetella pertussis
ucgagcgcggccagg

SEQ ID NO: 392180 - RNA, 19 nt, Bordetella pertussis
ucgagcuccugcucgaucc

SEQ ID NO: 392181 - RNA, 11 nt, Bordetella pertussis
ucgagcuggcc

SEQ ID NO: 392182 - RNA, 15 nt, Bordetella pertussis
ucgaggccaggcuga

SEQ ID NO: 392183 - RNA, 17 nt, Bordetella pertussis
ucgaggccaggcugacc

SEQ ID NO: 392184 - RNA, 23 nt, Bordetella pertussis
ucgaggcgcaguccagcguggag

SEQ ID NO: 392185 - RNA, 16 nt, Bordetella pertussis
ucgaggucagcggcuu

SEQ ID NO: 392186 - RNA, 20 nt, Bordetella pertussis
ucgauaccaacugccugcag

SEQ ID NO: 392187 - RNA, 19 nt, Bordetella pertussis
ucgauaugggcggccucgg

SEQ ID NO: 392188 - RNA, 19 nt, Bordetella pertussis
ucgaucaagggguggcugu

SEQ ID NO: 392189 - RNA, 18 nt, Bordetella pertussis
ucgaucacggcgcgcgcc

SEQ ID NO: 392190 - RNA, 21 nt, Bordetella pertussis
ucgaucacgaagcccaguucg

SEQ ID NO: 392191 - RNA, 22 nt, Bordetella pertussis
ucgaucaggcccagcacgauga

SEQ ID NO: 392192 - RNA, 23 nt, Bordetella pertussis
ucgaucagccacgugaagcgccg

SEQ ID NO: 392193 - RNA, 16 nt, Bordetella pertussis
ucgaucaucaggucca

SEQ ID NO: 392194 - RNA, 14 nt, Bordetella pertussis
ucgaucauggccag

SEQ ID NO: 392195 - RNA, 13 nt, Bordetella pertussis
ucgauccgggccu

SEQ ID NO: 392196 - RNA, 14 nt, Bordetella pertussis
ucgaucggcgcgcc

SEQ ID NO: 392197 - RNA, 13 nt, Bordetella pertussis
ucgaucuggcuca

SEQ ID NO: 392198 - RNA, 17 nt, Bordetella pertussis
ucgaucugguuggccac

SEQ ID NO: 392199 - RNA, 23 nt, Bordetella pertussis
ucgaugaagaucaggcggcugcc

SEQ ID NO: 392200 - RNA, 19 nt, Bordetella pertussis
ucgaugaauuccagccagg

SEQ ID NO: 392201 - RNA, 15 nt, Bordetella pertussis
ucgaugaggccaggg

SEQ ID NO: 392202 - RNA, 19 nt, Bordetella pertussis
ucgaugcgccgcaccagcg

SEQ ID NO: 392203 - RNA, 22 nt, Bordetella pertussis
ucgaugcgcaccaugcgcagca

SEQ ID NO: 392204 - RNA, 18 nt, Bordetella pertussis
ucgauggcggccagggca

SEQ ID NO: 392205 - RNA, 19 nt, Bordetella pertussis
ucgauggcggccagggcaa

SEQ ID NO: 392206 - RNA, 23 nt, Bordetella pertussis
ucgauggcguacagcagggugcc

SEQ ID NO: 392207 - RNA, 19 nt, Bordetella pertussis
ucgaugggcccgggcaggc

SEQ ID NO: 392208 - RNA, 22 nt, Bordetella pertussis
ucgaugggcccgggcaggcuca

SEQ ID NO: 392209 - RNA, 19 nt, Bordetella pertussis
ucgauguagagggucuggc

SEQ ID NO: 392210 - RNA, 16 nt, Bordetella pertussis
ucgauguccagcgcca

SEQ ID NO: 392211 - RNA, 18 nt, Bordetella pertussis
ucgauguggcgcuggcgg

SEQ ID NO: 392212 - RNA, 15 nt, Bordetella pertussis
ucgauuucggcggcc

SEQ ID NO: 392213 - RNA, 22 nt, Bordetella pertussis
ucgcaagcggccaugcgccgcu

SEQ ID NO: 392214 - RNA, 16 nt, Bordetella pertussis
ucgcacacaccgcguc

SEQ ID NO: 392215 - RNA, 16 nt, Bordetella pertussis
ucgcacgacagcaucu

SEQ ID NO: 392216 - RNA, 22 nt, Bordetella pertussis
ucgcacgcggcuucgcccggau

SEQ ID NO: 392217 - RNA, 20 nt, Bordetella pertussis
ucgcacuggguuuuuccggc

SEQ ID NO: 392218 - RNA, 13 nt, Bordetella pertussis
ucgcagcacgccc

SEQ ID NO: 392219 - RNA, 17 nt, Bordetella pertussis
ucgcaggccgcggccag

SEQ ID NO: 392220 - RNA, 19 nt, Bordetella pertussis
ucgcaggccgcggccaggc

SEQ ID NO: 392221 - RNA, 15 nt, Bordetella pertussis
ucgcagucccagucc

SEQ ID NO: 392222 - RNA, 15 nt, Bordetella pertussis
ucgcagucggggccg

SEQ ID NO: 392223 - RNA, 14 nt, Bordetella pertussis
ucgcauaccggccg

SEQ ID NO: 392224 - RNA, 21 nt, Bordetella pertussis
ucgcauaccggccgcgggugg

SEQ ID NO: 392225 - RNA, 17 nt, Bordetella pertussis
ucgcaugcgguuucuca

SEQ ID NO: 392226 - RNA, 18 nt, Bordetella pertussis
ucgcaugcgguuucucag

SEQ ID NO: 392227 - RNA, 21 nt, Bordetella pertussis
ucucgucgaggaucaaggccc

SEQ ID NO: 392228 - RNA, 12 nt, Bordetella pertussis
ucugaucaucuu

SEQ ID NO: 392229 - RNA, 15 nt, Bordetella pertussis
ucugaucggacuggg

SEQ ID NO: 392230 - RNA, 20 nt, Bordetella pertussis
ucugaucggacugggucaga

SEQ ID NO: 392231 - RNA, 14 nt, Bordetella pertussis
ucugccccauggcc

SEQ ID NO: 392232 - RNA, 17 nt, Bordetella pertussis
ucugcccgugcgugcgc

SEQ ID NO: 392233 - RNA, 20 nt, Bordetella pertussis
ucugcccgugcgugcgccug

SEQ ID NO: 392234 - RNA, 13 nt, Bordetella pertussis
ucugccgcugauc

SEQ ID NO: 392235 - RNA, 14 nt, Bordetella pertussis
ucugcgccacggcg

SEQ ID NO: 392236 - RNA, 17 nt, Bordetella pertussis
ucugcguuuucuggccu

SEQ ID NO: 392237 - RNA, 18 nt, Bordetella pertussis
ucugcuacaccgugcugg

SEQ ID NO: 392238 - RNA, 22 nt, Bordetella pertussis
ucugcuggucgcgggccaggcc

SEQ ID NO: 392239 - RNA, 23 nt, Bordetella pertussis
ucugcugguacagccccagcgcc

SEQ ID NO: 392240 - RNA, 19 nt, Bordetella pertussis
ucuggaagauguaccagcc

SEQ ID NO: 392241 - RNA, 18 nt, Bordetella pertussis
ucuggaucaccgccggcg

SEQ ID NO: 392242 - RNA, 15 nt, Bordetella pertussis
ucuggcaucagggcg

SEQ ID NO: 392243 - RNA, 20 nt, Bordetella pertussis
ucuggcccacgcgcacgacg

SEQ ID NO: 392244 - RNA, 22 nt, Bordetella pertussis
ucuggccgucgagccgguccgc

SEQ ID NO: 392245 - RNA, 18 nt, Bordetella pertussis
ucuggccugucugguggc

SEQ ID NO: 392246 - RNA, 12 nt, Bordetella pertussis
ucuggccuuccu

SEQ ID NO: 392247 - RNA, 23 nt, Bordetella pertussis
ucuggcgcgucaggccgggcagc

SEQ ID NO: 392248 - RNA, 20 nt, Bordetella pertussis
ucugggcgugaaaggccagc

SEQ ID NO: 392249 - RNA, 22 nt, Bordetella pertussis
ucugggcgugaaaggccagcgg

SEQ ID NO: 392250 - RNA, 13 nt, Bordetella pertussis
ucugguaguuggc

SEQ ID NO: 392251 - RNA, 18 nt, Bordetella pertussis
ucugguaguuggccaggg

SEQ ID NO: 392252 - RNA, 16 nt, Bordetella pertussis
ucuucagcuuggucac

SEQ ID NO: 392253 - RNA, 17 nt, Bordetella pertussis
ucuucaggcuccagugg

SEQ ID NO: 392254 - RNA, 17 nt, Bordetella pertussis
ucuucgagcgcggcgcg

SEQ ID NO: 392255 - RNA, 21 nt, Bordetella pertussis
ucuucgccugcauggugggca

SEQ ID NO: 392256 - RNA, 21 nt, Bordetella pertussis
ucuugaaaaagcugccggcau

SEQ ID NO: 392257 - RNA, 19 nt, Bordetella pertussis
ucuugaacucggccagcag

SEQ ID NO: 392258 - RNA, 18 nt, Bordetella pertussis
ucuugaugccgcccagca

SEQ ID NO: 392259 - RNA, 19 nt, Bordetella pertussis
ucuugcaggcgccaguccc

SEQ ID NO: 392260 - RNA, 17 nt, Bordetella pertussis
ucuugccaggcccggcg

SEQ ID NO: 392261 - RNA, 12 nt, Bordetella pertussis
ucuugccgccgu

SEQ ID NO: 392262 - RNA, 15 nt, Bordetella pertussis
ucuugccuuggcgaa

SEQ ID NO: 392263 - RNA, 15 nt, Bordetella pertussis
ucuugcgcaucggcg

SEQ ID NO: 392264 - RNA, 13 nt, Bordetella pertussis
ucuugcugccguc

SEQ ID NO: 392265 - RNA, 14 nt, Bordetella pertussis
ucuugguagcuccg

SEQ ID NO: 392266 - RNA, 20 nt, Bordetella pertussis
ucuuguaggcgauccaggcc

SEQ ID NO: 392267 - RNA, 21 nt, Bordetella pertussis
ucuuuucguccucgaccagga

SEQ ID NO: 392268 - RNA, 17 nt, Bordetella pertussis
ugaaacagcaucagcgg

SEQ ID NO: 392269 - RNA, 20 nt, Bordetella pertussis
ugaaacguacuccauugauu

SEQ ID NO: 392270 - RNA, 15 nt, Bordetella pertussis
ugaaaggccagcggc

SEQ ID NO: 392271 - RNA, 21 nt, Bordetella pertussis
ugaacagccgccccagcagca

SEQ ID NO: 392272 - RNA, 12 nt, Bordetella pertussis
ugaacagcgaga

SEQ ID NO: 392273 - RNA, 16 nt, Bordetella pertussis
ugaaccugcuggccgc

SEQ ID NO: 392274 - RNA, 14 nt, Bordetella pertussis
ugaacgccuugccc

SEQ ID NO: 392275 - RNA, 23 nt, Bordetella pertussis
ugaacgcgcauucgucgcugccg

SEQ ID NO: 392276 - RNA, 20 nt, Bordetella pertussis
ugaacgcuugacggccagga

SEQ ID NO: 392277 - RNA, 15 nt, Bordetella pertussis
ugaacggcagcgcgc

SEQ ID NO: 392278 - RNA, 15 nt, Bordetella pertussis
ugaacggcgcggccu

SEQ ID NO: 392279 - RNA, 18 nt, Bordetella pertussis
ugaacguguaggucagcg

SEQ ID NO: 392280 - RNA, 14 nt, Bordetella pertussis
ugaacuccugcaac

SEQ ID NO: 392281 - RNA, 14 nt, Bordetella pertussis
ugaagacgauggug

SEQ ID NO: 392282 - RNA, 15 nt, Bordetella pertussis
ugaagacgcccaggu

SEQ ID NO: 392283 - RNA, 17 nt, Bordetella pertussis
ugaagacgcccaggucc

SEQ ID NO: 392284 - RNA, 18 nt, Bordetella pertussis
ugaagcccauggcguagg

SEQ ID NO: 392285 - RNA, 18 nt, Bordetella pertussis
ugaaggccgaggccaggu

SEQ ID NO: 392286 - RNA, 16 nt, Bordetella pertussis
ugaaguaguacucgcc

SEQ ID NO: 392287 - RNA, 16 nt, Bordetella pertussis
ugaagucgcggcccgc

SEQ ID NO: 392288 - RNA, 18 nt, Bordetella pertussis
ugaagucgcggcccgcca

SEQ ID NO: 392289 - RNA, 19 nt, Bordetella pertussis
ugaaguccggaucccaggc

SEQ ID NO: 392290 - RNA, 17 nt, Bordetella pertussis
ugacaugcgggccucga

SEQ ID NO: 392291 - RNA, 19 nt, Bordetella pertussis
ugacauggccacggcccug

SEQ ID NO: 392292 - RNA, 16 nt, Bordetella pertussis
ugaccaccgggaugcc

SEQ ID NO: 392293 - RNA, 14 nt, Bordetella pertussis
ugaccaccuugccc

SEQ ID NO: 392294 - RNA, 15 nt, Bordetella pertussis
ugaccacgcccugga

SEQ ID NO: 392295 - RNA, 17 nt, Bordetella pertussis
ugaccacggccagcagc

SEQ ID NO: 392296 - RNA, 18 nt, Bordetella pertussis
ugaccacggccagcagca

SEQ ID NO: 392297 - RNA, 20 nt, Bordetella pertussis
ugaccacggccagcagcacg

SEQ ID NO: 392298 - RNA, 15 nt, Bordetella pertussis
ugaccacggcgcgcc

SEQ ID NO: 392299 - RNA, 17 nt, Bordetella pertussis
ugaccacggcgcgcccg

SEQ ID NO: 392300 - RNA, 19 nt, Bordetella pertussis
ugaccacggcgcgcccgca

SEQ ID NO: 392301 - RNA, 21 nt, Bordetella pertussis
ugaccacgucgaucaggccca

SEQ ID NO: 392302 - RNA, 17 nt, Bordetella pertussis
ugacccauaccagcccg

SEQ ID NO: 392303 - RNA, 21 nt, Bordetella pertussis
ugacccguuugcgcagcucgu

SEQ ID NO: 392304 - RNA, 21 nt, Bordetella pertussis
ugaccgaagcgggcgaggacu

SEQ ID NO: 392305 - RNA, 15 nt, Bordetella pertussis
ugaccgacaggccug

SEQ ID NO: 392306 - RNA, 17 nt, Bordetella pertussis
ugaccgacaggccuggc

SEQ ID NO: 392307 - RNA, 18 nt, Bordetella pertussis
ugaccgacgugcgccgca

SEQ ID NO: 392308 - RNA, 21 nt, Bordetella pertussis
ugaccgacgugcgccgcauca

SEQ ID NO: 392309 - RNA, 19 nt, Bordetella pertussis
ugaccgacgugcugcugca

SEQ ID NO: 392310 - RNA, 13 nt, Bordetella pertussis
ugaccgagcccgg

SEQ ID NO: 392311 - RNA, 22 nt, Bordetella pertussis
ugaccggcuauaccgggcuggu

SEQ ID NO: 392312 - RNA, 17 nt, Bordetella pertussis
ugacgaggugccugucc

SEQ ID NO: 392313 - RNA, 16 nt, Bordetella pertussis
ugacgaucucgcccug

SEQ ID NO: 392314 - RNA, 15 nt, Bordetella pertussis
ugacgaugcccaggu

SEQ ID NO: 392315 - RNA, 20 nt, Bordetella pertussis
ugacgauguucaggccaugc

SEQ ID NO: 392316 - RNA, 14 nt, Bordetella pertussis
ugacgcccacgcuc

SEQ ID NO: 392317 - RNA, 21 nt, Bordetella pertussis
ugacgccgggcgcggcccggc

SEQ ID NO: 392318 - RNA, 22 nt, Bordetella pertussis
ugacgccggcgaaugccggccg

SEQ ID NO: 392319 - RNA, 14 nt, Bordetella pertussis
ugacgcucauccag

SEQ ID NO: 392320 - RNA, 16 nt, Bordetella pertussis
ugacgcugauggccgc

SEQ ID NO: 392321 - RNA, 14 nt, Bordetella pertussis
ugacgcugcucuug

SEQ ID NO: 392322 - RNA, 16 nt, Bordetella pertussis
ugacggauucccagcu

SEQ ID NO: 392323 - RNA, 17 nt, Bordetella pertussis
ugacggccaggacggca

SEQ ID NO: 392324 - RNA, 22 nt, Bordetella pertussis
ugacggccauccggccacgcau

SEQ ID NO: 392325 - RNA, 12 nt, Bordetella pertussis
ugacggcccagc

SEQ ID NO: 392326 - RNA, 23 nt, Bordetella pertussis
ugacgggucacccgccgcaccag

SEQ ID NO: 392327 - RNA, 22 nt, Bordetella pertussis
ugacguagcggaucgcggcgcg

SEQ ID NO: 392328 - RNA, 22 nt, Bordetella pertussis
ugacguccagcgccaccagcag

SEQ ID NO: 392329 - RNA, 17 nt, Bordetella pertussis
ugacgucauggccgaua

SEQ ID NO: 392330 - RNA, 17 nt, Bordetella pertussis
ugacguccggcgggccg

SEQ ID NO: 392331 - RNA, 20 nt, Bordetella pertussis
ugacguccggcgggccgcug

SEQ ID NO: 392332 - RNA, 20 nt, Bordetella pertussis
ugacguucggggcgucgcug

SEQ ID NO: 392333 - RNA, 18 nt, Bordetella pertussis
ugacuucggccgccagcc

SEQ ID NO: 392334 - RNA, 19 nt, Bordetella pertussis
ugacuugaccgcaugcugc

SEQ ID NO: 392335 - RNA, 17 nt, Bordetella pertussis
ugagacggcggaucuuc

SEQ ID NO: 392336 - RNA, 21 nt, Bordetella pertussis
ugagacggaugcuugcggggc

SEQ ID NO: 392337 - RNA, 13 nt, Bordetella pertussis
ugagauugugcag

SEQ ID NO: 392338 - RNA, 14 nt, Bordetella pertussis
ugagcaagcgcugg

SEQ ID NO: 392339 - RNA, 15 nt, Bordetella pertussis
ugagcggcccgggcg

SEQ ID NO: 392340 - RNA, 22 nt, Bordetella pertussis
ugagcguaagcccacucacgca

SEQ ID NO: 392341 - RNA, 18 nt, Bordetella pertussis
ugagcugaugcucgcccu

SEQ ID NO: 392342 - RNA, 18 nt, Bordetella pertussis
ugaggaacggcaccagcc

SEQ ID NO: 392343 - RNA, 21 nt, Bordetella pertussis
ugaggaacuggacggcgcugg

SEQ ID NO: 392344 - RNA, 13 nt, Bordetella pertussis
ugagcugcgcgug

SEQ ID NO: 392345 - RNA, 19 nt, Bordetella pertussis
ugaggcgacgguggcuggg

SEQ ID NO: 392346 - RNA, 20 nt, Bordetella pertussis
ugaggcgacgguggcugggg

SEQ ID NO: 392347 - RNA, 16 nt, Bordetella pertussis
ugagggcgaucaugca

SEQ ID NO: 392348 - RNA, 12 nt, Bordetella pertussis
ugaggggccagc

SEQ ID NO: 392349 - RNA, 17 nt, Bordetella pertussis
ugaggggccagccuggc

SEQ ID NO: 392350 - RNA, 13 nt, Bordetella pertussis
ugagucuggagau

SEQ ID NO: 392351 - RNA, 16 nt, Bordetella pertussis
ugagugcccauggaga

SEQ ID NO: 392352 - RNA, 17 nt, Bordetella pertussis
ugaguucgcgcgccggc

SEQ ID NO: 392353 - RNA, 19 nt, Bordetella pertussis
ugauacguucagauacaaa

SEQ ID NO: 392354 - RNA, 19 nt, Bordetella pertussis
ugauagacauugcccagca

SEQ ID NO: 392355 - RNA, 17 nt, Bordetella pertussis
ugauaucgaagcgagug

SEQ ID NO: 392356 - RNA, 13 nt, Bordetella pertussis
ugaucagggccgc

SEQ ID NO: 392357 - RNA, 21 nt, Bordetella pertussis
ugauccgcaccggugggagcc

SEQ ID NO: 392358 - RNA, 12 nt, Bordetella pertussis
ugauccucgcca

SEQ ID NO: 392359 - RNA, 23 nt, Bordetella pertussis
ugaucgccagcgccggggucagc

SEQ ID NO: 392360 - RNA, 18 nt, Bordetella pertussis
ugaucgccggcgccccca

SEQ ID NO: 392361 - RNA, 16 nt, Bordetella pertussis
ugaucgcgcagcaccg

SEQ ID NO: 392362 - RNA, 12 nt, Bordetella pertussis
ugaucugcugcg

SEQ ID NO: 392363 - RNA, 15 nt, Bordetella pertussis
ugaucuggccgucga

SEQ ID NO: 392364 - RNA, 22 nt, Bordetella pertussis
ugaugacgaccuugcccgucag

SEQ ID NO: 392365 - RNA, 13 nt, Bordetella pertussis
ugaugauccugcu

SEQ ID NO: 392366 - RNA, 14 nt, Bordetella pertussis
ugaugauccugcug

SEQ ID NO: 392367 - RNA, 14 nt, Bordetella pertussis
ugaugauggccagg

SEQ ID NO: 392368 - RNA, 15 nt, Bordetella pertussis
ugaugauggccaggu

SEQ ID NO: 392369 - RNA, 22 nt, Bordetella pertussis
ugauuccaccuugccgcuuauc

SEQ ID NO: 392370 - RNA, 20 nt, Bordetella pertussis
ugauuccugucgcgcugcuu

SEQ ID NO: 392371 - RNA, 21 nt, Bordetella pertussis
ugcaaaagcguuccagcagau

SEQ ID NO: 392372 - RNA, 16 nt, Bordetella pertussis
ugcaaauucugcaaaa

SEQ ID NO: 392373 - RNA, 15 nt, Bordetella pertussis
ugcaacacgaccagc

SEQ ID NO: 392374 - RNA, 20 nt, Bordetella pertussis
ugcaaccgucggugaugcuc

SEQ ID NO: 392375 - RNA, 14 nt, Bordetella pertussis
ugcaaccuggucaa

SEQ ID NO: 392376 - RNA, 17 nt, Bordetella pertussis
ugcaagacgcccaggcc

SEQ ID NO: 392377 - RNA, 17 nt, Bordetella pertussis
ugcaagucuucuucagc

SEQ ID NO: 392378 - RNA, 22 nt, Bordetella pertussis
ugcaauuucucaagaaaaacaa

SEQ ID NO: 392379 - RNA, 21 nt, Bordetella pertussis
ugcacacgccuucggcgacuu

SEQ ID NO: 392380 - RNA, 21 nt, Bordetella pertussis
ugcacagguagaucagccgcu

SEQ ID NO: 392381 - RNA, 13 nt, Bordetella pertussis
ugcaccagcacau

SEQ ID NO: 392382 - RNA, 22 nt, Bordetella pertussis
ugcaccagcccgaugcgccagg

SEQ ID NO: 392383 - RNA, 16 nt, Bordetella pertussis
ugcaccgggccgaaca

SEQ ID NO: 392384 - RNA, 12 nt, Bordetella pertussis
ugcaccucagga

SEQ ID NO: 392385 - RNA, 18 nt, Bordetella pertussis
ugcacguagcgcagcacc

SEQ ID NO: 392386 - RNA, 23 nt, Bordetella pertussis
ugcacguagcgcagcaccggcag

SEQ ID NO: 392387 - RNA, 19 nt, Bordetella pertussis
ugcagaucaucggcgccau

SEQ ID NO: 392388 - RNA, 13 nt, Bordetella pertussis
ugcagaucugcac

SEQ ID NO: 392389 - RNA, 19 nt, Bordetella pertussis
ugcagcacacggucagcaa

SEQ ID NO: 392390 - RNA, 18 nt, Bordetella pertussis
ugcagccaguugggccag

SEQ ID NO: 392391 - RNA, 18 nt, Bordetella pertussis
ugcagccauucggccagg

SEQ ID NO: 392392 - RNA, 14 nt, Bordetella pertussis
ugcagcccagcacc

SEQ ID NO: 392393 - RNA, 15 nt, Bordetella pertussis
ugcagcccagcgcga

SEQ ID NO: 392394 - RNA, 19 nt, Bordetella pertussis
ugcagccgcaccagcgcau

SEQ ID NO: 392395 - RNA, 13 nt, Bordetella pertussis
ugcagcggcagca

SEQ ID NO: 392396 - RNA, 14 nt, Bordetella pertussis
ugcagcgucugcug

SEQ ID NO: 392397 - RNA, 19 nt, Bordetella pertussis
ugcagcgugauggggccgg

SEQ ID NO: 392398 - RNA, 16 nt, Bordetella pertussis
ugcaggucuucgggcg

SEQ ID NO: 392399 - RNA, 22 nt, Bordetella pertussis
ugcaggucgggauaguccagca

SEQ ID NO: 392400 - RNA, 14 nt, Bordetella pertussis
ugcagguggccagc

SEQ ID NO: 392401 - RNA, 16 nt, Bordetella pertussis
ugcagguugauuuccg

SEQ ID NO: 392402 - RNA, 16 nt, Bordetella pertussis
ugcaguacaggcgcgu

SEQ ID NO: 392403 - RNA, 16 nt, Bordetella pertussis
ugcaguucggcuuguu

SEQ ID NO: 392404 - RNA, 22 nt, Bordetella pertussis
ugcauucguccagguugucggc

SEQ ID NO: 392405 - RNA, 16 nt, Bordetella pertussis
ugccaccagcgcgcca

SEQ ID NO: 392406 - RNA, 18 nt, Bordetella pertussis
ugccaccagcgcgccagc

SEQ ID NO: 392407 - RNA, 22 nt, Bordetella pertussis
ugccaccagcgcgccagcagau

SEQ ID NO: 392408 - RNA, 23 nt, Bordetella pertussis
ugccggcauaggcggcgcaggcc

SEQ ID NO: 392409 - RNA, 15 nt, Bordetella pertussis
ugccggccagcagcg

SEQ ID NO: 392410 - RNA, 17 nt, Bordetella pertussis
ugccggccagccugccc

SEQ ID NO: 392411 - RNA, 23 nt, Bordetella pertussis
ugccggcccgguauuccucgacg

SEQ ID NO: 392412 - RNA, 15 nt, Bordetella pertussis
ugccggccgccucca

SEQ ID NO: 392413 - RNA, 16 nt, Bordetella pertussis
ugccggccgcccaggc

SEQ ID NO: 392414 - RNA, 23 nt, Bordetella pertussis
ugccggccgcccaggcgcagccg

SEQ ID NO: 392415 - RNA, 22 nt, Bordetella pertussis
ugccggccuggcgggccgaggc

SEQ ID NO: 392416 - RNA, 23 nt, Bordetella pertussis
ugccggcgcgcaaaccgacgcgg

SEQ ID NO: 392417 - RNA, 16 nt, Bordetella pertussis
ugccggcgcgggcgca

SEQ ID NO: 392418 - RNA, 19 nt, Bordetella pertussis
ugccgguaaccgacgcagc

SEQ ID NO: 392419 - RNA, 18 nt, Bordetella pertussis
ugccgguggacggccagc

SEQ ID NO: 392420 - RNA, 18 nt, Bordetella pertussis
ugccggugcucggccagc

SEQ ID NO: 392421 - RNA, 21 nt, Bordetella pertussis
ugccgguuuuuuugcgccgcu

SEQ ID NO: 392422 - RNA, 17 nt, Bordetella pertussis
ugccguaccaggugcgc

SEQ ID NO: 392423 - RNA, 19 nt, Bordetella pertussis
ugccguacgagugcaggcc

SEQ ID NO: 392424 - RNA, 14 nt, Bordetella pertussis
ugccguacuuggcg

SEQ ID NO: 392425 - RNA, 21 nt, Bordetella pertussis
ugccguagcccagguccagcg

SEQ ID NO: 392426 - RNA, 15 nt, Bordetella pertussis
ugccguccugcugcg

SEQ ID NO: 392427 - RNA, 14 nt, Bordetella pertussis
ugccguccuggccg

SEQ ID NO: 392428 - RNA, 21 nt, Bordetella pertussis
ugccguccuggcgaccggcgg

SEQ ID NO: 392429 - RNA, 13 nt, Bordetella pertussis
ugccgucggccgc

SEQ ID NO: 392430 - RNA, 15 nt, Bordetella pertussis
ugccgucggccgcgc

SEQ ID NO: 392431 - RNA, 14 nt, Bordetella pertussis
ugccugcagcgcgc

SEQ ID NO: 392432 - RNA, 13 nt, Bordetella pertussis
ugccugccgagcg

SEQ ID NO: 392433 - RNA, 16 nt, Bordetella pertussis
ugccugccgccugcca

SEQ ID NO: 392434 - RNA, 18 nt, Bordetella pertussis
ugccugcgaacgcccggc

SEQ ID NO: 392435 - RNA, 14 nt, Bordetella pertussis
ugccugucccaacc

SEQ ID NO: 392436 - RNA, 12 nt, Bordetella pertussis
ugccugucccag

SEQ ID NO: 392437 - RNA, 13 nt, Bordetella pertussis
ugccuguccccac

SEQ ID NO: 392438 - RNA, 18 nt, Bordetella pertussis
ugccuguccccacagggg

SEQ ID NO: 392439 - RNA, 19 nt, Bordetella pertussis
ugccuguccccacaugggg

SEQ ID NO: 392440 - RNA, 20 nt, Bordetella pertussis
ugccuguccccaccgggaca

SEQ ID NO: 392441 - RNA, 24 nt, Bordetella pertussis
ugccuguccccaccgggacaggca

SEQ ID NO: 392442 - RNA, 17 nt, Bordetella pertussis
ugccuguccccacgggg

SEQ ID NO: 392443 - RNA, 24 nt, Bordetella pertussis
ugccuguccccacguggacaggca

SEQ ID NO: 392444 - RNA, 17 nt, Bordetella pertussis
ugccuguccccacuggg

SEQ ID NO: 392445 - RNA, 14 nt, Bordetella pertussis
ugccuguccccgaa

SEQ ID NO: 392446 - RNA, 17 nt, Bordetella pertussis
ugccuguccccgaacgg

SEQ ID NO: 392447 - RNA, 19 nt, Bordetella pertussis
ugccuguccccgcacgggg

SEQ ID NO: 392448 - RNA, 22 nt, Bordetella pertussis
ugccuguccccgcacggggaca

SEQ ID NO: 392449 - RNA, 18 nt, Bordetella pertussis
ugccuguccccgcuggga

SEQ ID NO: 392450 - RNA, 20 nt, Bordetella pertussis
ugccuguccccgcugggaca

SEQ ID NO: 392451 - RNA, 13 nt, Bordetella pertussis
ugccuuggggcgg

SEQ ID NO: 392452 - RNA, 15 nt, Bordetella pertussis
ugcgaaacagcagcg

SEQ ID NO: 392453 - RNA, 20 nt, Bordetella pertussis
ugcgaaacccgcugggccag

SEQ ID NO: 392454 - RNA, 21 nt, Bordetella pertussis
ugcgaaacccgcugggccagc

SEQ ID NO: 392455 - RNA, 18 nt, Bordetella pertussis
ugcgaaagccggccuccg

SEQ ID NO: 392456 - RNA, 13 nt, Bordetella pertussis
ugcgaaaggccga

SEQ ID NO: 392457 - RNA, 19 nt, Bordetella pertussis
ugcgaggaaugcggcggga

SEQ ID NO: 392458 - RNA, 18 nt, Bordetella pertussis
ugcgaggcccggccugcg

SEQ ID NO: 392459 - RNA, 16 nt, Bordetella pertussis
ugcgaggugcccgcga

SEQ ID NO: 392460 - RNA, 23 nt, Bordetella pertussis
ugcgaggugcccgcgaagcagcc

SEQ ID NO: 392461 - RNA, 15 nt, Bordetella pertussis
ugcgaucggccucgg

SEQ ID NO: 392462 - RNA, 23 nt, Bordetella pertussis
ugcgauggaacucguuggccagc

SEQ ID NO: 392463 - RNA, 17 nt, Bordetella pertussis
ugcgcaauucuuccucc

SEQ ID NO: 392464 - RNA, 17 nt, Bordetella pertussis
ugcgcaccaccgccgau

SEQ ID NO: 392465 - RNA, 13 nt, Bordetella pertussis
ugcgcaccggccg

SEQ ID NO: 392466 - RNA, 17 nt, Bordetella pertussis
ugcgcacgauggggccg

SEQ ID NO: 392467 - RNA, 21 nt, Bordetella pertussis
ugcgcacggacagcccgcgcu

SEQ ID NO: 392468 - RNA, 24 nt, Bordetella pertussis
ugcgccacagcaugaccucggccu

SEQ ID NO: 392469 - RNA, 22 nt, Bordetella pertussis
ugcgccaccagcuugcgcgccg

SEQ ID NO: 392470 - RNA, 16 nt, Bordetella pertussis
ugcgccacgcccgucc

SEQ ID NO: 392471 - RNA, 13 nt, Bordetella pertussis
ugcgccacgcccg

SEQ ID NO: 392472 - RNA, 21 nt, Bordetella pertussis
ugcgccagccgcgccugcagc

SEQ ID NO: 392473 - RNA, 13 nt, Bordetella pertussis
ugcgccagcgcga

SEQ ID NO: 392474 - RNA, 20 nt, Bordetella pertussis
ugcgccagcggcgacugccc

SEQ ID NO: 392475 - RNA, 23 nt, Bordetella pertussis
ugcgccagcuugcgcgccuuggc

SEQ ID NO: 392476 - RNA, 18 nt, Bordetella pertussis
ugcgccaguccagcgcgc

SEQ ID NO: 392477 - RNA, 23 nt, Bordetella pertussis
ugcgcccgacgcuguaacaacac

SEQ ID NO: 392478 - RNA, 21 nt, Bordetella pertussis
ugcgcccgcuacgcgggcuug

SEQ ID NO: 392479 - RNA, 21 nt, Bordetella pertussis
ugcgcccgcuaugcgggcuug

SEQ ID NO: 392480 - RNA, 18 nt, Bordetella pertussis
ugcgccgcaccagcgccg

SEQ ID NO: 392481 - RNA, 22 nt, Bordetella pertussis
ugcgccgcaccagcgccgacgg

SEQ ID NO: 392482 - RNA, 22 nt, Bordetella pertussis
ugcgccgccgccgcggccuggc

SEQ ID NO: 392483 - RNA, 21 nt, Bordetella pertussis
ugcgccgccgcgcgcuggcug

SEQ ID NO: 392484 - RNA, 23 nt, Bordetella pertussis
ugcgccgccgcgcgcuggcugug

SEQ ID NO: 392485 - RNA, 20 nt, Bordetella pertussis
ugcgccgccggccugcugca

SEQ ID NO: 392486 - RNA, 12 nt, Bordetella pertussis
ugcgccgcggcg

SEQ ID NO: 392487 - RNA, 20 nt, Bordetella pertussis
ugcgccgcggcgcuggaugg

SEQ ID NO: 392488 - RNA, 22 nt, Bordetella pertussis
ugcgccgcgccguacagggccg

SEQ ID NO: 392489 - RNA, 17 nt, Bordetella pertussis
ugcgccgcuacgcggcg

SEQ ID NO: 392490 - RNA, 17 nt, Bordetella pertussis
ugcgccgcuuccggccg

SEQ ID NO: 392491 - RNA, 17 nt, Bordetella pertussis
ugcgccggcauggccaa

SEQ ID NO: 392492 - RNA, 14 nt, Bordetella pertussis
ugcgccggcccggc

SEQ ID NO: 392493 - RNA, 15 nt, Bordetella pertussis
ugcgccggcgcggcg

SEQ ID NO: 392494 - RNA, 21 nt, Bordetella pertussis
ugcgccgggcgcggccaggcg

SEQ ID NO: 392495 - RNA, 13 nt, Bordetella pertussis
ugcgcuggcuggg

SEQ ID NO: 392496 - RNA, 16 nt, Bordetella pertussis
ugcgcuggcugggccu

SEQ ID NO: 392497 - RNA, 15 nt, Bordetella pertussis
ugcgcugggccaggc

SEQ ID NO: 392498 - RNA, 16 nt, Bordetella pertussis
ugcgcugggccaggcc

SEQ ID NO: 392499 - RNA, 17 nt, Bordetella pertussis
ugcgcuuuuuucuccag

SEQ ID NO: 392500 - RNA, 21 nt, Bordetella pertussis
ugcggcaccucggccggggcg

SEQ ID NO: 392501 - RNA, 17 nt, Bordetella pertussis
ugcggcaccugcugcuu

SEQ ID NO: 392502 - RNA, 21 nt, Bordetella pertussis
ugcggcagcagggccacgccc

SEQ ID NO: 392503 - RNA, 21 nt, Bordetella pertussis
ugcggcagcgacucgccgugc

SEQ ID NO: 392504 - RNA, 12 nt, Bordetella pertussis
ugcggcagcgcc

SEQ ID NO: 392505 - RNA, 17 nt, Bordetella pertussis
ugcggcacggcuggguu

SEQ ID NO: 392506 - RNA, 14 nt, Bordetella pertussis
ugcggcaggccgca

SEQ ID NO: 392507 - RNA, 15 nt, Bordetella pertussis
ugcggcgcaugcugc

SEQ ID NO: 392508 - RNA, 20 nt, Bordetella pertussis
ugcggcgccggugcgcggcg

SEQ ID NO: 392509 - RNA, 22 nt, Bordetella pertussis
ugcggcgcgaccugcgcgaccg

SEQ ID NO: 392510 - RNA, 22 nt, Bordetella pertussis
ugcggcgcggcggugccugucc

SEQ ID NO: 392511 - RNA, 14 nt, Bordetella pertussis
ugcggcggcgacuc

SEQ ID NO: 392512 - RNA, 13 nt, Bordetella pertussis
ugcggcgggcggg

SEQ ID NO: 392513 - RNA, 17 nt, Bordetella pertussis
ugcggcgggcgggucga

SEQ ID NO: 392514 - RNA, 18 nt, Bordetella pertussis
ugcggcggcgggcggccg

SEQ ID NO: 392515 - RNA, 13 nt, Bordetella pertussis
ugcgggacaggca

SEQ ID NO: 392516 - RNA, 20 nt, Bordetella pertussis
ugcgggacaggcaucagguu

SEQ ID NO: 392517 - RNA, 16 nt, Bordetella pertussis
ugcgggacggccaggg

SEQ ID NO: 392518 - RNA, 15 nt, Bordetella pertussis
ugcggucggccacau

SEQ ID NO: 392519 - RNA, 13 nt, Bordetella pertussis
ugcggugccuguc

SEQ ID NO: 392520 - RNA, 15 nt, Bordetella pertussis
ugcggugccuguccc

SEQ ID NO: 392521 - RNA, 18 nt, Bordetella pertussis
ugcgguucgucagggccg

SEQ ID NO: 392522 - RNA, 19 nt, Bordetella pertussis
ugcgguucgucagggccgc

SEQ ID NO: 392523 - RNA, 20 nt, Bordetella pertussis
ugcgguucgucagggccgca

SEQ ID NO: 392524 - RNA, 18 nt, Bordetella pertussis
ugcgguucugggcccgau

SEQ ID NO: 392525 - RNA, 23 nt, Bordetella pertussis
ugcgucacgaaagcgcccaggcc

SEQ ID NO: 392526 - RNA, 21 nt, Bordetella pertussis
ugcgucagggcaaagaaauug

SEQ ID NO: 392527 - RNA, 17 nt, Bordetella pertussis
ugcguccgccgugcagg

SEQ ID NO: 392528 - RNA, 23 nt, Bordetella pertussis
ugcguccgccgugcaggcccggg

SEQ ID NO: 392529 - RNA, 17 nt, Bordetella pertussis
ugcgugacccggggcag

SEQ ID NO: 392530 - RNA, 19 nt, Bordetella pertussis
ugcgugacccggggcagga

SEQ ID NO: 392531 - RNA, 16 nt, Bordetella pertussis
ugcgugcgcccauggc

SEQ ID NO: 392532 - RNA, 16 nt, Bordetella pertussis
ugcgugcgccuguccc

SEQ ID NO: 392533 - RNA, 18 nt, Bordetella pertussis
ugcgugcgggacaggcau

SEQ ID NO: 392534 - RNA, 14 nt, Bordetella pertussis
ugcguggcgggccg

SEQ ID NO: 392535 - RNA, 19 nt, Bordetella pertussis
ugcucaaccucgacgcgca

SEQ ID NO: 392536 - RNA, 14 nt, Bordetella pertussis
ugcucagcagcacc

SEQ ID NO: 392537 - RNA, 14 nt, Bordetella pertussis
ugcucaucggcagg

SEQ ID NO: 392538 - RNA, 16 nt, Bordetella pertussis
ugcucauggcggcacg

SEQ ID NO: 392539 - RNA, 12 nt, Bordetella pertussis
ugcuccaccacc

SEQ ID NO: 392540 - RNA, 15 nt, Bordetella pertussis
ugcuccacgugcggc

SEQ ID NO: 392541 - RNA, 17 nt, Bordetella pertussis
ugcuccagaacgcgccg

SEQ ID NO: 392542 - RNA, 19 nt, Bordetella pertussis
ugcuccagcuugcaaaagc

SEQ ID NO: 392543 - RNA, 18 nt, Bordetella pertussis
ugcuccgguacgccugca

SEQ ID NO: 392544 - RNA, 21 nt, Bordetella pertussis
ugcuccgguacgccugcaccg

SEQ ID NO: 392545 - RNA, 23 nt, Bordetella pertussis
ugcucgaaaugcgcguuggccug

SEQ ID NO: 392546 - RNA, 24 nt, Bordetella pertussis
ugcucgacagcagcccgcuggccg

SEQ ID NO: 392547 - RNA, 19 nt, Bordetella pertussis
ugcucgaccaggucgccgu

SEQ ID NO: 392548 - RNA, 18 nt, Bordetella pertussis
ugcucgauaugcagcacc

SEQ ID NO: 392549 - RNA, 15 nt, Bordetella pertussis
ugcucgaugccggcc

SEQ ID NO: 392550 - RNA, 12 nt, Bordetella pertussis
ugcucgcaggcc

SEQ ID NO: 392551 - RNA, 13 nt, Bordetella pertussis
ugcucgcaggccu

SEQ ID NO: 392552 - RNA, 21 nt, Bordetella pertussis
ugcucgcccacauagcggccg

SEQ ID NO: 392553 - RNA, 15 nt, Bordetella pertussis
ugcucgccggccagc

SEQ ID NO: 392554 - RNA, 12 nt, Bordetella pertussis
ugcucgccggcc

SEQ ID NO: 392555 - RNA, 17 nt, Bordetella pertussis
ugcucgcgcgcaguccu

SEQ ID NO: 392556 - RNA, 19 nt, Bordetella pertussis
ugcucgcggauuugcuuca

SEQ ID NO: 392557 - RNA, 16 nt, Bordetella pertussis
ugcucggccagcgcgc

SEQ ID NO: 392558 - RNA, 21 nt, Bordetella pertussis
ugcucggcggucagcgcggcg

SEQ ID NO: 392559 - RNA, 17 nt, Bordetella pertussis
ugcucgggacgcaggcc

SEQ ID NO: 392560 - RNA, 19 nt, Bordetella pertussis
ugcucgggacgcaggccca

SEQ ID NO: 392561 - RNA, 16 nt, Bordetella pertussis
ugcucggugcgggccg

SEQ ID NO: 392562 - RNA, 21 nt, Bordetella pertussis
ugcucgucgccaugcggcugg

SEQ ID NO: 392563 - RNA, 17 nt, Bordetella pertussis
ugcucuacaccaucaac

SEQ ID NO: 392564 - RNA, 15 nt, Bordetella pertussis
ugcucuugaccuggg

SEQ ID NO: 392565 - RNA, 21 nt, Bordetella pertussis
ugcucuugaccugggccagca

SEQ ID NO: 392566 - RNA, 22 nt, Bordetella pertussis
ugcugaacgcgcgugaacggcu

SEQ ID NO: 392567 - RNA, 14 nt, Bordetella pertussis
ugcugaccaccggg

SEQ ID NO: 392568 - RNA, 21 nt, Bordetella pertussis
ugcugacugugcagccacgcc

SEQ ID NO: 392569 - RNA, 15 nt, Bordetella pertussis
ugcugauccuggcau

SEQ ID NO: 392570 - RNA, 18 nt, Bordetella pertussis
ugcugauccuggcauuga

SEQ ID NO: 392571 - RNA, 18 nt, Bordetella pertussis
ugcugcagcgucuggcac

SEQ ID NO: 392572 - RNA, 17 nt, Bordetella pertussis
ugcugcacgugaugcag

SEQ ID NO: 392573 - RNA, 15 nt, Bordetella pertussis
ugcugcaguugcgcc

SEQ ID NO: 392574 - RNA, 13 nt, Bordetella pertussis
ugcugcauguccu

SEQ ID NO: 392575 - RNA, 21 nt, Bordetella pertussis
ugcugccaugccgcgcgccuu

SEQ ID NO: 392576 - RNA, 14 nt, Bordetella pertussis
ugcugccccccgag

SEQ ID NO: 392577 - RNA, 22 nt, Bordetella pertussis
ugcugcccgacggcgccgaucc

SEQ ID NO: 392578 - RNA, 18 nt, Bordetella pertussis
ugcugcccgccgccgccc

SEQ ID NO: 392579 - RNA, 14 nt, Bordetella pertussis
ugcugccgucgcca

SEQ ID NO: 392580 - RNA, 15 nt, Bordetella pertussis
ugcugccgucggcgu

SEQ ID NO: 392581 - RNA, 16 nt, Bordetella pertussis
ugcugccgucggcguu

SEQ ID NO: 392582 - RNA, 15 nt, Bordetella pertussis
ugcugccguuucuca

SEQ ID NO: 392583 - RNA, 20 nt, Bordetella pertussis
ugcugcgacagcagggccag

SEQ ID NO: 392584 - RNA, 15 nt, Bordetella pertussis
ugcugcgccuggccg

SEQ ID NO: 392585 - RNA, 22 nt, Bordetella pertussis
ugcugcggcacggccagcggcg

SEQ ID NO: 392586 - RNA, 22 nt, Bordetella pertussis
ugcugcugcagccacuggaaca

SEQ ID NO: 392587 - RNA, 13 nt, Bordetella pertussis
ugcugcugggcgc

SEQ ID NO: 392588 - RNA, 16 nt, Bordetella pertussis
ugcugcuguuuuucau

SEQ ID NO: 392589 - RNA, 22 nt, Bordetella pertussis
ugcugcuugaccuuggcuugca

SEQ ID NO: 392590 - RNA, 16 nt, Bordetella pertussis
ugcuggaccugcuguu

SEQ ID NO: 392591 - RNA, 16 nt, Bordetella pertussis
ugcuggaccuggccac

SEQ ID NO: 392592 - RNA, 18 nt, Bordetella pertussis
ugcuggccaagcgcgccg

SEQ ID NO: 392593 - RNA, 12 nt, Bordetella pertussis
ugcuggccgcgg

SEQ ID NO: 392594 - RNA, 13 nt, Bordetella pertussis
ugcuggcccagga

SEQ ID NO: 392595 - RNA, 22 nt, Bordetella pertussis
ugcuggcgcagcagcgccggca

SEQ ID NO: 392596 - RNA, 22 nt, Bordetella pertussis
ugcuggcucguucgcucggcgu

SEQ ID NO: 392597 - RNA, 13 nt, Bordetella pertussis
ugcuggcugcccu

SEQ ID NO: 392598 - RNA, 23 nt, Bordetella pertussis
ugcugggcaugauggugcugccg

SEQ ID NO: 392599 - RNA, 12 nt, Bordetella pertussis
ugcugggccauc

SEQ ID NO: 392600 - RNA, 13 nt, Bordetella pertussis
ugcugggccaugc

SEQ ID NO: 392601 - RNA, 12 nt, Bordetella pertussis
ugcugggccggg

SEQ ID NO: 392602 - RNA, 14 nt, Bordetella pertussis
ugcugggccgggug

SEQ ID NO: 392603 - RNA, 14 nt, Bordetella pertussis
ugcuggggguuggc

SEQ ID NO: 392604 - RNA, 21 nt, Bordetella pertussis
ugcugguacagccccagcgcc

SEQ ID NO: 392605 - RNA, 19 nt, Bordetella pertussis
ugcuggucagccugggcgc

SEQ ID NO: 392606 - RNA, 19 nt, Bordetella pertussis
ugcuggucgcgggccaggc

SEQ ID NO: 392607 - RNA, 20 nt, Bordetella pertussis
ugcuggucgcgggccaggcc

SEQ ID NO: 392608 - RNA, 13 nt, Bordetella pertussis
ugcuggucggcgu

SEQ ID NO: 392609 - RNA, 23 nt, Bordetella pertussis
ugcuggugccgcuggcggcccug

SEQ ID NO: 392610 - RNA, 19 nt, Bordetella pertussis
ugcuguccagucuggaugg

SEQ ID NO: 392611 - RNA, 20 nt, Bordetella pertussis
ugcugucgcgcgacuggccc

SEQ ID NO: 392612 - RNA, 16 nt, Bordetella pertussis
ugcuuauaggcuuuca

SEQ ID NO: 392613 - RNA, 17 nt, Bordetella pertussis
ugcuugccauaggccag

SEQ ID NO: 392614 - RNA, 13 nt, Bordetella pertussis
ugcuugcccagca

SEQ ID NO: 392615 - RNA, 13 nt, Bordetella pertussis
ugcuugccugucc

SEQ ID NO: 392616 - RNA, 21 nt, Bordetella pertussis
ugcuugcgauaggugcgcagc

SEQ ID NO: 392617 - RNA, 15 nt, Bordetella pertussis
ugcuuggcagccuug

SEQ ID NO: 392618 - RNA, 18 nt, Bordetella pertussis
ugcuuggcgcgcagcagc

SEQ ID NO: 392619 - RNA, 15 nt, Bordetella pertussis
ugcuuucggcgacuu

SEQ ID NO: 392620 - RNA, 20 nt, Bordetella pertussis
uggaaauccuuggggucgcu

SEQ ID NO: 392621 - RNA, 16 nt, Bordetella pertussis
uggaacaccaugcccg

SEQ ID NO: 392622 - RNA, 15 nt, Bordetella pertussis
uggaacauggcccgg

SEQ ID NO: 392623 - RNA, 17 nt, Bordetella pertussis
uggaaccgguuggccag

SEQ ID NO: 392624 - RNA, 18 nt, Bordetella pertussis
uggaaccgguuggccagc

SEQ ID NO: 392625 - RNA, 21 nt, Bordetella pertussis
uggaacuugggaucggccagg

SEQ ID NO: 392626 - RNA, 13 nt, Bordetella pertussis
uggaagcgcgcca

SEQ ID NO: 392627 - RNA, 15 nt, Bordetella pertussis
uggaagcuggccagc

SEQ ID NO: 392628 - RNA, 23 nt, Bordetella pertussis
uggaagguccacggcauggccag

SEQ ID NO: 392629 - RNA, 17 nt, Bordetella pertussis
uggaaucauuggccagc

SEQ ID NO: 392630 - RNA, 18 nt, Bordetella pertussis
uggacagauccagcgcgg

SEQ ID NO: 392631 - RNA, 10 nt, Bordetella pertussis
uggacaggcg

SEQ ID NO: 392632 - RNA, 21 nt, Bordetella pertussis
uggacaggcgugcgcagcugu

SEQ ID NO: 392633 - RNA, 22 nt, Bordetella pertussis
uggacaggcgugcgcagcuguu

SEQ ID NO: 392634 - RNA, 20 nt, Bordetella pertussis
uggaccccaguuccagcacg

SEQ ID NO: 392635 - RNA, 14 nt, Bordetella pertussis
uggaccccgugguc

SEQ ID NO: 392636 - RNA, 13 nt, Bordetella pertussis
uggaccgccgccg

SEQ ID NO: 392637 - RNA, 15 nt, Bordetella pertussis
uggaccgccuggccu

SEQ ID NO: 392638 - RNA, 19 nt, Bordetella pertussis
uggaccgcgcgcgacgaca

SEQ ID NO: 392639 - RNA, 22 nt, Bordetella pertussis
uggaccugccguucgcgcugcc

SEQ ID NO: 392640 - RNA, 21 nt, Bordetella pertussis
uggacgagggccggcgccagc

SEQ ID NO: 392641 - RNA, 19 nt, Bordetella pertussis
uggacgccgccggcccagg

SEQ ID NO: 392642 - RNA, 21 nt, Bordetella pertussis
uggacgcgccgaacaccagcu

SEQ ID NO: 392643 - RNA, 15 nt, Bordetella pertussis
uggacgcgcgcggcg

SEQ ID NO: 392644 - RNA, 12 nt, Bordetella pertussis
uggacggccagc

SEQ ID NO: 392645 - RNA, 13 nt, Bordetella pertussis
uggacggcgcugg

SEQ ID NO: 392646 - RNA, 17 nt, Bordetella pertussis
uggagaacgagccggcc

SEQ ID NO: 392647 - RNA, 17 nt, Bordetella pertussis
uggagaauucggcgcgu

SEQ ID NO: 392648 - RNA, 19 nt, Bordetella pertussis
uggagacguagccgcugcc

SEQ ID NO: 392649 - RNA, 20 nt, Bordetella pertussis
uggagacgucuucguacagc

SEQ ID NO: 392650 - RNA, 18 nt, Bordetella pertussis
uggagacuggcaccggcc

SEQ ID NO: 392651 - RNA, 13 nt, Bordetella pertussis
uggagaucaugac

SEQ ID NO: 392652 - RNA, 21 nt, Bordetella pertussis
uggagauggguacagcgcgcc

SEQ ID NO: 392653 - RNA, 17 nt, Bordetella pertussis
uggagaugugcccgaga

SEQ ID NO: 392654 - RNA, 13 nt, Bordetella pertussis
uggagccaggcgg

SEQ ID NO: 392655 - RNA, 16 nt, Bordetella pertussis
uggaggcgcagcgcgg

SEQ ID NO: 392656 - RNA, 18 nt, Bordetella pertussis
uggaggcgcagcgcggca

SEQ ID NO: 392657 - RNA, 14 nt, Bordetella pertussis
uggaggggcgcagg

SEQ ID NO: 392658 - RNA, 14 nt, Bordetella pertussis
uggaguagccgcuc

SEQ ID NO: 392659 - RNA, 17 nt, Bordetella pertussis
uggagucgggcugcugc

SEQ ID NO: 392660 - RNA, 20 nt, Bordetella pertussis
uggaguucuucuuggccaga

SEQ ID NO: 392661 - RNA, 13 nt, Bordetella pertussis
uggaucaggguga

SEQ ID NO: 392662 - RNA, 19 nt, Bordetella pertussis
uggaucgcgcccagcgagc

SEQ ID NO: 392663 - RNA, 21 nt, Bordetella pertussis
uggaugcguucgaaagccagc

SEQ ID NO: 392664 - RNA, 12 nt, Bordetella pertussis
uggauggccugg

SEQ ID NO: 392665 - RNA, 21 nt, Bordetella pertussis
uggauggcggccgccagcgcc

SEQ ID NO: 392666 - RNA, 16 nt, Bordetella pertussis
uggauggcguauggaa

SEQ ID NO: 392667 - RNA, 17 nt, Bordetella pertussis
uggauggcucgggcagc

SEQ ID NO: 392668 - RNA, 21 nt, Bordetella pertussis
uggauggcucgggcagcagca

SEQ ID NO: 392669 - RNA, 19 nt, Bordetella pertussis
uggauggucacgcccaggc

SEQ ID NO: 392670 - RNA, 15 nt, Bordetella pertussis
uggaugugcaggccg

SEQ ID NO: 392671 - RNA, 15 nt, Bordetella pertussis
uggaugucggugaag

SEQ ID NO: 392672 - RNA, 19 nt, Bordetella pertussis
uggaugucggugaaggcca

SEQ ID NO: 392673 - RNA, 21 nt, Bordetella pertussis
uggcaaccucgccgcgccagc

SEQ ID NO: 392674 - RNA, 15 nt, Bordetella pertussis
uggcagaugcgcgcc

SEQ ID NO: 392675 - RNA, 15 nt, Bordetella pertussis
uggcaggugcggccg

SEQ ID NO: 392676 - RNA, 14 nt, Bordetella pertussis
uggcagucagccgu

SEQ ID NO: 392677 - RNA, 18 nt, Bordetella pertussis
uggcaucagggcgaugcc

SEQ ID NO: 392678 - RNA, 23 nt, Bordetella pertussis
uggcaucgggcagggcuuccagu

SEQ ID NO: 392679 - RNA, 17 nt, Bordetella pertussis
uggcaucgucgcgcugc

SEQ ID NO: 392680 - RNA, 22 nt, Bordetella pertussis
uggcaugagcgccucguuccug

SEQ ID NO: 392681 - RNA, 20 nt, Bordetella pertussis
uggcauggcgcgugcgcgcg

SEQ ID NO: 392682 - RNA, 22 nt, Bordetella pertussis
uggcauggcgcgugcgcgcgcc

SEQ ID NO: 392683 - RNA, 22 nt, Bordetella pertussis
uggcaugugccaccgcccaggc

SEQ ID NO: 392684 - RNA, 13 nt, Bordetella pertussis
uggcaugcggcgg

SEQ ID NO: 392685 - RNA, 21 nt, Bordetella pertussis
uggccaccagguagggcagca

SEQ ID NO: 392686 - RNA, 14 nt, Bordetella pertussis
uggccacgcugcug

SEQ ID NO: 392687 - RNA, 16 nt, Bordetella pertussis
uggccacggcccuggu

SEQ ID NO: 392688 - RNA, 15 nt, Bordetella pertussis
uggccacggccgcga

SEQ ID NO: 392689 - RNA, 17 nt, Bordetella pertussis
uggccauguccuggcag

SEQ ID NO: 392690 - RNA, 22 nt, Bordetella pertussis
uggccauguccuggcaggccgc

SEQ ID NO: 392691 - RNA, 20 nt, Bordetella pertussis
uggccauuccuuccgggccc

SEQ ID NO: 392692 - RNA, 17 nt, Bordetella pertussis
uggcccaagcccguggc

SEQ ID NO: 392693 - RNA, 13 nt, Bordetella pertussis
uggcccagcaccg

SEQ ID NO: 392694 - RNA, 15 nt, Bordetella pertussis
uggcccagcaccgcc

SEQ ID NO: 392695 - RNA, 20 nt, Bordetella pertussis
uggcccagcuccagcuggcg

SEQ ID NO: 392696 - RNA, 16 nt, Bordetella pertussis
uggcccagcugggcgg

SEQ ID NO: 392697 - RNA, 22 nt, Bordetella pertussis
uggcccaggccgaaccacagca

SEQ ID NO: 392698 - RNA, 18 nt, Bordetella pertussis
uggcccaguucgcgcagc

SEQ ID NO: 392699 - RNA, 13 nt, Bordetella pertussis
uggccccaggcgu

SEQ ID NO: 392700 - RNA, 14 nt, Bordetella pertussis
uggccccaggcgug

SEQ ID NO: 392701 - RNA, 15 nt, Bordetella pertussis
uggccccgggcgggu

SEQ ID NO: 392702 - RNA, 21 nt, Bordetella pertussis
uggcccgaacggcccauccau

SEQ ID NO: 392703 - RNA, 23 nt, Bordetella pertussis
uggcccgaauuccagcucugcuc

SEQ ID NO: 392704 - RNA, 13 nt, Bordetella pertussis
uggcccgccacca

SEQ ID NO: 392705 - RNA, 19 nt, Bordetella pertussis
uggcccggcaccguccagc

SEQ ID NO: 392706 - RNA, 22 nt, Bordetella pertussis
uggcccggcgggaacaggcacc

SEQ ID NO: 392707 - RNA, 17 nt, Bordetella pertussis
uggcccggcucgccgag

SEQ ID NO: 392708 - RNA, 17 nt, Bordetella pertussis
uggcccgggugccuguc

SEQ ID NO: 392709 - RNA, 23 nt, Bordetella pertussis
uggcccugcagcggccaguccac

SEQ ID NO: 392710 - RNA, 17 nt, Bordetella pertussis
uggcccugcuggggugg

SEQ ID NO: 392711 - RNA, 16 nt, Bordetella pertussis
uggcccuggcaugugc

SEQ ID NO: 392712 - RNA, 16 nt, Bordetella pertussis
uggcccuggcgggccg

SEQ ID NO: 392713 - RNA, 14 nt, Bordetella pertussis
uggcccuucuucag

SEQ ID NO: 392714 - RNA, 19 nt, Bordetella pertussis
uggcccuugcccagcgugu

SEQ ID NO: 392715 - RNA, 18 nt, Bordetella pertussis
uggcccuuggucugcagg

SEQ ID NO: 392716 - RNA, 16 nt, Bordetella pertussis
uggccgaacgccgccg

SEQ ID NO: 392717 - RNA, 21 nt, Bordetella pertussis
uggccgacagcgucgagcuga

SEQ ID NO: 392718 - RNA, 16 nt, Bordetella pertussis
uggccugcccuggacg

SEQ ID NO: 392719 - RNA, 15 nt, Bordetella pertussis
uggccugccgcgccg

SEQ ID NO: 392720 - RNA, 23 nt, Bordetella pertussis
uggccugccgcgccgaccggccc

SEQ ID NO: 392721 - RNA, 16 nt, Bordetella pertussis
uggccugcggaugcag

SEQ ID NO: 392722 - RNA, 17 nt, Bordetella pertussis
uggccugcuugaagacg

SEQ ID NO: 392723 - RNA, 23 nt, Bordetella pertussis
uggccugcuugaagacgcccagg

SEQ ID NO: 392724 - RNA, 17 nt, Bordetella pertussis
uggccuggguggccagc

SEQ ID NO: 392725 - RNA, 18 nt, Bordetella pertussis
uggccugguuggccgccu

SEQ ID NO: 392726 - RNA, 18 nt, Bordetella pertussis
uggccuucgaccugcccg

SEQ ID NO: 392727 - RNA, 13 nt, Bordetella pertussis
uggccuucuucac

SEQ ID NO: 392728 - RNA, 14 nt, Bordetella pertussis
uggccuugacggcg

SEQ ID NO: 392729 - RNA, 15 nt, Bordetella pertussis
uggccuugcccaggc

SEQ ID NO: 392730 - RNA, 22 nt, Bordetella pertussis
uggccuugcccuuggcggccuu

SEQ ID NO: 392731 - RNA, 21 nt, Bordetella pertussis
uggccuugcgcguccaggcca

SEQ ID NO: 392732 - RNA, 21 nt, Bordetella pertussis
uggccuugcgcuuuuuucucc

SEQ ID NO: 392733 - RNA, 12 nt, Bordetella pertussis
uggcgaugcuca

SEQ ID NO: 392734 - RNA, 19 nt, Bordetella pertussis
uggcgauggccgccagcgu

SEQ ID NO: 392735 - RNA, 15 nt, Bordetella pertussis
uggcgauggccugau

SEQ ID NO: 392736 - RNA, 18 nt, Bordetella pertussis
uggcgcaagacgcggcag

SEQ ID NO: 392737 - RNA, 23 nt, Bordetella pertussis
uggcgcaaggcaugcgccagcgc

SEQ ID NO: 392738 - RNA, 13 nt, Bordetella pertussis
uggcgcaccaggc

SEQ ID NO: 392739 - RNA, 14 nt, Bordetella pertussis
uggcgcaccgcgcu

SEQ ID NO: 392740 - RNA, 19 nt, Bordetella pertussis
uggcgcacgaugaggccga

SEQ ID NO: 392741 - RNA, 22 nt, Bordetella pertussis
uggcgcagcacgccgcgccagg

SEQ ID NO: 392742 - RNA, 22 nt, Bordetella pertussis
uggcgcagcaggcgcgcggccu

SEQ ID NO: 392743 - RNA, 20 nt, Bordetella pertussis
uggcgcagcauuucuuccag

SEQ ID NO: 392744 - RNA, 13 nt, Bordetella pertussis
uggcgcagguccu

SEQ ID NO: 392745 - RNA, 16 nt, Bordetella pertussis
uggcgcaguaucccgg

SEQ ID NO: 392746 - RNA, 21 nt, Bordetella pertussis
uggcgcaguaucccggccagg

SEQ ID NO: 392747 - RNA, 16 nt, Bordetella pertussis
uggcgccagcccgccc

SEQ ID NO: 392748 - RNA, 13 nt, Bordetella pertussis
uggcgccaugcga

SEQ ID NO: 392749 - RNA, 16 nt, Bordetella pertussis
uggcgcccgccugcgc

SEQ ID NO: 392750 - RNA, 20 nt, Bordetella pertussis
uggcgcccgccugcgccagc

SEQ ID NO: 392751 - RNA, 21 nt, Bordetella pertussis
uggcgcccgccugcgccagcc

SEQ ID NO: 392752 - RNA, 21 nt, Bordetella pertussis
uggcgcccggccugcgggcgc

SEQ ID NO: 392753 - RNA, 23 nt, Bordetella pertussis
uggcgcgaugugacggcucgaug

SEQ ID NO: 392754 - RNA, 19 nt, Bordetella pertussis
uggcgcgcaaccaggggcg

SEQ ID NO: 392755 - RNA, 21 nt, Bordetella pertussis
uggcgcgcacacuggccagca

SEQ ID NO: 392756 - RNA, 14 nt, Bordetella pertussis
uggcgcgcaccauc

SEQ ID NO: 392757 - RNA, 19 nt, Bordetella pertussis
uggcgcgcaccugggaggg

SEQ ID NO: 392758 - RNA, 15 nt, Bordetella pertussis
uggcgcgcagcagcg

SEQ ID NO: 392759 - RNA, 21 nt, Bordetella pertussis
uggcgcgcgaccaggcuggag

SEQ ID NO: 392760 - RNA, 17 nt, Bordetella pertussis
uggcgcgcggauccagc

SEQ ID NO: 392761 - RNA, 19 nt, Bordetella pertussis
uggcgcgcggcuggcuguu

SEQ ID NO: 392762 - RNA, 18 nt, Bordetella pertussis
uggcgcgcggcuggggcu

SEQ ID NO: 392763 - RNA, 19 nt, Bordetella pertussis
uggcgcgcggcuggggcug

SEQ ID NO: 392764 - RNA, 21 nt, Bordetella pertussis
uggcgcgcgugcugggccaug

SEQ ID NO: 392765 - RNA, 22 nt, Bordetella pertussis
uggcgcgcgcaagccgccgccc

SEQ ID NO: 392766 - RNA, 21 nt, Bordetella pertussis
uggcgcggcgcuacgccgccg

SEQ ID NO: 392767 - RNA, 19 nt, Bordetella pertussis
uggcgcggcggccaggcgu

SEQ ID NO: 392768 - RNA, 17 nt, Bordetella pertussis
uggcgcgugcgcgcgcc

SEQ ID NO: 392769 - RNA, 21 nt, Bordetella pertussis
uggcggccaggaucgcggcca

SEQ ID NO: 392770 - RNA, 14 nt, Bordetella pertussis
uggcggccaggccg

SEQ ID NO: 392771 - RNA, 20 nt, Bordetella pertussis
uggcggccaggccggggccg

SEQ ID NO: 392772 - RNA, 16 nt, Bordetella pertussis
uggcggccgcccagca

SEQ ID NO: 392773 - RNA, 15 nt, Bordetella pertussis
uggcggccgccgcca

SEQ ID NO: 392774 - RNA, 20 nt, Bordetella pertussis
uggcggccgcgggcagcaau

SEQ ID NO: 392775 - RNA, 18 nt, Bordetella pertussis
uggcggccuugcgggccg

SEQ ID NO: 392776 - RNA, 19 nt, Bordetella pertussis
uggcggccuugcgggccgg

SEQ ID NO: 392777 - RNA, 15 nt, Bordetella pertussis
uggcggcgcaggccg

SEQ ID NO: 392778 - RNA, 16 nt, Bordetella pertussis
uggcggcgcgcggcug

SEQ ID NO: 392779 - RNA, 15 nt, Bordetella pertussis
uggcggcggucaaug

SEQ ID NO: 392780 - RNA, 15 nt, Bordetella pertussis
uggcguagccggugc

SEQ ID NO: 392781 - RNA, 18 nt, Bordetella pertussis
uggcguaguagcccaggc

SEQ ID NO: 392782 - RNA, 21 nt, Bordetella pertussis
uggcguaugcccacucccgua

SEQ ID NO: 392783 - RNA, 19 nt, Bordetella pertussis
uggcgucaagccagcggcg

SEQ ID NO: 392784 - RNA, 23 nt, Bordetella pertussis
uggcguccagccugcccgggcag

SEQ ID NO: 392785 - RNA, 15 nt, Bordetella pertussis
uggcgucgagcaccg

SEQ ID NO: 392786 - RNA, 17 nt, Bordetella pertussis
uggcuaaaaggaaauau

SEQ ID NO: 392787 - RNA, 23 nt, Bordetella pertussis
uggcucaugguuucgagcaucau

SEQ ID NO: 392788 - RNA, 23 nt, Bordetella pertussis
uggcucgggcagcagcagggcca

SEQ ID NO: 392789 - RNA, 14 nt, Bordetella pertussis
uggcugcaccugcc

SEQ ID NO: 392790 - RNA, 15 nt, Bordetella pertussis
uggcugcaccugccu

SEQ ID NO: 392791 - RNA, 16 nt, Bordetella pertussis
uggcugcgcgccuggc

SEQ ID NO: 392792 - RNA, 17 nt, Bordetella pertussis
uggcuguaucuggccug

SEQ ID NO: 392793 - RNA, 21 nt, Bordetella pertussis
ugggaaauccgccgggugugg

SEQ ID NO: 392794 - RNA, 22 nt, Bordetella pertussis
ugggacaggcacaccgugccgc

SEQ ID NO: 392795 - RNA, 22 nt, Bordetella pertussis
ugggacaggcacaccguggcau

SEQ ID NO: 392796 - RNA, 19 nt, Bordetella pertussis
ugggacaggcccagcccgc

SEQ ID NO: 392797 - RNA, 22 nt, Bordetella pertussis
ugggcagcggacgguagcgcac

SEQ ID NO: 392798 - RNA, 17 nt, Bordetella pertussis
ugggcaguucgcccggc

SEQ ID NO: 392799 - RNA, 16 nt, Bordetella pertussis
ugggcaugcacgaugg

SEQ ID NO: 392800 - RNA, 22 nt, Bordetella pertussis
ugggccaaccacgagcugcagc

SEQ ID NO: 392801 - RNA, 16 nt, Bordetella pertussis
ugggccacucgauggg

SEQ ID NO: 392802 - RNA, 21 nt, Bordetella pertussis
ugggccagcagcuggcgcagc

SEQ ID NO: 392803 - RNA, 13 nt, Bordetella pertussis
ugggccagccagc

SEQ ID NO: 392804 - RNA, 24 nt, Bordetella pertussis
ugggccaggcgcuccagcaccugc

SEQ ID NO: 392805 - RNA, 21 nt, Bordetella pertussis
ugggccaguccgcagcgcagc

SEQ ID NO: 392806 - RNA, 21 nt, Bordetella pertussis
ugggccaugcguaucggcagc

SEQ ID NO: 392807 - RNA, 22 nt, Bordetella pertussis
ugggcccgggcaggcucagccc

SEQ ID NO: 392808 - RNA, 18 nt, Bordetella pertussis
ugggccgccugcugggcc

SEQ ID NO: 392809 - RNA, 15 nt, Bordetella pertussis
ugggccgcgccugca

SEQ ID NO: 392810 - RNA, 13 nt, Bordetella pertussis
ugggccgaggcgc

SEQ ID NO: 392811 - RNA, 18 nt, Bordetella pertussis
ugggccguccggccgugc

SEQ ID NO: 392812 - RNA, 22 nt, Bordetella pertussis
ugggccugcugucgcugggaug

SEQ ID NO: 392813 - RNA, 17 nt, Bordetella pertussis
ugggccuguacuggaug

SEQ ID NO: 392814 - RNA, 15 nt, Bordetella pertussis
ugggccuucuugucg

SEQ ID NO: 392815 - RNA, 19 nt, Bordetella pertussis
ugggcgaucuucagcacca

SEQ ID NO: 392816 - RNA, 18 nt, Bordetella pertussis
ugggcucgcgcgagccca

SEQ ID NO: 392817 - RNA, 23 nt, Bordetella pertussis
ugggcucggucucgcccauggga

SEQ ID NO: 392818 - RNA, 14 nt, Bordetella pertussis
ugggcucgugcagc

SEQ ID NO: 392819 - RNA, 19 nt, Bordetella pertussis
uggguccgcgugggcaugg

SEQ ID NO: 392820 - RNA, 15 nt, Bordetella pertussis
uggucgggcgugagc

SEQ ID NO: 392821 - RNA, 18 nt, Bordetella pertussis
uggucucccccucggccu

SEQ ID NO: 392822 - RNA, 19 nt, Bordetella pertussis
uggucucccggcaugaugg

SEQ ID NO: 392823 - RNA, 23 nt, Bordetella pertussis
uggucugcaagguggcgugcagc

SEQ ID NO: 392824 - RNA, 16 nt, Bordetella pertussis
uggucugccacaucac

SEQ ID NO: 392825 - RNA, 15 nt, Bordetella pertussis
uggugauaaggcuca

SEQ ID NO: 392826 - RNA, 14 nt, Bordetella pertussis
uggugaucugcugc

SEQ ID NO: 392827 - RNA, 20 nt, Bordetella pertussis
uggugaugucggaguugccc

SEQ ID NO: 392828 - RNA, 18 nt, Bordetella pertussis
uggugcaccacgcgcucc

SEQ ID NO: 392829 - RNA, 13 nt, Bordetella pertussis
uggugcagcggca

SEQ ID NO: 392830 - RNA, 16 nt, Bordetella pertussis
uggugcagcggcagca

SEQ ID NO: 392831 - RNA, 15 nt, Bordetella pertussis
uggugcccagcgagc

SEQ ID NO: 392832 - RNA, 18 nt, Bordetella pertussis
uggugccguaauccgugg

SEQ ID NO: 392833 - RNA, 21 nt, Bordetella pertussis
uggugcgcacaucgcccgugc

SEQ ID NO: 392834 - RNA, 23 nt, Bordetella pertussis
uggugcgcuaccgcuucccuggc

SEQ ID NO: 392835 - RNA, 21 nt, Bordetella pertussis
uggugcgccucgaagaucucg

SEQ ID NO: 392836 - RNA, 17 nt, Bordetella pertussis
uggugcucaguuucuuc

SEQ ID NO: 392837 - RNA, 12 nt, Bordetella pertussis
uggugcugcuca

SEQ ID NO: 392838 - RNA, 11 nt, Bordetella pertussis
uggugcugggc

SEQ ID NO: 392839 - RNA, 18 nt, Bordetella pertussis
uggugcuggugccgcugg

SEQ ID NO: 392840 - RNA, 15 nt, Bordetella pertussis
ugguggguuggccuu

SEQ ID NO: 392841 - RNA, 12 nt, Bordetella pertussis
ugguggucuggu

SEQ ID NO: 392842 - RNA, 13 nt, Bordetella pertussis
ugguggugcagcg

SEQ ID NO: 392843 - RNA, 14 nt, Bordetella pertussis
ugguguagccagga

SEQ ID NO: 392844 - RNA, 17 nt, Bordetella pertussis
uggugucgaagccgugc

SEQ ID NO: 392845 - RNA, 15 nt, Bordetella pertussis
uggugugccuguccc

SEQ ID NO: 392846 - RNA, 20 nt, Bordetella pertussis
ugguuacucuguucuaccug

SEQ ID NO: 392847 - RNA, 14 nt, Bordetella pertussis
ugguugagcagcac

SEQ ID NO: 392848 - RNA, 16 nt, Bordetella pertussis
ugguuggccacaucau

SEQ ID NO: 392849 - RNA, 20 nt, Bordetella pertussis
ugguuggccacaucaucgac

SEQ ID NO: 392850 - RNA, 14 nt, Bordetella pertussis
ugguuggccacgaa

SEQ ID NO: 392851 - RNA, 21 nt, Bordetella pertussis
ugguuggccacgaagcgcagc

SEQ ID NO: 392852 - RNA, 16 nt, Bordetella pertussis
ugguugggcucggucu

SEQ ID NO: 392853 - RNA, 15 nt, Bordetella pertussis
uguacucggccaggc

SEQ ID NO: 392854 - RNA, 18 nt, Bordetella pertussis
uguagcccauggccaggg

SEQ ID NO: 392855 - RNA, 20 nt, Bordetella pertussis
uguagcccuggcgcugcagc

SEQ ID NO: 392856 - RNA, 18 nt, Bordetella pertussis
uguaucuggccugucugg

SEQ ID NO: 392857 - RNA, 14 nt, Bordetella pertussis
uguauuggcccagu

SEQ ID NO: 392858 - RNA, 16 nt, Bordetella pertussis
ugucccacaggcgcgc

SEQ ID NO: 392859 - RNA, 16 nt, Bordetella pertussis
ugucccagauggcgcc

SEQ ID NO: 392860 - RNA, 14 nt, Bordetella pertussis
ugucccagcgcucg

SEQ ID NO: 392861 - RNA, 15 nt, Bordetella pertussis
ugucccagcggggac

SEQ ID NO: 392862 - RNA, 20 nt, Bordetella pertussis
ugucccagcggggacaggca

SEQ ID NO: 392863 - RNA, 13 nt, Bordetella pertussis
uguccccacaggg

SEQ ID NO: 392864 - RNA, 14 nt, Bordetella pertussis
uguccccacagggg

SEQ ID NO: 392865 - RNA, 23 nt, Bordetella pertussis
uguccccacagggggacuggcac

SEQ ID NO: 392866 - RNA, 12 nt, Bordetella pertussis
uguccccaccgg

SEQ ID NO: 392867 - RNA, 16 nt, Bordetella pertussis
uguccccaccgggaca

SEQ ID NO: 392868 - RNA, 22 nt, Bordetella pertussis
uguccccacguggacaggcacc

SEQ ID NO: 392869 - RNA, 12 nt, Bordetella pertussis
uguccccacugg

SEQ ID NO: 392870 - RNA, 13 nt, Bordetella pertussis
uguccccacuggg

SEQ ID NO: 392871 - RNA, 17 nt, Bordetella pertussis
uguccccgcgcgggggg

SEQ ID NO: 392872 - RNA, 16 nt, Bordetella pertussis
uguccccgcggggaca

SEQ ID NO: 392873 - RNA, 22 nt, Bordetella pertussis
uguccccgcggggacaggcacc

SEQ ID NO: 392874 - RNA, 22 nt, Bordetella pertussis
uguccccgcugggacaggcaca

SEQ ID NO: 392875 - RNA, 20 nt, Bordetella pertussis
uguccccgucgggacaggcu

SEQ ID NO: 392876 - RNA, 20 nt, Bordetella pertussis
uguccccguggggacaggca

SEQ ID NO: 392877 - RNA, 16 nt, Bordetella pertussis
ugucccgacggggaca

SEQ ID NO: 392878 - RNA, 15 nt, Bordetella pertussis
ugucccgcugggggc

SEQ ID NO: 392879 - RNA, 15 nt, Bordetella pertussis
ugucccggcggggac

SEQ ID NO: 392880 - RNA, 15 nt, Bordetella pertussis
ugucccugcgggggc

SEQ ID NO: 392881 - RNA, 20 nt, Bordetella pertussis
ugucccugcgggggcaggca

SEQ ID NO: 392882 - RNA, 22 nt, Bordetella pertussis
ugucccugcgggggcaggcacg

SEQ ID NO: 392883 - RNA, 16 nt, Bordetella pertussis
uguccgaaccacccgg

SEQ ID NO: 392884 - RNA, 12 nt, Bordetella pertussis
uguccgccaccc

SEQ ID NO: 392885 - RNA, 15 nt, Bordetella pertussis
uguccgcgucggccg

SEQ ID NO: 392886 - RNA, 18 nt, Bordetella pertussis
uguccggggcgcuugcca

SEQ ID NO: 392887 - RNA, 20 nt, Bordetella pertussis
uguccggggcgcuugccacu

SEQ ID NO: 392888 - RNA, 14 nt, Bordetella pertussis
uguccggcgcuggc

SEQ ID NO: 392889 - RNA, 19 nt, Bordetella pertussis
uguccugauucacaggccc

SEQ ID NO: 392890 - RNA, 15 nt, Bordetella pertussis
uguccugcagguccu

SEQ ID NO: 392891 - RNA, 21 nt, Bordetella pertussis
uguccuggacagugcccugac

SEQ ID NO: 392892 - RNA, 16 nt, Bordetella pertussis
uguccuucguggcgcc

SEQ ID NO: 392893 - RNA, 23 nt, Bordetella pertussis
uguccuugaacgccuugacgauc

SEQ ID NO: 392894 - RNA, 22 nt, Bordetella pertussis
ugucgaccauguccgcgcccau

SEQ ID NO: 392895 - RNA, 21 nt, Bordetella pertussis
ugucgaugggguagucggcca

SEQ ID NO: 392896 - RNA, 21 nt, Bordetella pertussis
ugucgcaacagcccccuggua

SEQ ID NO: 392897 - RNA, 18 nt, Bordetella pertussis
ugucgcaggccgcggcca

SEQ ID NO: 392898 - RNA, 23 nt, Bordetella pertussis
ugucggcaaccugcacgcgggcg

SEQ ID NO: 392899 - RNA, 12 nt, Bordetella pertussis
ugucggccaggg

SEQ ID NO: 392900 - RNA, 13 nt, Bordetella pertussis
ugucggccaggga

SEQ ID NO: 392901 - RNA, 13 nt, Bordetella pertussis
ugucggccagggc

SEQ ID NO: 392902 - RNA, 14 nt, Bordetella pertussis
ugucggccagggcg

SEQ ID NO: 392903 - RNA, 20 nt, Bordetella pertussis
ugucggccgaaccgcgcagc

SEQ ID NO: 392904 - RNA, 22 nt, Bordetella pertussis
ugucggccgaaccgcgcagccg

SEQ ID NO: 392905 - RNA, 21 nt, Bordetella pertussis
ugucggccuucugcgccagcg

SEQ ID NO: 392906 - RNA, 15 nt, Bordetella pertussis
ugugccccuugccca

SEQ ID NO: 392907 - RNA, 19 nt, Bordetella pertussis
ugugccccuugcccaacgc

SEQ ID NO: 392908 - RNA, 21 nt, Bordetella pertussis
ugugccgaugcuuagcgcagc

SEQ ID NO: 392909 - RNA, 17 nt, Bordetella pertussis
ugugcuugagauugugc

SEQ ID NO: 392910 - RNA, 14 nt, Bordetella pertussis
ugugcuugccgcag

SEQ ID NO: 392911 - RNA, 22 nt, Bordetella pertussis
uguggacgccgccggcccagga

SEQ ID NO: 392912 - RNA, 11 nt, Bordetella pertussis
uuacaugcagc

SEQ ID NO: 392913 - RNA, 18 nt, Bordetella pertussis
uuacaugccgcgcgcgca

SEQ ID NO: 392914 - RNA, 20 nt, Bordetella pertussis
uuacuccggcugcuugccca

SEQ ID NO: 392915 - RNA, 20 nt, Bordetella pertussis
uuacuuguacgacgucuugc

SEQ ID NO: 392916 - RNA, 11 nt, Bordetella pertussis
uuauauauaga

SEQ ID NO: 392917 - RNA, 22 nt, Bordetella pertussis
uucacagccauugcccacagca

SEQ ID NO: 392918 - RNA, 23 nt, Bordetella pertussis
uucacagccauugcccacagcac

SEQ ID NO: 392919 - RNA, 18 nt, Bordetella pertussis
uucaccccgccaccgccc

SEQ ID NO: 392920 - RNA, 10 nt, Bordetella pertussis
uucagcagca

SEQ ID NO: 392921 - RNA, 22 nt, Bordetella pertussis
uucagccacacgaucagcgccc

SEQ ID NO: 392922 - RNA, 12 nt, Bordetella pertussis
uucagccagcga

SEQ ID NO: 392923 - RNA, 13 nt, Bordetella pertussis
uuccacagcgccg

SEQ ID NO: 392924 - RNA, 17 nt, Bordetella pertussis
uuccagaacggcgcggg

SEQ ID NO: 392925 - RNA, 19 nt, Bordetella pertussis
uuccagaucgaccaggacc

SEQ ID NO: 392926 - RNA, 12 nt, Bordetella pertussis
uuccagcagcau

SEQ ID NO: 392927 - RNA, 14 nt, Bordetella pertussis
uuccagccaggccu

SEQ ID NO: 392928 - RNA, 15 nt, Bordetella pertussis
uuccagccaggccuc

SEQ ID NO: 392929 - RNA, 19 nt, Bordetella pertussis
uuccagccaguacaggcug

SEQ ID NO: 392930 - RNA, 20 nt, Bordetella pertussis
uuccagccaguacaggcugc

SEQ ID NO: 392931 - RNA, 17 nt, Bordetella pertussis
uuccagccuggcaaugc

SEQ ID NO: 392932 - RNA, 18 nt, Bordetella pertussis
uuccagccuggcaaugcg

SEQ ID NO: 392933 - RNA, 14 nt, Bordetella pertussis
uuccagcgccuggc

SEQ ID NO: 392934 - RNA, 15 nt, Bordetella pertussis
uuccagcucugcucu

SEQ ID NO: 392935 - RNA, 20 nt, Bordetella pertussis
uuccaggaaagaggccaggc

SEQ ID NO: 392936 - RNA, 16 nt, Bordetella pertussis
uuccaggacgacaggc

SEQ ID NO: 392937 - RNA, 17 nt, Bordetella pertussis
uuccaggacgacaggca

SEQ ID NO: 392938 - RNA, 21 nt, Bordetella pertussis
uuccaggacgacaggcaugca

SEQ ID NO: 392939 - RNA, 16 nt, Bordetella pertussis
uuccaguugcgcgccg

SEQ ID NO: 392940 - RNA, 19 nt, Bordetella pertussis
uuccaucggggggcaggcu

SEQ ID NO: 392941 - RNA, 20 nt, Bordetella pertussis
uuccaucggggggcaggcug

SEQ ID NO: 392942 - RNA, 20 nt, Bordetella pertussis
uuccaugacguccagcgcca

SEQ ID NO: 392943 - RNA, 18 nt, Bordetella pertussis
uuccaugcgauccagggc

SEQ ID NO: 392944 - RNA, 15 nt, Bordetella pertussis
uuccugccgcacuuc

SEQ ID NO: 392945 - RNA, 23 nt, Bordetella pertussis
uuccugcuggaccugcuguucac

SEQ ID NO: 392946 - RNA, 23 nt, Bordetella pertussis
uuccuguucgccaaucugccgcu

SEQ ID NO: 392947 - RNA, 18 nt, Bordetella pertussis
uuccuuggucagcgaugu

SEQ ID NO: 392948 - RNA, 15 nt, Bordetella pertussis
uuccuuuauugaaau

SEQ ID NO: 392949 - RNA, 17 nt, Bordetella pertussis
uucgaaagccagcgccu

SEQ ID NO: 392950 - RNA, 17 nt, Bordetella pertussis
uucgaacaacagcgccu

SEQ ID NO: 392951 - RNA, 23 nt, Bordetella pertussis
uucgcaccagucccgcaccgacc

SEQ ID NO: 392952 - RNA, 17 nt, Bordetella pertussis
uucgccaaucugccgcu

SEQ ID NO: 392953 - RNA, 19 nt, Bordetella pertussis
uucggaguaguugucgucg

SEQ ID NO: 392954 - RNA, 18 nt, Bordetella pertussis
uucggugcgcagcggcag

SEQ ID NO: 392955 - RNA, 13 nt, Bordetella pertussis
uucggugucggcg

SEQ ID NO: 392956 - RNA, 18 nt, Bordetella pertussis
uucucgaccaggcgggca

SEQ ID NO: 392957 - RNA, 18 nt, Bordetella pertussis
uucucggugcgccgccgc

SEQ ID NO: 392958 - RNA, 19 nt, Bordetella pertussis
uucugcaaggccugcugca

SEQ ID NO: 392959 - RNA, 18 nt, Bordetella pertussis
uucugcaucggcaugagc

SEQ ID NO: 392960 - RNA, 22 nt, Bordetella pertussis
uugaacagccgccccagcagca

SEQ ID NO: 392961 - RNA, 19 nt, Bordetella pertussis
uugaacucggccagcagcu

SEQ ID NO: 392962 - RNA, 13 nt, Bordetella pertussis
uugaacugcaggc

SEQ ID NO: 392963 - RNA, 18 nt, Bordetella pertussis
uugaacugcgcggucuug

SEQ ID NO: 392964 - RNA, 15 nt, Bordetella pertussis
uugaagccguaguug

SEQ ID NO: 392965 - RNA, 18 nt, Bordetella pertussis
uugaaggcuuucugcuug

SEQ ID NO: 392966 - RNA, 17 nt, Bordetella pertussis
uugaccagcaccagcgc

SEQ ID NO: 392967 - RNA, 19 nt, Bordetella pertussis
uugaccgccuccaggauga

SEQ ID NO: 392968 - RNA, 21 nt, Bordetella pertussis
uugaccgccucgaucgccagg

SEQ ID NO: 392969 - RNA, 16 nt, Bordetella pertussis
uugacgaucucgcccu

SEQ ID NO: 392970 - RNA, 19 nt, Bordetella pertussis
uugacgccggcggcgugcg

SEQ ID NO: 392971 - RNA, 22 nt, Bordetella pertussis
uugacgccggcuucagccgcaa

SEQ ID NO: 392972 - RNA, 13 nt, Bordetella pertussis
uugacggccagga

SEQ ID NO: 392973 - RNA, 15 nt, Bordetella pertussis
uugacggccaggacg

SEQ ID NO: 392974 - RNA, 15 nt, Bordetella pertussis
uugacggcgcucuug

SEQ ID NO: 392975 - RNA, 20 nt, Bordetella pertussis
uugagcaacgugcgcacgcg

SEQ ID NO: 392976 - RNA, 14 nt, Bordetella pertussis
uugaugccgcccag

SEQ ID NO: 392977 - RNA, 21 nt, Bordetella pertussis
uugaugcgggucaaggcgggg

SEQ ID NO: 392978 - RNA, 18 nt, Bordetella pertussis
uugcaaauucugcaaaag

SEQ ID NO: 392979 - RNA, 20 nt, Bordetella pertussis
uugccaagauggcccagggc

SEQ ID NO: 392980 - RNA, 18 nt, Bordetella pertussis
uugcccagcaccacgggc

SEQ ID NO: 392981 - RNA, 22 nt, Bordetella pertussis
uugcccgagcgcgacagcacca

SEQ ID NO: 392982 - RNA, 22 nt, Bordetella pertussis
uugcccgggcuggccgccugcu

SEQ ID NO: 392983 - RNA, 17 nt, Bordetella pertussis
uugcccuucggggcagc

SEQ ID NO: 392984 - RNA, 16 nt, Bordetella pertussis
uugcccuugaauucca

SEQ ID NO: 392985 - RNA, 15 nt, Bordetella pertussis
uugcccuuggcggcc

SEQ ID NO: 392986 - RNA, 13 nt, Bordetella pertussis
uugccgaccucca

SEQ ID NO: 392987 - RNA, 14 nt, Bordetella pertussis
uugccgcagcggcc

SEQ ID NO: 392988 - RNA, 21 nt, Bordetella pertussis
uugccgccggacggcgccuug

SEQ ID NO: 392989 - RNA, 22 nt, Bordetella pertussis
uugccgcggcgcggccuuccca

SEQ ID NO: 392990 - RNA, 14 nt, Bordetella pertussis
uugccggagcagca

SEQ ID NO: 392991 - RNA, 17 nt, Bordetella pertussis
uugccggaucagcgccu

SEQ ID NO: 392992 - RNA, 12 nt, Bordetella pertussis
uugccugggugc

SEQ ID NO: 392993 - RNA, 12 nt, Bordetella pertussis
uugcgcacggcg

SEQ ID NO: 392994 - RNA, 13 nt, Bordetella pertussis
uugcgcaggcugu

SEQ ID NO: 392995 - RNA, 14 nt, Bordetella pertussis
uugcgccacgcccg

SEQ ID NO: 392996 - RNA, 22 nt, Bordetella pertussis
uugcgccacggucugcacgccg

SEQ ID NO: 392997 - RNA, 16 nt, Bordetella pertussis
uugcgccgcccgugcc

SEQ ID NO: 392998 - RNA, 15 nt, Bordetella pertussis
uugcgugccgcccag

SEQ ID NO: 392999 - RNA, 22 nt, Bordetella pertussis
uugcgugggcuccguuccgaug

SEQ ID NO: 393000 - RNA, 23 nt, Bordetella pertussis
uugcgugggcuccguuccgaugc

SEQ ID NO: 393001 - RNA, 19 nt, Bordetella pertussis
uugcucgacauagagauug

SEQ ID NO: 393002 - RNA, 13 nt, Bordetella pertussis
uugcucuugaccu

SEQ ID NO: 393003 - RNA, 16 nt, Bordetella pertussis
uuguugcgugccgccc

SEQ ID NO: 393004 - RNA, 17 nt, Bordetella pertussis
uuguuggcgccggccgc

SEQ ID NO: 393005 - RNA, 23 nt, Bordetella pertussis
uuuacgccgagaagauuucccag

SEQ ID NO: 393006 - RNA, 17 nt, Bordetella pertussis
uuucagauccuuggugc

SEQ ID NO: 393007 - RNA, 17 nt, Bordetella pertussis
uuuccagcgcgaaaugc

SEQ ID NO: 393008 - RNA, 21 nt, Bordetella pertussis
uuuccaggaaagaggccaggc

SEQ ID NO: 393009 - RNA, 19 nt, Bordetella pertussis
uuuccaucagcucgaccac

SEQ ID NO: 393010 - RNA, 18 nt, Bordetella pertussis
uuuccaugacggugccga

SEQ ID NO: 393011 - RNA, 17 nt, Bordetella pertussis
uuucccucggugcugcu

SEQ ID NO: 393012 - RNA, 12 nt, Bordetella pertussis
uuucccuuccug

SEQ ID NO: 393013 - RNA, 14 nt, Bordetella pertussis
uuuccgcacccggu

SEQ ID NO: 393014 - RNA, 16 nt, Bordetella pertussis
uuuccgccgagaaauc

SEQ ID NO: 393015 - RNA, 20 nt, Bordetella pertussis
uuuccggaccggugcccucg

SEQ ID NO: 393016 - RNA, 15 nt, Bordetella pertussis
uuuccgggccuggcc

SEQ ID NO: 393017 - RNA, 22 nt, Bordetella pertussis
uuuccuggagcuuggccggugc

SEQ ID NO: 393018 - RNA, 20 nt, Bordetella pertussis
uuucgaacaaggcgguggcc

SEQ ID NO: 393019 - RNA, 21 nt, Bordetella pertussis
uuucgacgccuuccuugaacu

SEQ ID NO: 393020 - RNA, 20 nt, Bordetella pertussis
uuucgagccgcagaacagca

SEQ ID NO: 393021 - RNA, 21 nt, Bordetella pertussis
uuucgagccgcagaacagcag

SEQ ID NO: 393022 - RNA, 19 nt, Bordetella pertussis
uuucgcgcgcgccugcccc

SEQ ID NO: 393023 - RNA, 19 nt, Bordetella pertussis
uuucggcgccgccggccau

SEQ ID NO: 393024 - RNA, 17 nt, Bordetella pertussis
uuucggggcgcaagauc

SEQ ID NO: 393025 - RNA, 18 nt, Bordetella pertussis
uuucguugcauugcacaa

SEQ ID NO: 393026 - RNA, 22 nt, Bordetella pertussis
uuucucagcgcgcuuuucucaa

SEQ ID NO: 393027 - RNA, 18 nt, Bordetella pertussis
uuucuccagcgccagcac

SEQ ID NO: 393028 - RNA, 18 nt, Bordetella pertussis
uuucuggccuuccugcug

SEQ ID NO: 393029 - RNA, 19 nt, Bordetella pertussis
uuugcccuggccacgcugc

SEQ ID NO: 393030 - RNA, 18 nt, Bordetella pertussis
uuugcggacgggccagua

SEQ ID NO: 393031 - RNA, 21 nt, Bordetella pertussis
uuugcgucuccacgccgccga

SEQ ID NO: 393032 - RNA, 13 nt, Bordetella pertussis
uuugggucaugga

SEQ ID NO: 393033 - RNA, 17 nt, Bordetella pertussis
uuuuacaggcagcggcc

SEQ ID NO: 393034 - RNA, 17 nt, Bordetella pertussis
uuuuccacagccaggcc

SEQ ID NO: 393035 - RNA, 16 nt, Bordetella pertussis
uuuuccaucagcucga

SEQ ID NO: 393036 - RNA, 18 nt, Bordetella pertussis
uuuucggacgcagcuucu

SEQ ID NO: 393037 - RNA, 22 nt, Bordetella pertussis
uuuucuccagcgccagcacagu

SEQ ID NO: 393038 - RNA, 22 nt, Bordetella pertussis
uuuucuugccggcccaucugua

SEQ ID NO: 393039 - RNA, 13 nt, Bordetella pertussis
uuuugggaaggcc

SEQ ID NO: 393040 - RNA, 22 nt, Bordetella pertussis
uuuuugccuuggggcggcccgg

SEQ ID NO: 393041 - RNA, 13 nt, Bordetella pertussis
aaauucugcaaaa

SEQ ID NO: 393042 - RNA, 19 nt, Bordetella pertussis
aagaccgcggccgcgcugg

SEQ ID NO: 393043 - RNA, 23 nt, Bordetella pertussis
aagacgcggggacaggcacacca

SEQ ID NO: 393044 - RNA, 21 nt, Bordetella pertussis
aagacggcuugaccacggcca

SEQ ID NO: 393045 - RNA, 22 nt, Bordetella pertussis
aagacggcuugaccacggccag

SEQ ID NO: 393046 - RNA, 20 nt, Bordetella pertussis
aagacgguaucugucccggc

SEQ ID NO: 393047 - RNA, 14 nt, Bordetella pertussis
aagacguggcccgc

SEQ ID NO: 393048 - RNA, 20 nt, Bordetella pertussis
aagacuucgucaacgcccug

SEQ ID NO: 393049 - RNA, 13 nt, Bordetella pertussis
aagaggccaggcc

SEQ ID NO: 393050 - RNA, 21 nt, Bordetella pertussis
aagagggcuuuuugccuuggg

SEQ ID NO: 393051 - RNA, 16 nt, Bordetella pertussis
aagaucaccugggcca

SEQ ID NO: 393052 - RNA, 22 nt, Bordetella pertussis
aagaucgcauuucucggccugg

SEQ ID NO: 393053 - RNA, 20 nt, Bordetella pertussis
aagaugaaucgcaugcgguu

SEQ ID NO: 393054 - RNA, 13 nt, Bordetella pertussis
aagcacagaugca

SEQ ID NO: 393055 - RNA, 22 nt, Bordetella pertussis
aagcaccgccugcugcgccugg

SEQ ID NO: 393056 - RNA, 16 nt, Bordetella pertussis
aagcacgaacagguug

SEQ ID NO: 393057 - RNA, 22 nt, Bordetella pertussis
aagcagacccgcgcccagcugu

SEQ ID NO: 393058 - RNA, 18 nt, Bordetella pertussis
aagcgcuggacgcccugg

SEQ ID NO: 393059 - RNA, 19 nt, Bordetella pertussis
aagcgcuggauggucacgc

SEQ ID NO: 393060 - RNA, 15 nt, Bordetella pertussis
aagcgcuucugccag

SEQ ID NO: 393061 - RNA, 21 nt, Bordetella pertussis
aagcggcgcaccagcgaggcg

SEQ ID NO: 393062 - RNA, 22 nt, Bordetella pertussis
aagcggcgcaccagcgaggcgg

SEQ ID NO: 393063 - RNA, 16 nt, Bordetella pertussis
aagcguccgcgcgccg

SEQ ID NO: 393064 - RNA, 16 nt, Bordetella pertussis
aagcugcccagcaauu

SEQ ID NO: 393065 - RNA, 17 nt, Bordetella pertussis
aagcugcggccggucug

SEQ ID NO: 393066 - RNA, 23 nt, Bordetella pertussis
aagcugucggacgagcaagccca

SEQ ID NO: 393067 - RNA, 23 nt, Bordetella pertussis
aaggagcgagcgaugagcaauuu

SEQ ID NO: 393068 - RNA, 13 nt, Bordetella pertussis
aaggccacgcggg

SEQ ID NO: 393069 - RNA, 14 nt, Bordetella pertussis
aaggcccgccgcgg

SEQ ID NO: 393070 - RNA, 21 nt, Bordetella pertussis
aaggcccggauauggccggcg

SEQ ID NO: 393071 - RNA, 15 nt, Bordetella pertussis
aaggccgagguggac

SEQ ID NO: 393072 - RNA, 23 nt, Bordetella pertussis
aaggccggcggcacgcugcgcag

SEQ ID NO: 393073 - RNA, 13 nt, Bordetella pertussis
aaggccugcugca

SEQ ID NO: 393074 - RNA, 22 nt, Bordetella pertussis
aaggccuuggccugggccgaca

SEQ ID NO: 393075 - RNA, 20 nt, Bordetella pertussis
aaggcgaacugggucugccc

SEQ ID NO: 393076 - RNA, 22 nt, Bordetella pertussis
aaggcgaccggcaccugggccu

SEQ ID NO: 393077 - RNA, 16 nt, Bordetella pertussis
aaggcgaugggcaccu

SEQ ID NO: 393078 - RNA, 14 nt, Bordetella pertussis
aaggcgcacaaccu

SEQ ID NO: 393079 - RNA, 17 nt, Bordetella pertussis
aaggcgcgcuccagcau

SEQ ID NO: 393080 - RNA, 20 nt, Bordetella pertussis
aaggcgcgaguauucacgcc

SEQ ID NO: 393081 - RNA, 22 nt, Bordetella pertussis
aaggcugcagcuugcgcgccag

SEQ ID NO: 393082 - RNA, 17 nt, Bordetella pertussis
aaggcuuucugcuugcc

SEQ ID NO: 393083 - RNA, 16 nt, Bordetella pertussis
aagguacccgcgccgg

SEQ ID NO: 393084 - RNA, 18 nt, Bordetella pertussis
aagguacccgcgccggcg

SEQ ID NO: 393085 - RNA, 14 nt, Bordetella pertussis
aaggugccuguccc

SEQ ID NO: 393086 - RNA, 22 nt, Bordetella pertussis
aaggugccuguccccgcgggga

SEQ ID NO: 393087 - RNA, 20 nt, Bordetella pertussis
aaguccugcaucgccaugcc

SEQ ID NO: 393088 - RNA, 12 nt, Bordetella pertussis
aagugcccaggc

SEQ ID NO: 393089 - RNA, 14 nt, Bordetella pertussis
aagugggcauagcg

SEQ ID NO: 393090 - RNA, 23 nt, Bordetella pertussis
aauacgugcgcgacgcguagccg

SEQ ID NO: 393091 - RNA, 17 nt, Bordetella pertussis
aaucgauacgccgggcg

SEQ ID NO: 393092 - RNA, 23 nt, Bordetella pertussis
aaucgaugaagaucaggcggcug

SEQ ID NO: 393093 - RNA, 19 nt, Bordetella pertussis
aaucggcccguuccacagg

SEQ ID NO: 393094 - RNA, 23 nt, Bordetella pertussis
aaucgggcagcacgcgcaccagg

SEQ ID NO: 393095 - RNA, 19 nt, Bordetella pertussis
aaucgugccggagauccgg

SEQ ID NO: 393096 - RNA, 17 nt, Bordetella pertussis
aaugcccaggaugcccu

SEQ ID NO: 393097 - RNA, 16 nt, Bordetella pertussis
aauguauuuggcggcu

SEQ ID NO: 393098 - RNA, 19 nt, Bordetella pertussis
aauuaaugaaacugcaaaa

SEQ ID NO: 393099 - RNA, 14 nt, Bordetella pertussis
acaaccaggaaaac

SEQ ID NO: 393100 - RNA, 19 nt, Bordetella pertussis
acaaggccggagccaggua

SEQ ID NO: 393101 - RNA, 19 nt, Bordetella pertussis
acaccaucaagaugaacgc

SEQ ID NO: 393102 - RNA, 14 nt, Bordetella pertussis
acacccgcggccag

SEQ ID NO: 393103 - RNA, 16 nt, Bordetella pertussis
acaccgcggccuugcc

SEQ ID NO: 393104 - RNA, 17 nt, Bordetella pertussis
acaccggcgugcagagc

SEQ ID NO: 393105 - RNA, 15 nt, Bordetella pertussis
acaccgugcuggccg

SEQ ID NO: 393106 - RNA, 17 nt, Bordetella pertussis
acaccguuuuggcaggc

SEQ ID NO: 393107 - RNA, 21 nt, Bordetella pertussis
acaccuacauccuggaugugc

SEQ ID NO: 393108 - RNA, 14 nt, Bordetella pertussis
acacgaccagcagg

SEQ ID NO: 393109 - RNA, 16 nt, Bordetella pertussis
acacgaccagcaggcc

SEQ ID NO: 393110 - RNA, 18 nt, Bordetella pertussis
acacgaucagcgcccagg

SEQ ID NO: 393111 - RNA, 17 nt, Bordetella pertussis
acacgaucgucagcagc

SEQ ID NO: 393112 - RNA, 20 nt, Bordetella pertussis
acacgccacuacacucugcc

SEQ ID NO: 393113 - RNA, 12 nt, Bordetella pertussis
acacgcccagca

SEQ ID NO: 393114 - RNA, 21 nt, Bordetella pertussis
acacgccgauugaggccagca

SEQ ID NO: 393115 - RNA, 12 nt, Bordetella pertussis
acacgcgcgccg

SEQ ID NO: 393116 - RNA, 20 nt, Bordetella pertussis
acacgcggugcaucucggca

SEQ ID NO: 393117 - RNA, 18 nt, Bordetella pertussis
acacgcuggcggacacgc

SEQ ID NO: 393118 - RNA, 19 nt, Bordetella pertussis
acacgcuuugcgucuccac

SEQ ID NO: 393119 - RNA, 15 nt, Bordetella pertussis
acacggcaguaugac

SEQ ID NO: 393120 - RNA, 18 nt, Bordetella pertussis
acacggucaaccacgcca

SEQ ID NO: 393121 - RNA, 20 nt, Bordetella pertussis
acacggucagcaaccccagc

SEQ ID NO: 393122 - RNA, 13 nt, Bordetella pertussis
acacguccagcgc

SEQ ID NO: 393123 - RNA, 18 nt, Bordetella pertussis
acacguuggggaaccgca

SEQ ID NO: 393124 - RNA, 17 nt, Bordetella pertussis
acagauagaacgagguc

SEQ ID NO: 393125 - RNA, 14 nt, Bordetella pertussis
acagcaggccgguc

SEQ ID NO: 393126 - RNA, 16 nt, Bordetella pertussis
acagcagggccaggcc

SEQ ID NO: 393127 - RNA, 18 nt, Bordetella pertussis
acagcagggccaggccca

SEQ ID NO: 393128 - RNA, 16 nt, Bordetella pertussis
acagcaucagcggcag

SEQ ID NO: 393129 - RNA, 15 nt, Bordetella pertussis
acagcauggccacca

SEQ ID NO: 393130 - RNA, 21 nt, Bordetella pertussis
acagcaugaccucggccugcg

SEQ ID NO: 393131 - RNA, 18 nt, Bordetella pertussis
acauacgccgccgaggcg

SEQ ID NO: 393132 - RNA, 14 nt, Bordetella pertussis
acauagcccggcgc

SEQ ID NO: 393133 - RNA, 18 nt, Bordetella pertussis
acaucaggucgaccugcu

SEQ ID NO: 393134 - RNA, 18 nt, Bordetella pertussis
acaucaucgaccaccagc

SEQ ID NO: 393135 - RNA, 18 nt, Bordetella pertussis
acaucggaauuggcggcg

SEQ ID NO: 393136 - RNA, 19 nt, Bordetella pertussis
acaucgucgcgcuggggca

SEQ ID NO: 393137 - RNA, 16 nt, Bordetella pertussis
acaucgugcuguucgg

SEQ ID NO: 393138 - RNA, 15 nt, Bordetella pertussis
acaugccggacaagc

SEQ ID NO: 393139 - RNA, 23 nt, Bordetella pertussis
acauguuguuggucgccacgcca

SEQ ID NO: 393140 - RNA, 18 nt, Bordetella pertussis
acauugucaagcagcgcc

SEQ ID NO: 393141 - RNA, 17 nt, Bordetella pertussis
accaaucuugccaggcc

SEQ ID NO: 393142 - RNA, 16 nt, Bordetella pertussis
accacaggguggcgcc

SEQ ID NO: 393143 - RNA, 22 nt, Bordetella pertussis
accaccagcgucaccagcaggc

SEQ ID NO: 393144 - RNA, 15 nt, Bordetella pertussis
accaccaggccggcc

SEQ ID NO: 393145 - RNA, 22 nt, Bordetella pertussis
accaccaugugcuugccgcagc

SEQ ID NO: 393146 - RNA, 21 nt, Bordetella pertussis
accaccgucuugcccgccagc

SEQ ID NO: 393147 - RNA, 22 nt, Bordetella pertussis
accaccgugauauagaccagca

SEQ ID NO: 393148 - RNA, 20 nt, Bordetella pertussis
accaccuccaccgccagccc

SEQ ID NO: 393149 - RNA, 23 nt, Bordetella pertussis
accaccugcucggugagcggcac

SEQ ID NO: 393150 - RNA, 18 nt, Bordetella pertussis
accacgccaaggagacac

SEQ ID NO: 393151 - RNA, 22 nt, Bordetella pertussis
accacgcgcaccagcuuggccu

SEQ ID NO: 393152 - RNA, 14 nt, Bordetella pertussis
accacgcgcggcgg

SEQ ID NO: 393153 - RNA, 12 nt, Bordetella pertussis
accacgcggcgg

SEQ ID NO: 393154 - RNA, 13 nt, Bordetella pertussis
accacgcugggcc

SEQ ID NO: 393155 - RNA, 14 nt, Bordetella pertussis
accagcaccagcgc

SEQ ID NO: 393156 - RNA, 15 nt, Bordetella pertussis
accagcaccggcagc

SEQ ID NO: 393157 - RNA, 22 nt, Bordetella pertussis
accagcagcacguucuugcccu

SEQ ID NO: 393158 - RNA, 10 nt, Bordetella pertussis
accagcagcc

SEQ ID NO: 393159 - RNA, 19 nt, Bordetella pertussis
accagcagccgguuggcgc

SEQ ID NO: 393160 - RNA, 14 nt, Bordetella pertussis
accagcagcgccag

SEQ ID NO: 393161 - RNA, 14 nt, Bordetella pertussis
accagcccgcccgc

SEQ ID NO: 393162 - RNA, 13 nt, Bordetella pertussis
accagcccggcgc

SEQ ID NO: 393163 - RNA, 14 nt, Bordetella pertussis
accagccgccgcca

SEQ ID NO: 393164 - RNA, 21 nt, Bordetella pertussis
accagcggcgugcggcccagc

SEQ ID NO: 393165 - RNA, 22 nt, Bordetella pertussis
accagcguguagagcaggccgc

SEQ ID NO: 393166 - RNA, 15 nt, Bordetella pertussis
accaggaacgccagc

SEQ ID NO: 393167 - RNA, 17 nt, Bordetella pertussis
accaggauccccagcac

SEQ ID NO: 393168 - RNA, 16 nt, Bordetella pertussis
accaggaugaugcagc

SEQ ID NO: 393169 - RNA, 20 nt, Bordetella pertussis
accauccugccccaggaaac

SEQ ID NO: 393170 - RNA, 17 nt, Bordetella pertussis
accaucgcgcacuugug

SEQ ID NO: 393171 - RNA, 11 nt, Bordetella pertussis
accaucuuguc

SEQ ID NO: 393172 - RNA, 19 nt, Bordetella pertussis
accaugaccaugccggccu

SEQ ID NO: 393173 - RNA, 13 nt, Bordetella pertussis
accaugccuugcg

SEQ ID NO: 393174 - RNA, 23 nt, Bordetella pertussis
accaugccuugcgcgacagcagg

SEQ ID NO: 393175 - RNA, 22 nt, Bordetella pertussis
accaugcgcgagggcaucagcg

SEQ ID NO: 393176 - RNA, 21 nt, Bordetella pertussis
accaugggcucgugcagcagg

SEQ ID NO: 393177 - RNA, 21 nt, Bordetella pertussis
accaugugcgagagcuccagc

SEQ ID NO: 393178 - RNA, 21 nt, Bordetella pertussis
accauguugcuuggcgucagc

SEQ ID NO: 393179 - RNA, 22 nt, Bordetella pertussis
accauuucgauuucggcggcca

SEQ ID NO: 393180 - RNA, 14 nt, Bordetella pertussis
acccacccccagca

SEQ ID NO: 393181 - RNA, 18 nt, Bordetella pertussis
acccaccuggccacaagc

SEQ ID NO: 393182 - RNA, 17 nt, Bordetella pertussis
acccaggcccaguugac

SEQ ID NO: 393183 - RNA, 21 nt, Bordetella pertussis
acccaggcgccgauccagggc

SEQ ID NO: 393184 - RNA, 20 nt, Bordetella pertussis
acccaggccggcgccagccg

SEQ ID NO: 393185 - RNA, 18 nt, Bordetella pertussis
acccauaccagcccggcg

SEQ ID NO: 393186 - RNA, 19 nt, Bordetella pertussis
accccggucagcagggcgc

SEQ ID NO: 393187 - RNA, 20 nt, Bordetella pertussis
accccgucaugcgccaugaa

SEQ ID NO: 393188 - RNA, 14 nt, Bordetella pertussis
acccgaaggcgcgg

SEQ ID NO: 393189 - RNA, 16 nt, Bordetella pertussis
acccgauaugccaagg

SEQ ID NO: 393190 - RNA, 14 nt, Bordetella pertussis
acccgcaccgacgg

SEQ ID NO: 393191 - RNA, 21 nt, Bordetella pertussis
acccgcacgccggccugcgcc

SEQ ID NO: 393192 - RNA, 13 nt, Bordetella pertussis
acccgcaggcggc

SEQ ID NO: 393193 - RNA, 21 nt, Bordetella pertussis
acccgcgcccagcuguccaag

SEQ ID NO: 393194 - RNA, 23 nt, Bordetella pertussis
acccgcggccagggugccccgcc

SEQ ID NO: 393195 - RNA, 22 nt, Bordetella pertussis
acccgcggcgcaugcagccgca

SEQ ID NO: 393196 - RNA, 12 nt, Bordetella pertussis
acccggccgcug

SEQ ID NO: 393197 - RNA, 23 nt, Bordetella pertussis
acccggccggcgccggcaaaccc

SEQ ID NO: 393198 - RNA, 18 nt, Bordetella pertussis
acccggcgaagccggcac

SEQ ID NO: 393199 - RNA, 20 nt, Bordetella pertussis
acccggcgaggccgcccgcc

SEQ ID NO: 393200 - RNA, 19 nt, Bordetella pertussis
acccggucgaucagggcgc

SEQ ID NO: 393201 - RNA, 16 nt, Bordetella pertussis
acccguuccccaucau

SEQ ID NO: 393202 - RNA, 15 nt, Bordetella pertussis
acccucagcccgcac

SEQ ID NO: 393203 - RNA, 22 nt, Bordetella pertussis
acccucagcccgcaccgcccgc

SEQ ID NO: 393204 - RNA, 20 nt, Bordetella pertussis
acccucccacgaccugcaac

SEQ ID NO: 393205 - RNA, 19 nt, Bordetella pertussis
acccugccgugcagauggc

SEQ ID NO: 393206 - RNA, 20 nt, Bordetella pertussis
acccugccgugcagauggcg

SEQ ID NO: 393207 - RNA, 20 nt, Bordetella pertussis
acccugccucagaccacgac

SEQ ID NO: 393208 - RNA, 19 nt, Bordetella pertussis
acccugcucuacaccauca

SEQ ID NO: 393209 - RNA, 14 nt, Bordetella pertussis
acccuugccgcagg

SEQ ID NO: 393210 - RNA, 18 nt, Bordetella pertussis
acccuuuuuacaugcagc

SEQ ID NO: 393211 - RNA, 22 nt, Bordetella pertussis
accgaaccgauccagcccgcgg

SEQ ID NO: 393212 - RNA, 15 nt, Bordetella pertussis
accgaagcggcguuc

SEQ ID NO: 393213 - RNA, 13 nt, Bordetella pertussis
accgacagcaagg

SEQ ID NO: 393214 - RNA, 13 nt, Bordetella pertussis
accgacagcacau

SEQ ID NO: 393215 - RNA, 14 nt, Bordetella pertussis
accgacagcacaug

SEQ ID NO: 393216 - RNA, 14 nt, Bordetella pertussis
accgacaggccugg

SEQ ID NO: 393217 - RNA, 13 nt, Bordetella pertussis
accgagcccggca

SEQ ID NO: 393218 - RNA, 14 nt, Bordetella pertussis
accgagcccggcac

SEQ ID NO: 393219 - RNA, 17 nt, Bordetella pertussis
accgagcccggcaccau

SEQ ID NO: 393220 - RNA, 18 nt, Bordetella pertussis
accgagcugagcaccagc

SEQ ID NO: 393221 - RNA, 21 nt, Bordetella pertussis
accgagcugagcaccagcagc

SEQ ID NO: 393222 - RNA, 20 nt, Bordetella pertussis
accgagggcgcguccaagca

SEQ ID NO: 393223 - RNA, 17 nt, Bordetella pertussis
accgaggugccagccug

SEQ ID NO: 393224 - RNA, 14 nt, Bordetella pertussis
accgauccagcccg

SEQ ID NO: 393225 - RNA, 15 nt, Bordetella pertussis
accgcaaggaagugg

SEQ ID NO: 393226 - RNA, 16 nt, Bordetella pertussis
accgcagaagcagccg

SEQ ID NO: 393227 - RNA, 18 nt, Bordetella pertussis
accgcagaagcagccgcg

SEQ ID NO: 393228 - RNA, 16 nt, Bordetella pertussis
accgcauagcgcauga

SEQ ID NO: 393229 - RNA, 16 nt, Bordetella pertussis
accgcauagcuggaga

SEQ ID NO: 393230 - RNA, 21 nt, Bordetella pertussis
accgccacgcgguccagcccc

SEQ ID NO: 393231 - RNA, 23 nt, Bordetella pertussis
accgccacgucauaggcuucgcc

SEQ ID NO: 393232 - RNA, 15 nt, Bordetella pertussis
accgccagcccgguc

SEQ ID NO: 393233 - RNA, 15 nt, Bordetella pertussis
accgccgccagcagc

SEQ ID NO: 393234 - RNA, 15 nt, Bordetella pertussis
accgccgcccgccag

SEQ ID NO: 393235 - RNA, 14 nt, Bordetella pertussis
accgccgccggccc

SEQ ID NO: 393236 - RNA, 14 nt, Bordetella pertussis
accgccgccugcgc

SEQ ID NO: 393237 - RNA, 13 nt, Bordetella pertussis
accgccgcgccca

SEQ ID NO: 393238 - RNA, 17 nt, Bordetella pertussis
accgccgcggcuugccg

SEQ ID NO: 393239 - RNA, 18 nt, Bordetella pertussis
accgccgcguccucggcc

SEQ ID NO: 393240 - RNA, 23 nt, Bordetella pertussis
accgccgcguccucggccuggcc

SEQ ID NO: 393241 - RNA, 15 nt, Bordetella pertussis
accgcgcagcccggc

SEQ ID NO: 393242 - RNA, 15 nt, Bordetella pertussis
accgcgcagccgcuu

SEQ ID NO: 393243 - RNA, 11 nt, Bordetella pertussis
accgcggcgca

SEQ ID NO: 393244 - RNA, 18 nt, Bordetella pertussis
accgcggcgguccugcug

SEQ ID NO: 393245 - RNA, 17 nt, Bordetella pertussis
accgcgguacgcgggca

SEQ ID NO: 393246 - RNA, 22 nt, Bordetella pertussis
accgcgucggccugccagccug

SEQ ID NO: 393247 - RNA, 13 nt, Bordetella pertussis
acgcacagcaugc

SEQ ID NO: 393248 - RNA, 18 nt, Bordetella pertussis
acgcaccuuucugcugcu

SEQ ID NO: 393249 - RNA, 19 nt, Bordetella pertussis
acgcaccuuucugcugcuc

SEQ ID NO: 393250 - RNA, 18 nt, Bordetella pertussis
acgcacgauuucacccag

SEQ ID NO: 393251 - RNA, 20 nt, Bordetella pertussis
acgcacugagcuucgccccc

SEQ ID NO: 393252 - RNA, 20 nt, Bordetella pertussis
acgcagaaauggaugcgcgc

SEQ ID NO: 393253 - RNA, 15 nt, Bordetella pertussis
acgcagaccacgccg

SEQ ID NO: 393254 - RNA, 13 nt, Bordetella pertussis
acgcagccgcccg

SEQ ID NO: 393255 - RNA, 14 nt, Bordetella pertussis
acgcagccgcccgg

SEQ ID NO: 393256 - RNA, 15 nt, Bordetella pertussis
acgcagccgcccggc

SEQ ID NO: 393257 - RNA, 17 nt, Bordetella pertussis
acgcagccgcccggcag

SEQ ID NO: 393258 - RNA, 15 nt, Bordetella pertussis
acgcagcgcaccgac

SEQ ID NO: 393259 - RNA, 23 nt, Bordetella pertussis
acgcagcgcaggauuuccucgcc

SEQ ID NO: 393260 - RNA, 16 nt, Bordetella pertussis
acgcaggagucggagg

SEQ ID NO: 393261 - RNA, 16 nt, Bordetella pertussis
acgcaggcccagccag

SEQ ID NO: 393262 - RNA, 17 nt, Bordetella pertussis
acgcaggcccagccagc

SEQ ID NO: 393263 - RNA, 22 nt, Bordetella pertussis
acgcaggcgccgccccgucauc

SEQ ID NO: 393264 - RNA, 13 nt, Bordetella pertussis
acgcaggcgggcg

SEQ ID NO: 393265 - RNA, 13 nt, Bordetella pertussis
acgccaaggagac

SEQ ID NO: 393266 - RNA, 16 nt, Bordetella pertussis
acgccacaaagccucc

SEQ ID NO: 393267 - RNA, 20 nt, Bordetella pertussis
acgccacuggccuugugcgc

SEQ ID NO: 393268 - RNA, 20 nt, Bordetella pertussis
acgccaucuugcaggcgcca

SEQ ID NO: 393269 - RNA, 16 nt, Bordetella pertussis
acgcccacgcgccgcc

SEQ ID NO: 393270 - RNA, 15 nt, Bordetella pertussis
acgcccagccgcagc

SEQ ID NO: 393271 - RNA, 19 nt, Bordetella pertussis
acgcccagccgcagcaggc

SEQ ID NO: 393272 - RNA, 12 nt, Bordetella pertussis
acgcccagcagg

SEQ ID NO: 393273 - RNA, 17 nt, Bordetella pertussis
acgcccagccugccggc

SEQ ID NO: 393274 - RNA, 15 nt, Bordetella pertussis
acgcccaucugccag

SEQ ID NO: 393275 - RNA, 19 nt, Bordetella pertussis
acgcccgacgguaucucag

SEQ ID NO: 393276 - RNA, 19 nt, Bordetella pertussis
acgcccgccugcagcagcg

SEQ ID NO: 393277 - RNA, 14 nt, Bordetella pertussis
acgcccgcgccgca

SEQ ID NO: 393278 - RNA, 15 nt, Bordetella pertussis
acgcccuggcagcug

SEQ ID NO: 393279 - RNA, 16 nt, Bordetella pertussis
acgcccuggcagcugg

SEQ ID NO: 393280 - RNA, 21 nt, Bordetella pertussis
acgcccuggcgcaggccggcg

SEQ ID NO: 393281 - RNA, 16 nt, Bordetella pertussis
acgccgaccucggcac

SEQ ID NO: 393282 - RNA, 19 nt, Bordetella pertussis
acgccgaccucggcaccga

SEQ ID NO: 393283 - RNA, 21 nt, Bordetella pertussis
acgccgagaagauuucccaga

SEQ ID NO: 393284 - RNA, 19 nt, Bordetella pertussis
acgccgaugaccagggcgc

SEQ ID NO: 393285 - RNA, 18 nt, Bordetella pertussis
acgccgccaccagggcgc

SEQ ID NO: 393286 - RNA, 17 nt, Bordetella pertussis
acgccgccggcagggcc

SEQ ID NO: 393287 - RNA, 15 nt, Bordetella pertussis
acgccgcgccaggca

SEQ ID NO: 393288 - RNA, 17 nt, Bordetella pertussis
acgccgcgcgcgucgcc

SEQ ID NO: 393289 - RNA, 16 nt, Bordetella pertussis
acgccgcggugcuggg

SEQ ID NO: 393290 - RNA, 18 nt, Bordetella pertussis
acgccgcggugcugggcu

SEQ ID NO: 393291 - RNA, 18 nt, Bordetella pertussis
acgccggccagcuugagc

SEQ ID NO: 393292 - RNA, 21 nt, Bordetella pertussis
acgccggccauggcggccggc

SEQ ID NO: 393293 - RNA, 21 nt, Bordetella pertussis
acgccggccgccauggccggc

SEQ ID NO: 393294 - RNA, 13 nt, Bordetella pertussis
acgccggcggcca

SEQ ID NO: 393295 - RNA, 18 nt, Bordetella pertussis
acgccggcucaggccagc

SEQ ID NO: 393296 - RNA, 24 nt, Bordetella pertussis
acgccggcuucagccgcaagcugg

SEQ ID NO: 393297 - RNA, 22 nt, Bordetella pertussis
acgccgggcgcgcugcccagcc

SEQ ID NO: 393298 - RNA, 23 nt, Bordetella pertussis
acgccgggcgcgcugcccagcca

SEQ ID NO: 393299 - RNA, 15 nt, Bordetella pertussis
acgccgguguucucg

SEQ ID NO: 393300 - RNA, 14 nt, Bordetella pertussis
acgccugcaccgcc

SEQ ID NO: 393301 - RNA, 17 nt, Bordetella pertussis
acgccugccgcgcccgg

SEQ ID NO: 393302 - RNA, 15 nt, Bordetella pertussis
acgccuuccuugaac

SEQ ID NO: 393303 - RNA, 14 nt, Bordetella pertussis
acgccuucgagcac

SEQ ID NO: 393304 - RNA, 16 nt, Bordetella pertussis
acgccuucgagcacca

SEQ ID NO: 393305 - RNA, 23 nt, Bordetella pertussis
acgccuucggcgacuucggcggc

SEQ ID NO: 393306 - RNA, 19 nt, Bordetella pertussis
acgcgacaguucgcccccc

SEQ ID NO: 393307 - RNA, 18 nt, Bordetella pertussis
acgcgaugcccgcgcacc

SEQ ID NO: 393308 - RNA, 23 nt, Bordetella pertussis
acgcgaugcccgcgcaccaggcg

SEQ ID NO: 393309 - RNA, 17 nt, Bordetella pertussis
acgcgcaccaggccugc

SEQ ID NO: 393310 - RNA, 16 nt, Bordetella pertussis
acgcgcagcacgcugc

SEQ ID NO: 393311 - RNA, 16 nt, Bordetella pertussis
acgcgcagcggcaggc

SEQ ID NO: 393312 - RNA, 20 nt, Bordetella pertussis
acgcgcagcggcaggcccug

SEQ ID NO: 393313 - RNA, 17 nt, Bordetella pertussis
acgcgcaguccgcacag

SEQ ID NO: 393314 - RNA, 16 nt, Bordetella pertussis
acgcgccgaacaccag

SEQ ID NO: 393315 - RNA, 13 nt, Bordetella pertussis
acgcgccgcccgg

SEQ ID NO: 393316 - RNA, 20 nt, Bordetella pertussis
acgcgccgcuguaccguucg

SEQ ID NO: 393317 - RNA, 17 nt, Bordetella pertussis
acgcgccggcccaggcg

SEQ ID NO: 393318 - RNA, 12 nt, Bordetella pertussis
acgcgcgcgccg

SEQ ID NO: 393319 - RNA, 23 nt, Bordetella pertussis
acgcgcgcgccgccggccagccu

SEQ ID NO: 393320 - RNA, 19 nt, Bordetella pertussis
acgcgcgcgcgcacaggcg

SEQ ID NO: 393321 - RNA, 19 nt, Bordetella pertussis
acgcgcgcggcgcggcugg

SEQ ID NO: 393322 - RNA, 20 nt, Bordetella pertussis
acgcgcugggcguggcgcgc

SEQ ID NO: 393323 - RNA, 18 nt, Bordetella pertussis
acgcgcugguaguagagc

SEQ ID NO: 393324 - RNA, 20 nt, Bordetella pertussis
acgcgcuguaggcgccggcg

SEQ ID NO: 393325 - RNA, 20 nt, Bordetella pertussis
acgcgcuguugcuggccacc

SEQ ID NO: 393326 - RNA, 23 nt, Bordetella pertussis
acgcgcuccagcgugucgaacac

SEQ ID NO: 393327 - RNA, 13 nt, Bordetella pertussis
acgcggcagggcc

SEQ ID NO: 393328 - RNA, 18 nt, Bordetella pertussis
acgcggccgcgggccgcu

SEQ ID NO: 393329 - RNA, 13 nt, Bordetella pertussis
acgcggccgggca

SEQ ID NO: 393330 - RNA, 19 nt, Bordetella pertussis
acgcggccguggaggcggc

SEQ ID NO: 393331 - RNA, 21 nt, Bordetella pertussis
acgcggcgcgcgccugcagca

SEQ ID NO: 393332 - RNA, 20 nt, Bordetella pertussis
acgcggcgcugcuggccggc

SEQ ID NO: 393333 - RNA, 12 nt, Bordetella pertussis
acgcggcggccg

SEQ ID NO: 393334 - RNA, 22 nt, Bordetella pertussis
acgcggcggccgguaucggccu

SEQ ID NO: 393335 - RNA, 15 nt, Bordetella pertussis
acgcgggccggccgu

SEQ ID NO: 393336 - RNA, 18 nt, Bordetella pertussis
acgcgggcuugcugcccc

SEQ ID NO: 393337 - RNA, 16 nt, Bordetella pertussis
acgcggggacaggcac

SEQ ID NO: 393338 - RNA, 18 nt, Bordetella pertussis
acgcggggacaggcacac

SEQ ID NO: 393339 - RNA, 14 nt, Bordetella pertussis
acgcgguccagccc

SEQ ID NO: 393340 - RNA, 22 nt, Bordetella pertussis
acgcggucgcauuggccgccgc

SEQ ID NO: 393341 - RNA, 23 nt, Bordetella pertussis
acgcguaggucaggcccacgccg

SEQ ID NO: 393342 - RNA, 22 nt, Bordetella pertussis
acgcguccaggcccuggcggcg

SEQ ID NO: 393343 - RNA, 15 nt, Bordetella pertussis
acgcguccucggcca

SEQ ID NO: 393344 - RNA, 19 nt, Bordetella pertussis
acgcguccucggccagccg

SEQ ID NO: 393345 - RNA, 23 nt, Bordetella pertussis
acgcgucgcucauggaggggcgc

SEQ ID NO: 393346 - RNA, 23 nt, Bordetella pertussis
acgcguucgggcggcaggugcgc

SEQ ID NO: 393347 - RNA, 22 nt, Bordetella pertussis
acgcguuguucgggccggcugc

SEQ ID NO: 393348 - RNA, 17 nt, Bordetella pertussis
acgcucacgcccguguc

SEQ ID NO: 393349 - RNA, 23 nt, Bordetella pertussis
acgcucgaugcgccaguccagcg

SEQ ID NO: 393350 - RNA, 16 nt, Bordetella pertussis
acgcucuugagcgcgg

SEQ ID NO: 393351 - RNA, 15 nt, Bordetella pertussis
acgcugaucgccggc

SEQ ID NO: 393352 - RNA, 16 nt, Bordetella pertussis
acgcugaucgccggcg

SEQ ID NO: 393353 - RNA, 15 nt, Bordetella pertussis
acgcugauggccgcc

SEQ ID NO: 393354 - RNA, 21 nt, Bordetella pertussis
acgcugcccugcugcugcagc

SEQ ID NO: 393355 - RNA, 18 nt, Bordetella pertussis
acgcugcgcgaugcgcgc

SEQ ID NO: 393356 - RNA, 18 nt, Bordetella pertussis
acgcuuccugggccugcg

SEQ ID NO: 393357 - RNA, 14 nt, Bordetella pertussis
acgcuucguucagc

SEQ ID NO: 393358 - RNA, 17 nt, Bordetella pertussis
acgcuugacggccagga

SEQ ID NO: 393359 - RNA, 15 nt, Bordetella pertussis
acgcuugccgcaacc

SEQ ID NO: 393360 - RNA, 19 nt, Bordetella pertussis
acggauaauugggcggcau

SEQ ID NO: 393361 - RNA, 20 nt, Bordetella pertussis
acggauaauugggcggcauc

SEQ ID NO: 393362 - RNA, 16 nt, Bordetella pertussis
acggcagaugaucuac

SEQ ID NO: 393363 - RNA, 15 nt, Bordetella pertussis
acggcagcagcgcgc

SEQ ID NO: 393364 - RNA, 12 nt, Bordetella pertussis
acggcagcuugu

SEQ ID NO: 393365 - RNA, 22 nt, Bordetella pertussis
acggcaucgauuucucgcugcu

SEQ ID NO: 393366 - RNA, 19 nt, Bordetella pertussis
acggcgcacaccaucagcu

SEQ ID NO: 393367 - RNA, 18 nt, Bordetella pertussis
acggcgcccugcagggca

SEQ ID NO: 393368 - RNA, 17 nt, Bordetella pertussis
acggcgccgugcuggag

SEQ ID NO: 393369 - RNA, 20 nt, Bordetella pertussis
acggcgcgcccgcaggcggc

SEQ ID NO: 393370 - RNA, 16 nt, Bordetella pertussis
acggcgcgcgccugcu

SEQ ID NO: 393371 - RNA, 15 nt, Bordetella pertussis
acggcgcggugccug

SEQ ID NO: 393372 - RNA, 19 nt, Bordetella pertussis
acggcgcggugccugugcc

SEQ ID NO: 393373 - RNA, 15 nt, Bordetella pertussis
acggcgcggccugcu

SEQ ID NO: 393374 - RNA, 11 nt, Bordetella pertussis
acggcgcucuu

SEQ ID NO: 393375 - RNA, 17 nt, Bordetella pertussis
acggcggugaccaccag

SEQ ID NO: 393376 - RNA, 22 nt, Bordetella pertussis
acggcgucgggcagcaggcgca

SEQ ID NO: 393377 - RNA, 14 nt, Bordetella pertussis
acggcguggcgcgc

SEQ ID NO: 393378 - RNA, 23 nt, Bordetella pertussis
acggcuggguucaggccuguucg

SEQ ID NO: 393379 - RNA, 15 nt, Bordetella pertussis
acggcuggcugggcg

SEQ ID NO: 393380 - RNA, 22 nt, Bordetella pertussis
acggcuugaccacggccagcag

SEQ ID NO: 393381 - RNA, 16 nt, Bordetella pertussis
acggcuugcgcgccug

SEQ ID NO: 393382 - RNA, 18 nt, Bordetella pertussis
acggcuugcgcgccugcu

SEQ ID NO: 393383 - RNA, 19 nt, Bordetella pertussis
acgggaauggcggacacgc

SEQ ID NO: 393384 - RNA, 18 nt, Bordetella pertussis
acgggcaggcccagccag

SEQ ID NO: 393385 - RNA, 16 nt, Bordetella pertussis
acguagucggcgccca

SEQ ID NO: 393386 - RNA, 23 nt, Bordetella pertussis
acguaguugguggcaggcgccca

SEQ ID NO: 393387 - RNA, 16 nt, Bordetella pertussis
acgucaaggccugccc

SEQ ID NO: 393388 - RNA, 18 nt, Bordetella pertussis
acgucaaggccugcccgg

SEQ ID NO: 393389 - RNA, 22 nt, Bordetella pertussis
acgucaccccgcccugcccggc

SEQ ID NO: 393390 - RNA, 22 nt, Bordetella pertussis
acgucauugcaucgcagcagaa

SEQ ID NO: 393391 - RNA, 11 nt, Bordetella pertussis
acguccagcac

SEQ ID NO: 393392 - RNA, 22 nt, Bordetella pertussis
acguggacucgauggcgcaggc

SEQ ID NO: 393393 - RNA, 16 nt, Bordetella pertussis
acguggcgcggcugcu

SEQ ID NO: 393394 - RNA, 18 nt, Bordetella pertussis
acguggcgcuccaugcgg

SEQ ID NO: 393395 - RNA, 18 nt, Bordetella pertussis
acguggcguccacgcggg

SEQ ID NO: 393396 - RNA, 18 nt, Bordetella pertussis
acgugggcacgccggccu

SEQ ID NO: 393397 - RNA, 22 nt, Bordetella pertussis
acgugggcacgccggccuugcu

SEQ ID NO: 393398 - RNA, 17 nt, Bordetella pertussis
acguggucgugcaggac

SEQ ID NO: 393399 - RNA, 18 nt, Bordetella pertussis
acguucagcgccggcaug

SEQ ID NO: 393400 - RNA, 21 nt, Bordetella pertussis
acuaagaugaaucgcaugcgg

SEQ ID NO: 393401 - RNA, 22 nt, Bordetella pertussis
acucaccgccgcccgcaggcau

SEQ ID NO: 393402 - RNA, 14 nt, Bordetella pertussis
acucaccgccgccc

SEQ ID NO: 393403 - RNA, 14 nt, Bordetella pertussis
acucaugcgcugca

SEQ ID NO: 393404 - RNA, 21 nt, Bordetella pertussis
acuccaggaaagcgccgccgc

SEQ ID NO: 393405 - RNA, 17 nt, Bordetella pertussis
acucccacgcucuggag

SEQ ID NO: 393406 - RNA, 20 nt, Bordetella pertussis
acucgcacacgcgcugggcg

SEQ ID NO: 393407 - RNA, 17 nt, Bordetella pertussis
acucgcccgaugccgau

SEQ ID NO: 393408 - RNA, 16 nt, Bordetella pertussis
acucgcgcucggccag

SEQ ID NO: 393409 - RNA, 19 nt, Bordetella pertussis
acucgcgcucggccagcgc

SEQ ID NO: 393410 - RNA, 21 nt, Bordetella pertussis
acucgcgcucggccagcgcgc

SEQ ID NO: 393411 - RNA, 16 nt, Bordetella pertussis
acucgucgaccaccag

SEQ ID NO: 393412 - RNA, 13 nt, Bordetella pertussis
acucuuccccguc

SEQ ID NO: 393413 - RNA, 20 nt, Bordetella pertussis
acugaacgcguccaggcccu

SEQ ID NO: 393414 - RNA, 14 nt, Bordetella pertussis
acuucggccgccag

SEQ ID NO: 393415 - RNA, 13 nt, Bordetella pertussis
acuucggcggcca

SEQ ID NO: 393416 - RNA, 16 nt, Bordetella pertussis
acuucggucagcuugc

SEQ ID NO: 393417 - RNA, 19 nt, Bordetella pertussis
acuucguggcgcagcuccg

SEQ ID NO: 393418 - RNA, 17 nt, Bordetella pertussis
acuucuggggugccugu

SEQ ID NO: 393419 - RNA, 18 nt, Bordetella pertussis
acuugaacggcgcggccu

SEQ ID NO: 393420 - RNA, 20 nt, Bordetella pertussis
acuuggcgcgguccacgccc

SEQ ID NO: 393421 - RNA, 15 nt, Bordetella pertussis
acuuggugggcaccu

SEQ ID NO: 393422 - RNA, 13 nt, Bordetella pertussis
acuuguucuuguu

SEQ ID NO: 393423 - RNA, 15 nt, Bordetella pertussis
agaaauagcccgcgg

SEQ ID NO: 393424 - RNA, 22 nt, Bordetella pertussis
agaagccgaugucgaacagcug

SEQ ID NO: 393425 - RNA, 15 nt, Bordetella pertussis
agaaggcgaacuggg

SEQ ID NO: 393426 - RNA, 23 nt, Bordetella pertussis
agacaugcucgaugccggccucg

SEQ ID NO: 393427 - RNA, 19 nt, Bordetella pertussis
agacauugcccagcaccac

SEQ ID NO: 393428 - RNA, 17 nt, Bordetella pertussis
agaccaagcgccacagc

SEQ ID NO: 393429 - RNA, 20 nt, Bordetella pertussis
agacccgggccgcuggcccg

SEQ ID NO: 393430 - RNA, 14 nt, Bordetella pertussis
agaccggcgccugc

SEQ ID NO: 393431 - RNA, 17 nt, Bordetella pertussis
agaccggcgccugcggc

SEQ ID NO: 393432 - RNA, 18 nt, Bordetella pertussis
agaccggcgccugcggca

SEQ ID NO: 393433 - RNA, 21 nt, Bordetella pertussis
agaccggguugcccggcaggc

SEQ ID NO: 393434 - RNA, 21 nt, Bordetella pertussis
agacgaaggcgccggccaggc

SEQ ID NO: 393435 - RNA, 18 nt, Bordetella pertussis
agacgccaucuugcaggc

SEQ ID NO: 393436 - RNA, 19 nt, Bordetella pertussis
agacgccaucuugcaggcg

SEQ ID NO: 393437 - RNA, 20 nt, Bordetella pertussis
agacgccaucuugcaggcgc

SEQ ID NO: 393438 - RNA, 12 nt, Bordetella pertussis
agacgccgggac

SEQ ID NO: 393439 - RNA, 16 nt, Bordetella pertussis
agacgcggggacaggc

SEQ ID NO: 393440 - RNA, 18 nt, Bordetella pertussis
agacgcggggacaggcac

SEQ ID NO: 393441 - RNA, 19 nt, Bordetella pertussis
agacuggcaccggccaagc

SEQ ID NO: 393442 - RNA, 16 nt, Bordetella pertussis
agacuuccgugccaua

SEQ ID NO: 393443 - RNA, 19 nt, Bordetella pertussis
agagcaggccgcccagcgc

SEQ ID NO: 393444 - RNA, 17 nt, Bordetella pertussis
agagcaugcggcguccu

SEQ ID NO: 393445 - RNA, 20 nt, Bordetella pertussis
agagcaugcggcguccugcc

SEQ ID NO: 393446 - RNA, 22 nt, Bordetella pertussis
agagccggccacgcgcugcagc

SEQ ID NO: 393447 - RNA, 23 nt, Bordetella pertussis
agagccggccacgcgcugcagca

SEQ ID NO: 393448 - RNA, 15 nt, Bordetella pertussis
agagcuccagccggg

SEQ ID NO: 393449 - RNA, 22 nt, Bordetella pertussis
agaggcauuggcggcggcguuc

SEQ ID NO: 393450 - RNA, 12 nt, Bordetella pertussis
agaggccaggcc

SEQ ID NO: 393451 - RNA, 14 nt, Bordetella pertussis
agaggccaggcccu

SEQ ID NO: 393452 - RNA, 20 nt, Bordetella pertussis
agaguguugacgguggucgg

SEQ ID NO: 393453 - RNA, 14 nt, Bordetella pertussis
agcaaacaggcugc

SEQ ID NO: 393454 - RNA, 12 nt, Bordetella pertussis
agcaacaaccgc

SEQ ID NO: 393455 - RNA, 13 nt, Bordetella pertussis
agcaaccccagca

SEQ ID NO: 393456 - RNA, 16 nt, Bordetella pertussis
agcaaccccagcagcg

SEQ ID NO: 393457 - RNA, 20 nt, Bordetella pertussis
agcaaccggaacaccagcaa

SEQ ID NO: 393458 - RNA, 21 nt, Bordetella pertussis
agcaacggugagccggccacc

SEQ ID NO: 393459 - RNA, 16 nt, Bordetella pertussis
agcaagaaucggggcg

SEQ ID NO: 393460 - RNA, 22 nt, Bordetella pertussis
agcaagcccaccgggccggccu

SEQ ID NO: 393461 - RNA, 22 nt, Bordetella pertussis
agcaaggcgucgaagccgguga

SEQ ID NO: 393462 - RNA, 23 nt, Bordetella pertussis
agcaaggcgucggccaggccgau

SEQ ID NO: 393463 - RNA, 13 nt, Bordetella pertussis
agcaagggcccca

SEQ ID NO: 393464 - RNA, 14 nt, Bordetella pertussis
agcaauccgaggcc

SEQ ID NO: 393465 - RNA, 20 nt, Bordetella pertussis
agcaauggauucgauugccu

SEQ ID NO: 393466 - RNA, 17 nt, Bordetella pertussis
agcaauugccccagcac

SEQ ID NO: 393467 - RNA, 19 nt, Bordetella pertussis
agcacaucgacgucggccu

SEQ ID NO: 393468 - RNA, 16 nt, Bordetella pertussis
agcacaucgcccggca

SEQ ID NO: 393469 - RNA, 15 nt, Bordetella pertussis
agcacauggcgcgcc

SEQ ID NO: 393470 - RNA, 23 nt, Bordetella pertussis
agcacaugggcgcgguagcgccc

SEQ ID NO: 393471 - RNA, 16 nt, Bordetella pertussis
agcaccacggcggcca

SEQ ID NO: 393472 - RNA, 15 nt, Bordetella pertussis
agcaccagcagcccc

SEQ ID NO: 393473 - RNA, 17 nt, Bordetella pertussis
agcaccagcgccugccg

SEQ ID NO: 393474 - RNA, 14 nt, Bordetella pertussis
agcaccagcuccuc

SEQ ID NO: 393475 - RNA, 19 nt, Bordetella pertussis
agcaccaggccgccggcca

SEQ ID NO: 393476 - RNA, 22 nt, Bordetella pertussis
agcaccagggcgcgcagcaggc

SEQ ID NO: 393477 - RNA, 21 nt, Bordetella pertussis
agcaccgccaccguggcgucc

SEQ ID NO: 393478 - RNA, 17 nt, Bordetella pertussis
agcaccgccgccaguuc

SEQ ID NO: 393479 - RNA, 16 nt, Bordetella pertussis
agcaccgcgaccaugc

SEQ ID NO: 393480 - RNA, 18 nt, Bordetella pertussis
agcaccgcgaccaugcgg

SEQ ID NO: 393481 - RNA, 22 nt, Bordetella pertussis
agcaccgcgcgcacgaccacca

SEQ ID NO: 393482 - RNA, 21 nt, Bordetella pertussis
agcaccggcacgcgccaggcg

SEQ ID NO: 393483 - RNA, 14 nt, Bordetella pertussis
agcaccggcugcca

SEQ ID NO: 393484 - RNA, 22 nt, Bordetella pertussis
agcaccucggacgagacaggcg

SEQ ID NO: 393485 - RNA, 19 nt, Bordetella pertussis
agcaccucggcgcccagcu

SEQ ID NO: 393486 - RNA, 21 nt, Bordetella pertussis
agcaccuugaccuggucggcc

SEQ ID NO: 393487 - RNA, 19 nt, Bordetella pertussis
agcacgaagggcagcagca

SEQ ID NO: 393488 - RNA, 22 nt, Bordetella pertussis
agcacgagauguccauggccug

SEQ ID NO: 393489 - RNA, 19 nt, Bordetella pertussis
agcacgaucuggcgcgcga

SEQ ID NO: 393490 - RNA, 19 nt, Bordetella pertussis
agcacgauggggccauggc

SEQ ID NO: 393491 - RNA, 20 nt, Bordetella pertussis
agcacgauggggccauggca

SEQ ID NO: 393492 - RNA, 16 nt, Bordetella pertussis
agcacgcaccaggcgc

SEQ ID NO: 393493 - RNA, 17 nt, Bordetella pertussis
agcacgcaccaggcgca

SEQ ID NO: 393494 - RNA, 16 nt, Bordetella pertussis
agcacgcccaugguca

SEQ ID NO: 393495 - RNA, 22 nt, Bordetella pertussis
agcacgcccauggucaggacga

SEQ ID NO: 393496 - RNA, 12 nt, Bordetella pertussis
agcacgccccaa

SEQ ID NO: 393497 - RNA, 18 nt, Bordetella pertussis
agcacgcccgccagcagc

SEQ ID NO: 393498 - RNA, 19 nt, Bordetella pertussis
agcacgcccgccagcagcu

SEQ ID NO: 393499 - RNA, 13 nt, Bordetella pertussis
agcacgcccgcgc

SEQ ID NO: 393500 - RNA, 17 nt, Bordetella pertussis
agcacgcccgcgcgcga

SEQ ID NO: 393501 - RNA, 18 nt, Bordetella pertussis
agcacgccgaucgcgcac

SEQ ID NO: 393502 - RNA, 18 nt, Bordetella pertussis
agcacgccgcgccaggca

SEQ ID NO: 393503 - RNA, 16 nt, Bordetella pertussis
agcacgccggccaggu

SEQ ID NO: 393504 - RNA, 18 nt, Bordetella pertussis
agcacgcgcaccaggccu

SEQ ID NO: 393505 - RNA, 12 nt, Bordetella pertussis
agcacggccacg

SEQ ID NO: 393506 - RNA, 19 nt, Bordetella pertussis
agcacggccgcggccggca

SEQ ID NO: 393507 - RNA, 20 nt, Bordetella pertussis
agcacgguggcgcccggcgg

SEQ ID NO: 393508 - RNA, 19 nt, Bordetella pertussis
agcacgguugccacgguga

SEQ ID NO: 393509 - RNA, 13 nt, Bordetella pertussis
agcacguccagcg

SEQ ID NO: 393510 - RNA, 15 nt, Bordetella pertussis
agcacguucuugccc

SEQ ID NO: 393511 - RNA, 21 nt, Bordetella pertussis
agcacugcaccugcuccagcg

SEQ ID NO: 393512 - RNA, 12 nt, Bordetella pertussis
agcacugcaggc

SEQ ID NO: 393513 - RNA, 22 nt, Bordetella pertussis
agcacuugccggccgcccaggc

SEQ ID NO: 393514 - RNA, 23 nt, Bordetella pertussis
agcacuuucgacacggggcaacc

SEQ ID NO: 393515 - RNA, 19 nt, Bordetella pertussis
agcagaaugccgcccacga

SEQ ID NO: 393516 - RNA, 21 nt, Bordetella pertussis
agcagaauguauuggcccagu

SEQ ID NO: 393517 - RNA, 15 nt, Bordetella pertussis
agcagacccuggcgc

SEQ ID NO: 393518 - RNA, 16 nt, Bordetella pertussis
agcagauaccggcaug

SEQ ID NO: 393519 - RNA, 19 nt, Bordetella pertussis
agcagauaccggcauggca

SEQ ID NO: 393520 - RNA, 16 nt, Bordetella pertussis
agcagaucggcggccu

SEQ ID NO: 393521 - RNA, 20 nt, Bordetella pertussis
agcagaucggcggccugggc

SEQ ID NO: 393522 - RNA, 13 nt, Bordetella pertussis
agcagaugcaccg

SEQ ID NO: 393523 - RNA, 19 nt, Bordetella pertussis
agcagaugcgacuggcggc

SEQ ID NO: 393524 - RNA, 21 nt, Bordetella pertussis
agcagcacgaucgcggcgcug

SEQ ID NO: 393525 - RNA, 13 nt, Bordetella pertussis
agcagcacgcaga

SEQ ID NO: 393526 - RNA, 13 nt, Bordetella pertussis
agcagcacggcca

SEQ ID NO: 393527 - RNA, 23 nt, Bordetella pertussis
agcagcacggccacgaucaucag

SEQ ID NO: 393528 - RNA, 14 nt, Bordetella pertussis
agcagcaggcuggc

SEQ ID NO: 393529 - RNA, 13 nt, Bordetella pertussis
agcagcagggcca

SEQ ID NO: 393530 - RNA, 17 nt, Bordetella pertussis
agcagcagggccaggcc

SEQ ID NO: 393531 - RNA, 18 nt, Bordetella pertussis
agcagcaguugcagcaug

SEQ ID NO: 393532 - RNA, 15 nt, Bordetella pertussis
agcagcauggcgggc

SEQ ID NO: 393533 - RNA, 23 nt, Bordetella pertussis
agcagccggccaaggcaagcagc

SEQ ID NO: 393534 - RNA, 18 nt, Bordetella pertussis
agcagccgguuggcgccu

SEQ ID NO: 393535 - RNA, 16 nt, Bordetella pertussis
agcagcgagagcgcca

SEQ ID NO: 393536 - RNA, 21 nt, Bordetella pertussis
agcagcgagagcgccacgcca

SEQ ID NO: 393537 - RNA, 23 nt, Bordetella pertussis
agcagcgagcccgccaucgccag

SEQ ID NO: 393538 - RNA, 16 nt, Bordetella pertussis
agcagcgcaucgcgcg

SEQ ID NO: 393539 - RNA, 18 nt, Bordetella pertussis
agcagcgccaccguggcc

SEQ ID NO: 393540 - RNA, 20 nt, Bordetella pertussis
agcagcgccacgacgccguc

SEQ ID NO: 393541 - RNA, 14 nt, Bordetella pertussis
agcagcgcgguggc

SEQ ID NO: 393542 - RNA, 17 nt, Bordetella pertussis
agcagcggcagcagcag

SEQ ID NO: 393543 - RNA, 21 nt, Bordetella pertussis
agcagcgggcuggggcaggca

SEQ ID NO: 393544 - RNA, 11 nt, Bordetella pertussis
agcagcguggc

SEQ ID NO: 393545 - RNA, 18 nt, Bordetella pertussis
agcagcguggccgccacc

SEQ ID NO: 393546 - RNA, 13 nt, Bordetella pertussis
agcagcuccucgg

SEQ ID NO: 393547 - RNA, 19 nt, Bordetella pertussis
agcagcucggccaccgccg

SEQ ID NO: 393548 - RNA, 14 nt, Bordetella pertussis
agcagcuggcgcag

SEQ ID NO: 393549 - RNA, 23 nt, Bordetella pertussis
agcagcuuggccacuucgccggu

SEQ ID NO: 393550 - RNA, 13 nt, Bordetella pertussis
agcaggcccacca

SEQ ID NO: 393551 - RNA, 22 nt, Bordetella pertussis
agcaggcccuccggcgccagca

SEQ ID NO: 393552 - RNA, 15 nt, Bordetella pertussis
agcaggcccugggcg

SEQ ID NO: 393553 - RNA, 16 nt, Bordetella pertussis
agcaggcccugggcga

SEQ ID NO: 393554 - RNA, 21 nt, Bordetella pertussis
agcaggccgccggggaggccu

SEQ ID NO: 393555 - RNA, 14 nt, Bordetella pertussis
agcaggccggucag

SEQ ID NO: 393556 - RNA, 16 nt, Bordetella pertussis
agcaggcgcaccagcg

SEQ ID NO: 393557 - RNA, 13 nt, Bordetella pertussis
agcaggcgccugc

SEQ ID NO: 393558 - RNA, 16 nt, Bordetella pertussis
agcaggcgcgcggccu

SEQ ID NO: 393559 - RNA, 17 nt, Bordetella pertussis
agcaggcgcgcggccuc

SEQ ID NO: 393560 - RNA, 13 nt, Bordetella pertussis
agcaggcgcucgg

SEQ ID NO: 393561 - RNA, 17 nt, Bordetella pertussis
agcaggcucagcgggcu

SEQ ID NO: 393562 - RNA, 22 nt, Bordetella pertussis
agcaggcucagcgggcugcugg

SEQ ID NO: 393563 - RNA, 19 nt, Bordetella pertussis
agcagggacuugggcaggc

SEQ ID NO: 393564 - RNA, 22 nt, Bordetella pertussis
agcagggccacgcccaggccgu

SEQ ID NO: 393565 - RNA, 13 nt, Bordetella pertussis
agcagggccaggc

SEQ ID NO: 393566 - RNA, 14 nt, Bordetella pertussis
agcagggccaggcc

SEQ ID NO: 393567 - RNA, 17 nt, Bordetella pertussis
agcagggccaggccgau

SEQ ID NO: 393568 - RNA, 14 nt, Bordetella pertussis
agcagggccuggca

SEQ ID NO: 393569 - RNA, 15 nt, Bordetella pertussis
agcagggccuggcag

SEQ ID NO: 393570 - RNA, 13 nt, Bordetella pertussis
agcagggcggcgg

SEQ ID NO: 393571 - RNA, 13 nt, Bordetella pertussis
agcagggcggcgu

SEQ ID NO: 393572 - RNA, 22 nt, Bordetella pertussis
agcaggggcugccauuccagcu

SEQ ID NO: 393573 - RNA, 20 nt, Bordetella pertussis
agcagggggucgaucauggc

SEQ ID NO: 393574 - RNA, 17 nt, Bordetella pertussis
agcagggucgagaccag

SEQ ID NO: 393575 - RNA, 20 nt, Bordetella pertussis
agcagggucgagaccagcag

SEQ ID NO: 393576 - RNA, 16 nt, Bordetella pertussis
agcaggguggccacgc

SEQ ID NO: 393577 - RNA, 17 nt, Bordetella pertussis
agcaggucgagguccug

SEQ ID NO: 393578 - RNA, 19 nt, Bordetella pertussis
agcaggucgcgcacgcugg

SEQ ID NO: 393579 - RNA, 18 nt, Bordetella pertussis
agcaggucguuggccguc

SEQ ID NO: 393580 - RNA, 20 nt, Bordetella pertussis
agcaggucugcacgaggcgc

SEQ ID NO: 393581 - RNA, 21 nt, Bordetella pertussis
agcaggucugcacgaggcgcu

SEQ ID NO: 393582 - RNA, 13 nt, Bordetella pertussis
agcagguggaucg

SEQ ID NO: 393583 - RNA, 14 nt, Bordetella pertussis
agcagguggaucga

SEQ ID NO: 393584 - RNA, 20 nt, Bordetella pertussis
agcagucauggaucgacugc

SEQ ID NO: 393585 - RNA, 16 nt, Bordetella pertussis
agcagucgcgcagcca

SEQ ID NO: 393586 - RNA, 22 nt, Bordetella pertussis
agcagucgcgcagccacagcgc

SEQ ID NO: 393587 - RNA, 20 nt, Bordetella pertussis
agcagugugccugucccagc

SEQ ID NO: 393588 - RNA, 15 nt, Bordetella pertussis
agcaguugcagcaug

SEQ ID NO: 393589 - RNA, 19 nt, Bordetella pertussis
agcauaucgucgcugcggc

SEQ ID NO: 393590 - RNA, 20 nt, Bordetella pertussis
agcauaucgucgcugcggcc

SEQ ID NO: 393591 - RNA, 14 nt, Bordetella pertussis
agcaucaccagcuc

SEQ ID NO: 393592 - RNA, 22 nt, Bordetella pertussis
agcaucaccagcucgcggcccu

SEQ ID NO: 393593 - RNA, 18 nt, Bordetella pertussis
agcaucagcccuacccug

SEQ ID NO: 393594 - RNA, 22 nt, Bordetella pertussis
agcaucagcccuacccugauca

SEQ ID NO: 393595 - RNA, 14 nt, Bordetella pertussis
agcaucccggcgcu

SEQ ID NO: 393596 - RNA, 14 nt, Bordetella pertussis
agcaucgccgccag

SEQ ID NO: 393597 - RNA, 13 nt, Bordetella pertussis
agcaugaaaugcu

SEQ ID NO: 393598 - RNA, 16 nt, Bordetella pertussis
agcaugaagcgguggc

SEQ ID NO: 393599 - RNA, 14 nt, Bordetella pertussis
agcaugaccgacag

SEQ ID NO: 393600 - RNA, 15 nt, Bordetella pertussis
agcaugcgcuggucg

SEQ ID NO: 393601 - RNA, 14 nt, Bordetella pertussis
agcaugcgggccau

SEQ ID NO: 393602 - RNA, 14 nt, Bordetella pertussis
agcauggcgccaug

SEQ ID NO: 393603 - RNA, 16 nt, Bordetella pertussis
agcauggcggccaggc

SEQ ID NO: 393604 - RNA, 18 nt, Bordetella pertussis
agcauggcggccaggcgc

SEQ ID NO: 393605 - RNA, 19 nt, Bordetella pertussis
agcauggcggccaggcgcg

SEQ ID NO: 393606 - RNA, 12 nt, Bordetella pertussis
agcauggcggcg

SEQ ID NO: 393607 - RNA, 16 nt, Bordetella pertussis
agcauggcgggaauga

SEQ ID NO: 393608 - RNA, 24 nt, Bordetella pertussis
agcauggccguggcgugcaggccg

SEQ ID NO: 393609 - RNA, 18 nt, Bordetella pertussis
agcauggcgguggccagc

SEQ ID NO: 393610 - RNA, 22 nt, Bordetella pertussis
agcauggcgguggccagcgccu

SEQ ID NO: 393611 - RNA, 22 nt, Bordetella pertussis
agcauggucggcauggccagga

SEQ ID NO: 393612 - RNA, 20 nt, Bordetella pertussis
agcauguccguaucgcggcc

SEQ ID NO: 393613 - RNA, 22 nt, Bordetella pertussis
agcaugucgacguuaugcucgc

SEQ ID NO: 393614 - RNA, 16 nt, Bordetella pertussis
agcauuaccagcaacg

SEQ ID NO: 393615 - RNA, 13 nt, Bordetella pertussis
agcauuucuucca

SEQ ID NO: 393616 - RNA, 20 nt, Bordetella pertussis
agccacacgaucagcgccca

SEQ ID NO: 393617 - RNA, 22 nt, Bordetella pertussis
agccaccgguugcagcgcgcca

SEQ ID NO: 393618 - RNA, 19 nt, Bordetella pertussis
agccacgcgcgcuggcgcc

SEQ ID NO: 393619 - RNA, 18 nt, Bordetella pertussis
agccacugcggcccgagc

SEQ ID NO: 393620 - RNA, 20 nt, Bordetella pertussis
agccagauaaaggccgcaac

SEQ ID NO: 393621 - RNA, 15 nt, Bordetella pertussis
agccagauucccccg

SEQ ID NO: 393622 - RNA, 16 nt, Bordetella pertussis
agccagccggcggcca

SEQ ID NO: 393623 - RNA, 15 nt, Bordetella pertussis
agccagcgccgcagc

SEQ ID NO: 393624 - RNA, 20 nt, Bordetella pertussis
agccaggccgaucagcacca

SEQ ID NO: 393625 - RNA, 19 nt, Bordetella pertussis
agccaggcgccagcggcau

SEQ ID NO: 393626 - RNA, 21 nt, Bordetella pertussis
agccaggcggcguaguucagc

SEQ ID NO: 393627 - RNA, 17 nt, Bordetella pertussis
agccaggcgguggccuc

SEQ ID NO: 393628 - RNA, 19 nt, Bordetella pertussis
agccaggguuguccgaacc

SEQ ID NO: 393629 - RNA, 16 nt, Bordetella pertussis
agccagguaagcuggc

SEQ ID NO: 393630 - RNA, 18 nt, Bordetella pertussis
agccagguggcgaugccg

SEQ ID NO: 393631 - RNA, 14 nt, Bordetella pertussis
agccagguggacag

SEQ ID NO: 393632 - RNA, 15 nt, Bordetella pertussis
agccaguacaggcug

SEQ ID NO: 393633 - RNA, 16 nt, Bordetella pertussis
agccaguacaggcugc

SEQ ID NO: 393634 - RNA, 20 nt, Bordetella pertussis
agccaguccccgcagggaca

SEQ ID NO: 393635 - RNA, 11 nt, Bordetella pertussis
agccagugccu

SEQ ID NO: 393636 - RNA, 15 nt, Bordetella pertussis
agccagugccucagg

SEQ ID NO: 393637 - RNA, 17 nt, Bordetella pertussis
agccaguugggccaggg

SEQ ID NO: 393638 - RNA, 18 nt, Bordetella pertussis
agccauccucgcccagcg

SEQ ID NO: 393639 - RNA, 20 nt, Bordetella pertussis
agccauucgauggcggcgcu

SEQ ID NO: 393640 - RNA, 15 nt, Bordetella pertussis
agcccaccgcgaacc

SEQ ID NO: 393641 - RNA, 18 nt, Bordetella pertussis
agcccaccgggccggccu

SEQ ID NO: 393642 - RNA, 12 nt, Bordetella pertussis
agcccagcaccu

SEQ ID NO: 393643 - RNA, 21 nt, Bordetella pertussis
agcccaggccgccggcggcgu

SEQ ID NO: 393644 - RNA, 15 nt, Bordetella pertussis
agcccaggcggccca

SEQ ID NO: 393645 - RNA, 23 nt, Bordetella pertussis
agcccaggcgggcgugcugcagg

SEQ ID NO: 393646 - RNA, 17 nt, Bordetella pertussis
agcccagguccagcgcc

SEQ ID NO: 393647 - RNA, 18 nt, Bordetella pertussis
agcccagguccagcgcca

SEQ ID NO: 393648 - RNA, 21 nt, Bordetella pertussis
agcccaguugcuggcccagga

SEQ ID NO: 393649 - RNA, 15 nt, Bordetella pertussis
agcccaucagguggg

SEQ ID NO: 393650 - RNA, 23 nt, Bordetella pertussis
agcccaucaggugggccgagccc

SEQ ID NO: 393651 - RNA, 21 nt, Bordetella pertussis
agcccauguugaacugcaggc

SEQ ID NO: 393652 - RNA, 12 nt, Bordetella pertussis
agccccaccuug

SEQ ID NO: 393653 - RNA, 12 nt, Bordetella pertussis
agccccagcagc

SEQ ID NO: 393654 - RNA, 13 nt, Bordetella pertussis
agccccagcagca

SEQ ID NO: 393655 - RNA, 12 nt, Bordetella pertussis
agccccagcgcc

SEQ ID NO: 393656 - RNA, 14 nt, Bordetella pertussis
agccccagcgccca

SEQ ID NO: 393657 - RNA, 20 nt, Bordetella pertussis
agccccagcguccaggcggc

SEQ ID NO: 393658 - RNA, 23 nt, Bordetella pertussis
agccccaggaacuugaacggcgc

SEQ ID NO: 393659 - RNA, 20 nt, Bordetella pertussis
agccccccguaggcggccca

SEQ ID NO: 393660 - RNA, 19 nt, Bordetella pertussis
agcccccgcgcugcgcccg

SEQ ID NO: 393661 - RNA, 18 nt, Bordetella pertussis
agcccgagcggcgccagu

SEQ ID NO: 393662 - RNA, 17 nt, Bordetella pertussis
agcccgauaugcagccg

SEQ ID NO: 393663 - RNA, 20 nt, Bordetella pertussis
agcccgaugccgccaugcgc

SEQ ID NO: 393664 - RNA, 16 nt, Bordetella pertussis
agcccgcacauacaag

SEQ ID NO: 393665 - RNA, 19 nt, Bordetella pertussis
agcccgccaucgccaggac

SEQ ID NO: 393666 - RNA, 15 nt, Bordetella pertussis
agcccgcgccaccac

SEQ ID NO: 393667 - RNA, 16 nt, Bordetella pertussis
agcccgcgcgccugca

SEQ ID NO: 393668 - RNA, 13 nt, Bordetella pertussis
agcccgcgcgcgu

SEQ ID NO: 393669 - RNA, 20 nt, Bordetella pertussis
agcccgcggccaccaggcug

SEQ ID NO: 393670 - RNA, 15 nt, Bordetella pertussis
agcccggcaccaugc

SEQ ID NO: 393671 - RNA, 17 nt, Bordetella pertussis
agcccggcaccaugcgc

SEQ ID NO: 393672 - RNA, 12 nt, Bordetella pertussis
agcccggcccca

SEQ ID NO: 393673 - RNA, 15 nt, Bordetella pertussis
agcccggccgccagc

SEQ ID NO: 393674 - RNA, 18 nt, Bordetella pertussis
agcccggccgccagcaug

SEQ ID NO: 393675 - RNA, 23 nt, Bordetella pertussis
agcccggccgccagcauggcguc

SEQ ID NO: 393676 - RNA, 16 nt, Bordetella pertussis
agcccggcgcgccacc

SEQ ID NO: 393677 - RNA, 20 nt, Bordetella pertussis
agcccggcuucgaucaugcc

SEQ ID NO: 393678 - RNA, 20 nt, Bordetella pertussis
agcccgugcgggccugcagu

SEQ ID NO: 393679 - RNA, 13 nt, Bordetella pertussis
agcccugcccgca

SEQ ID NO: 393680 - RNA, 11 nt, Bordetella pertussis
agcccuggccc

SEQ ID NO: 393681 - RNA, 18 nt, Bordetella pertussis
agcccuggcgcugcagcg

SEQ ID NO: 393682 - RNA, 15 nt, Bordetella pertussis
agccgaacugggucu

SEQ ID NO: 393683 - RNA, 12 nt, Bordetella pertussis
agccgacaggcg

SEQ ID NO: 393684 - RNA, 19 nt, Bordetella pertussis
agccgacaggcgcgcaggc

SEQ ID NO: 393685 - RNA, 12 nt, Bordetella pertussis
agccgagccugg

SEQ ID NO: 393686 - RNA, 15 nt, Bordetella pertussis
agccgagccuggcgu

SEQ ID NO: 393687 - RNA, 15 nt, Bordetella pertussis
agccgaguggcgggc

SEQ ID NO: 393688 - RNA, 13 nt, Bordetella pertussis
agccgaugcgccg

SEQ ID NO: 393689 - RNA, 15 nt, Bordetella pertussis
agccgaugcgccgcg

SEQ ID NO: 393690 - RNA, 19 nt, Bordetella pertussis
agccgauggcauggggcag

SEQ ID NO: 393691 - RNA, 20 nt, Bordetella pertussis
agccgaugucgaacagcugc

SEQ ID NO: 393692 - RNA, 13 nt, Bordetella pertussis
agccgcaccagcg

SEQ ID NO: 393693 - RNA, 18 nt, Bordetella pertussis
agccgcacgcccgccugc

SEQ ID NO: 393694 - RNA, 17 nt, Bordetella pertussis
agccgcagaacagcagc

SEQ ID NO: 393695 - RNA, 18 nt, Bordetella pertussis
agccgcagaacagcagcg

SEQ ID NO: 393696 - RNA, 17 nt, Bordetella pertussis
agccgcaguauuccugc

SEQ ID NO: 393697 - RNA, 19 nt, Bordetella pertussis
agccgcaugccggcgauga

SEQ ID NO: 393698 - RNA, 20 nt, Bordetella pertussis
agccgccagcgccuggaccu

SEQ ID NO: 393699 - RNA, 21 nt, Bordetella pertussis
agccgccauaggcgcgcacca

SEQ ID NO: 393700 - RNA, 16 nt, Bordetella pertussis
agccgccccagcagca

SEQ ID NO: 393701 - RNA, 17 nt, Bordetella pertussis
agccgccccagcagcag

SEQ ID NO: 393702 - RNA, 21 nt, Bordetella pertussis
agccgcccggaugggcggccu

SEQ ID NO: 393703 - RNA, 23 nt, Bordetella pertussis
agccgccgcgauugcagguggcc

SEQ ID NO: 393704 - RNA, 16 nt, Bordetella pertussis
agccgccgcccucgcc

SEQ ID NO: 393705 - RNA, 15 nt, Bordetella pertussis
agccgcgccaagggc

SEQ ID NO: 393706 - RNA, 19 nt, Bordetella pertussis
agccgcgccagcgccucca

SEQ ID NO: 393707 - RNA, 17 nt, Bordetella pertussis
agccgcgccugcagcag

SEQ ID NO: 393708 - RNA, 17 nt, Bordetella pertussis
agccgcgcgccugcagc

SEQ ID NO: 393709 - RNA, 19 nt, Bordetella pertussis
agccgcgcgccugcagcag

SEQ ID NO: 393710 - RNA, 24 nt, Bordetella pertussis
agccgcgcgccugcagcagcgugg

SEQ ID NO: 393711 - RNA, 15 nt, Bordetella pertussis
agccgcggccgccgu

SEQ ID NO: 393712 - RNA, 18 nt, Bordetella pertussis
agccgcucgcgcgaccac

SEQ ID NO: 393713 - RNA, 23 nt, Bordetella pertussis
agccgcucgcgcgaccacuggca

SEQ ID NO: 393714 - RNA, 22 nt, Bordetella pertussis
agccgcuaugacgaccgcuacc

SEQ ID NO: 393715 - RNA, 15 nt, Bordetella pertussis
agccgcucggccacg

SEQ ID NO: 393716 - RNA, 17 nt, Bordetella pertussis
agccgcugucgcaggcg

SEQ ID NO: 393717 - RNA, 18 nt, Bordetella pertussis
agccgcuuggccugcgcc

SEQ ID NO: 393718 - RNA, 23 nt, Bordetella pertussis
agccggaauccuggcgacggccu

SEQ ID NO: 393719 - RNA, 23 nt, Bordetella pertussis
agccggaaugcaccacggccacg

SEQ ID NO: 393720 - RNA, 16 nt, Bordetella pertussis
agccggcacgccugcc

SEQ ID NO: 393721 - RNA, 17 nt, Bordetella pertussis
agccggcacgccugccg

SEQ ID NO: 393722 - RNA, 20 nt, Bordetella pertussis
agccggcagaucggcgcugg

SEQ ID NO: 393723 - RNA, 19 nt, Bordetella pertussis
agccggccagcgccugggc

SEQ ID NO: 393724 - RNA, 13 nt, Bordetella pertussis
agccggccauggc

SEQ ID NO: 393725 - RNA, 13 nt, Bordetella pertussis
agccggcccagca

SEQ ID NO: 393726 - RNA, 15 nt, Bordetella pertussis
agccggcccagcacg

SEQ ID NO: 393727 - RNA, 16 nt, Bordetella pertussis
agccggccccgcaagg

SEQ ID NO: 393728 - RNA, 20 nt, Bordetella pertussis
agccggcccguuggcaggcc

SEQ ID NO: 393729 - RNA, 18 nt, Bordetella pertussis
agccggcggccagcuugu

SEQ ID NO: 393730 - RNA, 15 nt, Bordetella pertussis
agccggcgggcggcu

SEQ ID NO: 393731 - RNA, 23 nt, Bordetella pertussis
agccggcugcaagacgcccaggc

SEQ ID NO: 393732 - RNA, 15 nt, Bordetella pertussis
agccgggcggccacg

SEQ ID NO: 393733 - RNA, 17 nt, Bordetella pertussis
agccgggcggccacggc

SEQ ID NO: 393734 - RNA, 20 nt, Bordetella pertussis
agccgggccaugcgggucag

SEQ ID NO: 393735 - RNA, 22 nt, Bordetella pertussis
agccgggccaugcgggucaggc

SEQ ID NO: 393736 - RNA, 14 nt, Bordetella pertussis
agccgggcgccgau

SEQ ID NO: 393737 - RNA, 13 nt, Bordetella pertussis
agccgggcggcca

SEQ ID NO: 393738 - RNA, 18 nt, Bordetella pertussis
agccgguacagccaggcc

SEQ ID NO: 393739 - RNA, 21 nt, Bordetella pertussis
agccgguaucgcggcgcaggc

SEQ ID NO: 393740 - RNA, 18 nt, Bordetella pertussis
agccggugcgcagcacca

SEQ ID NO: 393741 - RNA, 14 nt, Bordetella pertussis
agccgguuggcgcc

SEQ ID NO: 393742 - RNA, 18 nt, Bordetella pertussis
agccguccucgcgggccu

SEQ ID NO: 393743 - RNA, 14 nt, Bordetella pertussis
agccgucgcgcugc

SEQ ID NO: 393744 - RNA, 16 nt, Bordetella pertussis
agccgucgcgcugcag

SEQ ID NO: 393745 - RNA, 14 nt, Bordetella pertussis
agccgugaccugcu

SEQ ID NO: 393746 - RNA, 16 nt, Bordetella pertussis
agccguucuggcagug

SEQ ID NO: 393747 - RNA, 15 nt, Bordetella pertussis
agccuaggcugcagc

SEQ ID NO: 393748 - RNA, 16 nt, Bordetella pertussis
agccuaggcugcagcc

SEQ ID NO: 393749 - RNA, 17 nt, Bordetella pertussis
agccuaggcugcagcca

SEQ ID NO: 393750 - RNA, 22 nt, Bordetella pertussis
agccucgcccuugcggcgaggc

SEQ ID NO: 393751 - RNA, 22 nt, Bordetella pertussis
agccugauucccaggcccggcc

SEQ ID NO: 393752 - RNA, 21 nt, Bordetella pertussis
agccugccccgauacaaggug

SEQ ID NO: 393753 - RNA, 13 nt, Bordetella pertussis
agccugcccucgg

SEQ ID NO: 393754 - RNA, 23 nt, Bordetella pertussis
agccugcccucgggcgacaggcg

SEQ ID NO: 393755 - RNA, 14 nt, Bordetella pertussis
agccugccgcggcc

SEQ ID NO: 393756 - RNA, 12 nt, Bordetella pertussis
agccugccggcg

SEQ ID NO: 393757 - RNA, 16 nt, Bordetella pertussis
agccugccggcggccu

SEQ ID NO: 393758 - RNA, 18 nt, Bordetella pertussis
agccugcccugguggcag

SEQ ID NO: 393759 - RNA, 15 nt, Bordetella pertussis
agccugcuggugcug

SEQ ID NO: 393760 - RNA, 17 nt, Bordetella pertussis
agccugcuggugcuggu

SEQ ID NO: 393761 - RNA, 21 nt, Bordetella pertussis
agccuggaagugaugccgccg

SEQ ID NO: 393762 - RNA, 14 nt, Bordetella pertussis
agccuggcaaugcg

SEQ ID NO: 393763 - RNA, 17 nt, Bordetella pertussis
agccuggccuugcgcuu

SEQ ID NO: 393764 - RNA, 19 nt, Bordetella pertussis
agccugggccuguacugga

SEQ ID NO: 393765 - RNA, 15 nt, Bordetella pertussis
agccuggggcaggcg

SEQ ID NO: 393766 - RNA, 15 nt, Bordetella pertussis
agccuggucagguug

SEQ ID NO: 393767 - RNA, 20 nt, Bordetella pertussis
agccuguccccgccggggca

SEQ ID NO: 393768 - RNA, 23 nt, Bordetella pertussis
agccuguccccgucgggacaggc

SEQ ID NO: 393769 - RNA, 18 nt, Bordetella pertussis
agccugucccugcgggga

SEQ ID NO: 393770 - RNA, 15 nt, Bordetella pertussis
agccuugaaagaggc

SEQ ID NO: 393771 - RNA, 14 nt, Bordetella pertussis
agccuugcgcggcc

SEQ ID NO: 393772 - RNA, 17 nt, Bordetella pertussis
agccuugcgcggccagc

SEQ ID NO: 393773 - RNA, 20 nt, Bordetella pertussis
agccuugcgcggccagcacc

SEQ ID NO: 393774 - RNA, 14 nt, Bordetella pertussis
agccuuggcccacu

SEQ ID NO: 393775 - RNA, 16 nt, Bordetella pertussis
agcgaaauggcggccu

SEQ ID NO: 393776 - RNA, 18 nt, Bordetella pertussis
agcgaaauggcggccucg

SEQ ID NO: 393777 - RNA, 15 nt, Bordetella pertussis
agcgaaggggcgcau

SEQ ID NO: 393778 - RNA, 16 nt, Bordetella pertussis
agcgacacccgcggcc

SEQ ID NO: 393779 - RNA, 20 nt, Bordetella pertussis
agcgacacccgcggccaggg

SEQ ID NO: 393780 - RNA, 15 nt, Bordetella pertussis
agcgacagccaggcc

SEQ ID NO: 393781 - RNA, 21 nt, Bordetella pertussis
agcgacccgcaaaaccgggcc

SEQ ID NO: 393782 - RNA, 21 nt, Bordetella pertussis
agcgacucgacgaacacgcgc

SEQ ID NO: 393783 - RNA, 22 nt, Bordetella pertussis
agcgacuugucgcgcccgaagc

SEQ ID NO: 393784 - RNA, 14 nt, Bordetella pertussis
agcgagaucagcac

SEQ ID NO: 393785 - RNA, 14 nt, Bordetella pertussis
agcgagcggggcug

SEQ ID NO: 393786 - RNA, 16 nt, Bordetella pertussis
agcgcaaaacgcauga

SEQ ID NO: 393787 - RNA, 21 nt, Bordetella pertussis
agcgcaaacgggggcaggccg

SEQ ID NO: 393788 - RNA, 14 nt, Bordetella pertussis
agcgcaagcccagg

SEQ ID NO: 393789 - RNA, 15 nt, Bordetella pertussis
agcgcaauggacaca

SEQ ID NO: 393790 - RNA, 19 nt, Bordetella pertussis
agcgcaccaccaccaugug

SEQ ID NO: 393791 - RNA, 20 nt, Bordetella pertussis
agcgcaccaccagcaccgcc

SEQ ID NO: 393792 - RNA, 20 nt, Bordetella pertussis
agcgcacgcugggcuacgac

SEQ ID NO: 393793 - RNA, 15 nt, Bordetella pertussis
agcgcacgguccagg

SEQ ID NO: 393794 - RNA, 18 nt, Bordetella pertussis
agcgcacugagaaaggcc

SEQ ID NO: 393795 - RNA, 11 nt, Bordetella pertussis
agcgcacugau

SEQ ID NO: 393796 - RNA, 18 nt, Bordetella pertussis
agcgcacugaucgccgcc

SEQ ID NO: 393797 - RNA, 17 nt, Bordetella pertussis
agcgcacgcagcgcuca

SEQ ID NO: 393798 - RNA, 18 nt, Bordetella pertussis
agcgcagcaagcugcugc

SEQ ID NO: 393799 - RNA, 15 nt, Bordetella pertussis
agcgcagcaccggca

SEQ ID NO: 393800 - RNA, 20 nt, Bordetella pertussis
agcgcagcaccggcagaugg

SEQ ID NO: 393801 - RNA, 18 nt, Bordetella pertussis
agcgcagccgcuccagcc

SEQ ID NO: 393802 - RNA, 20 nt, Bordetella pertussis
agcgcagguucaucgagaac

SEQ ID NO: 393803 - RNA, 20 nt, Bordetella pertussis
agcgcauaggacgccaccag

SEQ ID NO: 393804 - RNA, 17 nt, Bordetella pertussis
agcgcaucgagcuccug

SEQ ID NO: 393805 - RNA, 16 nt, Bordetella pertussis
agcgcaucgccgcagg

SEQ ID NO: 393806 - RNA, 17 nt, Bordetella pertussis
agcgcaugaugcugccg

SEQ ID NO: 393807 - RNA, 21 nt, Bordetella pertussis
agcgcaugaugcugccgggca

SEQ ID NO: 393808 - RNA, 19 nt, Bordetella pertussis
agcgcaugccgucgagcgc

SEQ ID NO: 393809 - RNA, 21 nt, Bordetella pertussis
agcgcauuggugagcacgcgc

SEQ ID NO: 393810 - RNA, 14 nt, Bordetella pertussis
agcgccaccagcag

SEQ ID NO: 393811 - RNA, 16 nt, Bordetella pertussis
agcgccaccagcagcg

SEQ ID NO: 393812 - RNA, 15 nt, Bordetella pertussis
agcgccacgccagcg

SEQ ID NO: 393813 - RNA, 21 nt, Bordetella pertussis
agcgccacgcgagcccgcguc

SEQ ID NO: 393814 - RNA, 22 nt, Bordetella pertussis
agcgccagcacgaucacgaaca

SEQ ID NO: 393815 - RNA, 11 nt, Bordetella pertussis
agcgccagcac

SEQ ID NO: 393816 - RNA, 14 nt, Bordetella pertussis
agcgccagcagcag

SEQ ID NO: 393817 - RNA, 23 nt, Bordetella pertussis
agcgccagcagcaggccguaacc

SEQ ID NO: 393818 - RNA, 17 nt, Bordetella pertussis
agcgccagggccaggcc

SEQ ID NO: 393819 - RNA, 13 nt, Bordetella pertussis
agcgccagggccu

SEQ ID NO: 393820 - RNA, 16 nt, Bordetella pertussis
agcgccagggccuccu

SEQ ID NO: 393821 - RNA, 19 nt, Bordetella pertussis
agcgccccgaucagcaagg

SEQ ID NO: 393822 - RNA, 22 nt, Bordetella pertussis
agcgcccgcgccaucgcgucga

SEQ ID NO: 393823 - RNA, 19 nt, Bordetella pertussis
agcgccgacggcauggccg

SEQ ID NO: 393824 - RNA, 18 nt, Bordetella pertussis
agcgccgccacaggcuga

SEQ ID NO: 393825 - RNA, 14 nt, Bordetella pertussis
agcgccgccagccg

SEQ ID NO: 393826 - RNA, 16 nt, Bordetella pertussis
agcgccgccagccgcu

SEQ ID NO: 393827 - RNA, 23 nt, Bordetella pertussis
agcgccgccagccgcuggcgcgc

SEQ ID NO: 393828 - RNA, 14 nt, Bordetella pertussis
agcgccgccaggcc

SEQ ID NO: 393829 - RNA, 15 nt, Bordetella pertussis
agcgccgccauggcg

SEQ ID NO: 393830 - RNA, 17 nt, Bordetella pertussis
agcgccgcgagcgccga

SEQ ID NO: 393831 - RNA, 20 nt, Bordetella pertussis
agcgccgcgagcgccgaacc

SEQ ID NO: 393832 - RNA, 15 nt, Bordetella pertussis
agcgccgcgccucgg

SEQ ID NO: 393833 - RNA, 14 nt, Bordetella pertussis
agcgccgcgcgcgu

SEQ ID NO: 393834 - RNA, 17 nt, Bordetella pertussis
agcgccgcgucgagcgc

SEQ ID NO: 393835 - RNA, 14 nt, Bordetella pertussis
agcgccggcaggcg

SEQ ID NO: 393836 - RNA, 23 nt, Bordetella pertussis
agcgccggcaggcgcgccagccc

SEQ ID NO: 393837 - RNA, 12 nt, Bordetella pertussis
agcgccggcccg

SEQ ID NO: 393838 - RNA, 16 nt, Bordetella pertussis
agcgccggcugggcgu

SEQ ID NO: 393839 - RNA, 21 nt, Bordetella pertussis
agcgccggcuugcgccagcca

SEQ ID NO: 393840 - RNA, 22 nt, Bordetella pertussis
agcgccggggucagcgccggca

SEQ ID NO: 393841 - RNA, 23 nt, Bordetella pertussis
agcgccgggucaucgagguggcg

SEQ ID NO: 393842 - RNA, 16 nt, Bordetella pertussis
agcgccgucagcagcg

SEQ ID NO: 393843 - RNA, 19 nt, Bordetella pertussis
agcgccucguuccuguucc

SEQ ID NO: 393844 - RNA, 22 nt, Bordetella pertussis
agcgccugccgcgugcccgcgu

SEQ ID NO: 393845 - RNA, 14 nt, Bordetella pertussis
agcgccuggaccug

SEQ ID NO: 393846 - RNA, 12 nt, Bordetella pertussis
agcgccuggcgg

SEQ ID NO: 393847 - RNA, 21 nt, Bordetella pertussis
agcgcgaaauccagcgcgccc

SEQ ID NO: 393848 - RNA, 16 nt, Bordetella pertussis
agcgcgaacgccugcc

SEQ ID NO: 393849 - RNA, 17 nt, Bordetella pertussis
agcgcgaacgccugcca

SEQ ID NO: 393850 - RNA, 16 nt, Bordetella pertussis
agcgcgguggccagcg

SEQ ID NO: 393851 - RNA, 17 nt, Bordetella pertussis
agcgcgguggccgcuuc

SEQ ID NO: 393852 - RNA, 15 nt, Bordetella pertussis
agcgcgguguugcgg

SEQ ID NO: 393853 - RNA, 13 nt, Bordetella pertussis
agcgcguccaggu

SEQ ID NO: 393854 - RNA, 15 nt, Bordetella pertussis
agcgcgucgcacugg

SEQ ID NO: 393855 - RNA, 16 nt, Bordetella pertussis
agcgcgucggccaggc

SEQ ID NO: 393856 - RNA, 17 nt, Bordetella pertussis
agcgcgucggccaggcg

SEQ ID NO: 393857 - RNA, 19 nt, Bordetella pertussis
agcgcgucggccaggcgcc

SEQ ID NO: 393858 - RNA, 18 nt, Bordetella pertussis
agcgcgucguccagcgug

SEQ ID NO: 393859 - RNA, 17 nt, Bordetella pertussis
agcgcgugcagccagcg

SEQ ID NO: 393860 - RNA, 15 nt, Bordetella pertussis
agcgcguggccagca

SEQ ID NO: 393861 - RNA, 15 nt, Bordetella pertussis
agcgcguggccauca

SEQ ID NO: 393862 - RNA, 20 nt, Bordetella pertussis
agcgcgugugguuggcgcug

SEQ ID NO: 393863 - RNA, 21 nt, Bordetella pertussis
agcgcucgccggcgcgcaggc

SEQ ID NO: 393864 - RNA, 15 nt, Bordetella pertussis
agcgcucgcgcaggc

SEQ ID NO: 393865 - RNA, 16 nt, Bordetella pertussis
agcgcuucgugcagcg

SEQ ID NO: 393866 - RNA, 15 nt, Bordetella pertussis
agcggaucgcggcgc

SEQ ID NO: 393867 - RNA, 17 nt, Bordetella pertussis
agcggaugaagggcugg

SEQ ID NO: 393868 - RNA, 23 nt, Bordetella pertussis
agcggauugaccagcgcggccgu

SEQ ID NO: 393869 - RNA, 15 nt, Bordetella pertussis
agcggcaaagccgcu

SEQ ID NO: 393870 - RNA, 19 nt, Bordetella pertussis
agcggcacgccggcggccc

SEQ ID NO: 393871 - RNA, 17 nt, Bordetella pertussis
agcggcagcagcagcgc

SEQ ID NO: 393872 - RNA, 18 nt, Bordetella pertussis
agcggcagcauggcgcgc

SEQ ID NO: 393873 - RNA, 13 nt, Bordetella pertussis
agcggcagcgcgc

SEQ ID NO: 393874 - RNA, 24 nt, Bordetella pertussis
agcggcagcgcgcaggacaaggcg

SEQ ID NO: 393875 - RNA, 13 nt, Bordetella pertussis
agcggcaggcggc

SEQ ID NO: 393876 - RNA, 16 nt, Bordetella pertussis
agcggcaggcggcuga

SEQ ID NO: 393877 - RNA, 14 nt, Bordetella pertussis
agcggcaggcuggc

SEQ ID NO: 393878 - RNA, 15 nt, Bordetella pertussis
agcgggugaugcugc

SEQ ID NO: 393879 - RNA, 20 nt, Bordetella pertussis
agcgguucgucggcgcucuu

SEQ ID NO: 393880 - RNA, 22 nt, Bordetella pertussis
agcgguucgucggcgcucuugg

SEQ ID NO: 393881 - RNA, 18 nt, Bordetella pertussis
agcgguugcgccagcuug

SEQ ID NO: 393882 - RNA, 18 nt, Bordetella pertussis
agcgucaauccgccgcca

SEQ ID NO: 393883 - RNA, 21 nt, Bordetella pertussis
agcgucaauccgccgccagca

SEQ ID NO: 393884 - RNA, 23 nt, Bordetella pertussis
agcgucaauccgccgccagcacg

SEQ ID NO: 393885 - RNA, 14 nt, Bordetella pertussis
agcgucaccagcag

SEQ ID NO: 393886 - RNA, 15 nt, Bordetella pertussis
agcgucaccagcagg

SEQ ID NO: 393887 - RNA, 17 nt, Bordetella pertussis
agcgucaccagcaggcg

SEQ ID NO: 393888 - RNA, 17 nt, Bordetella pertussis
agcgucagcacaucgcc

SEQ ID NO: 393889 - RNA, 15 nt, Bordetella pertussis
agcgucagcugggca

SEQ ID NO: 393890 - RNA, 21 nt, Bordetella pertussis
agcgucgauggcguacagcag

SEQ ID NO: 393891 - RNA, 20 nt, Bordetella pertussis
agcguucgcgcuugcggccg

SEQ ID NO: 393892 - RNA, 14 nt, Bordetella pertussis
agcguuggcggccg

SEQ ID NO: 393893 - RNA, 20 nt, Bordetella pertussis
agcguuggcggccggccagc

SEQ ID NO: 393894 - RNA, 22 nt, Bordetella pertussis
agcguuggcggccggccagcca

SEQ ID NO: 393895 - RNA, 15 nt, Bordetella pertussis
agcuacccccugacc

SEQ ID NO: 393896 - RNA, 20 nt, Bordetella pertussis
agcuccaggaaaaccuccuc

SEQ ID NO: 393897 - RNA, 15 nt, Bordetella pertussis
agcucccccacgccg

SEQ ID NO: 393898 - RNA, 19 nt, Bordetella pertussis
agcucccccacgccgccgu

SEQ ID NO: 393899 - RNA, 16 nt, Bordetella pertussis
agcuccucgagcgugg

SEQ ID NO: 393900 - RNA, 17 nt, Bordetella pertussis
agcuccuugaccaguuc

SEQ ID NO: 393901 - RNA, 14 nt, Bordetella pertussis
agcucgauggcuuc

SEQ ID NO: 393902 - RNA, 17 nt, Bordetella pertussis
agcucgcgcaugcagcg

SEQ ID NO: 393903 - RNA, 16 nt, Bordetella pertussis
agcucgcgcgcuucga

SEQ ID NO: 393904 - RNA, 13 nt, Bordetella pertussis
agcucgcggcccu

SEQ ID NO: 393905 - RNA, 16 nt, Bordetella pertussis
agcucgcguugcaccg

SEQ ID NO: 393906 - RNA, 15 nt, Bordetella pertussis
agcucggccaaggca

SEQ ID NO: 393907 - RNA, 22 nt, Bordetella pertussis
agcucggcccauugcggcaccu

SEQ ID NO: 393908 - RNA, 15 nt, Bordetella pertussis
agcucggccugcggc

SEQ ID NO: 393909 - RNA, 21 nt, Bordetella pertussis
agcucggcgaagccgcagcgg

SEQ ID NO: 393910 - RNA, 16 nt, Bordetella pertussis
agcucggcgaccaggc

SEQ ID NO: 393911 - RNA, 13 nt, Bordetella pertussis
agcucggcggcga

SEQ ID NO: 393912 - RNA, 20 nt, Bordetella pertussis
agcucggugcagcccagcac

SEQ ID NO: 393913 - RNA, 13 nt, Bordetella pertussis
agcucgucgccgc

SEQ ID NO: 393914 - RNA, 20 nt, Bordetella pertussis
agcucgucgccgcuggacag

SEQ ID NO: 393915 - RNA, 18 nt, Bordetella pertussis
agcucguggcgcgccucc

SEQ ID NO: 393916 - RNA, 17 nt, Bordetella pertussis
agcucguguagggccug

SEQ ID NO: 393917 - RNA, 15 nt, Bordetella pertussis
agcucugguccaggc

SEQ ID NO: 393918 - RNA, 23 nt, Bordetella pertussis
agcugacgggucuccacgaaguc

SEQ ID NO: 393919 - RNA, 16 nt, Bordetella pertussis
agcugagcaccagcag

SEQ ID NO: 393920 - RNA, 17 nt, Bordetella pertussis
agcugcggccccggcac

SEQ ID NO: 393921 - RNA, 16 nt, Bordetella pertussis
agcugcggcgcggcgc

SEQ ID NO: 393922 - RNA, 15 nt, Bordetella pertussis
agcugcucgagcaug

SEQ ID NO: 393923 - RNA, 15 nt, Bordetella pertussis
agcugcuggccggcc

SEQ ID NO: 393924 - RNA, 14 nt, Bordetella pertussis
agcuggcccugggc

SEQ ID NO: 393925 - RNA, 17 nt, Bordetella pertussis
agcuggcgcgggcggcc

SEQ ID NO: 393926 - RNA, 18 nt, Bordetella pertussis
agcuggcgcgggcggccu

SEQ ID NO: 393927 - RNA, 19 nt, Bordetella pertussis
agcuggcgcgggcggccua

SEQ ID NO: 393928 - RNA, 19 nt, Bordetella pertussis
agcuggcgcguggccgcca

SEQ ID NO: 393929 - RNA, 16 nt, Bordetella pertussis
agcuggcgcuuggcca

SEQ ID NO: 393930 - RNA, 12 nt, Bordetella pertussis
agcuggcggcgc

SEQ ID NO: 393931 - RNA, 18 nt, Bordetella pertussis
agcuggcggcgcagcacc

SEQ ID NO: 393932 - RNA, 18 nt, Bordetella pertussis
agcuggcggcgcgcggcu

SEQ ID NO: 393933 - RNA, 20 nt, Bordetella pertussis
agcuggcggcgcgcggcugg

SEQ ID NO: 393934 - RNA, 22 nt, Bordetella pertussis
agcuggcggcgcgcuuggucag

SEQ ID NO: 393935 - RNA, 20 nt, Bordetella pertussis
aguagccgaauccggccagc

SEQ ID NO: 393936 - RNA, 21 nt, Bordetella pertussis
aguagccgaauccggccagca

SEQ ID NO: 393937 - RNA, 22 nt, Bordetella pertussis
aguaggccacugcguccuugag

SEQ ID NO: 393938 - RNA, 15 nt, Bordetella pertussis
aguaggcggccaggc

SEQ ID NO: 393939 - RNA, 19 nt, Bordetella pertussis
aguagugcccccacgcugc

SEQ ID NO: 393940 - RNA, 14 nt, Bordetella pertussis
aguauucacgccgc

SEQ ID NO: 393941 - RNA, 16 nt, Bordetella pertussis
aguccagcaccggcug

SEQ ID NO: 393942 - RNA, 21 nt, Bordetella pertussis
aguccaggccggccugcaaug

SEQ ID NO: 393943 - RNA, 20 nt, Bordetella pertussis
aguccaggguguccuggucg

SEQ ID NO: 393944 - RNA, 18 nt, Bordetella pertussis
agucccagccggcccccu

SEQ ID NO: 393945 - RNA, 20 nt, Bordetella pertussis
agucccaguccggcagcacc

SEQ ID NO: 393946 - RNA, 19 nt, Bordetella pertussis
aguccccauguggggacag

SEQ ID NO: 393947 - RNA, 22 nt, Bordetella pertussis
aguccccauguggggacaggca

SEQ ID NO: 393948 - RNA, 19 nt, Bordetella pertussis
aguccccgcagggacaggc

SEQ ID NO: 393949 - RNA, 20 nt, Bordetella pertussis
aguccccgcagggacaggcu

SEQ ID NO: 393950 - RNA, 22 nt, Bordetella pertussis
aguccccgcauggggacuggcg

SEQ ID NO: 393951 - RNA, 20 nt, Bordetella pertussis
agucccccugcggggacagg

SEQ ID NO: 393952 - RNA, 22 nt, Bordetella pertussis
aguccccguucggggacaggca

SEQ ID NO: 393953 - RNA, 21 nt, Bordetella pertussis
aguccccugcggggacaggca

SEQ ID NO: 393954 - RNA, 16 nt, Bordetella pertussis
aguccgacaggcagac

SEQ ID NO: 393955 - RNA, 22 nt, Bordetella pertussis
aguccgcagcgcagcgccacgc

SEQ ID NO: 393956 - RNA, 23 nt, Bordetella pertussis
aguccgcagcgcagcgccacgcu

SEQ ID NO: 393957 - RNA, 17 nt, Bordetella pertussis
aguccgcccagccaggc

SEQ ID NO: 393958 - RNA, 18 nt, Bordetella pertussis
aguccgccgcguugaagu

SEQ ID NO: 393959 - RNA, 18 nt, Bordetella pertussis
aguccucguugcccgcgg

SEQ ID NO: 393960 - RNA, 13 nt, Bordetella pertussis
aguccucuacugg

SEQ ID NO: 393961 - RNA, 16 nt, Bordetella pertussis
aguccucuacuggcug

SEQ ID NO: 393962 - RNA, 17 nt, Bordetella pertussis
aguccucuacuggcuga

SEQ ID NO: 393963 - RNA, 14 nt, Bordetella pertussis
aguccugcaugcca

SEQ ID NO: 393964 - RNA, 19 nt, Bordetella pertussis
agucgaguucggcgcgccc

SEQ ID NO: 393965 - RNA, 16 nt, Bordetella pertussis
agucgaugaaggcgcc

SEQ ID NO: 393966 - RNA, 20 nt, Bordetella pertussis
agucgaugaaggcgccgacu

SEQ ID NO: 393967 - RNA, 17 nt, Bordetella pertussis
agucgaugauccacagu

SEQ ID NO: 393968 - RNA, 19 nt, Bordetella pertussis
agucggccuggcgcuccuc

SEQ ID NO: 393969 - RNA, 19 nt, Bordetella pertussis
agucggcgcccagcuccac

SEQ ID NO: 393970 - RNA, 16 nt, Bordetella pertussis
agucgggcaccagcac

SEQ ID NO: 393971 - RNA, 21 nt, Bordetella pertussis
agucgggcaccagcacuucga

SEQ ID NO: 393972 - RNA, 18 nt, Bordetella pertussis
agucggggccgcagcugg

SEQ ID NO: 393973 - RNA, 21 nt, Bordetella pertussis
agugaaagguucggagcacgg

SEQ ID NO: 393974 - RNA, 13 nt, Bordetella pertussis
agugcccccacgc

SEQ ID NO: 393975 - RNA, 22 nt, Bordetella pertussis
agugcccugacccgcuggcugg

SEQ ID NO: 393976 - RNA, 15 nt, Bordetella pertussis
agugcgccuggcuga

SEQ ID NO: 393977 - RNA, 20 nt, Bordetella pertussis
agugcggcgccagcugggcg

SEQ ID NO: 393978 - RNA, 18 nt, Bordetella pertussis
agugcuggcccgccagca

SEQ ID NO: 393979 - RNA, 23 nt, Bordetella pertussis
agugcuggcccgccagcaaggcg

SEQ ID NO: 393980 - RNA, 21 nt, Bordetella pertussis
aguggccguagagggucuggc

SEQ ID NO: 393981 - RNA, 18 nt, Bordetella pertussis
aguggcgagggucaggcg

SEQ ID NO: 393982 - RNA, 11 nt, Bordetella pertussis
aguggcggcgg

SEQ ID NO: 393983 - RNA, 13 nt, Bordetella pertussis
aguucagccacac

SEQ ID NO: 393984 - RNA, 16 nt, Bordetella pertussis
aguucauccacagcca

SEQ ID NO: 393985 - RNA, 22 nt, Bordetella pertussis
aguucgcugcgaaacagcagcg

SEQ ID NO: 393986 - RNA, 16 nt, Bordetella pertussis
aguucgcuuuccaggg

SEQ ID NO: 393987 - RNA, 23 nt, Bordetella pertussis
aguucggagcgguugaaauccuu

SEQ ID NO: 393988 - RNA, 13 nt, Bordetella pertussis
aguucggccagca

SEQ ID NO: 393989 - RNA, 16 nt, Bordetella pertussis
aguucggccagcagcu

SEQ ID NO: 393990 - RNA, 17 nt, Bordetella pertussis
aguucggccagcggcag

SEQ ID NO: 393991 - RNA, 19 nt, Bordetella pertussis
aguucggccagcggcaggc

SEQ ID NO: 393992 - RNA, 14 nt, Bordetella pertussis
aguucuucuuggcc

SEQ ID NO: 393993 - RNA, 15 nt, Bordetella pertussis
aguucuucuuggcca

SEQ ID NO: 393994 - RNA, 12 nt, Bordetella pertussis
aguugccgccgc

SEQ ID NO: 393995 - RNA, 21 nt, Bordetella pertussis
aguugcgggucgucccagcgc

SEQ ID NO: 393996 - RNA, 13 nt, Bordetella pertussis
aguugggccaggg

SEQ ID NO: 393997 - RNA, 15 nt, Bordetella pertussis
aguugggcgccuugc

SEQ ID NO: 393998 - RNA, 14 nt, Bordetella pertussis
aguuguagguccag

SEQ ID NO: 393999 - RNA, 18 nt, Bordetella pertussis
aguugucggcgcagaugg

SEQ ID NO: 394000 - RNA, 22 nt, Bordetella pertussis
aguuuggcgaaggcgucggcca

SEQ ID NO: 394001 - RNA, 18 nt, Bordetella pertussis
aguuuuuccucuaccccg

SEQ ID NO: 394002 - RNA, 20 nt, Bordetella pertussis
auaacgccacuugcaggccg

SEQ ID NO: 394003 - RNA, 20 nt, Bordetella pertussis
auacaaggcgcggcaaaaug

SEQ ID NO: 394004 - RNA, 17 nt, Bordetella pertussis
auacaaggugccugucc

SEQ ID NO: 394005 - RNA, 17 nt, Bordetella pertussis
auacagaucgccgccgc

SEQ ID NO: 394006 - RNA, 13 nt, Bordetella pertussis
auacagcaaggac

SEQ ID NO: 394007 - RNA, 17 nt, Bordetella pertussis
auacaggaagcgcuggc

SEQ ID NO: 394008 - RNA, 15 nt, Bordetella pertussis
auacccguccuuggc

SEQ ID NO: 394009 - RNA, 14 nt, Bordetella pertussis
auacgccgugcugu

SEQ ID NO: 394010 - RNA, 21 nt, Bordetella pertussis
auagacauugcccagcaccac

SEQ ID NO: 394011 - RNA, 14 nt, Bordetella pertussis
auagacccuccucg

SEQ ID NO: 394012 - RNA, 14 nt, Bordetella pertussis
auagacgccgaccg

SEQ ID NO: 394013 - RNA, 22 nt, Bordetella pertussis
auagacgcgcagcggcaggccc

SEQ ID NO: 394014 - RNA, 17 nt, Bordetella pertussis
auagaucauccaggugg

SEQ ID NO: 394015 - RNA, 14 nt, Bordetella pertussis
auagccgcgcgccu

SEQ ID NO: 394016 - RNA, 18 nt, Bordetella pertussis
auagcgcaugaugcugcc

SEQ ID NO: 394017 - RNA, 20 nt, Bordetella pertussis
auauagggccauggcagggc

SEQ ID NO: 394018 - RNA, 20 nt, Bordetella pertussis
auaucggcacccgcauggug

SEQ ID NO: 394019 - RNA, 13 nt, Bordetella pertussis
auaucggccaggc

SEQ ID NO: 394020 - RNA, 12 nt, Bordetella pertussis
auaugccgccgg

SEQ ID NO: 394021 - RNA, 13 nt, Bordetella pertussis
auaugcgccaggc

SEQ ID NO: 394022 - RNA, 14 nt, Bordetella pertussis
auauggagccaggc

SEQ ID NO: 394023 - RNA, 15 nt, Bordetella pertussis
auauggagccaggcg

SEQ ID NO: 394024 - RNA, 12 nt, Bordetella pertussis
auauggccaggg

SEQ ID NO: 394025 - RNA, 13 nt, Bordetella pertussis
auauggccagggu

SEQ ID NO: 394026 - RNA, 23 nt, Bordetella pertussis
auauggccggcgcgcucgcugcc

SEQ ID NO: 394027 - RNA, 17 nt, Bordetella pertussis
auauugaaggccgaggc

SEQ ID NO: 394028 - RNA, 21 nt, Bordetella pertussis
auauuggcgaacgugcgcgcc

SEQ ID NO: 394029 - RNA, 20 nt, Bordetella pertussis
aucaacgugcgccaggcaaa

SEQ ID NO: 394030 - RNA, 19 nt, Bordetella pertussis
aucaacuucaucgucauca

SEQ ID NO: 394031 - RNA, 14 nt, Bordetella pertussis
aucaacuuccagcg

SEQ ID NO: 394032 - RNA, 15 nt, Bordetella pertussis
aucaacuuccagcgc

SEQ ID NO: 394033 - RNA, 14 nt, Bordetella pertussis
aucaagagccugga

SEQ ID NO: 394034 - RNA, 16 nt, Bordetella pertussis
aucaaucugaucaucu

SEQ ID NO: 394035 - RNA, 19 nt, Bordetella pertussis
aucaaucugaucaucuucg

SEQ ID NO: 394036 - RNA, 19 nt, Bordetella pertussis
aucaggcccagcacgauga

SEQ ID NO: 394037 - RNA, 22 nt, Bordetella pertussis
aucaggccgaacugggacaggc

SEQ ID NO: 394038 - RNA, 17 nt, Bordetella pertussis
aucaggcgcuccauggc

SEQ ID NO: 394039 - RNA, 18 nt, Bordetella pertussis
aucaggcggcugcccacc

SEQ ID NO: 394040 - RNA, 16 nt, Bordetella pertussis
aucagguccaugaacg

SEQ ID NO: 394041 - RNA, 16 nt, Bordetella pertussis
aucaggugggccgagc

SEQ ID NO: 394042 - RNA, 17 nt, Bordetella pertussis
aucaucagguccacuuc

SEQ ID NO: 394043 - RNA, 14 nt, Bordetella pertussis
aucauccgcgcaug

SEQ ID NO: 394044 - RNA, 19 nt, Bordetella pertussis
aucaugaccacgucgauca

SEQ ID NO: 394045 - RNA, 18 nt, Bordetella pertussis
aucaugcgcugcuggcca

SEQ ID NO: 394046 - RNA, 15 nt, Bordetella pertussis
aucaugggccugccc

SEQ ID NO: 394047 - RNA, 21 nt, Bordetella pertussis
aucaugggcgaagccacggcc

SEQ ID NO: 394048 - RNA, 18 nt, Bordetella pertussis
aucauguaaggcgcaugc

SEQ ID NO: 394049 - RNA, 13 nt, Bordetella pertussis
aucauuggccagc

SEQ ID NO: 394050 - RNA, 15 nt, Bordetella pertussis
auccacugcagcagu

SEQ ID NO: 394051 - RNA, 21 nt, Bordetella pertussis
auccagccauggaagcggcag

SEQ ID NO: 394052 - RNA, 21 nt, Bordetella pertussis
auccagcgccagcaccggcac

SEQ ID NO: 394053 - RNA, 14 nt, Bordetella pertussis
auccagcgccuggg

SEQ ID NO: 394054 - RNA, 17 nt, Bordetella pertussis
auccagcuugcguccca

SEQ ID NO: 394055 - RNA, 21 nt, Bordetella pertussis
auccagcuugcgucccaccug

SEQ ID NO: 394056 - RNA, 11 nt, Bordetella pertussis
auccagcuugc

SEQ ID NO: 394057 - RNA, 14 nt, Bordetella pertussis
auccaggcggcgcu

SEQ ID NO: 394058 - RNA, 16 nt, Bordetella pertussis
auccagggccgcagca

SEQ ID NO: 394059 - RNA, 18 nt, Bordetella pertussis
auccagggccgccagcac

SEQ ID NO: 394060 - RNA, 22 nt, Bordetella pertussis
auccagggcgaucagcaccgcg

SEQ ID NO: 394061 - RNA, 20 nt, Bordetella pertussis
auccaguugagaaugcccag

SEQ ID NO: 394062 - RNA, 14 nt, Bordetella pertussis
auccauuccauaug

SEQ ID NO: 394063 - RNA, 20 nt, Bordetella pertussis
aucccaauuggccgcccugg

SEQ ID NO: 394064 - RNA, 19 nt, Bordetella pertussis
auccccaaguacacgguca

SEQ ID NO: 394065 - RNA, 16 nt, Bordetella pertussis
auccccagcgccgcca

SEQ ID NO: 394066 - RNA, 14 nt, Bordetella pertussis
auccccugcccgcc

SEQ ID NO: 394067 - RNA, 17 nt, Bordetella pertussis
aucccgcccccgccgca

SEQ ID NO: 394068 - RNA, 15 nt, Bordetella pertussis
aucccgcgccuauca

SEQ ID NO: 394069 - RNA, 16 nt, Bordetella pertussis
aucccuaccgccuugc

SEQ ID NO: 394070 - RNA, 22 nt, Bordetella pertussis
auccgccauaugcgcgaagugg

SEQ ID NO: 394071 - RNA, 17 nt, Bordetella pertussis
auccgcgacgcccuggc

SEQ ID NO: 394072 - RNA, 12 nt, Bordetella pertussis
auccgcgcauga

SEQ ID NO: 394073 - RNA, 18 nt, Bordetella pertussis
auccgcgccacacgggcg

SEQ ID NO: 394074 - RNA, 14 nt, Bordetella pertussis
auccgcgccaggau

SEQ ID NO: 394075 - RNA, 13 nt, Bordetella pertussis
auccgcugcgccg

SEQ ID NO: 394076 - RNA, 23 nt, Bordetella pertussis
auccggacugaacgcguccaggc

SEQ ID NO: 394077 - RNA, 14 nt, Bordetella pertussis
auccggcagcagca

SEQ ID NO: 394078 - RNA, 13 nt, Bordetella pertussis
auccggccagcac

SEQ ID NO: 394079 - RNA, 21 nt, Bordetella pertussis
auccggcgcaugauggccggc

SEQ ID NO: 394080 - RNA, 22 nt, Bordetella pertussis
auccgggccuggcguucggcac

SEQ ID NO: 394081 - RNA, 18 nt, Bordetella pertussis
auccguaguccagcagca

SEQ ID NO: 394082 - RNA, 18 nt, Bordetella pertussis
auccugaccaucaucaac

SEQ ID NO: 394083 - RNA, 15 nt, Bordetella pertussis
auccugaugucggcc

SEQ ID NO: 394084 - RNA, 16 nt, Bordetella pertussis
auccugaugucggccu

SEQ ID NO: 394085 - RNA, 23 nt, Bordetella pertussis
auccugcugguggcgauguucac

SEQ ID NO: 394086 - RNA, 15 nt, Bordetella pertussis
auccuggcauugagc

SEQ ID NO: 394087 - RNA, 14 nt, Bordetella pertussis
auccuggccgccgc

SEQ ID NO: 394088 - RNA, 15 nt, Bordetella pertussis
auccuggcgcggaca

SEQ ID NO: 394089 - RNA, 22 nt, Bordetella pertussis
auccugggcgcgcgccagguug

SEQ ID NO: 394090 - RNA, 21 nt, Bordetella pertussis
auccuggucgaacguggcggc

SEQ ID NO: 394091 - RNA, 18 nt, Bordetella pertussis
auccuguucgugauccug

SEQ ID NO: 394092 - RNA, 17 nt, Bordetella pertussis
auccuucagguuccagg

SEQ ID NO: 394093 - RNA, 23 nt, Bordetella pertussis
auccuugacgaauuucucggcca

SEQ ID NO: 394094 - RNA, 20 nt, Bordetella pertussis
auccuugcgcucgcccagca

SEQ ID NO: 394095 - RNA, 15 nt, Bordetella pertussis
aucgacaacaagccg

SEQ ID NO: 394096 - RNA, 17 nt, Bordetella pertussis
aucgaccaggaccugua

SEQ ID NO: 394097 - RNA, 16 nt, Bordetella pertussis
aucgacgggcggcugc

SEQ ID NO: 394098 - RNA, 22 nt, Bordetella pertussis
aucgagaaaccagccgccgcca

SEQ ID NO: 394099 - RNA, 14 nt, Bordetella pertussis
aucgagaaguuggc

SEQ ID NO: 394100 - RNA, 18 nt, Bordetella pertussis
aucgaugcgccgcaccag

SEQ ID NO: 394101 - RNA, 14 nt, Bordetella pertussis
aucgauggccaggu

SEQ ID NO: 394102 - RNA, 20 nt, Bordetella pertussis
aucgccaccagcgucagcac

SEQ ID NO: 394103 - RNA, 20 nt, Bordetella pertussis
aucgccaggaccaggaugau

SEQ ID NO: 394104 - RNA, 15 nt, Bordetella pertussis
aucgccgaucggcaa

SEQ ID NO: 394105 - RNA, 13 nt, Bordetella pertussis
aucgccgcaggcg

SEQ ID NO: 394106 - RNA, 11 nt, Bordetella pertussis
aucgccgccgg

SEQ ID NO: 394107 - RNA, 24 nt, Bordetella pertussis
aucgccgcgucguucaucgcccau

SEQ ID NO: 394108 - RNA, 19 nt, Bordetella pertussis
aucgccgcugcgcagcagc

SEQ ID NO: 394109 - RNA, 16 nt, Bordetella pertussis
aucgccgcggcgggcg

SEQ ID NO: 394110 - RNA, 21 nt, Bordetella pertussis
aucgccggcgcccccagcagc

SEQ ID NO: 394111 - RNA, 22 nt, Bordetella pertussis
aucgccggcgcccccagcagcg

SEQ ID NO: 394112 - RNA, 20 nt, Bordetella pertussis
aucgccucguauucgcccgg

SEQ ID NO: 394113 - RNA, 13 nt, Bordetella pertussis
aucgccuggggca

SEQ ID NO: 394114 - RNA, 20 nt, Bordetella pertussis
aucgccuggggcaguuucca

SEQ ID NO: 394115 - RNA, 15 nt, Bordetella pertussis
aucgcgaaagcggcg

SEQ ID NO: 394116 - RNA, 22 nt, Bordetella pertussis
aucggacgggccgaugaagacg

SEQ ID NO: 394117 - RNA, 20 nt, Bordetella pertussis
aucggagaaaucgccgccgg

SEQ ID NO: 394118 - RNA, 19 nt, Bordetella pertussis
aucggcacccgcauggugg

SEQ ID NO: 394119 - RNA, 17 nt, Bordetella pertussis
aucggcacgggucaggc

SEQ ID NO: 394120 - RNA, 20 nt, Bordetella pertussis
aucggcgccaagcggcaggc

SEQ ID NO: 394121 - RNA, 20 nt, Bordetella pertussis
aucggcgcgagcgaugcccu

SEQ ID NO: 394122 - RNA, 17 nt, Bordetella pertussis
aucggcgcuggccuggc

SEQ ID NO: 394123 - RNA, 18 nt, Bordetella pertussis
aucggcggccugggccau

SEQ ID NO: 394124 - RNA, 15 nt, Bordetella pertussis
aucggcguaccaggc

SEQ ID NO: 394125 - RNA, 22 nt, Bordetella pertussis
aucguaggcgcuguuggccguc

SEQ ID NO: 394126 - RNA, 18 nt, Bordetella pertussis
aucgucaggcaggcgcgc

SEQ ID NO: 394127 - RNA, 14 nt, Bordetella pertussis
aucgucuugaccag

SEQ ID NO: 394128 - RNA, 18 nt, Bordetella pertussis
aucgucuugaccagcagg

SEQ ID NO: 394129 - RNA, 12 nt, Bordetella pertussis
aucugcuugccg

SEQ ID NO: 394130 - RNA, 14 nt, Bordetella pertussis
aucugguugagcag

SEQ ID NO: 394131 - RNA, 17 nt, Bordetella pertussis
aucugguugagcagcac

SEQ ID NO: 394132 - RNA, 23 nt, Bordetella pertussis
aucuguccccgcggggacaggca

SEQ ID NO: 394133 - RNA, 19 nt, Bordetella pertussis
aucuguucggcgccgggcg

SEQ ID NO: 394134 - RNA, 18 nt, Bordetella pertussis
aucuucgugcuggccauc

SEQ ID NO: 394135 - RNA, 17 nt, Bordetella pertussis
aucuugccaggcccggc

SEQ ID NO: 394136 - RNA, 18 nt, Bordetella pertussis
aucuugccaggcccggcg

SEQ ID NO: 394137 - RNA, 17 nt, Bordetella pertussis
aucuugccgaccgcguc

SEQ ID NO: 394138 - RNA, 13 nt, Bordetella pertussis
aucuugccgccgg

SEQ ID NO: 394139 - RNA, 23 nt, Bordetella pertussis
aucuugccggccuguucuuucuu

SEQ ID NO: 394140 - RNA, 14 nt, Bordetella pertussis
aucuuggccuguuc

SEQ ID NO: 394141 - RNA, 15 nt, Bordetella pertussis
aucuuggugcgcgcc

SEQ ID NO: 394142 - RNA, 20 nt, Bordetella pertussis
augaaaaaccccgccaggcg

SEQ ID NO: 394143 - RNA, 21 nt, Bordetella pertussis
augaaaugcuggucgcgcacc

SEQ ID NO: 394144 - RNA, 21 nt, Bordetella pertussis
augaacgcuugacggccagga

SEQ ID NO: 394145 - RNA, 17 nt, Bordetella pertussis
augaccgccgccagcag

SEQ ID NO: 394146 - RNA, 18 nt, Bordetella pertussis
augaccgccggcaccagc

SEQ ID NO: 394147 - RNA, 20 nt, Bordetella pertussis
augaccucgcgcugcagcau

SEQ ID NO: 394148 - RNA, 23 nt, Bordetella pertussis
augaccucgcgcugcagcaugaa

SEQ ID NO: 394149 - RNA, 15 nt, Bordetella pertussis
augaccugcgacagc

SEQ ID NO: 394150 - RNA, 20 nt, Bordetella pertussis
augaccugcgccaggugcuu

SEQ ID NO: 394151 - RNA, 14 nt, Bordetella pertussis
augacgggcggcgg

SEQ ID NO: 394152 - RNA, 20 nt, Bordetella pertussis
augacggggucggggcaggc

SEQ ID NO: 394153 - RNA, 19 nt, Bordetella pertussis
augacggggugccuguccc

SEQ ID NO: 394154 - RNA, 19 nt, Bordetella pertussis
augacucgggcaugcgccu

SEQ ID NO: 394155 - RNA, 14 nt, Bordetella pertussis
augaggaacggcac

SEQ ID NO: 394156 - RNA, 19 nt, Bordetella pertussis
augaucaggccgaacuggg

SEQ ID NO: 394157 - RNA, 14 nt, Bordetella pertussis
augauccugcuggu

SEQ ID NO: 394158 - RNA, 17 nt, Bordetella pertussis
augaucgccucggggcu

SEQ ID NO: 394159 - RNA, 18 nt, Bordetella pertussis
augaucgccucggggcuc

SEQ ID NO: 394160 - RNA, 14 nt, Bordetella pertussis
augaugcagcacac

SEQ ID NO: 394161 - RNA, 13 nt, Bordetella pertussis
augaugcccagcg

SEQ ID NO: 394162 - RNA, 10 nt, Bordetella pertussis
augcaccagc

SEQ ID NO: 394163 - RNA, 14 nt, Bordetella pertussis
augcaccagcacau

SEQ ID NO: 394164 - RNA, 15 nt, Bordetella pertussis
augcaccagcacauc

SEQ ID NO: 394165 - RNA, 12 nt, Bordetella pertussis
augcaccgggcc

SEQ ID NO: 394166 - RNA, 17 nt, Bordetella pertussis
augcaccugcaggguca

SEQ ID NO: 394167 - RNA, 21 nt, Bordetella pertussis
augcacgggcgcugcccagga

SEQ ID NO: 394168 - RNA, 20 nt, Bordetella pertussis
augcacguagcgcagcaccg

SEQ ID NO: 394169 - RNA, 17 nt, Bordetella pertussis
augcagcacgucggcgu

SEQ ID NO: 394170 - RNA, 11 nt, Bordetella pertussis
augcagcagcg

SEQ ID NO: 394171 - RNA, 19 nt, Bordetella pertussis
augcgacagcgacagccag

SEQ ID NO: 394172 - RNA, 16 nt, Bordetella pertussis
augcgacaugagcugc

SEQ ID NO: 394173 - RNA, 23 nt, Bordetella pertussis
augcgauagcgggccugcagcau

SEQ ID NO: 394174 - RNA, 13 nt, Bordetella pertussis
augcgcaugcugg

SEQ ID NO: 394175 - RNA, 16 nt, Bordetella pertussis
augcgcauggccagca

SEQ ID NO: 394176 - RNA, 17 nt, Bordetella pertussis
augcgcauggccagcac

SEQ ID NO: 394177 - RNA, 13 nt, Bordetella pertussis
augcgccagcagg

SEQ ID NO: 394178 - RNA, 17 nt, Bordetella pertussis
augcgccagcaggaugu

SEQ ID NO: 394179 - RNA, 15 nt, Bordetella pertussis
augcgccagccagcg

SEQ ID NO: 394180 - RNA, 12 nt, Bordetella pertussis
augcgccaggcc

SEQ ID NO: 394181 - RNA, 15 nt, Bordetella pertussis
augcgccgcaccagc

SEQ ID NO: 394182 - RNA, 15 nt, Bordetella pertussis
augcgccggcccggc

SEQ ID NO: 394183 - RNA, 16 nt, Bordetella pertussis
augcgccggccuggcg

SEQ ID NO: 394184 - RNA, 13 nt, Bordetella pertussis
augcgccgcccca

SEQ ID NO: 394185 - RNA, 23 nt, Bordetella pertussis
augcgccguccucaggcccgcgg

SEQ ID NO: 394186 - RNA, 14 nt, Bordetella pertussis
augcgcgccagcau

SEQ ID NO: 394187 - RNA, 14 nt, Bordetella pertussis
augcgcgccaggcg

SEQ ID NO: 394188 - RNA, 18 nt, Bordetella pertussis
augcgcgccgcucuuggc

SEQ ID NO: 394189 - RNA, 19 nt, Bordetella pertussis
augcgcgcgcgggccagca

SEQ ID NO: 394190 - RNA, 15 nt, Bordetella pertussis
augcgcgcggccagc

SEQ ID NO: 394191 - RNA, 16 nt, Bordetella pertussis
augcgcgcggccagcg

SEQ ID NO: 394192 - RNA, 14 nt, Bordetella pertussis
augcgcggcccggc

SEQ ID NO: 394193 - RNA, 22 nt, Bordetella pertussis
augcgcgucuccagcgccggca

SEQ ID NO: 394194 - RNA, 21 nt, Bordetella pertussis
augcgcugcacgguggacagg

SEQ ID NO: 394195 - RNA, 14 nt, Bordetella pertussis
augcgcuggccggc

SEQ ID NO: 394196 - RNA, 16 nt, Bordetella pertussis
augcgcugggccaggc

SEQ ID NO: 394197 - RNA, 17 nt, Bordetella pertussis
augcgcugggccaggcc

SEQ ID NO: 394198 - RNA, 19 nt, Bordetella pertussis
augcgcuggucgcgcagca

SEQ ID NO: 394199 - RNA, 16 nt, Bordetella pertussis
augcgcuugccgccca

SEQ ID NO: 394200 - RNA, 16 nt, Bordetella pertussis
augcggacgccagccc

SEQ ID NO: 394201 - RNA, 21 nt, Bordetella pertussis
augcggcacaaccuggcgcgc

SEQ ID NO: 394202 - RNA, 15 nt, Bordetella pertussis
augcggcagcagggc

SEQ ID NO: 394203 - RNA, 16 nt, Bordetella pertussis
augcggcagcagggcc

SEQ ID NO: 394204 - RNA, 18 nt, Bordetella pertussis
augcggcgcccaggccca

SEQ ID NO: 394205 - RNA, 13 nt, Bordetella pertussis
augcggcgcgccg

SEQ ID NO: 394206 - RNA, 15 nt, Bordetella pertussis
augcggcggcgcugg

SEQ ID NO: 394207 - RNA, 22 nt, Bordetella pertussis
augcggcggcgcuggccugccg

SEQ ID NO: 394208 - RNA, 21 nt, Bordetella pertussis
augcggcggcgggcggccggc

SEQ ID NO: 394209 - RNA, 13 nt, Bordetella pertussis
augcggcgcaugc

SEQ ID NO: 394210 - RNA, 15 nt, Bordetella pertussis
augcggcguccugcc

SEQ ID NO: 394211 - RNA, 23 nt, Bordetella pertussis
augcggcuggccgaucaccugca

SEQ ID NO: 394212 - RNA, 15 nt, Bordetella pertussis
augcggggacaggca

SEQ ID NO: 394213 - RNA, 20 nt, Bordetella pertussis
augcggggacuggcaccagg

SEQ ID NO: 394214 - RNA, 13 nt, Bordetella pertussis
augcgggucaggc

SEQ ID NO: 394215 - RNA, 17 nt, Bordetella pertussis
augcgguaggcccagca

SEQ ID NO: 394216 - RNA, 17 nt, Bordetella pertussis
augcgguuuuugaggac

SEQ ID NO: 394217 - RNA, 22 nt, Bordetella pertussis
augcgucaggggcaugccggca

SEQ ID NO: 394218 - RNA, 13 nt, Bordetella pertussis
augcguccgccgu

SEQ ID NO: 394219 - RNA, 19 nt, Bordetella pertussis
augcgucgaacggccgggc

SEQ ID NO: 394220 - RNA, 13 nt, Bordetella pertussis
augcguggccggc

SEQ ID NO: 394221 - RNA, 14 nt, Bordetella pertussis
augcguggccggcg

SEQ ID NO: 394222 - RNA, 19 nt, Bordetella pertussis
augcguucgaaagccagcg

SEQ ID NO: 394223 - RNA, 15 nt, Bordetella pertussis
augcguucggccagc

SEQ ID NO: 394224 - RNA, 21 nt, Bordetella pertussis
augcucuugcucaucaccagc

SEQ ID NO: 394225 - RNA, 13 nt, Bordetella pertussis
augcugauccugg

SEQ ID NO: 394226 - RNA, 23 nt, Bordetella pertussis
augcugcagcugcuugcccaggc

SEQ ID NO: 394227 - RNA, 13 nt, Bordetella pertussis
augcugcagggcc

SEQ ID NO: 394228 - RNA, 15 nt, Bordetella pertussis
augcugcgacagcag

SEQ ID NO: 394229 - RNA, 16 nt, Bordetella pertussis
augcuggcccagcugg

SEQ ID NO: 394230 - RNA, 21 nt, Bordetella pertussis
augcuggcccagcugggcggc

SEQ ID NO: 394231 - RNA, 20 nt, Bordetella pertussis
augcugggcgggcugguggu

SEQ ID NO: 394232 - RNA, 18 nt, Bordetella pertussis
augcuugccauaggccag

SEQ ID NO: 394233 - RNA, 21 nt, Bordetella pertussis
auggaaucgucgaccagcagc

SEQ ID NO: 394234 - RNA, 16 nt, Bordetella pertussis
auggagccaggcggcg

SEQ ID NO: 394235 - RNA, 18 nt, Bordetella pertussis
auggauucgcgccggccg

SEQ ID NO: 394236 - RNA, 19 nt, Bordetella pertussis
auggccgaaugcccgcccu

SEQ ID NO: 394237 - RNA, 21 nt, Bordetella pertussis
auggccgccuuuucgcagcgg

SEQ ID NO: 394238 - RNA, 16 nt, Bordetella pertussis
auggccucgcugccag

SEQ ID NO: 394239 - RNA, 22 nt, Bordetella pertussis
auggccucgcugccagggugca

SEQ ID NO: 394240 - RNA, 16 nt, Bordetella pertussis
auggccucggcggccu

SEQ ID NO: 394241 - RNA, 14 nt, Bordetella pertussis
auggccugggugcg

SEQ ID NO: 394242 - RNA, 16 nt, Bordetella pertussis
auggcgcaggcgcgcc

SEQ ID NO: 394243 - RNA, 19 nt, Bordetella pertussis
auggcgccagcccgcccgc

SEQ ID NO: 394244 - RNA, 18 nt, Bordetella pertussis
auggcgccgcgccgccgc

SEQ ID NO: 394245 - RNA, 21 nt, Bordetella pertussis
auggcgccgugaaugcgccug

SEQ ID NO: 394246 - RNA, 21 nt, Bordetella pertussis
auggcggggaauucgaccgga

SEQ ID NO: 394247 - RNA, 15 nt, Bordetella pertussis
auggcggggauggag

SEQ ID NO: 394248 - RNA, 17 nt, Bordetella pertussis
auggcggugaaggcgcc

SEQ ID NO: 394249 - RNA, 17 nt, Bordetella pertussis
auggcguagagcagugu

SEQ ID NO: 394250 - RNA, 22 nt, Bordetella pertussis
auggcguagagcagugugccug

SEQ ID NO: 394251 - RNA, 16 nt, Bordetella pertussis
auggcguaugacaggg

SEQ ID NO: 394252 - RNA, 18 nt, Bordetella pertussis
auggcgucgaaacgcugc

SEQ ID NO: 394253 - RNA, 22 nt, Bordetella pertussis
auggcgugcacgcguaugcccu

SEQ ID NO: 394254 - RNA, 16 nt, Bordetella pertussis
auggcuuccugcaccu

SEQ ID NO: 394255 - RNA, 23 nt, Bordetella pertussis
auggguaaagcgccggcccgccu

SEQ ID NO: 394256 - RNA, 16 nt, Bordetella pertussis
auggguacgccggccu

SEQ ID NO: 394257 - RNA, 21 nt, Bordetella pertussis
auggugcuccgacggcuggag

SEQ ID NO: 394258 - RNA, 13 nt, Bordetella pertussis
auguagcccaugg

SEQ ID NO: 394259 - RNA, 19 nt, Bordetella pertussis
auguagcccauggccaggg

SEQ ID NO: 394260 - RNA, 16 nt, Bordetella pertussis
augucgaucuggcuca

SEQ ID NO: 394261 - RNA, 16 nt, Bordetella pertussis
augucgcccaugcuga

SEQ ID NO: 394262 - RNA, 21 nt, Bordetella pertussis
augucgcggcccacggccagc

SEQ ID NO: 394263 - RNA, 18 nt, Bordetella pertussis
augucguccucggccacg

SEQ ID NO: 394264 - RNA, 17 nt, Bordetella pertussis
augucguugcacagcac

SEQ ID NO: 394265 - RNA, 16 nt, Bordetella pertussis
augugcguugccagcc

SEQ ID NO: 394266 - RNA, 23 nt, Bordetella pertussis
auguugauccggucgcccgccgc

SEQ ID NO: 394267 - RNA, 14 nt, Bordetella pertussis
auuccagccaggcc

SEQ ID NO: 394268 - RNA, 19 nt, Bordetella pertussis
auuccagcgccgccuucac

SEQ ID NO: 394269 - RNA, 14 nt, Bordetella pertussis
auuccaucuugccg

SEQ ID NO: 394270 - RNA, 17 nt, Bordetella pertussis
auuccgccccccugcau

SEQ ID NO: 394271 - RNA, 18 nt, Bordetella pertussis
auuccgccgucagcucga

SEQ ID NO: 394272 - RNA, 18 nt, Bordetella pertussis
auuccugucgcgcugcuu

SEQ ID NO: 394273 - RNA, 19 nt, Bordetella pertussis
auucgcagauuuuguggag

SEQ ID NO: 394274 - RNA, 13 nt, Bordetella pertussis
auucgcugcuggc

SEQ ID NO: 394275 - RNA, 14 nt, Bordetella pertussis
auucggcggccggc

SEQ ID NO: 394276 - RNA, 22 nt, Bordetella pertussis
auucggcggugaugucgccggu

SEQ ID NO: 394277 - RNA, 15 nt, Bordetella pertussis
auucucaccagcgca

SEQ ID NO: 394278 - RNA, 12 nt, Bordetella pertussis
auucugcaaaag

SEQ ID NO: 394279 - RNA, 14 nt, Bordetella pertussis
auugcaucgcagca

SEQ ID NO: 394280 - RNA, 18 nt, Bordetella pertussis
auugcaugaccgccggca

SEQ ID NO: 394281 - RNA, 19 nt, Bordetella pertussis
auugccacggcgggccggc

SEQ ID NO: 394282 - RNA, 23 nt, Bordetella pertussis
auugcgccagcgcuguccaggcc

SEQ ID NO: 394283 - RNA, 14 nt, Bordetella pertussis
auugcggcaccugc

SEQ ID NO: 394284 - RNA, 16 nt, Bordetella pertussis
auugcggcaccugcug

SEQ ID NO: 394285 - RNA, 22 nt, Bordetella pertussis
auugcgguacaggucguagacc

SEQ ID NO: 394286 - RNA, 12 nt, Bordetella pertussis
auugcugcugcu

SEQ ID NO: 394287 - RNA, 22 nt, Bordetella pertussis
auuggacagcaguucggccggc

SEQ ID NO: 394288 - RNA, 21 nt, Bordetella pertussis
auuggcccugcugggguggag

SEQ ID NO: 394289 - RNA, 17 nt, Bordetella pertussis
auuggcgaaaggcaccg

SEQ ID NO: 394290 - RNA, 19 nt, Bordetella pertussis
auuggcggcggcguucagg

SEQ ID NO: 394291 - RNA, 14 nt, Bordetella pertussis
auuuccagcucguc

SEQ ID NO: 394292 - RNA, 22 nt, Bordetella pertussis
auuuccauuuguugggccaccu

SEQ ID NO: 394293 - RNA, 14 nt, Bordetella pertussis
auuucgcuggccau

SEQ ID NO: 394294 - RNA, 17 nt, Bordetella pertussis
auuucguaaagccgcac

SEQ ID NO: 394295 - RNA, 13 nt, Bordetella pertussis
auuugcagcagca

SEQ ID NO: 394296 - RNA, 17 nt, Bordetella pertussis
auuugcagcggcggcac

SEQ ID NO: 394297 - RNA, 15 nt, Bordetella pertussis
caaaagucguguuau

SEQ ID NO: 394298 - RNA, 15 nt, Bordetella pertussis
caaaauuggugucau

SEQ ID NO: 394299 - RNA, 16 nt, Bordetella pertussis
caaaauuggugucaua

SEQ ID NO: 394300 - RNA, 20 nt, Bordetella pertussis
caaacccggcgaagccggca

SEQ ID NO: 394301 - RNA, 23 nt, Bordetella pertussis
caaaccgucgaugaccagcgccg

SEQ ID NO: 394302 - RNA, 23 nt, Bordetella pertussis
caaaccugccguaauccaggcaa

SEQ ID NO: 394303 - RNA, 23 nt, Bordetella pertussis
caaagacggcuugaccacggcca

SEQ ID NO: 394304 - RNA, 14 nt, Bordetella pertussis
caaaggacacgcgc

SEQ ID NO: 394305 - RNA, 18 nt, Bordetella pertussis
caacaacggggucaucgc

SEQ ID NO: 394306 - RNA, 16 nt, Bordetella pertussis
caacaagccgggcgcc

SEQ ID NO: 394307 - RNA, 14 nt, Bordetella pertussis
caacacgaccagca

SEQ ID NO: 394308 - RNA, 12 nt, Bordetella pertussis
caacagcccccu

SEQ ID NO: 394309 - RNA, 13 nt, Bordetella pertussis
caacagcgccugc

SEQ ID NO: 394310 - RNA, 19 nt, Bordetella pertussis
caacaucaaugacauggcc

SEQ ID NO: 394311 - RNA, 19 nt, Bordetella pertussis
caaccuucacgacacgccc

SEQ ID NO: 394312 - RNA, 18 nt, Bordetella pertussis
caacgaaggcauccaggu

SEQ ID NO: 394313 - RNA, 18 nt, Bordetella pertussis
caacgaguaccugcuggu

SEQ ID NO: 394314 - RNA, 23 nt, Bordetella pertussis
caacgcaugcgcgaucucguggc

SEQ ID NO: 394315 - RNA, 19 nt, Bordetella pertussis
caacgccggccgccauggc

SEQ ID NO: 394316 - RNA, 20 nt, Bordetella pertussis
caacgccggccgccauggcc

SEQ ID NO: 394317 - RNA, 15 nt, Bordetella pertussis
caacgcgcgcgcgca

SEQ ID NO: 394318 - RNA, 17 nt, Bordetella pertussis
caacgcgcgcgcgcaca

SEQ ID NO: 394319 - RNA, 18 nt, Bordetella pertussis
caacgggauccggcagca

SEQ ID NO: 394320 - RNA, 23 nt, Bordetella pertussis
caacgggccggccgccggcggca

SEQ ID NO: 394321 - RNA, 18 nt, Bordetella pertussis
caacggugccaguccccc

SEQ ID NO: 394322 - RNA, 18 nt, Bordetella pertussis
caacuccuggacgaugcg

SEQ ID NO: 394323 - RNA, 17 nt, Bordetella pertussis
caagaagaagccgggcu

SEQ ID NO: 394324 - RNA, 13 nt, Bordetella pertussis
caagacagcaaga

SEQ ID NO: 394325 - RNA, 14 nt, Bordetella pertussis
caagacgcccaggc

SEQ ID NO: 394326 - RNA, 13 nt, Bordetella pertussis
caagacgguaucu

SEQ ID NO: 394327 - RNA, 23 nt, Bordetella pertussis
caagauggcccagggcagcggcc

SEQ ID NO: 394328 - RNA, 20 nt, Bordetella pertussis
caagcgcucgccggcgcgca

SEQ ID NO: 394329 - RNA, 16 nt, Bordetella pertussis
caagcucgcgcaugca

SEQ ID NO: 394330 - RNA, 13 nt, Bordetella pertussis
caagcugcugcug

SEQ ID NO: 394331 - RNA, 20 nt, Bordetella pertussis
caagcugcugcuggaccugg

SEQ ID NO: 394332 - RNA, 17 nt, Bordetella pertussis
caagcugcuggccggcc

SEQ ID NO: 394333 - RNA, 17 nt, Bordetella pertussis
caagcugcuggcgcgcc

SEQ ID NO: 394334 - RNA, 18 nt, Bordetella pertussis
caagcugcuggcgcgcca

SEQ ID NO: 394335 - RNA, 17 nt, Bordetella pertussis
caagcuggcggcgcgcg

SEQ ID NO: 394336 - RNA, 12 nt, Bordetella pertussis
caaggcaagcag

SEQ ID NO: 394337 - RNA, 22 nt, Bordetella pertussis
caaggcaugcgccagcgccugg

SEQ ID NO: 394338 - RNA, 18 nt, Bordetella pertussis
caaggcauuggcgccgcg

SEQ ID NO: 394339 - RNA, 23 nt, Bordetella pertussis
caaggccccgcgacccagaaccc

SEQ ID NO: 394340 - RNA, 14 nt, Bordetella pertussis
caaggcgucggcca

SEQ ID NO: 394341 - RNA, 23 nt, Bordetella pertussis
caagggccagucguucagcgucu

SEQ ID NO: 394342 - RNA, 14 nt, Bordetella pertussis
caaguccggcgccg

SEQ ID NO: 394343 - RNA, 15 nt, Bordetella pertussis
caauaccuucagccc

SEQ ID NO: 394344 - RNA, 13 nt, Bordetella pertussis
caaucagccccag

SEQ ID NO: 394345 - RNA, 17 nt, Bordetella pertussis
caaucagccccaggcgc

SEQ ID NO: 394346 - RNA, 17 nt, Bordetella pertussis
caauugcgcggccaugc

SEQ ID NO: 394347 - RNA, 23 nt, Bordetella pertussis
caauuuuguugauggcgauggcu

SEQ ID NO: 394348 - RNA, 17 nt, Bordetella pertussis
cacaaagacggcuugac

SEQ ID NO: 394349 - RNA, 13 nt, Bordetella pertussis
cacaacccgcccg

SEQ ID NO: 394350 - RNA, 16 nt, Bordetella pertussis
cacaaccuggcgcgcg

SEQ ID NO: 394351 - RNA, 14 nt, Bordetella pertussis
cacaaugccccacg

SEQ ID NO: 394352 - RNA, 16 nt, Bordetella pertussis
cacaccacgcgaugcg

SEQ ID NO: 394353 - RNA, 21 nt, Bordetella pertussis
cacaccguggcaugccaugcg

SEQ ID NO: 394354 - RNA, 14 nt, Bordetella pertussis
cacacgaccgagcc

SEQ ID NO: 394355 - RNA, 20 nt, Bordetella pertussis
cacacgaucagcgcccaggu

SEQ ID NO: 394356 - RNA, 17 nt, Bordetella pertussis
cacacgaucgucagcag

SEQ ID NO: 394357 - RNA, 19 nt, Bordetella pertussis
cacacgcauuugcagcggc

SEQ ID NO: 394358 - RNA, 12 nt, Bordetella pertussis
cacacgcgcgca

SEQ ID NO: 394359 - RNA, 18 nt, Bordetella pertussis
cacagauuggccaccagg

SEQ ID NO: 394360 - RNA, 19 nt, Bordetella pertussis
cacagauuggccaccaggg

SEQ ID NO: 394361 - RNA, 16 nt, Bordetella pertussis
cacagcaacucuuccc

SEQ ID NO: 394362 - RNA, 18 nt, Bordetella pertussis
cacagcaacucuuccccg

SEQ ID NO: 394363 - RNA, 12 nt, Bordetella pertussis
cacagcaccugg

SEQ ID NO: 394364 - RNA, 14 nt, Bordetella pertussis
cacagcagcgcgcc

SEQ ID NO: 394365 - RNA, 21 nt, Bordetella pertussis
cacagccacugcggcccgagc

SEQ ID NO: 394366 - RNA, 19 nt, Bordetella pertussis
cacagccauugcccacagc

SEQ ID NO: 394367 - RNA, 11 nt, Bordetella pertussis
cacagccgcag

SEQ ID NO: 394368 - RNA, 13 nt, Bordetella pertussis
cacagccgcagcc

SEQ ID NO: 394369 - RNA, 15 nt, Bordetella pertussis
cacagccgccauacc

SEQ ID NO: 394370 - RNA, 12 nt, Bordetella pertussis
cacagcggcgcg

SEQ ID NO: 394371 - RNA, 15 nt, Bordetella pertussis
cacagcgucccagcc

SEQ ID NO: 394372 - RNA, 14 nt, Bordetella pertussis
cacaggaacagccu

SEQ ID NO: 394373 - RNA, 22 nt, Bordetella pertussis
cacaggaacaggccggccuggg

SEQ ID NO: 394374 - RNA, 16 nt, Bordetella pertussis
cacaggcccgcgcggc

SEQ ID NO: 394375 - RNA, 17 nt, Bordetella pertussis
cacaggcccgcgcggcc

SEQ ID NO: 394376 - RNA, 18 nt, Bordetella pertussis
cacaggcccgcgcggcca

SEQ ID NO: 394377 - RNA, 15 nt, Bordetella pertussis
cacaggcgcgcggcg

SEQ ID NO: 394378 - RNA, 18 nt, Bordetella pertussis
cacaggcgcuugccauaa

SEQ ID NO: 394379 - RNA, 14 nt, Bordetella pertussis
cacaggcggcgccg

SEQ ID NO: 394380 - RNA, 19 nt, Bordetella pertussis
cacaggcugacgcccggcu

SEQ ID NO: 394381 - RNA, 21 nt, Bordetella pertussis
cacagggcgaaggccagcgcc

SEQ ID NO: 394382 - RNA, 12 nt, Bordetella pertussis
cacagggggacu

SEQ ID NO: 394383 - RNA, 21 nt, Bordetella pertussis
cacagggucaaggcgcggccg

SEQ ID NO: 394384 - RNA, 15 nt, Bordetella pertussis
cacaggugcgcggcg

SEQ ID NO: 394385 - RNA, 20 nt, Bordetella pertussis
cacaggugcgcggcgcgccg

SEQ ID NO: 394386 - RNA, 18 nt, Bordetella pertussis
cacagucggucgccgcag

SEQ ID NO: 394387 - RNA, 18 nt, Bordetella pertussis
cacaguucggccagcggc

SEQ ID NO: 394388 - RNA, 20 nt, Bordetella pertussis
cacaguucggccagcggcag

SEQ ID NO: 394389 - RNA, 17 nt, Bordetella pertussis
cacaguucgugcaccag

SEQ ID NO: 394390 - RNA, 14 nt, Bordetella pertussis
cacauacaaggcgc

SEQ ID NO: 394391 - RNA, 18 nt, Bordetella pertussis
cacauacagcggagccgc

SEQ ID NO: 394392 - RNA, 20 nt, Bordetella pertussis
cacauacagcggagccgcgc

SEQ ID NO: 394393 - RNA, 14 nt, Bordetella pertussis
cacauacgccgccg

SEQ ID NO: 394394 - RNA, 14 nt, Bordetella pertussis
cacauagcccggcg

SEQ ID NO: 394395 - RNA, 16 nt, Bordetella pertussis
cacauagcgcaagccc

SEQ ID NO: 394396 - RNA, 20 nt, Bordetella pertussis
cacauagcggccggcgcgcg

SEQ ID NO: 394397 - RNA, 23 nt, Bordetella pertussis
cacaucaggucgaccugcuugcc

SEQ ID NO: 394398 - RNA, 14 nt, Bordetella pertussis
cacauccagcgcca

SEQ ID NO: 394399 - RNA, 20 nt, Bordetella pertussis
cacauccagcgccagcaccg

SEQ ID NO: 394400 - RNA, 23 nt, Bordetella pertussis
cacaucgaauuugaacagccgcc

SEQ ID NO: 394401 - RNA, 24 nt, Bordetella pertussis
cacaucgaauuugaacagccgccc

SEQ ID NO: 394402 - RNA, 21 nt, Bordetella pertussis
cacaucgagggcgucaucggc

SEQ ID NO: 394403 - RNA, 18 nt, Bordetella pertussis
cacaucgcccggcagguc

SEQ ID NO: 394404 - RNA, 14 nt, Bordetella pertussis
cacaucggccaccc

SEQ ID NO: 394405 - RNA, 18 nt, Bordetella pertussis
cacaucuguccugauuca

SEQ ID NO: 394406 - RNA, 15 nt, Bordetella pertussis
cacaugaugcccagc

SEQ ID NO: 394407 - RNA, 16 nt, Bordetella pertussis
cacaugaugcccagcg

SEQ ID NO: 394408 - RNA, 15 nt, Bordetella pertussis
cacauggaaauccuu

SEQ ID NO: 394409 - RNA, 18 nt, Bordetella pertussis
cacauggcggauggcaua

SEQ ID NO: 394410 - RNA, 19 nt, Bordetella pertussis
caccaaccaacaugccgga

SEQ ID NO: 394411 - RNA, 12 nt, Bordetella pertussis
caccaaccugcu

SEQ ID NO: 394412 - RNA, 22 nt, Bordetella pertussis
caccaacugguagugcggcgcc

SEQ ID NO: 394413 - RNA, 13 nt, Bordetella pertussis
caccaagggcgcc

SEQ ID NO: 394414 - RNA, 14 nt, Bordetella pertussis
caccaagggcgccg

SEQ ID NO: 394415 - RNA, 14 nt, Bordetella pertussis
caccaccaccaccu

SEQ ID NO: 394416 - RNA, 16 nt, Bordetella pertussis
caccaccaccgcccgc

SEQ ID NO: 394417 - RNA, 18 nt, Bordetella pertussis
caccaccagcaccgccac

SEQ ID NO: 394418 - RNA, 14 nt, Bordetella pertussis
caccaccagcggcg

SEQ ID NO: 394419 - RNA, 15 nt, Bordetella pertussis
caccaccagcggcgu

SEQ ID NO: 394420 - RNA, 12 nt, Bordetella pertussis
caccaccaggcc

SEQ ID NO: 394421 - RNA, 13 nt, Bordetella pertussis
caccaccaggccc

SEQ ID NO: 394422 - RNA, 15 nt, Bordetella pertussis
caccaccaggccggc

SEQ ID NO: 394423 - RNA, 16 nt, Bordetella pertussis
caccaccaggccggcc

SEQ ID NO: 394424 - RNA, 16 nt, Bordetella pertussis
caccaccaucugcgag

SEQ ID NO: 394425 - RNA, 18 nt, Bordetella pertussis
caccaccggcacgccggc

SEQ ID NO: 394426 - RNA, 23 nt, Bordetella pertussis
caccaccgucucgaacgccgcgu

SEQ ID NO: 394427 - RNA, 17 nt, Bordetella pertussis
caccaccucggccucgc

SEQ ID NO: 394428 - RNA, 14 nt, Bordetella pertussis
caccacgaccggcu

SEQ ID NO: 394429 - RNA, 16 nt, Bordetella pertussis
caccacgcccgcgccg

SEQ ID NO: 394430 - RNA, 14 nt, Bordetella pertussis
caccacgcgcacca

SEQ ID NO: 394431 - RNA, 18 nt, Bordetella pertussis
caccacggcaucggcgcc

SEQ ID NO: 394432 - RNA, 19 nt, Bordetella pertussis
caccacgggcucgcugacc

SEQ ID NO: 394433 - RNA, 20 nt, Bordetella pertussis
caccacugcaaggcccgccc

SEQ ID NO: 394434 - RNA, 12 nt, Bordetella pertussis
caccagcaagcc

SEQ ID NO: 394435 - RNA, 14 nt, Bordetella pertussis
caccagcaccaugc

SEQ ID NO: 394436 - RNA, 13 nt, Bordetella pertussis
caccagcaccggc

SEQ ID NO: 394437 - RNA, 15 nt, Bordetella pertussis
caccagcagccccag

SEQ ID NO: 394438 - RNA, 14 nt, Bordetella pertussis
caccagcagcgcca

SEQ ID NO: 394439 - RNA, 15 nt, Bordetella pertussis
caccagcagcgccag

SEQ ID NO: 394440 - RNA, 12 nt, Bordetella pertussis
caccagcaggau

SEQ ID NO: 394441 - RNA, 10 nt, Bordetella pertussis
caccagcagg

SEQ ID NO: 394442 - RNA, 11 nt, Bordetella pertussis
caccagcaggu

SEQ ID NO: 394443 - RNA, 13 nt, Bordetella pertussis
caccagcccgccc

SEQ ID NO: 394444 - RNA, 14 nt, Bordetella pertussis
caccagcccgcccg

SEQ ID NO: 394445 - RNA, 20 nt, Bordetella pertussis
caccagcccgcccgcgccca

SEQ ID NO: 394446 - RNA, 22 nt, Bordetella pertussis
caccagcccgcccgcgcccagc

SEQ ID NO: 394447 - RNA, 23 nt, Bordetella pertussis
caccagcccgcccgcgcccagcu

SEQ ID NO: 394448 - RNA, 13 nt, Bordetella pertussis
caccagccgcccg

SEQ ID NO: 394449 - RNA, 14 nt, Bordetella pertussis
caccagccggccgc

SEQ ID NO: 394450 - RNA, 13 nt, Bordetella pertussis
caccagccgggcg

SEQ ID NO: 394451 - RNA, 16 nt, Bordetella pertussis
caccagcgaggcggca

SEQ ID NO: 394452 - RNA, 14 nt, Bordetella pertussis
caccagcgcacuga

SEQ ID NO: 394453 - RNA, 20 nt, Bordetella pertussis
caccagcgccacgcccaggc

SEQ ID NO: 394454 - RNA, 13 nt, Bordetella pertussis
caccagcgcgcca

SEQ ID NO: 394455 - RNA, 13 nt, Bordetella pertussis
caccagcgcgccg

SEQ ID NO: 394456 - RNA, 20 nt, Bordetella pertussis
caccagcgcgccgaucacca

SEQ ID NO: 394457 - RNA, 22 nt, Bordetella pertussis
caccagcgcgccgaucaccacg

SEQ ID NO: 394458 - RNA, 21 nt, Bordetella pertussis
caccagcgcgccgcgcgcggc

SEQ ID NO: 394459 - RNA, 19 nt, Bordetella pertussis
caccagcgcggccagcacc

SEQ ID NO: 394460 - RNA, 19 nt, Bordetella pertussis
caccagcgcgucgccgcca

SEQ ID NO: 394461 - RNA, 13 nt, Bordetella pertussis
caccagcggcgcc

SEQ ID NO: 394462 - RNA, 12 nt, Bordetella pertussis
caccagcggcgu

SEQ ID NO: 394463 - RNA, 17 nt, Bordetella pertussis
caccagcggcgugcggc

SEQ ID NO: 394464 - RNA, 22 nt, Bordetella pertussis
caccagcggcgugcggcccagc

SEQ ID NO: 394465 - RNA, 23 nt, Bordetella pertussis
caccagcggcguggcggccaggc

SEQ ID NO: 394466 - RNA, 16 nt, Bordetella pertussis
caccagcggcgccgga

SEQ ID NO: 394467 - RNA, 20 nt, Bordetella pertussis
caccagcguguagagcaggc

SEQ ID NO: 394468 - RNA, 16 nt, Bordetella pertussis
caccagcucgcggccc

SEQ ID NO: 394469 - RNA, 17 nt, Bordetella pertussis
caccagcucgcggcccu

SEQ ID NO: 394470 - RNA, 14 nt, Bordetella pertussis
caccagcuuggccu

SEQ ID NO: 394471 - RNA, 22 nt, Bordetella pertussis
caccagcuuggccugcggaugc

SEQ ID NO: 394472 - RNA, 19 nt, Bordetella pertussis
caccaggaacgccagcagc

SEQ ID NO: 394473 - RNA, 20 nt, Bordetella pertussis
caccaggaacgccagcagca

SEQ ID NO: 394474 - RNA, 18 nt, Bordetella pertussis
caccaggaagagcuggcg

SEQ ID NO: 394475 - RNA, 20 nt, Bordetella pertussis
caccaggaagagcuggcgcu

SEQ ID NO: 394476 - RNA, 20 nt, Bordetella pertussis
caccaggauuccugcgagga

SEQ ID NO: 394477 - RNA, 13 nt, Bordetella pertussis
caccaggccgccg

SEQ ID NO: 394478 - RNA, 17 nt, Bordetella pertussis
caccaggccgccggcca

SEQ ID NO: 394479 - RNA, 22 nt, Bordetella pertussis
caccaggccgccggccagcgcc

SEQ ID NO: 394480 - RNA, 23 nt, Bordetella pertussis
caccaggccgccggccagcgcca

SEQ ID NO: 394481 - RNA, 14 nt, Bordetella pertussis
caccaggccgcggc

SEQ ID NO: 394482 - RNA, 16 nt, Bordetella pertussis
caccaggccgcggcgc

SEQ ID NO: 394483 - RNA, 17 nt, Bordetella pertussis
caccaggccgcggcgcc

SEQ ID NO: 394484 - RNA, 13 nt, Bordetella pertussis
caccaggccggcc

SEQ ID NO: 394485 - RNA, 13 nt, Bordetella pertussis
caccaggcgcgcg

SEQ ID NO: 394486 - RNA, 16 nt, Bordetella pertussis
caccaggcgcgcgcca

SEQ ID NO: 394487 - RNA, 21 nt, Bordetella pertussis
caccaggcuuucgaagccgcc

SEQ ID NO: 394488 - RNA, 23 nt, Bordetella pertussis
caccaggcuuucgaagccgcccc

SEQ ID NO: 394489 - RNA, 14 nt, Bordetella pertussis
caccagggccagcu

SEQ ID NO: 394490 - RNA, 20 nt, Bordetella pertussis
caccagggcccggacgcggc

SEQ ID NO: 394491 - RNA, 12 nt, Bordetella pertussis
caccagggcgcc

SEQ ID NO: 394492 - RNA, 14 nt, Bordetella pertussis
caccagggcgcgca

SEQ ID NO: 394493 - RNA, 22 nt, Bordetella pertussis
caccagggcgcgcagcaggccc

SEQ ID NO: 394494 - RNA, 21 nt, Bordetella pertussis
caccaggguggcgggcgccug

SEQ ID NO: 394495 - RNA, 22 nt, Bordetella pertussis
caccaggguggcgggcgccugc

SEQ ID NO: 394496 - RNA, 23 nt, Bordetella pertussis
caccaggucgaacggauugcuga

SEQ ID NO: 394497 - RNA, 23 nt, Bordetella pertussis
caccaggucgcggugcgccacga

SEQ ID NO: 394498 - RNA, 21 nt, Bordetella pertussis
caccagguugcauccggcccg

SEQ ID NO: 394499 - RNA, 17 nt, Bordetella pertussis
caccaggucgucguagc

SEQ ID NO: 394500 - RNA, 19 nt, Bordetella pertussis
caccagguugucggcgcca

SEQ ID NO: 394501 - RNA, 14 nt, Bordetella pertussis
caccagucccgcac

SEQ ID NO: 394502 - RNA, 22 nt, Bordetella pertussis
caccagugcgccggcgcggcgg

SEQ ID NO: 394503 - RNA, 21 nt, Bordetella pertussis
caccagugcgccggcggcggu

SEQ ID NO: 394504 - RNA, 15 nt, Bordetella pertussis
caccaucagccagcc

SEQ ID NO: 394505 - RNA, 18 nt, Bordetella pertussis
caccauccugccccagga

SEQ ID NO: 394506 - RNA, 14 nt, Bordetella pertussis
caccaucgaugugg

SEQ ID NO: 394507 - RNA, 13 nt, Bordetella pertussis
caccaucgccgcc

SEQ ID NO: 394508 - RNA, 23 nt, Bordetella pertussis
caccaucguugccugggugcugg

SEQ ID NO: 394509 - RNA, 14 nt, Bordetella pertussis
caccaugcgcacca

SEQ ID NO: 394510 - RNA, 17 nt, Bordetella pertussis
caccaugcgcagcaaca

SEQ ID NO: 394511 - RNA, 22 nt, Bordetella pertussis
caccaugggcgucgucgccguc

SEQ ID NO: 394512 - RNA, 16 nt, Bordetella pertussis
caccaugggcucgugc

SEQ ID NO: 394513 - RNA, 14 nt, Bordetella pertussis
caccaugucccugg

SEQ ID NO: 394514 - RNA, 20 nt, Bordetella pertussis
caccaugucccuggccauuc

SEQ ID NO: 394515 - RNA, 23 nt, Bordetella pertussis
caccaugugcgagagcuccagcc

SEQ ID NO: 394516 - RNA, 17 nt, Bordetella pertussis
caccauucucgcccugc

SEQ ID NO: 394517 - RNA, 18 nt, Bordetella pertussis
caccauugccggcgcgca

SEQ ID NO: 394518 - RNA, 20 nt, Bordetella pertussis
cacccacacuuggccggcga

SEQ ID NO: 394519 - RNA, 15 nt, Bordetella pertussis
cacccagcggcuggc

SEQ ID NO: 394520 - RNA, 22 nt, Bordetella pertussis
cacccaggcccaguugacgaug

SEQ ID NO: 394521 - RNA, 12 nt, Bordetella pertussis
caccccaccacg

SEQ ID NO: 394522 - RNA, 14 nt, Bordetella pertussis
cacccccagcagca

SEQ ID NO: 394523 - RNA, 20 nt, Bordetella pertussis
cacccccagggcgcgccgga

SEQ ID NO: 394524 - RNA, 21 nt, Bordetella pertussis
cacccccgaccgagccacacc

SEQ ID NO: 394525 - RNA, 20 nt, Bordetella pertussis
caccccgagauaggcggcca

SEQ ID NO: 394526 - RNA, 20 nt, Bordetella pertussis
caccccgcccggcggcgcgc

SEQ ID NO: 394527 - RNA, 14 nt, Bordetella pertussis
caccccgcccugcc

SEQ ID NO: 394528 - RNA, 19 nt, Bordetella pertussis
caccccggccgacggcaag

SEQ ID NO: 394529 - RNA, 15 nt, Bordetella pertussis
caccccggcgccgcg

SEQ ID NO: 394530 - RNA, 16 nt, Bordetella pertussis
caccccggucagcagg

SEQ ID NO: 394531 - RNA, 20 nt, Bordetella pertussis
cacccgauacgacacgccgc

SEQ ID NO: 394532 - RNA, 23 nt, Bordetella pertussis
cacccgaugacggggcggcgccu

SEQ ID NO: 394533 - RNA, 22 nt, Bordetella pertussis
cacccgcaaaccugaugccugu

SEQ ID NO: 394534 - RNA, 15 nt, Bordetella pertussis
cacccgcacgccggc

SEQ ID NO: 394535 - RNA, 24 nt, Bordetella pertussis
cacccgcacgccggccugcgccag

SEQ ID NO: 394536 - RNA, 16 nt, Bordetella pertussis
cacccgcgcgcagcgu

SEQ ID NO: 394537 - RNA, 12 nt, Bordetella pertussis
cacccgcggcca

SEQ ID NO: 394538 - RNA, 18 nt, Bordetella pertussis
cacccgguauccgcgcau

SEQ ID NO: 394539 - RNA, 20 nt, Bordetella pertussis
cacccugccccaucccaucc

SEQ ID NO: 394540 - RNA, 14 nt, Bordetella pertussis
cacccuugccgcgg

SEQ ID NO: 394541 - RNA, 16 nt, Bordetella pertussis
caccgaacccugccuc

SEQ ID NO: 394542 - RNA, 14 nt, Bordetella pertussis
caccgaagcauccc

SEQ ID NO: 394543 - RNA, 15 nt, Bordetella pertussis
caccgacacgcuggc

SEQ ID NO: 394544 - RNA, 19 nt, Bordetella pertussis
caccgacaggaugggcgcu

SEQ ID NO: 394545 - RNA, 19 nt, Bordetella pertussis
caccgacaggccgaugcug

SEQ ID NO: 394546 - RNA, 13 nt, Bordetella pertussis
caccgacaugacc

SEQ ID NO: 394547 - RNA, 23 nt, Bordetella pertussis
caccgauccgaugaugcccagga

SEQ ID NO: 394548 - RNA, 17 nt, Bordetella pertussis
caccgcaggugccuguc

SEQ ID NO: 394549 - RNA, 19 nt, Bordetella pertussis
caccgcaggugccuguccc

SEQ ID NO: 394550 - RNA, 22 nt, Bordetella pertussis
caccgcaggugccuguccccac

SEQ ID NO: 394551 - RNA, 23 nt, Bordetella pertussis
caccgcaugggccaggcgcucca

SEQ ID NO: 394552 - RNA, 16 nt, Bordetella pertussis
caccgcauggggcgag

SEQ ID NO: 394553 - RNA, 22 nt, Bordetella pertussis
caccgccacgcgguccagcccc

SEQ ID NO: 394554 - RNA, 19 nt, Bordetella pertussis
caccgccauggcggccgcc

SEQ ID NO: 394555 - RNA, 15 nt, Bordetella pertussis
caccgcccagaaugc

SEQ ID NO: 394556 - RNA, 18 nt, Bordetella pertussis
caccgcccccgccgccau

SEQ ID NO: 394557 - RNA, 13 nt, Bordetella pertussis
caccgccccgacc

SEQ ID NO: 394558 - RNA, 15 nt, Bordetella pertussis
caccgccccgacccu

SEQ ID NO: 394559 - RNA, 19 nt, Bordetella pertussis
caccgccgauaccacgcgc

SEQ ID NO: 394560 - RNA, 17 nt, Bordetella pertussis
caccgccgaugccgcca

SEQ ID NO: 394561 - RNA, 15 nt, Bordetella pertussis
caccgccgcccgcca

SEQ ID NO: 394562 - RNA, 16 nt, Bordetella pertussis
caccgccgccgcgccg

SEQ ID NO: 394563 - RNA, 16 nt, Bordetella pertussis
caccgccgcgccgccc

SEQ ID NO: 394564 - RNA, 13 nt, Bordetella pertussis
caccgccggcggc

SEQ ID NO: 394565 - RNA, 23 nt, Bordetella pertussis
caccgccucgaugucaucgcccu

SEQ ID NO: 394566 - RNA, 19 nt, Bordetella pertussis
caccgccugugccagcugg

SEQ ID NO: 394567 - RNA, 19 nt, Bordetella pertussis
caccgcgaaccaggccugc

SEQ ID NO: 394568 - RNA, 20 nt, Bordetella pertussis
caccgcgaccaugcggccgu

SEQ ID NO: 394569 - RNA, 16 nt, Bordetella pertussis
caccgcgccagcgccg

SEQ ID NO: 394570 - RNA, 12 nt, Bordetella pertussis
caccgcgccgcc

SEQ ID NO: 394571 - RNA, 13 nt, Bordetella pertussis
caccgcgccgccc

SEQ ID NO: 394572 - RNA, 14 nt, Bordetella pertussis
caccgcggccuugc

SEQ ID NO: 394573 - RNA, 21 nt, Bordetella pertussis
caccgcggcggaccacacgau

SEQ ID NO: 394574 - RNA, 19 nt, Bordetella pertussis
caccgcggugccgcgcgcg

SEQ ID NO: 394575 - RNA, 21 nt, Bordetella pertussis
caccgcggugccgcgcgcggc

SEQ ID NO: 394576 - RNA, 22 nt, Bordetella pertussis
caccgcuucuucgucgcgccag

SEQ ID NO: 394577 - RNA, 19 nt, Bordetella pertussis
caccggauccugcggcgcg

SEQ ID NO: 394578 - RNA, 22 nt, Bordetella pertussis
caccggcaagccuugcggcccu

SEQ ID NO: 394579 - RNA, 15 nt, Bordetella pertussis
caccggcaaggccgc

SEQ ID NO: 394580 - RNA, 15 nt, Bordetella pertussis
caccggcacgcgcca

SEQ ID NO: 394581 - RNA, 21 nt, Bordetella pertussis
caccggcacgacggccuccgc

SEQ ID NO: 394582 - RNA, 23 nt, Bordetella pertussis
caccggcaggccgcgcugccagc

SEQ ID NO: 394583 - RNA, 13 nt, Bordetella pertussis
caccggccccauc

SEQ ID NO: 394584 - RNA, 14 nt, Bordetella pertussis
caccggccccauca

SEQ ID NO: 394585 - RNA, 15 nt, Bordetella pertussis
caccggcccgaagau

SEQ ID NO: 394586 - RNA, 18 nt, Bordetella pertussis
caccggccgacccgcggc

SEQ ID NO: 394587 - RNA, 13 nt, Bordetella pertussis
caccggcgcgccu

SEQ ID NO: 394588 - RNA, 18 nt, Bordetella pertussis
caccggcgcgcgcaugcc

SEQ ID NO: 394589 - RNA, 23 nt, Bordetella pertussis
caccggcgcgcgcaugcccgacc

SEQ ID NO: 394590 - RNA, 14 nt, Bordetella pertussis
caccggcgugcgcu

SEQ ID NO: 394591 - RNA, 13 nt, Bordetella pertussis
caccggcugccag

SEQ ID NO: 394592 - RNA, 19 nt, Bordetella pertussis
caccggcuuggggcgcgcc

SEQ ID NO: 394593 - RNA, 20 nt, Bordetella pertussis
caccggcuuggggcgcgccg

SEQ ID NO: 394594 - RNA, 16 nt, Bordetella pertussis
caccggcuugucgacc

SEQ ID NO: 394595 - RNA, 15 nt, Bordetella pertussis
caccgggacaggcac

SEQ ID NO: 394596 - RNA, 17 nt, Bordetella pertussis
caccgggacaggcaccc

SEQ ID NO: 394597 - RNA, 23 nt, Bordetella pertussis
caccgggccggccugcgucgcca

SEQ ID NO: 394598 - RNA, 20 nt, Bordetella pertussis
caccggguaauggcgcucca

SEQ ID NO: 394599 - RNA, 23 nt, Bordetella pertussis
caccggguaauggcgcuccagcc

SEQ ID NO: 394600 - RNA, 19 nt, Bordetella pertussis
caccgguugcagcgcgcca

SEQ ID NO: 394601 - RNA, 15 nt, Bordetella pertussis
caccgucccguagcg

SEQ ID NO: 394602 - RNA, 20 nt, Bordetella pertussis
caccgucgacuucgacccgg

SEQ ID NO: 394603 - RNA, 22 nt, Bordetella pertussis
caccgucgacuucgacccggac

SEQ ID NO: 394604 - RNA, 21 nt, Bordetella pertussis
caccgucucgaacgccgcguc

SEQ ID NO: 394605 - RNA, 17 nt, Bordetella pertussis
caccgucuugcccgcca

SEQ ID NO: 394606 - RNA, 24 nt, Bordetella pertussis
caccgucuugcccgccagcgcggc

SEQ ID NO: 394607 - RNA, 16 nt, Bordetella pertussis
caccgugaccugcguc

SEQ ID NO: 394608 - RNA, 22 nt, Bordetella pertussis
caccgugauauagaccagcagc

SEQ ID NO: 394609 - RNA, 23 nt, Bordetella pertussis
caccgugauauagaccagcagcu

SEQ ID NO: 394610 - RNA, 17 nt, Bordetella pertussis
caccgugaugcgcgccg

SEQ ID NO: 394611 - RNA, 20 nt, Bordetella pertussis
caccgugaugcgcgccgcuc

SEQ ID NO: 394612 - RNA, 16 nt, Bordetella pertussis
caccgugaugggcgca

SEQ ID NO: 394613 - RNA, 18 nt, Bordetella pertussis
caccgugaugucgccguc

SEQ ID NO: 394614 - RNA, 23 nt, Bordetella pertussis
caccgugaugucgccgucggcau

SEQ ID NO: 394615 - RNA, 13 nt, Bordetella pertussis
caccguucuuccg

SEQ ID NO: 394616 - RNA, 23 nt, Bordetella pertussis
caccucgcuugcccgugccuugc

SEQ ID NO: 394617 - RNA, 22 nt, Bordetella pertussis
caccucggcgcccagcugcuuc

SEQ ID NO: 394618 - RNA, 19 nt, Bordetella pertussis
caccucggcgccgcggcgc

SEQ ID NO: 394619 - RNA, 21 nt, Bordetella pertussis
caccucggggugcagcuucuu

SEQ ID NO: 394620 - RNA, 15 nt, Bordetella pertussis
caccucguaaguggc

SEQ ID NO: 394621 - RNA, 15 nt, Bordetella pertussis
caccugaacaccggc

SEQ ID NO: 394622 - RNA, 19 nt, Bordetella pertussis
caccugaacaccggcgcgc

SEQ ID NO: 394623 - RNA, 21 nt, Bordetella pertussis
caccugcaccgaagcauccca

SEQ ID NO: 394624 - RNA, 15 nt, Bordetella pertussis
caccugcaccgccgc

SEQ ID NO: 394625 - RNA, 15 nt, Bordetella pertussis
caccugcagccagau

SEQ ID NO: 394626 - RNA, 19 nt, Bordetella pertussis
caccugcaggcccaccggc

SEQ ID NO: 394627 - RNA, 18 nt, Bordetella pertussis
caccugcaggccgccggc

SEQ ID NO: 394628 - RNA, 14 nt, Bordetella pertussis
caccugcaggguca

SEQ ID NO: 394629 - RNA, 17 nt, Bordetella pertussis
caccugcagggucagcc

SEQ ID NO: 394630 - RNA, 18 nt, Bordetella pertussis
caccugccugccgccugc

SEQ ID NO: 394631 - RNA, 19 nt, Bordetella pertussis
caccugcguggccucuugc

SEQ ID NO: 394632 - RNA, 20 nt, Bordetella pertussis
caccugcugcuugaccuugg

SEQ ID NO: 394633 - RNA, 21 nt, Bordetella pertussis
caccuggccacaagcggcccc

SEQ ID NO: 394634 - RNA, 15 nt, Bordetella pertussis
caccuggcgcccggc

SEQ ID NO: 394635 - RNA, 21 nt, Bordetella pertussis
caccuggcugaacaggccuuc

SEQ ID NO: 394636 - RNA, 19 nt, Bordetella pertussis
caccugggccgccugcugg

SEQ ID NO: 394637 - RNA, 20 nt, Bordetella pertussis
caccuucagggcgccggcgu

SEQ ID NO: 394638 - RNA, 19 nt, Bordetella pertussis
caccuuccugcuggaccug

SEQ ID NO: 394639 - RNA, 16 nt, Bordetella pertussis
caccuugaccuggucg

SEQ ID NO: 394640 - RNA, 16 nt, Bordetella pertussis
caccuugaguugcggg

SEQ ID NO: 394641 - RNA, 15 nt, Bordetella pertussis
caccuuggcccggcg

SEQ ID NO: 394642 - RNA, 21 nt, Bordetella pertussis
caccuuguuggcgccggccgc

SEQ ID NO: 394643 - RNA, 19 nt, Bordetella pertussis
caccuuuccgaucagcugc

SEQ ID NO: 394644 - RNA, 13 nt, Bordetella pertussis
caccuuucugcug

SEQ ID NO: 394645 - RNA, 16 nt, Bordetella pertussis
caccuuucugcugcuc

SEQ ID NO: 394646 - RNA, 13 nt, Bordetella pertussis
cacgaacgccacg

SEQ ID NO: 394647 - RNA, 21 nt, Bordetella pertussis
cacgaaggcgaucugcggcgu

SEQ ID NO: 394648 - RNA, 16 nt, Bordetella pertussis
cacgaagggcagcagc

SEQ ID NO: 394649 - RNA, 13 nt, Bordetella pertussis
cacgaccaccagc

SEQ ID NO: 394650 - RNA, 14 nt, Bordetella pertussis
cacgaccaccagcg

SEQ ID NO: 394651 - RNA, 23 nt, Bordetella pertussis
cacgaccaccagcgcacugagaa

SEQ ID NO: 394652 - RNA, 17 nt, Bordetella pertussis
cacgaccagcaggccca

SEQ ID NO: 394653 - RNA, 19 nt, Bordetella pertussis
cacgaccugcaaccccacc

SEQ ID NO: 394654 - RNA, 22 nt, Bordetella pertussis
cacgaccugcaaccccaccggc

SEQ ID NO: 394655 - RNA, 23 nt, Bordetella pertussis
cacgaccugcaaccccaccggca

SEQ ID NO: 394656 - RNA, 16 nt, Bordetella pertussis
cacgacgaacaacacg

SEQ ID NO: 394657 - RNA, 18 nt, Bordetella pertussis
cacgacgcgaaccaggcc

SEQ ID NO: 394658 - RNA, 22 nt, Bordetella pertussis
cacgacgcgaaccaggccaccg

SEQ ID NO: 394659 - RNA, 19 nt, Bordetella pertussis
cacgacguagucggcgccc

SEQ ID NO: 394660 - RNA, 22 nt, Bordetella pertussis
cacgacgucguagugcgcgccg

SEQ ID NO: 394661 - RNA, 16 nt, Bordetella pertussis
cacgagaucgccuggg

SEQ ID NO: 394662 - RNA, 20 nt, Bordetella pertussis
cacgagaucgccuggggcag

SEQ ID NO: 394663 - RNA, 14 nt, Bordetella pertussis
cacgaggucuugcc

SEQ ID NO: 394664 - RNA, 15 nt, Bordetella pertussis
cacgaucagcgccca

SEQ ID NO: 394665 - RNA, 13 nt, Bordetella pertussis
cacgaucaccgcc

SEQ ID NO: 394666 - RNA, 17 nt, Bordetella pertussis
cacgaucaucaggauga

SEQ ID NO: 394667 - RNA, 19 nt, Bordetella pertussis
cacgaucauggucaugccc

SEQ ID NO: 394668 - RNA, 15 nt, Bordetella pertussis
cacgaucgcgccggc

SEQ ID NO: 394669 - RNA, 22 nt, Bordetella pertussis
cacgaucggcgccuggccgccc

SEQ ID NO: 394670 - RNA, 17 nt, Bordetella pertussis
cacgaucuggcgcgcga

SEQ ID NO: 394671 - RNA, 18 nt, Bordetella pertussis
cacgaugccgucgccgcc

SEQ ID NO: 394672 - RNA, 20 nt, Bordetella pertussis
cacgaugccgucgccgccca

SEQ ID NO: 394673 - RNA, 16 nt, Bordetella pertussis
cacgauggccgcgccc

SEQ ID NO: 394674 - RNA, 17 nt, Bordetella pertussis
cacgauggccgcgccca

SEQ ID NO: 394675 - RNA, 17 nt, Bordetella pertussis
cacgauggccggcgcga

SEQ ID NO: 394676 - RNA, 15 nt, Bordetella pertussis
cacgauggcgcgcga

SEQ ID NO: 394677 - RNA, 14 nt, Bordetella pertussis
cacgauugucgucg

SEQ ID NO: 394678 - RNA, 23 nt, Bordetella pertussis
cacgauuucggccaugugcgcca

SEQ ID NO: 394679 - RNA, 13 nt, Bordetella pertussis
cacgauuuuucgc

SEQ ID NO: 394680 - RNA, 14 nt, Bordetella pertussis
cacgcacagcaccu

SEQ ID NO: 394681 - RNA, 17 nt, Bordetella pertussis
cacgcacagcaugcgcu

SEQ ID NO: 394682 - RNA, 17 nt, Bordetella pertussis
cacgcacaugaugccca

SEQ ID NO: 394683 - RNA, 18 nt, Bordetella pertussis
cacgcaccgcgccagcgc

SEQ ID NO: 394684 - RNA, 23 nt, Bordetella pertussis
cacgcagaaauggaugcgcgccc

SEQ ID NO: 394685 - RNA, 20 nt, Bordetella pertussis
cacgccacuacacucugccc

SEQ ID NO: 394686 - RNA, 14 nt, Bordetella pertussis
cacgccacuggccu

SEQ ID NO: 394687 - RNA, 17 nt, Bordetella pertussis
cacgccagcggcgagca

SEQ ID NO: 394688 - RNA, 16 nt, Bordetella pertussis
cacgccauggucucgu

SEQ ID NO: 394689 - RNA, 15 nt, Bordetella pertussis
cacgcccagccgcag

SEQ ID NO: 394690 - RNA, 13 nt, Bordetella pertussis
cacgcccagcgcc

SEQ ID NO: 394691 - RNA, 16 nt, Bordetella pertussis
cacgcccagcgccggc

SEQ ID NO: 394692 - RNA, 13 nt, Bordetella pertussis
cacgcccaggccg

SEQ ID NO: 394693 - RNA, 14 nt, Bordetella pertussis
cacgcccaggccgu

SEQ ID NO: 394694 - RNA, 21 nt, Bordetella pertussis
cacgcccaucuaugaggaugg

SEQ ID NO: 394695 - RNA, 14 nt, Bordetella pertussis
cacgcccaucugcc

SEQ ID NO: 394696 - RNA, 14 nt, Bordetella pertussis
cacgcccgagaugg

SEQ ID NO: 394697 - RNA, 13 nt, Bordetella pertussis
cacgcccgccagc

SEQ ID NO: 394698 - RNA, 17 nt, Bordetella pertussis
cacgcccgccagcagcu

SEQ ID NO: 394699 - RNA, 15 nt, Bordetella pertussis
cacgcccgcgcgcga

SEQ ID NO: 394700 - RNA, 12 nt, Bordetella pertussis
cacgcccgccuu

SEQ ID NO: 394701 - RNA, 20 nt, Bordetella pertussis
cacgcccgucucgcgcgcca

SEQ ID NO: 394702 - RNA, 13 nt, Bordetella pertussis
cacgcccuggcug

SEQ ID NO: 394703 - RNA, 22 nt, Bordetella pertussis
cacgcccuguugcuucaacucc

SEQ ID NO: 394704 - RNA, 18 nt, Bordetella pertussis
cacgccgaccuggcgccc

SEQ ID NO: 394705 - RNA, 22 nt, Bordetella pertussis
cacgccgaucgcgcacagcaug

SEQ ID NO: 394706 - RNA, 20 nt, Bordetella pertussis
cacgccgaugaacgacaggg

SEQ ID NO: 394707 - RNA, 18 nt, Bordetella pertussis
cacgccgaugccgcgcac

SEQ ID NO: 394708 - RNA, 22 nt, Bordetella pertussis
cacgccgauugaggccagcacg

SEQ ID NO: 394709 - RNA, 20 nt, Bordetella pertussis
cacgccggccugcgccagcu

SEQ ID NO: 394710 - RNA, 22 nt, Bordetella pertussis
cacgccgggcgcgcugcccagc

SEQ ID NO: 394711 - RNA, 23 nt, Bordetella pertussis
cacgccgucgagcugcucgagca

SEQ ID NO: 394712 - RNA, 17 nt, Bordetella pertussis
cacgccucgccggcccu

SEQ ID NO: 394713 - RNA, 17 nt, Bordetella pertussis
cacgccuggccgcgcuc

SEQ ID NO: 394714 - RNA, 22 nt, Bordetella pertussis
cacgccuggccgcgcucagccu

SEQ ID NO: 394715 - RNA, 22 nt, Bordetella pertussis
cacgccuucgagcugcacccac

SEQ ID NO: 394716 - RNA, 16 nt, Bordetella pertussis
cacgcgagcccgcguc

SEQ ID NO: 394717 - RNA, 17 nt, Bordetella pertussis
cacgcgcaacgccgcca

SEQ ID NO: 394718 - RNA, 18 nt, Bordetella pertussis
cacgcgcaacgccgccac

SEQ ID NO: 394719 - RNA, 14 nt, Bordetella pertussis
cacgcgcaccaggc

SEQ ID NO: 394720 - RNA, 15 nt, Bordetella pertussis
cacgcgcaccaggcc

SEQ ID NO: 394721 - RNA, 18 nt, Bordetella pertussis
cacgcgccagcugaccuc

SEQ ID NO: 394722 - RNA, 19 nt, Bordetella pertussis
cacgcgccgccaggcgcga

SEQ ID NO: 394723 - RNA, 18 nt, Bordetella pertussis
cacgcgcgauccgcgcca

SEQ ID NO: 394724 - RNA, 13 nt, Bordetella pertussis
cacgcgcgcgccg

SEQ ID NO: 394725 - RNA, 14 nt, Bordetella pertussis
cacgcgcgcggcgc

SEQ ID NO: 394726 - RNA, 15 nt, Bordetella pertussis
cacgcgcgcggcgcg

SEQ ID NO: 394727 - RNA, 18 nt, Bordetella pertussis
cacgcgcgcgggcgcgcc

SEQ ID NO: 394728 - RNA, 22 nt, Bordetella pertussis
cacgcgcgcuggcgcccggccu

SEQ ID NO: 394729 - RNA, 23 nt, Bordetella pertussis
cacgcgcuccggcugcgcgcgca

SEQ ID NO: 394730 - RNA, 16 nt, Bordetella pertussis
cacgcgcugcgcgccg

SEQ ID NO: 394731 - RNA, 22 nt, Bordetella pertussis
cacgcgcugggcguggcgcgcg

SEQ ID NO: 394732 - RNA, 20 nt, Bordetella pertussis
cacgcgcuugaggcugguga

SEQ ID NO: 394733 - RNA, 17 nt, Bordetella pertussis
cacgcgcuugcgcgcca

SEQ ID NO: 394734 - RNA, 21 nt, Bordetella pertussis
cacgcgcuugcgcgccacguc

SEQ ID NO: 394735 - RNA, 14 nt, Bordetella pertussis
cacgcggcgcggca

SEQ ID NO: 394736 - RNA, 21 nt, Bordetella pertussis
cacgcggcgcugcuggccggc

SEQ ID NO: 394737 - RNA, 14 nt, Bordetella pertussis
cacgcgggccggcc

SEQ ID NO: 394738 - RNA, 17 nt, Bordetella pertussis
cacgcgguagguagcgc

SEQ ID NO: 394739 - RNA, 21 nt, Bordetella pertussis
cacgcggucgaugcgcacgcc

SEQ ID NO: 394740 - RNA, 17 nt, Bordetella pertussis
cacgcguacggcccugg

SEQ ID NO: 394741 - RNA, 20 nt, Bordetella pertussis
cacgcguacggcccuggucu

SEQ ID NO: 394742 - RNA, 21 nt, Bordetella pertussis
cacgcucagcaugcgcugggc

SEQ ID NO: 394743 - RNA, 16 nt, Bordetella pertussis
cacgcucuugagcgcg

SEQ ID NO: 394744 - RNA, 19 nt, Bordetella pertussis
cacgcucuugagcgcggcc

SEQ ID NO: 394745 - RNA, 21 nt, Bordetella pertussis
cacgcugaucgccggcgcccc

SEQ ID NO: 394746 - RNA, 16 nt, Bordetella pertussis
cacgcugcccugcugc

SEQ ID NO: 394747 - RNA, 16 nt, Bordetella pertussis
cacgcugcgcggcggc

SEQ ID NO: 394748 - RNA, 17 nt, Bordetella pertussis
cacgcugcgcggcggcu

SEQ ID NO: 394749 - RNA, 17 nt, Bordetella pertussis
cacgcugcgcaggcgcg

SEQ ID NO: 394750 - RNA, 19 nt, Bordetella pertussis
cacgcugcgcaggcgcgcg

SEQ ID NO: 394751 - RNA, 23 nt, Bordetella pertussis
cacgcugcugauccucgccagcg

SEQ ID NO: 394752 - RNA, 12 nt, Bordetella pertussis
cacgcugcugcc

SEQ ID NO: 394753 - RNA, 16 nt, Bordetella pertussis
cacgcuggccgcgccc

SEQ ID NO: 394754 - RNA, 19 nt, Bordetella pertussis
cacgcugguggccaccagc

SEQ ID NO: 394755 - RNA, 22 nt, Bordetella pertussis
cacgcugguggccaccagcccc

SEQ ID NO: 394756 - RNA, 19 nt, Bordetella pertussis
cacgcuuugcgucuccacg

SEQ ID NO: 394757 - RNA, 23 nt, Bordetella pertussis
cacggaauggucaagcggcugcc

SEQ ID NO: 394758 - RNA, 19 nt, Bordetella pertussis
cacggcaggcgccugcccu

SEQ ID NO: 394759 - RNA, 14 nt, Bordetella pertussis
cacggccagcagca

SEQ ID NO: 394760 - RNA, 18 nt, Bordetella pertussis
cacggccagcagcacgau

SEQ ID NO: 394761 - RNA, 18 nt, Bordetella pertussis
cacggcccgccaggaagc

SEQ ID NO: 394762 - RNA, 18 nt, Bordetella pertussis
cacggccgccaccugggc

SEQ ID NO: 394763 - RNA, 14 nt, Bordetella pertussis
cacggccggccugc

SEQ ID NO: 394764 - RNA, 15 nt, Bordetella pertussis
cacggccugcccggg

SEQ ID NO: 394765 - RNA, 14 nt, Bordetella pertussis
cacggcgcgcgccu

SEQ ID NO: 394766 - RNA, 15 nt, Bordetella pertussis
cacggcgcgcgccug

SEQ ID NO: 394767 - RNA, 21 nt, Bordetella pertussis
cacggcgcgcgccugcucgac

SEQ ID NO: 394768 - RNA, 14 nt, Bordetella pertussis
cacggcgcggaugc

SEQ ID NO: 394769 - RNA, 16 nt, Bordetella pertussis
cacggcgcggcugccc

SEQ ID NO: 394770 - RNA, 23 nt, Bordetella pertussis
cacggcggaaugcggcgacaggg

SEQ ID NO: 394771 - RNA, 12 nt, Bordetella pertussis
cacggcggcggc

SEQ ID NO: 394772 - RNA, 12 nt, Bordetella pertussis
cacggcgggccg

SEQ ID NO: 394773 - RNA, 13 nt, Bordetella pertussis
cacggcgggccgg

SEQ ID NO: 394774 - RNA, 18 nt, Bordetella pertussis
cacggcguggcgcgcaca

SEQ ID NO: 394775 - RNA, 20 nt, Bordetella pertussis
cacggcguggcgcgcacacu

SEQ ID NO: 394776 - RNA, 19 nt, Bordetella pertussis
cacggcuucguucaagcgu

SEQ ID NO: 394777 - RNA, 18 nt, Bordetella pertussis
cacgggcgagggcugccc

SEQ ID NO: 394778 - RNA, 16 nt, Bordetella pertussis
cacgggcgccuguccc

SEQ ID NO: 394779 - RNA, 18 nt, Bordetella pertussis
cacgggcgcugcccagga

SEQ ID NO: 394780 - RNA, 13 nt, Bordetella pertussis
cacggggacaggc

SEQ ID NO: 394781 - RNA, 15 nt, Bordetella pertussis
cacggggacaggcac

SEQ ID NO: 394782 - RNA, 17 nt, Bordetella pertussis
cacggggacaggcaccu

SEQ ID NO: 394783 - RNA, 14 nt, Bordetella pertussis
cacggggacuggca

SEQ ID NO: 394784 - RNA, 15 nt, Bordetella pertussis
cacggggacuggcuc

SEQ ID NO: 394785 - RNA, 16 nt, Bordetella pertussis
cacggucaaccacgcc

SEQ ID NO: 394786 - RNA, 21 nt, Bordetella pertussis
cacggucagcaaccccagcag

SEQ ID NO: 394787 - RNA, 20 nt, Bordetella pertussis
cacggucgaagaucuucggc

SEQ ID NO: 394788 - RNA, 15 nt, Bordetella pertussis
cacggucggcgcgua

SEQ ID NO: 394789 - RNA, 16 nt, Bordetella pertussis
cacgguggacaggcuc

SEQ ID NO: 394790 - RNA, 16 nt, Bordetella pertussis
cacgguggcgccgucg

SEQ ID NO: 394791 - RNA, 14 nt, Bordetella pertussis
cacggugggcagca

SEQ ID NO: 394792 - RNA, 16 nt, Bordetella pertussis
cacggugggcagcagc

SEQ ID NO: 394793 - RNA, 21 nt, Bordetella pertussis
cacggugucgaugggcccggg

SEQ ID NO: 394794 - RNA, 18 nt, Bordetella pertussis
cacgguguugaccaccac

SEQ ID NO: 394795 - RNA, 14 nt, Bordetella pertussis
cacgguuuccaggu

SEQ ID NO: 394796 - RNA, 16 nt, Bordetella pertussis
cacguaguacagcagc

SEQ ID NO: 394797 - RNA, 18 nt, Bordetella pertussis
cacguccagcacggccgc

SEQ ID NO: 394798 - RNA, 14 nt, Bordetella pertussis
cacguccagcgccg

SEQ ID NO: 394799 - RNA, 16 nt, Bordetella pertussis
cacgugaugcaggcgg

SEQ ID NO: 394800 - RNA, 21 nt, Bordetella pertussis
cacgugccggccgccuccagg

SEQ ID NO: 394801 - RNA, 17 nt, Bordetella pertussis
cacguggacaggcaccu

SEQ ID NO: 394802 - RNA, 21 nt, Bordetella pertussis
cacgugguccacgaagcaggu

SEQ ID NO: 394803 - RNA, 18 nt, Bordetella pertussis
cacguucgaccugccgcc

SEQ ID NO: 394804 - RNA, 12 nt, Bordetella pertussis
cacuacaaugca

SEQ ID NO: 394805 - RNA, 18 nt, Bordetella pertussis
cacuccggauaccgccgc

SEQ ID NO: 394806 - RNA, 22 nt, Bordetella pertussis
cacuccggauaccgccgccgcu

SEQ ID NO: 394807 - RNA, 23 nt, Bordetella pertussis
cacucgaccgccgggacaggcac

SEQ ID NO: 394808 - RNA, 18 nt, Bordetella pertussis
cacugagaaaggccgcca

SEQ ID NO: 394809 - RNA, 19 nt, Bordetella pertussis
cacugagaaaggccgccac

SEQ ID NO: 394810 - RNA, 23 nt, Bordetella pertussis
cagcgggagccuguccccgcggg

SEQ ID NO: 394811 - RNA, 19 nt, Bordetella pertussis
cagcgggcccgucgcgcca

SEQ ID NO: 394812 - RNA, 13 nt, Bordetella pertussis
cagcgggcgcgcc

SEQ ID NO: 394813 - RNA, 20 nt, Bordetella pertussis
cagcggggccgugacgugcu

SEQ ID NO: 394814 - RNA, 14 nt, Bordetella pertussis
cagcggggacaggc

SEQ ID NO: 394815 - RNA, 20 nt, Bordetella pertussis
cagcggggacaggcaccccu

SEQ ID NO: 394816 - RNA, 15 nt, Bordetella pertussis
cagcguacgcacgcc

SEQ ID NO: 394817 - RNA, 17 nt, Bordetella pertussis
cagcgucaauccgccgc

SEQ ID NO: 394818 - RNA, 22 nt, Bordetella pertussis
cagcgucaugugcugcggcagc

SEQ ID NO: 394819 - RNA, 14 nt, Bordetella pertussis
cagcguccagccgc

SEQ ID NO: 394820 - RNA, 16 nt, Bordetella pertussis
cagcguccagccgccc

SEQ ID NO: 394821 - RNA, 13 nt, Bordetella pertussis
cagcguccaggcg

SEQ ID NO: 394822 - RNA, 13 nt, Bordetella pertussis
cagcgucccagcc

SEQ ID NO: 394823 - RNA, 14 nt, Bordetella pertussis
cagcgucccagcca

SEQ ID NO: 394824 - RNA, 14 nt, Bordetella pertussis
cagcgucgagcuga

SEQ ID NO: 394825 - RNA, 16 nt, Bordetella pertussis
cagcgucucgggcugg

SEQ ID NO: 394826 - RNA, 22 nt, Bordetella pertussis
cagcgucugcugguacagcccc

SEQ ID NO: 394827 - RNA, 14 nt, Bordetella pertussis
cagcgucuggcacg

SEQ ID NO: 394828 - RNA, 21 nt, Bordetella pertussis
cagcgugaccgacaggccugg

SEQ ID NO: 394829 - RNA, 23 nt, Bordetella pertussis
cagcgugacggcggcgcgcggau

SEQ ID NO: 394830 - RNA, 23 nt, Bordetella pertussis
cagcgugauggggccgggcgcca

SEQ ID NO: 394831 - RNA, 13 nt, Bordetella pertussis
cagcgugcccagc

SEQ ID NO: 394832 - RNA, 14 nt, Bordetella pertussis
cagcgugcccagcg

SEQ ID NO: 394833 - RNA, 13 nt, Bordetella pertussis
cagcgugcgcccc

SEQ ID NO: 394834 - RNA, 14 nt, Bordetella pertussis
cagcgugcgccccg

SEQ ID NO: 394835 - RNA, 23 nt, Bordetella pertussis
cagcguggccaccaggcgcgcgc

SEQ ID NO: 394836 - RNA, 21 nt, Bordetella pertussis
cagcguggccgccaccagcgc

SEQ ID NO: 394837 - RNA, 18 nt, Bordetella pertussis
cagcguggggacgcgggc

SEQ ID NO: 394838 - RNA, 17 nt, Bordetella pertussis
cagcguguagagcaggc

SEQ ID NO: 394839 - RNA, 22 nt, Bordetella pertussis
cagcguguagagcaggccgccc

SEQ ID NO: 394840 - RNA, 17 nt, Bordetella pertussis
cagcgugucgccgaccc

SEQ ID NO: 394841 - RNA, 21 nt, Bordetella pertussis
cagcguucggccacccggccc

SEQ ID NO: 394842 - RNA, 21 nt, Bordetella pertussis
cagcguuuccagggcgcgccg

SEQ ID NO: 394843 - RNA, 23 nt, Bordetella pertussis
cagcguuuccagggcgcgccgca

SEQ ID NO: 394844 - RNA, 13 nt, Bordetella pertussis
cagcucagcagcg

SEQ ID NO: 394845 - RNA, 16 nt, Bordetella pertussis
cagcucagcagcgcca

SEQ ID NO: 394846 - RNA, 18 nt, Bordetella pertussis
cagcucagcagcgccagg

SEQ ID NO: 394847 - RNA, 19 nt, Bordetella pertussis
cagcucagcagcgccaggg

SEQ ID NO: 394848 - RNA, 20 nt, Bordetella pertussis
cagcucagcagcgccagggc

SEQ ID NO: 394849 - RNA, 20 nt, Bordetella pertussis
cagcucgaccacggcggcuu

SEQ ID NO: 394850 - RNA, 20 nt, Bordetella pertussis
cagcucuucgagcgcggcgc

SEQ ID NO: 394851 - RNA, 19 nt, Bordetella pertussis
cagcugaccucgcccaggc

SEQ ID NO: 394852 - RNA, 15 nt, Bordetella pertussis
cagcugcaguaugca

SEQ ID NO: 394853 - RNA, 23 nt, Bordetella pertussis
cagcugccugagcaccgccgcgu

SEQ ID NO: 394854 - RNA, 14 nt, Bordetella pertussis
cagcugcgccagcc

SEQ ID NO: 394855 - RNA, 18 nt, Bordetella pertussis
cagcugcgcccccucuuc

SEQ ID NO: 394856 - RNA, 18 nt, Bordetella pertussis
cagcugcgcgucgacagc

SEQ ID NO: 394857 - RNA, 16 nt, Bordetella pertussis
cagcugcggccccggc

SEQ ID NO: 394858 - RNA, 23 nt, Bordetella pertussis
cagcugcguggcgacgcgcugcc

SEQ ID NO: 394859 - RNA, 14 nt, Bordetella pertussis
cagcuggcgccccu

SEQ ID NO: 394860 - RNA, 23 nt, Bordetella pertussis
cagcuggcgccccuuccacccgc

SEQ ID NO: 394861 - RNA, 21 nt, Bordetella pertussis
cagcuggcggcgcagcaccag

SEQ ID NO: 394862 - RNA, 14 nt, Bordetella pertussis
cagcugggaggcgu

SEQ ID NO: 394863 - RNA, 23 nt, Bordetella pertussis
cagcugggccaguucggcuugca

SEQ ID NO: 394864 - RNA, 14 nt, Bordetella pertussis
cagcugggcggcgu

SEQ ID NO: 394865 - RNA, 23 nt, Bordetella pertussis
cagcuggugccgguugcgcgccg

SEQ ID NO: 394866 - RNA, 14 nt, Bordetella pertussis
cagcuucuaucugc

SEQ ID NO: 394867 - RNA, 17 nt, Bordetella pertussis
cagcuucugcgccugcu

SEQ ID NO: 394868 - RNA, 14 nt, Bordetella pertussis
cagcuugcgcgccc

SEQ ID NO: 394869 - RNA, 15 nt, Bordetella pertussis
cagcuugcgcgccgc

SEQ ID NO: 394870 - RNA, 22 nt, Bordetella pertussis
cagcuugcgcuggcgcgcggcc

SEQ ID NO: 394871 - RNA, 20 nt, Bordetella pertussis
cagcuugcgucccaccugca

SEQ ID NO: 394872 - RNA, 12 nt, Bordetella pertussis
cagcuuggccag

SEQ ID NO: 394873 - RNA, 14 nt, Bordetella pertussis
cagcuuggccaggc

SEQ ID NO: 394874 - RNA, 15 nt, Bordetella pertussis
cagcuuggccaggcu

SEQ ID NO: 394875 - RNA, 17 nt, Bordetella pertussis
cagcuuggccaggcugu

SEQ ID NO: 394876 - RNA, 19 nt, Bordetella pertussis
cagcuuggcguacggcugc

SEQ ID NO: 394877 - RNA, 21 nt, Bordetella pertussis
cagcuugggcauuucccagcc

SEQ ID NO: 394878 - RNA, 23 nt, Bordetella pertussis
cagcuugggcuugauggccagcg

SEQ ID NO: 394879 - RNA, 22 nt, Bordetella pertussis
cagcuugucgaucgccaccagc

SEQ ID NO: 394880 - RNA, 17 nt, Bordetella pertussis
caggaaagaggccaggc

SEQ ID NO: 394881 - RNA, 18 nt, Bordetella pertussis
caggaaagaggccaggcc

SEQ ID NO: 394882 - RNA, 19 nt, Bordetella pertussis
caggaaagaggccaggccc

SEQ ID NO: 394883 - RNA, 14 nt, Bordetella pertussis
caggaaagcgccgc

SEQ ID NO: 394884 - RNA, 14 nt, Bordetella pertussis
caggaacaccaccu

SEQ ID NO: 394885 - RNA, 18 nt, Bordetella pertussis
caggaacagccugcccuc

SEQ ID NO: 394886 - RNA, 23 nt, Bordetella pertussis
caggaacagccugcccucgggcg

SEQ ID NO: 394887 - RNA, 20 nt, Bordetella pertussis
caggaacauguucacgccca

SEQ ID NO: 394888 - RNA, 23 nt, Bordetella pertussis
caggaacauguucacgcccagga

SEQ ID NO: 394889 - RNA, 14 nt, Bordetella pertussis
caggaaccagcggc

SEQ ID NO: 394890 - RNA, 16 nt, Bordetella pertussis
caggaaccagcggcug

SEQ ID NO: 394891 - RNA, 14 nt, Bordetella pertussis
caggauccccagca

SEQ ID NO: 394892 - RNA, 17 nt, Bordetella pertussis
caggauccccagcacau

SEQ ID NO: 394893 - RNA, 20 nt, Bordetella pertussis
caggaugaacaucggcagcg

SEQ ID NO: 394894 - RNA, 17 nt, Bordetella pertussis
caggaugaugcagcaca

SEQ ID NO: 394895 - RNA, 13 nt, Bordetella pertussis
caggaugcccggg

SEQ ID NO: 394896 - RNA, 18 nt, Bordetella pertussis
caggaugcgcaccggcca

SEQ ID NO: 394897 - RNA, 20 nt, Bordetella pertussis
caggaugcgcaccggccagg

SEQ ID NO: 394898 - RNA, 23 nt, Bordetella pertussis
caggaugcgcaccggccaggggc

SEQ ID NO: 394899 - RNA, 15 nt, Bordetella pertussis
caggaugcgcauggg

SEQ ID NO: 394900 - RNA, 14 nt, Bordetella pertussis
caggaugcgcgaca

SEQ ID NO: 394901 - RNA, 14 nt, Bordetella pertussis
caggaugcgcggca

SEQ ID NO: 394902 - RNA, 21 nt, Bordetella pertussis
caggauggccacgaccaccag

SEQ ID NO: 394903 - RNA, 14 nt, Bordetella pertussis
caggauggccaugc

SEQ ID NO: 394904 - RNA, 17 nt, Bordetella pertussis
caggauggcgccagccc

SEQ ID NO: 394905 - RNA, 16 nt, Bordetella pertussis
caggaugggccguccg

SEQ ID NO: 394906 - RNA, 20 nt, Bordetella pertussis
caggaugggcgcggcgcgcg

SEQ ID NO: 394907 - RNA, 21 nt, Bordetella pertussis
caggauggggcgguggucauc

SEQ ID NO: 394908 - RNA, 20 nt, Bordetella pertussis
caggauuuccucgccguagg

SEQ ID NO: 394909 - RNA, 18 nt, Bordetella pertussis
caggcaaaggcccaggca

SEQ ID NO: 394910 - RNA, 21 nt, Bordetella pertussis
caggcaagcugcuggcgcgcc

SEQ ID NO: 394911 - RNA, 22 nt, Bordetella pertussis
caggcaagcugcuggcgcgcca

SEQ ID NO: 394912 - RNA, 22 nt, Bordetella pertussis
caggcaaugcgcaggcccgaca

SEQ ID NO: 394913 - RNA, 22 nt, Bordetella pertussis
caggcacacccuccuacgccau

SEQ ID NO: 394914 - RNA, 18 nt, Bordetella pertussis
caggcacaccgugccgca

SEQ ID NO: 394915 - RNA, 17 nt, Bordetella pertussis
caggcaccccagcaccc

SEQ ID NO: 394916 - RNA, 20 nt, Bordetella pertussis
caggcaccccggcgccgcgu

SEQ ID NO: 394917 - RNA, 24 nt, Bordetella pertussis
caggcaccccgucaugcgccauga

SEQ ID NO: 394918 - RNA, 20 nt, Bordetella pertussis
caggcacccgagggucaggu

SEQ ID NO: 394919 - RNA, 22 nt, Bordetella pertussis
caggcacccgauggucacacug

SEQ ID NO: 394920 - RNA, 16 nt, Bordetella pertussis
caggcacccgcgcgca

SEQ ID NO: 394921 - RNA, 20 nt, Bordetella pertussis
caggcacccgggguuagagu

SEQ ID NO: 394922 - RNA, 16 nt, Bordetella pertussis
caggcacccugcccca

SEQ ID NO: 394923 - RNA, 20 nt, Bordetella pertussis
caggcacccugccccauccc

SEQ ID NO: 394924 - RNA, 18 nt, Bordetella pertussis
caggcacccuugccgcgg

SEQ ID NO: 394925 - RNA, 19 nt, Bordetella pertussis
caggcaccgaacccugccu

SEQ ID NO: 394926 - RNA, 18 nt, Bordetella pertussis
caggcaccgaacgggcgu

SEQ ID NO: 394927 - RNA, 15 nt, Bordetella pertussis
caggcacaggaacag

SEQ ID NO: 394928 - RNA, 19 nt, Bordetella pertussis
caggcaccgaauacgucag

SEQ ID NO: 394929 - RNA, 16 nt, Bordetella pertussis
caggcaccugcgaccg

SEQ ID NO: 394930 - RNA, 21 nt, Bordetella pertussis
caggcacgccgggguuggagu

SEQ ID NO: 394931 - RNA, 22 nt, Bordetella pertussis
caggcacgcgccgacuucagac

SEQ ID NO: 394932 - RNA, 21 nt, Bordetella pertussis
caggcaucagguuugcgggug

SEQ ID NO: 394933 - RNA, 19 nt, Bordetella pertussis
caggcauucgugaugcccc

SEQ ID NO: 394934 - RNA, 17 nt, Bordetella pertussis
caggcauugcgccagcc

SEQ ID NO: 394935 - RNA, 22 nt, Bordetella pertussis
caggccaacgggauccggcagc

SEQ ID NO: 394936 - RNA, 22 nt, Bordetella pertussis
caggccaccgacggcgcggcga

SEQ ID NO: 394937 - RNA, 13 nt, Bordetella pertussis
caggccagcagcu

SEQ ID NO: 394938 - RNA, 13 nt, Bordetella pertussis
caggccaggaagc

SEQ ID NO: 394939 - RNA, 17 nt, Bordetella pertussis
caggccaggaagcggcg

SEQ ID NO: 394940 - RNA, 18 nt, Bordetella pertussis
caggccaggaagcggcgc

SEQ ID NO: 394941 - RNA, 14 nt, Bordetella pertussis
caggccaggcucag

SEQ ID NO: 394942 - RNA, 15 nt, Bordetella pertussis
caggccaggcucagc

SEQ ID NO: 394943 - RNA, 16 nt, Bordetella pertussis
caggccaggcucagca

SEQ ID NO: 394944 - RNA, 13 nt, Bordetella pertussis
caggccagcgccg

SEQ ID NO: 394945 - RNA, 15 nt, Bordetella pertussis
caggccagcgccgcg

SEQ ID NO: 394946 - RNA, 16 nt, Bordetella pertussis
caggccagugauggcc

SEQ ID NO: 394947 - RNA, 17 nt, Bordetella pertussis
caggccagugccuggac

SEQ ID NO: 394948 - RNA, 18 nt, Bordetella pertussis
caggccagugccuggacg

SEQ ID NO: 394949 - RNA, 16 nt, Bordetella pertussis
caggccaucggcgcca

SEQ ID NO: 394950 - RNA, 15 nt, Bordetella pertussis
caggccaugcugggc

SEQ ID NO: 394951 - RNA, 14 nt, Bordetella pertussis
caggcccaccaggg

SEQ ID NO: 394952 - RNA, 16 nt, Bordetella pertussis
caggcccaccagggcc

SEQ ID NO: 394953 - RNA, 17 nt, Bordetella pertussis
caggcccaccagggcca

SEQ ID NO: 394954 - RNA, 19 nt, Bordetella pertussis
caggcccacaaugccccac

SEQ ID NO: 394955 - RNA, 12 nt, Bordetella pertussis
caggcccaccag

SEQ ID NO: 394956 - RNA, 16 nt, Bordetella pertussis
caggcccaccggcaug

SEQ ID NO: 394957 - RNA, 11 nt, Bordetella pertussis
caggcccagca

SEQ ID NO: 394958 - RNA, 15 nt, Bordetella pertussis
caggcccagcacgcg

SEQ ID NO: 394959 - RNA, 22 nt, Bordetella pertussis
caggcccagcacgcgcgccagc

SEQ ID NO: 394960 - RNA, 13 nt, Bordetella pertussis
caggcccacgccg

SEQ ID NO: 394961 - RNA, 16 nt, Bordetella pertussis
caggcccacgccgcgu

SEQ ID NO: 394962 - RNA, 16 nt, Bordetella pertussis
caggcccagccagccc

SEQ ID NO: 394963 - RNA, 15 nt, Bordetella pertussis
caggcccagcccgcc

SEQ ID NO: 394964 - RNA, 14 nt, Bordetella pertussis
caggcccagcgcca

SEQ ID NO: 394965 - RNA, 16 nt, Bordetella pertussis
caggcccagcgccagc

SEQ ID NO: 394966 - RNA, 16 nt, Bordetella pertussis
caggcccagcgcgcca

SEQ ID NO: 394967 - RNA, 22 nt, Bordetella pertussis
caggcccagcuugaacaggcag

SEQ ID NO: 394968 - RNA, 14 nt, Bordetella pertussis
caggcccagggcca

SEQ ID NO: 394969 - RNA, 21 nt, Bordetella pertussis
caggcccagggcgaugcggua

SEQ ID NO: 394970 - RNA, 17 nt, Bordetella pertussis
caggcccaugccgcccg

SEQ ID NO: 394971 - RNA, 13 nt, Bordetella pertussis
caggcccauggcg

SEQ ID NO: 394972 - RNA, 14 nt, Bordetella pertussis
caggcccauggcgu

SEQ ID NO: 394973 - RNA, 22 nt, Bordetella pertussis
caggcccgaaacgcgcagcacc

SEQ ID NO: 394974 - RNA, 23 nt, Bordetella pertussis
caggcccgaaacgcgcagcaccg

SEQ ID NO: 394975 - RNA, 22 nt, Bordetella pertussis
caggccccgccgggccgcgccc

SEQ ID NO: 394976 - RNA, 22 nt, Bordetella pertussis
caggccccggcccggcgggccg

SEQ ID NO: 394977 - RNA, 22 nt, Bordetella pertussis
caggcccgcgcggccagcgccg

SEQ ID NO: 394978 - RNA, 15 nt, Bordetella pertussis
caggcccgcggccgc

SEQ ID NO: 394979 - RNA, 16 nt, Bordetella pertussis
caggcccgcggcgcca

SEQ ID NO: 394980 - RNA, 21 nt, Bordetella pertussis
caggcccgcggcgccagcgcu

SEQ ID NO: 394981 - RNA, 17 nt, Bordetella pertussis
caggcccgccagggcca

SEQ ID NO: 394982 - RNA, 15 nt, Bordetella pertussis
caggcccggcgcgca

SEQ ID NO: 394983 - RNA, 17 nt, Bordetella pertussis
caggcccgggcgccugc

SEQ ID NO: 394984 - RNA, 14 nt, Bordetella pertussis
caggcccuccggcg

SEQ ID NO: 394985 - RNA, 16 nt, Bordetella pertussis
caggcccugccgccuc

SEQ ID NO: 394986 - RNA, 20 nt, Bordetella pertussis
caggcccugccgccucagcg

SEQ ID NO: 394987 - RNA, 16 nt, Bordetella pertussis
caggcccuggcggcgc

SEQ ID NO: 394988 - RNA, 12 nt, Bordetella pertussis
caggcccugggc

SEQ ID NO: 394989 - RNA, 16 nt, Bordetella pertussis
caggcccugggccagc

SEQ ID NO: 394990 - RNA, 13 nt, Bordetella pertussis
caggcccuggggc

SEQ ID NO: 394991 - RNA, 16 nt, Bordetella pertussis
caggcccuugauggcc

SEQ ID NO: 394992 - RNA, 17 nt, Bordetella pertussis
caggccgaaccacagca

SEQ ID NO: 394993 - RNA, 15 nt, Bordetella pertussis
caggccgaacuggga

SEQ ID NO: 394994 - RNA, 22 nt, Bordetella pertussis
caggccgaacugggacaggccc

SEQ ID NO: 394995 - RNA, 23 nt, Bordetella pertussis
caggccgaaaccgggggaccuuc

SEQ ID NO: 394996 - RNA, 20 nt, Bordetella pertussis
caggccucggcuccgccauu

SEQ ID NO: 394997 - RNA, 16 nt, Bordetella pertussis
caggccugcggcgcca

SEQ ID NO: 394998 - RNA, 18 nt, Bordetella pertussis
caggccugcggcgccagc

SEQ ID NO: 394999 - RNA, 21 nt, Bordetella pertussis
caggccugcggcgccagcgcc

SEQ ID NO: 395000 - RNA, 23 nt, Bordetella pertussis
caggccugcggcgccagcgccgc

SEQ ID NO: 395001 - RNA, 21 nt, Bordetella pertussis
caggccugcgggugcgccugc

SEQ ID NO: 395002 - RNA, 15 nt, Bordetella pertussis
caggccugcugcagc

SEQ ID NO: 395003 - RNA, 14 nt, Bordetella pertussis
caggccugggaacg

SEQ ID NO: 395004 - RNA, 15 nt, Bordetella pertussis
caggcgaaacgccag

SEQ ID NO: 395005 - RNA, 20 nt, Bordetella pertussis
caggcgaauccgcaacccag

SEQ ID NO: 395006 - RNA, 20 nt, Bordetella pertussis
caggcgagcgccgcgcucca

SEQ ID NO: 395007 - RNA, 19 nt, Bordetella pertussis
caggcgaggcuggcgccca

SEQ ID NO: 395008 - RNA, 20 nt, Bordetella pertussis
caggcgaugcccagcgccgc

SEQ ID NO: 395009 - RNA, 14 nt, Bordetella pertussis
caggcgcaccagcg

SEQ ID NO: 395010 - RNA, 21 nt, Bordetella pertussis
caggcgcaccagcgcgccgau

SEQ ID NO: 395011 - RNA, 16 nt, Bordetella pertussis
caggcgcacggcggca

SEQ ID NO: 395012 - RNA, 15 nt, Bordetella pertussis
caggcgcagccgcgc

SEQ ID NO: 395013 - RNA, 18 nt, Bordetella pertussis
caggcgcucgaggcgcug

SEQ ID NO: 395014 - RNA, 13 nt, Bordetella pertussis
caggcgcucgccc

SEQ ID NO: 395015 - RNA, 16 nt, Bordetella pertussis
caggcgcucgcgcgcc

SEQ ID NO: 395016 - RNA, 17 nt, Bordetella pertussis
caggcgcucgcgcgcca

SEQ ID NO: 395017 - RNA, 22 nt, Bordetella pertussis
caggcgcucgcgcgccagcagu

SEQ ID NO: 395018 - RNA, 20 nt, Bordetella pertussis
caggcgcucgcgcugcagga

SEQ ID NO: 395019 - RNA, 20 nt, Bordetella pertussis
caggcgcucgcgggugcgca

SEQ ID NO: 395020 - RNA, 18 nt, Bordetella pertussis
caggcgcucggccagcga

SEQ ID NO: 395021 - RNA, 23 nt, Bordetella pertussis
caggcgcugguaaagggcgcgga

SEQ ID NO: 395022 - RNA, 22 nt, Bordetella pertussis
caggcgcugguaguaggccacu

SEQ ID NO: 395023 - RNA, 20 nt, Bordetella pertussis
caggcggcaggcgccgccgc

SEQ ID NO: 395024 - RNA, 13 nt, Bordetella pertussis
caggcggccaggg

SEQ ID NO: 395025 - RNA, 23 nt, Bordetella pertussis
caggcgguuggccuugacggcgc

SEQ ID NO: 395026 - RNA, 15 nt, Bordetella pertussis
caggcguccaggcug

SEQ ID NO: 395027 - RNA, 18 nt, Bordetella pertussis
caggcguccaggcugccg

SEQ ID NO: 395028 - RNA, 13 nt, Bordetella pertussis
caggcgucggcca

SEQ ID NO: 395029 - RNA, 15 nt, Bordetella pertussis
caggcgucggccagc

SEQ ID NO: 395030 - RNA, 17 nt, Bordetella pertussis
caggcgucggcggccca

SEQ ID NO: 395031 - RNA, 18 nt, Bordetella pertussis
caggcgucggcggcccac

SEQ ID NO: 395032 - RNA, 22 nt, Bordetella pertussis
caggcgucggcggcccacagcg

SEQ ID NO: 395033 - RNA, 22 nt, Bordetella pertussis
caggcugaucacccacagcagc

SEQ ID NO: 395034 - RNA, 19 nt, Bordetella pertussis
caggcugcccuggcccagg

SEQ ID NO: 395035 - RNA, 20 nt, Bordetella pertussis
caggcugcgcaggcgccgca

SEQ ID NO: 395036 - RNA, 14 nt, Bordetella pertussis
caggcugcgcgccg

SEQ ID NO: 395037 - RNA, 20 nt, Bordetella pertussis
caggcugcgcgccggcgccu

SEQ ID NO: 395038 - RNA, 13 nt, Bordetella pertussis
caggcuggacccg

SEQ ID NO: 395039 - RNA, 15 nt, Bordetella pertussis
caggcuggcauggaa

SEQ ID NO: 395040 - RNA, 14 nt, Bordetella pertussis
caggcugggagagc

SEQ ID NO: 395041 - RNA, 22 nt, Bordetella pertussis
caggcugggcgaaacggccagc

SEQ ID NO: 395042 - RNA, 17 nt, Bordetella pertussis
caggcugucgucgucgg

SEQ ID NO: 395043 - RNA, 20 nt, Bordetella pertussis
caggcugucgucgucggcac

SEQ ID NO: 395044 - RNA, 16 nt, Bordetella pertussis
caggcuguggccgcgg

SEQ ID NO: 395045 - RNA, 21 nt, Bordetella pertussis
caggcuguggccgcggcccag

SEQ ID NO: 395046 - RNA, 18 nt, Bordetella pertussis
caggcuuucgaagccgcc

SEQ ID NO: 395047 - RNA, 21 nt, Bordetella pertussis
caggcuuucgaagccgcccca

SEQ ID NO: 395048 - RNA, 22 nt, Bordetella pertussis
caggcuuucgcacagccggggc

SEQ ID NO: 395049 - RNA, 15 nt, Bordetella pertussis
caggcuuugcuggcc

SEQ ID NO: 395050 - RNA, 22 nt, Bordetella pertussis
caggcuuugcuggccauagggc

SEQ ID NO: 395051 - RNA, 16 nt, Bordetella pertussis
cagggaggaacugggc

SEQ ID NO: 395052 - RNA, 17 nt, Bordetella pertussis
cagggaggcuguccccg

SEQ ID NO: 395053 - RNA, 21 nt, Bordetella pertussis
cagguacacgcuuugcgucuc

SEQ ID NO: 395054 - RNA, 19 nt, Bordetella pertussis
cagguacaucauccccagc

SEQ ID NO: 395055 - RNA, 22 nt, Bordetella pertussis
cagguacccggcuucuggguca

SEQ ID NO: 395056 - RNA, 22 nt, Bordetella pertussis
cagguagaucagccgcugcagc

SEQ ID NO: 395057 - RNA, 17 nt, Bordetella pertussis
cagguagcggucgccgc

SEQ ID NO: 395058 - RNA, 18 nt, Bordetella pertussis
cagguagcggucgccgcg

SEQ ID NO: 395059 - RNA, 17 nt, Bordetella pertussis
cagguaggccggcgcga

SEQ ID NO: 395060 - RNA, 22 nt, Bordetella pertussis
cagguaggcgccgguccagcgc

SEQ ID NO: 395061 - RNA, 18 nt, Bordetella pertussis
cagguaggcggcgcgccc

SEQ ID NO: 395062 - RNA, 17 nt, Bordetella pertussis
cagguagucggucaccg

SEQ ID NO: 395063 - RNA, 23 nt, Bordetella pertussis
cagguagucgucgaaggcgcgcu

SEQ ID NO: 395064 - RNA, 15 nt, Bordetella pertussis
cagguaucgacccag

SEQ ID NO: 395065 - RNA, 23 nt, Bordetella pertussis
cagguauucgggaugggccaccc

SEQ ID NO: 395066 - RNA, 21 nt, Bordetella pertussis
cagguccacauccgcgcugcu

SEQ ID NO: 395067 - RNA, 21 nt, Bordetella pertussis
cagguccaugaacgccgcgcc

SEQ ID NO: 395068 - RNA, 22 nt, Bordetella pertussis
cagguccaugaacgccgcgccc

SEQ ID NO: 395069 - RNA, 12 nt, Bordetella pertussis
cagguccuggcg

SEQ ID NO: 395070 - RNA, 19 nt, Bordetella pertussis
cagguccuggcggccgccc

SEQ ID NO: 395071 - RNA, 17 nt, Bordetella pertussis
caggucgaacaggcugg

SEQ ID NO: 395072 - RNA, 21 nt, Bordetella pertussis
caggucgaacggauugcugau

SEQ ID NO: 395073 - RNA, 22 nt, Bordetella pertussis
caggucgaagcacugcaggcca

SEQ ID NO: 395074 - RNA, 15 nt, Bordetella pertussis
caggucgaccugcuu

SEQ ID NO: 395075 - RNA, 19 nt, Bordetella pertussis
caggucgaccugcuugccc

SEQ ID NO: 395076 - RNA, 22 nt, Bordetella pertussis
caggucgaccugcuugcccagc

SEQ ID NO: 395077 - RNA, 18 nt, Bordetella pertussis
caggucgagguccugcuc

SEQ ID NO: 395078 - RNA, 16 nt, Bordetella pertussis
caggucgaugcccucc

SEQ ID NO: 395079 - RNA, 19 nt, Bordetella pertussis
caggucgaugcccucccag

SEQ ID NO: 395080 - RNA, 13 nt, Bordetella pertussis
caggucgccagca

SEQ ID NO: 395081 - RNA, 21 nt, Bordetella pertussis
caggucgccagcaggcccugg

SEQ ID NO: 395082 - RNA, 20 nt, Bordetella pertussis
caggucgccguucuggcugc

SEQ ID NO: 395083 - RNA, 15 nt, Bordetella pertussis
caggucgcgcgacgu

SEQ ID NO: 395084 - RNA, 16 nt, Bordetella pertussis
caggucgcugcccagc

SEQ ID NO: 395085 - RNA, 13 nt, Bordetella pertussis
caggucggccagc

SEQ ID NO: 395086 - RNA, 14 nt, Bordetella pertussis
caggucggccagcg

SEQ ID NO: 395087 - RNA, 21 nt, Bordetella pertussis
caggucggccagcgugccggu

SEQ ID NO: 395088 - RNA, 15 nt, Bordetella pertussis
caggucggcgcggcc

SEQ ID NO: 395089 - RNA, 16 nt, Bordetella pertussis
caggucggcggccagc

SEQ ID NO: 395090 - RNA, 23 nt, Bordetella pertussis
caggucgggauaguccagcaccg

SEQ ID NO: 395091 - RNA, 23 nt, Bordetella pertussis
caggucgggcacgaucaccgccg

SEQ ID NO: 395092 - RNA, 18 nt, Bordetella pertussis
caggucgggcaggguggg

SEQ ID NO: 395093 - RNA, 14 nt, Bordetella pertussis
caggucggggcgcu

SEQ ID NO: 395094 - RNA, 14 nt, Bordetella pertussis
caggucggucgccu

SEQ ID NO: 395095 - RNA, 18 nt, Bordetella pertussis
caggucguagaccgccgc

SEQ ID NO: 395096 - RNA, 19 nt, Bordetella pertussis
caggucguagaccgccgcg

SEQ ID NO: 395097 - RNA, 20 nt, Bordetella pertussis
caggucgucgagccgggcca

SEQ ID NO: 395098 - RNA, 16 nt, Bordetella pertussis
caggucguggcccagc

SEQ ID NO: 395099 - RNA, 19 nt, Bordetella pertussis
caggucguggcccagccgg

SEQ ID NO: 395100 - RNA, 15 nt, Bordetella pertussis
caggucuucgggcgu

SEQ ID NO: 395101 - RNA, 16 nt, Bordetella pertussis
caggugaaacagcagc

SEQ ID NO: 395102 - RNA, 19 nt, Bordetella pertussis
caggugaugcgcgcggcca

SEQ ID NO: 395103 - RNA, 21 nt, Bordetella pertussis
caggugaugcgcgcggccagc

SEQ ID NO: 395104 - RNA, 20 nt, Bordetella pertussis
caggugcacagcgucccagc

SEQ ID NO: 395105 - RNA, 21 nt, Bordetella pertussis
caggugcagaaaccccagggg

SEQ ID NO: 395106 - RNA, 22 nt, Bordetella pertussis
caggugcaggguuggcgcgccg

SEQ ID NO: 395107 - RNA, 15 nt, Bordetella pertussis
caggugccagauauc

SEQ ID NO: 395108 - RNA, 14 nt, Bordetella pertussis
caggugccccacgc

SEQ ID NO: 395109 - RNA, 21 nt, Bordetella pertussis
caggugccccacgccgaugcc

SEQ ID NO: 395110 - RNA, 21 nt, Bordetella pertussis
cagguuagccagugccucagg

SEQ ID NO: 395111 - RNA, 19 nt, Bordetella pertussis
cagguucuggucgaacugg

SEQ ID NO: 395112 - RNA, 17 nt, Bordetella pertussis
cagguugaaggccgcga

SEQ ID NO: 395113 - RNA, 17 nt, Bordetella pertussis
cagguugagucuggaga

SEQ ID NO: 395114 - RNA, 22 nt, Bordetella pertussis
cagguugagucuggagaugggu

SEQ ID NO: 395115 - RNA, 16 nt, Bordetella pertussis
cagguugaucuucuuc

SEQ ID NO: 395116 - RNA, 21 nt, Bordetella pertussis
cagguugucgcgcgagaccag

SEQ ID NO: 395117 - RNA, 21 nt, Bordetella pertussis
cagguuuccuuggggucccac

SEQ ID NO: 395118 - RNA, 18 nt, Bordetella pertussis
cagguuuuccacagccag

SEQ ID NO: 395119 - RNA, 13 nt, Bordetella pertussis
caguacgaugccg

SEQ ID NO: 395120 - RNA, 13 nt, Bordetella pertussis
caguagcgccggc

SEQ ID NO: 395121 - RNA, 14 nt, Bordetella pertussis
caguaggcgcccca

SEQ ID NO: 395122 - RNA, 23 nt, Bordetella pertussis
caguaucucggcgcccgcggccu

SEQ ID NO: 395123 - RNA, 23 nt, Bordetella pertussis
caguaugggcugucgcaacagcc

SEQ ID NO: 395124 - RNA, 21 nt, Bordetella pertussis
cagucauggaucgacugcccc

SEQ ID NO: 395125 - RNA, 20 nt, Bordetella pertussis
caguccaaggaaagcccggc

SEQ ID NO: 395126 - RNA, 17 nt, Bordetella pertussis
caguccagcgcgccgcg

SEQ ID NO: 395127 - RNA, 17 nt, Bordetella pertussis
caguccagcgucggcgu

SEQ ID NO: 395128 - RNA, 14 nt, Bordetella pertussis
caguccaggguguc

SEQ ID NO: 395129 - RNA, 22 nt, Bordetella pertussis
cagucccaggaucaccgccgcg

SEQ ID NO: 395130 - RNA, 18 nt, Bordetella pertussis
caguccccaugcggggac

SEQ ID NO: 395131 - RNA, 22 nt, Bordetella pertussis
caguccccaugcggggacuggc

SEQ ID NO: 395132 - RNA, 16 nt, Bordetella pertussis
caguccccaugugggg

SEQ ID NO: 395133 - RNA, 15 nt, Bordetella pertussis
cagucccccgcgggg

SEQ ID NO: 395134 - RNA, 17 nt, Bordetella pertussis
caguccccgcagggaca

SEQ ID NO: 395135 - RNA, 20 nt, Bordetella pertussis
caguccccgcagggacaggc

SEQ ID NO: 395136 - RNA, 22 nt, Bordetella pertussis
caguccccugcggggacaggca

SEQ ID NO: 395137 - RNA, 23 nt, Bordetella pertussis
cagucccgcaccgaccagcgcgc

SEQ ID NO: 395138 - RNA, 20 nt, Bordetella pertussis
caguccgcagcgcagcgcca

SEQ ID NO: 395139 - RNA, 13 nt, Bordetella pertussis
caguccgcccagc

SEQ ID NO: 395140 - RNA, 18 nt, Bordetella pertussis
caguccgcccagccaggc

SEQ ID NO: 395141 - RNA, 16 nt, Bordetella pertussis
caguccggcagcaccc

SEQ ID NO: 395142 - RNA, 23 nt, Bordetella pertussis
caguccguaguugcgccccgcca

SEQ ID NO: 395143 - RNA, 17 nt, Bordetella pertussis
caguccguggcgcggcc

SEQ ID NO: 395144 - RNA, 20 nt, Bordetella pertussis
caguccguggcgcggccaau

SEQ ID NO: 395145 - RNA, 20 nt, Bordetella pertussis
caguccucaugcgggacagg

SEQ ID NO: 395146 - RNA, 15 nt, Bordetella pertussis
cagugcccugacccg

SEQ ID NO: 395147 - RNA, 17 nt, Bordetella pertussis
cagugcccugacccgcu

SEQ ID NO: 395148 - RNA, 22 nt, Bordetella pertussis
cagugcccugacccgcuggcug

SEQ ID NO: 395149 - RNA, 12 nt, Bordetella pertussis
cagugcgccggc

SEQ ID NO: 395150 - RNA, 17 nt, Bordetella pertussis
cagugguggugcagcgg

SEQ ID NO: 395151 - RNA, 16 nt, Bordetella pertussis
caguuccaccugcaug

SEQ ID NO: 395152 - RNA, 15 nt, Bordetella pertussis
caguuccacgcggcc

SEQ ID NO: 395153 - RNA, 17 nt, Bordetella pertussis
caguuccacgcggccgu

SEQ ID NO: 395154 - RNA, 20 nt, Bordetella pertussis
caguucgacaccuacauccu

SEQ ID NO: 395155 - RNA, 17 nt, Bordetella pertussis
caguucgccggcgccgu

SEQ ID NO: 395156 - RNA, 16 nt, Bordetella pertussis
caguucggccagcagc

SEQ ID NO: 395157 - RNA, 17 nt, Bordetella pertussis
caguucggccagcggca

SEQ ID NO: 395158 - RNA, 17 nt, Bordetella pertussis
caguucggccggcggcc

SEQ ID NO: 395159 - RNA, 15 nt, Bordetella pertussis
caguucggcgacgau

SEQ ID NO: 395160 - RNA, 23 nt, Bordetella pertussis
caguucggcgacgaucuccaccc

SEQ ID NO: 395161 - RNA, 15 nt, Bordetella pertussis
caguucggcgcgcgu

SEQ ID NO: 395162 - RNA, 20 nt, Bordetella pertussis
caguucgguuucccgaugcu

SEQ ID NO: 395163 - RNA, 22 nt, Bordetella pertussis
caguucgucccagggggucagg

SEQ ID NO: 395164 - RNA, 18 nt, Bordetella pertussis
caguucgugcaccagccc

SEQ ID NO: 395165 - RNA, 21 nt, Bordetella pertussis
caguuuccaucggggggcagg

SEQ ID NO: 395166 - RNA, 18 nt, Bordetella pertussis
cauagacccacagguugg

SEQ ID NO: 395167 - RNA, 19 nt, Bordetella pertussis
cauagcccaggccgccggc

SEQ ID NO: 395168 - RNA, 14 nt, Bordetella pertussis
cauagcgcuggaac

SEQ ID NO: 395169 - RNA, 21 nt, Bordetella pertussis
cauagcggccggcgcgcgcga

SEQ ID NO: 395170 - RNA, 14 nt, Bordetella pertussis
cauaggccagcgcc

SEQ ID NO: 395171 - RNA, 16 nt, Bordetella pertussis
cauaggcgcgcaccag

SEQ ID NO: 395172 - RNA, 18 nt, Bordetella pertussis
cauagguaucggcccgcg

SEQ ID NO: 395173 - RNA, 22 nt, Bordetella pertussis
caucaccaagggcgccgggcgg

SEQ ID NO: 395174 - RNA, 17 nt, Bordetella pertussis
caucaccaggguggcgg

SEQ ID NO: 395175 - RNA, 18 nt, Bordetella pertussis
caucagcgcgcccgcuuc

SEQ ID NO: 395176 - RNA, 13 nt, Bordetella pertussis
caucagcucgacc

SEQ ID NO: 395177 - RNA, 19 nt, Bordetella pertussis
caucagcuggaucugguga

SEQ ID NO: 395178 - RNA, 22 nt, Bordetella pertussis
caucagcuuggccaccacgccc

SEQ ID NO: 395179 - RNA, 13 nt, Bordetella pertussis
cauccagccgaug

SEQ ID NO: 395180 - RNA, 23 nt, Bordetella pertussis
cauccagcgcgcgaucgccagca

SEQ ID NO: 395181 - RNA, 11 nt, Bordetella pertussis
cauccagcggc

SEQ ID NO: 395182 - RNA, 20 nt, Bordetella pertussis
cauccaggccgugagcgccg

SEQ ID NO: 395183 - RNA, 22 nt, Bordetella pertussis
cauccagguggcggacaggccc

SEQ ID NO: 395184 - RNA, 19 nt, Bordetella pertussis
caucccaauuggccgcccu

SEQ ID NO: 395185 - RNA, 16 nt, Bordetella pertussis
cauccccagcgccgcc

SEQ ID NO: 395186 - RNA, 18 nt, Bordetella pertussis
caucccgacaugccgccc

SEQ ID NO: 395187 - RNA, 19 nt, Bordetella pertussis
caucccgacaugccgcccc

SEQ ID NO: 395188 - RNA, 19 nt, Bordetella pertussis
caucccggcgcucagcgcg

SEQ ID NO: 395189 - RNA, 12 nt, Bordetella pertussis
cauccggcccgg

SEQ ID NO: 395190 - RNA, 20 nt, Bordetella pertussis
cauccuggccgccgcgggcg

SEQ ID NO: 395191 - RNA, 17 nt, Bordetella pertussis
caucgaucagcgcgccg

SEQ ID NO: 395192 - RNA, 15 nt, Bordetella pertussis
caucgaugcgccgca

SEQ ID NO: 395193 - RNA, 19 nt, Bordetella pertussis
caucgaugcgccgcaccag

SEQ ID NO: 395194 - RNA, 19 nt, Bordetella pertussis
caucgauuucucgcugcug

SEQ ID NO: 395195 - RNA, 21 nt, Bordetella pertussis
caucgauuucucgcugcugac

SEQ ID NO: 395196 - RNA, 13 nt, Bordetella pertussis
caucgcccugcuc

SEQ ID NO: 395197 - RNA, 15 nt, Bordetella pertussis
caucgcccugcucga

SEQ ID NO: 395198 - RNA, 19 nt, Bordetella pertussis
caucgccgacgcgccgggc

SEQ ID NO: 395199 - RNA, 15 nt, Bordetella pertussis
caucgccgagccgcu

SEQ ID NO: 395200 - RNA, 16 nt, Bordetella pertussis
caucgccgccagcuug

SEQ ID NO: 395201 - RNA, 15 nt, Bordetella pertussis
caucggcacccagcc

SEQ ID NO: 395202 - RNA, 17 nt, Bordetella pertussis
caucggcacccagccgg

SEQ ID NO: 395203 - RNA, 20 nt, Bordetella pertussis
caucggcaggccggcgcgcg

SEQ ID NO: 395204 - RNA, 21 nt, Bordetella pertussis
caucguaguugggcgccuugc

SEQ ID NO: 395205 - RNA, 14 nt, Bordetella pertussis
caucgucaucacca

SEQ ID NO: 395206 - RNA, 19 nt, Bordetella pertussis
caucgucggcgccaugcug

SEQ ID NO: 395207 - RNA, 21 nt, Bordetella pertussis
caucgucggcgccaugcuggc

SEQ ID NO: 395208 - RNA, 22 nt, Bordetella pertussis
caucgucggcgccaugcuggcc

SEQ ID NO: 395209 - RNA, 13 nt, Bordetella pertussis
caucguggcugcc

SEQ ID NO: 395210 - RNA, 15 nt, Bordetella pertussis
caucguuacagcucc

SEQ ID NO: 395211 - RNA, 14 nt, Bordetella pertussis
caucguugccuggg

SEQ ID NO: 395212 - RNA, 18 nt, Bordetella pertussis
caucguugccugggugcu

SEQ ID NO: 395213 - RNA, 17 nt, Bordetella pertussis
caucuacagcgccuggc

SEQ ID NO: 395214 - RNA, 19 nt, Bordetella pertussis
caucucggcaucggccacg

SEQ ID NO: 395215 - RNA, 23 nt, Bordetella pertussis
caugaaaugcuggucgcgcaccu

SEQ ID NO: 395216 - RNA, 14 nt, Bordetella pertussis
caugaacgcuugac

SEQ ID NO: 395217 - RNA, 18 nt, Bordetella pertussis
caugaacgcuugacggcc

SEQ ID NO: 395218 - RNA, 15 nt, Bordetella pertussis
caugaagcgcagcag

SEQ ID NO: 395219 - RNA, 14 nt, Bordetella pertussis
caugaaggcggcca

SEQ ID NO: 395220 - RNA, 22 nt, Bordetella pertussis
caugaaggcggccagcaugcug

SEQ ID NO: 395221 - RNA, 17 nt, Bordetella pertussis
caugaauaugcgcccga

SEQ ID NO: 395222 - RNA, 16 nt, Bordetella pertussis
caugacaugcgggccu

SEQ ID NO: 395223 - RNA, 19 nt, Bordetella pertussis
caugaccgccgccagcagc

SEQ ID NO: 395224 - RNA, 20 nt, Bordetella pertussis
caugaccgccgccagcagcg

SEQ ID NO: 395225 - RNA, 22 nt, Bordetella pertussis
caugaccgccgccagcagcgcc

SEQ ID NO: 395226 - RNA, 20 nt, Bordetella pertussis
caugaccgccggcaccagcg

SEQ ID NO: 395227 - RNA, 14 nt, Bordetella pertussis
caugacggccagga

SEQ ID NO: 395228 - RNA, 17 nt, Bordetella pertussis
caugacggccaggaugg

SEQ ID NO: 395229 - RNA, 14 nt, Bordetella pertussis
caugacguccagcg

SEQ ID NO: 395230 - RNA, 20 nt, Bordetella pertussis
caugacguccagcgccacca

SEQ ID NO: 395231 - RNA, 17 nt, Bordetella pertussis
caugacguucuccagcg

SEQ ID NO: 395232 - RNA, 21 nt, Bordetella pertussis
caugaggaacggcaccagccg

SEQ ID NO: 395233 - RNA, 18 nt, Bordetella pertussis
caugaggccccuguccuc

SEQ ID NO: 395234 - RNA, 22 nt, Bordetella pertussis
caugaggcggcgguaccaggcc

SEQ ID NO: 395235 - RNA, 19 nt, Bordetella pertussis
caugaguucuggcaucagg

SEQ ID NO: 395236 - RNA, 16 nt, Bordetella pertussis
caugaucaggccgaac

SEQ ID NO: 395237 - RNA, 13 nt, Bordetella pertussis
caugaugcccagc

SEQ ID NO: 395238 - RNA, 17 nt, Bordetella pertussis
caugaugcgcugggcca

SEQ ID NO: 395239 - RNA, 18 nt, Bordetella pertussis
caugauggccgcgcgcag

SEQ ID NO: 395240 - RNA, 15 nt, Bordetella pertussis
caugauggugcugcc

SEQ ID NO: 395241 - RNA, 18 nt, Bordetella pertussis
caugauggugcugccgcu

SEQ ID NO: 395242 - RNA, 18 nt, Bordetella pertussis
caugauguagcccauguu

SEQ ID NO: 395243 - RNA, 17 nt, Bordetella pertussis
caugaugucgcgcgccu

SEQ ID NO: 395244 - RNA, 17 nt, Bordetella pertussis
caugaugucgcgggccc

SEQ ID NO: 395245 - RNA, 14 nt, Bordetella pertussis
caugauuccaccuu

SEQ ID NO: 395246 - RNA, 22 nt, Bordetella pertussis
caugauuuccaucgacuuggcc

SEQ ID NO: 395247 - RNA, 13 nt, Bordetella pertussis
caugcagguccug

SEQ ID NO: 395248 - RNA, 16 nt, Bordetella pertussis
caugccgcgcgccuua

SEQ ID NO: 395249 - RNA, 16 nt, Bordetella pertussis
caugccgcgcgcgcag

SEQ ID NO: 395250 - RNA, 15 nt, Bordetella pertussis
caugccggaacaggc

SEQ ID NO: 395251 - RNA, 15 nt, Bordetella pertussis
caugccggacaagcc

SEQ ID NO: 395252 - RNA, 21 nt, Bordetella pertussis
caugccggccaugcucagcag

SEQ ID NO: 395253 - RNA, 14 nt, Bordetella pertussis
caugcucagcagca

SEQ ID NO: 395254 - RNA, 20 nt, Bordetella pertussis
caugcucuggcacaccagcg

SEQ ID NO: 395255 - RNA, 19 nt, Bordetella pertussis
caugcugaauugcgggccg

SEQ ID NO: 395256 - RNA, 18 nt, Bordetella pertussis
caugcugcguaggcaggg

SEQ ID NO: 395257 - RNA, 18 nt, Bordetella pertussis
caugcuggcccagcuggg

SEQ ID NO: 395258 - RNA, 19 nt, Bordetella pertussis
caugcuggcccagcugggc

SEQ ID NO: 395259 - RNA, 12 nt, Bordetella pertussis
cauggcaugcac

SEQ ID NO: 395260 - RNA, 22 nt, Bordetella pertussis
cauggccaaugaccgacgccgu

SEQ ID NO: 395261 - RNA, 19 nt, Bordetella pertussis
cauggccaucgcgguccug

SEQ ID NO: 395262 - RNA, 14 nt, Bordetella pertussis
cauggcccggcucg

SEQ ID NO: 395263 - RNA, 14 nt, Bordetella pertussis
cauggccuggccca

SEQ ID NO: 395264 - RNA, 18 nt, Bordetella pertussis
cauggccuggcccagcuc

SEQ ID NO: 395265 - RNA, 12 nt, Bordetella pertussis
cauggcgccgcg

SEQ ID NO: 395266 - RNA, 14 nt, Bordetella pertussis
cauggcgccgcgcg

SEQ ID NO: 395267 - RNA, 14 nt, Bordetella pertussis
cauggcgcgcgcca

SEQ ID NO: 395268 - RNA, 23 nt, Bordetella pertussis
cauggcgcgcgccagcggcugcu

SEQ ID NO: 395269 - RNA, 14 nt, Bordetella pertussis
cauggcgcgcgccg

SEQ ID NO: 395270 - RNA, 18 nt, Bordetella pertussis
cauggcggccgccgccag

SEQ ID NO: 395271 - RNA, 19 nt, Bordetella pertussis
cauggcggcggccacgacc

SEQ ID NO: 395272 - RNA, 23 nt, Bordetella pertussis
cauggcgguggccagcgccugga

SEQ ID NO: 395273 - RNA, 18 nt, Bordetella pertussis
cauguaaaaacccggccu

SEQ ID NO: 395274 - RNA, 19 nt, Bordetella pertussis
cauguaaggcgcaugccac

SEQ ID NO: 395275 - RNA, 19 nt, Bordetella pertussis
cauguagaacgccaggguc

SEQ ID NO: 395276 - RNA, 20 nt, Bordetella pertussis
cauguagaacgccagggucu

SEQ ID NO: 395277 - RNA, 21 nt, Bordetella pertussis
cauguagaacgccagggucug

SEQ ID NO: 395278 - RNA, 17 nt, Bordetella pertussis
cauguacucggccaggc

SEQ ID NO: 395279 - RNA, 15 nt, Bordetella pertussis
cauguagcggccgcc

SEQ ID NO: 395280 - RNA, 12 nt, Bordetella pertussis
cauguaguucac

SEQ ID NO: 395281 - RNA, 20 nt, Bordetella pertussis
cauguauaacguggcgcgca

SEQ ID NO: 395282 - RNA, 16 nt, Bordetella pertussis
caugucacgacgucca

SEQ ID NO: 395283 - RNA, 23 nt, Bordetella pertussis
caugucacgacguccacgauguc

SEQ ID NO: 395284 - RNA, 14 nt, Bordetella pertussis
caugucagcgccug

SEQ ID NO: 395285 - RNA, 16 nt, Bordetella pertussis
caugucagcgccuggc

SEQ ID NO: 395286 - RNA, 20 nt, Bordetella pertussis
caugucagucguccuccgcg

SEQ ID NO: 395287 - RNA, 23 nt, Bordetella pertussis
cauguccaccagccggccgccga

SEQ ID NO: 395288 - RNA, 14 nt, Bordetella pertussis
cauguccagcgcca

SEQ ID NO: 395289 - RNA, 17 nt, Bordetella pertussis
cauguccagcgccaggc

SEQ ID NO: 395290 - RNA, 15 nt, Bordetella pertussis
caugucccagcgcuc

SEQ ID NO: 395291 - RNA, 15 nt, Bordetella pertussis
caugucccgaggcgc

SEQ ID NO: 395292 - RNA, 17 nt, Bordetella pertussis
caugucccgaggcgccc

SEQ ID NO: 395293 - RNA, 21 nt, Bordetella pertussis
cauguccagguagcgccucgc

SEQ ID NO: 395294 - RNA, 14 nt, Bordetella pertussis
cauguccgagucga

SEQ ID NO: 395295 - RNA, 15 nt, Bordetella pertussis
cauguccgccacgcc

SEQ ID NO: 395296 - RNA, 15 nt, Bordetella pertussis
cauguccgccaugcg

SEQ ID NO: 395297 - RNA, 20 nt, Bordetella pertussis
caugucgcgggugcgggcaa

SEQ ID NO: 395298 - RNA, 15 nt, Bordetella pertussis
cauguggggacaggc

SEQ ID NO: 395299 - RNA, 17 nt, Bordetella pertussis
cauguggggacaggcac

SEQ ID NO: 395300 - RNA, 17 nt, Bordetella pertussis
cauguucacgcccagga

SEQ ID NO: 395301 - RNA, 17 nt, Bordetella pertussis
cauuagggcccagcugc

SEQ ID NO: 395302 - RNA, 17 nt, Bordetella pertussis
cauucgauggcggcgcu

SEQ ID NO: 395303 - RNA, 20 nt, Bordetella pertussis
cauucggcgcgcucggcgcc

SEQ ID NO: 395304 - RNA, 17 nt, Bordetella pertussis
cauugaaacguacucca

SEQ ID NO: 395305 - RNA, 14 nt, Bordetella pertussis
cauugcaggguguc

SEQ ID NO: 395306 - RNA, 19 nt, Bordetella pertussis
cauugcagggugucggcca

SEQ ID NO: 395307 - RNA, 14 nt, Bordetella pertussis
cauugcccacagca

SEQ ID NO: 395308 - RNA, 13 nt, Bordetella pertussis
cauugcccagcac

SEQ ID NO: 395309 - RNA, 20 nt, Bordetella pertussis
cauugcccagcaccacgggc

SEQ ID NO: 395310 - RNA, 18 nt, Bordetella pertussis
cauugcggcaccugcugc

SEQ ID NO: 395311 - RNA, 23 nt, Bordetella pertussis
cauugcgggugggcauccagcgg

SEQ ID NO: 395312 - RNA, 15 nt, Bordetella pertussis
cauugcgguccagga

SEQ ID NO: 395313 - RNA, 20 nt, Bordetella pertussis
cauugcgguccaggaagcgc

SEQ ID NO: 395314 - RNA, 14 nt, Bordetella pertussis
cauuggcccugcug

SEQ ID NO: 395315 - RNA, 16 nt, Bordetella pertussis
cauuggccgccgccac

SEQ ID NO: 395316 - RNA, 13 nt, Bordetella pertussis
cauuggcgccgcg

SEQ ID NO: 395317 - RNA, 19 nt, Bordetella pertussis
cauuuccagaacggcuugg

SEQ ID NO: 395318 - RNA, 22 nt, Bordetella pertussis
cauuuccucgaccagcgcgcgg

SEQ ID NO: 395319 - RNA, 23 nt, Bordetella pertussis
cauuuccugggccucuagcucau

SEQ ID NO: 395320 - RNA, 22 nt, Bordetella pertussis
cauuucgaugcgcaccaugcgc

SEQ ID NO: 395321 - RNA, 19 nt, Bordetella pertussis
cauuucgcaaagaagcugc

SEQ ID NO: 395322 - RNA, 15 nt, Bordetella pertussis
cauuucggcgccgcc

SEQ ID NO: 395323 - RNA, 17 nt, Bordetella pertussis
ccaaaaggcagcaggcu

SEQ ID NO: 395324 - RNA, 16 nt, Bordetella pertussis
ccaacacgauccacgg

SEQ ID NO: 395325 - RNA, 13 nt, Bordetella pertussis
ccaaccccgaggg

SEQ ID NO: 395326 - RNA, 13 nt, Bordetella pertussis
ccaaccugaccgc

SEQ ID NO: 395327 - RNA, 17 nt, Bordetella pertussis
ccaacgcgaucucagcc

SEQ ID NO: 395328 - RNA, 21 nt, Bordetella pertussis
ccaacggugccagucccccug

SEQ ID NO: 395329 - RNA, 15 nt, Bordetella pertussis
ccaacgucggcagcc

SEQ ID NO: 395330 - RNA, 12 nt, Bordetella pertussis
ccaacugccugc

SEQ ID NO: 395331 - RNA, 16 nt, Bordetella pertussis
ccaacuuccguugguc

SEQ ID NO: 395332 - RNA, 14 nt, Bordetella pertussis
ccaagauggcccag

SEQ ID NO: 395333 - RNA, 19 nt, Bordetella pertussis
ccaagauggcccagggcag

SEQ ID NO: 395334 - RNA, 11 nt, Bordetella pertussis
ccaagcagggc

SEQ ID NO: 395335 - RNA, 13 nt, Bordetella pertussis
ccaagcagcgccu

SEQ ID NO: 395336 - RNA, 15 nt, Bordetella pertussis
ccaagcagcgccugc

SEQ ID NO: 395337 - RNA, 21 nt, Bordetella pertussis
ccaagcgccgcggccacgccc

SEQ ID NO: 395338 - RNA, 15 nt, Bordetella pertussis
ccaagcggcaggcgg

SEQ ID NO: 395339 - RNA, 23 nt, Bordetella pertussis
ccaaggccggcgcgucgcgcggc

SEQ ID NO: 395340 - RNA, 14 nt, Bordetella pertussis
ccaagggcgccgcg

SEQ ID NO: 395341 - RNA, 17 nt, Bordetella pertussis
ccaagggcgccgcgccg

SEQ ID NO: 395342 - RNA, 17 nt, Bordetella pertussis
ccaagggcgcgccagca

SEQ ID NO: 395343 - RNA, 22 nt, Bordetella pertussis
ccaauacccgccacagauuggc

SEQ ID NO: 395344 - RNA, 14 nt, Bordetella pertussis
ccaauacgccgcca

SEQ ID NO: 395345 - RNA, 16 nt, Bordetella pertussis
ccaauccgaucagcac

SEQ ID NO: 395346 - RNA, 15 nt, Bordetella pertussis
ccaaugccaggguga

SEQ ID NO: 395347 - RNA, 20 nt, Bordetella pertussis
ccaaugccuauuggcuguau

SEQ ID NO: 395348 - RNA, 16 nt, Bordetella pertussis
ccaauggccgcggcgu

SEQ ID NO: 395349 - RNA, 14 nt, Bordetella pertussis
ccaauucgagcagg

SEQ ID NO: 395350 - RNA, 18 nt, Bordetella pertussis
ccacaagcggccccaggu

SEQ ID NO: 395351 - RNA, 14 nt, Bordetella pertussis
ccacacgggcgccu

SEQ ID NO: 395352 - RNA, 13 nt, Bordetella pertussis
ccacagccacugc

SEQ ID NO: 395353 - RNA, 14 nt, Bordetella pertussis
ccacagccaggccg

SEQ ID NO: 395354 - RNA, 15 nt, Bordetella pertussis
ccacagcccggcccc

SEQ ID NO: 395355 - RNA, 16 nt, Bordetella pertussis
ccacagcccggccccc

SEQ ID NO: 395356 - RNA, 22 nt, Bordetella pertussis
ccacagcuggugccgguugcgc

SEQ ID NO: 395357 - RNA, 21 nt, Bordetella pertussis
ccacaggagacuggcagugcg

SEQ ID NO: 395358 - RNA, 23 nt, Bordetella pertussis
ccacaggccuucguugaccgcuu

SEQ ID NO: 395359 - RNA, 23 nt, Bordetella pertussis
ccacaggcgcgcggcguugcggc

SEQ ID NO: 395360 - RNA, 22 nt, Bordetella pertussis
ccacaggcugacgcccggcucg

SEQ ID NO: 395361 - RNA, 14 nt, Bordetella pertussis
ccacaggguggcgc

SEQ ID NO: 395362 - RNA, 16 nt, Bordetella pertussis
ccacaggguggcgccc

SEQ ID NO: 395363 - RNA, 17 nt, Bordetella pertussis
ccacaggguggcgccca

SEQ ID NO: 395364 - RNA, 17 nt, Bordetella pertussis
ccacagucggucgccgc

SEQ ID NO: 395365 - RNA, 18 nt, Bordetella pertussis
ccacaguucggccagcgg

SEQ ID NO: 395366 - RNA, 15 nt, Bordetella pertussis
ccacauagaccggcu

SEQ ID NO: 395367 - RNA, 12 nt, Bordetella pertussis
ccacaucaucga

SEQ ID NO: 395368 - RNA, 19 nt, Bordetella pertussis
ccacauccgcgcugcugcc

SEQ ID NO: 395369 - RNA, 15 nt, Bordetella pertussis
ccacaucgccggcgg

SEQ ID NO: 395370 - RNA, 14 nt, Bordetella pertussis
ccaccaccaggccg

SEQ ID NO: 395371 - RNA, 16 nt, Bordetella pertussis
ccaccaccaggccggc

SEQ ID NO: 395372 - RNA, 17 nt, Bordetella pertussis
ccaccaccucggccucg

SEQ ID NO: 395373 - RNA, 14 nt, Bordetella pertussis
ccaccacgccgccc

SEQ ID NO: 395374 - RNA, 18 nt, Bordetella pertussis
ccaccacgcgcaccagcu

SEQ ID NO: 395375 - RNA, 14 nt, Bordetella pertussis
ccaccacgcuggcu

SEQ ID NO: 395376 - RNA, 23 nt, Bordetella pertussis
ccaccacggcgggaucgggcagc

SEQ ID NO: 395377 - RNA, 11 nt, Bordetella pertussis
ccaccagcacc

SEQ ID NO: 395378 - RNA, 18 nt, Bordetella pertussis
ccaccagcaccggcagcg

SEQ ID NO: 395379 - RNA, 15 nt, Bordetella pertussis
ccaccagcaggaugg

SEQ ID NO: 395380 - RNA, 14 nt, Bordetella pertussis
ccaccagccggccg

SEQ ID NO: 395381 - RNA, 15 nt, Bordetella pertussis
ccaccagcgccacgc

SEQ ID NO: 395382 - RNA, 17 nt, Bordetella pertussis
ccaccagcggcgugcgg

SEQ ID NO: 395383 - RNA, 20 nt, Bordetella pertussis
ccaccagcguguagagcagg

SEQ ID NO: 395384 - RNA, 23 nt, Bordetella pertussis
ccaccagcguguagagcaggccg

SEQ ID NO: 395385 - RNA, 13 nt, Bordetella pertussis
ccaccaggccgcc

SEQ ID NO: 395386 - RNA, 14 nt, Bordetella pertussis
ccaccaggccggcc

SEQ ID NO: 395387 - RNA, 15 nt, Bordetella pertussis
ccaccaggccgucgg

SEQ ID NO: 395388 - RNA, 19 nt, Bordetella pertussis
ccaccaggcugaucaccca

SEQ ID NO: 395389 - RNA, 14 nt, Bordetella pertussis
ccaccagggccagc

SEQ ID NO: 395390 - RNA, 16 nt, Bordetella pertussis
ccaccaucagccagcc

SEQ ID NO: 395391 - RNA, 22 nt, Bordetella pertussis
ccaccaugccuugcgcgacagc

SEQ ID NO: 395392 - RNA, 16 nt, Bordetella pertussis
ccacccaggcggcagg

SEQ ID NO: 395393 - RNA, 15 nt, Bordetella pertussis
ccacccccagcagca

SEQ ID NO: 395394 - RNA, 14 nt, Bordetella pertussis
ccaccccguugcag

SEQ ID NO: 395395 - RNA, 22 nt, Bordetella pertussis
ccaccgagacgcugucgcgccc

SEQ ID NO: 395396 - RNA, 15 nt, Bordetella pertussis
ccaccgugaccagcg

SEQ ID NO: 395397 - RNA, 16 nt, Bordetella pertussis
ccaccguggcguccau

SEQ ID NO: 395398 - RNA, 17 nt, Bordetella pertussis
ccaccuccaccgccagc

SEQ ID NO: 395399 - RNA, 18 nt, Bordetella pertussis
ccaccuccaccgccagcc

SEQ ID NO: 395400 - RNA, 15 nt, Bordetella pertussis
ccaccuuccugcugg

SEQ ID NO: 395401 - RNA, 22 nt, Bordetella pertussis
ccaccuuccugcuggaccugcu

SEQ ID NO: 395402 - RNA, 17 nt, Bordetella pertussis
ccaccuucagggcgccg

SEQ ID NO: 395403 - RNA, 19 nt, Bordetella pertussis
ccaccuugacgcgcaggcc

SEQ ID NO: 395404 - RNA, 22 nt, Bordetella pertussis
ccacgaugcgggcaucgcccug

SEQ ID NO: 395405 - RNA, 13 nt, Bordetella pertussis
ccacgauggcgca

SEQ ID NO: 395406 - RNA, 15 nt, Bordetella pertussis
ccacgaugucggcgc

SEQ ID NO: 395407 - RNA, 13 nt, Bordetella pertussis
ccacgccacuggc

SEQ ID NO: 395408 - RNA, 12 nt, Bordetella pertussis
ccacgccagcgg

SEQ ID NO: 395409 - RNA, 13 nt, Bordetella pertussis
ccacgccauggac

SEQ ID NO: 395410 - RNA, 13 nt, Bordetella pertussis
ccacgcccacuuc

SEQ ID NO: 395411 - RNA, 15 nt, Bordetella pertussis
ccacgcccaucuaug

SEQ ID NO: 395412 - RNA, 14 nt, Bordetella pertussis
ccacgcccaggccg

SEQ ID NO: 395413 - RNA, 14 nt, Bordetella pertussis
ccacgcccuggauc

SEQ ID NO: 395414 - RNA, 17 nt, Bordetella pertussis
ccacgcugcccugcugc

SEQ ID NO: 395415 - RNA, 18 nt, Bordetella pertussis
ccacgcugcccugcugcu

SEQ ID NO: 395416 - RNA, 16 nt, Bordetella pertussis
ccacgcugcgcccgcu

SEQ ID NO: 395417 - RNA, 16 nt, Bordetella pertussis
ccacgcuggccgcgcu

SEQ ID NO: 395418 - RNA, 18 nt, Bordetella pertussis
ccacgcugggccagaccg

SEQ ID NO: 395419 - RNA, 21 nt, Bordetella pertussis
ccacgcugggccagaccgcgc

SEQ ID NO: 395420 - RNA, 22 nt, Bordetella pertussis
ccacggcaaugucgcaggccgc

SEQ ID NO: 395421 - RNA, 15 nt, Bordetella pertussis
ccacggcaucgccgc

SEQ ID NO: 395422 - RNA, 15 nt, Bordetella pertussis
ccacggcaucggcca

SEQ ID NO: 395423 - RNA, 18 nt, Bordetella pertussis
ccacggcaucggccagca

SEQ ID NO: 395424 - RNA, 13 nt, Bordetella pertussis
ccacggcauggcc

SEQ ID NO: 395425 - RNA, 16 nt, Bordetella pertussis
ccacggcauggccagc

SEQ ID NO: 395426 - RNA, 20 nt, Bordetella pertussis
ccacggcaggcgccugcccu

SEQ ID NO: 395427 - RNA, 20 nt, Bordetella pertussis
ccacggccacgucggucgcu

SEQ ID NO: 395428 - RNA, 16 nt, Bordetella pertussis
ccacggccagcacuuu

SEQ ID NO: 395429 - RNA, 15 nt, Bordetella pertussis
ccacggccagcagca

SEQ ID NO: 395430 - RNA, 14 nt, Bordetella pertussis
ccacggccgggccu

SEQ ID NO: 395431 - RNA, 14 nt, Bordetella pertussis
ccacggccugcccg

SEQ ID NO: 395432 - RNA, 18 nt, Bordetella pertussis
ccacggccugcccgggcg

SEQ ID NO: 395433 - RNA, 22 nt, Bordetella pertussis
ccacggcgaugaacagcggcac

SEQ ID NO: 395434 - RNA, 19 nt, Bordetella pertussis
ccacggcgccaaagcacag

SEQ ID NO: 395435 - RNA, 20 nt, Bordetella pertussis
ccacggcgccaaagcacagg

SEQ ID NO: 395436 - RNA, 15 nt, Bordetella pertussis
ccacggcgcgcccgc

SEQ ID NO: 395437 - RNA, 15 nt, Bordetella pertussis
ccacggcggccaggc

SEQ ID NO: 395438 - RNA, 16 nt, Bordetella pertussis
ccacggcggccaggcc

SEQ ID NO: 395439 - RNA, 20 nt, Bordetella pertussis
ccacggcggccaggccggcg

SEQ ID NO: 395440 - RNA, 15 nt, Bordetella pertussis
ccacggcgggccggc

SEQ ID NO: 395441 - RNA, 22 nt, Bordetella pertussis
ccacggcggugaccaccaggcc

SEQ ID NO: 395442 - RNA, 19 nt, Bordetella pertussis
ccacggcgucgccggccag

SEQ ID NO: 395443 - RNA, 16 nt, Bordetella pertussis
ccacggcguggcgcgc

SEQ ID NO: 395444 - RNA, 17 nt, Bordetella pertussis
ccacggcguggcgcgcc

SEQ ID NO: 395445 - RNA, 16 nt, Bordetella pertussis
ccacgggaccgcucag

SEQ ID NO: 395446 - RNA, 18 nt, Bordetella pertussis
ccacggggacuggcuccc

SEQ ID NO: 395447 - RNA, 16 nt, Bordetella pertussis
ccacggucggcacguc

SEQ ID NO: 395448 - RNA, 13 nt, Bordetella pertussis
ccacgucgcccac

SEQ ID NO: 395449 - RNA, 14 nt, Bordetella pertussis
ccacgucgccggcg

SEQ ID NO: 395450 - RNA, 23 nt, Bordetella pertussis
ccacgucgccggcguucuucagc

SEQ ID NO: 395451 - RNA, 16 nt, Bordetella pertussis
ccacgucggcggccgc

SEQ ID NO: 395452 - RNA, 19 nt, Bordetella pertussis
ccacguguggcaggccagc

SEQ ID NO: 395453 - RNA, 23 nt, Bordetella pertussis
ccacguguggcaggccagcgcca

SEQ ID NO: 395454 - RNA, 22 nt, Bordetella pertussis
ccagaacgcgccguaccccagc

SEQ ID NO: 395455 - RNA, 23 nt, Bordetella pertussis
ccagaccaagcgccacagcgcca

SEQ ID NO: 395456 - RNA, 16 nt, Bordetella pertussis
ccagaccugcgcgccg

SEQ ID NO: 395457 - RNA, 15 nt, Bordetella pertussis
ccagacgcagaccac

SEQ ID NO: 395458 - RNA, 13 nt, Bordetella pertussis
ccagacggccagc

SEQ ID NO: 395459 - RNA, 20 nt, Bordetella pertussis
ccagacggccagcgcgcgug

SEQ ID NO: 395460 - RNA, 20 nt, Bordetella pertussis
ccagagcaccgagaccgggc

SEQ ID NO: 395461 - RNA, 12 nt, Bordetella pertussis
ccagcaagccga

SEQ ID NO: 395462 - RNA, 17 nt, Bordetella pertussis
ccagcaagcgcucggcc

SEQ ID NO: 395463 - RNA, 13 nt, Bordetella pertussis
ccagcaaggcggc

SEQ ID NO: 395464 - RNA, 21 nt, Bordetella pertussis
ccagcaaggcgucggccaggc

SEQ ID NO: 395465 - RNA, 23 nt, Bordetella pertussis
ccagcaaggcgucggccaggccg

SEQ ID NO: 395466 - RNA, 21 nt, Bordetella pertussis
ccagcaagggguccguggcgg

SEQ ID NO: 395467 - RNA, 16 nt, Bordetella pertussis
ccagcaccagcgccug

SEQ ID NO: 395468 - RNA, 12 nt, Bordetella pertussis
ccagcaccaugg

SEQ ID NO: 395469 - RNA, 16 nt, Bordetella pertussis
ccagcaccccgucggc

SEQ ID NO: 395470 - RNA, 13 nt, Bordetella pertussis
ccagcaccgccac

SEQ ID NO: 395471 - RNA, 13 nt, Bordetella pertussis
ccagcacggccgc

SEQ ID NO: 395472 - RNA, 14 nt, Bordetella pertussis
ccagcacggccgcg

SEQ ID NO: 395473 - RNA, 17 nt, Bordetella pertussis
ccagcacggccgcggcc

SEQ ID NO: 395474 - RNA, 15 nt, Bordetella pertussis
ccagcacgguggcgc

SEQ ID NO: 395475 - RNA, 20 nt, Bordetella pertussis
ccagcacgguggcgcccggc

SEQ ID NO: 395476 - RNA, 20 nt, Bordetella pertussis
ccagcagaaugccgcccacg

SEQ ID NO: 395477 - RNA, 21 nt, Bordetella pertussis
ccagcagauaccggcauggca

SEQ ID NO: 395478 - RNA, 14 nt, Bordetella pertussis
ccagcagcaugccg

SEQ ID NO: 395479 - RNA, 13 nt, Bordetella pertussis
ccagcagccccag

SEQ ID NO: 395480 - RNA, 14 nt, Bordetella pertussis
ccagcagccccagc

SEQ ID NO: 395481 - RNA, 13 nt, Bordetella pertussis
ccagcagcgccgc

SEQ ID NO: 395482 - RNA, 16 nt, Bordetella pertussis
ccagcagcgccugggg

SEQ ID NO: 395483 - RNA, 14 nt, Bordetella pertussis
ccagcauccagccg

SEQ ID NO: 395484 - RNA, 15 nt, Bordetella pertussis
ccagcaucgccgcca

SEQ ID NO: 395485 - RNA, 19 nt, Bordetella pertussis
ccagcaucggcacccagcc

SEQ ID NO: 395486 - RNA, 23 nt, Bordetella pertussis
ccagcaugaucaugccgcugccc

SEQ ID NO: 395487 - RNA, 17 nt, Bordetella pertussis
ccagcaugcgcgcggcc

SEQ ID NO: 395488 - RNA, 15 nt, Bordetella pertussis
ccagcauggccgugg

SEQ ID NO: 395489 - RNA, 18 nt, Bordetella pertussis
ccagcauggccguggcgu

SEQ ID NO: 395490 - RNA, 20 nt, Bordetella pertussis
ccagcauggucggcauggcc

SEQ ID NO: 395491 - RNA, 17 nt, Bordetella pertussis
ccagccacaccagguug

SEQ ID NO: 395492 - RNA, 15 nt, Bordetella pertussis
ccagccaccacugca

SEQ ID NO: 395493 - RNA, 20 nt, Bordetella pertussis
ccagccaccaugucccuggc

SEQ ID NO: 395494 - RNA, 11 nt, Bordetella pertussis
ccagccagcgc

SEQ ID NO: 395495 - RNA, 14 nt, Bordetella pertussis
ccagccagcgccgc

SEQ ID NO: 395496 - RNA, 21 nt, Bordetella pertussis
ccagccagcggugcgcggcgc

SEQ ID NO: 395497 - RNA, 17 nt, Bordetella pertussis
ccagccaggccucggcu

SEQ ID NO: 395498 - RNA, 12 nt, Bordetella pertussis
ccagccaggcgg

SEQ ID NO: 395499 - RNA, 20 nt, Bordetella pertussis
ccagccaggcgguggccucg

SEQ ID NO: 395500 - RNA, 17 nt, Bordetella pertussis
ccagccccgcggccgcg

SEQ ID NO: 395501 - RNA, 17 nt, Bordetella pertussis
ccagccccggcgcgccg

SEQ ID NO: 395502 - RNA, 20 nt, Bordetella pertussis
ccagccccggcgcgccggcc

SEQ ID NO: 395503 - RNA, 16 nt, Bordetella pertussis
ccagccccugcccguc

SEQ ID NO: 395504 - RNA, 20 nt, Bordetella pertussis
ccagcccgaugcgccaggcc

SEQ ID NO: 395505 - RNA, 21 nt, Bordetella pertussis
ccagcccgaugcgccaggccu

SEQ ID NO: 395506 - RNA, 23 nt, Bordetella pertussis
ccagcccgaugcgccaggccucg

SEQ ID NO: 395507 - RNA, 15 nt, Bordetella pertussis
ccagcccgccgcugg

SEQ ID NO: 395508 - RNA, 18 nt, Bordetella pertussis
ccagcccgccggcgcgcg

SEQ ID NO: 395509 - RNA, 15 nt, Bordetella pertussis
ccagcccgcccgcgc

SEQ ID NO: 395510 - RNA, 16 nt, Bordetella pertussis
ccagcccgcccgcgcc

SEQ ID NO: 395511 - RNA, 12 nt, Bordetella pertussis
ccagcggcagcg

SEQ ID NO: 395512 - RNA, 22 nt, Bordetella pertussis
ccagcggcagcgcgcaggacaa

SEQ ID NO: 395513 - RNA, 13 nt, Bordetella pertussis
ccagcggcaggcc

SEQ ID NO: 395514 - RNA, 21 nt, Bordetella pertussis
ccagcggcauugcccagguug

SEQ ID NO: 395515 - RNA, 19 nt, Bordetella pertussis
ccagcggcgcaccgacagc

SEQ ID NO: 395516 - RNA, 23 nt, Bordetella pertussis
ccagcggcgcaccgacagcaagg

SEQ ID NO: 395517 - RNA, 15 nt, Bordetella pertussis
ccagcggcgcagccg

SEQ ID NO: 395518 - RNA, 15 nt, Bordetella pertussis
ccagcggcgcggcgc

SEQ ID NO: 395519 - RNA, 19 nt, Bordetella pertussis
ccagcggcgcuuaccgcgc

SEQ ID NO: 395520 - RNA, 20 nt, Bordetella pertussis
ccagcggcguauaggccacc

SEQ ID NO: 395521 - RNA, 18 nt, Bordetella pertussis
ccagcggcgugcggccca

SEQ ID NO: 395522 - RNA, 21 nt, Bordetella pertussis
ccagcggcgugcggcccagcc

SEQ ID NO: 395523 - RNA, 17 nt, Bordetella pertussis
ccagcggugcgcggcgc

SEQ ID NO: 395524 - RNA, 21 nt, Bordetella pertussis
ccagcggugcgcggcgcagcc

SEQ ID NO: 395525 - RNA, 18 nt, Bordetella pertussis
ccagcgguucgucggcgc

SEQ ID NO: 395526 - RNA, 15 nt, Bordetella pertussis
ccagcgguugcgcca

SEQ ID NO: 395527 - RNA, 21 nt, Bordetella pertussis
ccagcguaucgccgccgccgg

SEQ ID NO: 395528 - RNA, 14 nt, Bordetella pertussis
ccagcgugcccagc

SEQ ID NO: 395529 - RNA, 16 nt, Bordetella pertussis
ccagcgugcccagcga

SEQ ID NO: 395530 - RNA, 17 nt, Bordetella pertussis
ccagcguggagcugcuc

SEQ ID NO: 395531 - RNA, 16 nt, Bordetella pertussis
ccagcguggccgaggu

SEQ ID NO: 395532 - RNA, 20 nt, Bordetella pertussis
ccagcguguagagcaggccg

SEQ ID NO: 395533 - RNA, 21 nt, Bordetella pertussis
ccagcguguagagcaggccgc

SEQ ID NO: 395534 - RNA, 22 nt, Bordetella pertussis
ccagcguguagagcaggccgcc

SEQ ID NO: 395535 - RNA, 23 nt, Bordetella pertussis
ccagcguguagagcaggccgccc

SEQ ID NO: 395536 - RNA, 21 nt, Bordetella pertussis
ccagcguguaggcggccggcu

SEQ ID NO: 395537 - RNA, 14 nt, Bordetella pertussis
ccagcucagcagcg

SEQ ID NO: 395538 - RNA, 16 nt, Bordetella pertussis
ccagcucagcagcgcc

SEQ ID NO: 395539 - RNA, 13 nt, Bordetella pertussis
ccagcuccagcgc

SEQ ID NO: 395540 - RNA, 16 nt, Bordetella pertussis
ccagcuccagcgcgcc

SEQ ID NO: 395541 - RNA, 17 nt, Bordetella pertussis
ccagcuccagcgcgccg

SEQ ID NO: 395542 - RNA, 14 nt, Bordetella pertussis
ccagcuccagcugg

SEQ ID NO: 395543 - RNA, 14 nt, Bordetella pertussis
ccagcuccggcggc

SEQ ID NO: 395544 - RNA, 17 nt, Bordetella pertussis
ccagcuccggcggcagc

SEQ ID NO: 395545 - RNA, 22 nt, Bordetella pertussis
ccagcucgguggucaacggcaa

SEQ ID NO: 395546 - RNA, 16 nt, Bordetella pertussis
ccagcucugcucuguc

SEQ ID NO: 395547 - RNA, 19 nt, Bordetella pertussis
ccagcucugguccaggcgg

SEQ ID NO: 395548 - RNA, 17 nt, Bordetella pertussis
ccagcucuucgagcgcg

SEQ ID NO: 395549 - RNA, 16 nt, Bordetella pertussis
ccagcugaccucgccc

SEQ ID NO: 395550 - RNA, 22 nt, Bordetella pertussis
ccagcugaccucgcccaggccg

SEQ ID NO: 395551 - RNA, 16 nt, Bordetella pertussis
ccagcuggcgccccuu

SEQ ID NO: 395552 - RNA, 17 nt, Bordetella pertussis
ccagcuggcgccccuuc

SEQ ID NO: 395553 - RNA, 21 nt, Bordetella pertussis
ccagcuggcggcgcagcacca

SEQ ID NO: 395554 - RNA, 12 nt, Bordetella pertussis
ccagcugggcca

SEQ ID NO: 395555 - RNA, 16 nt, Bordetella pertussis
ccagcugggccacagg

SEQ ID NO: 395556 - RNA, 18 nt, Bordetella pertussis
ccagcugggcggcgugac

SEQ ID NO: 395557 - RNA, 15 nt, Bordetella pertussis
ccagcuguccaagcg

SEQ ID NO: 395558 - RNA, 15 nt, Bordetella pertussis
ccagcuucgggcccu

SEQ ID NO: 395559 - RNA, 17 nt, Bordetella pertussis
ccagcuugaccgccagc

SEQ ID NO: 395560 - RNA, 21 nt, Bordetella pertussis
ccagcuugagauagcccuuga

SEQ ID NO: 395561 - RNA, 14 nt, Bordetella pertussis
ccagcuugagcagg

SEQ ID NO: 395562 - RNA, 13 nt, Bordetella pertussis
ccagcuugcaaaa

SEQ ID NO: 395563 - RNA, 21 nt, Bordetella pertussis
ccagcuugcaggcgccuucgg

SEQ ID NO: 395564 - RNA, 13 nt, Bordetella pertussis
ccagcuuggccug

SEQ ID NO: 395565 - RNA, 20 nt, Bordetella pertussis
ccagcuuguagcggccaucg

SEQ ID NO: 395566 - RNA, 15 nt, Bordetella pertussis
ccagcuugucgacca

SEQ ID NO: 395567 - RNA, 20 nt, Bordetella pertussis
ccaggaaaaccuccuccgcg

SEQ ID NO: 395568 - RNA, 17 nt, Bordetella pertussis
ccaggaaagaggccagg

SEQ ID NO: 395569 - RNA, 15 nt, Bordetella pertussis
ccaggaaagcgccgc

SEQ ID NO: 395570 - RNA, 17 nt, Bordetella pertussis
ccaggaaagcgccgccg

SEQ ID NO: 395571 - RNA, 13 nt, Bordetella pertussis
ccaggaacagcaa

SEQ ID NO: 395572 - RNA, 15 nt, Bordetella pertussis
ccaggaacagcgccg

SEQ ID NO: 395573 - RNA, 20 nt, Bordetella pertussis
ccaggaacagcgccggcagc

SEQ ID NO: 395574 - RNA, 23 nt, Bordetella pertussis
ccaggaacagcgccggcagcgca

SEQ ID NO: 395575 - RNA, 20 nt, Bordetella pertussis
ccaggagcaacuggggcgcu

SEQ ID NO: 395576 - RNA, 13 nt, Bordetella pertussis
ccaggagcucguc

SEQ ID NO: 395577 - RNA, 19 nt, Bordetella pertussis
ccaggaucaccgccgcgcc

SEQ ID NO: 395578 - RNA, 19 nt, Bordetella pertussis
ccaggaucgcggccagccg

SEQ ID NO: 395579 - RNA, 18 nt, Bordetella pertussis
ccaggcaaugcgcaggcc

SEQ ID NO: 395580 - RNA, 16 nt, Bordetella pertussis
ccaggcagccggcccc

SEQ ID NO: 395581 - RNA, 17 nt, Bordetella pertussis
ccaggcagccggccccg

SEQ ID NO: 395582 - RNA, 18 nt, Bordetella pertussis
ccaggccgugagcgccgc

SEQ ID NO: 395583 - RNA, 18 nt, Bordetella pertussis
ccaggccguggcccagcc

SEQ ID NO: 395584 - RNA, 21 nt, Bordetella pertussis
ccaggccuucgacguccagcc

SEQ ID NO: 395585 - RNA, 15 nt, Bordetella pertussis
ccaggcgaaccuggc

SEQ ID NO: 395586 - RNA, 16 nt, Bordetella pertussis
ccaggcgacccagcac

SEQ ID NO: 395587 - RNA, 20 nt, Bordetella pertussis
ccaggcgaggcuggcgccca

SEQ ID NO: 395588 - RNA, 21 nt, Bordetella pertussis
ccaggcgaugcccagcgccgc

SEQ ID NO: 395589 - RNA, 22 nt, Bordetella pertussis
ccaggcgaugcccagcgccgcc

SEQ ID NO: 395590 - RNA, 12 nt, Bordetella pertussis
ccaggcgcccgc

SEQ ID NO: 395591 - RNA, 14 nt, Bordetella pertussis
ccaggcgcccgcca

SEQ ID NO: 395592 - RNA, 18 nt, Bordetella pertussis
ccaggcgcccggcgugac

SEQ ID NO: 395593 - RNA, 21 nt, Bordetella pertussis
ccaggcgccgauccagggccg

SEQ ID NO: 395594 - RNA, 12 nt, Bordetella pertussis
ccaggcgccgcg

SEQ ID NO: 395595 - RNA, 12 nt, Bordetella pertussis
ccaggcgcgcca

SEQ ID NO: 395596 - RNA, 16 nt, Bordetella pertussis
ccaggcgcgccagccg

SEQ ID NO: 395597 - RNA, 23 nt, Bordetella pertussis
ccaggcgcgccagccgcugcagc

SEQ ID NO: 395598 - RNA, 12 nt, Bordetella pertussis
ccaggcgcgccg

SEQ ID NO: 395599 - RNA, 17 nt, Bordetella pertussis
ccaggcgccgggccgcu

SEQ ID NO: 395600 - RNA, 12 nt, Bordetella pertussis
ccaggcgcgcgc

SEQ ID NO: 395601 - RNA, 19 nt, Bordetella pertussis
ccaggcgcgugcgcaggcg

SEQ ID NO: 395602 - RNA, 20 nt, Bordetella pertussis
ccaggcgcucagccgugccg

SEQ ID NO: 395603 - RNA, 23 nt, Bordetella pertussis
ccaggcgcucagccgugccgcgc

SEQ ID NO: 395604 - RNA, 19 nt, Bordetella pertussis
ccaggcgcuccagcaccug

SEQ ID NO: 395605 - RNA, 14 nt, Bordetella pertussis
ccaggcugucgucg

SEQ ID NO: 395606 - RNA, 17 nt, Bordetella pertussis
ccaggcuuucgaagccg

SEQ ID NO: 395607 - RNA, 20 nt, Bordetella pertussis
ccaggcuuucgaagccgccc

SEQ ID NO: 395608 - RNA, 15 nt, Bordetella pertussis
ccagggaggaacugg

SEQ ID NO: 395609 - RNA, 13 nt, Bordetella pertussis
ccagggcaggagg

SEQ ID NO: 395610 - RNA, 22 nt, Bordetella pertussis
ccagggcagggcgccguccagu

SEQ ID NO: 395611 - RNA, 22 nt, Bordetella pertussis
ccagggccacgcccacgcgccg

SEQ ID NO: 395612 - RNA, 18 nt, Bordetella pertussis
ccagggccacgccggccg

SEQ ID NO: 395613 - RNA, 20 nt, Bordetella pertussis
ccagggccacgccggccgcc

SEQ ID NO: 395614 - RNA, 21 nt, Bordetella pertussis
ccagggccacgccggccgccu

SEQ ID NO: 395615 - RNA, 16 nt, Bordetella pertussis
ccagggccccuccggc

SEQ ID NO: 395616 - RNA, 21 nt, Bordetella pertussis
ccagggccgagccggauggcu

SEQ ID NO: 395617 - RNA, 16 nt, Bordetella pertussis
ccagggccgcagcaau

SEQ ID NO: 395618 - RNA, 12 nt, Bordetella pertussis
ccagggccgcca

SEQ ID NO: 395619 - RNA, 17 nt, Bordetella pertussis
ccagggccgccagcacc

SEQ ID NO: 395620 - RNA, 18 nt, Bordetella pertussis
ccagggccgccagcaccu

SEQ ID NO: 395621 - RNA, 13 nt, Bordetella pertussis
ccagggcgcccgc

SEQ ID NO: 395622 - RNA, 14 nt, Bordetella pertussis
ccagggcgcccgcc

SEQ ID NO: 395623 - RNA, 15 nt, Bordetella pertussis
ccagggcgcccgccg

SEQ ID NO: 395624 - RNA, 12 nt, Bordetella pertussis
ccagggcgcgcc

SEQ ID NO: 395625 - RNA, 20 nt, Bordetella pertussis
ccagggcggugggcagcgcg

SEQ ID NO: 395626 - RNA, 21 nt, Bordetella pertussis
ccagggcuugcggcgcuggcu

SEQ ID NO: 395627 - RNA, 13 nt, Bordetella pertussis
ccaggguggcgcc

SEQ ID NO: 395628 - RNA, 16 nt, Bordetella pertussis
ccaggguggcgccggc

SEQ ID NO: 395629 - RNA, 23 nt, Bordetella pertussis
ccaggguggcgccggccaccgcc

SEQ ID NO: 395630 - RNA, 18 nt, Bordetella pertussis
ccaggguggcguccuggu

SEQ ID NO: 395631 - RNA, 21 nt, Bordetella pertussis
ccaggggaugacgggcgagca

SEQ ID NO: 395632 - RNA, 18 nt, Bordetella pertussis
ccaggguguccuggucgg

SEQ ID NO: 395633 - RNA, 20 nt, Bordetella pertussis
ccaggguuuccucgccgacg

SEQ ID NO: 395634 - RNA, 13 nt, Bordetella pertussis
ccagguacaggcc

SEQ ID NO: 395635 - RNA, 17 nt, Bordetella pertussis
ccagguacaggccgccg

SEQ ID NO: 395636 - RNA, 14 nt, Bordetella pertussis
ccagguagcgggug

SEQ ID NO: 395637 - RNA, 17 nt, Bordetella pertussis
ccagguaggcggcgcgc

SEQ ID NO: 395638 - RNA, 13 nt, Bordetella pertussis
ccaggugccgcgu

SEQ ID NO: 395639 - RNA, 15 nt, Bordetella pertussis
ccaggugcgcaugua

SEQ ID NO: 395640 - RNA, 20 nt, Bordetella pertussis
ccagguggacagcgccagcc

SEQ ID NO: 395641 - RNA, 14 nt, Bordetella pertussis
ccaggugggcgcgc

SEQ ID NO: 395642 - RNA, 15 nt, Bordetella pertussis
ccaggugggcgcgcu

SEQ ID NO: 395643 - RNA, 10 nt, Bordetella pertussis
ccagguugag

SEQ ID NO: 395644 - RNA, 18 nt, Bordetella pertussis
ccagguugagucuggaga

SEQ ID NO: 395645 - RNA, 18 nt, Bordetella pertussis
ccagguugcauccggccc

SEQ ID NO: 395646 - RNA, 19 nt, Bordetella pertussis
ccagguugcauccggcccg

SEQ ID NO: 395647 - RNA, 16 nt, Bordetella pertussis
ccagguugcggccgcc

SEQ ID NO: 395648 - RNA, 17 nt, Bordetella pertussis
ccagguugggcaccacc

SEQ ID NO: 395649 - RNA, 20 nt, Bordetella pertussis
ccagguugggugcgccgccg

SEQ ID NO: 395650 - RNA, 15 nt, Bordetella pertussis
ccagguugucggcgc

SEQ ID NO: 395651 - RNA, 17 nt, Bordetella pertussis
ccagguuuuccacagcc

SEQ ID NO: 395652 - RNA, 22 nt, Bordetella pertussis
ccagguuuuccacagccaggcc

SEQ ID NO: 395653 - RNA, 16 nt, Bordetella pertussis
ccaguacaggcugccg

SEQ ID NO: 395654 - RNA, 14 nt, Bordetella pertussis
ccaguacgaagggg

SEQ ID NO: 395655 - RNA, 15 nt, Bordetella pertussis
ccaguacgucggaca

SEQ ID NO: 395656 - RNA, 19 nt, Bordetella pertussis
ccaguacgucggacagggc

SEQ ID NO: 395657 - RNA, 23 nt, Bordetella pertussis
ccaguacgucggacagggccccg

SEQ ID NO: 395658 - RNA, 14 nt, Bordetella pertussis
ccaguggugcuccc

SEQ ID NO: 395659 - RNA, 17 nt, Bordetella pertussis
ccaguggugcucccagg

SEQ ID NO: 395660 - RNA, 18 nt, Bordetella pertussis
ccaguuccgugcgcgccc

SEQ ID NO: 395661 - RNA, 13 nt, Bordetella pertussis
ccauaggccagcg

SEQ ID NO: 395662 - RNA, 15 nt, Bordetella pertussis
ccauauugaugcagc

SEQ ID NO: 395663 - RNA, 17 nt, Bordetella pertussis
ccaucaacgacaaagcc

SEQ ID NO: 395664 - RNA, 20 nt, Bordetella pertussis
ccauccacggcgccaugccg

SEQ ID NO: 395665 - RNA, 14 nt, Bordetella pertussis
ccauccagccaggc

SEQ ID NO: 395666 - RNA, 19 nt, Bordetella pertussis
ccauccagccaggccgcau

SEQ ID NO: 395667 - RNA, 21 nt, Bordetella pertussis
ccauccagcggacgggccagg

SEQ ID NO: 395668 - RNA, 22 nt, Bordetella pertussis
ccauccgucugguuccagauuu

SEQ ID NO: 395669 - RNA, 17 nt, Bordetella pertussis
ccauccucgcccagcgg

SEQ ID NO: 395670 - RNA, 10 nt, Bordetella pertussis
ccauccugaa

SEQ ID NO: 395671 - RNA, 14 nt, Bordetella pertussis
ccauccuggccgcc

SEQ ID NO: 395672 - RNA, 18 nt, Bordetella pertussis
ccaucgccgagccgcugu

SEQ ID NO: 395673 - RNA, 12 nt, Bordetella pertussis
ccaucgccgcca

SEQ ID NO: 395674 - RNA, 21 nt, Bordetella pertussis
ccaucgccgccacgugcacga

SEQ ID NO: 395675 - RNA, 12 nt, Bordetella pertussis
ccaucgccgccg

SEQ ID NO: 395676 - RNA, 20 nt, Bordetella pertussis
ccaucgccugcacgaccugc

SEQ ID NO: 395677 - RNA, 21 nt, Bordetella pertussis
ccaucgcggucgaugaccagc

SEQ ID NO: 395678 - RNA, 17 nt, Bordetella pertussis
ccaucgcguccaggccc

SEQ ID NO: 395679 - RNA, 13 nt, Bordetella pertussis
ccaucgcgugcag

SEQ ID NO: 395680 - RNA, 19 nt, Bordetella pertussis
ccaucgcugguaugcacga

SEQ ID NO: 395681 - RNA, 14 nt, Bordetella pertussis
ccaucgucguagcg

SEQ ID NO: 395682 - RNA, 23 nt, Bordetella pertussis
ccaucuacgugcuggacccgcug

SEQ ID NO: 395683 - RNA, 17 nt, Bordetella pertussis
ccaugaaagcgaacagg

SEQ ID NO: 395684 - RNA, 19 nt, Bordetella pertussis
ccaugaaagcgaacagggc

SEQ ID NO: 395685 - RNA, 15 nt, Bordetella pertussis
ccaugaacgccgcgc

SEQ ID NO: 395686 - RNA, 16 nt, Bordetella pertussis
ccaugaacgcuugacg

SEQ ID NO: 395687 - RNA, 23 nt, Bordetella pertussis
ccaugaacgcuugacggccagga

SEQ ID NO: 395688 - RNA, 19 nt, Bordetella pertussis
ccaugacaugcgggccucg

SEQ ID NO: 395689 - RNA, 19 nt, Bordetella pertussis
ccaugaccacgucgaccag

SEQ ID NO: 395690 - RNA, 16 nt, Bordetella pertussis
ccaugacgaccuugcg

SEQ ID NO: 395691 - RNA, 19 nt, Bordetella pertussis
ccaugacgaccuugcggcc

SEQ ID NO: 395692 - RNA, 22 nt, Bordetella pertussis
ccaugacgcuggucgagagccu

SEQ ID NO: 395693 - RNA, 21 nt, Bordetella pertussis
ccaugaggaacggcaccagcc

SEQ ID NO: 395694 - RNA, 23 nt, Bordetella pertussis
ccaugaggaacggcaccagccgg

SEQ ID NO: 395695 - RNA, 17 nt, Bordetella pertussis
ccaugaucucgggcgag

SEQ ID NO: 395696 - RNA, 22 nt, Bordetella pertussis
ccaugcaacacgaccagcaggc

SEQ ID NO: 395697 - RNA, 16 nt, Bordetella pertussis
ccaugcagcuggaugg

SEQ ID NO: 395698 - RNA, 15 nt, Bordetella pertussis
ccaugcaguagcgcu

SEQ ID NO: 395699 - RNA, 19 nt, Bordetella pertussis
ccaugccccauccagcgga

SEQ ID NO: 395700 - RNA, 16 nt, Bordetella pertussis
ccaugcccaggcccag

SEQ ID NO: 395701 - RNA, 17 nt, Bordetella pertussis
ccaugccgaugccgcag

SEQ ID NO: 395702 - RNA, 20 nt, Bordetella pertussis
ccaugccgcccaugccgccg

SEQ ID NO: 395703 - RNA, 14 nt, Bordetella pertussis
ccaugccgcccgcc

SEQ ID NO: 395704 - RNA, 12 nt, Bordetella pertussis
ccaugccgcgcc

SEQ ID NO: 395705 - RNA, 16 nt, Bordetella pertussis
ccaugccgcgcccgcc

SEQ ID NO: 395706 - RNA, 17 nt, Bordetella pertussis
ccaugccgcggacccag

SEQ ID NO: 395707 - RNA, 23 nt, Bordetella pertussis
ccaugccgcggacccaggccucg

SEQ ID NO: 395708 - RNA, 15 nt, Bordetella pertussis
ccaugccggaacagg

SEQ ID NO: 395709 - RNA, 14 nt, Bordetella pertussis
ccaugccggccugc

SEQ ID NO: 395710 - RNA, 16 nt, Bordetella pertussis
ccaugccguccugcug

SEQ ID NO: 395711 - RNA, 17 nt, Bordetella pertussis
ccaugccguccugcugc

SEQ ID NO: 395712 - RNA, 17 nt, Bordetella pertussis
ccaugccgucgcgcacc

SEQ ID NO: 395713 - RNA, 20 nt, Bordetella pertussis
ccaugccgucuggcggcagc

SEQ ID NO: 395714 - RNA, 18 nt, Bordetella pertussis
ccaugcgaaagcggccag

SEQ ID NO: 395715 - RNA, 21 nt, Bordetella pertussis
ccaugcgacagcccgggaaac

SEQ ID NO: 395716 - RNA, 23 nt, Bordetella pertussis
ccaugcgauagcgggccugcagc

SEQ ID NO: 395717 - RNA, 18 nt, Bordetella pertussis
ccaugcgaugcugcaggg

SEQ ID NO: 395718 - RNA, 14 nt, Bordetella pertussis
ccaugcgcauggcc

SEQ ID NO: 395719 - RNA, 15 nt, Bordetella pertussis
ccaugcgccagcagg

SEQ ID NO: 395720 - RNA, 14 nt, Bordetella pertussis
ccaugcgcccggcc

SEQ ID NO: 395721 - RNA, 19 nt, Bordetella pertussis
ccaugcgcuggcgcaagga

SEQ ID NO: 395722 - RNA, 14 nt, Bordetella pertussis
ccaugcgcugggca

SEQ ID NO: 395723 - RNA, 18 nt, Bordetella pertussis
ccaugcgcuuggaccccg

SEQ ID NO: 395724 - RNA, 15 nt, Bordetella pertussis
ccaugcggacgccag

SEQ ID NO: 395725 - RNA, 19 nt, Bordetella pertussis
ccaugcggacgccagcccu

SEQ ID NO: 395726 - RNA, 21 nt, Bordetella pertussis
ccaugcggaugaacgaccagc

SEQ ID NO: 395727 - RNA, 20 nt, Bordetella pertussis
ccaugcggggacuggcacca

SEQ ID NO: 395728 - RNA, 22 nt, Bordetella pertussis
ccaugcggugcgcccuuugcau

SEQ ID NO: 395729 - RNA, 19 nt, Bordetella pertussis
ccaugcguaucggcagcgu

SEQ ID NO: 395730 - RNA, 14 nt, Bordetella pertussis
ccaugcucagcagc

SEQ ID NO: 395731 - RNA, 22 nt, Bordetella pertussis
ccaugcugaauugcgggccggc

SEQ ID NO: 395732 - RNA, 16 nt, Bordetella pertussis
ccaugcuggccgccgc

SEQ ID NO: 395733 - RNA, 12 nt, Bordetella pertussis
ccaugcugggcg

SEQ ID NO: 395734 - RNA, 16 nt, Bordetella pertussis
ccaugcugggcgggcu

SEQ ID NO: 395735 - RNA, 19 nt, Bordetella pertussis
ccaugcugggcgggcuggu

SEQ ID NO: 395736 - RNA, 17 nt, Bordetella pertussis
ccauggacagcaccgac

SEQ ID NO: 395737 - RNA, 16 nt, Bordetella pertussis
ccauggaggcgcagcg

SEQ ID NO: 395738 - RNA, 18 nt, Bordetella pertussis
ccauggaggcgcagcgcg

SEQ ID NO: 395739 - RNA, 19 nt, Bordetella pertussis
ccauggcaagcgcaaugga

SEQ ID NO: 395740 - RNA, 22 nt, Bordetella pertussis
ccauggcaugaaaaagggcgca

SEQ ID NO: 395741 - RNA, 13 nt, Bordetella pertussis
ccauggcagggcg

SEQ ID NO: 395742 - RNA, 22 nt, Bordetella pertussis
ccauggccagggaggaacuggg

SEQ ID NO: 395743 - RNA, 15 nt, Bordetella pertussis
ccauggccgacagcg

SEQ ID NO: 395744 - RNA, 14 nt, Bordetella pertussis
ccauggccggcguu

SEQ ID NO: 395745 - RNA, 19 nt, Bordetella pertussis
ccauggccugcaggaagcc

SEQ ID NO: 395746 - RNA, 18 nt, Bordetella pertussis
ccauggcggccgccgcca

SEQ ID NO: 395747 - RNA, 21 nt, Bordetella pertussis
ccauggggugcuccugccagg

SEQ ID NO: 395748 - RNA, 21 nt, Bordetella pertussis
ccauggucgcgaccaccguga

SEQ ID NO: 395749 - RNA, 11 nt, Bordetella pertussis
ccauggucucc

SEQ ID NO: 395750 - RNA, 21 nt, Bordetella pertussis
ccaugucggccgaccacugga

SEQ ID NO: 395751 - RNA, 14 nt, Bordetella pertussis
ccauguggccagcu

SEQ ID NO: 395752 - RNA, 17 nt, Bordetella pertussis
ccauguggccagcucca

SEQ ID NO: 395753 - RNA, 20 nt, Bordetella pertussis
ccauguggggacaggcaccc

SEQ ID NO: 395754 - RNA, 15 nt, Bordetella pertussis
ccauguucagcuuca

SEQ ID NO: 395755 - RNA, 22 nt, Bordetella pertussis
ccauguucagcuucagccuggg

SEQ ID NO: 395756 - RNA, 17 nt, Bordetella pertussis
ccauuagggcccagcug

SEQ ID NO: 395757 - RNA, 17 nt, Bordetella pertussis
ccauuccggcuggucgg

SEQ ID NO: 395758 - RNA, 16 nt, Bordetella pertussis
ccauucgguggucugc

SEQ ID NO: 395759 - RNA, 13 nt, Bordetella pertussis
ccauugcgcggcc

SEQ ID NO: 395760 - RNA, 17 nt, Bordetella pertussis
ccauugcggcaccugcu

SEQ ID NO: 395761 - RNA, 18 nt, Bordetella pertussis
ccauugcggcaccugcug

SEQ ID NO: 395762 - RNA, 21 nt, Bordetella pertussis
ccauugcgggugggcauccag

SEQ ID NO: 395763 - RNA, 15 nt, Bordetella pertussis
cccaauuggccgccc

SEQ ID NO: 395764 - RNA, 17 nt, Bordetella pertussis
cccacaggaacaggccg

SEQ ID NO: 395765 - RNA, 24 nt, Bordetella pertussis
cccacagggggucuggcaccugcc

SEQ ID NO: 395766 - RNA, 21 nt, Bordetella pertussis
cccaccaugagcacgccccaa

SEQ ID NO: 395767 - RNA, 14 nt, Bordetella pertussis
cccacccggcacgc

SEQ ID NO: 395768 - RNA, 14 nt, Bordetella pertussis
cccaccuuccugcu

SEQ ID NO: 395769 - RNA, 15 nt, Bordetella pertussis
cccaccuuccugcug

SEQ ID NO: 395770 - RNA, 16 nt, Bordetella pertussis
cccaccuuccugcugg

SEQ ID NO: 395771 - RNA, 16 nt, Bordetella pertussis
cccaccuugcgcgcga

SEQ ID NO: 395772 - RNA, 18 nt, Bordetella pertussis
cccacgaacgccacgccc

SEQ ID NO: 395773 - RNA, 19 nt, Bordetella pertussis
cccacgaacgccacgcccg

SEQ ID NO: 395774 - RNA, 19 nt, Bordetella pertussis
cccacgaucaccacgcccg

SEQ ID NO: 395775 - RNA, 17 nt, Bordetella pertussis
cccacucccguaagcag

SEQ ID NO: 395776 - RNA, 22 nt, Bordetella pertussis
cccacugccaguaggcgcccca

SEQ ID NO: 395777 - RNA, 16 nt, Bordetella pertussis
cccacuucgaaacccu

SEQ ID NO: 395778 - RNA, 15 nt, Bordetella pertussis
cccacuugagcagcg

SEQ ID NO: 395779 - RNA, 13 nt, Bordetella pertussis
cccagaaacuggc

SEQ ID NO: 395780 - RNA, 20 nt, Bordetella pertussis
cccagaaacuggcgcugccg

SEQ ID NO: 395781 - RNA, 17 nt, Bordetella pertussis
cccagacagccacgcgc

SEQ ID NO: 395782 - RNA, 23 nt, Bordetella pertussis
cccagacgcagaccacgccggcg

SEQ ID NO: 395783 - RNA, 18 nt, Bordetella pertussis
cccagacuggcguaguag

SEQ ID NO: 395784 - RNA, 23 nt, Bordetella pertussis
cccagagcaccgagaccgggcgg

SEQ ID NO: 395785 - RNA, 15 nt, Bordetella pertussis
cccagauccagcuug

SEQ ID NO: 395786 - RNA, 18 nt, Bordetella pertussis
cccagaucgccugggggg

SEQ ID NO: 395787 - RNA, 23 nt, Bordetella pertussis
cccagcaauuaugcguggccgcc

SEQ ID NO: 395788 - RNA, 23 nt, Bordetella pertussis
cccagcacauagcgcaagcccgu

SEQ ID NO: 395789 - RNA, 16 nt, Bordetella pertussis
cccagcauccgcgcca

SEQ ID NO: 395790 - RNA, 19 nt, Bordetella pertussis
cccagcauccgcgccagga

SEQ ID NO: 395791 - RNA, 21 nt, Bordetella pertussis
cccagcaucugccccagcuug

SEQ ID NO: 395792 - RNA, 20 nt, Bordetella pertussis
cccagcaugugcgcggcguu

SEQ ID NO: 395793 - RNA, 13 nt, Bordetella pertussis
cccagccagcccu

SEQ ID NO: 395794 - RNA, 14 nt, Bordetella pertussis
cccagccagcccug

SEQ ID NO: 395795 - RNA, 18 nt, Bordetella pertussis
cccagccagcccuggccc

SEQ ID NO: 395796 - RNA, 15 nt, Bordetella pertussis
cccagccaggcgcca

SEQ ID NO: 395797 - RNA, 13 nt, Bordetella pertussis
cccagcuccagcu

SEQ ID NO: 395798 - RNA, 17 nt, Bordetella pertussis
cccagcuccagcuggcg

SEQ ID NO: 395799 - RNA, 19 nt, Bordetella pertussis
cccagcucugguccaggcg

SEQ ID NO: 395800 - RNA, 16 nt, Bordetella pertussis
cccagcugcuucaugc

SEQ ID NO: 395801 - RNA, 14 nt, Bordetella pertussis
cccagcugggccac

SEQ ID NO: 395802 - RNA, 18 nt, Bordetella pertussis
cccagcuugaugccgccg

SEQ ID NO: 395803 - RNA, 18 nt, Bordetella pertussis
cccaggaaaucaggcgca

SEQ ID NO: 395804 - RNA, 20 nt, Bordetella pertussis
cccaggaaaucaggcgcauc

SEQ ID NO: 395805 - RNA, 23 nt, Bordetella pertussis
cccaggaacuugaacggcgcggc

SEQ ID NO: 395806 - RNA, 12 nt, Bordetella pertussis
cccaggccggcg

SEQ ID NO: 395807 - RNA, 13 nt, Bordetella pertussis
cccaggccggcgc

SEQ ID NO: 395808 - RNA, 17 nt, Bordetella pertussis
cccaggccggcgccagc

SEQ ID NO: 395809 - RNA, 19 nt, Bordetella pertussis
cccaggccggcgccagccg

SEQ ID NO: 395810 - RNA, 19 nt, Bordetella pertussis
cccaggccgccggcggcgu

SEQ ID NO: 395811 - RNA, 16 nt, Bordetella pertussis
cccaggccggcucgcc

SEQ ID NO: 395812 - RNA, 17 nt, Bordetella pertussis
cccaggcgaugcccagc

SEQ ID NO: 395813 - RNA, 21 nt, Bordetella pertussis
cccaggcgaugcccagcgccg

SEQ ID NO: 395814 - RNA, 23 nt, Bordetella pertussis
cccaggcgaugcccagcgccgcc

SEQ ID NO: 395815 - RNA, 14 nt, Bordetella pertussis
cccaggcgcagccg

SEQ ID NO: 395816 - RNA, 16 nt, Bordetella pertussis
cccaggcgacccagca

SEQ ID NO: 395817 - RNA, 11 nt, Bordetella pertussis
cccaggcgcgu

SEQ ID NO: 395818 - RNA, 18 nt, Bordetella pertussis
cccaggcgcucagccgug

SEQ ID NO: 395819 - RNA, 21 nt, Bordetella pertussis
cccaggcggcaggcgccgccg

SEQ ID NO: 395820 - RNA, 13 nt, Bordetella pertussis
cccaggcgggcca

SEQ ID NO: 395821 - RNA, 18 nt, Bordetella pertussis
cccaggcguccaggcugc

SEQ ID NO: 395822 - RNA, 19 nt, Bordetella pertussis
cccaggcguccaggcugcc

SEQ ID NO: 395823 - RNA, 16 nt, Bordetella pertussis
cccaggcgggcgugcu

SEQ ID NO: 395824 - RNA, 17 nt, Bordetella pertussis
cccaggcgggcuggcgu

SEQ ID NO: 395825 - RNA, 17 nt, Bordetella pertussis
cccagguugaaggccgc

SEQ ID NO: 395826 - RNA, 17 nt, Bordetella pertussis
cccagguugcggccgcc

SEQ ID NO: 395827 - RNA, 18 nt, Bordetella pertussis
cccagguugcggccgcca

SEQ ID NO: 395828 - RNA, 21 nt, Bordetella pertussis
cccaguauggugaccggcgug

SEQ ID NO: 395829 - RNA, 15 nt, Bordetella pertussis
cccaguccagggugu

SEQ ID NO: 395830 - RNA, 16 nt, Bordetella pertussis
cccaguccggcagcac

SEQ ID NO: 395831 - RNA, 19 nt, Bordetella pertussis
cccaguccggcagcaccca

SEQ ID NO: 395832 - RNA, 20 nt, Bordetella pertussis
cccaguccggcagcacccag

SEQ ID NO: 395833 - RNA, 16 nt, Bordetella pertussis
cccagucgccgcgccc

SEQ ID NO: 395834 - RNA, 18 nt, Bordetella pertussis
cccaguuccacgcggccg

SEQ ID NO: 395835 - RNA, 17 nt, Bordetella pertussis
cccaguucgcggccggc

SEQ ID NO: 395836 - RNA, 17 nt, Bordetella pertussis
cccaguucggccgccag

SEQ ID NO: 395837 - RNA, 16 nt, Bordetella pertussis
cccaguugcgcgucca

SEQ ID NO: 395838 - RNA, 17 nt, Bordetella pertussis
cccaguugcgcguccag

SEQ ID NO: 395839 - RNA, 18 nt, Bordetella pertussis
cccaguugcgcguccagg

SEQ ID NO: 395840 - RNA, 19 nt, Bordetella pertussis
cccaguugcgcguccaggc

SEQ ID NO: 395841 - RNA, 14 nt, Bordetella pertussis
cccaguugcuggcc

SEQ ID NO: 395842 - RNA, 15 nt, Bordetella pertussis
cccaguugcuggccc

SEQ ID NO: 395843 - RNA, 17 nt, Bordetella pertussis
cccauaugccgccggcc

SEQ ID NO: 395844 - RNA, 23 nt, Bordetella pertussis
cccaucauguuguagugcuccac

SEQ ID NO: 395845 - RNA, 14 nt, Bordetella pertussis
cccaucccauccgc

SEQ ID NO: 395846 - RNA, 23 nt, Bordetella pertussis
cccauccucaucgugcucgugcu

SEQ ID NO: 395847 - RNA, 16 nt, Bordetella pertussis
cccaucucggccgcgg

SEQ ID NO: 395848 - RNA, 23 nt, Bordetella pertussis
cccaucugguugagcagcaccug

SEQ ID NO: 395849 - RNA, 20 nt, Bordetella pertussis
cccaugaacacuugacggcc

SEQ ID NO: 395850 - RNA, 18 nt, Bordetella pertussis
cccaugaaggcggccagc

SEQ ID NO: 395851 - RNA, 16 nt, Bordetella pertussis
cccaugaccggcgugu

SEQ ID NO: 395852 - RNA, 20 nt, Bordetella pertussis
cccauugcggcaccugcugc

SEQ ID NO: 395853 - RNA, 19 nt, Bordetella pertussis
cccauugggacgccagccc

SEQ ID NO: 395854 - RNA, 20 nt, Bordetella pertussis
ccccagcgccgucagcagcg

SEQ ID NO: 395855 - RNA, 14 nt, Bordetella pertussis
ccccagcggcgcac

SEQ ID NO: 395856 - RNA, 20 nt, Bordetella pertussis
ccccagcuugucggccgcgc

SEQ ID NO: 395857 - RNA, 12 nt, Bordetella pertussis
ccccaggcgccc

SEQ ID NO: 395858 - RNA, 21 nt, Bordetella pertussis
ccccaggcgcccgagagcugc

SEQ ID NO: 395859 - RNA, 16 nt, Bordetella pertussis
ccccaggcgucggcgg

SEQ ID NO: 395860 - RNA, 12 nt, Bordetella pertussis
ccccaggggacg

SEQ ID NO: 395861 - RNA, 18 nt, Bordetella pertussis
ccccaguccaggccggcc

SEQ ID NO: 395862 - RNA, 13 nt, Bordetella pertussis
ccccagucgcugc

SEQ ID NO: 395863 - RNA, 15 nt, Bordetella pertussis
ccccagucgcugcuc

SEQ ID NO: 395864 - RNA, 12 nt, Bordetella pertussis
ccccaguugcgc

SEQ ID NO: 395865 - RNA, 22 nt, Bordetella pertussis
ccccaguugcgcguccaggcgg

SEQ ID NO: 395866 - RNA, 14 nt, Bordetella pertussis
ccccaucaccaugg

SEQ ID NO: 395867 - RNA, 13 nt, Bordetella pertussis
ccccauccagcgg

SEQ ID NO: 395868 - RNA, 19 nt, Bordetella pertussis
ccccauccagcggacgggc

SEQ ID NO: 395869 - RNA, 16 nt, Bordetella pertussis
ccccaucaucugcggc

SEQ ID NO: 395870 - RNA, 19 nt, Bordetella pertussis
ccccaugcggggacaggca

SEQ ID NO: 395871 - RNA, 14 nt, Bordetella pertussis
ccccauggcaugca

SEQ ID NO: 395872 - RNA, 23 nt, Bordetella pertussis
ccccauggggacuggcaccugca

SEQ ID NO: 395873 - RNA, 23 nt, Bordetella pertussis
ccccaugucgaucuggcucacga

SEQ ID NO: 395874 - RNA, 18 nt, Bordetella pertussis
cccccgcgcugcgcccgc

SEQ ID NO: 395875 - RNA, 22 nt, Bordetella pertussis
cccccgcgucggacgcgcgccg

SEQ ID NO: 395876 - RNA, 20 nt, Bordetella pertussis
cccccuacgaauccccgcuc

SEQ ID NO: 395877 - RNA, 13 nt, Bordetella pertussis
cccccuacugccc

SEQ ID NO: 395878 - RNA, 21 nt, Bordetella pertussis
ccccgaacggggacuggcacc

SEQ ID NO: 395879 - RNA, 21 nt, Bordetella pertussis
ccccgaagcacagaugcacca

SEQ ID NO: 395880 - RNA, 16 nt, Bordetella pertussis
ccccgaaggccgcgcc

SEQ ID NO: 395881 - RNA, 14 nt, Bordetella pertussis
ccccgaccgagcca

SEQ ID NO: 395882 - RNA, 17 nt, Bordetella pertussis
ccccgacgcgcuuccag

SEQ ID NO: 395883 - RNA, 18 nt, Bordetella pertussis
ccccggcaccaucgccgc

SEQ ID NO: 395884 - RNA, 23 nt, Bordetella pertussis
ccccggcagcgucaauccgccgc

SEQ ID NO: 395885 - RNA, 21 nt, Bordetella pertussis
ccccggcccggcgggccggcu

SEQ ID NO: 395886 - RNA, 22 nt, Bordetella pertussis
ccccgggcgggcacaacccgcc

SEQ ID NO: 395887 - RNA, 18 nt, Bordetella pertussis
ccccgguagucgccggcu

SEQ ID NO: 395888 - RNA, 20 nt, Bordetella pertussis
ccccggugucgccguggcgg

SEQ ID NO: 395889 - RNA, 19 nt, Bordetella pertussis
ccccgucaucgggugcggc

SEQ ID NO: 395890 - RNA, 12 nt, Bordetella pertussis
ccccgucggccg

SEQ ID NO: 395891 - RNA, 19 nt, Bordetella pertussis
ccccgucggcggcaagcag

SEQ ID NO: 395892 - RNA, 13 nt, Bordetella pertussis
ccccgugcaccau

SEQ ID NO: 395893 - RNA, 15 nt, Bordetella pertussis
ccccguucggggaca

SEQ ID NO: 395894 - RNA, 15 nt, Bordetella pertussis
ccccuagcgccgcgc

SEQ ID NO: 395895 - RNA, 18 nt, Bordetella pertussis
ccccugguacgaucaggc

SEQ ID NO: 395896 - RNA, 14 nt, Bordetella pertussis
ccccuuccacccgc

SEQ ID NO: 395897 - RNA, 24 nt, Bordetella pertussis
cccucgggcgacaggcgcgcccgc

SEQ ID NO: 395898 - RNA, 21 nt, Bordetella pertussis
cccucgggugccuguccccac

SEQ ID NO: 395899 - RNA, 22 nt, Bordetella pertussis
cccucgggugccuguccccaca

SEQ ID NO: 395900 - RNA, 13 nt, Bordetella pertussis
cccucggugcugc

SEQ ID NO: 395901 - RNA, 17 nt, Bordetella pertussis
cccucggugcugcuguu

SEQ ID NO: 395902 - RNA, 15 nt, Bordetella pertussis
cccucgucgcggccg

SEQ ID NO: 395903 - RNA, 21 nt, Bordetella pertussis
cccucgugaucgaccgccagc

SEQ ID NO: 395904 - RNA, 21 nt, Bordetella pertussis
cccucguugacgccgacgaug

SEQ ID NO: 395905 - RNA, 21 nt, Bordetella pertussis
cccucuucggcggccagccgg

SEQ ID NO: 395906 - RNA, 18 nt, Bordetella pertussis
cccugacccgcuggcugg

SEQ ID NO: 395907 - RNA, 15 nt, Bordetella pertussis
cccugcaugaccgcc

SEQ ID NO: 395908 - RNA, 22 nt, Bordetella pertussis
cccugcaugaccgccgccagca

SEQ ID NO: 395909 - RNA, 23 nt, Bordetella pertussis
cccugccaauagcgguggcgggc

SEQ ID NO: 395910 - RNA, 17 nt, Bordetella pertussis
cccugcccauucccgcc

SEQ ID NO: 395911 - RNA, 20 nt, Bordetella pertussis
cccugcccauucccgcccug

SEQ ID NO: 395912 - RNA, 18 nt, Bordetella pertussis
cccugccccaucccaucc

SEQ ID NO: 395913 - RNA, 12 nt, Bordetella pertussis
cccugcccggcg

SEQ ID NO: 395914 - RNA, 21 nt, Bordetella pertussis
cccugcccgucuauggccugc

SEQ ID NO: 395915 - RNA, 17 nt, Bordetella pertussis
cccugccgcccuggcgc

SEQ ID NO: 395916 - RNA, 21 nt, Bordetella pertussis
cccugccgggacaggcacccu

SEQ ID NO: 395917 - RNA, 19 nt, Bordetella pertussis
cccugccgugggacaggca

SEQ ID NO: 395918 - RNA, 16 nt, Bordetella pertussis
cccugccuacuugcgg

SEQ ID NO: 395919 - RNA, 12 nt, Bordetella pertussis
cccugccuccag

SEQ ID NO: 395920 - RNA, 13 nt, Bordetella pertussis
cccugcgcacccg

SEQ ID NO: 395921 - RNA, 15 nt, Bordetella pertussis
cccugcgcacccgcc

SEQ ID NO: 395922 - RNA, 16 nt, Bordetella pertussis
cccugcgccagcgccu

SEQ ID NO: 395923 - RNA, 19 nt, Bordetella pertussis
cccugcgccagcgccucgc

SEQ ID NO: 395924 - RNA, 15 nt, Bordetella pertussis
cccugcgcgccgccg

SEQ ID NO: 395925 - RNA, 22 nt, Bordetella pertussis
cccugcgcguacguggcgcggc

SEQ ID NO: 395926 - RNA, 22 nt, Bordetella pertussis
cccugcgcguugagcagcaugu

SEQ ID NO: 395927 - RNA, 22 nt, Bordetella pertussis
cccugcgcugcauacgccgcug

SEQ ID NO: 395928 - RNA, 14 nt, Bordetella pertussis
cccugcgggccgcu

SEQ ID NO: 395929 - RNA, 20 nt, Bordetella pertussis
cccugcggggacaggcaccc

SEQ ID NO: 395930 - RNA, 13 nt, Bordetella pertussis
cccugcgggggca

SEQ ID NO: 395931 - RNA, 15 nt, Bordetella pertussis
cccugcgggggcagg

SEQ ID NO: 395932 - RNA, 16 nt, Bordetella pertussis
cccugcgggggcaggc

SEQ ID NO: 395933 - RNA, 17 nt, Bordetella pertussis
cccugcggcgcggccag

SEQ ID NO: 395934 - RNA, 21 nt, Bordetella pertussis
cccugcggcgcggccagcacg

SEQ ID NO: 395935 - RNA, 15 nt, Bordetella pertussis
cccugcguggcgcag

SEQ ID NO: 395936 - RNA, 15 nt, Bordetella pertussis
cccugcgugugccug

SEQ ID NO: 395937 - RNA, 14 nt, Bordetella pertussis
cccugcucgcgcag

SEQ ID NO: 395938 - RNA, 17 nt, Bordetella pertussis
cccugcucuacaccauc

SEQ ID NO: 395939 - RNA, 18 nt, Bordetella pertussis
cccugcugcccgccgccg

SEQ ID NO: 395940 - RNA, 20 nt, Bordetella pertussis
cccugcuugagcgaaauggc

SEQ ID NO: 395941 - RNA, 22 nt, Bordetella pertussis
cccuggagaucgccgccgaagc

SEQ ID NO: 395942 - RNA, 19 nt, Bordetella pertussis
cccuggauggcggccgcca

SEQ ID NO: 395943 - RNA, 20 nt, Bordetella pertussis
cccuggauggcggccgccag

SEQ ID NO: 395944 - RNA, 16 nt, Bordetella pertussis
cccuggauggccuggg

SEQ ID NO: 395945 - RNA, 14 nt, Bordetella pertussis
cccuggcagcuggc

SEQ ID NO: 395946 - RNA, 18 nt, Bordetella pertussis
cccuggccacgcugcugc

SEQ ID NO: 395947 - RNA, 23 nt, Bordetella pertussis
cccuggccauuccuuccgggccc

SEQ ID NO: 395948 - RNA, 14 nt, Bordetella pertussis
cccuggccgcgccg

SEQ ID NO: 395949 - RNA, 20 nt, Bordetella pertussis
cccuggccuucgaccugccc

SEQ ID NO: 395950 - RNA, 15 nt, Bordetella pertussis
cccuggcgcaggccg

SEQ ID NO: 395951 - RNA, 18 nt, Bordetella pertussis
cccuggcgcaggccggcg

SEQ ID NO: 395952 - RNA, 16 nt, Bordetella pertussis
cccuggcgcgaggcgg

SEQ ID NO: 395953 - RNA, 16 nt, Bordetella pertussis
cccuggcguggcgcgc

SEQ ID NO: 395954 - RNA, 19 nt, Bordetella pertussis
cccuggcugagcgacaugu

SEQ ID NO: 395955 - RNA, 13 nt, Bordetella pertussis
cccugggccagca

SEQ ID NO: 395956 - RNA, 13 nt, Bordetella pertussis
cccugggccagcc

SEQ ID NO: 395957 - RNA, 23 nt, Bordetella pertussis
cccugggccagccagcgccgcag

SEQ ID NO: 395958 - RNA, 23 nt, Bordetella pertussis
cccugggcgagguagggcgcggc

SEQ ID NO: 395959 - RNA, 15 nt, Bordetella pertussis
cccuggguggcgggg

SEQ ID NO: 395960 - RNA, 15 nt, Bordetella pertussis
cccuggucaucgcca

SEQ ID NO: 395961 - RNA, 18 nt, Bordetella pertussis
cccuguacaagcgcacgc

SEQ ID NO: 395962 - RNA, 17 nt, Bordetella pertussis
cccuguccucgcaggaa

SEQ ID NO: 395963 - RNA, 19 nt, Bordetella pertussis
cccuguccucgcaggaauc

SEQ ID NO: 395964 - RNA, 14 nt, Bordetella pertussis
cccugucggccgaa

SEQ ID NO: 395965 - RNA, 22 nt, Bordetella pertussis
cccuguguccacgaacgcgauu

SEQ ID NO: 395966 - RNA, 20 nt, Bordetella pertussis
cccuucgcgcagcaacccgc

SEQ ID NO: 395967 - RNA, 21 nt, Bordetella pertussis
cccuucgcgcagcaacccgcc

SEQ ID NO: 395968 - RNA, 19 nt, Bordetella pertussis
cccuugagcaaucaagggc

SEQ ID NO: 395969 - RNA, 19 nt, Bordetella pertussis
cccuugaucagcggcggca

SEQ ID NO: 395970 - RNA, 19 nt, Bordetella pertussis
cccuugcccaacgcggcgu

SEQ ID NO: 395971 - RNA, 11 nt, Bordetella pertussis
cccuugccgcc

SEQ ID NO: 395972 - RNA, 22 nt, Bordetella pertussis
ccgaaccagcgcaccaccagca

SEQ ID NO: 395973 - RNA, 17 nt, Bordetella pertussis
ccgaaccgaccgccacg

SEQ ID NO: 395974 - RNA, 17 nt, Bordetella pertussis
ccgaaccgauccagccc

SEQ ID NO: 395975 - RNA, 17 nt, Bordetella pertussis
ccgaacugggcgcgucg

SEQ ID NO: 395976 - RNA, 15 nt, Bordetella pertussis
ccgaagcacagaugc

SEQ ID NO: 395977 - RNA, 20 nt, Bordetella pertussis
ccgaagugucagguuagcgg

SEQ ID NO: 395978 - RNA, 18 nt, Bordetella pertussis
ccgaaguugcggccgugc

SEQ ID NO: 395979 - RNA, 20 nt, Bordetella pertussis
ccgacgagaaugcgccgucc

SEQ ID NO: 395980 - RNA, 19 nt, Bordetella pertussis
ccgacgaggagccggcggg

SEQ ID NO: 395981 - RNA, 19 nt, Bordetella pertussis
ccgacgaugaucaugauga

SEQ ID NO: 395982 - RNA, 15 nt, Bordetella pertussis
ccgacgaugccgccc

SEQ ID NO: 395983 - RNA, 16 nt, Bordetella pertussis
ccgacgaugccggucu

SEQ ID NO: 395984 - RNA, 19 nt, Bordetella pertussis
ccgacgaugccggucucca

SEQ ID NO: 395985 - RNA, 14 nt, Bordetella pertussis
ccgacgaugucgcc

SEQ ID NO: 395986 - RNA, 16 nt, Bordetella pertussis
ccgacgaugucgccgc

SEQ ID NO: 395987 - RNA, 18 nt, Bordetella pertussis
ccgacgaugucgccgccg

SEQ ID NO: 395988 - RNA, 20 nt, Bordetella pertussis
ccgacgcgaggcagaagugg

SEQ ID NO: 395989 - RNA, 16 nt, Bordetella pertussis
ccgacgcggccagcgg

SEQ ID NO: 395990 - RNA, 19 nt, Bordetella pertussis
ccgacgcggccagcggcgc

SEQ ID NO: 395991 - RNA, 20 nt, Bordetella pertussis
ccgacgcgcugguccgccgc

SEQ ID NO: 395992 - RNA, 17 nt, Bordetella pertussis
ccgacgugcugcugcac

SEQ ID NO: 395993 - RNA, 21 nt, Bordetella pertussis
ccgacuaugcuuuacccugaa

SEQ ID NO: 395994 - RNA, 16 nt, Bordetella pertussis
ccgagaacgccgucgg

SEQ ID NO: 395995 - RNA, 14 nt, Bordetella pertussis
ccgagaccgcccgc

SEQ ID NO: 395996 - RNA, 15 nt, Bordetella pertussis
ccgagaccgggcggu

SEQ ID NO: 395997 - RNA, 16 nt, Bordetella pertussis
ccgagaccgggcggua

SEQ ID NO: 395998 - RNA, 14 nt, Bordetella pertussis
ccgagaugccguuc

SEQ ID NO: 395999 - RNA, 12 nt, Bordetella pertussis
ccgagcacagca

SEQ ID NO: 396000 - RNA, 22 nt, Bordetella pertussis
ccgagcacagcaacucuucccc

SEQ ID NO: 396001 - RNA, 17 nt, Bordetella pertussis
ccgagccgcagguccag

SEQ ID NO: 396002 - RNA, 13 nt, Bordetella pertussis
ccgagccgguggg

SEQ ID NO: 396003 - RNA, 20 nt, Bordetella pertussis
ccgagccggugggcgcguuc

SEQ ID NO: 396004 - RNA, 14 nt, Bordetella pertussis
ccgagcgcgagcag

SEQ ID NO: 396005 - RNA, 23 nt, Bordetella pertussis
ccgagcugccgccuucgucgcgc

SEQ ID NO: 396006 - RNA, 18 nt, Bordetella pertussis
ccgaggcgccccagagca

SEQ ID NO: 396007 - RNA, 21 nt, Bordetella pertussis
ccgaggcgccccagagcaccg

SEQ ID NO: 396008 - RNA, 13 nt, Bordetella pertussis
ccgaggcgccgcc

SEQ ID NO: 396009 - RNA, 19 nt, Bordetella pertussis
ccgaggcgccgccgugcgc

SEQ ID NO: 396010 - RNA, 19 nt, Bordetella pertussis
ccgaggcggucgaugaagc

SEQ ID NO: 396011 - RNA, 19 nt, Bordetella pertussis
ccgaggcuucgauggcggc

SEQ ID NO: 396012 - RNA, 22 nt, Bordetella pertussis
ccgaggcuucgauggcggcggc

SEQ ID NO: 396013 - RNA, 21 nt, Bordetella pertussis
ccgagggccggacuggcgcgc

SEQ ID NO: 396014 - RNA, 17 nt, Bordetella pertussis
ccgagggcgcggcgccg

SEQ ID NO: 396015 - RNA, 18 nt, Bordetella pertussis
ccgagggcgcguccaagc

SEQ ID NO: 396016 - RNA, 23 nt, Bordetella pertussis
ccgaguggaugcgcuugccgccc

SEQ ID NO: 396017 - RNA, 23 nt, Bordetella pertussis
ccgaguugaggaugcgcgcggcc

SEQ ID NO: 396018 - RNA, 24 nt, Bordetella pertussis
ccgaguugaggaugcgcgcggcca

SEQ ID NO: 396019 - RNA, 18 nt, Bordetella pertussis
ccgaucaccacgggcacg

SEQ ID NO: 396020 - RNA, 13 nt, Bordetella pertussis
ccgaucagcaagg

SEQ ID NO: 396021 - RNA, 18 nt, Bordetella pertussis
ccgaucgcggcuccagcu

SEQ ID NO: 396022 - RNA, 22 nt, Bordetella pertussis
ccgaugaacgacaggguccagg

SEQ ID NO: 396023 - RNA, 16 nt, Bordetella pertussis
ccgaugaccggccagg

SEQ ID NO: 396024 - RNA, 17 nt, Bordetella pertussis
ccgaugacggggcggcg

SEQ ID NO: 396025 - RNA, 22 nt, Bordetella pertussis
ccgaugauggauucgcgccggc

SEQ ID NO: 396026 - RNA, 20 nt, Bordetella pertussis
ccgaugauggugaacgccac

SEQ ID NO: 396027 - RNA, 13 nt, Bordetella pertussis
ccgaugccgcgca

SEQ ID NO: 396028 - RNA, 19 nt, Bordetella pertussis
ccgaugccuuggugggguc

SEQ ID NO: 396029 - RNA, 15 nt, Bordetella pertussis
ccgauggugccgggc

SEQ ID NO: 396030 - RNA, 20 nt, Bordetella pertussis
ccgaugucgaacagcugcag

SEQ ID NO: 396031 - RNA, 15 nt, Bordetella pertussis
ccgaugucgccgccu

SEQ ID NO: 396032 - RNA, 23 nt, Bordetella pertussis
ccgauguuguuggccgccagccg

SEQ ID NO: 396033 - RNA, 14 nt, Bordetella pertussis
ccgauguuuuccug

SEQ ID NO: 396034 - RNA, 14 nt, Bordetella pertussis
ccgauuucgccgcc

SEQ ID NO: 396035 - RNA, 15 nt, Bordetella pertussis
ccgauuucgccgccg

SEQ ID NO: 396036 - RNA, 17 nt, Bordetella pertussis
ccgauuucggccgccgg

SEQ ID NO: 396037 - RNA, 21 nt, Bordetella pertussis
ccgcaaaaccgggcccggauc

SEQ ID NO: 396038 - RNA, 22 nt, Bordetella pertussis
ccgcaaaccugaugccuguccc

SEQ ID NO: 396039 - RNA, 23 nt, Bordetella pertussis
ccgcaacccacccccagcagcau

SEQ ID NO: 396040 - RNA, 21 nt, Bordetella pertussis
ccgcaacccagcagcggcagc

SEQ ID NO: 396041 - RNA, 14 nt, Bordetella pertussis
ccgcaacgccgccc

SEQ ID NO: 396042 - RNA, 15 nt, Bordetella pertussis
ccgcaacgccgccgg

SEQ ID NO: 396043 - RNA, 16 nt, Bordetella pertussis
ccgcaacgccgccggc

SEQ ID NO: 396044 - RNA, 18 nt, Bordetella pertussis
ccgcaacgccgggccgcg

SEQ ID NO: 396045 - RNA, 12 nt, Bordetella pertussis
ccgcaagcuggc

SEQ ID NO: 396046 - RNA, 19 nt, Bordetella pertussis
ccgcaaggaaguggccgag

SEQ ID NO: 396047 - RNA, 20 nt, Bordetella pertussis
ccgcaagggggacuggcacc

SEQ ID NO: 396048 - RNA, 23 nt, Bordetella pertussis
ccgcaagggggacuggcaccggc

SEQ ID NO: 396049 - RNA, 20 nt, Bordetella pertussis
ccgcaauaccuucagcccgg

SEQ ID NO: 396050 - RNA, 22 nt, Bordetella pertussis
ccgcaauagaucauccaggugg

SEQ ID NO: 396051 - RNA, 19 nt, Bordetella pertussis
ccgcaccaggccgcggcgc

SEQ ID NO: 396052 - RNA, 11 nt, Bordetella pertussis
ccgcaccaugc

SEQ ID NO: 396053 - RNA, 22 nt, Bordetella pertussis
ccgcacccgaugacggggcggc

SEQ ID NO: 396054 - RNA, 16 nt, Bordetella pertussis
ccgcacgggccgacgg

SEQ ID NO: 396055 - RNA, 21 nt, Bordetella pertussis
ccgcacgggccgacggccucg

SEQ ID NO: 396056 - RNA, 19 nt, Bordetella pertussis
ccgcacggggacuggcacg

SEQ ID NO: 396057 - RNA, 16 nt, Bordetella pertussis
ccgcacggggagcgac

SEQ ID NO: 396058 - RNA, 20 nt, Bordetella pertussis
ccgcacgguggcgccgucgc

SEQ ID NO: 396059 - RNA, 15 nt, Bordetella pertussis
ccgcacuucgggcca

SEQ ID NO: 396060 - RNA, 22 nt, Bordetella pertussis
ccgcacuucgggccacccgccg

SEQ ID NO: 396061 - RNA, 20 nt, Bordetella pertussis
ccgcagcaccacaucgccgg

SEQ ID NO: 396062 - RNA, 23 nt, Bordetella pertussis
ccgcagcaguucggucagcgcgg

SEQ ID NO: 396063 - RNA, 15 nt, Bordetella pertussis
ccgcagcauggcgcc

SEQ ID NO: 396064 - RNA, 17 nt, Bordetella pertussis
ccgcagcauggcgccag

SEQ ID NO: 396065 - RNA, 16 nt, Bordetella pertussis
ccgcagccgccagcgc

SEQ ID NO: 396066 - RNA, 20 nt, Bordetella pertussis
ccgcagccgccagcgccugg

SEQ ID NO: 396067 - RNA, 19 nt, Bordetella pertussis
ccgcagcgucgcggcgucg

SEQ ID NO: 396068 - RNA, 17 nt, Bordetella pertussis
ccgcaggagcaugcccu

SEQ ID NO: 396069 - RNA, 19 nt, Bordetella pertussis
ccgcaggcaagcugcuggc

SEQ ID NO: 396070 - RNA, 16 nt, Bordetella pertussis
ccgcaggcauugcgcc

SEQ ID NO: 396071 - RNA, 14 nt, Bordetella pertussis
ccgcaggccguugg

SEQ ID NO: 396072 - RNA, 19 nt, Bordetella pertussis
ccgcaggcggcggccucca

SEQ ID NO: 396073 - RNA, 15 nt, Bordetella pertussis
ccgcaggugccuguc

SEQ ID NO: 396074 - RNA, 17 nt, Bordetella pertussis
ccgcaggugccuguccc

SEQ ID NO: 396075 - RNA, 18 nt, Bordetella pertussis
ccgcaguauuccugcugg

SEQ ID NO: 396076 - RNA, 22 nt, Bordetella pertussis
ccgcaguauuccugcugguaga

SEQ ID NO: 396077 - RNA, 21 nt, Bordetella pertussis
ccgcauaccuuggcgcccagc

SEQ ID NO: 396078 - RNA, 23 nt, Bordetella pertussis
ccgccaucgucguagcgccagcg

SEQ ID NO: 396079 - RNA, 14 nt, Bordetella pertussis
ccgccaugcgcaug

SEQ ID NO: 396080 - RNA, 20 nt, Bordetella pertussis
ccgccaugcgcauggccagc

SEQ ID NO: 396081 - RNA, 15 nt, Bordetella pertussis
ccgccaugcgccagc

SEQ ID NO: 396082 - RNA, 19 nt, Bordetella pertussis
ccgccaugcgccagcagga

SEQ ID NO: 396083 - RNA, 14 nt, Bordetella pertussis
ccgccaugcggcgc

SEQ ID NO: 396084 - RNA, 16 nt, Bordetella pertussis
ccgccaugcggcgcca

SEQ ID NO: 396085 - RNA, 16 nt, Bordetella pertussis
ccgccaugcagcugga

SEQ ID NO: 396086 - RNA, 14 nt, Bordetella pertussis
ccgccauggccggc

SEQ ID NO: 396087 - RNA, 16 nt, Bordetella pertussis
ccgccauggcggccgc

SEQ ID NO: 396088 - RNA, 15 nt, Bordetella pertussis
ccgccauggcggcgc

SEQ ID NO: 396089 - RNA, 17 nt, Bordetella pertussis
ccgccauggcggcgccc

SEQ ID NO: 396090 - RNA, 18 nt, Bordetella pertussis
ccgccauggcggcgccca

SEQ ID NO: 396091 - RNA, 23 nt, Bordetella pertussis
ccgccauggugccgcgcaggccc

SEQ ID NO: 396092 - RNA, 21 nt, Bordetella pertussis
ccgccauguauaacguggcgc

SEQ ID NO: 396093 - RNA, 19 nt, Bordetella pertussis
ccgccauugcacgcgcagg

SEQ ID NO: 396094 - RNA, 11 nt, Bordetella pertussis
ccgcccaggcg

SEQ ID NO: 396095 - RNA, 12 nt, Bordetella pertussis
ccgcccaggcgc

SEQ ID NO: 396096 - RNA, 16 nt, Bordetella pertussis
ccgcccaggcgcagcc

SEQ ID NO: 396097 - RNA, 20 nt, Bordetella pertussis
ccgcccaggugcgggagccg

SEQ ID NO: 396098 - RNA, 22 nt, Bordetella pertussis
ccgcccaggugcgggagccggc

SEQ ID NO: 396099 - RNA, 14 nt, Bordetella pertussis
ccgccccagcagca

SEQ ID NO: 396100 - RNA, 15 nt, Bordetella pertussis
ccgccccagcagcag

SEQ ID NO: 396101 - RNA, 23 nt, Bordetella pertussis
ccgccccggcgcggcgcgcgccg

SEQ ID NO: 396102 - RNA, 12 nt, Bordetella pertussis
ccgccccgggca

SEQ ID NO: 396103 - RNA, 15 nt, Bordetella pertussis
ccgccccgugcacca

SEQ ID NO: 396104 - RNA, 20 nt, Bordetella pertussis
ccgcccgaaagguccuggag

SEQ ID NO: 396105 - RNA, 14 nt, Bordetella pertussis
ccgcccgcaggcau

SEQ ID NO: 396106 - RNA, 23 nt, Bordetella pertussis
ccgcccgcaggcauugcgccagc

SEQ ID NO: 396107 - RNA, 21 nt, Bordetella pertussis
ccgcccgcaugucccagcgcu

SEQ ID NO: 396108 - RNA, 14 nt, Bordetella pertussis
ccgcccgggccggc

SEQ ID NO: 396109 - RNA, 15 nt, Bordetella pertussis
ccgcccggggccaug

SEQ ID NO: 396110 - RNA, 16 nt, Bordetella pertussis
ccgcccguccgggcgg

SEQ ID NO: 396111 - RNA, 12 nt, Bordetella pertussis
ccgcccugcccg

SEQ ID NO: 396112 - RNA, 18 nt, Bordetella pertussis
ccgcccugccgccaaggg

SEQ ID NO: 396113 - RNA, 22 nt, Bordetella pertussis
ccgcccuggccgcgccguucgg

SEQ ID NO: 396114 - RNA, 16 nt, Bordetella pertussis
ccgccgaagccgccgc

SEQ ID NO: 396115 - RNA, 18 nt, Bordetella pertussis
ccgccgacguagucgcgc

SEQ ID NO: 396116 - RNA, 22 nt, Bordetella pertussis
ccgccgacguagucgcgccagc

SEQ ID NO: 396117 - RNA, 16 nt, Bordetella pertussis
ccgccgcagccgccag

SEQ ID NO: 396118 - RNA, 16 nt, Bordetella pertussis
ccgccgccaccagcgg

SEQ ID NO: 396119 - RNA, 15 nt, Bordetella pertussis
ccgccgccagcagcg

SEQ ID NO: 396120 - RNA, 19 nt, Bordetella pertussis
ccgccgcgauugcaggugg

SEQ ID NO: 396121 - RNA, 15 nt, Bordetella pertussis
ccgccgcgcccagca

SEQ ID NO: 396122 - RNA, 18 nt, Bordetella pertussis
ccgccgcgcccagcagcg

SEQ ID NO: 396123 - RNA, 22 nt, Bordetella pertussis
ccgccgcgcccggaucaguccg

SEQ ID NO: 396124 - RNA, 15 nt, Bordetella pertussis
ccgccgcgccggugg

SEQ ID NO: 396125 - RNA, 21 nt, Bordetella pertussis
ccgccgcgccgguggccagca

SEQ ID NO: 396126 - RNA, 21 nt, Bordetella pertussis
ccgccgcgcucaccgagggcc

SEQ ID NO: 396127 - RNA, 18 nt, Bordetella pertussis
ccgccgcggccagcgccg

SEQ ID NO: 396128 - RNA, 19 nt, Bordetella pertussis
ccgccgcggccagcgccgc

SEQ ID NO: 396129 - RNA, 14 nt, Bordetella pertussis
ccgccgcggccucg

SEQ ID NO: 396130 - RNA, 14 nt, Bordetella pertussis
ccgccggacggcgc

SEQ ID NO: 396131 - RNA, 15 nt, Bordetella pertussis
ccgccggacggcgcc

SEQ ID NO: 396132 - RNA, 16 nt, Bordetella pertussis
ccgccggacggcgccu

SEQ ID NO: 396133 - RNA, 15 nt, Bordetella pertussis
ccgccggcagggcca

SEQ ID NO: 396134 - RNA, 18 nt, Bordetella pertussis
ccgccggcagggccagcg

SEQ ID NO: 396135 - RNA, 20 nt, Bordetella pertussis
ccgccggcagggccagcgcc

SEQ ID NO: 396136 - RNA, 15 nt, Bordetella pertussis
ccgccggcagugccu

SEQ ID NO: 396137 - RNA, 15 nt, Bordetella pertussis
ccgccggccaccagc

SEQ ID NO: 396138 - RNA, 16 nt, Bordetella pertussis
ccgccggccaccagcg

SEQ ID NO: 396139 - RNA, 15 nt, Bordetella pertussis
ccgccggccagccug

SEQ ID NO: 396140 - RNA, 13 nt, Bordetella pertussis
ccgccggccagcg

SEQ ID NO: 396141 - RNA, 13 nt, Bordetella pertussis
ccgccggcccagg

SEQ ID NO: 396142 - RNA, 22 nt, Bordetella pertussis
ccgccggccucuucgucgccgg

SEQ ID NO: 396143 - RNA, 20 nt, Bordetella pertussis
ccgccggcgauauggccagg

SEQ ID NO: 396144 - RNA, 13 nt, Bordetella pertussis
ccgccggcgcgcg

SEQ ID NO: 396145 - RNA, 14 nt, Bordetella pertussis
ccgccggcgcgcgc

SEQ ID NO: 396146 - RNA, 14 nt, Bordetella pertussis
ccgccggcgcggcu

SEQ ID NO: 396147 - RNA, 17 nt, Bordetella pertussis
ccgccggcgcggcugcu

SEQ ID NO: 396148 - RNA, 23 nt, Bordetella pertussis
ccgccggcggccuggaccugagc

SEQ ID NO: 396149 - RNA, 15 nt, Bordetella pertussis
ccgccggcggcgucg

SEQ ID NO: 396150 - RNA, 16 nt, Bordetella pertussis
ccgccggcggcgugcc

SEQ ID NO: 396151 - RNA, 11 nt, Bordetella pertussis
ccgccggcgug

SEQ ID NO: 396152 - RNA, 13 nt, Bordetella pertussis
ccgccgggacagg

SEQ ID NO: 396153 - RNA, 16 nt, Bordetella pertussis
ccgccgggacaggcac

SEQ ID NO: 396154 - RNA, 15 nt, Bordetella pertussis
ccgccgggccgcgac

SEQ ID NO: 396155 - RNA, 19 nt, Bordetella pertussis
ccgccgggccgcgaccacg

SEQ ID NO: 396156 - RNA, 13 nt, Bordetella pertussis
ccgccgggccugc

SEQ ID NO: 396157 - RNA, 16 nt, Bordetella pertussis
ccgccgggccugcccg

SEQ ID NO: 396158 - RNA, 14 nt, Bordetella pertussis
ccgccggggcaggc

SEQ ID NO: 396159 - RNA, 15 nt, Bordetella pertussis
ccgccgggcuggauc

SEQ ID NO: 396160 - RNA, 13 nt, Bordetella pertussis
ccgccggucgaga

SEQ ID NO: 396161 - RNA, 21 nt, Bordetella pertussis
ccgccggugauaugcgccagg

SEQ ID NO: 396162 - RNA, 16 nt, Bordetella pertussis
ccgccggugcaccagg

SEQ ID NO: 396163 - RNA, 20 nt, Bordetella pertussis
ccgccggugucggggccggg

SEQ ID NO: 396164 - RNA, 21 nt, Bordetella pertussis
ccgccgucaacgcccagguug

SEQ ID NO: 396165 - RNA, 15 nt, Bordetella pertussis
ccgccgucagcucga

SEQ ID NO: 396166 - RNA, 15 nt, Bordetella pertussis
ccgccgugcaggccc

SEQ ID NO: 396167 - RNA, 16 nt, Bordetella pertussis
ccgccgugcaggcccg

SEQ ID NO: 396168 - RNA, 15 nt, Bordetella pertussis
ccgccgugccgggcc

SEQ ID NO: 396169 - RNA, 21 nt, Bordetella pertussis
ccgccguggccaagggcgccg

SEQ ID NO: 396170 - RNA, 14 nt, Bordetella pertussis
ccgccguggccggc

SEQ ID NO: 396171 - RNA, 24 nt, Bordetella pertussis
ccgccuauguaggcgccgcgcccg

SEQ ID NO: 396172 - RNA, 14 nt, Bordetella pertussis
ccgccuccaggcgg

SEQ ID NO: 396173 - RNA, 16 nt, Bordetella pertussis
ccgccucgcgcuccag

SEQ ID NO: 396174 - RNA, 14 nt, Bordetella pertussis
ccgccucgggcacg

SEQ ID NO: 396175 - RNA, 15 nt, Bordetella pertussis
ccgccuucccaggcg

SEQ ID NO: 396176 - RNA, 15 nt, Bordetella pertussis
ccgccuucgccgugg

SEQ ID NO: 396177 - RNA, 22 nt, Bordetella pertussis
ccgccuucgucgcgcacccgca

SEQ ID NO: 396178 - RNA, 22 nt, Bordetella pertussis
ccgcgacgcauauccaggcggc

SEQ ID NO: 396179 - RNA, 16 nt, Bordetella pertussis
ccgcgacgcuggcgau

SEQ ID NO: 396180 - RNA, 17 nt, Bordetella pertussis
ccgcgaggcgcaggccg

SEQ ID NO: 396181 - RNA, 15 nt, Bordetella pertussis
ccgcgcacacauggc

SEQ ID NO: 396182 - RNA, 15 nt, Bordetella pertussis
ccgcgcaccugggcg

SEQ ID NO: 396183 - RNA, 19 nt, Bordetella pertussis
ccgcgcacgauggggcagc

SEQ ID NO: 396184 - RNA, 21 nt, Bordetella pertussis
ccgcgcagcccggcgugccca

SEQ ID NO: 396185 - RNA, 11 nt, Bordetella pertussis
ccgcgcagccg

SEQ ID NO: 396186 - RNA, 13 nt, Bordetella pertussis
ccgcgcagcagca

SEQ ID NO: 396187 - RNA, 14 nt, Bordetella pertussis
ccgcgcagcagcaa

SEQ ID NO: 396188 - RNA, 22 nt, Bordetella pertussis
ccgcgccauugccacggcgggc

SEQ ID NO: 396189 - RNA, 14 nt, Bordetella pertussis
ccgcgcccacagga

SEQ ID NO: 396190 - RNA, 15 nt, Bordetella pertussis
ccgcgcccagcagcg

SEQ ID NO: 396191 - RNA, 12 nt, Bordetella pertussis
ccgcgcccaggg

SEQ ID NO: 396192 - RNA, 22 nt, Bordetella pertussis
ccgcgcccagguccugcgccag

SEQ ID NO: 396193 - RNA, 22 nt, Bordetella pertussis
ccgcgcccaguuccacgcggcc

SEQ ID NO: 396194 - RNA, 19 nt, Bordetella pertussis
ccgcgcccauuucgauggc

SEQ ID NO: 396195 - RNA, 18 nt, Bordetella pertussis
ccgcgccccuagcgccgc

SEQ ID NO: 396196 - RNA, 21 nt, Bordetella pertussis
ccgcgccccuagcgccgcgcc

SEQ ID NO: 396197 - RNA, 21 nt, Bordetella pertussis
ccgcgcccgcaacgggccggc

SEQ ID NO: 396198 - RNA, 19 nt, Bordetella pertussis
ccgcgcccgccuucagcgg

SEQ ID NO: 396199 - RNA, 22 nt, Bordetella pertussis
ccgcgcccgccuucagcgggcc

SEQ ID NO: 396200 - RNA, 17 nt, Bordetella pertussis
ccgcgcccggcggccag

SEQ ID NO: 396201 - RNA, 18 nt, Bordetella pertussis
ccgcgcccggcggccagg

SEQ ID NO: 396202 - RNA, 23 nt, Bordetella pertussis
ccgcgcccggcggccaggccggc

SEQ ID NO: 396203 - RNA, 20 nt, Bordetella pertussis
ccgcgcccggaucaguccgg

SEQ ID NO: 396204 - RNA, 13 nt, Bordetella pertussis
ccgcgcccgucca

SEQ ID NO: 396205 - RNA, 20 nt, Bordetella pertussis
ccgcgcccuggcgcggcggc

SEQ ID NO: 396206 - RNA, 15 nt, Bordetella pertussis
ccgcgccgaccggcc

SEQ ID NO: 396207 - RNA, 17 nt, Bordetella pertussis
ccgcgccgaccggcccc

SEQ ID NO: 396208 - RNA, 16 nt, Bordetella pertussis
ccgcgccgcccacgcc

SEQ ID NO: 396209 - RNA, 17 nt, Bordetella pertussis
ccgcgccgcccccgccc

SEQ ID NO: 396210 - RNA, 11 nt, Bordetella pertussis
ccgcgccgccc

SEQ ID NO: 396211 - RNA, 15 nt, Bordetella pertussis
ccgcgccgccgcccu

SEQ ID NO: 396212 - RNA, 16 nt, Bordetella pertussis
ccgcgccgccgcccug

SEQ ID NO: 396213 - RNA, 12 nt, Bordetella pertussis
ccgcgccgcgca

SEQ ID NO: 396214 - RNA, 14 nt, Bordetella pertussis
ccgcgccgcggcac

SEQ ID NO: 396215 - RNA, 21 nt, Bordetella pertussis
ccgcgccgcguugcagccaca

SEQ ID NO: 396216 - RNA, 16 nt, Bordetella pertussis
ccgcgccgcuggcggc

SEQ ID NO: 396217 - RNA, 19 nt, Bordetella pertussis
ccgcgccgcuggcggccgc

SEQ ID NO: 396218 - RNA, 20 nt, Bordetella pertussis
ccgcgccgcuggcguccagg

SEQ ID NO: 396219 - RNA, 23 nt, Bordetella pertussis
ccgcgccgcuguugcccaccagc

SEQ ID NO: 396220 - RNA, 14 nt, Bordetella pertussis
ccgcgccggcgcgc

SEQ ID NO: 396221 - RNA, 15 nt, Bordetella pertussis
ccgcgccggggcggc

SEQ ID NO: 396222 - RNA, 19 nt, Bordetella pertussis
ccgcgccgggcgcgccggc

SEQ ID NO: 396223 - RNA, 12 nt, Bordetella pertussis
ccgcgccgucga

SEQ ID NO: 396224 - RNA, 21 nt, Bordetella pertussis
ccgcgccuauaucgacggcgc

SEQ ID NO: 396225 - RNA, 21 nt, Bordetella pertussis
ccgcgccugcagcagcggcag

SEQ ID NO: 396226 - RNA, 17 nt, Bordetella pertussis
ccgcgcgacagccgcgc

SEQ ID NO: 396227 - RNA, 20 nt, Bordetella pertussis
ccgcgcgacagccgcgccag

SEQ ID NO: 396228 - RNA, 16 nt, Bordetella pertussis
ccgcggcgcggcccgc

SEQ ID NO: 396229 - RNA, 19 nt, Bordetella pertussis
ccgcggcgguuucggccgg

SEQ ID NO: 396230 - RNA, 16 nt, Bordetella pertussis
ccgcggcgggcucggc

SEQ ID NO: 396231 - RNA, 18 nt, Bordetella pertussis
ccgcggcgguccugcuga

SEQ ID NO: 396232 - RNA, 15 nt, Bordetella pertussis
ccgcggcguccgcgc

SEQ ID NO: 396233 - RNA, 18 nt, Bordetella pertussis
ccgcggcgugcugcccgc

SEQ ID NO: 396234 - RNA, 13 nt, Bordetella pertussis
ccgcgggccugcu

SEQ ID NO: 396235 - RNA, 14 nt, Bordetella pertussis
ccgcgggcgcgcgc

SEQ ID NO: 396236 - RNA, 18 nt, Bordetella pertussis
ccgcgggcgcgcgccccg

SEQ ID NO: 396237 - RNA, 18 nt, Bordetella pertussis
ccgcggggacaggcaccc

SEQ ID NO: 396238 - RNA, 23 nt, Bordetella pertussis
ccgcggggacaggcaccccguca

SEQ ID NO: 396239 - RNA, 20 nt, Bordetella pertussis
ccgcggggacaggcaccgcc

SEQ ID NO: 396240 - RNA, 22 nt, Bordetella pertussis
ccgcggggacaggcaccgccgc

SEQ ID NO: 396241 - RNA, 18 nt, Bordetella pertussis
ccgcggggacaggcaccu

SEQ ID NO: 396242 - RNA, 19 nt, Bordetella pertussis
ccgcggggacaggcucccg

SEQ ID NO: 396243 - RNA, 16 nt, Bordetella pertussis
ccgcgggcgcccggcc

SEQ ID NO: 396244 - RNA, 13 nt, Bordetella pertussis
ccgcgggcggcgc

SEQ ID NO: 396245 - RNA, 20 nt, Bordetella pertussis
ccgcggggcuggccagcugg

SEQ ID NO: 396246 - RNA, 21 nt, Bordetella pertussis
ccgcggggcuggccagcuggc

SEQ ID NO: 396247 - RNA, 15 nt, Bordetella pertussis
ccgcggguggccgcu

SEQ ID NO: 396248 - RNA, 18 nt, Bordetella pertussis
ccgcggguucgcccggug

SEQ ID NO: 396249 - RNA, 17 nt, Bordetella pertussis
ccgcguaggcggucagc

SEQ ID NO: 396250 - RNA, 18 nt, Bordetella pertussis
ccgcguaguugucggcgc

SEQ ID NO: 396251 - RNA, 16 nt, Bordetella pertussis
ccgcguaugcggcagc

SEQ ID NO: 396252 - RNA, 14 nt, Bordetella pertussis
ccgcguccgcccgc

SEQ ID NO: 396253 - RNA, 15 nt, Bordetella pertussis
ccgcguccgcccgcu

SEQ ID NO: 396254 - RNA, 21 nt, Bordetella pertussis
ccgcgucgagcgcgacgcgcu

SEQ ID NO: 396255 - RNA, 19 nt, Bordetella pertussis
ccgcgucgaucagcgcggg

SEQ ID NO: 396256 - RNA, 18 nt, Bordetella pertussis
ccgcguucacgccggcgc

SEQ ID NO: 396257 - RNA, 19 nt, Bordetella pertussis
ccgcguugagcgccgacgg

SEQ ID NO: 396258 - RNA, 22 nt, Bordetella pertussis
ccgcuaugcgggcuugcugccc

SEQ ID NO: 396259 - RNA, 17 nt, Bordetella pertussis
ccgcucaauucggccug

SEQ ID NO: 396260 - RNA, 22 nt, Bordetella pertussis
ccgcucagcuuguagcccucgg

SEQ ID NO: 396261 - RNA, 23 nt, Bordetella pertussis
ccgcugaacguguaggucagcgc

SEQ ID NO: 396262 - RNA, 20 nt, Bordetella pertussis
ccgcugcaugggcggcccgc

SEQ ID NO: 396263 - RNA, 15 nt, Bordetella pertussis
ccgcugcccaccuuc

SEQ ID NO: 396264 - RNA, 22 nt, Bordetella pertussis
ccgcugcccaccuuccugcugg

SEQ ID NO: 396265 - RNA, 18 nt, Bordetella pertussis
ccgcugcccagcgucagc

SEQ ID NO: 396266 - RNA, 20 nt, Bordetella pertussis
ccgcugccgagacggccgcc

SEQ ID NO: 396267 - RNA, 21 nt, Bordetella pertussis
ccgcugccgagacggccgccg

SEQ ID NO: 396268 - RNA, 17 nt, Bordetella pertussis
ccgcugccgggcucggc

SEQ ID NO: 396269 - RNA, 18 nt, Bordetella pertussis
ccgcugccgggcucggcc

SEQ ID NO: 396270 - RNA, 19 nt, Bordetella pertussis
ccgcuggccagccgcucgc

SEQ ID NO: 396271 - RNA, 14 nt, Bordetella pertussis
ccgcuggccaggcu

SEQ ID NO: 396272 - RNA, 14 nt, Bordetella pertussis
ccgcuggccaugcc

SEQ ID NO: 396273 - RNA, 21 nt, Bordetella pertussis
ccgcuggccaugccgucgcgc

SEQ ID NO: 396274 - RNA, 18 nt, Bordetella pertussis
ccgcuggccgaucugcug

SEQ ID NO: 396275 - RNA, 19 nt, Bordetella pertussis
ccgcuggccgaucugcugg

SEQ ID NO: 396276 - RNA, 21 nt, Bordetella pertussis
ccgcuggccgaucugcugggc

SEQ ID NO: 396277 - RNA, 13 nt, Bordetella pertussis
ccgcuggccgucg

SEQ ID NO: 396278 - RNA, 17 nt, Bordetella pertussis
ccgcuggccgucgccgc

SEQ ID NO: 396279 - RNA, 16 nt, Bordetella pertussis
ccgcuggcgaucaggc

SEQ ID NO: 396280 - RNA, 19 nt, Bordetella pertussis
ccgcuggcgaucaggccgc

SEQ ID NO: 396281 - RNA, 17 nt, Bordetella pertussis
ccgcuggcgcgccgccu

SEQ ID NO: 396282 - RNA, 18 nt, Bordetella pertussis
ccgcuggcggcccugccg

SEQ ID NO: 396283 - RNA, 16 nt, Bordetella pertussis
ccgcuggcggccgcgg

SEQ ID NO: 396284 - RNA, 17 nt, Bordetella pertussis
ccgcuggcguccagguu

SEQ ID NO: 396285 - RNA, 19 nt, Bordetella pertussis
ccgcuggcgucgcgcuucu

SEQ ID NO: 396286 - RNA, 16 nt, Bordetella pertussis
ccgcuguggacgccgc

SEQ ID NO: 396287 - RNA, 19 nt, Bordetella pertussis
ccgcuguggacgccgccgg

SEQ ID NO: 396288 - RNA, 21 nt, Bordetella pertussis
ccgcuguggacgccgccggcc

SEQ ID NO: 396289 - RNA, 16 nt, Bordetella pertussis
ccgcuguggcgcgcca

SEQ ID NO: 396290 - RNA, 21 nt, Bordetella pertussis
ccgcuguucggcgagccgggc

SEQ ID NO: 396291 - RNA, 17 nt, Bordetella pertussis
ccgcuguugcccaccag

SEQ ID NO: 396292 - RNA, 23 nt, Bordetella pertussis
ccgcuuccgccaccgcgccgccc

SEQ ID NO: 396293 - RNA, 21 nt, Bordetella pertussis
ccgcuuccggccgggccagua

SEQ ID NO: 396294 - RNA, 15 nt, Bordetella pertussis
ccgcuuucgaccagc

SEQ ID NO: 396295 - RNA, 16 nt, Bordetella pertussis
ccggaaaucacgaucu

SEQ ID NO: 396296 - RNA, 23 nt, Bordetella pertussis
ccggaacaccagcaagccggcgg

SEQ ID NO: 396297 - RNA, 18 nt, Bordetella pertussis
ccggaaucaccgccgcga

SEQ ID NO: 396298 - RNA, 18 nt, Bordetella pertussis
ccggacaagccccuccga

SEQ ID NO: 396299 - RNA, 13 nt, Bordetella pertussis
ccggacagggccg

SEQ ID NO: 396300 - RNA, 20 nt, Bordetella pertussis
ccggacugaacgcguccagg

SEQ ID NO: 396301 - RNA, 23 nt, Bordetella pertussis
ccggacuggauauggcgccgcac

SEQ ID NO: 396302 - RNA, 19 nt, Bordetella pertussis
ccggacugggcgucgcucu

SEQ ID NO: 396303 - RNA, 14 nt, Bordetella pertussis
ccggauaccgccgc

SEQ ID NO: 396304 - RNA, 15 nt, Bordetella pertussis
ccggauaccgccgcc

SEQ ID NO: 396305 - RNA, 21 nt, Bordetella pertussis
ccggcaagaugccggccuguc

SEQ ID NO: 396306 - RNA, 17 nt, Bordetella pertussis
ccggcaagccagggcag

SEQ ID NO: 396307 - RNA, 14 nt, Bordetella pertussis
ccggcaagccuugc

SEQ ID NO: 396308 - RNA, 16 nt, Bordetella pertussis
ccggcaagcgcucgcc

SEQ ID NO: 396309 - RNA, 16 nt, Bordetella pertussis
ccggcaaggggccagc

SEQ ID NO: 396310 - RNA, 19 nt, Bordetella pertussis
ccggcaaggggccagccug

SEQ ID NO: 396311 - RNA, 21 nt, Bordetella pertussis
ccggcaaucgaaaagcccgcc

SEQ ID NO: 396312 - RNA, 13 nt, Bordetella pertussis
ccggcacccggcu

SEQ ID NO: 396313 - RNA, 19 nt, Bordetella pertussis
ccggcacccggcucagccu

SEQ ID NO: 396314 - RNA, 23 nt, Bordetella pertussis
ccggcacgacggccuccgcgccg

SEQ ID NO: 396315 - RNA, 19 nt, Bordetella pertussis
ccggcacgccugccgcgcc

SEQ ID NO: 396316 - RNA, 21 nt, Bordetella pertussis
ccggcacgccugccgcgcccg

SEQ ID NO: 396317 - RNA, 15 nt, Bordetella pertussis
ccggcacgcgccagc

SEQ ID NO: 396318 - RNA, 19 nt, Bordetella pertussis
ccggcacgcugaucgccgg

SEQ ID NO: 396319 - RNA, 22 nt, Bordetella pertussis
ccggcacgcugaucgccggcgc

SEQ ID NO: 396320 - RNA, 23 nt, Bordetella pertussis
ccggcacgucauugcaucgcagc

SEQ ID NO: 396321 - RNA, 13 nt, Bordetella pertussis
ccggcagcgccuu

SEQ ID NO: 396322 - RNA, 21 nt, Bordetella pertussis
ccggcagcgcgaccggcgcga

SEQ ID NO: 396323 - RNA, 15 nt, Bordetella pertussis
ccggcagcggccagc

SEQ ID NO: 396324 - RNA, 15 nt, Bordetella pertussis
ccggcagcggcgcca

SEQ ID NO: 396325 - RNA, 23 nt, Bordetella pertussis
ccggcagcgucaauccgccgcca

SEQ ID NO: 396326 - RNA, 16 nt, Bordetella pertussis
ccggcagggccagcgc

SEQ ID NO: 396327 - RNA, 20 nt, Bordetella pertussis
ccggcaugccguccacgccc

SEQ ID NO: 396328 - RNA, 20 nt, Bordetella pertussis
ccggcaugguguaccgggcc

SEQ ID NO: 396329 - RNA, 17 nt, Bordetella pertussis
ccggcauugcccaccac

SEQ ID NO: 396330 - RNA, 15 nt, Bordetella pertussis
ccggccaagcuccag

SEQ ID NO: 396331 - RNA, 16 nt, Bordetella pertussis
ccggccaaggcaagca

SEQ ID NO: 396332 - RNA, 17 nt, Bordetella pertussis
ccggccaccagcggcgc

SEQ ID NO: 396333 - RNA, 15 nt, Bordetella pertussis
ccggccagcggcagg

SEQ ID NO: 396334 - RNA, 20 nt, Bordetella pertussis
ccggccaggacgaucccggc

SEQ ID NO: 396335 - RNA, 13 nt, Bordetella pertussis
ccggccaggauga

SEQ ID NO: 396336 - RNA, 10 nt, Bordetella pertussis
ccggccaggc

SEQ ID NO: 396337 - RNA, 14 nt, Bordetella pertussis
ccggccaggcgccg

SEQ ID NO: 396338 - RNA, 16 nt, Bordetella pertussis
ccggccaggcgccggc

SEQ ID NO: 396339 - RNA, 18 nt, Bordetella pertussis
ccggccaggcgccggcgg

SEQ ID NO: 396340 - RNA, 21 nt, Bordetella pertussis
ccggccagggccacgccggcc

SEQ ID NO: 396341 - RNA, 23 nt, Bordetella pertussis
ccggccagggccacgccggccgc

SEQ ID NO: 396342 - RNA, 16 nt, Bordetella pertussis
ccggccaggggcgcug

SEQ ID NO: 396343 - RNA, 22 nt, Bordetella pertussis
ccggccagggcgaugcggcggc

SEQ ID NO: 396344 - RNA, 19 nt, Bordetella pertussis
ccggccaucgaagccagau

SEQ ID NO: 396345 - RNA, 22 nt, Bordetella pertussis
ccggcggcaccauugccggcgc

SEQ ID NO: 396346 - RNA, 15 nt, Bordetella pertussis
ccggcggcaccgcgc

SEQ ID NO: 396347 - RNA, 20 nt, Bordetella pertussis
ccggcggcaccgcgcagccc

SEQ ID NO: 396348 - RNA, 21 nt, Bordetella pertussis
ccggcggcacgcugcgcaggc

SEQ ID NO: 396349 - RNA, 18 nt, Bordetella pertussis
ccggcggcacggccggcc

SEQ ID NO: 396350 - RNA, 12 nt, Bordetella pertussis
ccggcggcagcg

SEQ ID NO: 396351 - RNA, 15 nt, Bordetella pertussis
ccggcggcaugcgcc

SEQ ID NO: 396352 - RNA, 14 nt, Bordetella pertussis
ccggcggccagcgc

SEQ ID NO: 396353 - RNA, 18 nt, Bordetella pertussis
ccggcggccaggccggcg

SEQ ID NO: 396354 - RNA, 19 nt, Bordetella pertussis
ccggcggccaggccggcgc

SEQ ID NO: 396355 - RNA, 17 nt, Bordetella pertussis
ccggcggccggucaggg

SEQ ID NO: 396356 - RNA, 22 nt, Bordetella pertussis
ccggcggcgagcgcggcgcgcg

SEQ ID NO: 396357 - RNA, 16 nt, Bordetella pertussis
ccggcggcgccggccu

SEQ ID NO: 396358 - RNA, 18 nt, Bordetella pertussis
ccggcggcgcucaucauc

SEQ ID NO: 396359 - RNA, 13 nt, Bordetella pertussis
ccggcggcgcgcc

SEQ ID NO: 396360 - RNA, 16 nt, Bordetella pertussis
ccggcggcgucggcgc

SEQ ID NO: 396361 - RNA, 14 nt, Bordetella pertussis
ccggcggcgugccc

SEQ ID NO: 396362 - RNA, 22 nt, Bordetella pertussis
ccggcggcgugcccugcggcgc

SEQ ID NO: 396363 - RNA, 17 nt, Bordetella pertussis
ccggcgggaacaggcac

SEQ ID NO: 396364 - RNA, 18 nt, Bordetella pertussis
ccggcgggaacaggcacc

SEQ ID NO: 396365 - RNA, 16 nt, Bordetella pertussis
ccggcgggcaggcucc

SEQ ID NO: 396366 - RNA, 22 nt, Bordetella pertussis
ccggcgggcaggcuccacagcc

SEQ ID NO: 396367 - RNA, 13 nt, Bordetella pertussis
ccggcgggccgca

SEQ ID NO: 396368 - RNA, 20 nt, Bordetella pertussis
ccggcgggccgcgccccuag

SEQ ID NO: 396369 - RNA, 12 nt, Bordetella pertussis
ccggcgggccgg

SEQ ID NO: 396370 - RNA, 22 nt, Bordetella pertussis
ccggcgggcggcugcccgggcu

SEQ ID NO: 396371 - RNA, 13 nt, Bordetella pertussis
ccggcggggacag

SEQ ID NO: 396372 - RNA, 12 nt, Bordetella pertussis
ccggcgggggcg

SEQ ID NO: 396373 - RNA, 20 nt, Bordetella pertussis
ccggcgguaagcguccgcgc

SEQ ID NO: 396374 - RNA, 12 nt, Bordetella pertussis
ccggcggucccg

SEQ ID NO: 396375 - RNA, 19 nt, Bordetella pertussis
ccggcggucgcgcuggccc

SEQ ID NO: 396376 - RNA, 19 nt, Bordetella pertussis
ccggcguagcugcgccgca

SEQ ID NO: 396377 - RNA, 16 nt, Bordetella pertussis
ccggcguauggcccgc

SEQ ID NO: 396378 - RNA, 17 nt, Bordetella pertussis
ccggcguauggcccgcc

SEQ ID NO: 396379 - RNA, 19 nt, Bordetella pertussis
ccggcguccugcggcggca

SEQ ID NO: 396380 - RNA, 18 nt, Bordetella pertussis
ccggcgucuggagcggcc

SEQ ID NO: 396381 - RNA, 18 nt, Bordetella pertussis
ccggcgugcagagcacca

SEQ ID NO: 396382 - RNA, 14 nt, Bordetella pertussis
ccggcgugcccagu

SEQ ID NO: 396383 - RNA, 21 nt, Bordetella pertussis
ccggcgugcgcuggcugggcc

SEQ ID NO: 396384 - RNA, 16 nt, Bordetella pertussis
ccggcguggccugccc

SEQ ID NO: 396385 - RNA, 21 nt, Bordetella pertussis
ccggcguggccugcccgucgg

SEQ ID NO: 396386 - RNA, 20 nt, Bordetella pertussis
ccggcgugguaucgcgccag

SEQ ID NO: 396387 - RNA, 19 nt, Bordetella pertussis
ccggcguguccagcggcgc

SEQ ID NO: 396388 - RNA, 18 nt, Bordetella pertussis
ccggcguucuggucagcc

SEQ ID NO: 396389 - RNA, 20 nt, Bordetella pertussis
ccggcguucuucagcgcgcu

SEQ ID NO: 396390 - RNA, 22 nt, Bordetella pertussis
ccggcguuggccgggucgcgca

SEQ ID NO: 396391 - RNA, 22 nt, Bordetella pertussis
ccggcuacagcucgccggcgau

SEQ ID NO: 396392 - RNA, 13 nt, Bordetella pertussis
ccggcuacggcaa

SEQ ID NO: 396393 - RNA, 13 nt, Bordetella pertussis
ccggcucagcccc

SEQ ID NO: 396394 - RNA, 16 nt, Bordetella pertussis
ccggcucaggccagcg

SEQ ID NO: 396395 - RNA, 17 nt, Bordetella pertussis
ccggcucaggccagcga

SEQ ID NO: 396396 - RNA, 21 nt, Bordetella pertussis
ccggcucaggccagcgacccg

SEQ ID NO: 396397 - RNA, 16 nt, Bordetella pertussis
ccggcucauucggcgc

SEQ ID NO: 396398 - RNA, 16 nt, Bordetella pertussis
ccggcuccaggccgcc

SEQ ID NO: 396399 - RNA, 14 nt, Bordetella pertussis
ccggcucccgcgcu

SEQ ID NO: 396400 - RNA, 18 nt, Bordetella pertussis
ccggcuccgauagcggcg

SEQ ID NO: 396401 - RNA, 19 nt, Bordetella pertussis
ccggcuccgauagcggcgc

SEQ ID NO: 396402 - RNA, 16 nt, Bordetella pertussis
ccggcucgaucgccgc

SEQ ID NO: 396403 - RNA, 19 nt, Bordetella pertussis
ccggcucgaucgccgccgg

SEQ ID NO: 396404 - RNA, 20 nt, Bordetella pertussis
ccggcucgaucgccgccggc

SEQ ID NO: 396405 - RNA, 19 nt, Bordetella pertussis
ccggcucgccgagccgggc

SEQ ID NO: 396406 - RNA, 15 nt, Bordetella pertussis
ccggcucggaccugg

SEQ ID NO: 396407 - RNA, 20 nt, Bordetella pertussis
ccggcucuaccaacccugcc

SEQ ID NO: 396408 - RNA, 23 nt, Bordetella pertussis
ccggcugcaagacgcccaggccc

SEQ ID NO: 396409 - RNA, 14 nt, Bordetella pertussis
ccggcugcgcgccg

SEQ ID NO: 396410 - RNA, 17 nt, Bordetella pertussis
ccggcugcgcgccgacc

SEQ ID NO: 396411 - RNA, 17 nt, Bordetella pertussis
ccggcugcgcgcgcagc

SEQ ID NO: 396412 - RNA, 14 nt, Bordetella pertussis
ccggcugcgcggcc

SEQ ID NO: 396413 - RNA, 15 nt, Bordetella pertussis
ccggcugcgcggccg

SEQ ID NO: 396414 - RNA, 23 nt, Bordetella pertussis
ccggcugcucguucugcgcgccc

SEQ ID NO: 396415 - RNA, 23 nt, Bordetella pertussis
ccggcuggauggugccgccgccc

SEQ ID NO: 396416 - RNA, 19 nt, Bordetella pertussis
ccggcugcuugcccagcgg

SEQ ID NO: 396417 - RNA, 20 nt, Bordetella pertussis
ccggcugcuugcccagcgga

SEQ ID NO: 396418 - RNA, 16 nt, Bordetella pertussis
ccggcuuccagcagca

SEQ ID NO: 396419 - RNA, 14 nt, Bordetella pertussis
ccggcuugcauggu

SEQ ID NO: 396420 - RNA, 15 nt, Bordetella pertussis
ccggcuugcgccagc

SEQ ID NO: 396421 - RNA, 15 nt, Bordetella pertussis
ccggcuuggccucgg

SEQ ID NO: 396422 - RNA, 21 nt, Bordetella pertussis
ccggcuuggggcgcgccgcgg

SEQ ID NO: 396423 - RNA, 21 nt, Bordetella pertussis
ccggcuuuggacaggcgugcg

SEQ ID NO: 396424 - RNA, 13 nt, Bordetella pertussis
ccgggaaggcggg

SEQ ID NO: 396425 - RNA, 15 nt, Bordetella pertussis
ccgggacaggcaccc

SEQ ID NO: 396426 - RNA, 17 nt, Bordetella pertussis
ccgggacaggcacccgc

SEQ ID NO: 396427 - RNA, 18 nt, Bordetella pertussis
ccgggaccuuggcggcug

SEQ ID NO: 396428 - RNA, 20 nt, Bordetella pertussis
ccgggaccuuggcggcuggc

SEQ ID NO: 396429 - RNA, 15 nt, Bordetella pertussis
ccgggagccuguccc

SEQ ID NO: 396430 - RNA, 18 nt, Bordetella pertussis
ccgggagccuguccccga

SEQ ID NO: 396431 - RNA, 19 nt, Bordetella pertussis
ccgggcauggcccggcucg

SEQ ID NO: 396432 - RNA, 13 nt, Bordetella pertussis
ccgggccacgagc

SEQ ID NO: 396433 - RNA, 12 nt, Bordetella pertussis
ccgggcccgcgc

SEQ ID NO: 396434 - RNA, 14 nt, Bordetella pertussis
ccgggcccgcgccg

SEQ ID NO: 396435 - RNA, 23 nt, Bordetella pertussis
ccgggccgaccaggccggcggcg

SEQ ID NO: 396436 - RNA, 15 nt, Bordetella pertussis
ccgggccgacgcgcc

SEQ ID NO: 396437 - RNA, 16 nt, Bordetella pertussis
ccgggcccggcgcgcc

SEQ ID NO: 396438 - RNA, 14 nt, Bordetella pertussis
ccgggcggcgagau

SEQ ID NO: 396439 - RNA, 22 nt, Bordetella pertussis
ccgggcggguugugcccgcccg

SEQ ID NO: 396440 - RNA, 14 nt, Bordetella pertussis
ccgggcgguacagg

SEQ ID NO: 396441 - RNA, 20 nt, Bordetella pertussis
ccgggcgguccgguucgccc

SEQ ID NO: 396442 - RNA, 15 nt, Bordetella pertussis
ccgggcucggccacc

SEQ ID NO: 396443 - RNA, 19 nt, Bordetella pertussis
ccgggcucggccaccaugc

SEQ ID NO: 396444 - RNA, 17 nt, Bordetella pertussis
ccgggcugccggcagca

SEQ ID NO: 396445 - RNA, 13 nt, Bordetella pertussis
ccgggcuggaucc

SEQ ID NO: 396446 - RNA, 14 nt, Bordetella pertussis
ccgggcuggccgcc

SEQ ID NO: 396447 - RNA, 15 nt, Bordetella pertussis
ccgggcuggccgccu

SEQ ID NO: 396448 - RNA, 18 nt, Bordetella pertussis
ccgggcuguccgccacca

SEQ ID NO: 396449 - RNA, 21 nt, Bordetella pertussis
ccggggcacccaggcgggcug

SEQ ID NO: 396450 - RNA, 20 nt, Bordetella pertussis
ccggggcaggaagccggccc

SEQ ID NO: 396451 - RNA, 11 nt, Bordetella pertussis
ccggggccgcc

SEQ ID NO: 396452 - RNA, 13 nt, Bordetella pertussis
ccggggccgcccu

SEQ ID NO: 396453 - RNA, 19 nt, Bordetella pertussis
ccggggcgcaccggcacgc

SEQ ID NO: 396454 - RNA, 22 nt, Bordetella pertussis
ccggggcgccggugucggccca

SEQ ID NO: 396455 - RNA, 22 nt, Bordetella pertussis
ccggggcggucaaugcggcggc

SEQ ID NO: 396456 - RNA, 19 nt, Bordetella pertussis
ccgggguugggaucgcgcc

SEQ ID NO: 396457 - RNA, 19 nt, Bordetella pertussis
ccggguguggggggucagg

SEQ ID NO: 396458 - RNA, 16 nt, Bordetella pertussis
ccggguuggcgaugcu

SEQ ID NO: 396459 - RNA, 22 nt, Bordetella pertussis
ccggguuggcguccaggcgcgc

SEQ ID NO: 396460 - RNA, 23 nt, Bordetella pertussis
ccggguuggcguccaggcgcgcc

SEQ ID NO: 396461 - RNA, 22 nt, Bordetella pertussis
ccggguuuuuacaugccgcgcg

SEQ ID NO: 396462 - RNA, 13 nt, Bordetella pertussis
ccggguuucggca

SEQ ID NO: 396463 - RNA, 22 nt, Bordetella pertussis
ccgguauccuggcgcggacauc

SEQ ID NO: 396464 - RNA, 21 nt, Bordetella pertussis
ccggucacguacucgccgucg

SEQ ID NO: 396465 - RNA, 15 nt, Bordetella pertussis
ccggucgcccgccgc

SEQ ID NO: 396466 - RNA, 16 nt, Bordetella pertussis
ccggucgcccgccgcg

SEQ ID NO: 396467 - RNA, 13 nt, Bordetella pertussis
ccggucgccgcgg

SEQ ID NO: 396468 - RNA, 18 nt, Bordetella pertussis
ccggugaacaccagggug

SEQ ID NO: 396469 - RNA, 21 nt, Bordetella pertussis
ccggugaucagcaggcccacc

SEQ ID NO: 396470 - RNA, 15 nt, Bordetella pertussis
ccggugaucuugccg

SEQ ID NO: 396471 - RNA, 15 nt, Bordetella pertussis
ccggugaugcggcgc

SEQ ID NO: 396472 - RNA, 18 nt, Bordetella pertussis
ccggugaugcggcgcgcc

SEQ ID NO: 396473 - RNA, 22 nt, Bordetella pertussis
ccggugaugcggcgcgccgcgu

SEQ ID NO: 396474 - RNA, 19 nt, Bordetella pertussis
ccggugcaccaggccaccc

SEQ ID NO: 396475 - RNA, 19 nt, Bordetella pertussis
ccggugcagccgccgcagg

SEQ ID NO: 396476 - RNA, 21 nt, Bordetella pertussis
ccggugcagccgccgcaggcu

SEQ ID NO: 396477 - RNA, 21 nt, Bordetella pertussis
ccggugccagucuccaggcuc

SEQ ID NO: 396478 - RNA, 17 nt, Bordetella pertussis
ccgguuuuuuugcgccg

SEQ ID NO: 396479 - RNA, 17 nt, Bordetella pertussis
ccguaaagaugcgcgcc

SEQ ID NO: 396480 - RNA, 18 nt, Bordetella pertussis
ccguacgccacuuccuug

SEQ ID NO: 396481 - RNA, 20 nt, Bordetella pertussis
ccguacuugcuccgguacgc

SEQ ID NO: 396482 - RNA, 22 nt, Bordetella pertussis
ccguacuuggcgauggccgcca

SEQ ID NO: 396483 - RNA, 19 nt, Bordetella pertussis
ccguagagggucuggcggc

SEQ ID NO: 396484 - RNA, 13 nt, Bordetella pertussis
ccguagcccaggu

SEQ ID NO: 396485 - RNA, 14 nt, Bordetella pertussis
ccguagcgcaggcg

SEQ ID NO: 396486 - RNA, 14 nt, Bordetella pertussis
ccguaggacagccc

SEQ ID NO: 396487 - RNA, 23 nt, Bordetella pertussis
ccguaggugcgcgccacauccug

SEQ ID NO: 396488 - RNA, 14 nt, Bordetella pertussis
ccgucagcaugccg

SEQ ID NO: 396489 - RNA, 16 nt, Bordetella pertussis
ccgucagcggcgcgcc

SEQ ID NO: 396490 - RNA, 17 nt, Bordetella pertussis
ccgucaggaucaggccg

SEQ ID NO: 396491 - RNA, 20 nt, Bordetella pertussis
ccgucaggaucaggccggcg

SEQ ID NO: 396492 - RNA, 14 nt, Bordetella pertussis
ccgucgaacuccug

SEQ ID NO: 396493 - RNA, 18 nt, Bordetella pertussis
ccgucgaagccggcgcca

SEQ ID NO: 396494 - RNA, 14 nt, Bordetella pertussis
ccgucgaccgacag

SEQ ID NO: 396495 - RNA, 20 nt, Bordetella pertussis
ccgucgagcgcggccaggcg

SEQ ID NO: 396496 - RNA, 18 nt, Bordetella pertussis
ccgucgaugaccagcgcc

SEQ ID NO: 396497 - RNA, 14 nt, Bordetella pertussis
ccgucggccgcgcc

SEQ ID NO: 396498 - RNA, 12 nt, Bordetella pertussis
ccgucggcggca

SEQ ID NO: 396499 - RNA, 20 nt, Bordetella pertussis
ccgucggcggcaagcagccg

SEQ ID NO: 396500 - RNA, 22 nt, Bordetella pertussis
ccgucggcggcaagcagccgga

SEQ ID NO: 396501 - RNA, 13 nt, Bordetella pertussis
ccgucgggacagg

SEQ ID NO: 396502 - RNA, 19 nt, Bordetella pertussis
ccgucguccguccuggcca

SEQ ID NO: 396503 - RNA, 14 nt, Bordetella pertussis
ccgucgugcagcgu

SEQ ID NO: 396504 - RNA, 14 nt, Bordetella pertussis
ccgucgugcgccug

SEQ ID NO: 396505 - RNA, 20 nt, Bordetella pertussis
ccgucgugcgccuggcggcu

SEQ ID NO: 396506 - RNA, 22 nt, Bordetella pertussis
ccgucguugacggggacgccgg

SEQ ID NO: 396507 - RNA, 15 nt, Bordetella pertussis
ccgucucgcccaggc

SEQ ID NO: 396508 - RNA, 17 nt, Bordetella pertussis
ccgucucgcgcgccagg

SEQ ID NO: 396509 - RNA, 15 nt, Bordetella pertussis
ccgucugcgccgccg

SEQ ID NO: 396510 - RNA, 16 nt, Bordetella pertussis
ccgucugcgccgccgc

SEQ ID NO: 396511 - RNA, 17 nt, Bordetella pertussis
ccgucuugcccgccagc

SEQ ID NO: 396512 - RNA, 20 nt, Bordetella pertussis
ccgucuugcccgccagcgcg

SEQ ID NO: 396513 - RNA, 15 nt, Bordetella pertussis
ccgucuuggcgggcu

SEQ ID NO: 396514 - RNA, 18 nt, Bordetella pertussis
ccgugaaugcgccuggcg

SEQ ID NO: 396515 - RNA, 16 nt, Bordetella pertussis
ccgugacgcugauggc

SEQ ID NO: 396516 - RNA, 23 nt, Bordetella pertussis
ccgugacuucggccgccagccgg

SEQ ID NO: 396517 - RNA, 20 nt, Bordetella pertussis
ccgugcccgagggcgcgucg

SEQ ID NO: 396518 - RNA, 15 nt, Bordetella pertussis
ccgugcccggcgggc

SEQ ID NO: 396519 - RNA, 21 nt, Bordetella pertussis
ccgugccgcggcgcggcccgc

SEQ ID NO: 396520 - RNA, 22 nt, Bordetella pertussis
ccgugcgagcacggcguggcgc

SEQ ID NO: 396521 - RNA, 21 nt, Bordetella pertussis
ccgugcgaggcgaacaggcac

SEQ ID NO: 396522 - RNA, 22 nt, Bordetella pertussis
ccgugcgaggcgaacaggcaca

SEQ ID NO: 396523 - RNA, 13 nt, Bordetella pertussis
ccgugccucaacu

SEQ ID NO: 396524 - RNA, 13 nt, Bordetella pertussis
ccgugcgcccgac

SEQ ID NO: 396525 - RNA, 15 nt, Bordetella pertussis
ccgugcgcggcgagc

SEQ ID NO: 396526 - RNA, 23 nt, Bordetella pertussis
ccgugcgcgggcgcggcaggcgg

SEQ ID NO: 396527 - RNA, 22 nt, Bordetella pertussis
ccgugcggcgcgcacgggcgag

SEQ ID NO: 396528 - RNA, 17 nt, Bordetella pertussis
ccgugcgugugccuguc

SEQ ID NO: 396529 - RNA, 19 nt, Bordetella pertussis
ccgugcgugugccuguccc

SEQ ID NO: 396530 - RNA, 21 nt, Bordetella pertussis
ccgugcuggaggugccguccg

SEQ ID NO: 396531 - RNA, 18 nt, Bordetella pertussis
ccgugcugggcggccagg

SEQ ID NO: 396532 - RNA, 19 nt, Bordetella pertussis
ccguucagggacgggccag

SEQ ID NO: 396533 - RNA, 21 nt, Bordetella pertussis
ccguucagguucaucagccgg

SEQ ID NO: 396534 - RNA, 23 nt, Bordetella pertussis
ccguuccagacgauggugccggc

SEQ ID NO: 396535 - RNA, 15 nt, Bordetella pertussis
ccguuccccaucauc

SEQ ID NO: 396536 - RNA, 20 nt, Bordetella pertussis
ccguucccggugccaguccc

SEQ ID NO: 396537 - RNA, 19 nt, Bordetella pertussis
ccguugcccagauccagcu

SEQ ID NO: 396538 - RNA, 14 nt, Bordetella pertussis
ccguugcuccagcc

SEQ ID NO: 396539 - RNA, 15 nt, Bordetella pertussis
ccguuggcaggccag

SEQ ID NO: 396540 - RNA, 17 nt, Bordetella pertussis
ccguuggccaaugcgcc

SEQ ID NO: 396541 - RNA, 11 nt, Bordetella pertussis
ccguuucaggc

SEQ ID NO: 396542 - RNA, 17 nt, Bordetella pertussis
ccguuucucaacccgcc

SEQ ID NO: 396543 - RNA, 20 nt, Bordetella pertussis
ccguuucucaacccgccggc

SEQ ID NO: 396544 - RNA, 16 nt, Bordetella pertussis
ccuacagcagcggcuc

SEQ ID NO: 396545 - RNA, 21 nt, Bordetella pertussis
ccucauccccgcgugccuguc

SEQ ID NO: 396546 - RNA, 24 nt, Bordetella pertussis
ccucaucguucugcgucaaggcaa

SEQ ID NO: 396547 - RNA, 16 nt, Bordetella pertussis
ccucaugcgggacagg

SEQ ID NO: 396548 - RNA, 19 nt, Bordetella pertussis
ccuccagcaucgccgccag

SEQ ID NO: 396549 - RNA, 12 nt, Bordetella pertussis
ccuccagcucca

SEQ ID NO: 396550 - RNA, 18 nt, Bordetella pertussis
ccuccaggcgcaagccug

SEQ ID NO: 396551 - RNA, 20 nt, Bordetella pertussis
ccuccaucagcagcaccuuc

SEQ ID NO: 396552 - RNA, 20 nt, Bordetella pertussis
ccucccagaccugcgcgccg

SEQ ID NO: 396553 - RNA, 20 nt, Bordetella pertussis
ccucccauugcgcggccagg

SEQ ID NO: 396554 - RNA, 20 nt, Bordetella pertussis
ccuccccaggccagcugcgc

SEQ ID NO: 396555 - RNA, 21 nt, Bordetella pertussis
ccucccgucgucguccacgcc

SEQ ID NO: 396556 - RNA, 13 nt, Bordetella pertussis
ccucccugugggg

SEQ ID NO: 396557 - RNA, 17 nt, Bordetella pertussis
ccucccugugggggaca

SEQ ID NO: 396558 - RNA, 19 nt, Bordetella pertussis
ccucccugugggggacagg

SEQ ID NO: 396559 - RNA, 21 nt, Bordetella pertussis
ccucccugugggggacaggca

SEQ ID NO: 396560 - RNA, 19 nt, Bordetella pertussis
ccuccgcguugcgcugccc

SEQ ID NO: 396561 - RNA, 15 nt, Bordetella pertussis
ccuccggcgccgccu

SEQ ID NO: 396562 - RNA, 23 nt, Bordetella pertussis
ccuccggcucuaccaacccugcc

SEQ ID NO: 396563 - RNA, 14 nt, Bordetella pertussis
ccuccguccaugcg

SEQ ID NO: 396564 - RNA, 19 nt, Bordetella pertussis
ccucgaagaccucggcgcu

SEQ ID NO: 396565 - RNA, 14 nt, Bordetella pertussis
ccucgaccagcccg

SEQ ID NO: 396566 - RNA, 20 nt, Bordetella pertussis
ccucgaccagcccggccgcc

SEQ ID NO: 396567 - RNA, 21 nt, Bordetella pertussis
ccucgacgaugcccugcgcca

SEQ ID NO: 396568 - RNA, 22 nt, Bordetella pertussis
ccucgacgaugcccugcgccag

SEQ ID NO: 396569 - RNA, 23 nt, Bordetella pertussis
ccucgacgaugcccugcgccagc

SEQ ID NO: 396570 - RNA, 19 nt, Bordetella pertussis
ccucgacgcccgggcggcu

SEQ ID NO: 396571 - RNA, 24 nt, Bordetella pertussis
ccucgacgcuguagaggcgcggcu

SEQ ID NO: 396572 - RNA, 19 nt, Bordetella pertussis
ccucgacguaagugcccag

SEQ ID NO: 396573 - RNA, 21 nt, Bordetella pertussis
ccucgacguaagugcccaggc

SEQ ID NO: 396574 - RNA, 17 nt, Bordetella pertussis
ccucgcgcagggcggcc

SEQ ID NO: 396575 - RNA, 21 nt, Bordetella pertussis
ccucgcgcgcgaugcgcaggc

SEQ ID NO: 396576 - RNA, 16 nt, Bordetella pertussis
ccucgcgcugcagcau

SEQ ID NO: 396577 - RNA, 22 nt, Bordetella pertussis
ccucgcggaugaccuggugcac

SEQ ID NO: 396578 - RNA, 15 nt, Bordetella pertussis
ccucgcggcgcagca

SEQ ID NO: 396579 - RNA, 14 nt, Bordetella pertussis
ccucggcgccgcgg

SEQ ID NO: 396580 - RNA, 13 nt, Bordetella pertussis
ccucggcggccag

SEQ ID NO: 396581 - RNA, 21 nt, Bordetella pertussis
ccucggcggccagcgcgcccu

SEQ ID NO: 396582 - RNA, 17 nt, Bordetella pertussis
ccucggcggccuccggc

SEQ ID NO: 396583 - RNA, 22 nt, Bordetella pertussis
ccucggcggcgucgcuggcagc

SEQ ID NO: 396584 - RNA, 16 nt, Bordetella pertussis
ccucggcgggcggcgc

SEQ ID NO: 396585 - RNA, 19 nt, Bordetella pertussis
ccucggcgggcggcgccag

SEQ ID NO: 396586 - RNA, 23 nt, Bordetella pertussis
ccucggcgggcggcgccagcgga

SEQ ID NO: 396587 - RNA, 18 nt, Bordetella pertussis
ccucggcuugcgcggcgc

SEQ ID NO: 396588 - RNA, 15 nt, Bordetella pertussis
ccucgggaaacaggc

SEQ ID NO: 396589 - RNA, 20 nt, Bordetella pertussis
ccucgggcgacuccagcccg

SEQ ID NO: 396590 - RNA, 16 nt, Bordetella pertussis
ccucggggcgcggccg

SEQ ID NO: 396591 - RNA, 15 nt, Bordetella pertussis
ccucggggugcagcu

SEQ ID NO: 396592 - RNA, 12 nt, Bordetella pertussis
ccucgguccagc

SEQ ID NO: 396593 - RNA, 22 nt, Bordetella pertussis
ccucggucgucagcacgcccug

SEQ ID NO: 396594 - RNA, 16 nt, Bordetella pertussis
ccucggucagcgccag

SEQ ID NO: 396595 - RNA, 15 nt, Bordetella pertussis
ccucguaaguggcgg

SEQ ID NO: 396596 - RNA, 19 nt, Bordetella pertussis
ccucgugaucgaccgccag

SEQ ID NO: 396597 - RNA, 16 nt, Bordetella pertussis
ccucguucaugucgcg

SEQ ID NO: 396598 - RNA, 19 nt, Bordetella pertussis
ccucuccacuggccuucuu

SEQ ID NO: 396599 - RNA, 13 nt, Bordetella pertussis
ccucuucggcggc

SEQ ID NO: 396600 - RNA, 16 nt, Bordetella pertussis
ccucuugcgugacccg

SEQ ID NO: 396601 - RNA, 21 nt, Bordetella pertussis
ccucuugcgugacccggggca

SEQ ID NO: 396602 - RNA, 23 nt, Bordetella pertussis
ccucuugcgugacccggggcagg

SEQ ID NO: 396603 - RNA, 14 nt, Bordetella pertussis
ccugaaccaggccg

SEQ ID NO: 396604 - RNA, 16 nt, Bordetella pertussis
ccugaaccaggccgcc

SEQ ID NO: 396605 - RNA, 23 nt, Bordetella pertussis
ccugaaccaggccgccagggccg

SEQ ID NO: 396606 - RNA, 14 nt, Bordetella pertussis
ccugcaaggccggc

SEQ ID NO: 396607 - RNA, 17 nt, Bordetella pertussis
ccugcaagauuucaugg

SEQ ID NO: 396608 - RNA, 13 nt, Bordetella pertussis
ccugcaccgccgc

SEQ ID NO: 396609 - RNA, 16 nt, Bordetella pertussis
ccugcaccgccgcgcg

SEQ ID NO: 396610 - RNA, 18 nt, Bordetella pertussis
ccugcacgaccugcgcau

SEQ ID NO: 396611 - RNA, 15 nt, Bordetella pertussis
ccugcacgcucuuga

SEQ ID NO: 396612 - RNA, 16 nt, Bordetella pertussis
ccugcacgcucuugag

SEQ ID NO: 396613 - RNA, 21 nt, Bordetella pertussis
ccugcacggugggcagcagca

SEQ ID NO: 396614 - RNA, 15 nt, Bordetella pertussis
ccugcacgucccagu

SEQ ID NO: 396615 - RNA, 14 nt, Bordetella pertussis
ccugcagcacggcc

SEQ ID NO: 396616 - RNA, 12 nt, Bordetella pertussis
ccugcagcagcg

SEQ ID NO: 396617 - RNA, 14 nt, Bordetella pertussis
ccugcagcagcgcc

SEQ ID NO: 396618 - RNA, 17 nt, Bordetella pertussis
ccugcagcagcguggcc

SEQ ID NO: 396619 - RNA, 18 nt, Bordetella pertussis
ccugcagcaggcgcacca

SEQ ID NO: 396620 - RNA, 13 nt, Bordetella pertussis
ccugcaggucuuc

SEQ ID NO: 396621 - RNA, 16 nt, Bordetella pertussis
ccugcaggugccgccg

SEQ ID NO: 396622 - RNA, 17 nt, Bordetella pertussis
ccugcaguucggccgcc

SEQ ID NO: 396623 - RNA, 17 nt, Bordetella pertussis
ccugcaucgccaugccg

SEQ ID NO: 396624 - RNA, 20 nt, Bordetella pertussis
ccugcaugccauagucgcgc

SEQ ID NO: 396625 - RNA, 19 nt, Bordetella pertussis
ccugcaugucguacaggcc

SEQ ID NO: 396626 - RNA, 18 nt, Bordetella pertussis
ccugccccugcggggaca

SEQ ID NO: 396627 - RNA, 14 nt, Bordetella pertussis
ccugcccggcaggg

SEQ ID NO: 396628 - RNA, 14 nt, Bordetella pertussis
ccugcccggcgagc

SEQ ID NO: 396629 - RNA, 20 nt, Bordetella pertussis
ccugcccgggcaccaggucc

SEQ ID NO: 396630 - RNA, 16 nt, Bordetella pertussis
ccugcccgggcagcac

SEQ ID NO: 396631 - RNA, 22 nt, Bordetella pertussis
ccugcccgggcagcaccgcugc

SEQ ID NO: 396632 - RNA, 13 nt, Bordetella pertussis
ccugcccgggcgg

SEQ ID NO: 396633 - RNA, 22 nt, Bordetella pertussis
ccugcccgucuauggccugcag

SEQ ID NO: 396634 - RNA, 23 nt, Bordetella pertussis
ccugcccgucuauggccugcagg

SEQ ID NO: 396635 - RNA, 21 nt, Bordetella pertussis
ccugccgcacuucgggccacc

SEQ ID NO: 396636 - RNA, 21 nt, Bordetella pertussis
ccugccgccaagggcgcgcca

SEQ ID NO: 396637 - RNA, 19 nt, Bordetella pertussis
ccugccgcccgagcuggcc

SEQ ID NO: 396638 - RNA, 21 nt, Bordetella pertussis
ccugccgcaucccgcccccgc

SEQ ID NO: 396639 - RNA, 22 nt, Bordetella pertussis
ccugccgcgccgaccggcccca

SEQ ID NO: 396640 - RNA, 20 nt, Bordetella pertussis
ccugccggcgcgcccagggg

SEQ ID NO: 396641 - RNA, 15 nt, Bordetella pertussis
ccugccggcgcgccu

SEQ ID NO: 396642 - RNA, 20 nt, Bordetella pertussis
ccugccggggcacccaggcg

SEQ ID NO: 396643 - RNA, 13 nt, Bordetella pertussis
ccugccgugcaga

SEQ ID NO: 396644 - RNA, 16 nt, Bordetella pertussis
ccugccgugggacagg

SEQ ID NO: 396645 - RNA, 19 nt, Bordetella pertussis
ccugccgugggacaggcac

SEQ ID NO: 396646 - RNA, 21 nt, Bordetella pertussis
ccugccguuauauauagagga

SEQ ID NO: 396647 - RNA, 12 nt, Bordetella pertussis
ccugccucagac

SEQ ID NO: 396648 - RNA, 16 nt, Bordetella pertussis
ccugcgaacgcccggc

SEQ ID NO: 396649 - RNA, 17 nt, Bordetella pertussis
ccugcgaacgcccggcc

SEQ ID NO: 396650 - RNA, 22 nt, Bordetella pertussis
ccugcgagagauagcccagcac

SEQ ID NO: 396651 - RNA, 14 nt, Bordetella pertussis
ccugcgaggacagg

SEQ ID NO: 396652 - RNA, 18 nt, Bordetella pertussis
ccugcgcaauucuuccuc

SEQ ID NO: 396653 - RNA, 18 nt, Bordetella pertussis
ccugcgcaccggccggcc

SEQ ID NO: 396654 - RNA, 21 nt, Bordetella pertussis
ccugcgcaccggccggccggg

SEQ ID NO: 396655 - RNA, 22 nt, Bordetella pertussis
ccugcgccaccuggcgcccggc

SEQ ID NO: 396656 - RNA, 17 nt, Bordetella pertussis
ccugcgccagccgcgcc

SEQ ID NO: 396657 - RNA, 15 nt, Bordetella pertussis
ccugcgccagcgccu

SEQ ID NO: 396658 - RNA, 18 nt, Bordetella pertussis
ccugcgccauggcgcgca

SEQ ID NO: 396659 - RNA, 21 nt, Bordetella pertussis
ccugcgccauguggcgacgcc

SEQ ID NO: 396660 - RNA, 16 nt, Bordetella pertussis
ccugcgccagcuuggc

SEQ ID NO: 396661 - RNA, 16 nt, Bordetella pertussis
ccugcgccgccgcgcg

SEQ ID NO: 396662 - RNA, 17 nt, Bordetella pertussis
ccugcgcgaccgccgcg

SEQ ID NO: 396663 - RNA, 22 nt, Bordetella pertussis
ccugcgcgaggugccggacgcc

SEQ ID NO: 396664 - RNA, 16 nt, Bordetella pertussis
ccugcgcgccgaccag

SEQ ID NO: 396665 - RNA, 16 nt, Bordetella pertussis
ccugcgcgccgccucg

SEQ ID NO: 396666 - RNA, 23 nt, Bordetella pertussis
ccugcgcugcauacgccgcugau

SEQ ID NO: 396667 - RNA, 15 nt, Bordetella pertussis
ccugcggcagcgacu

SEQ ID NO: 396668 - RNA, 19 nt, Bordetella pertussis
ccugcggcgccagcgccgc

SEQ ID NO: 396669 - RNA, 18 nt, Bordetella pertussis
ccugcggcgcggccagca

SEQ ID NO: 396670 - RNA, 18 nt, Bordetella pertussis
ccugcggcuugggcccgg

SEQ ID NO: 396671 - RNA, 16 nt, Bordetella pertussis
ccugcgggaacugcgu

SEQ ID NO: 396672 - RNA, 12 nt, Bordetella pertussis
ccugcgggccgg

SEQ ID NO: 396673 - RNA, 19 nt, Bordetella pertussis
ccugcgggccgggcaggcc

SEQ ID NO: 396674 - RNA, 17 nt, Bordetella pertussis
ccugcgggcgcagcgcc

SEQ ID NO: 396675 - RNA, 23 nt, Bordetella pertussis
ccugcgggcugaugcaggccugc

SEQ ID NO: 396676 - RNA, 14 nt, Bordetella pertussis
ccugcggggacagg

SEQ ID NO: 396677 - RNA, 17 nt, Bordetella pertussis
ccugcggggacaggcac

SEQ ID NO: 396678 - RNA, 19 nt, Bordetella pertussis
ccugcggggacaggcaccc

SEQ ID NO: 396679 - RNA, 22 nt, Bordetella pertussis
ccugcggggacaggcacccugc

SEQ ID NO: 396680 - RNA, 17 nt, Bordetella pertussis
ccugcgggggcaggcac

SEQ ID NO: 396681 - RNA, 23 nt, Bordetella pertussis
ccugcgggugcgccugcagcgcc

SEQ ID NO: 396682 - RNA, 18 nt, Bordetella pertussis
ccugcguggcgggccgcg

SEQ ID NO: 396683 - RNA, 21 nt, Bordetella pertussis
ccugcuaguacaccgucgcgc

SEQ ID NO: 396684 - RNA, 14 nt, Bordetella pertussis
ccugcucguacagc

SEQ ID NO: 396685 - RNA, 19 nt, Bordetella pertussis
ccugcucgucgccaugcgg

SEQ ID NO: 396686 - RNA, 22 nt, Bordetella pertussis
ccugcucgugcaucaucugggc

SEQ ID NO: 396687 - RNA, 18 nt, Bordetella pertussis
ccugcugcagcacacgca

SEQ ID NO: 396688 - RNA, 14 nt, Bordetella pertussis
ccugcugcagcgug

SEQ ID NO: 396689 - RNA, 19 nt, Bordetella pertussis
ccuggacgucugagcgccg

SEQ ID NO: 396690 - RNA, 21 nt, Bordetella pertussis
ccuggagacguagccgcugcc

SEQ ID NO: 396691 - RNA, 22 nt, Bordetella pertussis
ccuggagcucgggugggccggc

SEQ ID NO: 396692 - RNA, 20 nt, Bordetella pertussis
ccuggaucacgugccagccg

SEQ ID NO: 396693 - RNA, 17 nt, Bordetella pertussis
ccuggauggcggccgcc

SEQ ID NO: 396694 - RNA, 23 nt, Bordetella pertussis
ccuggauggcggccgccagcgcc

SEQ ID NO: 396695 - RNA, 17 nt, Bordetella pertussis
ccuggaugugcgcgggc

SEQ ID NO: 396696 - RNA, 20 nt, Bordetella pertussis
ccuggcaaugcguggccggc

SEQ ID NO: 396697 - RNA, 21 nt, Bordetella pertussis
ccuggcaaugcguggccggcg

SEQ ID NO: 396698 - RNA, 11 nt, Bordetella pertussis
ccuggcacgcu

SEQ ID NO: 396699 - RNA, 14 nt, Bordetella pertussis
ccuggcacgcugga

SEQ ID NO: 396700 - RNA, 18 nt, Bordetella pertussis
ccuggcagaugcgcgcca

SEQ ID NO: 396701 - RNA, 23 nt, Bordetella pertussis
ccuggcagaugcgcgccaggcgc

SEQ ID NO: 396702 - RNA, 22 nt, Bordetella pertussis
ccuggcagccgaugauggugaa

SEQ ID NO: 396703 - RNA, 23 nt, Bordetella pertussis
ccuggcagcuggcgcgggcggcc

SEQ ID NO: 396704 - RNA, 13 nt, Bordetella pertussis
ccuggcaggccgc

SEQ ID NO: 396705 - RNA, 16 nt, Bordetella pertussis
ccuggcagucagccgu

SEQ ID NO: 396706 - RNA, 20 nt, Bordetella pertussis
ccuggccacaagcggcccca

SEQ ID NO: 396707 - RNA, 21 nt, Bordetella pertussis
ccuggccacaagcggccccag

SEQ ID NO: 396708 - RNA, 14 nt, Bordetella pertussis
ccuggcggccgccc

SEQ ID NO: 396709 - RNA, 20 nt, Bordetella pertussis
ccuggcgguaugcggcgccc

SEQ ID NO: 396710 - RNA, 17 nt, Bordetella pertussis
ccugggccagcagcugg

SEQ ID NO: 396711 - RNA, 22 nt, Bordetella pertussis
ccugggccagcaggucguuggc

SEQ ID NO: 396712 - RNA, 15 nt, Bordetella pertussis
ccugggccagccagc

SEQ ID NO: 396713 - RNA, 20 nt, Bordetella pertussis
ccugggccagccagcgccgc

SEQ ID NO: 396714 - RNA, 21 nt, Bordetella pertussis
ccugggccgagcgcgccagca

SEQ ID NO: 396715 - RNA, 18 nt, Bordetella pertussis
ccugggccgccugcuggg

SEQ ID NO: 396716 - RNA, 20 nt, Bordetella pertussis
ccugggccgccugcugggcc

SEQ ID NO: 396717 - RNA, 21 nt, Bordetella pertussis
ccugggcgcgaugggccugcc

SEQ ID NO: 396718 - RNA, 22 nt, Bordetella pertussis
ccugggcgcgaugggccugccc

SEQ ID NO: 396719 - RNA, 15 nt, Bordetella pertussis
ccugggcuuuggcuu

SEQ ID NO: 396720 - RNA, 22 nt, Bordetella pertussis
ccuggggggucaaccagguacc

SEQ ID NO: 396721 - RNA, 20 nt, Bordetella pertussis
ccugguaagaaaccuggccc

SEQ ID NO: 396722 - RNA, 15 nt, Bordetella pertussis
ccugguacgacagcu

SEQ ID NO: 396723 - RNA, 20 nt, Bordetella pertussis
ccugguauccggcgcacgcc

SEQ ID NO: 396724 - RNA, 17 nt, Bordetella pertussis
ccuggucaagggcggcc

SEQ ID NO: 396725 - RNA, 20 nt, Bordetella pertussis
ccugguauugccuguggaua

SEQ ID NO: 396726 - RNA, 17 nt, Bordetella pertussis
ccuggucagcgccgacg

SEQ ID NO: 396727 - RNA, 20 nt, Bordetella pertussis
ccugucccagcggggacagg

SEQ ID NO: 396728 - RNA, 21 nt, Bordetella pertussis
ccuguccccacagggggacug

SEQ ID NO: 396729 - RNA, 21 nt, Bordetella pertussis
ccuguccccacugggggacug

SEQ ID NO: 396730 - RNA, 17 nt, Bordetella pertussis
ccuguccccgcaagggg

SEQ ID NO: 396731 - RNA, 18 nt, Bordetella pertussis
ccuguccccgcugggaca

SEQ ID NO: 396732 - RNA, 23 nt, Bordetella pertussis
ccugucccgcacgcagcccuucg

SEQ ID NO: 396733 - RNA, 15 nt, Bordetella pertussis
ccuguccuccccgcu

SEQ ID NO: 396734 - RNA, 21 nt, Bordetella pertussis
ccugucgcgcugcuuucccug

SEQ ID NO: 396735 - RNA, 19 nt, Bordetella pertussis
ccugucggugaugauccug

SEQ ID NO: 396736 - RNA, 20 nt, Bordetella pertussis
ccugugggggacaggcacgc

SEQ ID NO: 396737 - RNA, 15 nt, Bordetella pertussis
ccuuccaccagccgu

SEQ ID NO: 396738 - RNA, 14 nt, Bordetella pertussis
ccuucccaaaaaaa

SEQ ID NO: 396739 - RNA, 23 nt, Bordetella pertussis
ccuucccaaaaaaaaaccccgcc

SEQ ID NO: 396740 - RNA, 12 nt, Bordetella pertussis
ccuucccaggcg

SEQ ID NO: 396741 - RNA, 22 nt, Bordetella pertussis
ccuucccggccgaaaccgccgc

SEQ ID NO: 396742 - RNA, 18 nt, Bordetella pertussis
ccuuccggcagcggccag

SEQ ID NO: 396743 - RNA, 22 nt, Bordetella pertussis
ccuuccggcagcggccagcgcg

SEQ ID NO: 396744 - RNA, 12 nt, Bordetella pertussis
ccuuccuggcca

SEQ ID NO: 396745 - RNA, 20 nt, Bordetella pertussis
ccuuccuugaccaccuugcc

SEQ ID NO: 396746 - RNA, 14 nt, Bordetella pertussis
ccuucgaggaaagc

SEQ ID NO: 396747 - RNA, 19 nt, Bordetella pertussis
ccuucgcgcagcggcgcgc

SEQ ID NO: 396748 - RNA, 18 nt, Bordetella pertussis
ccuucggcauggucggca

SEQ ID NO: 396749 - RNA, 16 nt, Bordetella pertussis
ccuucggccaaucggc

SEQ ID NO: 396750 - RNA, 21 nt, Bordetella pertussis
ccuucggccaaucggccugcu

SEQ ID NO: 396751 - RNA, 19 nt, Bordetella pertussis
ccuucggcgcgcgccggcu

SEQ ID NO: 396752 - RNA, 15 nt, Bordetella pertussis
ccuucggggcagcga

SEQ ID NO: 396753 - RNA, 18 nt, Bordetella pertussis
ccuucggguugcaaauuc

SEQ ID NO: 396754 - RNA, 17 nt, Bordetella pertussis
ccuucgucgcgcacccg

SEQ ID NO: 396755 - RNA, 18 nt, Bordetella pertussis
ccuucugccgccaggcau

SEQ ID NO: 396756 - RNA, 17 nt, Bordetella pertussis
ccuugaccaccuugccc

SEQ ID NO: 396757 - RNA, 14 nt, Bordetella pertussis
ccuugacgccgccg

SEQ ID NO: 396758 - RNA, 18 nt, Bordetella pertussis
ccuugagaugccagcggc

SEQ ID NO: 396759 - RNA, 13 nt, Bordetella pertussis
ccuugagcgccag

SEQ ID NO: 396760 - RNA, 20 nt, Bordetella pertussis
ccuugagggcgcgggccagc

SEQ ID NO: 396761 - RNA, 23 nt, Bordetella pertussis
ccuugauggccgggccguggcga

SEQ ID NO: 396762 - RNA, 18 nt, Bordetella pertussis
ccuugccauccagccagg

SEQ ID NO: 396763 - RNA, 19 nt, Bordetella pertussis
ccuugcccaggcugggcca

SEQ ID NO: 396764 - RNA, 22 nt, Bordetella pertussis
ccuugcccgggcuggccgccug

SEQ ID NO: 396765 - RNA, 23 nt, Bordetella pertussis
ccuugcccgggcuggccgccugc

SEQ ID NO: 396766 - RNA, 22 nt, Bordetella pertussis
ccuugccgauccagcgccuggg

SEQ ID NO: 396767 - RNA, 19 nt, Bordetella pertussis
ccuugccgcagcggggaca

SEQ ID NO: 396768 - RNA, 18 nt, Bordetella pertussis
ccuugccgggcucgauga

SEQ ID NO: 396769 - RNA, 15 nt, Bordetella pertussis
ccuugcgaugccagu

SEQ ID NO: 396770 - RNA, 21 nt, Bordetella pertussis
ccuugcgcgaaggccgccccc

SEQ ID NO: 396771 - RNA, 15 nt, Bordetella pertussis
ccuugcgcgacagca

SEQ ID NO: 396772 - RNA, 18 nt, Bordetella pertussis
ccuugcgcgacagcaggc

SEQ ID NO: 396773 - RNA, 21 nt, Bordetella pertussis
ccuugcgcggcgagcgccgcc

SEQ ID NO: 396774 - RNA, 15 nt, Bordetella pertussis
ccuugcgcguccagg

SEQ ID NO: 396775 - RNA, 18 nt, Bordetella pertussis
ccuugcgcucgcccagca

SEQ ID NO: 396776 - RNA, 13 nt, Bordetella pertussis
ccuugcggcgccg

SEQ ID NO: 396777 - RNA, 16 nt, Bordetella pertussis
ccuugcgggccggcug

SEQ ID NO: 396778 - RNA, 24 nt, Bordetella pertussis
ccuugcucagucgggcagcgcccg

SEQ ID NO: 396779 - RNA, 21 nt, Bordetella pertussis
ccuugcucccaguucugcagc

SEQ ID NO: 396780 - RNA, 14 nt, Bordetella pertussis
ccuugcugaaccug

SEQ ID NO: 396781 - RNA, 20 nt, Bordetella pertussis
ccuugcugaaccugcuggcc

SEQ ID NO: 396782 - RNA, 14 nt, Bordetella pertussis
ccuugcugcccgac

SEQ ID NO: 396783 - RNA, 19 nt, Bordetella pertussis
ccuuggaguagccgcucag

SEQ ID NO: 396784 - RNA, 13 nt, Bordetella pertussis
ccuuggccagcag

SEQ ID NO: 396785 - RNA, 14 nt, Bordetella pertussis
ccuuggccagcagc

SEQ ID NO: 396786 - RNA, 10 nt, Bordetella pertussis
ccuuggccau

SEQ ID NO: 396787 - RNA, 13 nt, Bordetella pertussis
ccuuggcccacuc

SEQ ID NO: 396788 - RNA, 14 nt, Bordetella pertussis
ccuuggccgcagcc

SEQ ID NO: 396789 - RNA, 15 nt, Bordetella pertussis
ccuuggccgcagccg

SEQ ID NO: 396790 - RNA, 16 nt, Bordetella pertussis
ccuuggccgcagccgg

SEQ ID NO: 396791 - RNA, 18 nt, Bordetella pertussis
ccuuggccgcagccggcu

SEQ ID NO: 396792 - RNA, 12 nt, Bordetella pertussis
ccuuggccgcag

SEQ ID NO: 396793 - RNA, 17 nt, Bordetella pertussis
ccuuggccugggccgac

SEQ ID NO: 396794 - RNA, 16 nt, Bordetella pertussis
ccuuggccuuggcggc

SEQ ID NO: 396795 - RNA, 16 nt, Bordetella pertussis
ccuuggcgcgcagacg

SEQ ID NO: 396796 - RNA, 20 nt, Bordetella pertussis
ccuuggcggccgacagcuug

SEQ ID NO: 396797 - RNA, 16 nt, Bordetella pertussis
ccuuggcguccggccc

SEQ ID NO: 396798 - RNA, 19 nt, Bordetella pertussis
ccuuggcguccggccccag

SEQ ID NO: 396799 - RNA, 21 nt, Bordetella pertussis
ccuuggcuucggucacacugg

SEQ ID NO: 396800 - RNA, 22 nt, Bordetella pertussis
ccuuguacuggucgcgcagcug

SEQ ID NO: 396801 - RNA, 20 nt, Bordetella pertussis
ccuugucgcccgauugcagu

SEQ ID NO: 396802 - RNA, 15 nt, Bordetella pertussis
ccuugugcacgugcg

SEQ ID NO: 396803 - RNA, 13 nt, Bordetella pertussis
ccuugugcgccag

SEQ ID NO: 396804 - RNA, 18 nt, Bordetella pertussis
ccuugugcggcagguuga

SEQ ID NO: 396805 - RNA, 22 nt, Bordetella pertussis
ccuugugcugccaugccgcgcg

SEQ ID NO: 396806 - RNA, 14 nt, Bordetella pertussis
ccuuguggccgccg

SEQ ID NO: 396807 - RNA, 18 nt, Bordetella pertussis
ccuuguuggcgccggccg

SEQ ID NO: 396808 - RNA, 22 nt, Bordetella pertussis
ccuuguuggcgccggccgcgcg

SEQ ID NO: 396809 - RNA, 15 nt, Bordetella pertussis
ccuuuccuccugccg

SEQ ID NO: 396810 - RNA, 21 nt, Bordetella pertussis
ccuuuuccaggcgugcccggu

SEQ ID NO: 396811 - RNA, 19 nt, Bordetella pertussis
ccuuuuuacaugcagccgc

SEQ ID NO: 396812 - RNA, 17 nt, Bordetella pertussis
cgaaaaacggcggaaau

SEQ ID NO: 396813 - RNA, 23 nt, Bordetella pertussis
cgaaaaagcccgcgccaccaccg

SEQ ID NO: 396814 - RNA, 16 nt, Bordetella pertussis
cgaaaaccaggcugcc

SEQ ID NO: 396815 - RNA, 13 nt, Bordetella pertussis
cgaaacagcagcg

SEQ ID NO: 396816 - RNA, 23 nt, Bordetella pertussis
cgaaacccgcugggccagcaucg

SEQ ID NO: 396817 - RNA, 20 nt, Bordetella pertussis
cgaaaccggugaucagcagg

SEQ ID NO: 396818 - RNA, 15 nt, Bordetella pertussis
cgaaacgccagcccg

SEQ ID NO: 396819 - RNA, 15 nt, Bordetella pertussis
cgaaacgcgcagcac

SEQ ID NO: 396820 - RNA, 19 nt, Bordetella pertussis
cgaaacgcgcguccuuggc

SEQ ID NO: 396821 - RNA, 17 nt, Bordetella pertussis
cgaaacgguucuggauc

SEQ ID NO: 396822 - RNA, 23 nt, Bordetella pertussis
cgaaagccagcgccugcgcggcc

SEQ ID NO: 396823 - RNA, 18 nt, Bordetella pertussis
cgaaagccggccuccggg

SEQ ID NO: 396824 - RNA, 17 nt, Bordetella pertussis
cgaaagguccuggagac

SEQ ID NO: 396825 - RNA, 21 nt, Bordetella pertussis
cgaaaugaagucgucgauggc

SEQ ID NO: 396826 - RNA, 16 nt, Bordetella pertussis
cgaaaugccgcagcac

SEQ ID NO: 396827 - RNA, 16 nt, Bordetella pertussis
cgaaauggcggccucg

SEQ ID NO: 396828 - RNA, 14 nt, Bordetella pertussis
cgaacacgccgacc

SEQ ID NO: 396829 - RNA, 14 nt, Bordetella pertussis
cgaacagcauggcg

SEQ ID NO: 396830 - RNA, 13 nt, Bordetella pertussis
cgaaccacccggc

SEQ ID NO: 396831 - RNA, 16 nt, Bordetella pertussis
cgaaccacccggccau

SEQ ID NO: 396832 - RNA, 17 nt, Bordetella pertussis
cgaaccagcgcaccacc

SEQ ID NO: 396833 - RNA, 20 nt, Bordetella pertussis
cgaaccaguugcgggccucg

SEQ ID NO: 396834 - RNA, 12 nt, Bordetella pertussis
cgaaccgaauuc

SEQ ID NO: 396835 - RNA, 17 nt, Bordetella pertussis
cgaaccgauccagcccg

SEQ ID NO: 396836 - RNA, 21 nt, Bordetella pertussis
cgaaccuuccuccgacaggcg

SEQ ID NO: 396837 - RNA, 12 nt, Bordetella pertussis
cgaacgccacgc

SEQ ID NO: 396838 - RNA, 12 nt, Bordetella pertussis
cgaacgccgcgu

SEQ ID NO: 396839 - RNA, 15 nt, Bordetella pertussis
cgaacgccugccaga

SEQ ID NO: 396840 - RNA, 13 nt, Bordetella pertussis
cgaacgcgcagcg

SEQ ID NO: 396841 - RNA, 15 nt, Bordetella pertussis
cgaacggccgcccgg

SEQ ID NO: 396842 - RNA, 14 nt, Bordetella pertussis
cgaacggccgggcg

SEQ ID NO: 396843 - RNA, 15 nt, Bordetella pertussis
cgaacggcagcagcg

SEQ ID NO: 396844 - RNA, 22 nt, Bordetella pertussis
cgaacgggccgcaagcaagccc

SEQ ID NO: 396845 - RNA, 14 nt, Bordetella pertussis
cgaacuccugcaac

SEQ ID NO: 396846 - RNA, 22 nt, Bordetella pertussis
cgaacuccugcaaccagcucag

SEQ ID NO: 396847 - RNA, 19 nt, Bordetella pertussis
cgaacugucgcgccacggc

SEQ ID NO: 396848 - RNA, 20 nt, Bordetella pertussis
cgaagaacaccaucaaggcc

SEQ ID NO: 396849 - RNA, 23 nt, Bordetella pertussis
cgaagaaccaguagcacacgccg

SEQ ID NO: 396850 - RNA, 18 nt, Bordetella pertussis
cgaagaaggccuuggccu

SEQ ID NO: 396851 - RNA, 14 nt, Bordetella pertussis
cgaagaagcagccg

SEQ ID NO: 396852 - RNA, 23 nt, Bordetella pertussis
cgaagacgaucucacagacgauc

SEQ ID NO: 396853 - RNA, 23 nt, Bordetella pertussis
cgaagaggguuauuuccggccgc

SEQ ID NO: 396854 - RNA, 12 nt, Bordetella pertussis
cgaagcaaacag

SEQ ID NO: 396855 - RNA, 23 nt, Bordetella pertussis
cgaagcaggugaugcgcgcggcc

SEQ ID NO: 396856 - RNA, 19 nt, Bordetella pertussis
cgaagccgcagcggcagcg

SEQ ID NO: 396857 - RNA, 18 nt, Bordetella pertussis
cgaagccuugcgcggcca

SEQ ID NO: 396858 - RNA, 18 nt, Bordetella pertussis
cgaagcgcgccagcagcg

SEQ ID NO: 396859 - RNA, 15 nt, Bordetella pertussis
cgaagcggaugcgcc

SEQ ID NO: 396860 - RNA, 20 nt, Bordetella pertussis
cgaagcgggcgccggcgccc

SEQ ID NO: 396861 - RNA, 18 nt, Bordetella pertussis
cgaaggcaaucagcccgg

SEQ ID NO: 396862 - RNA, 13 nt, Bordetella pertussis
cgaaggcgccggc

SEQ ID NO: 396863 - RNA, 15 nt, Bordetella pertussis
cgaaggcgucggcca

SEQ ID NO: 396864 - RNA, 21 nt, Bordetella pertussis
cgaaggcgucggccauggcgc

SEQ ID NO: 396865 - RNA, 19 nt, Bordetella pertussis
cgaaggcgugaggcccagc

SEQ ID NO: 396866 - RNA, 19 nt, Bordetella pertussis
cgaaggggacuggcucccg

SEQ ID NO: 396867 - RNA, 20 nt, Bordetella pertussis
cgaaggucuggucgcacgac

SEQ ID NO: 396868 - RNA, 16 nt, Bordetella pertussis
cgaaggugcggaucac

SEQ ID NO: 396869 - RNA, 21 nt, Bordetella pertussis
cgaagguggcacaucagcgug

SEQ ID NO: 396870 - RNA, 21 nt, Bordetella pertussis
cgaagguguccggaugcacgu

SEQ ID NO: 396871 - RNA, 22 nt, Bordetella pertussis
cgaagguuucgcugcgcacgcu

SEQ ID NO: 396872 - RNA, 20 nt, Bordetella pertussis
cgaagguuucguagccgccg

SEQ ID NO: 396873 - RNA, 17 nt, Bordetella pertussis
cgaaguacacggccagc

SEQ ID NO: 396874 - RNA, 22 nt, Bordetella pertussis
cgaagucauguagcggccgccc

SEQ ID NO: 396875 - RNA, 14 nt, Bordetella pertussis
cgaagucccagccg

SEQ ID NO: 396876 - RNA, 14 nt, Bordetella pertussis
cgaauaugcccucu

SEQ ID NO: 396877 - RNA, 17 nt, Bordetella pertussis
cgaauccagggccacgc

SEQ ID NO: 396878 - RNA, 11 nt, Bordetella pertussis
cgaaugcacgg

SEQ ID NO: 396879 - RNA, 23 nt, Bordetella pertussis
cgaaugcacgggcgcugcccagg

SEQ ID NO: 396880 - RNA, 21 nt, Bordetella pertussis
cgaaugcguguuccagcgccu

SEQ ID NO: 396881 - RNA, 20 nt, Bordetella pertussis
cgacacccccagggcgcgcc

SEQ ID NO: 396882 - RNA, 18 nt, Bordetella pertussis
cgacaccgucaggaagcc

SEQ ID NO: 396883 - RNA, 18 nt, Bordetella pertussis
cgacaccuacauccugga

SEQ ID NO: 396884 - RNA, 16 nt, Bordetella pertussis
cgacacgccgcgcgau

SEQ ID NO: 396885 - RNA, 21 nt, Bordetella pertussis
cgacacgccgcgcgaucgccg

SEQ ID NO: 396886 - RNA, 22 nt, Bordetella pertussis
cgacagaccguagcgcaggcgc

SEQ ID NO: 396887 - RNA, 21 nt, Bordetella pertussis
cgacagcaccggguaauggcg

SEQ ID NO: 396888 - RNA, 11 nt, Bordetella pertussis
cgacagcagca

SEQ ID NO: 396889 - RNA, 16 nt, Bordetella pertussis
cgacagcgacacggcg

SEQ ID NO: 396890 - RNA, 13 nt, Bordetella pertussis
cgacagcgcgccc

SEQ ID NO: 396891 - RNA, 23 nt, Bordetella pertussis
cgacaggaacauguucacgccca

SEQ ID NO: 396892 - RNA, 22 nt, Bordetella pertussis
cgacaggaugggcgcuuggccc

SEQ ID NO: 396893 - RNA, 13 nt, Bordetella pertussis
cgacaggcgcgcc

SEQ ID NO: 396894 - RNA, 21 nt, Bordetella pertussis
cgacaggcggugcgcgcggcc

SEQ ID NO: 396895 - RNA, 20 nt, Bordetella pertussis
cgacagggcgucgucgggac

SEQ ID NO: 396896 - RNA, 14 nt, Bordetella pertussis
cgacaggguccagg

SEQ ID NO: 396897 - RNA, 19 nt, Bordetella pertussis
cgacauagagauuguccag

SEQ ID NO: 396898 - RNA, 22 nt, Bordetella pertussis
cgacauagagauuguccagcgg

SEQ ID NO: 396899 - RNA, 14 nt, Bordetella pertussis
cgacauagcgcugg

SEQ ID NO: 396900 - RNA, 22 nt, Bordetella pertussis
cgacauagcgcuggaacguuug

SEQ ID NO: 396901 - RNA, 19 nt, Bordetella pertussis
cgaccaaccugaccgccuu

SEQ ID NO: 396902 - RNA, 18 nt, Bordetella pertussis
cgaccaacucgaggcggc

SEQ ID NO: 396903 - RNA, 15 nt, Bordetella pertussis
cgaccaccagcacca

SEQ ID NO: 396904 - RNA, 15 nt, Bordetella pertussis
cgaccaccagcaccg

SEQ ID NO: 396905 - RNA, 21 nt, Bordetella pertussis
cgaccaccagcaucgcgccuu

SEQ ID NO: 396906 - RNA, 12 nt, Bordetella pertussis
cgaccaccagcg

SEQ ID NO: 396907 - RNA, 13 nt, Bordetella pertussis
cgaccacccgcgc

SEQ ID NO: 396908 - RNA, 18 nt, Bordetella pertussis
cgaccaccugcaccgccg

SEQ ID NO: 396909 - RNA, 16 nt, Bordetella pertussis
cgaccacgccggcggc

SEQ ID NO: 396910 - RNA, 22 nt, Bordetella pertussis
cgaccacgcgcgcgccgccggc

SEQ ID NO: 396911 - RNA, 18 nt, Bordetella pertussis
cgaccacggaauguugau

SEQ ID NO: 396912 - RNA, 17 nt, Bordetella pertussis
cgaccacuaucagcgcg

SEQ ID NO: 396913 - RNA, 14 nt, Bordetella pertussis
cgaccacuggaagc

SEQ ID NO: 396914 - RNA, 20 nt, Bordetella pertussis
cgaccacuggaagcugcggc

SEQ ID NO: 396915 - RNA, 12 nt, Bordetella pertussis
cgaccacuggca

SEQ ID NO: 396916 - RNA, 21 nt, Bordetella pertussis
cgaccacuggcagaccgagcg

SEQ ID NO: 396917 - RNA, 11 nt, Bordetella pertussis
cgaccagcagc

SEQ ID NO: 396918 - RNA, 21 nt, Bordetella pertussis
cgaccagcaggcccaccaggg

SEQ ID NO: 396919 - RNA, 14 nt, Bordetella pertussis
cgaccagcgacagc

SEQ ID NO: 396920 - RNA, 20 nt, Bordetella pertussis
cgaccagcgcacggucgaag

SEQ ID NO: 396921 - RNA, 15 nt, Bordetella pertussis
cgaccagcgcgcgcc

SEQ ID NO: 396922 - RNA, 18 nt, Bordetella pertussis
cgaccagcgcgcgccggc

SEQ ID NO: 396923 - RNA, 14 nt, Bordetella pertussis
cgaccagcuucugc

SEQ ID NO: 396924 - RNA, 14 nt, Bordetella pertussis
cgaccaggaccugu

SEQ ID NO: 396925 - RNA, 15 nt, Bordetella pertussis
cgaccaggaccugua

SEQ ID NO: 396926 - RNA, 20 nt, Bordetella pertussis
cgaccaggcgggcaucgccc

SEQ ID NO: 396927 - RNA, 12 nt, Bordetella pertussis
cgaccaggcugc

SEQ ID NO: 396928 - RNA, 22 nt, Bordetella pertussis
cgaccaggcugcgcgccggcgc

SEQ ID NO: 396929 - RNA, 14 nt, Bordetella pertussis
cgaccaggcuggag

SEQ ID NO: 396930 - RNA, 20 nt, Bordetella pertussis
cgaccaguucggccagcagc

SEQ ID NO: 396931 - RNA, 16 nt, Bordetella pertussis
cgaccaucauggccag

SEQ ID NO: 396932 - RNA, 17 nt, Bordetella pertussis
cgaccaugcggccgucg

SEQ ID NO: 396933 - RNA, 17 nt, Bordetella pertussis
cgaccauguccgcgccc

SEQ ID NO: 396934 - RNA, 20 nt, Bordetella pertussis
cgacccacuugagcagcgcc

SEQ ID NO: 396935 - RNA, 19 nt, Bordetella pertussis
cgacccagaacccggccgg

SEQ ID NO: 396936 - RNA, 20 nt, Bordetella pertussis
cgacccagaacccggccggc

SEQ ID NO: 396937 - RNA, 22 nt, Bordetella pertussis
cgacccagaacccggccggcgc

SEQ ID NO: 396938 - RNA, 22 nt, Bordetella pertussis
cgaccauuucgauuucggcggc

SEQ ID NO: 396939 - RNA, 14 nt, Bordetella pertussis
cgacccaggccggc

SEQ ID NO: 396940 - RNA, 20 nt, Bordetella pertussis
cgacccaggccggcgccagc

SEQ ID NO: 396941 - RNA, 18 nt, Bordetella pertussis
cgaccccgccgugccggg

SEQ ID NO: 396942 - RNA, 19 nt, Bordetella pertussis
cgacccggacaacgcgcgc

SEQ ID NO: 396943 - RNA, 13 nt, Bordetella pertussis
cgacccugcccgg

SEQ ID NO: 396944 - RNA, 14 nt, Bordetella pertussis
cgacccugcccggc

SEQ ID NO: 396945 - RNA, 21 nt, Bordetella pertussis
cgaccgagccggccagcgccu

SEQ ID NO: 396946 - RNA, 16 nt, Bordetella pertussis
cgaccgcaugggcgcc

SEQ ID NO: 396947 - RNA, 17 nt, Bordetella pertussis
cgaccgccagcaggccc

SEQ ID NO: 396948 - RNA, 13 nt, Bordetella pertussis
cgaccgccggccg

SEQ ID NO: 396949 - RNA, 14 nt, Bordetella pertussis
cgaccgccggccgg

SEQ ID NO: 396950 - RNA, 13 nt, Bordetella pertussis
cgaccgccgcggg

SEQ ID NO: 396951 - RNA, 17 nt, Bordetella pertussis
cgaccgcgaagccgccc

SEQ ID NO: 396952 - RNA, 15 nt, Bordetella pertussis
cgaccgcgcggcgcu

SEQ ID NO: 396953 - RNA, 18 nt, Bordetella pertussis
cgaccgcgggcgcgcgcc

SEQ ID NO: 396954 - RNA, 16 nt, Bordetella pertussis
cgaccgcuucggucag

SEQ ID NO: 396955 - RNA, 20 nt, Bordetella pertussis
cgaccggcgaagagccguac

SEQ ID NO: 396956 - RNA, 14 nt, Bordetella pertussis
cgaccggcgccggc

SEQ ID NO: 396957 - RNA, 15 nt, Bordetella pertussis
cgaccucgagcaccu

SEQ ID NO: 396958 - RNA, 18 nt, Bordetella pertussis
cgaccucgggacggcccu

SEQ ID NO: 396959 - RNA, 23 nt, Bordetella pertussis
cgaccugaauccguaagcgcugg

SEQ ID NO: 396960 - RNA, 17 nt, Bordetella pertussis
cgaccugaucgcgcagc

SEQ ID NO: 396961 - RNA, 11 nt, Bordetella pertussis
cgaccugcccg

SEQ ID NO: 396962 - RNA, 19 nt, Bordetella pertussis
cgaccugcgcaccggccgg

SEQ ID NO: 396963 - RNA, 22 nt, Bordetella pertussis
cgaccuggaucacgugccagcc

SEQ ID NO: 396964 - RNA, 16 nt, Bordetella pertussis
cgaccuugcggccgcg

SEQ ID NO: 396965 - RNA, 12 nt, Bordetella pertussis
cgaccuugcugg

SEQ ID NO: 396966 - RNA, 17 nt, Bordetella pertussis
cgaccuugcuggaccgc

SEQ ID NO: 396967 - RNA, 18 nt, Bordetella pertussis
cgacgaaacccgggccgu

SEQ ID NO: 396968 - RNA, 13 nt, Bordetella pertussis
cgacgaacacgcg

SEQ ID NO: 396969 - RNA, 18 nt, Bordetella pertussis
cgacgaacacgcgcgccg

SEQ ID NO: 396970 - RNA, 22 nt, Bordetella pertussis
cgacgaagcccgugucggcaac

SEQ ID NO: 396971 - RNA, 23 nt, Bordetella pertussis
cgacgaccccgccgugccgggcc

SEQ ID NO: 396972 - RNA, 14 nt, Bordetella pertussis
cgacgagcgcacca

SEQ ID NO: 396973 - RNA, 19 nt, Bordetella pertussis
cgacgaggggguguucucc

SEQ ID NO: 396974 - RNA, 15 nt, Bordetella pertussis
cgacgauggccgggg

SEQ ID NO: 396975 - RNA, 15 nt, Bordetella pertussis
cgacgaugucgccgc

SEQ ID NO: 396976 - RNA, 15 nt, Bordetella pertussis
cgacgcaggcgccgc

SEQ ID NO: 396977 - RNA, 22 nt, Bordetella pertussis
cgacgcauauccaggcggcgcu

SEQ ID NO: 396978 - RNA, 18 nt, Bordetella pertussis
cgacgcaugucagcgccu

SEQ ID NO: 396979 - RNA, 13 nt, Bordetella pertussis
cgacgccgcgcgc

SEQ ID NO: 396980 - RNA, 15 nt, Bordetella pertussis
cgacgccgcgcgcga

SEQ ID NO: 396981 - RNA, 19 nt, Bordetella pertussis
cgacgccgcggugcugggc

SEQ ID NO: 396982 - RNA, 21 nt, Bordetella pertussis
cgacgccgcggugcugggcuu

SEQ ID NO: 396983 - RNA, 20 nt, Bordetella pertussis
cgacgcgauguccagcucca

SEQ ID NO: 396984 - RNA, 12 nt, Bordetella pertussis
cgacgcgccggg

SEQ ID NO: 396985 - RNA, 14 nt, Bordetella pertussis
cgacgcgccgggcc

SEQ ID NO: 396986 - RNA, 16 nt, Bordetella pertussis
cgacgcgcgccggcgc

SEQ ID NO: 396987 - RNA, 12 nt, Bordetella pertussis
cgacgcgcugcc

SEQ ID NO: 396988 - RNA, 20 nt, Bordetella pertussis
cgacgcggccagcggcgcuu

SEQ ID NO: 396989 - RNA, 16 nt, Bordetella pertussis
cgacgcggcggccggu

SEQ ID NO: 396990 - RNA, 21 nt, Bordetella pertussis
cgacgcguuguucgggccggc

SEQ ID NO: 396991 - RNA, 16 nt, Bordetella pertussis
cgacgcgggcggccga

SEQ ID NO: 396992 - RNA, 19 nt, Bordetella pertussis
cgacgcugaucggccgacu

SEQ ID NO: 396993 - RNA, 16 nt, Bordetella pertussis
cgacgcuugccggcga

SEQ ID NO: 396994 - RNA, 22 nt, Bordetella pertussis
cgacgcuugccggcgaucacgc

SEQ ID NO: 396995 - RNA, 18 nt, Bordetella pertussis
cgacggauucgcccaggg

SEQ ID NO: 396996 - RNA, 19 nt, Bordetella pertussis
cgacggcagauggacaaga

SEQ ID NO: 396997 - RNA, 20 nt, Bordetella pertussis
cgacggcauggcggccagcu

SEQ ID NO: 396998 - RNA, 18 nt, Bordetella pertussis
cgacggccccagcgccgc

SEQ ID NO: 396999 - RNA, 19 nt, Bordetella pertussis
cgacggccucccgccgccc

SEQ ID NO: 397000 - RNA, 18 nt, Bordetella pertussis
cgacggccuccgcgccga

SEQ ID NO: 397001 - RNA, 18 nt, Bordetella pertussis
cgacggccucggccagga

SEQ ID NO: 397002 - RNA, 16 nt, Bordetella pertussis
cgacggccuggaggcc

SEQ ID NO: 397003 - RNA, 21 nt, Bordetella pertussis
cgacggccuggaggccgagcg

SEQ ID NO: 397004 - RNA, 22 nt, Bordetella pertussis
cgacggccggcgcgugcuggcg

SEQ ID NO: 397005 - RNA, 13 nt, Bordetella pertussis
cgacggcgcgccc

SEQ ID NO: 397006 - RNA, 14 nt, Bordetella pertussis
cgacggcgcgcgcg

SEQ ID NO: 397007 - RNA, 13 nt, Bordetella pertussis
cgacggcgcggcg

SEQ ID NO: 397008 - RNA, 18 nt, Bordetella pertussis
cgacgguccugcgcgccg

SEQ ID NO: 397009 - RNA, 19 nt, Bordetella pertussis
cgacguaaaaucccgcguu

SEQ ID NO: 397010 - RNA, 15 nt, Bordetella pertussis
cgacguaagugccca

SEQ ID NO: 397011 - RNA, 20 nt, Bordetella pertussis
cgacguaagugcccaggccc

SEQ ID NO: 397012 - RNA, 12 nt, Bordetella pertussis
cgacguccuggu

SEQ ID NO: 397013 - RNA, 17 nt, Bordetella pertussis
cgacgucguaccccgag

SEQ ID NO: 397014 - RNA, 15 nt, Bordetella pertussis
cgacguggaccgcgc

SEQ ID NO: 397015 - RNA, 20 nt, Bordetella pertussis
cgacguugcgcgacaggccc

SEQ ID NO: 397016 - RNA, 14 nt, Bordetella pertussis
cgacuacuggcaac

SEQ ID NO: 397017 - RNA, 16 nt, Bordetella pertussis
cgacuccggccgggcc

SEQ ID NO: 397018 - RNA, 19 nt, Bordetella pertussis
cgacucgucgaccaccagc

SEQ ID NO: 397019 - RNA, 20 nt, Bordetella pertussis
cgacugccccagcggcuggc

SEQ ID NO: 397020 - RNA, 18 nt, Bordetella pertussis
cgacuggcccaggcgggc

SEQ ID NO: 397021 - RNA, 21 nt, Bordetella pertussis
cgacugggugcgccugaccca

SEQ ID NO: 397022 - RNA, 14 nt, Bordetella pertussis
cgacuucaccgagg

SEQ ID NO: 397023 - RNA, 21 nt, Bordetella pertussis
cgacuuccucgacccgcgccu

SEQ ID NO: 397024 - RNA, 15 nt, Bordetella pertussis
cgacuucggcggcca

SEQ ID NO: 397025 - RNA, 20 nt, Bordetella pertussis
cgacuucggcggccaugccg

SEQ ID NO: 397026 - RNA, 17 nt, Bordetella pertussis
cgacuuggugggcaccu

SEQ ID NO: 397027 - RNA, 15 nt, Bordetella pertussis
cgagaaaccagccgc

SEQ ID NO: 397028 - RNA, 16 nt, Bordetella pertussis
cgagaagcggaugucc

SEQ ID NO: 397029 - RNA, 21 nt, Bordetella pertussis
cgagaagucaucgauggccag

SEQ ID NO: 397030 - RNA, 13 nt, Bordetella pertussis
cgagaccaugacg

SEQ ID NO: 397031 - RNA, 23 nt, Bordetella pertussis
cgagacgaaggcgccggccaggc

SEQ ID NO: 397032 - RNA, 15 nt, Bordetella pertussis
cgagagauagcccag

SEQ ID NO: 397033 - RNA, 21 nt, Bordetella pertussis
cgagagccugggcgcgcgccc

SEQ ID NO: 397034 - RNA, 16 nt, Bordetella pertussis
cgagaucagcaccgcg

SEQ ID NO: 397035 - RNA, 14 nt, Bordetella pertussis
cgagaugccgucga

SEQ ID NO: 397036 - RNA, 14 nt, Bordetella pertussis
cgagauguccaugg

SEQ ID NO: 397037 - RNA, 16 nt, Bordetella pertussis
cgagauugagcacgca

SEQ ID NO: 397038 - RNA, 20 nt, Bordetella pertussis
cgagcaauugccggaucagc

SEQ ID NO: 397039 - RNA, 13 nt, Bordetella pertussis
cgagcacggggcu

SEQ ID NO: 397040 - RNA, 20 nt, Bordetella pertussis
cgagcaggcgcgcggugacg

SEQ ID NO: 397041 - RNA, 16 nt, Bordetella pertussis
cgagcaucauggcgcg

SEQ ID NO: 397042 - RNA, 18 nt, Bordetella pertussis
cgagcaucauggcgcgcg

SEQ ID NO: 397043 - RNA, 16 nt, Bordetella pertussis
cgagcaucccggcgcu

SEQ ID NO: 397044 - RNA, 19 nt, Bordetella pertussis
cgagcaucccggcgcucag

SEQ ID NO: 397045 - RNA, 23 nt, Bordetella pertussis
cgagcaugagugauuguccugca

SEQ ID NO: 397046 - RNA, 15 nt, Bordetella pertussis
cgagcaugcgcagcg

SEQ ID NO: 397047 - RNA, 21 nt, Bordetella pertussis
cgagcaugcgcagcgcgucgg

SEQ ID NO: 397048 - RNA, 18 nt, Bordetella pertussis
cgagcauggcaucgguca

SEQ ID NO: 397049 - RNA, 21 nt, Bordetella pertussis
cgagcauggcgguggccagcg

SEQ ID NO: 397050 - RNA, 15 nt, Bordetella pertussis
cgagcauugccgcgg

SEQ ID NO: 397051 - RNA, 23 nt, Bordetella pertussis
cgagccaauaacagaggaacgcc

SEQ ID NO: 397052 - RNA, 13 nt, Bordetella pertussis
cgagcccagguug

SEQ ID NO: 397053 - RNA, 24 nt, Bordetella pertussis
cgagcccaucaggugggccgagcc

SEQ ID NO: 397054 - RNA, 24 nt, Bordetella pertussis
cgagcccgccaucgccaggaccag

SEQ ID NO: 397055 - RNA, 16 nt, Bordetella pertussis
cgagcccuggcuuggc

SEQ ID NO: 397056 - RNA, 23 nt, Bordetella pertussis
cgagccgaaguacacggccagca

SEQ ID NO: 397057 - RNA, 18 nt, Bordetella pertussis
cgagccgcagguccaggc

SEQ ID NO: 397058 - RNA, 20 nt, Bordetella pertussis
cgagccgccccggcgcggcg

SEQ ID NO: 397059 - RNA, 13 nt, Bordetella pertussis
cgagccggccagc

SEQ ID NO: 397060 - RNA, 14 nt, Bordetella pertussis
cgagccggccagcg

SEQ ID NO: 397061 - RNA, 16 nt, Bordetella pertussis
cgagccggccagcgcc

SEQ ID NO: 397062 - RNA, 21 nt, Bordetella pertussis
cgagccggccagcgccugggc

SEQ ID NO: 397063 - RNA, 18 nt, Bordetella pertussis
cgagccggcuccaguccc

SEQ ID NO: 397064 - RNA, 16 nt, Bordetella pertussis
cgagccgggcaccgag

SEQ ID NO: 397065 - RNA, 16 nt, Bordetella pertussis
cgagccgguccgccuc

SEQ ID NO: 397066 - RNA, 17 nt, Bordetella pertussis
cgagccgguccgccucg

SEQ ID NO: 397067 - RNA, 14 nt, Bordetella pertussis
cgagccucacucca

SEQ ID NO: 397068 - RNA, 20 nt, Bordetella pertussis
cgagcgcaagcaccgccugc

SEQ ID NO: 397069 - RNA, 16 nt, Bordetella pertussis
cgagcgcaccauggcg

SEQ ID NO: 397070 - RNA, 15 nt, Bordetella pertussis
cgagcgcagccgcuc

SEQ ID NO: 397071 - RNA, 17 nt, Bordetella pertussis
cgagcgccgcgcuccag

SEQ ID NO: 397072 - RNA, 17 nt, Bordetella pertussis
cgagcgccucgcgcucc

SEQ ID NO: 397073 - RNA, 16 nt, Bordetella pertussis
cgagcgccugcagcgu

SEQ ID NO: 397074 - RNA, 23 nt, Bordetella pertussis
cgagcgcgcccgcuugggccgcg

SEQ ID NO: 397075 - RNA, 17 nt, Bordetella pertussis
cgagcgcggcaugcgca

SEQ ID NO: 397076 - RNA, 16 nt, Bordetella pertussis
cgagcgcggccaggcg

SEQ ID NO: 397077 - RNA, 23 nt, Bordetella pertussis
cgagcgcggcgauacgcgccgcc

SEQ ID NO: 397078 - RNA, 18 nt, Bordetella pertussis
cgagcgcgcgcaugcgca

SEQ ID NO: 397079 - RNA, 19 nt, Bordetella pertussis
cgagcgcgcgcaugcgcac

SEQ ID NO: 397080 - RNA, 19 nt, Bordetella pertussis
cgagcgcgguggccgcuuc

SEQ ID NO: 397081 - RNA, 20 nt, Bordetella pertussis
cgagcgcguggaaccgccgc

SEQ ID NO: 397082 - RNA, 18 nt, Bordetella pertussis
cgagcgcucgcucacggg

SEQ ID NO: 397083 - RNA, 16 nt, Bordetella pertussis
cgagcgggccagcgcg

SEQ ID NO: 397084 - RNA, 19 nt, Bordetella pertussis
cgagcgggccagcgcggcc

SEQ ID NO: 397085 - RNA, 20 nt, Bordetella pertussis
cgagcgggccagcgcggcca

SEQ ID NO: 397086 - RNA, 21 nt, Bordetella pertussis
cgagcgggcccgacagcgccc

SEQ ID NO: 397087 - RNA, 15 nt, Bordetella pertussis
cgagcggggcugguc

SEQ ID NO: 397088 - RNA, 19 nt, Bordetella pertussis
cgagcgggugaugcugcag

SEQ ID NO: 397089 - RNA, 17 nt, Bordetella pertussis
cgagcuccuggagucug

SEQ ID NO: 397090 - RNA, 15 nt, Bordetella pertussis
cgagcugagcaccag

SEQ ID NO: 397091 - RNA, 20 nt, Bordetella pertussis
cgagcugagcaccagcagcc

SEQ ID NO: 397092 - RNA, 23 nt, Bordetella pertussis
cgagcugagcaccagcagcccca

SEQ ID NO: 397093 - RNA, 14 nt, Bordetella pertussis
cgagcugccgccuu

SEQ ID NO: 397094 - RNA, 14 nt, Bordetella pertussis
cgagcugcgcggcu

SEQ ID NO: 397095 - RNA, 13 nt, Bordetella pertussis
cgagcugcgcugc

SEQ ID NO: 397096 - RNA, 17 nt, Bordetella pertussis
cgagcuggcccugggcu

SEQ ID NO: 397097 - RNA, 14 nt, Bordetella pertussis
cgagcuggccggcg

SEQ ID NO: 397098 - RNA, 15 nt, Bordetella pertussis
cgaggaaggcccgcg

SEQ ID NO: 397099 - RNA, 11 nt, Bordetella pertussis
cgaggaccuga

SEQ ID NO: 397100 - RNA, 14 nt, Bordetella pertussis
cgaggacaggccag

SEQ ID NO: 397101 - RNA, 13 nt, Bordetella pertussis
cgaggagccggcg

SEQ ID NO: 397102 - RNA, 21 nt, Bordetella pertussis
cgaggcaaucagccccaggcg

SEQ ID NO: 397103 - RNA, 23 nt, Bordetella pertussis
cgaggcagaaguggucgcgcagg

SEQ ID NO: 397104 - RNA, 20 nt, Bordetella pertussis
cgaggcauacaggcuguggc

SEQ ID NO: 397105 - RNA, 19 nt, Bordetella pertussis
cgaggccagcgugcccagc

SEQ ID NO: 397106 - RNA, 17 nt, Bordetella pertussis
cgaggccaggcugacca

SEQ ID NO: 397107 - RNA, 19 nt, Bordetella pertussis
cgaggccaggcugaccagc

SEQ ID NO: 397108 - RNA, 21 nt, Bordetella pertussis
cgaggccagguugggugcgcc

SEQ ID NO: 397109 - RNA, 14 nt, Bordetella pertussis
cgaggccggcgucu

SEQ ID NO: 397110 - RNA, 22 nt, Bordetella pertussis
cgaggccggcgucuggagcggc

SEQ ID NO: 397111 - RNA, 22 nt, Bordetella pertussis
cgaggccuugcucgcccauggc

SEQ ID NO: 397112 - RNA, 20 nt, Bordetella pertussis
cgaggcgaacaggcacagga

SEQ ID NO: 397113 - RNA, 17 nt, Bordetella pertussis
cgaggcgaugccccggu

SEQ ID NO: 397114 - RNA, 15 nt, Bordetella pertussis
cgaggcgcgcagcac

SEQ ID NO: 397115 - RNA, 18 nt, Bordetella pertussis
cgaggcgcgcagcacgcc

SEQ ID NO: 397116 - RNA, 16 nt, Bordetella pertussis
cgaggcgcgggcgaug

SEQ ID NO: 397117 - RNA, 13 nt, Bordetella pertussis
cgaggcggcaagc

SEQ ID NO: 397118 - RNA, 14 nt, Bordetella pertussis
cgaggcggcaagcg

SEQ ID NO: 397119 - RNA, 13 nt, Bordetella pertussis
cgaggcggggcug

SEQ ID NO: 397120 - RNA, 16 nt, Bordetella pertussis
cgaggcggggcuggcg

SEQ ID NO: 397121 - RNA, 17 nt, Bordetella pertussis
cgaggcugcgcgcgcca

SEQ ID NO: 397122 - RNA, 14 nt, Bordetella pertussis
cgagggccgcggcg

SEQ ID NO: 397123 - RNA, 16 nt, Bordetella pertussis
cgagggccggaacagc

SEQ ID NO: 397124 - RNA, 12 nt, Bordetella pertussis
cgagggccggcg

SEQ ID NO: 397125 - RNA, 15 nt, Bordetella pertussis
cgagggcgcgucgac

SEQ ID NO: 397126 - RNA, 20 nt, Bordetella pertussis
cgagggcgucguagcccucg

SEQ ID NO: 397127 - RNA, 12 nt, Bordetella pertussis
cgagggcucgac

SEQ ID NO: 397128 - RNA, 14 nt, Bordetella pertussis
cgaggggguguucu

SEQ ID NO: 397129 - RNA, 17 nt, Bordetella pertussis
cgagggucaggcgcgcu

SEQ ID NO: 397130 - RNA, 18 nt, Bordetella pertussis
cgagguagggcgcggcca

SEQ ID NO: 397131 - RNA, 20 nt, Bordetella pertussis
cgagguagggcgcggccagg

SEQ ID NO: 397132 - RNA, 16 nt, Bordetella pertussis
cgaggucagcccggcg

SEQ ID NO: 397133 - RNA, 19 nt, Bordetella pertussis
cgaggugcccgcgaagcag

SEQ ID NO: 397134 - RNA, 21 nt, Bordetella pertussis
cgaggugcccgcgaagcagcc

SEQ ID NO: 397135 - RNA, 13 nt, Bordetella pertussis
cgaggugccggcg

SEQ ID NO: 397136 - RNA, 15 nt, Bordetella pertussis
cgaggugccggcggu

SEQ ID NO: 397137 - RNA, 22 nt, Bordetella pertussis
cgaggugggcggcagcaggcgc

SEQ ID NO: 397138 - RNA, 19 nt, Bordetella pertussis
cgaggugucgcuucccgca

SEQ ID NO: 397139 - RNA, 15 nt, Bordetella pertussis
cgagguugcaggcca

SEQ ID NO: 397140 - RNA, 20 nt, Bordetella pertussis
cgaguacauauucacagcca

SEQ ID NO: 397141 - RNA, 17 nt, Bordetella pertussis
cgaguagacgcagccgc

SEQ ID NO: 397142 - RNA, 13 nt, Bordetella pertussis
cgagugcuugacg

SEQ ID NO: 397143 - RNA, 15 nt, Bordetella pertussis
cgaguucgacucucg

SEQ ID NO: 397144 - RNA, 14 nt, Bordetella pertussis
cgaguucggcgcgc

SEQ ID NO: 397145 - RNA, 23 nt, Bordetella pertussis
cgaguugaggaugcgcgcggcca

SEQ ID NO: 397146 - RNA, 14 nt, Bordetella pertussis
cgaguugcgcgcca

SEQ ID NO: 397147 - RNA, 18 nt, Bordetella pertussis
cgauacaaggugccuguc

SEQ ID NO: 397148 - RNA, 21 nt, Bordetella pertussis
cgauaccgcaaacgugguguc

SEQ ID NO: 397149 - RNA, 16 nt, Bordetella pertussis
cgauagcgccgcgcau

SEQ ID NO: 397150 - RNA, 16 nt, Bordetella pertussis
cgauagcgcuccagcg

SEQ ID NO: 397151 - RNA, 19 nt, Bordetella pertussis
cgauagcgggccugcagca

SEQ ID NO: 397152 - RNA, 17 nt, Bordetella pertussis
cgauaggugcgcagccg

SEQ ID NO: 397153 - RNA, 22 nt, Bordetella pertussis
cgauaugcgagacgaaggcgcc

SEQ ID NO: 397154 - RNA, 16 nt, Bordetella pertussis
cgaucaagagccugga

SEQ ID NO: 397155 - RNA, 18 nt, Bordetella pertussis
cgaucacggccaacccuc

SEQ ID NO: 397156 - RNA, 22 nt, Bordetella pertussis
cgaucacgggcuguucgcgcag

SEQ ID NO: 397157 - RNA, 16 nt, Bordetella pertussis
cgaugcccucgcgcac

SEQ ID NO: 397158 - RNA, 17 nt, Bordetella pertussis
cgaugcccugcgccagc

SEQ ID NO: 397159 - RNA, 15 nt, Bordetella pertussis
cgaugccgcgcaccu

SEQ ID NO: 397160 - RNA, 17 nt, Bordetella pertussis
cgaugccggccagcagc

SEQ ID NO: 397161 - RNA, 15 nt, Bordetella pertussis
cgaugcgcagcagca

SEQ ID NO: 397162 - RNA, 15 nt, Bordetella pertussis
cgaugcgccagucca

SEQ ID NO: 397163 - RNA, 21 nt, Bordetella pertussis
cgaugcgcaccaugcgcagca

SEQ ID NO: 397164 - RNA, 17 nt, Bordetella pertussis
cgaugcuuagcgcagca

SEQ ID NO: 397165 - RNA, 20 nt, Bordetella pertussis
cgauggaacucguuggccag

SEQ ID NO: 397166 - RNA, 21 nt, Bordetella pertussis
cgauggaacucguuggccagc

SEQ ID NO: 397167 - RNA, 20 nt, Bordetella pertussis
cgauggcggccagggcaagc

SEQ ID NO: 397168 - RNA, 18 nt, Bordetella pertussis
cgauggcggcgcuggcgu

SEQ ID NO: 397169 - RNA, 21 nt, Bordetella pertussis
cgauggcgggguuggccgcca

SEQ ID NO: 397170 - RNA, 15 nt, Bordetella pertussis
cgauggcggugguga

SEQ ID NO: 397171 - RNA, 15 nt, Bordetella pertussis
cgauggcguacagca

SEQ ID NO: 397172 - RNA, 17 nt, Bordetella pertussis
cgauggcguccagcagc

SEQ ID NO: 397173 - RNA, 23 nt, Bordetella pertussis
cgaugggcccgggcaggcucagc

SEQ ID NO: 397174 - RNA, 15 nt, Bordetella pertussis
cgaugggccugccca

SEQ ID NO: 397175 - RNA, 20 nt, Bordetella pertussis
cgauggggccauggcacagg

SEQ ID NO: 397176 - RNA, 17 nt, Bordetella pertussis
cgauggggucgggccgc

SEQ ID NO: 397177 - RNA, 18 nt, Bordetella pertussis
cgaugguaucggccgggc

SEQ ID NO: 397178 - RNA, 21 nt, Bordetella pertussis
cgaugguaucggccgggccgg

SEQ ID NO: 397179 - RNA, 13 nt, Bordetella pertussis
cgauguccagcga

SEQ ID NO: 397180 - RNA, 20 nt, Bordetella pertussis
cgauguccagcgccagcagg

SEQ ID NO: 397181 - RNA, 21 nt, Bordetella pertussis
cgaugucgaacagcugcagcg

SEQ ID NO: 397182 - RNA, 15 nt, Bordetella pertussis
cgauguggccgucgu

SEQ ID NO: 397183 - RNA, 16 nt, Bordetella pertussis
cgauguggccuaccgc

SEQ ID NO: 397184 - RNA, 17 nt, Bordetella pertussis
cgauguucaggccaugc

SEQ ID NO: 397185 - RNA, 14 nt, Bordetella pertussis
cgauguugaacagc

SEQ ID NO: 397186 - RNA, 21 nt, Bordetella pertussis
cgauuccgccuacuggcgcgc

SEQ ID NO: 397187 - RNA, 20 nt, Bordetella pertussis
cgauucggagucgugcagga

SEQ ID NO: 397188 - RNA, 18 nt, Bordetella pertussis
cgauugaggccagcacgc

SEQ ID NO: 397189 - RNA, 20 nt, Bordetella pertussis
cgauugaccagcaccagcgc

SEQ ID NO: 397190 - RNA, 15 nt, Bordetella pertussis
cgauugcgccagcgc

SEQ ID NO: 397191 - RNA, 19 nt, Bordetella pertussis
cgauuucgcgcgccagcgc

SEQ ID NO: 397192 - RNA, 15 nt, Bordetella pertussis
cgcaacccaccccca

SEQ ID NO: 397193 - RNA, 17 nt, Bordetella pertussis
cgcaacccacccccagc

SEQ ID NO: 397194 - RNA, 21 nt, Bordetella pertussis
cgcaacccacccccagcagca

SEQ ID NO: 397195 - RNA, 14 nt, Bordetella pertussis
cgcaaccggcccga

SEQ ID NO: 397196 - RNA, 22 nt, Bordetella pertussis
cgcaaccggucggccggcagcg

SEQ ID NO: 397197 - RNA, 13 nt, Bordetella pertussis
cgcaacgccgccg

SEQ ID NO: 397198 - RNA, 14 nt, Bordetella pertussis
cgcaacgccggccg

SEQ ID NO: 397199 - RNA, 19 nt, Bordetella pertussis
cgcaagauuucauggcguc

SEQ ID NO: 397200 - RNA, 21 nt, Bordetella pertussis
cgcaagauuucauggcgucug

SEQ ID NO: 397201 - RNA, 15 nt, Bordetella pertussis
cgcaagcccaggcgg

SEQ ID NO: 397202 - RNA, 16 nt, Bordetella pertussis
cgcaagcccaggcggc

SEQ ID NO: 397203 - RNA, 22 nt, Bordetella pertussis
cgcaagccgcccgcggcggccc

SEQ ID NO: 397204 - RNA, 15 nt, Bordetella pertussis
cgcaagcgcgccgac

SEQ ID NO: 397205 - RNA, 19 nt, Bordetella pertussis
cgcaaggccgacuggauga

SEQ ID NO: 397206 - RNA, 19 nt, Bordetella pertussis
cgcaaucgacgaacaaggc

SEQ ID NO: 397207 - RNA, 22 nt, Bordetella pertussis
cgcacaguucgugcaccagccc

SEQ ID NO: 397208 - RNA, 15 nt, Bordetella pertussis
cgcacauacaaggcg

SEQ ID NO: 397209 - RNA, 18 nt, Bordetella pertussis
cgcacauuggaguagugg

SEQ ID NO: 397210 - RNA, 13 nt, Bordetella pertussis
cgcaccaccagca

SEQ ID NO: 397211 - RNA, 13 nt, Bordetella pertussis
cgcaccaccgccg

SEQ ID NO: 397212 - RNA, 15 nt, Bordetella pertussis
cgcaccaccuggcug

SEQ ID NO: 397213 - RNA, 13 nt, Bordetella pertussis
cgcaccaccuggc

SEQ ID NO: 397214 - RNA, 15 nt, Bordetella pertussis
cgcaccgaccagcgc

SEQ ID NO: 397215 - RNA, 20 nt, Bordetella pertussis
cgcaccgaccagcgcgcgcc

SEQ ID NO: 397216 - RNA, 15 nt, Bordetella pertussis
cgcaccgacggcagc

SEQ ID NO: 397217 - RNA, 16 nt, Bordetella pertussis
cgcaccgacugcgcau

SEQ ID NO: 397218 - RNA, 20 nt, Bordetella pertussis
cgcaccgacugcgcaugguc

SEQ ID NO: 397219 - RNA, 17 nt, Bordetella pertussis
cgcaccgaggugccggc

SEQ ID NO: 397220 - RNA, 16 nt, Bordetella pertussis
cgcaccgccgccggcc

SEQ ID NO: 397221 - RNA, 14 nt, Bordetella pertussis
cgcaccgcgccagc

SEQ ID NO: 397222 - RNA, 17 nt, Bordetella pertussis
cgcaccgcgccagcgcc

SEQ ID NO: 397223 - RNA, 22 nt, Bordetella pertussis
cgcaccgcgccagcgccggcgc

SEQ ID NO: 397224 - RNA, 20 nt, Bordetella pertussis
cgcaccgcgcugggaaacag

SEQ ID NO: 397225 - RNA, 14 nt, Bordetella pertussis
cgcaccggccggcc

SEQ ID NO: 397226 - RNA, 15 nt, Bordetella pertussis
cgcaccgggcggccc

SEQ ID NO: 397227 - RNA, 19 nt, Bordetella pertussis
cgcaccgucgccagggcga

SEQ ID NO: 397228 - RNA, 22 nt, Bordetella pertussis
cgcacgaaguacucgccggcgc

SEQ ID NO: 397229 - RNA, 13 nt, Bordetella pertussis
cgcacgacagcau

SEQ ID NO: 397230 - RNA, 14 nt, Bordetella pertussis
cgcacgaccaccag

SEQ ID NO: 397231 - RNA, 16 nt, Bordetella pertussis
cgcacgaucgcgccgg

SEQ ID NO: 397232 - RNA, 19 nt, Bordetella pertussis
cgcacgaucgcgccggccu

SEQ ID NO: 397233 - RNA, 22 nt, Bordetella pertussis
cgcacgaucgcgccggccuggg

SEQ ID NO: 397234 - RNA, 17 nt, Bordetella pertussis
cgcacgauuucacccag

SEQ ID NO: 397235 - RNA, 14 nt, Bordetella pertussis
cgcacgcagcgcuc

SEQ ID NO: 397236 - RNA, 19 nt, Bordetella pertussis
cgcacgcccgccugcagca

SEQ ID NO: 397237 - RNA, 17 nt, Bordetella pertussis
cgcacgcccgcgacgcu

SEQ ID NO: 397238 - RNA, 17 nt, Bordetella pertussis
cgcacgccgaccuggcg

SEQ ID NO: 397239 - RNA, 21 nt, Bordetella pertussis
cgcacgggcgaggcggggcug

SEQ ID NO: 397240 - RNA, 14 nt, Bordetella pertussis
cgcacgggcgccug

SEQ ID NO: 397241 - RNA, 23 nt, Bordetella pertussis
cgcacggggacuggcacgcgcug

SEQ ID NO: 397242 - RNA, 21 nt, Bordetella pertussis
cgcacgguccaggcggccgcg

SEQ ID NO: 397243 - RNA, 16 nt, Bordetella pertussis
cgcacgguggcgccgu

SEQ ID NO: 397244 - RNA, 16 nt, Bordetella pertussis
cgcacguccagagucu

SEQ ID NO: 397245 - RNA, 21 nt, Bordetella pertussis
cgcagaagcagccgcgcggcc

SEQ ID NO: 397246 - RNA, 21 nt, Bordetella pertussis
cgcagaaggcgaacugggucu

SEQ ID NO: 397247 - RNA, 16 nt, Bordetella pertussis
cgcagacgacgcagcg

SEQ ID NO: 397248 - RNA, 17 nt, Bordetella pertussis
cgcagacgaugaagacg

SEQ ID NO: 397249 - RNA, 22 nt, Bordetella pertussis
cgcagagggagcgacacccgcg

SEQ ID NO: 397250 - RNA, 21 nt, Bordetella pertussis
cgcagauggcggcgaugccgc

SEQ ID NO: 397251 - RNA, 17 nt, Bordetella pertussis
cgcagcaacccgcccgg

SEQ ID NO: 397252 - RNA, 15 nt, Bordetella pertussis
cgcagcaaggcgcgc

SEQ ID NO: 397253 - RNA, 21 nt, Bordetella pertussis
cgcagcaacggugagccggcc

SEQ ID NO: 397254 - RNA, 14 nt, Bordetella pertussis
cgcagcaccacauc

SEQ ID NO: 397255 - RNA, 19 nt, Bordetella pertussis
cgcagcaccacaucgccgg

SEQ ID NO: 397256 - RNA, 13 nt, Bordetella pertussis
cgcagcaccgcca

SEQ ID NO: 397257 - RNA, 12 nt, Bordetella pertussis
cgcagcaccgcg

SEQ ID NO: 397258 - RNA, 15 nt, Bordetella pertussis
cgcagcaccggcaga

SEQ ID NO: 397259 - RNA, 18 nt, Bordetella pertussis
cgcagcacgauggggcca

SEQ ID NO: 397260 - RNA, 22 nt, Bordetella pertussis
cgcagcaccucggggcgcggcc

SEQ ID NO: 397261 - RNA, 19 nt, Bordetella pertussis
cgcagcagacgcuucaggc

SEQ ID NO: 397262 - RNA, 21 nt, Bordetella pertussis
cgcagcagacgcuucaggccg

SEQ ID NO: 397263 - RNA, 18 nt, Bordetella pertussis
cgcagcucccccacgccg

SEQ ID NO: 397264 - RNA, 15 nt, Bordetella pertussis
cgcagcucguggcgc

SEQ ID NO: 397265 - RNA, 20 nt, Bordetella pertussis
cgcaggcaguuggcggcgca

SEQ ID NO: 397266 - RNA, 16 nt, Bordetella pertussis
cgcaggcccagccagc

SEQ ID NO: 397267 - RNA, 12 nt, Bordetella pertussis
cgcaggccgcca

SEQ ID NO: 397268 - RNA, 14 nt, Bordetella pertussis
cgcaggccgcgccg

SEQ ID NO: 397269 - RNA, 15 nt, Bordetella pertussis
cgcaggccggcggcc

SEQ ID NO: 397270 - RNA, 16 nt, Bordetella pertussis
cgcaggccggcggcca

SEQ ID NO: 397271 - RNA, 18 nt, Bordetella pertussis
cgcaggccgcggccaggc

SEQ ID NO: 397272 - RNA, 13 nt, Bordetella pertussis
cgcaggcgccgca

SEQ ID NO: 397273 - RNA, 14 nt, Bordetella pertussis
cgcaggcgccgcag

SEQ ID NO: 397274 - RNA, 15 nt, Bordetella pertussis
cgcaggcgccgcccc

SEQ ID NO: 397275 - RNA, 12 nt, Bordetella pertussis
cgcaggcgcgcc

SEQ ID NO: 397276 - RNA, 13 nt, Bordetella pertussis
cgcaggcgcgcgc

SEQ ID NO: 397277 - RNA, 23 nt, Bordetella pertussis
cgcagggcgaacguggccugcuu

SEQ ID NO: 397278 - RNA, 21 nt, Bordetella pertussis
cgcagggcgcaacgccggccg

SEQ ID NO: 397279 - RNA, 16 nt, Bordetella pertussis
cgcagggcggccggca

SEQ ID NO: 397280 - RNA, 12 nt, Bordetella pertussis
cgcaggucggcc

SEQ ID NO: 397281 - RNA, 12 nt, Bordetella pertussis
cgcagucggggc

SEQ ID NO: 397282 - RNA, 22 nt, Bordetella pertussis
cgcaguggcgagggucaggcgc

SEQ ID NO: 397283 - RNA, 16 nt, Bordetella pertussis
cgcauaccggccgcgg

SEQ ID NO: 397284 - RNA, 23 nt, Bordetella pertussis
cgcauacucgaugcccagcaccg

SEQ ID NO: 397285 - RNA, 14 nt, Bordetella pertussis
cgcauagacgccga

SEQ ID NO: 397286 - RNA, 17 nt, Bordetella pertussis
cgcauauggagccaggc

SEQ ID NO: 397287 - RNA, 17 nt, Bordetella pertussis
cgcaucccagacagcca

SEQ ID NO: 397288 - RNA, 21 nt, Bordetella pertussis
cgcaucccagacagccacgcg

SEQ ID NO: 397289 - RNA, 22 nt, Bordetella pertussis
cgcaucccagacagccacgcgc

SEQ ID NO: 397290 - RNA, 21 nt, Bordetella pertussis
cgcauccgguggugcugggcg

SEQ ID NO: 397291 - RNA, 20 nt, Bordetella pertussis
cgcaucgacagcgcgcccgc

SEQ ID NO: 397292 - RNA, 17 nt, Bordetella pertussis
cgcaucgaucucggccu

SEQ ID NO: 397293 - RNA, 16 nt, Bordetella pertussis
cgcaucgaugcggccu

SEQ ID NO: 397294 - RNA, 17 nt, Bordetella pertussis
cgcaucgcgcgccgccg

SEQ ID NO: 397295 - RNA, 18 nt, Bordetella pertussis
cgcaucgcgcgccgccgc

SEQ ID NO: 397296 - RNA, 22 nt, Bordetella pertussis
cgcaucgcgcgccgccgcccgc

SEQ ID NO: 397297 - RNA, 14 nt, Bordetella pertussis
cgcaucgcggcagc

SEQ ID NO: 397298 - RNA, 15 nt, Bordetella pertussis
cgcaucgcggcagcc

SEQ ID NO: 397299 - RNA, 16 nt, Bordetella pertussis
cgcaucgcggcagccc

SEQ ID NO: 397300 - RNA, 18 nt, Bordetella pertussis
cgcaucgcggcagcccgg

SEQ ID NO: 397301 - RNA, 19 nt, Bordetella pertussis
cgcaucgcgaccgccaagc

SEQ ID NO: 397302 - RNA, 14 nt, Bordetella pertussis
cgcaucgcgcaccc

SEQ ID NO: 397303 - RNA, 16 nt, Bordetella pertussis
cgcaugauggccggcc

SEQ ID NO: 397304 - RNA, 17 nt, Bordetella pertussis
cgcaugauggccggccu

SEQ ID NO: 397305 - RNA, 18 nt, Bordetella pertussis
cgcaugcaagacaggccg

SEQ ID NO: 397306 - RNA, 18 nt, Bordetella pertussis
cgcaugccagcuugcagg

SEQ ID NO: 397307 - RNA, 16 nt, Bordetella pertussis
cgcauggacgccgccg

SEQ ID NO: 397308 - RNA, 18 nt, Bordetella pertussis
cgcauggacugcaggcgc

SEQ ID NO: 397309 - RNA, 16 nt, Bordetella pertussis
cgcauggagaccggcg

SEQ ID NO: 397310 - RNA, 20 nt, Bordetella pertussis
cgcaugcugcagcugcuugc

SEQ ID NO: 397311 - RNA, 22 nt, Bordetella pertussis
cgcauggccgguucgaugaccu

SEQ ID NO: 397312 - RNA, 19 nt, Bordetella pertussis
cgcauggcgaugaccucgg

SEQ ID NO: 397313 - RNA, 17 nt, Bordetella pertussis
cgcauggcuggucccug

SEQ ID NO: 397314 - RNA, 18 nt, Bordetella pertussis
cgcaugggcgcgcccggc

SEQ ID NO: 397315 - RNA, 21 nt, Bordetella pertussis
cgcauggggacuggcgccugc

SEQ ID NO: 397316 - RNA, 14 nt, Bordetella pertussis
cgcaugucagcgcc

SEQ ID NO: 397317 - RNA, 13 nt, Bordetella pertussis
cgcauucgcgccu

SEQ ID NO: 397318 - RNA, 15 nt, Bordetella pertussis
cgcauucgcgccuga

SEQ ID NO: 397319 - RNA, 16 nt, Bordetella pertussis
cgcauugccgccgccc

SEQ ID NO: 397320 - RNA, 16 nt, Bordetella pertussis
cgcauuggccgccgcc

SEQ ID NO: 397321 - RNA, 15 nt, Bordetella pertussis
cgcauuucucggccu

SEQ ID NO: 397322 - RNA, 21 nt, Bordetella pertussis
cgcauuucucggccugggcgc

SEQ ID NO: 397323 - RNA, 16 nt, Bordetella pertussis
cgccaaagcgcagcgu

SEQ ID NO: 397324 - RNA, 19 nt, Bordetella pertussis
cgccaacccgccauccugg

SEQ ID NO: 397325 - RNA, 21 nt, Bordetella pertussis
cgccaacccggccucagcggc

SEQ ID NO: 397326 - RNA, 12 nt, Bordetella pertussis
cgccaacgccaa

SEQ ID NO: 397327 - RNA, 15 nt, Bordetella pertussis
cgccaacgcggcgcg

SEQ ID NO: 397328 - RNA, 20 nt, Bordetella pertussis
cgccaacgucggcagccaga

SEQ ID NO: 397329 - RNA, 18 nt, Bordetella pertussis
cgccaagaccgcggccgc

SEQ ID NO: 397330 - RNA, 13 nt, Bordetella pertussis
cgccaagcagacc

SEQ ID NO: 397331 - RNA, 19 nt, Bordetella pertussis
cgccaaucugccgcugacc

SEQ ID NO: 397332 - RNA, 13 nt, Bordetella pertussis
cgccaccccgccg

SEQ ID NO: 397333 - RNA, 15 nt, Bordetella pertussis
cgccaccccgccgcu

SEQ ID NO: 397334 - RNA, 12 nt, Bordetella pertussis
cgccaccgccca

SEQ ID NO: 397335 - RNA, 23 nt, Bordetella pertussis
cgccaccgcccagaaugcggcgg

SEQ ID NO: 397336 - RNA, 15 nt, Bordetella pertussis
cgccaccgcccccgc

SEQ ID NO: 397337 - RNA, 17 nt, Bordetella pertussis
cgccaccgcgccgccca

SEQ ID NO: 397338 - RNA, 14 nt, Bordetella pertussis
cgccacgccagcgg

SEQ ID NO: 397339 - RNA, 16 nt, Bordetella pertussis
cgccacgccagcggcg

SEQ ID NO: 397340 - RNA, 17 nt, Bordetella pertussis
cgccacgcccaggccgc

SEQ ID NO: 397341 - RNA, 18 nt, Bordetella pertussis
cgccacgcccaggccgcu

SEQ ID NO: 397342 - RNA, 13 nt, Bordetella pertussis
cgccacgcccguc

SEQ ID NO: 397343 - RNA, 20 nt, Bordetella pertussis
cgccacgccggccacgaacg

SEQ ID NO: 397344 - RNA, 17 nt, Bordetella pertussis
cgccacgccggccagcu

SEQ ID NO: 397345 - RNA, 20 nt, Bordetella pertussis
cgccacgccuuguucgcgcg

SEQ ID NO: 397346 - RNA, 22 nt, Bordetella pertussis
cgccacgccuuguucgcgcgcg

SEQ ID NO: 397347 - RNA, 22 nt, Bordetella pertussis
cgccacgcgcggaucggccacg

SEQ ID NO: 397348 - RNA, 17 nt, Bordetella pertussis
cgccacgcgggccggcc

SEQ ID NO: 397349 - RNA, 18 nt, Bordetella pertussis
cgccacgcgguccagccc

SEQ ID NO: 397350 - RNA, 18 nt, Bordetella pertussis
cgccacgcuggccgcgcu

SEQ ID NO: 397351 - RNA, 14 nt, Bordetella pertussis
cgccacugccaggc

SEQ ID NO: 397352 - RNA, 17 nt, Bordetella pertussis
cgccagaaagcgcggcc

SEQ ID NO: 397353 - RNA, 20 nt, Bordetella pertussis
cgcgccggcuaccgcgccau

SEQ ID NO: 397354 - RNA, 18 nt, Bordetella pertussis
cgcgccggcucccgcgcu

SEQ ID NO: 397355 - RNA, 14 nt, Bordetella pertussis
cgcgccgggcgcgc

SEQ ID NO: 397356 - RNA, 13 nt, Bordetella pertussis
cgcgccgggccgg

SEQ ID NO: 397357 - RNA, 14 nt, Bordetella pertussis
cgcgccgggccggc

SEQ ID NO: 397358 - RNA, 21 nt, Bordetella pertussis
cgcgccggucaugcaccugca

SEQ ID NO: 397359 - RNA, 19 nt, Bordetella pertussis
cgcgccggucgccgcgggc

SEQ ID NO: 397360 - RNA, 19 nt, Bordetella pertussis
cgcgccgucgggggccggc

SEQ ID NO: 397361 - RNA, 17 nt, Bordetella pertussis
cgcgccguucagggacg

SEQ ID NO: 397362 - RNA, 19 nt, Bordetella pertussis
cgcgccguucagggacggg

SEQ ID NO: 397363 - RNA, 22 nt, Bordetella pertussis
cgcgccguucucaggccgaggc

SEQ ID NO: 397364 - RNA, 15 nt, Bordetella pertussis
cgcgccucggacgcc

SEQ ID NO: 397365 - RNA, 14 nt, Bordetella pertussis
cgcgccugagcugc

SEQ ID NO: 397366 - RNA, 15 nt, Bordetella pertussis
cgcgccugagcugcc

SEQ ID NO: 397367 - RNA, 23 nt, Bordetella pertussis
cgcgccugcagcacggccacggc

SEQ ID NO: 397368 - RNA, 16 nt, Bordetella pertussis
cgcgccugcagcagcg

SEQ ID NO: 397369 - RNA, 19 nt, Bordetella pertussis
cgcgccugcauguccagcg

SEQ ID NO: 397370 - RNA, 14 nt, Bordetella pertussis
cgcgccugcccagg

SEQ ID NO: 397371 - RNA, 14 nt, Bordetella pertussis
cgcgccugccccgc

SEQ ID NO: 397372 - RNA, 17 nt, Bordetella pertussis
cgcgccugccccgccug

SEQ ID NO: 397373 - RNA, 17 nt, Bordetella pertussis
cgcgccugcgcgccgcc

SEQ ID NO: 397374 - RNA, 19 nt, Bordetella pertussis
cgcgccuggcgcgcccacu

SEQ ID NO: 397375 - RNA, 21 nt, Bordetella pertussis
cgcgccuuacgcggcgcgcgc

SEQ ID NO: 397376 - RNA, 21 nt, Bordetella pertussis
cgcgccuuccugggcgccggc

SEQ ID NO: 397377 - RNA, 22 nt, Bordetella pertussis
cgcgccuucggcaggcgccggc

SEQ ID NO: 397378 - RNA, 19 nt, Bordetella pertussis
cgcgccuugcgcggcgagc

SEQ ID NO: 397379 - RNA, 13 nt, Bordetella pertussis
cgcgcgacagccg

SEQ ID NO: 397380 - RNA, 23 nt, Bordetella pertussis
cgcgcgacagccgcgccagcgcc

SEQ ID NO: 397381 - RNA, 14 nt, Bordetella pertussis
cgcgcgaccaggcu

SEQ ID NO: 397382 - RNA, 14 nt, Bordetella pertussis
cgcgcgagcugcgc

SEQ ID NO: 397383 - RNA, 18 nt, Bordetella pertussis
cgcgcgagcugcgcggcu

SEQ ID NO: 397384 - RNA, 16 nt, Bordetella pertussis
cgcgcgaggcggcggc

SEQ ID NO: 397385 - RNA, 14 nt, Bordetella pertussis
cgcgcgauccgcgc

SEQ ID NO: 397386 - RNA, 15 nt, Bordetella pertussis
cgcgcgaucgccagc

SEQ ID NO: 397387 - RNA, 14 nt, Bordetella pertussis
cgcgcgaugcgcag

SEQ ID NO: 397388 - RNA, 17 nt, Bordetella pertussis
cgcgcgaugcgcggccc

SEQ ID NO: 397389 - RNA, 20 nt, Bordetella pertussis
cgcgcgcaaugcgcggcgcu

SEQ ID NO: 397390 - RNA, 14 nt, Bordetella pertussis
cgcgcgcaggcgcu

SEQ ID NO: 397391 - RNA, 16 nt, Bordetella pertussis
cgcgcgcaucgggauc

SEQ ID NO: 397392 - RNA, 14 nt, Bordetella pertussis
cgcgcgccagcgcc

SEQ ID NO: 397393 - RNA, 18 nt, Bordetella pertussis
cgcgcgccagcggcugcu

SEQ ID NO: 397394 - RNA, 12 nt, Bordetella pertussis
cgcgcgccacca

SEQ ID NO: 397395 - RNA, 13 nt, Bordetella pertussis
cgcgcgccaccgc

SEQ ID NO: 397396 - RNA, 14 nt, Bordetella pertussis
cgcgcgccgaugcg

SEQ ID NO: 397397 - RNA, 14 nt, Bordetella pertussis
cgcgcgccggcgcu

SEQ ID NO: 397398 - RNA, 16 nt, Bordetella pertussis
cgcgcgccugcagcag

SEQ ID NO: 397399 - RNA, 14 nt, Bordetella pertussis
cgcgcgccugcccc

SEQ ID NO: 397400 - RNA, 17 nt, Bordetella pertussis
cgcgcgcgacuccaccg

SEQ ID NO: 397401 - RNA, 14 nt, Bordetella pertussis
cgcgcgcgccggca

SEQ ID NO: 397402 - RNA, 15 nt, Bordetella pertussis
cgcgcgcgccugccc

SEQ ID NO: 397403 - RNA, 14 nt, Bordetella pertussis
cgcgcgcgcguagc

SEQ ID NO: 397404 - RNA, 12 nt, Bordetella pertussis
cgcgcgcgcaga

SEQ ID NO: 397405 - RNA, 14 nt, Bordetella pertussis
cgcgcgcgcagacg

SEQ ID NO: 397406 - RNA, 15 nt, Bordetella pertussis
cgcgcgcgcuggggc

SEQ ID NO: 397407 - RNA, 17 nt, Bordetella pertussis
cgcgcgcggacugccag

SEQ ID NO: 397408 - RNA, 22 nt, Bordetella pertussis
cgcgcgcggccguccaaaacag

SEQ ID NO: 397409 - RNA, 15 nt, Bordetella pertussis
cgcgcgcggcgccug

SEQ ID NO: 397410 - RNA, 14 nt, Bordetella pertussis
cgcgcgcggcggcc

SEQ ID NO: 397411 - RNA, 14 nt, Bordetella pertussis
cgcgcgcgggcgcg

SEQ ID NO: 397412 - RNA, 13 nt, Bordetella pertussis
cgcgcgcgggcgu

SEQ ID NO: 397413 - RNA, 16 nt, Bordetella pertussis
cgcgcgcgugccgcag

SEQ ID NO: 397414 - RNA, 15 nt, Bordetella pertussis
cgcgcgcuggcgccc

SEQ ID NO: 397415 - RNA, 20 nt, Bordetella pertussis
cgcgcgcuggcgcccggccu

SEQ ID NO: 397416 - RNA, 23 nt, Bordetella pertussis
cgcgcgcuggcugugcccgcccc

SEQ ID NO: 397417 - RNA, 13 nt, Bordetella pertussis
cgcgcgcuggggc

SEQ ID NO: 397418 - RNA, 15 nt, Bordetella pertussis
cgcgcgcuggggcug

SEQ ID NO: 397419 - RNA, 20 nt, Bordetella pertussis
cgcgcgcuucaggcgccgca

SEQ ID NO: 397420 - RNA, 16 nt, Bordetella pertussis
cgcgcggacugccaga

SEQ ID NO: 397421 - RNA, 17 nt, Bordetella pertussis
cgcgcggacugccagau

SEQ ID NO: 397422 - RNA, 23 nt, Bordetella pertussis
cgcgcggauauucgucggccgcc

SEQ ID NO: 397423 - RNA, 20 nt, Bordetella pertussis
cgcgcggaugaucgcgcagc

SEQ ID NO: 397424 - RNA, 12 nt, Bordetella pertussis
cgcgcggcagcg

SEQ ID NO: 397425 - RNA, 14 nt, Bordetella pertussis
cgcgcggccggcac

SEQ ID NO: 397426 - RNA, 13 nt, Bordetella pertussis
cgcgcggccggcc

SEQ ID NO: 397427 - RNA, 15 nt, Bordetella pertussis
cgcgcggccggccgc

SEQ ID NO: 397428 - RNA, 15 nt, Bordetella pertussis
cgcgcggccugggcg

SEQ ID NO: 397429 - RNA, 22 nt, Bordetella pertussis
cgcgcggccugggcggcgcgcu

SEQ ID NO: 397430 - RNA, 23 nt, Bordetella pertussis
cgcgcggcgacacccccagggcg

SEQ ID NO: 397431 - RNA, 14 nt, Bordetella pertussis
cgcgcggcgcggcu

SEQ ID NO: 397432 - RNA, 16 nt, Bordetella pertussis
cgcgcggcggccuugu

SEQ ID NO: 397433 - RNA, 12 nt, Bordetella pertussis
cgcgcggcggcg

SEQ ID NO: 397434 - RNA, 14 nt, Bordetella pertussis
cgcgcggcgccugc

SEQ ID NO: 397435 - RNA, 14 nt, Bordetella pertussis
cgcgcggcuggggc

SEQ ID NO: 397436 - RNA, 15 nt, Bordetella pertussis
cgcgcgggccagcag

SEQ ID NO: 397437 - RNA, 15 nt, Bordetella pertussis
cgcgcgggcgcgcag

SEQ ID NO: 397438 - RNA, 16 nt, Bordetella pertussis
cgcgcgggcgcgccgu

SEQ ID NO: 397439 - RNA, 14 nt, Bordetella pertussis
cgcgcgggcggccc

SEQ ID NO: 397440 - RNA, 16 nt, Bordetella pertussis
cgcgcgggcggcccgc

SEQ ID NO: 397441 - RNA, 21 nt, Bordetella pertussis
cgcgcgggggugcgcgacagc

SEQ ID NO: 397442 - RNA, 17 nt, Bordetella pertussis
cgcgcggguccaggccc

SEQ ID NO: 397443 - RNA, 20 nt, Bordetella pertussis
cgcgcggguuggcucaugca

SEQ ID NO: 397444 - RNA, 18 nt, Bordetella pertussis
cgcgcgguacgcaccgcc

SEQ ID NO: 397445 - RNA, 16 nt, Bordetella pertussis
cgcgcgugcagcgccg

SEQ ID NO: 397446 - RNA, 22 nt, Bordetella pertussis
cgcgcgugcagcgccgcgcgcu

SEQ ID NO: 397447 - RNA, 16 nt, Bordetella pertussis
cgcgcgugccgcgcag

SEQ ID NO: 397448 - RNA, 14 nt, Bordetella pertussis
cgcgcgugcggggc

SEQ ID NO: 397449 - RNA, 20 nt, Bordetella pertussis
cgcgcguugaccgccucgau

SEQ ID NO: 397450 - RNA, 20 nt, Bordetella pertussis
cgcgcucagcaccaggccgc

SEQ ID NO: 397451 - RNA, 13 nt, Bordetella pertussis
cgcgcucaggccg

SEQ ID NO: 397452 - RNA, 15 nt, Bordetella pertussis
cgcgcucaggccgcu

SEQ ID NO: 397453 - RNA, 15 nt, Bordetella pertussis
cgcgcucauggcgca

SEQ ID NO: 397454 - RNA, 11 nt, Bordetella pertussis
cgcgcuccggc

SEQ ID NO: 397455 - RNA, 20 nt, Bordetella pertussis
cgcgcucgaacaucgcgaag

SEQ ID NO: 397456 - RNA, 14 nt, Bordetella pertussis
cgcgcucgcccagc

SEQ ID NO: 397457 - RNA, 14 nt, Bordetella pertussis
cgcgcucgcccggc

SEQ ID NO: 397458 - RNA, 15 nt, Bordetella pertussis
cgcgcucgcccggcc

SEQ ID NO: 397459 - RNA, 18 nt, Bordetella pertussis
cgcgcucgcgcucggcca

SEQ ID NO: 397460 - RNA, 15 nt, Bordetella pertussis
cgcgcucggccagca

SEQ ID NO: 397461 - RNA, 21 nt, Bordetella pertussis
cgcgcucggccagcgcgcggc

SEQ ID NO: 397462 - RNA, 13 nt, Bordetella pertussis
cgcgcucggcgcu

SEQ ID NO: 397463 - RNA, 14 nt, Bordetella pertussis
cgcgcugcccagcc

SEQ ID NO: 397464 - RNA, 15 nt, Bordetella pertussis
cgcgcugcccagcca

SEQ ID NO: 397465 - RNA, 21 nt, Bordetella pertussis
cgcgcugccggaaacccgggc

SEQ ID NO: 397466 - RNA, 23 nt, Bordetella pertussis
cgcgcugccugaaaccgcaggca

SEQ ID NO: 397467 - RNA, 14 nt, Bordetella pertussis
cgcgcugcgacagc

SEQ ID NO: 397468 - RNA, 15 nt, Bordetella pertussis
cgcgcugcgcccgcu

SEQ ID NO: 397469 - RNA, 13 nt, Bordetella pertussis
cgcgcugcgcgcc

SEQ ID NO: 397470 - RNA, 15 nt, Bordetella pertussis
cgcgcuggcgcagca

SEQ ID NO: 397471 - RNA, 20 nt, Bordetella pertussis
cgcgcuggcgcucgggcgcg

SEQ ID NO: 397472 - RNA, 20 nt, Bordetella pertussis
cgcgcuggcgcuggccgccc

SEQ ID NO: 397473 - RNA, 15 nt, Bordetella pertussis
cgcgcuggcggcgca

SEQ ID NO: 397474 - RNA, 21 nt, Bordetella pertussis
cgcgcuggcgguggccgcgca

SEQ ID NO: 397475 - RNA, 11 nt, Bordetella pertussis
cgcgcuggcug

SEQ ID NO: 397476 - RNA, 17 nt, Bordetella pertussis
cgcgcuggcgcccggcc

SEQ ID NO: 397477 - RNA, 14 nt, Bordetella pertussis
cgcgcuggggcagc

SEQ ID NO: 397478 - RNA, 23 nt, Bordetella pertussis
cgcgcugggucaggucgcugccc

SEQ ID NO: 397479 - RNA, 18 nt, Bordetella pertussis
cgcgcuguccgaugcgcu

SEQ ID NO: 397480 - RNA, 19 nt, Bordetella pertussis
cgcgcuugagcggcucgcc

SEQ ID NO: 397481 - RNA, 14 nt, Bordetella pertussis
cgcgcuugcgcgcc

SEQ ID NO: 397482 - RNA, 15 nt, Bordetella pertussis
cgcgcuugcgcgcca

SEQ ID NO: 397483 - RNA, 15 nt, Bordetella pertussis
cgcgcuugcggccgu

SEQ ID NO: 397484 - RNA, 19 nt, Bordetella pertussis
cgcgcuucguccugaucga

SEQ ID NO: 397485 - RNA, 23 nt, Bordetella pertussis
cgcgcuucuuggcgaccaggccc

SEQ ID NO: 397486 - RNA, 20 nt, Bordetella pertussis
cgcgcuuuuccccgcccagc

SEQ ID NO: 397487 - RNA, 18 nt, Bordetella pertussis
cgcggaaauccgggcgcu

SEQ ID NO: 397488 - RNA, 17 nt, Bordetella pertussis
cgcggaccugcucgagc

SEQ ID NO: 397489 - RNA, 18 nt, Bordetella pertussis
cgcggaccugcucgagcg

SEQ ID NO: 397490 - RNA, 19 nt, Bordetella pertussis
cgcggacgccauggcggcg

SEQ ID NO: 397491 - RNA, 23 nt, Bordetella pertussis
cgcggacuucgcuuucgguggcg

SEQ ID NO: 397492 - RNA, 20 nt, Bordetella pertussis
cgcggauauucgucggccgc

SEQ ID NO: 397493 - RNA, 22 nt, Bordetella pertussis
cgcggauauucgucggccgccg

SEQ ID NO: 397494 - RNA, 21 nt, Bordetella pertussis
cgcggaucaugggcucgcgcg

SEQ ID NO: 397495 - RNA, 19 nt, Bordetella pertussis
cgcggcacgaaaagccgcg

SEQ ID NO: 397496 - RNA, 24 nt, Bordetella pertussis
cgcggcacgaaaagccgcggccgc

SEQ ID NO: 397497 - RNA, 13 nt, Bordetella pertussis
cgcggcagcccgg

SEQ ID NO: 397498 - RNA, 15 nt, Bordetella pertussis
cgcggcagcccggca

SEQ ID NO: 397499 - RNA, 22 nt, Bordetella pertussis
cgcggccacccugccgugcaga

SEQ ID NO: 397500 - RNA, 18 nt, Bordetella pertussis
cgcggccacggccugccc

SEQ ID NO: 397501 - RNA, 18 nt, Bordetella pertussis
cgcggccagcagcgcgug

SEQ ID NO: 397502 - RNA, 13 nt, Bordetella pertussis
cgcggccagccac

SEQ ID NO: 397503 - RNA, 17 nt, Bordetella pertussis
cgcggccagcaccggcc

SEQ ID NO: 397504 - RNA, 14 nt, Bordetella pertussis
cgcggccagcgccg

SEQ ID NO: 397505 - RNA, 16 nt, Bordetella pertussis
cgcggccagcggcgcu

SEQ ID NO: 397506 - RNA, 13 nt, Bordetella pertussis
cgcggccaggccc

SEQ ID NO: 397507 - RNA, 21 nt, Bordetella pertussis
cgcggccaggcgcgugcgcag

SEQ ID NO: 397508 - RNA, 15 nt, Bordetella pertussis
cgcggccaggcgcuc

SEQ ID NO: 397509 - RNA, 13 nt, Bordetella pertussis
cgcggccagggcu

SEQ ID NO: 397510 - RNA, 16 nt, Bordetella pertussis
cgcggccagggcugcg

SEQ ID NO: 397511 - RNA, 20 nt, Bordetella pertussis
cgcggccagggugccccgcc

SEQ ID NO: 397512 - RNA, 22 nt, Bordetella pertussis
cgcggccagggugccccgccgg

SEQ ID NO: 397513 - RNA, 21 nt, Bordetella pertussis
cgcggccaugcggugcgccgc

SEQ ID NO: 397514 - RNA, 13 nt, Bordetella pertussis
cgcggccaugucc

SEQ ID NO: 397515 - RNA, 14 nt, Bordetella pertussis
cgcggccugcucga

SEQ ID NO: 397516 - RNA, 20 nt, Bordetella pertussis
cgcggccuugcaugcgccgc

SEQ ID NO: 397517 - RNA, 14 nt, Bordetella pertussis
cgcggcgagcgccg

SEQ ID NO: 397518 - RNA, 18 nt, Bordetella pertussis
cgcggcgagccgcgcgca

SEQ ID NO: 397519 - RNA, 20 nt, Bordetella pertussis
cgcggcggcaccagcaggcc

SEQ ID NO: 397520 - RNA, 16 nt, Bordetella pertussis
cgcggcggccaggcgu

SEQ ID NO: 397521 - RNA, 20 nt, Bordetella pertussis
cgcggcggccaugcccaggc

SEQ ID NO: 397522 - RNA, 21 nt, Bordetella pertussis
cgcggcggccaugcccaggcc

SEQ ID NO: 397523 - RNA, 14 nt, Bordetella pertussis
cgcggcggcggcca

SEQ ID NO: 397524 - RNA, 20 nt, Bordetella pertussis
cgcggcggcgucaaugccag

SEQ ID NO: 397525 - RNA, 12 nt, Bordetella pertussis
cgcggcgggcgc

SEQ ID NO: 397526 - RNA, 21 nt, Bordetella pertussis
cgcggcgggcgcuggcgcgcg

SEQ ID NO: 397527 - RNA, 15 nt, Bordetella pertussis
cgcggcgggcggcgc

SEQ ID NO: 397528 - RNA, 19 nt, Bordetella pertussis
cgcggcggguggccucgcc

SEQ ID NO: 397529 - RNA, 20 nt, Bordetella pertussis
cgcggcggguggccucgccc

SEQ ID NO: 397530 - RNA, 21 nt, Bordetella pertussis
cgcggcgguccugcugaucca

SEQ ID NO: 397531 - RNA, 14 nt, Bordetella pertussis
cgcggcggugccgc

SEQ ID NO: 397532 - RNA, 21 nt, Bordetella pertussis
cgcggcgucgaccgcgggcgc

SEQ ID NO: 397533 - RNA, 19 nt, Bordetella pertussis
cgcggcgucgacgcccgcg

SEQ ID NO: 397534 - RNA, 23 nt, Bordetella pertussis
cgcggcuuucgccggaggcgcgc

SEQ ID NO: 397535 - RNA, 23 nt, Bordetella pertussis
cgcggcuuuuucucggccucgcg

SEQ ID NO: 397536 - RNA, 20 nt, Bordetella pertussis
cgcgggaagcugucggcgcu

SEQ ID NO: 397537 - RNA, 22 nt, Bordetella pertussis
cgcgggagaucuguaccgccgg

SEQ ID NO: 397538 - RNA, 23 nt, Bordetella pertussis
cgcgggagaucuguaccgccggg

SEQ ID NO: 397539 - RNA, 14 nt, Bordetella pertussis
cgcgggagcccgca

SEQ ID NO: 397540 - RNA, 22 nt, Bordetella pertussis
cgcgggcgauuugccgcagccc

SEQ ID NO: 397541 - RNA, 15 nt, Bordetella pertussis
cgcgggcgccgcgca

SEQ ID NO: 397542 - RNA, 13 nt, Bordetella pertussis
cgcgggcgcggca

SEQ ID NO: 397543 - RNA, 20 nt, Bordetella pertussis
cgcgggcggccacgcgccgc

SEQ ID NO: 397544 - RNA, 22 nt, Bordetella pertussis
cgcgggcggccuaucaccuggg

SEQ ID NO: 397545 - RNA, 14 nt, Bordetella pertussis
cgcgggcgggccgc

SEQ ID NO: 397546 - RNA, 15 nt, Bordetella pertussis
cgcgggcggcgcgcc

SEQ ID NO: 397547 - RNA, 20 nt, Bordetella pertussis
cgcgggcuugcugccccccg

SEQ ID NO: 397548 - RNA, 13 nt, Bordetella pertussis
cgcggggacaggc

SEQ ID NO: 397549 - RNA, 18 nt, Bordetella pertussis
cgcggggacaggcacacc

SEQ ID NO: 397550 - RNA, 17 nt, Bordetella pertussis
cgcggggacaggcaccc

SEQ ID NO: 397551 - RNA, 17 nt, Bordetella pertussis
cgcggggacaggcaccg

SEQ ID NO: 397552 - RNA, 12 nt, Bordetella pertussis
cgcggggccagg

SEQ ID NO: 397553 - RNA, 13 nt, Bordetella pertussis
cgcggggccaggc

SEQ ID NO: 397554 - RNA, 15 nt, Bordetella pertussis
cgcggggccaggcgc

SEQ ID NO: 397555 - RNA, 19 nt, Bordetella pertussis
cgcggugccgcgcgcggcc

SEQ ID NO: 397556 - RNA, 20 nt, Bordetella pertussis
cgcggugccgcgcgcggccg

SEQ ID NO: 397557 - RNA, 15 nt, Bordetella pertussis
cgcgguggccgccgc

SEQ ID NO: 397558 - RNA, 21 nt, Bordetella pertussis
cgcgguggccgccgcgcgccg

SEQ ID NO: 397559 - RNA, 13 nt, Bordetella pertussis
cgcggugcgggug

SEQ ID NO: 397560 - RNA, 20 nt, Bordetella pertussis
cgcggugcgggugggcgcgc

SEQ ID NO: 397561 - RNA, 14 nt, Bordetella pertussis
cgcgguggggcgca

SEQ ID NO: 397562 - RNA, 14 nt, Bordetella pertussis
cgcggugucggaca

SEQ ID NO: 397563 - RNA, 14 nt, Bordetella pertussis
cgcguacagcccga

SEQ ID NO: 397564 - RNA, 18 nt, Bordetella pertussis
cgcguacguggcgcggcu

SEQ ID NO: 397565 - RNA, 20 nt, Bordetella pertussis
cgcguaccucggugaggauu

SEQ ID NO: 397566 - RNA, 18 nt, Bordetella pertussis
cgcguaugcccugcggac

SEQ ID NO: 397567 - RNA, 16 nt, Bordetella pertussis
cgcguauggcggcgcc

SEQ ID NO: 397568 - RNA, 16 nt, Bordetella pertussis
cgcgucggccugccag

SEQ ID NO: 397569 - RNA, 16 nt, Bordetella pertussis
cgcgucggccagcgcc

SEQ ID NO: 397570 - RNA, 22 nt, Bordetella pertussis
cgcgucgguggccagccaggcg

SEQ ID NO: 397571 - RNA, 16 nt, Bordetella pertussis
cgcgucgucguuuccc

SEQ ID NO: 397572 - RNA, 23 nt, Bordetella pertussis
cgcgucgugcccgccacccaggg

SEQ ID NO: 397573 - RNA, 15 nt, Bordetella pertussis
cgcgucuccagcgcc

SEQ ID NO: 397574 - RNA, 22 nt, Bordetella pertussis
cgcgucuccagcgccggcagcc

SEQ ID NO: 397575 - RNA, 19 nt, Bordetella pertussis
cgcgucuggaggacgagcg

SEQ ID NO: 397576 - RNA, 19 nt, Bordetella pertussis
cgcguggaaccgccgcuuu

SEQ ID NO: 397577 - RNA, 12 nt, Bordetella pertussis
cgcguggccacg

SEQ ID NO: 397578 - RNA, 13 nt, Bordetella pertussis
cgcguggccagca

SEQ ID NO: 397579 - RNA, 21 nt, Bordetella pertussis
cgcgugucccagccggcggca

SEQ ID NO: 397580 - RNA, 22 nt, Bordetella pertussis
cgcgugugguuggcgcugcugc

SEQ ID NO: 397581 - RNA, 19 nt, Bordetella pertussis
cgcguucagcauuucgcaa

SEQ ID NO: 397582 - RNA, 13 nt, Bordetella pertussis
cgcguuccaugcg

SEQ ID NO: 397583 - RNA, 15 nt, Bordetella pertussis
cgcguucgccgcagc

SEQ ID NO: 397584 - RNA, 15 nt, Bordetella pertussis
cgcguucgccgucgu

SEQ ID NO: 397585 - RNA, 19 nt, Bordetella pertussis
cgcguucucagccgcccgc

SEQ ID NO: 397586 - RNA, 21 nt, Bordetella pertussis
cgcguugcaccgcgucggccu

SEQ ID NO: 397587 - RNA, 15 nt, Bordetella pertussis
cgcguugccggugcg

SEQ ID NO: 397588 - RNA, 22 nt, Bordetella pertussis
cgcguugccggugcgcgugggc

SEQ ID NO: 397589 - RNA, 19 nt, Bordetella pertussis
cgcuacagcgucacggcaa

SEQ ID NO: 397590 - RNA, 13 nt, Bordetella pertussis
cgcuaccaggcgc

SEQ ID NO: 397591 - RNA, 17 nt, Bordetella pertussis
cgcuaucauccgcgcau

SEQ ID NO: 397592 - RNA, 17 nt, Bordetella pertussis
cgcucaaggauuucacc

SEQ ID NO: 397593 - RNA, 13 nt, Bordetella pertussis
cgcucauccaggc

SEQ ID NO: 397594 - RNA, 14 nt, Bordetella pertussis
cgcucauccaggcg

SEQ ID NO: 397595 - RNA, 13 nt, Bordetella pertussis
cgcucaucaucgc

SEQ ID NO: 397596 - RNA, 21 nt, Bordetella pertussis
cgcucaugaaacgaucggcga

SEQ ID NO: 397597 - RNA, 16 nt, Bordetella pertussis
cgcucaugaccagcgg

SEQ ID NO: 397598 - RNA, 19 nt, Bordetella pertussis
cgcucaugaccagcggcgu

SEQ ID NO: 397599 - RNA, 21 nt, Bordetella pertussis
cgcuccaccagcaccggcagc

SEQ ID NO: 397600 - RNA, 19 nt, Bordetella pertussis
cgcuccagauaugccccuc

SEQ ID NO: 397601 - RNA, 22 nt, Bordetella pertussis
cgcuccaugaucucgggcgagg

SEQ ID NO: 397602 - RNA, 16 nt, Bordetella pertussis
cgcuccaugcggcggc

SEQ ID NO: 397603 - RNA, 21 nt, Bordetella pertussis
cgcuccauggcgccggcggcc

SEQ ID NO: 397604 - RNA, 21 nt, Bordetella pertussis
cgcuccauguaaaaacccggc

SEQ ID NO: 397605 - RNA, 18 nt, Bordetella pertussis
cgcuccggcugcgcgcgc

SEQ ID NO: 397606 - RNA, 14 nt, Bordetella pertussis
cgcuccucgcgcgc

SEQ ID NO: 397607 - RNA, 20 nt, Bordetella pertussis
cgcuccugcucggcgaugcg

SEQ ID NO: 397608 - RNA, 14 nt, Bordetella pertussis
cgcucgaaggcgcc

SEQ ID NO: 397609 - RNA, 16 nt, Bordetella pertussis
cgcucgaauggcugcg

SEQ ID NO: 397610 - RNA, 17 nt, Bordetella pertussis
cgcucgagcgccugcag

SEQ ID NO: 397611 - RNA, 23 nt, Bordetella pertussis
cgcucgagguaggcgggacuggc

SEQ ID NO: 397612 - RNA, 15 nt, Bordetella pertussis
cgcucgaugcgccag

SEQ ID NO: 397613 - RNA, 22 nt, Bordetella pertussis
cgcucgcccccgcgccgcgcag

SEQ ID NO: 397614 - RNA, 13 nt, Bordetella pertussis
cgcucgcccggcc

SEQ ID NO: 397615 - RNA, 14 nt, Bordetella pertussis
cgcucgcccggcca

SEQ ID NO: 397616 - RNA, 13 nt, Bordetella pertussis
cgcucgccgucga

SEQ ID NO: 397617 - RNA, 15 nt, Bordetella pertussis
cgcucgcgcaggcgu

SEQ ID NO: 397618 - RNA, 23 nt, Bordetella pertussis
cgcucgcgcccaucucggccgcg

SEQ ID NO: 397619 - RNA, 16 nt, Bordetella pertussis
cgcucgcgcgaccacu

SEQ ID NO: 397620 - RNA, 19 nt, Bordetella pertussis
cgcucgcgcgaccacuggc

SEQ ID NO: 397621 - RNA, 16 nt, Bordetella pertussis
cgcucgcugccggcgu

SEQ ID NO: 397622 - RNA, 21 nt, Bordetella pertussis
cgcucggagggcuccaggcug

SEQ ID NO: 397623 - RNA, 13 nt, Bordetella pertussis
cgcucggccagca

SEQ ID NO: 397624 - RNA, 14 nt, Bordetella pertussis
cgcucggccagcag

SEQ ID NO: 397625 - RNA, 21 nt, Bordetella pertussis
cgcucggccacgcucacgccc

SEQ ID NO: 397626 - RNA, 19 nt, Bordetella pertussis
cgcucuugagcgcggccuc

SEQ ID NO: 397627 - RNA, 15 nt, Bordetella pertussis
cgcugcacgcggccg

SEQ ID NO: 397628 - RNA, 14 nt, Bordetella pertussis
cgcugcagcacgca

SEQ ID NO: 397629 - RNA, 21 nt, Bordetella pertussis
cgcugcagccauucggccacu

SEQ ID NO: 397630 - RNA, 13 nt, Bordetella pertussis
cgcugcagcauga

SEQ ID NO: 397631 - RNA, 19 nt, Bordetella pertussis
cgcugcaggaucgcggcca

SEQ ID NO: 397632 - RNA, 20 nt, Bordetella pertussis
cgcugcaggaucgcggccag

SEQ ID NO: 397633 - RNA, 21 nt, Bordetella pertussis
cgcugcaggaucgcggccagc

SEQ ID NO: 397634 - RNA, 17 nt, Bordetella pertussis
cgcugcaugggcggccc

SEQ ID NO: 397635 - RNA, 19 nt, Bordetella pertussis
cgcugcaugggcggcccgc

SEQ ID NO: 397636 - RNA, 20 nt, Bordetella pertussis
cgcugcaugggcggcccgcu

SEQ ID NO: 397637 - RNA, 14 nt, Bordetella pertussis
cgcugccgcgcgau

SEQ ID NO: 397638 - RNA, 14 nt, Bordetella pertussis
cgcugccgcgcgcc

SEQ ID NO: 397639 - RNA, 21 nt, Bordetella pertussis
cgcugccggaaacccgggcuu

SEQ ID NO: 397640 - RNA, 15 nt, Bordetella pertussis
cgcugccggcgcccu

SEQ ID NO: 397641 - RNA, 14 nt, Bordetella pertussis
cgcugccggggucc

SEQ ID NO: 397642 - RNA, 23 nt, Bordetella pertussis
cgcuuccaggaguucccagcgcg

SEQ ID NO: 397643 - RNA, 20 nt, Bordetella pertussis
cgcuuccucgaccaggucca

SEQ ID NO: 397644 - RNA, 12 nt, Bordetella pertussis
cgcuuccuuggg

SEQ ID NO: 397645 - RNA, 22 nt, Bordetella pertussis
cgcuucggccugcgccaccagc

SEQ ID NO: 397646 - RNA, 22 nt, Bordetella pertussis
cgcuucgggcagcucgcgcgcu

SEQ ID NO: 397647 - RNA, 13 nt, Bordetella pertussis
cgcuucgggccgg

SEQ ID NO: 397648 - RNA, 14 nt, Bordetella pertussis
cgcuucgugcagcg

SEQ ID NO: 397649 - RNA, 19 nt, Bordetella pertussis
cgcuucgugcggccgcagc

SEQ ID NO: 397650 - RNA, 21 nt, Bordetella pertussis
cgcuucucggugcgccgccgc

SEQ ID NO: 397651 - RNA, 21 nt, Bordetella pertussis
cgcuucugccagacggccagc

SEQ ID NO: 397652 - RNA, 23 nt, Bordetella pertussis
cgcuucuuccuugcgaugccagu

SEQ ID NO: 397653 - RNA, 18 nt, Bordetella pertussis
cgcuugcgcuuggcaggc

SEQ ID NO: 397654 - RNA, 18 nt, Bordetella pertussis
cgcuuggcguagccggaa

SEQ ID NO: 397655 - RNA, 12 nt, Bordetella pertussis
cggaacaccagc

SEQ ID NO: 397656 - RNA, 16 nt, Bordetella pertussis
cggaacaccagcaagc

SEQ ID NO: 397657 - RNA, 19 nt, Bordetella pertussis
cggaacagcguccagccgc

SEQ ID NO: 397658 - RNA, 12 nt, Bordetella pertussis
cggaacauggcg

SEQ ID NO: 397659 - RNA, 19 nt, Bordetella pertussis
cggaaguauucgcgcggcg

SEQ ID NO: 397660 - RNA, 18 nt, Bordetella pertussis
cggaagucgggcaccagc

SEQ ID NO: 397661 - RNA, 18 nt, Bordetella pertussis
cggaauccuggcgacggc

SEQ ID NO: 397662 - RNA, 22 nt, Bordetella pertussis
cggaauggggcccgcauccuuc

SEQ ID NO: 397663 - RNA, 14 nt, Bordetella pertussis
cggacaacgcgcgc

SEQ ID NO: 397664 - RNA, 14 nt, Bordetella pertussis
cggacaagccccuc

SEQ ID NO: 397665 - RNA, 15 nt, Bordetella pertussis
cggacacgcaugcag

SEQ ID NO: 397666 - RNA, 18 nt, Bordetella pertussis
cggacacgcaugcaggua

SEQ ID NO: 397667 - RNA, 13 nt, Bordetella pertussis
cggacagcccgcg

SEQ ID NO: 397668 - RNA, 15 nt, Bordetella pertussis
cggacaggucggcgc

SEQ ID NO: 397669 - RNA, 22 nt, Bordetella pertussis
cggaccacacgaucgucagcag

SEQ ID NO: 397670 - RNA, 21 nt, Bordetella pertussis
cggaccagcgguugcgccagc

SEQ ID NO: 397671 - RNA, 16 nt, Bordetella pertussis
cggacccgcgccgcag

SEQ ID NO: 397672 - RNA, 18 nt, Bordetella pertussis
cggacccgcgccgcaggc

SEQ ID NO: 397673 - RNA, 18 nt, Bordetella pertussis
cggaccugcucgagcggc

SEQ ID NO: 397674 - RNA, 15 nt, Bordetella pertussis
cggacgagacaggcg

SEQ ID NO: 397675 - RNA, 19 nt, Bordetella pertussis
cggacgagacaggcgcgcc

SEQ ID NO: 397676 - RNA, 16 nt, Bordetella pertussis
cggacgagcgcagcaa

SEQ ID NO: 397677 - RNA, 23 nt, Bordetella pertussis
cggacgcaaaaacgcccggcgcg

SEQ ID NO: 397678 - RNA, 12 nt, Bordetella pertussis
cggacgauggcc

SEQ ID NO: 397679 - RNA, 19 nt, Bordetella pertussis
cggacgccagcccugggug

SEQ ID NO: 397680 - RNA, 14 nt, Bordetella pertussis
cggacgccauggcg

SEQ ID NO: 397681 - RNA, 15 nt, Bordetella pertussis
cggacgcgccgggcg

SEQ ID NO: 397682 - RNA, 16 nt, Bordetella pertussis
cggacgcgccgggcga

SEQ ID NO: 397683 - RNA, 17 nt, Bordetella pertussis
cggacgcgcgccgcauc

SEQ ID NO: 397684 - RNA, 17 nt, Bordetella pertussis
cggacgcggccggcaag

SEQ ID NO: 397685 - RNA, 16 nt, Bordetella pertussis
cggacgggccaggccg

SEQ ID NO: 397686 - RNA, 23 nt, Bordetella pertussis
cggacggguaucgucgaccugga

SEQ ID NO: 397687 - RNA, 17 nt, Bordetella pertussis
cggacuggcgcgcacca

SEQ ID NO: 397688 - RNA, 17 nt, Bordetella pertussis
cggacugggcgucgcuc

SEQ ID NO: 397689 - RNA, 12 nt, Bordetella pertussis
cggaggcgcgca

SEQ ID NO: 397690 - RNA, 14 nt, Bordetella pertussis
cggaggcgcgcagc

SEQ ID NO: 397691 - RNA, 17 nt, Bordetella pertussis
cggagguaugcacgacc

SEQ ID NO: 397692 - RNA, 21 nt, Bordetella pertussis
cggagguaugcacgaccaggc

SEQ ID NO: 397693 - RNA, 15 nt, Bordetella pertussis
cggaggugucgccgc

SEQ ID NO: 397694 - RNA, 18 nt, Bordetella pertussis
cggaguaguugucgucgc

SEQ ID NO: 397695 - RNA, 21 nt, Bordetella pertussis
cggagucggcgccgcgcagca

SEQ ID NO: 397696 - RNA, 17 nt, Bordetella pertussis
cggauagcggugcaggg

SEQ ID NO: 397697 - RNA, 20 nt, Bordetella pertussis
cggauauggccggcgcgcuc

SEQ ID NO: 397698 - RNA, 16 nt, Bordetella pertussis
cggaucacccagcggc

SEQ ID NO: 397699 - RNA, 20 nt, Bordetella pertussis
cggaucacccagcggcuggc

SEQ ID NO: 397700 - RNA, 21 nt, Bordetella pertussis
cggaucacccagcggcuggcc

SEQ ID NO: 397701 - RNA, 15 nt, Bordetella pertussis
cggauccuugacgaa

SEQ ID NO: 397702 - RNA, 17 nt, Bordetella pertussis
cggaucgaacgccucgg

SEQ ID NO: 397703 - RNA, 22 nt, Bordetella pertussis
cggcaaccugcacgcgggcgcu

SEQ ID NO: 397704 - RNA, 16 nt, Bordetella pertussis
cggcaagccgcggcgg

SEQ ID NO: 397705 - RNA, 19 nt, Bordetella pertussis
cggcaaggggccagccugg

SEQ ID NO: 397706 - RNA, 22 nt, Bordetella pertussis
cggcaaggggccagccuggcgc

SEQ ID NO: 397707 - RNA, 15 nt, Bordetella pertussis
cggcaagggugccug

SEQ ID NO: 397708 - RNA, 19 nt, Bordetella pertussis
cggcaagggugccuguccc

SEQ ID NO: 397709 - RNA, 18 nt, Bordetella pertussis
cggcaagucgacgcugau

SEQ ID NO: 397710 - RNA, 23 nt, Bordetella pertussis
cggcaauaccuucugcaaggccu

SEQ ID NO: 397711 - RNA, 19 nt, Bordetella pertussis
cggcaaucgaaaagcccgc

SEQ ID NO: 397712 - RNA, 16 nt, Bordetella pertussis
cggcaaucuugccgcc

SEQ ID NO: 397713 - RNA, 18 nt, Bordetella pertussis
cggcaaucuugccgccgg

SEQ ID NO: 397714 - RNA, 22 nt, Bordetella pertussis
cggcaaugacauccucgggcga

SEQ ID NO: 397715 - RNA, 15 nt, Bordetella pertussis
cggcaaugcgcgcgc

SEQ ID NO: 397716 - RNA, 16 nt, Bordetella pertussis
cggcaauguccggggc

SEQ ID NO: 397717 - RNA, 17 nt, Bordetella pertussis
cggcaaugucgcaggcc

SEQ ID NO: 397718 - RNA, 15 nt, Bordetella pertussis
cggcaccgcgcagcc

SEQ ID NO: 397719 - RNA, 19 nt, Bordetella pertussis
cggcaccgcgcagcccggc

SEQ ID NO: 397720 - RNA, 13 nt, Bordetella pertussis
cggcacgccugcc

SEQ ID NO: 397721 - RNA, 19 nt, Bordetella pertussis
cggcacgccugccgcgccc

SEQ ID NO: 397722 - RNA, 13 nt, Bordetella pertussis
cggcacggcuggg

SEQ ID NO: 397723 - RNA, 15 nt, Bordetella pertussis
cggcacggccggccu

SEQ ID NO: 397724 - RNA, 23 nt, Bordetella pertussis
cggcacgguggcgaaggccgccg

SEQ ID NO: 397725 - RNA, 16 nt, Bordetella pertussis
cggcacguaccaggcg

SEQ ID NO: 397726 - RNA, 22 nt, Bordetella pertussis
cggcacguaccaggcgcugacc

SEQ ID NO: 397727 - RNA, 13 nt, Bordetella pertussis
cggcacgucgggc

SEQ ID NO: 397728 - RNA, 19 nt, Bordetella pertussis
cggcacguugucgagcagg

SEQ ID NO: 397729 - RNA, 22 nt, Bordetella pertussis
cggcacguugucgagcaggccg

SEQ ID NO: 397730 - RNA, 22 nt, Bordetella pertussis
cggcagacgaucauccaggccg

SEQ ID NO: 397731 - RNA, 18 nt, Bordetella pertussis
cggcagaucggcgcuggc

SEQ ID NO: 397732 - RNA, 17 nt, Bordetella pertussis
cggcagaucuccggauc

SEQ ID NO: 397733 - RNA, 22 nt, Bordetella pertussis
cggcagaugaucuacgcgcgcg

SEQ ID NO: 397734 - RNA, 19 nt, Bordetella pertussis
cggcagcacgauggcgccc

SEQ ID NO: 397735 - RNA, 24 nt, Bordetella pertussis
cggcagcacgauggcgcccacggc

SEQ ID NO: 397736 - RNA, 19 nt, Bordetella pertussis
cggcagcagcgcgccgggc

SEQ ID NO: 397737 - RNA, 22 nt, Bordetella pertussis
cggcagcagcgcgccgggcggg

SEQ ID NO: 397738 - RNA, 14 nt, Bordetella pertussis
cggcagcagggcca

SEQ ID NO: 397739 - RNA, 20 nt, Bordetella pertussis
cggcagcauggcgcgcgggc

SEQ ID NO: 397740 - RNA, 13 nt, Bordetella pertussis
cggcagccccagc

SEQ ID NO: 397741 - RNA, 20 nt, Bordetella pertussis
cggcagccccagcgcccagg

SEQ ID NO: 397742 - RNA, 23 nt, Bordetella pertussis
cggcagccccgggugcagguccg

SEQ ID NO: 397743 - RNA, 22 nt, Bordetella pertussis
cggcagcgucaauccgccgcca

SEQ ID NO: 397744 - RNA, 15 nt, Bordetella pertussis
cggcagcucgcgcug

SEQ ID NO: 397745 - RNA, 22 nt, Bordetella pertussis
cggcagcucgcgcugcgcgccg

SEQ ID NO: 397746 - RNA, 20 nt, Bordetella pertussis
cggcagcuugucgaucgcca

SEQ ID NO: 397747 - RNA, 13 nt, Bordetella pertussis
cggcaucuugccu

SEQ ID NO: 397748 - RNA, 17 nt, Bordetella pertussis
cggcaugaccgcggacg

SEQ ID NO: 397749 - RNA, 19 nt, Bordetella pertussis
cggcaugaccgcggacgcc

SEQ ID NO: 397750 - RNA, 22 nt, Bordetella pertussis
cggcaugccguccacgcccagc

SEQ ID NO: 397751 - RNA, 17 nt, Bordetella pertussis
cggcauggcggccagcu

SEQ ID NO: 397752 - RNA, 15 nt, Bordetella pertussis
cggcaugggcgugcc

SEQ ID NO: 397753 - RNA, 20 nt, Bordetella pertussis
cggcauggugugccuguccc

SEQ ID NO: 397754 - RNA, 21 nt, Bordetella pertussis
cggcauggugugccugucccc

SEQ ID NO: 397755 - RNA, 20 nt, Bordetella pertussis
cggcaugucccgaggcgccc

SEQ ID NO: 397756 - RNA, 16 nt, Bordetella pertussis
cggcauuucgcugggc

SEQ ID NO: 397757 - RNA, 18 nt, Bordetella pertussis
cggcauuucgcugggcgc

SEQ ID NO: 397758 - RNA, 22 nt, Bordetella pertussis
cggcauuucgcugggcgcgcac

SEQ ID NO: 397759 - RNA, 19 nt, Bordetella pertussis
cggccaaccccgagggcgc

SEQ ID NO: 397760 - RNA, 17 nt, Bordetella pertussis
cggccaacggcuggcug

SEQ ID NO: 397761 - RNA, 21 nt, Bordetella pertussis
cggccaagacgcggggacagg

SEQ ID NO: 397762 - RNA, 15 nt, Bordetella pertussis
cggccaagcagcgcc

SEQ ID NO: 397763 - RNA, 16 nt, Bordetella pertussis
cggccaagcagcgccu

SEQ ID NO: 397764 - RNA, 18 nt, Bordetella pertussis
cggccaagcagcgccugc

SEQ ID NO: 397765 - RNA, 21 nt, Bordetella pertussis
cggccaagcuggagaagcgcc

SEQ ID NO: 397766 - RNA, 14 nt, Bordetella pertussis
cggccaaggcaagc

SEQ ID NO: 397767 - RNA, 18 nt, Bordetella pertussis
cggccaaggcauuggcgc

SEQ ID NO: 397768 - RNA, 18 nt, Bordetella pertussis
cggccaaucggccugcug

SEQ ID NO: 397769 - RNA, 12 nt, Bordetella pertussis
cggccaccacca

SEQ ID NO: 397770 - RNA, 13 nt, Bordetella pertussis
cggccaccaccag

SEQ ID NO: 397771 - RNA, 15 nt, Bordetella pertussis
cggccaccaggcuga

SEQ ID NO: 397772 - RNA, 15 nt, Bordetella pertussis
cggccaccagggccc

SEQ ID NO: 397773 - RNA, 15 nt, Bordetella pertussis
cggccaccagcggcg

SEQ ID NO: 397774 - RNA, 14 nt, Bordetella pertussis
cggccacccggccc

SEQ ID NO: 397775 - RNA, 16 nt, Bordetella pertussis
cggccaccgccugugc

SEQ ID NO: 397776 - RNA, 13 nt, Bordetella pertussis
cggccaccgccug

SEQ ID NO: 397777 - RNA, 15 nt, Bordetella pertussis
cggccacgcagcgcg

SEQ ID NO: 397778 - RNA, 18 nt, Bordetella pertussis
cggccacgcgcaacgccg

SEQ ID NO: 397779 - RNA, 14 nt, Bordetella pertussis
cggccacgcgccgc

SEQ ID NO: 397780 - RNA, 20 nt, Bordetella pertussis
cggccacgcgccgcccgggc

SEQ ID NO: 397781 - RNA, 17 nt, Bordetella pertussis
cggccacggccggcagc

SEQ ID NO: 397782 - RNA, 16 nt, Bordetella pertussis
cggccacggccgggcc

SEQ ID NO: 397783 - RNA, 15 nt, Bordetella pertussis
cggccacggccugcc

SEQ ID NO: 397784 - RNA, 16 nt, Bordetella pertussis
cggccacggccugccc

SEQ ID NO: 397785 - RNA, 17 nt, Bordetella pertussis
cggccacggccugcccg

SEQ ID NO: 397786 - RNA, 18 nt, Bordetella pertussis
cggccacggccugcccgg

SEQ ID NO: 397787 - RNA, 22 nt, Bordetella pertussis
cggccacggcggugaccaccag

SEQ ID NO: 397788 - RNA, 19 nt, Bordetella pertussis
cggccacgggaccgcucag

SEQ ID NO: 397789 - RNA, 14 nt, Bordetella pertussis
cggccacggucggc

SEQ ID NO: 397790 - RNA, 14 nt, Bordetella pertussis
cggccagagccugg

SEQ ID NO: 397791 - RNA, 15 nt, Bordetella pertussis
cggccagagccugga

SEQ ID NO: 397792 - RNA, 16 nt, Bordetella pertussis
cggccagagccuggaa

SEQ ID NO: 397793 - RNA, 19 nt, Bordetella pertussis
cggccagagccuggaagug

SEQ ID NO: 397794 - RNA, 12 nt, Bordetella pertussis
cggccagcaagc

SEQ ID NO: 397795 - RNA, 19 nt, Bordetella pertussis
cggccagcacgccggcggg

SEQ ID NO: 397796 - RNA, 15 nt, Bordetella pertussis
cggccagcgcggcgg

SEQ ID NO: 397797 - RNA, 16 nt, Bordetella pertussis
cggccagcgcggcggc

SEQ ID NO: 397798 - RNA, 17 nt, Bordetella pertussis
cggccagcgcggcggca

SEQ ID NO: 397799 - RNA, 15 nt, Bordetella pertussis
cggccagcgcggugu

SEQ ID NO: 397800 - RNA, 14 nt, Bordetella pertussis
cggccagcggcgcu

SEQ ID NO: 397801 - RNA, 21 nt, Bordetella pertussis
cggccagcucggcggccgccu

SEQ ID NO: 397802 - RNA, 20 nt, Bordetella pertussis
cggccagcuuguagcggcca

SEQ ID NO: 397803 - RNA, 20 nt, Bordetella pertussis
cggccaggaucgcggccagc

SEQ ID NO: 397804 - RNA, 11 nt, Bordetella pertussis
cggccaggcca

SEQ ID NO: 397805 - RNA, 11 nt, Bordetella pertussis
cggccaggccg

SEQ ID NO: 397806 - RNA, 16 nt, Bordetella pertussis
cggccaggcgccgcuc

SEQ ID NO: 397807 - RNA, 15 nt, Bordetella pertussis
cggccaggcgccggc

SEQ ID NO: 397808 - RNA, 17 nt, Bordetella pertussis
cggccaggcgccggcgg

SEQ ID NO: 397809 - RNA, 14 nt, Bordetella pertussis
cggccaggcgccug

SEQ ID NO: 397810 - RNA, 15 nt, Bordetella pertussis
cggccaggcgccuga

SEQ ID NO: 397811 - RNA, 18 nt, Bordetella pertussis
cggccaggcgccugagcc

SEQ ID NO: 397812 - RNA, 17 nt, Bordetella pertussis
cggccaggccggcgcgc

SEQ ID NO: 397813 - RNA, 21 nt, Bordetella pertussis
cggccaggccggcgcgccggc

SEQ ID NO: 397814 - RNA, 13 nt, Bordetella pertussis
cggccaggccggg

SEQ ID NO: 397815 - RNA, 16 nt, Bordetella pertussis
cggccaggcgcucagc

SEQ ID NO: 397816 - RNA, 20 nt, Bordetella pertussis
cggccagggcaagcgcgucg

SEQ ID NO: 397817 - RNA, 13 nt, Bordetella pertussis
cggccagggccac

SEQ ID NO: 397818 - RNA, 15 nt, Bordetella pertussis
cggccagggccacca

SEQ ID NO: 397819 - RNA, 14 nt, Bordetella pertussis
cggccaggggcagc

SEQ ID NO: 397820 - RNA, 19 nt, Bordetella pertussis
cggccaucgggcugcggau

SEQ ID NO: 397821 - RNA, 17 nt, Bordetella pertussis
cggccaucuuggugcgc

SEQ ID NO: 397822 - RNA, 20 nt, Bordetella pertussis
cggccaucuuggugcgcgcc

SEQ ID NO: 397823 - RNA, 13 nt, Bordetella pertussis
cggccaugcccag

SEQ ID NO: 397824 - RNA, 15 nt, Bordetella pertussis
cggccaugcccaggc

SEQ ID NO: 397825 - RNA, 17 nt, Bordetella pertussis
cggccaugcccaggccc

SEQ ID NO: 397826 - RNA, 15 nt, Bordetella pertussis
cggccaugcgcgcca

SEQ ID NO: 397827 - RNA, 17 nt, Bordetella pertussis
cggccaugcgcgccagc

SEQ ID NO: 397828 - RNA, 21 nt, Bordetella pertussis
cggccaugcggugcgccgcgu

SEQ ID NO: 397829 - RNA, 18 nt, Bordetella pertussis
cggccaugcucagcagca

SEQ ID NO: 397830 - RNA, 21 nt, Bordetella pertussis
cggccaugcucagcagcaccg

SEQ ID NO: 397831 - RNA, 21 nt, Bordetella pertussis
cggccauguagauggccgccu

SEQ ID NO: 397832 - RNA, 16 nt, Bordetella pertussis
cggcccagcgcggcgg

SEQ ID NO: 397833 - RNA, 15 nt, Bordetella pertussis
cggcccaggccgggc

SEQ ID NO: 397834 - RNA, 15 nt, Bordetella pertussis
cggcccaggcgcgcu

SEQ ID NO: 397835 - RNA, 21 nt, Bordetella pertussis
cggcccagcucugguccaggc

SEQ ID NO: 397836 - RNA, 16 nt, Bordetella pertussis
cggcccauucgcgcac

SEQ ID NO: 397837 - RNA, 18 nt, Bordetella pertussis
cggcccauugcggcaccu

SEQ ID NO: 397838 - RNA, 22 nt, Bordetella pertussis
cggcccauugcggcaccugcug

SEQ ID NO: 397839 - RNA, 14 nt, Bordetella pertussis
cggccccagcgccg

SEQ ID NO: 397840 - RNA, 19 nt, Bordetella pertussis
cggccccagcgccgcgagc

SEQ ID NO: 397841 - RNA, 15 nt, Bordetella pertussis
cggccccagguagac

SEQ ID NO: 397842 - RNA, 18 nt, Bordetella pertussis
cggccccagucgcugcuc

SEQ ID NO: 397843 - RNA, 18 nt, Bordetella pertussis
cggccccaugcgcggcac

SEQ ID NO: 397844 - RNA, 17 nt, Bordetella pertussis
cggccuugcgggccggc

SEQ ID NO: 397845 - RNA, 20 nt, Bordetella pertussis
cggccuugcugaaccugcug

SEQ ID NO: 397846 - RNA, 19 nt, Bordetella pertussis
cggccuuuuuuugcggcac

SEQ ID NO: 397847 - RNA, 15 nt, Bordetella pertussis
cggcgaagccggcac

SEQ ID NO: 397848 - RNA, 14 nt, Bordetella pertussis
cggcgaagccgcag

SEQ ID NO: 397849 - RNA, 16 nt, Bordetella pertussis
cggcgaagccgcagcg

SEQ ID NO: 397850 - RNA, 20 nt, Bordetella pertussis
cggcgaagccuugcgcggcc

SEQ ID NO: 397851 - RNA, 21 nt, Bordetella pertussis
cggcgaagccuugcgcggcca

SEQ ID NO: 397852 - RNA, 16 nt, Bordetella pertussis
cggcgaagcuguccuu

SEQ ID NO: 397853 - RNA, 14 nt, Bordetella pertussis
cggcgaccaggccc

SEQ ID NO: 397854 - RNA, 14 nt, Bordetella pertussis
cggcgaccaggugc

SEQ ID NO: 397855 - RNA, 22 nt, Bordetella pertussis
cggcgaccaggugcgggccgcu

SEQ ID NO: 397856 - RNA, 18 nt, Bordetella pertussis
cggcgaccgccggccggu

SEQ ID NO: 397857 - RNA, 17 nt, Bordetella pertussis
cggcgaccggcgccggc

SEQ ID NO: 397858 - RNA, 19 nt, Bordetella pertussis
cggcgacgaacccgggcgu

SEQ ID NO: 397859 - RNA, 13 nt, Bordetella pertussis
cggcgacgcagca

SEQ ID NO: 397860 - RNA, 18 nt, Bordetella pertussis
cggcgacgcagcacggcu

SEQ ID NO: 397861 - RNA, 15 nt, Bordetella pertussis
cggcgacguggcgcu

SEQ ID NO: 397862 - RNA, 16 nt, Bordetella pertussis
cggcgacugccccagc

SEQ ID NO: 397863 - RNA, 17 nt, Bordetella pertussis
cggcgacuuccgcuucc

SEQ ID NO: 397864 - RNA, 17 nt, Bordetella pertussis
cggcgagcacggccugc

SEQ ID NO: 397865 - RNA, 14 nt, Bordetella pertussis
cggcgagccgggca

SEQ ID NO: 397866 - RNA, 17 nt, Bordetella pertussis
cggcgagccgggcaccg

SEQ ID NO: 397867 - RNA, 14 nt, Bordetella pertussis
cggcgagcgccgcc

SEQ ID NO: 397868 - RNA, 15 nt, Bordetella pertussis
cggcgagcgccgcca

SEQ ID NO: 397869 - RNA, 20 nt, Bordetella pertussis
cggcgagcgccgccaggccg

SEQ ID NO: 397870 - RNA, 12 nt, Bordetella pertussis
cggcgagcgcgg

SEQ ID NO: 397871 - RNA, 15 nt, Bordetella pertussis
cggcgagcgcggcgc

SEQ ID NO: 397872 - RNA, 13 nt, Bordetella pertussis
cggcgaggaggug

SEQ ID NO: 397873 - RNA, 20 nt, Bordetella pertussis
cggcgaggaggugcgccgcu

SEQ ID NO: 397874 - RNA, 20 nt, Bordetella pertussis
cggcgaggcguccagccccu

SEQ ID NO: 397875 - RNA, 15 nt, Bordetella pertussis
cggcgaggccgcccg

SEQ ID NO: 397876 - RNA, 19 nt, Bordetella pertussis
cggcgaggccgcccgcccc

SEQ ID NO: 397877 - RNA, 14 nt, Bordetella pertussis
cggcgauauggcca

SEQ ID NO: 397878 - RNA, 17 nt, Bordetella pertussis
cggcgauauggccaggg

SEQ ID NO: 397879 - RNA, 15 nt, Bordetella pertussis
cggcgaucacgccga

SEQ ID NO: 397880 - RNA, 22 nt, Bordetella pertussis
cggcgauccgccgcggccagcg

SEQ ID NO: 397881 - RNA, 20 nt, Bordetella pertussis
cggcgaucgaauggucggcc

SEQ ID NO: 397882 - RNA, 24 nt, Bordetella pertussis
cggcgaucgccgcaaaucaaugaa

SEQ ID NO: 397883 - RNA, 18 nt, Bordetella pertussis
cggcgaucucgcgcgcgc

SEQ ID NO: 397884 - RNA, 22 nt, Bordetella pertussis
cggcgaucucgucgaccgccuc

SEQ ID NO: 397885 - RNA, 16 nt, Bordetella pertussis
cggcgaucuuguaggc

SEQ ID NO: 397886 - RNA, 20 nt, Bordetella pertussis
cggcgaugaagucgcggccc

SEQ ID NO: 397887 - RNA, 21 nt, Bordetella pertussis
cggcgaugaucgccucggggc

SEQ ID NO: 397888 - RNA, 13 nt, Bordetella pertussis
cggcgaugccgcu

SEQ ID NO: 397889 - RNA, 14 nt, Bordetella pertussis
cggcgaugccggcg

SEQ ID NO: 397890 - RNA, 15 nt, Bordetella pertussis
cggcgaugccggcgc

SEQ ID NO: 397891 - RNA, 16 nt, Bordetella pertussis
cggcgaugcgcggggc

SEQ ID NO: 397892 - RNA, 14 nt, Bordetella pertussis
cggcgaugcgggcg

SEQ ID NO: 397893 - RNA, 14 nt, Bordetella pertussis
cggcgaugcugccg

SEQ ID NO: 397894 - RNA, 17 nt, Bordetella pertussis
cggcgauggcgcgcgcc

SEQ ID NO: 397895 - RNA, 21 nt, Bordetella pertussis
cggcgauggcguugcgcacca

SEQ ID NO: 397896 - RNA, 17 nt, Bordetella pertussis
cggcgauguggcgcgcc

SEQ ID NO: 397897 - RNA, 18 nt, Bordetella pertussis
cggcgauguggcgcgcca

SEQ ID NO: 397898 - RNA, 16 nt, Bordetella pertussis
cggcgauugcgccagc

SEQ ID NO: 397899 - RNA, 19 nt, Bordetella pertussis
cggcgcaacccggccucgc

SEQ ID NO: 397900 - RNA, 14 nt, Bordetella pertussis
cggcgcaaccggcc

SEQ ID NO: 397901 - RNA, 15 nt, Bordetella pertussis
cggcgcaaccggccc

SEQ ID NO: 397902 - RNA, 16 nt, Bordetella pertussis
cggcgcaaccggcccg

SEQ ID NO: 397903 - RNA, 17 nt, Bordetella pertussis
cggcgcaaccggcccga

SEQ ID NO: 397904 - RNA, 15 nt, Bordetella pertussis
cggcgcaauccccgc

SEQ ID NO: 397905 - RNA, 20 nt, Bordetella pertussis
cggcgcacaccaucagcugg

SEQ ID NO: 397906 - RNA, 14 nt, Bordetella pertussis
cggcgcacccgcgg

SEQ ID NO: 397907 - RNA, 16 nt, Bordetella pertussis
cggcgcaccgacagca

SEQ ID NO: 397908 - RNA, 16 nt, Bordetella pertussis
cggcgcacgccccgac

SEQ ID NO: 397909 - RNA, 13 nt, Bordetella pertussis
cggcgcagauggc

SEQ ID NO: 397910 - RNA, 12 nt, Bordetella pertussis
cggcgcagcaug

SEQ ID NO: 397911 - RNA, 15 nt, Bordetella pertussis
cggcgcagccgccau

SEQ ID NO: 397912 - RNA, 14 nt, Bordetella pertussis
cggcgcagccggcc

SEQ ID NO: 397913 - RNA, 16 nt, Bordetella pertussis
cggcgcagccggccgg

SEQ ID NO: 397914 - RNA, 13 nt, Bordetella pertussis
cggcgcagcgccc

SEQ ID NO: 397915 - RNA, 17 nt, Bordetella pertussis
cggcgcaggccgcgccg

SEQ ID NO: 397916 - RNA, 19 nt, Bordetella pertussis
cggcgcaggccgcgccggc

SEQ ID NO: 397917 - RNA, 13 nt, Bordetella pertussis
cggcgcaggccug

SEQ ID NO: 397918 - RNA, 17 nt, Bordetella pertussis
cggcgcaggccugcggc

SEQ ID NO: 397919 - RNA, 15 nt, Bordetella pertussis
cggcgcaggaugcgc

SEQ ID NO: 397920 - RNA, 17 nt, Bordetella pertussis
cggcgcaggcgggcgau

SEQ ID NO: 397921 - RNA, 18 nt, Bordetella pertussis
cggcgcaucagcgcgccc

SEQ ID NO: 397922 - RNA, 24 nt, Bordetella pertussis
cggcgcaugagccggcagaucggc

SEQ ID NO: 397923 - RNA, 17 nt, Bordetella pertussis
cggcgcauuggccaacg

SEQ ID NO: 397924 - RNA, 12 nt, Bordetella pertussis
cggcgccacccc

SEQ ID NO: 397925 - RNA, 16 nt, Bordetella pertussis
cggcgccacgcagaag

SEQ ID NO: 397926 - RNA, 21 nt, Bordetella pertussis
cggcgccacugccaggcgccc

SEQ ID NO: 397927 - RNA, 13 nt, Bordetella pertussis
cggcgccagcauc

SEQ ID NO: 397928 - RNA, 13 nt, Bordetella pertussis
cggcgccagcgcc

SEQ ID NO: 397929 - RNA, 14 nt, Bordetella pertussis
cggcgccagcgccc

SEQ ID NO: 397930 - RNA, 18 nt, Bordetella pertussis
cggcgccagcgccccggc

SEQ ID NO: 397931 - RNA, 18 nt, Bordetella pertussis
cggcgccagcgccgcguc

SEQ ID NO: 397932 - RNA, 14 nt, Bordetella pertussis
cggcgccagcgcuu

SEQ ID NO: 397933 - RNA, 15 nt, Bordetella pertussis
cggcgccagucgcgc

SEQ ID NO: 397934 - RNA, 17 nt, Bordetella pertussis
cggcgccagucgcgcag

SEQ ID NO: 397935 - RNA, 18 nt, Bordetella pertussis
cggcgccagucgcgcagc

SEQ ID NO: 397936 - RNA, 21 nt, Bordetella pertussis
cggcgccauauugaugcagca

SEQ ID NO: 397937 - RNA, 22 nt, Bordetella pertussis
cggcgccauauugaugcagcac

SEQ ID NO: 397938 - RNA, 16 nt, Bordetella pertussis
cggcgccaugccgcgc

SEQ ID NO: 397939 - RNA, 19 nt, Bordetella pertussis
cggcgccaugccgcgcccg

SEQ ID NO: 397940 - RNA, 12 nt, Bordetella pertussis
cggcgcccaggc

SEQ ID NO: 397941 - RNA, 14 nt, Bordetella pertussis
cggcgcccaggccc

SEQ ID NO: 397942 - RNA, 17 nt, Bordetella pertussis
cggcgcccaggcccagc

SEQ ID NO: 397943 - RNA, 15 nt, Bordetella pertussis
cggcgcccccagcag

SEQ ID NO: 397944 - RNA, 17 nt, Bordetella pertussis
cggcgcccccgcggcgc

SEQ ID NO: 397945 - RNA, 19 nt, Bordetella pertussis
cggcgcccccgcggcgccc

SEQ ID NO: 397946 - RNA, 10 nt, Bordetella pertussis
cggcgcccgc

SEQ ID NO: 397947 - RNA, 18 nt, Bordetella pertussis
cggcgcccgccgccgggc

SEQ ID NO: 397948 - RNA, 22 nt, Bordetella pertussis
cggcgcccgcgcaugcaagaca

SEQ ID NO: 397949 - RNA, 15 nt, Bordetella pertussis
cggcgcccggcagcc

SEQ ID NO: 397950 - RNA, 20 nt, Bordetella pertussis
cggcgcccggcgccgcgcgc

SEQ ID NO: 397951 - RNA, 19 nt, Bordetella pertussis
cggcgcccggugcgcgcag

SEQ ID NO: 397952 - RNA, 14 nt, Bordetella pertussis
cggcgcccugcgcg

SEQ ID NO: 397953 - RNA, 14 nt, Bordetella pertussis
cggcgccgaccagg

SEQ ID NO: 397954 - RNA, 15 nt, Bordetella pertussis
cggcgccgacgcgcu

SEQ ID NO: 397955 - RNA, 21 nt, Bordetella pertussis
cggcgccgccggcggccugga

SEQ ID NO: 397956 - RNA, 13 nt, Bordetella pertussis
cggcgccgccggg

SEQ ID NO: 397957 - RNA, 11 nt, Bordetella pertussis
cggcgccgcgc

SEQ ID NO: 397958 - RNA, 13 nt, Bordetella pertussis
cggcgccgcgcgc

SEQ ID NO: 397959 - RNA, 13 nt, Bordetella pertussis
cggcgccgccucg

SEQ ID NO: 397960 - RNA, 16 nt, Bordetella pertussis
cggcgccgcgcgcggc

SEQ ID NO: 397961 - RNA, 14 nt, Bordetella pertussis
cggcgccgcgcgcu

SEQ ID NO: 397962 - RNA, 23 nt, Bordetella pertussis
cggcgccgcgcguaugcaccggg

SEQ ID NO: 397963 - RNA, 14 nt, Bordetella pertussis
cggcgccgcggcgc

SEQ ID NO: 397964 - RNA, 16 nt, Bordetella pertussis
cggcgccgcuuccggc

SEQ ID NO: 397965 - RNA, 17 nt, Bordetella pertussis
cggcgccggaucggccg

SEQ ID NO: 397966 - RNA, 18 nt, Bordetella pertussis
cggcgccggaucggccgg

SEQ ID NO: 397967 - RNA, 19 nt, Bordetella pertussis
cggcgccggaucggccggc

SEQ ID NO: 397968 - RNA, 13 nt, Bordetella pertussis
cggcgccggcaaa

SEQ ID NO: 397969 - RNA, 23 nt, Bordetella pertussis
cggcgccggcgacgccgcggugc

SEQ ID NO: 397970 - RNA, 17 nt, Bordetella pertussis
cggcgccggcgcgccgc

SEQ ID NO: 397971 - RNA, 14 nt, Bordetella pertussis
cggcgccgggcagc

SEQ ID NO: 397972 - RNA, 12 nt, Bordetella pertussis
cggcgccgggcg

SEQ ID NO: 397973 - RNA, 20 nt, Bordetella pertussis
cggcgccgggcuggugcgcc

SEQ ID NO: 397974 - RNA, 20 nt, Bordetella pertussis
cggcgccggugaccgccagc

SEQ ID NO: 397975 - RNA, 21 nt, Bordetella pertussis
cggcgccggugcgcggcgccc

SEQ ID NO: 397976 - RNA, 18 nt, Bordetella pertussis
cggcgccggugggcaggg

SEQ ID NO: 397977 - RNA, 22 nt, Bordetella pertussis
cggcgccguuuucagcgcaggc

SEQ ID NO: 397978 - RNA, 22 nt, Bordetella pertussis
cggcgccugccugccgagcgcu

SEQ ID NO: 397979 - RNA, 16 nt, Bordetella pertussis
cggcgccuggccgccc

SEQ ID NO: 397980 - RNA, 19 nt, Bordetella pertussis
cggcgccuggccgcccagc

SEQ ID NO: 397981 - RNA, 14 nt, Bordetella pertussis
cggcgccugggccu

SEQ ID NO: 397982 - RNA, 13 nt, Bordetella pertussis
cggcgccuggggc

SEQ ID NO: 397983 - RNA, 18 nt, Bordetella pertussis
cggcgccuggucgcgcgc

SEQ ID NO: 397984 - RNA, 20 nt, Bordetella pertussis
cggcgccuggucgcgcgccu

SEQ ID NO: 397985 - RNA, 19 nt, Bordetella pertussis
cggcgccuuggccugggcg

SEQ ID NO: 397986 - RNA, 15 nt, Bordetella pertussis
cggcgcgaccgccuc

SEQ ID NO: 397987 - RNA, 14 nt, Bordetella pertussis
cggcgcgacgcgcu

SEQ ID NO: 397988 - RNA, 22 nt, Bordetella pertussis
cggcgcgaguaucccuaccgcc

SEQ ID NO: 397989 - RNA, 21 nt, Bordetella pertussis
cggcgcgauggucaccacccg

SEQ ID NO: 397990 - RNA, 21 nt, Bordetella pertussis
cggcgcgcacgcucugcaccu

SEQ ID NO: 397991 - RNA, 14 nt, Bordetella pertussis
cggcgcgcagcgcc

SEQ ID NO: 397992 - RNA, 21 nt, Bordetella pertussis
cggcgcgcauccgguggugcu

SEQ ID NO: 397993 - RNA, 20 nt, Bordetella pertussis
cggcgcgcaucgucaggcag

SEQ ID NO: 397994 - RNA, 22 nt, Bordetella pertussis
cggcgcgcaucgucaggcaggc

SEQ ID NO: 397995 - RNA, 13 nt, Bordetella pertussis
cggcgcgcccagc

SEQ ID NO: 397996 - RNA, 20 nt, Bordetella pertussis
cggcgcgcccagcggcaggc

SEQ ID NO: 397997 - RNA, 14 nt, Bordetella pertussis
cggcgcgcccaggg

SEQ ID NO: 397998 - RNA, 16 nt, Bordetella pertussis
cggcgcgcccgccacg

SEQ ID NO: 397999 - RNA, 19 nt, Bordetella pertussis
cggcgcgcccgccccgcag

SEQ ID NO: 398000 - RNA, 14 nt, Bordetella pertussis
cggcgcgccgcguc

SEQ ID NO: 398001 - RNA, 14 nt, Bordetella pertussis
cggcgcgccggccg

SEQ ID NO: 398002 - RNA, 20 nt, Bordetella pertussis
cggcgcgccggccgcggggc

SEQ ID NO: 398003 - RNA, 12 nt, Bordetella pertussis
cggcgcgccggc

SEQ ID NO: 398004 - RNA, 19 nt, Bordetella pertussis
cggcgcgccgggccagacc

SEQ ID NO: 398005 - RNA, 14 nt, Bordetella pertussis
cggcgcgccuggcg

SEQ ID NO: 398006 - RNA, 19 nt, Bordetella pertussis
cggcgcgccuggcgcgccc

SEQ ID NO: 398007 - RNA, 16 nt, Bordetella pertussis
cggcgcgcgccaggcc

SEQ ID NO: 398008 - RNA, 17 nt, Bordetella pertussis
cggcgcgcgccaggccc

SEQ ID NO: 398009 - RNA, 17 nt, Bordetella pertussis
cggcgcgcgccagggcg

SEQ ID NO: 398010 - RNA, 14 nt, Bordetella pertussis
cggcgcgcgccggc

SEQ ID NO: 398011 - RNA, 16 nt, Bordetella pertussis
cggcgcgcgccggcuc

SEQ ID NO: 398012 - RNA, 12 nt, Bordetella pertussis
cggcgcgcgccu

SEQ ID NO: 398013 - RNA, 14 nt, Bordetella pertussis
cggcgcgcgccugc

SEQ ID NO: 398014 - RNA, 18 nt, Bordetella pertussis
cggcgcgcgccugcagca

SEQ ID NO: 398015 - RNA, 16 nt, Bordetella pertussis
cggcgcgcgcgccgcc

SEQ ID NO: 398016 - RNA, 16 nt, Bordetella pertussis
cggcgcgcgcgcgccg

SEQ ID NO: 398017 - RNA, 13 nt, Bordetella pertussis
cggcgcgcgcggc

SEQ ID NO: 398018 - RNA, 19 nt, Bordetella pertussis
cggcgcgcgcggucggugc

SEQ ID NO: 398019 - RNA, 17 nt, Bordetella pertussis
cggcgcgcgcugauucg

SEQ ID NO: 398020 - RNA, 13 nt, Bordetella pertussis
cggcgcgcgcugc

SEQ ID NO: 398021 - RNA, 20 nt, Bordetella pertussis
cggcgcgcgugccgcgcagu

SEQ ID NO: 398022 - RNA, 14 nt, Bordetella pertussis
cggcgcggcgggcg

SEQ ID NO: 398023 - RNA, 16 nt, Bordetella pertussis
cggcgcggcgggcgcu

SEQ ID NO: 398024 - RNA, 13 nt, Bordetella pertussis
cggcgcgggcggu

SEQ ID NO: 398025 - RNA, 15 nt, Bordetella pertussis
cggcgcggggcaccg

SEQ ID NO: 398026 - RNA, 22 nt, Bordetella pertussis
cggcgcgggucuugagcggccc

SEQ ID NO: 398027 - RNA, 18 nt, Bordetella pertussis
cggcgcgguauggccgcc

SEQ ID NO: 398028 - RNA, 19 nt, Bordetella pertussis
cggcgcgguauggccgccc

SEQ ID NO: 398029 - RNA, 22 nt, Bordetella pertussis
cggcgcgguauggccgcccagc

SEQ ID NO: 398030 - RNA, 16 nt, Bordetella pertussis
cggcgcggucagcaug

SEQ ID NO: 398031 - RNA, 17 nt, Bordetella pertussis
cggcgcgucgccggcga

SEQ ID NO: 398032 - RNA, 15 nt, Bordetella pertussis
cggcgcgucgcgcgc

SEQ ID NO: 398033 - RNA, 17 nt, Bordetella pertussis
cggcgcgucgcgcgcca

SEQ ID NO: 398034 - RNA, 16 nt, Bordetella pertussis
cggcgcgucgcgcggc

SEQ ID NO: 398035 - RNA, 20 nt, Bordetella pertussis
cggcgcgucgcgguacaggc

SEQ ID NO: 398036 - RNA, 16 nt, Bordetella pertussis
cggcgcgugccagcag

SEQ ID NO: 398037 - RNA, 14 nt, Bordetella pertussis
cggcgcugcgcagc

SEQ ID NO: 398038 - RNA, 15 nt, Bordetella pertussis
cggcgcugcgcagca

SEQ ID NO: 398039 - RNA, 23 nt, Bordetella pertussis
cggcgcuggauggcucgggcagc

SEQ ID NO: 398040 - RNA, 15 nt, Bordetella pertussis
cggcgcuggccauca

SEQ ID NO: 398041 - RNA, 13 nt, Bordetella pertussis
cggcgcuggccug

SEQ ID NO: 398042 - RNA, 15 nt, Bordetella pertussis
cggcgcuggccugcc

SEQ ID NO: 398043 - RNA, 20 nt, Bordetella pertussis
cggcgcuggccuggccgccg

SEQ ID NO: 398044 - RNA, 22 nt, Bordetella pertussis
cggcgcuggccuggccgccggc

SEQ ID NO: 398045 - RNA, 19 nt, Bordetella pertussis
cggcgcuggcuggacgcgc

SEQ ID NO: 398046 - RNA, 21 nt, Bordetella pertussis
cggcgcuggcuggacgcgcgc

SEQ ID NO: 398047 - RNA, 15 nt, Bordetella pertussis
cggcggaaauugggg

SEQ ID NO: 398048 - RNA, 15 nt, Bordetella pertussis
cggcggcaagcagcc

SEQ ID NO: 398049 - RNA, 17 nt, Bordetella pertussis
cggcggcaagcagccgg

SEQ ID NO: 398050 - RNA, 15 nt, Bordetella pertussis
cggcggcaccagcag

SEQ ID NO: 398051 - RNA, 13 nt, Bordetella pertussis
cggcggcacggcc

SEQ ID NO: 398052 - RNA, 17 nt, Bordetella pertussis
cggcggcaccgcgcagc

SEQ ID NO: 398053 - RNA, 16 nt, Bordetella pertussis
cggcggcagcuugacc

SEQ ID NO: 398054 - RNA, 16 nt, Bordetella pertussis
cggcggcagccggcca

SEQ ID NO: 398055 - RNA, 19 nt, Bordetella pertussis
cggcggcauacauccucga

SEQ ID NO: 398056 - RNA, 23 nt, Bordetella pertussis
cggcggcauacauccucgaugcc

SEQ ID NO: 398057 - RNA, 17 nt, Bordetella pertussis
cggcggggacaggcgcc

SEQ ID NO: 398058 - RNA, 16 nt, Bordetella pertussis
cggcggggcaggcgcc

SEQ ID NO: 398059 - RNA, 15 nt, Bordetella pertussis
cggcggguggccucg

SEQ ID NO: 398060 - RNA, 14 nt, Bordetella pertussis
cggcggguggcggc

SEQ ID NO: 398061 - RNA, 20 nt, Bordetella pertussis
cggcggguucgcagggcgca

SEQ ID NO: 398062 - RNA, 19 nt, Bordetella pertussis
cggcggugaucugcucgcc

SEQ ID NO: 398063 - RNA, 18 nt, Bordetella pertussis
cggcggugaugucgccgg

SEQ ID NO: 398064 - RNA, 15 nt, Bordetella pertussis
cggcggugccugucc

SEQ ID NO: 398065 - RNA, 18 nt, Bordetella pertussis
cggcggugccugucccca

SEQ ID NO: 398066 - RNA, 16 nt, Bordetella pertussis
cggcguauaggccacc

SEQ ID NO: 398067 - RNA, 18 nt, Bordetella pertussis
cggcguauaggccacccc

SEQ ID NO: 398068 - RNA, 19 nt, Bordetella pertussis
cggcguauaggccaccccg

SEQ ID NO: 398069 - RNA, 22 nt, Bordetella pertussis
cggcgguucguccucgucggcc

SEQ ID NO: 398070 - RNA, 23 nt, Bordetella pertussis
cggcgucaaaccaagcagggaca

SEQ ID NO: 398071 - RNA, 20 nt, Bordetella pertussis
cggcgucacgcggccgggca

SEQ ID NO: 398072 - RNA, 22 nt, Bordetella pertussis
cggcgucaggccgucgagccgg

SEQ ID NO: 398073 - RNA, 21 nt, Bordetella pertussis
cggcguccauuagggcccagc

SEQ ID NO: 398074 - RNA, 18 nt, Bordetella pertussis
cggcguccgaauacgcca

SEQ ID NO: 398075 - RNA, 18 nt, Bordetella pertussis
cggcguccugcggcggca

SEQ ID NO: 398076 - RNA, 16 nt, Bordetella pertussis
cggcgucgacgcccgc

SEQ ID NO: 398077 - RNA, 20 nt, Bordetella pertussis
cggcgucgagcacgcggcgc

SEQ ID NO: 398078 - RNA, 18 nt, Bordetella pertussis
cggcgucgaugcgcgcgc

SEQ ID NO: 398079 - RNA, 17 nt, Bordetella pertussis
cggcgucggcgcccggc

SEQ ID NO: 398080 - RNA, 18 nt, Bordetella pertussis
cggcgucuggagcggccu

SEQ ID NO: 398081 - RNA, 21 nt, Bordetella pertussis
cggcgugacguugccgcgcgc

SEQ ID NO: 398082 - RNA, 17 nt, Bordetella pertussis
cggcgugagcgccaccg

SEQ ID NO: 398083 - RNA, 13 nt, Bordetella pertussis
cggcgugaugccc

SEQ ID NO: 398084 - RNA, 19 nt, Bordetella pertussis
cggcgugaugcccaggccc

SEQ ID NO: 398085 - RNA, 17 nt, Bordetella pertussis
cggcguucuggcgcagc

SEQ ID NO: 398086 - RNA, 15 nt, Bordetella pertussis
cggcguugcggcagc

SEQ ID NO: 398087 - RNA, 14 nt, Bordetella pertussis
cggcguugcggcgc

SEQ ID NO: 398088 - RNA, 15 nt, Bordetella pertussis
cggcguugcggcgcc

SEQ ID NO: 398089 - RNA, 17 nt, Bordetella pertussis
cggcguuggccgggucg

SEQ ID NO: 398090 - RNA, 18 nt, Bordetella pertussis
cggcguugugccggcgca

SEQ ID NO: 398091 - RNA, 13 nt, Bordetella pertussis
cggcuccaggccg

SEQ ID NO: 398092 - RNA, 21 nt, Bordetella pertussis
cggcuccagucccgcaccggg

SEQ ID NO: 398093 - RNA, 22 nt, Bordetella pertussis
cggcucccgcgccauugccacg

SEQ ID NO: 398094 - RNA, 21 nt, Bordetella pertussis
cggcuccgauagcggcgccgc

SEQ ID NO: 398095 - RNA, 22 nt, Bordetella pertussis
cggcuccgauagcggcgccgcu

SEQ ID NO: 398096 - RNA, 16 nt, Bordetella pertussis
cggcucgcgcucgccc

SEQ ID NO: 398097 - RNA, 15 nt, Bordetella pertussis
cggcucggaccuggc

SEQ ID NO: 398098 - RNA, 22 nt, Bordetella pertussis
cggcucggugaugauggccagg

SEQ ID NO: 398099 - RNA, 22 nt, Bordetella pertussis
cggcucguaggcgagguccagg

SEQ ID NO: 398100 - RNA, 19 nt, Bordetella pertussis
cggcucuaccaacccugcc

SEQ ID NO: 398101 - RNA, 22 nt, Bordetella pertussis
cggcucuaccaacccugccucc

SEQ ID NO: 398102 - RNA, 12 nt, Bordetella pertussis
cggcucuggauc

SEQ ID NO: 398103 - RNA, 20 nt, Bordetella pertussis
cggcucuuccaucuacgugc

SEQ ID NO: 398104 - RNA, 22 nt, Bordetella pertussis
cggcucuuccaucuacgugcug

SEQ ID NO: 398105 - RNA, 17 nt, Bordetella pertussis
cggcugaauuggcgccc

SEQ ID NO: 398106 - RNA, 21 nt, Bordetella pertussis
cggcugaugcccuucggcaug

SEQ ID NO: 398107 - RNA, 19 nt, Bordetella pertussis
cggcugcgcgcgcagccag

SEQ ID NO: 398108 - RNA, 18 nt, Bordetella pertussis
cggcugcgcggccgagcg

SEQ ID NO: 398109 - RNA, 14 nt, Bordetella pertussis
cggcugcgggccgg

SEQ ID NO: 398110 - RNA, 14 nt, Bordetella pertussis
cggcugcuggaacg

SEQ ID NO: 398111 - RNA, 13 nt, Bordetella pertussis
cggcugcuggccc

SEQ ID NO: 398112 - RNA, 20 nt, Bordetella pertussis
cggcugcuugagcagccacu

SEQ ID NO: 398113 - RNA, 16 nt, Bordetella pertussis
cggcugcuugcccagc

SEQ ID NO: 398114 - RNA, 14 nt, Bordetella pertussis
cggcuggacgcuuu

SEQ ID NO: 398115 - RNA, 22 nt, Bordetella pertussis
cggcuggacgcuuucggggcgc

SEQ ID NO: 398116 - RNA, 22 nt, Bordetella pertussis
cggcuggauggugccgccgccc

SEQ ID NO: 398117 - RNA, 21 nt, Bordetella pertussis
cggcuucuccucuuuccccuc

SEQ ID NO: 398118 - RNA, 18 nt, Bordetella pertussis
cggcuugcacgccggcca

SEQ ID NO: 398119 - RNA, 16 nt, Bordetella pertussis
cggcuugccgcggcgc

SEQ ID NO: 398120 - RNA, 21 nt, Bordetella pertussis
cggcuugccgcggcgcggccu

SEQ ID NO: 398121 - RNA, 23 nt, Bordetella pertussis
cggcuugccgaaggugccugucc

SEQ ID NO: 398122 - RNA, 14 nt, Bordetella pertussis
cggcuugcgcgccu

SEQ ID NO: 398123 - RNA, 16 nt, Bordetella pertussis
cggcuugggcgugccc

SEQ ID NO: 398124 - RNA, 13 nt, Bordetella pertussis
cgggacaggcacc

SEQ ID NO: 398125 - RNA, 14 nt, Bordetella pertussis
cgggacaggcaccc

SEQ ID NO: 398126 - RNA, 21 nt, Bordetella pertussis
cgggacgcaggcccagccagc

SEQ ID NO: 398127 - RNA, 14 nt, Bordetella pertussis
cgggacggccaggg

SEQ ID NO: 398128 - RNA, 16 nt, Bordetella pertussis
cgggacggccaggggc

SEQ ID NO: 398129 - RNA, 15 nt, Bordetella pertussis
cgggacuggcgagca

SEQ ID NO: 398130 - RNA, 19 nt, Bordetella pertussis
cgggacuguaccgcgcgau

SEQ ID NO: 398131 - RNA, 22 nt, Bordetella pertussis
cgggagccaguccccgugggga

SEQ ID NO: 398132 - RNA, 20 nt, Bordetella pertussis
cgggagccggcaagccaggg

SEQ ID NO: 398133 - RNA, 14 nt, Bordetella pertussis
cgggagccucugga

SEQ ID NO: 398134 - RNA, 22 nt, Bordetella pertussis
cgggagccuguccccgcgggga

SEQ ID NO: 398135 - RNA, 18 nt, Bordetella pertussis
cgggagcggccagcaagc

SEQ ID NO: 398136 - RNA, 21 nt, Bordetella pertussis
cgggauaggccucggccaccu

SEQ ID NO: 398137 - RNA, 17 nt, Bordetella pertussis
cgggauaguccagcacc

SEQ ID NO: 398138 - RNA, 17 nt, Bordetella pertussis
cgggauccacgccgccg

SEQ ID NO: 398139 - RNA, 20 nt, Bordetella pertussis
cgggaucggcgucagcgccc

SEQ ID NO: 398140 - RNA, 17 nt, Bordetella pertussis
cgggaugggccacccag

SEQ ID NO: 398141 - RNA, 18 nt, Bordetella pertussis
cgggaugggccacccagc

SEQ ID NO: 398142 - RNA, 17 nt, Bordetella pertussis
cgggauggucgcggccg

SEQ ID NO: 398143 - RNA, 17 nt, Bordetella pertussis
cgggauguccgcgucgg

SEQ ID NO: 398144 - RNA, 15 nt, Bordetella pertussis
cgggauucugcugca

SEQ ID NO: 398145 - RNA, 19 nt, Bordetella pertussis
cgggcaacaaggccacgaa

SEQ ID NO: 398146 - RNA, 14 nt, Bordetella pertussis
cgggcaacuucacc

SEQ ID NO: 398147 - RNA, 15 nt, Bordetella pertussis
cgggcagcaccgcug

SEQ ID NO: 398148 - RNA, 11 nt, Bordetella pertussis
cgggcagcacg

SEQ ID NO: 398149 - RNA, 21 nt, Bordetella pertussis
cgggcagcacgcgcaccaggc

SEQ ID NO: 398150 - RNA, 23 nt, Bordetella pertussis
cgggcagcagcagggccaggccg

SEQ ID NO: 398151 - RNA, 15 nt, Bordetella pertussis
cgggcagcgcggcgg

SEQ ID NO: 398152 - RNA, 16 nt, Bordetella pertussis
cgggcagcgcggcggc

SEQ ID NO: 398153 - RNA, 20 nt, Bordetella pertussis
cgggcaucgggguuccacag

SEQ ID NO: 398154 - RNA, 16 nt, Bordetella pertussis
cgggcaugcaccaggc

SEQ ID NO: 398155 - RNA, 18 nt, Bordetella pertussis
cgggcaugcgccugcgcc

SEQ ID NO: 398156 - RNA, 20 nt, Bordetella pertussis
cgggcauugccggagcagca

SEQ ID NO: 398157 - RNA, 15 nt, Bordetella pertussis
cgggcugccggcagc

SEQ ID NO: 398158 - RNA, 20 nt, Bordetella pertussis
cgggcugccguagcccaggu

SEQ ID NO: 398159 - RNA, 12 nt, Bordetella pertussis
cgggcugcugca

SEQ ID NO: 398160 - RNA, 16 nt, Bordetella pertussis
cgggcugcugcacgcg

SEQ ID NO: 398161 - RNA, 19 nt, Bordetella pertussis
cgggcugcugcacgcgcgc

SEQ ID NO: 398162 - RNA, 13 nt, Bordetella pertussis
cgggcugcugccc

SEQ ID NO: 398163 - RNA, 18 nt, Bordetella pertussis
cgggcuggauccggcgcu

SEQ ID NO: 398164 - RNA, 14 nt, Bordetella pertussis
cgggcuggccgccu

SEQ ID NO: 398165 - RNA, 18 nt, Bordetella pertussis
cgggcuggggcaggcacu

SEQ ID NO: 398166 - RNA, 20 nt, Bordetella pertussis
cggggaacaggcgcgccagc

SEQ ID NO: 398167 - RNA, 20 nt, Bordetella pertussis
cggggaaccccgcauuuuug

SEQ ID NO: 398168 - RNA, 16 nt, Bordetella pertussis
cggggacaggcacacc

SEQ ID NO: 398169 - RNA, 16 nt, Bordetella pertussis
cggggacaggcaccgc

SEQ ID NO: 398170 - RNA, 16 nt, Bordetella pertussis
cggggacaggcgccuc

SEQ ID NO: 398171 - RNA, 17 nt, Bordetella pertussis
cggggaccggcacccgc

SEQ ID NO: 398172 - RNA, 15 nt, Bordetella pertussis
cggggacgccggcgg

SEQ ID NO: 398173 - RNA, 17 nt, Bordetella pertussis
cggggacuggcaccaau

SEQ ID NO: 398174 - RNA, 15 nt, Bordetella pertussis
cggggacuggcaccg

SEQ ID NO: 398175 - RNA, 15 nt, Bordetella pertussis
cggggaucaccagcc

SEQ ID NO: 398176 - RNA, 18 nt, Bordetella pertussis
cggggauggaguucagca

SEQ ID NO: 398177 - RNA, 20 nt, Bordetella pertussis
cggggauggcuuccugcggc

SEQ ID NO: 398178 - RNA, 21 nt, Bordetella pertussis
cggggauggcuuccugcggca

SEQ ID NO: 398179 - RNA, 15 nt, Bordetella pertussis
cggggcacccaggcg

SEQ ID NO: 398180 - RNA, 14 nt, Bordetella pertussis
cggggcaggccugg

SEQ ID NO: 398181 - RNA, 16 nt, Bordetella pertussis
cggggcagggcgccug

SEQ ID NO: 398182 - RNA, 21 nt, Bordetella pertussis
cggggcagggcgccugcagac

SEQ ID NO: 398183 - RNA, 24 nt, Bordetella pertussis
cggggcaucaauagcccgugcggg

SEQ ID NO: 398184 - RNA, 22 nt, Bordetella pertussis
cggggccgauggucagcguguc

SEQ ID NO: 398185 - RNA, 22 nt, Bordetella pertussis
cggggccgcccagcaccuuggc

SEQ ID NO: 398186 - RNA, 23 nt, Bordetella pertussis
cggggccgcuucggccugcgcca

SEQ ID NO: 398187 - RNA, 12 nt, Bordetella pertussis
cggggccgccuc

SEQ ID NO: 398188 - RNA, 12 nt, Bordetella pertussis
cggggccgggcc

SEQ ID NO: 398189 - RNA, 20 nt, Bordetella pertussis
cggggcgucgucgcggucca

SEQ ID NO: 398190 - RNA, 21 nt, Bordetella pertussis
cggggcucgugguggguuggc

SEQ ID NO: 398191 - RNA, 21 nt, Bordetella pertussis
cggggcuggcgcggcuggcga

SEQ ID NO: 398192 - RNA, 15 nt, Bordetella pertussis
cggggcugucgcgcg

SEQ ID NO: 398193 - RNA, 17 nt, Bordetella pertussis
cggggcugucgcgcgca

SEQ ID NO: 398194 - RNA, 13 nt, Bordetella pertussis
cgggguucugucc

SEQ ID NO: 398195 - RNA, 23 nt, Bordetella pertussis
cgggguugccaagauggcccagg

SEQ ID NO: 398196 - RNA, 15 nt, Bordetella pertussis
cggguaccaggcucc

SEQ ID NO: 398197 - RNA, 13 nt, Bordetella pertussis
cggguacggcaga

SEQ ID NO: 398198 - RNA, 15 nt, Bordetella pertussis
cgggucaggccgccg

SEQ ID NO: 398199 - RNA, 21 nt, Bordetella pertussis
cggguccagcacgccuugcuc

SEQ ID NO: 398200 - RNA, 18 nt, Bordetella pertussis
cggguccagcaggauggc

SEQ ID NO: 398201 - RNA, 19 nt, Bordetella pertussis
cgggucccaaccagggccg

SEQ ID NO: 398202 - RNA, 18 nt, Bordetella pertussis
cgggucccuggcccuggc

SEQ ID NO: 398203 - RNA, 15 nt, Bordetella pertussis
cgggucuugagcggc

SEQ ID NO: 398204 - RNA, 20 nt, Bordetella pertussis
cgggugaggggccagccugg

SEQ ID NO: 398205 - RNA, 17 nt, Bordetella pertussis
cgggugccuguccccac

SEQ ID NO: 398206 - RNA, 22 nt, Bordetella pertussis
cgggugccuguccccgcgggga

SEQ ID NO: 398207 - RNA, 23 nt, Bordetella pertussis
cgggugcgccugcagcgccgccu

SEQ ID NO: 398208 - RNA, 15 nt, Bordetella pertussis
cgggugcugcagcgc

SEQ ID NO: 398209 - RNA, 22 nt, Bordetella pertussis
cgggugcugcagcgcaccacca

SEQ ID NO: 398210 - RNA, 12 nt, Bordetella pertussis
cggguggccucg

SEQ ID NO: 398211 - RNA, 19 nt, Bordetella pertussis
cggguggccucgcccuggc

SEQ ID NO: 398212 - RNA, 14 nt, Bordetella pertussis
cgggugggccggcu

SEQ ID NO: 398213 - RNA, 15 nt, Bordetella pertussis
cgggugggccggcuu

SEQ ID NO: 398214 - RNA, 14 nt, Bordetella pertussis
cgggugggcgcgcc

SEQ ID NO: 398215 - RNA, 17 nt, Bordetella pertussis
cgggugggcgcgccgcg

SEQ ID NO: 398216 - RNA, 15 nt, Bordetella pertussis
cggguggugcugcuc

SEQ ID NO: 398217 - RNA, 18 nt, Bordetella pertussis
cggguguagaagaacagc

SEQ ID NO: 398218 - RNA, 20 nt, Bordetella pertussis
cggguucgacgccggcagcg

SEQ ID NO: 398219 - RNA, 13 nt, Bordetella pertussis
cggguugcccggc

SEQ ID NO: 398220 - RNA, 17 nt, Bordetella pertussis
cggguugcggcagcgcc

SEQ ID NO: 398221 - RNA, 19 nt, Bordetella pertussis
cggguuggcguccaggcgc

SEQ ID NO: 398222 - RNA, 12 nt, Bordetella pertussis
cgguaauccagu

SEQ ID NO: 398223 - RNA, 16 nt, Bordetella pertussis
cgguaaugacgcagcc

SEQ ID NO: 398224 - RNA, 15 nt, Bordetella pertussis
cgguacaggcugccg

SEQ ID NO: 398225 - RNA, 18 nt, Bordetella pertussis
cgguacaggucguagacc

SEQ ID NO: 398226 - RNA, 22 nt, Bordetella pertussis
cgguaccguccuggcagucagc

SEQ ID NO: 398227 - RNA, 17 nt, Bordetella pertussis
cgguacgcaccgccgcc

SEQ ID NO: 398228 - RNA, 16 nt, Bordetella pertussis
cgguacgccugcaccg

SEQ ID NO: 398229 - RNA, 15 nt, Bordetella pertussis
cgguacgcgcagucc

SEQ ID NO: 398230 - RNA, 20 nt, Bordetella pertussis
cgguacuccuugacgcgcgc

SEQ ID NO: 398231 - RNA, 18 nt, Bordetella pertussis
cgguacugcggcgccugg

SEQ ID NO: 398232 - RNA, 21 nt, Bordetella pertussis
cgguacugcggcgccugggcc

SEQ ID NO: 398233 - RNA, 19 nt, Bordetella pertussis
cgguaggacggcagcaccg

SEQ ID NO: 398234 - RNA, 20 nt, Bordetella pertussis
cgguaggccuggucgggguc

SEQ ID NO: 398235 - RNA, 21 nt, Bordetella pertussis
cgguagguaugguuggccacg

SEQ ID NO: 398236 - RNA, 17 nt, Bordetella pertussis
cgguagucgccggcuuc

SEQ ID NO: 398237 - RNA, 22 nt, Bordetella pertussis
cgguaucucagcgcgccgcgcc

SEQ ID NO: 398238 - RNA, 15 nt, Bordetella pertussis
cgguaugccugccag

SEQ ID NO: 398239 - RNA, 19 nt, Bordetella pertussis
cgguauggccgcccagcau

SEQ ID NO: 398240 - RNA, 18 nt, Bordetella pertussis
cgguauucggcgaccagg

SEQ ID NO: 398241 - RNA, 17 nt, Bordetella pertussis
cgguauugcgccacccc

SEQ ID NO: 398242 - RNA, 24 nt, Bordetella pertussis
cggucacugccgaaacgcuggcgu

SEQ ID NO: 398243 - RNA, 16 nt, Bordetella pertussis
cggucagcccaggcgg

SEQ ID NO: 398244 - RNA, 15 nt, Bordetella pertussis
cggucagcgcggcgc

SEQ ID NO: 398245 - RNA, 19 nt, Bordetella pertussis
cggucugggcgucccaggc

SEQ ID NO: 398246 - RNA, 17 nt, Bordetella pertussis
cggucuggucuggcaac

SEQ ID NO: 398247 - RNA, 20 nt, Bordetella pertussis
cggucuucacauagcccggc

SEQ ID NO: 398248 - RNA, 13 nt, Bordetella pertussis
cggugaaggccac

SEQ ID NO: 398249 - RNA, 14 nt, Bordetella pertussis
cggugaaggcgccc

SEQ ID NO: 398250 - RNA, 20 nt, Bordetella pertussis
cggugaaggcgcccgggcug

SEQ ID NO: 398251 - RNA, 17 nt, Bordetella pertussis
cggugaccaccaggccg

SEQ ID NO: 398252 - RNA, 15 nt, Bordetella pertussis
cggugauaugcgcca

SEQ ID NO: 398253 - RNA, 11 nt, Bordetella pertussis
cggugaucagc

SEQ ID NO: 398254 - RNA, 13 nt, Bordetella pertussis
cggugaucagcag

SEQ ID NO: 398255 - RNA, 21 nt, Bordetella pertussis
cggugaucagcaggcccacca

SEQ ID NO: 398256 - RNA, 21 nt, Bordetella pertussis
cggugaucaucgugccgggga

SEQ ID NO: 398257 - RNA, 17 nt, Bordetella pertussis
cggugauccacugcagc

SEQ ID NO: 398258 - RNA, 18 nt, Bordetella pertussis
cggugauccacugcagca

SEQ ID NO: 398259 - RNA, 20 nt, Bordetella pertussis
cggugauccacugcagcagu

SEQ ID NO: 398260 - RNA, 15 nt, Bordetella pertussis
cggugccgccgaucu

SEQ ID NO: 398261 - RNA, 13 nt, Bordetella pertussis
cggugccgcgcac

SEQ ID NO: 398262 - RNA, 17 nt, Bordetella pertussis
cggugccgcgcacccag

SEQ ID NO: 398263 - RNA, 19 nt, Bordetella pertussis
cggugccgcgcacccaggc

SEQ ID NO: 398264 - RNA, 12 nt, Bordetella pertussis
cggugccggcca

SEQ ID NO: 398265 - RNA, 22 nt, Bordetella pertussis
cggugccggccagccugcccgu

SEQ ID NO: 398266 - RNA, 21 nt, Bordetella pertussis
cggugccguccagcgcggcgc

SEQ ID NO: 398267 - RNA, 16 nt, Bordetella pertussis
cggugccuguccccgc

SEQ ID NO: 398268 - RNA, 21 nt, Bordetella pertussis
cggugccuguccccgcgggga

SEQ ID NO: 398269 - RNA, 21 nt, Bordetella pertussis
cggugccuguucccgccgggc

SEQ ID NO: 398270 - RNA, 16 nt, Bordetella pertussis
cggugccugccccugc

SEQ ID NO: 398271 - RNA, 15 nt, Bordetella pertussis
cggugcgagaucucg

SEQ ID NO: 398272 - RNA, 18 nt, Bordetella pertussis
cggugcgauagcgccgcg

SEQ ID NO: 398273 - RNA, 15 nt, Bordetella pertussis
cggugcgcacauggc

SEQ ID NO: 398274 - RNA, 21 nt, Bordetella pertussis
cggugcgcacauggcggaugg

SEQ ID NO: 398275 - RNA, 17 nt, Bordetella pertussis
cggugcgcagcaccagc

SEQ ID NO: 398276 - RNA, 19 nt, Bordetella pertussis
cggugcgcagcaccagcau

SEQ ID NO: 398277 - RNA, 16 nt, Bordetella pertussis
cggugcgcaccaggcc

SEQ ID NO: 398278 - RNA, 14 nt, Bordetella pertussis
cggugcgcgcgccc

SEQ ID NO: 398279 - RNA, 15 nt, Bordetella pertussis
cggugcgcgcggccg

SEQ ID NO: 398280 - RNA, 18 nt, Bordetella pertussis
cggugcgcggcgcagccc

SEQ ID NO: 398281 - RNA, 22 nt, Bordetella pertussis
cggugcggaggcggccgcgggc

SEQ ID NO: 398282 - RNA, 20 nt, Bordetella pertussis
cggugcggaucaagcggccc

SEQ ID NO: 398283 - RNA, 14 nt, Bordetella pertussis
cggugcgggccggc

SEQ ID NO: 398284 - RNA, 17 nt, Bordetella pertussis
cggugcgggccggcgcg

SEQ ID NO: 398285 - RNA, 20 nt, Bordetella pertussis
cggugcgggccggcgcgccu

SEQ ID NO: 398286 - RNA, 14 nt, Bordetella pertussis
cggugcgggugggc

SEQ ID NO: 398287 - RNA, 20 nt, Bordetella pertussis
cggugcgggugggcgcgccg

SEQ ID NO: 398288 - RNA, 21 nt, Bordetella pertussis
cggugcgggugggcgcgccgc

SEQ ID NO: 398289 - RNA, 15 nt, Bordetella pertussis
cggugcguaccagcc

SEQ ID NO: 398290 - RNA, 14 nt, Bordetella pertussis
cggugcguccagga

SEQ ID NO: 398291 - RNA, 18 nt, Bordetella pertussis
cggugcgugcgcccaugg

SEQ ID NO: 398292 - RNA, 18 nt, Bordetella pertussis
cggugcuugaugcccagc

SEQ ID NO: 398293 - RNA, 22 nt, Bordetella pertussis
cgguggcgaaggccgccgcgcc

SEQ ID NO: 398294 - RNA, 23 nt, Bordetella pertussis
cgguggcgaaggccgccgcgccc

SEQ ID NO: 398295 - RNA, 16 nt, Bordetella pertussis
cgguggcgcccggcgg

SEQ ID NO: 398296 - RNA, 14 nt, Bordetella pertussis
cgguggcgcgcagu

SEQ ID NO: 398297 - RNA, 21 nt, Bordetella pertussis
cgguggcggccguuggcgugc

SEQ ID NO: 398298 - RNA, 13 nt, Bordetella pertussis
cgguggcgggcca

SEQ ID NO: 398299 - RNA, 23 nt, Bordetella pertussis
cgguggcgguuggugucgcgcag

SEQ ID NO: 398300 - RNA, 21 nt, Bordetella pertussis
cgguggcguaguagcccaggc

SEQ ID NO: 398301 - RNA, 21 nt, Bordetella pertussis
cgguggugaccacggcgcgcc

SEQ ID NO: 398302 - RNA, 13 nt, Bordetella pertussis
cgguggugcccau

SEQ ID NO: 398303 - RNA, 21 nt, Bordetella pertussis
cgguggugcugcugggcgcca

SEQ ID NO: 398304 - RNA, 18 nt, Bordetella pertussis
cgguggugcugggcggcg

SEQ ID NO: 398305 - RNA, 15 nt, Bordetella pertussis
cgguggugucggcgg

SEQ ID NO: 398306 - RNA, 21 nt, Bordetella pertussis
cgguggugucggcggccagca

SEQ ID NO: 398307 - RNA, 15 nt, Bordetella pertussis
cgguguagaccacca

SEQ ID NO: 398308 - RNA, 11 nt, Bordetella pertussis
cgguguucucg

SEQ ID NO: 398309 - RNA, 20 nt, Bordetella pertussis
cgguguugcucgugcuggcc

SEQ ID NO: 398310 - RNA, 16 nt, Bordetella pertussis
cgguucaggccccggc

SEQ ID NO: 398311 - RNA, 14 nt, Bordetella pertussis
cgguuccagccugg

SEQ ID NO: 398312 - RNA, 22 nt, Bordetella pertussis
cgguucgcccaccaccagcggc

SEQ ID NO: 398313 - RNA, 23 nt, Bordetella pertussis
cgguucguccucgucggccaugc

SEQ ID NO: 398314 - RNA, 21 nt, Bordetella pertussis
cgguugcagcgcgccaggcgc

SEQ ID NO: 398315 - RNA, 20 nt, Bordetella pertussis
cgguuuuuucuugccggccc

SEQ ID NO: 398316 - RNA, 13 nt, Bordetella pertussis
cguaaggccgccg

SEQ ID NO: 398317 - RNA, 21 nt, Bordetella pertussis
cguaauagcuggcggcgcgcu

SEQ ID NO: 398318 - RNA, 20 nt, Bordetella pertussis
cguacagcgccugcgcggcg

SEQ ID NO: 398319 - RNA, 16 nt, Bordetella pertussis
cguacagggccgcgau

SEQ ID NO: 398320 - RNA, 19 nt, Bordetella pertussis
cguaccaggcgcugaccug

SEQ ID NO: 398321 - RNA, 21 nt, Bordetella pertussis
cguaccccagcaugugcgcgg

SEQ ID NO: 398322 - RNA, 18 nt, Bordetella pertussis
cguaccgccacaccgcug

SEQ ID NO: 398323 - RNA, 15 nt, Bordetella pertussis
cguaccugcagcagg

SEQ ID NO: 398324 - RNA, 16 nt, Bordetella pertussis
cguacgcccggccgcc

SEQ ID NO: 398325 - RNA, 20 nt, Bordetella pertussis
cguacgcggcgcccgcgcau

SEQ ID NO: 398326 - RNA, 19 nt, Bordetella pertussis
cguacgcuuaucgcggcgc

SEQ ID NO: 398327 - RNA, 16 nt, Bordetella pertussis
cguacguggcgcggcu

SEQ ID NO: 398328 - RNA, 18 nt, Bordetella pertussis
cguacuggcgcggcggcc

SEQ ID NO: 398329 - RNA, 17 nt, Bordetella pertussis
cguccaccuugacgcgc

SEQ ID NO: 398330 - RNA, 20 nt, Bordetella pertussis
cguccacggcaucggccagc

SEQ ID NO: 398331 - RNA, 23 nt, Bordetella pertussis
cguccacugaaagaaccgccuuc

SEQ ID NO: 398332 - RNA, 16 nt, Bordetella pertussis
cguccagcacgcggcg

SEQ ID NO: 398333 - RNA, 17 nt, Bordetella pertussis
cguccagcacgcggcgc

SEQ ID NO: 398334 - RNA, 17 nt, Bordetella pertussis
cguccagcacggccgcg

SEQ ID NO: 398335 - RNA, 18 nt, Bordetella pertussis
cguccagcccgugggcgg

SEQ ID NO: 398336 - RNA, 13 nt, Bordetella pertussis
cguccagcgccgc

SEQ ID NO: 398337 - RNA, 20 nt, Bordetella pertussis
cguccagcgacuccggccgg

SEQ ID NO: 398338 - RNA, 19 nt, Bordetella pertussis
cguccagcgccaccagcag

SEQ ID NO: 398339 - RNA, 20 nt, Bordetella pertussis
cguccagcggcgcgacgcgc

SEQ ID NO: 398340 - RNA, 17 nt, Bordetella pertussis
cguccagcguggcgcag

SEQ ID NO: 398341 - RNA, 17 nt, Bordetella pertussis
cguccaggaagcagccc

SEQ ID NO: 398342 - RNA, 17 nt, Bordetella pertussis
cguccaggcccuggcgg

SEQ ID NO: 398343 - RNA, 21 nt, Bordetella pertussis
cguccaggcccuggcggcgca

SEQ ID NO: 398344 - RNA, 15 nt, Bordetella pertussis
cguccaggcgcaccu

SEQ ID NO: 398345 - RNA, 14 nt, Bordetella pertussis
cguccaggcgcgcc

SEQ ID NO: 398346 - RNA, 20 nt, Bordetella pertussis
cguccaggcggccaucgccg

SEQ ID NO: 398347 - RNA, 18 nt, Bordetella pertussis
cguccaggugcggcggcg

SEQ ID NO: 398348 - RNA, 22 nt, Bordetella pertussis
cguccagguugucggccaugcg

SEQ ID NO: 398349 - RNA, 18 nt, Bordetella pertussis
cguccagucccguggcgc

SEQ ID NO: 398350 - RNA, 16 nt, Bordetella pertussis
cguccaucgacgcggc

SEQ ID NO: 398351 - RNA, 17 nt, Bordetella pertussis
cguccauuagggcccag

SEQ ID NO: 398352 - RNA, 18 nt, Bordetella pertussis
cgucccagcgcacgcagc

SEQ ID NO: 398353 - RNA, 20 nt, Bordetella pertussis
cgucccagucgccgcgcccg

SEQ ID NO: 398354 - RNA, 22 nt, Bordetella pertussis
cguccccaauacccgccacaga

SEQ ID NO: 398355 - RNA, 19 nt, Bordetella pertussis
cgucccccuacugcccucg

SEQ ID NO: 398356 - RNA, 18 nt, Bordetella pertussis
cgucccgacccccggccc

SEQ ID NO: 398357 - RNA, 14 nt, Bordetella pertussis
cgucccgugccggc

SEQ ID NO: 398358 - RNA, 15 nt, Bordetella pertussis
cgucccgugccggcc

SEQ ID NO: 398359 - RNA, 17 nt, Bordetella pertussis
cgucccgugccggccgg

SEQ ID NO: 398360 - RNA, 13 nt, Bordetella pertussis
cgucccuggucca

SEQ ID NO: 398361 - RNA, 18 nt, Bordetella pertussis
cguccgcccgcuccacca

SEQ ID NO: 398362 - RNA, 22 nt, Bordetella pertussis
cguccgccgugcaggcccgggc

SEQ ID NO: 398363 - RNA, 15 nt, Bordetella pertussis
cguccgcgcgccgcu

SEQ ID NO: 398364 - RNA, 18 nt, Bordetella pertussis
cguccgcggcccgcccgc

SEQ ID NO: 398365 - RNA, 15 nt, Bordetella pertussis
cguccgcgucgccgc

SEQ ID NO: 398366 - RNA, 17 nt, Bordetella pertussis
cguccgcgucgccgccg

SEQ ID NO: 398367 - RNA, 19 nt, Bordetella pertussis
cguccgcuucgucgggcag

SEQ ID NO: 398368 - RNA, 15 nt, Bordetella pertussis
cguccggaucuuccu

SEQ ID NO: 398369 - RNA, 21 nt, Bordetella pertussis
cguccggcgcccgccgccggg

SEQ ID NO: 398370 - RNA, 23 nt, Bordetella pertussis
cguccgucggguugccgcugcau

SEQ ID NO: 398371 - RNA, 18 nt, Bordetella pertussis
cguccgucucgcccaggc

SEQ ID NO: 398372 - RNA, 16 nt, Bordetella pertussis
cguccguggccggcgc

SEQ ID NO: 398373 - RNA, 13 nt, Bordetella pertussis
cguccucgaccag

SEQ ID NO: 398374 - RNA, 18 nt, Bordetella pertussis
cguccucgcgggccuggc

SEQ ID NO: 398375 - RNA, 18 nt, Bordetella pertussis
cguccucggcacggccag

SEQ ID NO: 398376 - RNA, 20 nt, Bordetella pertussis
cguccucggcacggccagca

SEQ ID NO: 398377 - RNA, 21 nt, Bordetella pertussis
cguccucggccagccgggcga

SEQ ID NO: 398378 - RNA, 15 nt, Bordetella pertussis
cguccucggccuggc

SEQ ID NO: 398379 - RNA, 16 nt, Bordetella pertussis
cguccugcacguccuc

SEQ ID NO: 398380 - RNA, 19 nt, Bordetella pertussis
cguccugcaggcggcgcau

SEQ ID NO: 398381 - RNA, 21 nt, Bordetella pertussis
cguccugccaguugccgccgc

SEQ ID NO: 398382 - RNA, 20 nt, Bordetella pertussis
cguccugccauugcgcggcc

SEQ ID NO: 398383 - RNA, 15 nt, Bordetella pertussis
cguccugccgcgacc

SEQ ID NO: 398384 - RNA, 15 nt, Bordetella pertussis
cguccugcggcggca

SEQ ID NO: 398385 - RNA, 18 nt, Bordetella pertussis
cguccugcggcggcagcu

SEQ ID NO: 398386 - RNA, 15 nt, Bordetella pertussis
cguccugcugcggca

SEQ ID NO: 398387 - RNA, 17 nt, Bordetella pertussis
cguccuggccacugccu

SEQ ID NO: 398388 - RNA, 20 nt, Bordetella pertussis
cguccuggcgaccggcggca

SEQ ID NO: 398389 - RNA, 19 nt, Bordetella pertussis
cguccugguggaccugccg

SEQ ID NO: 398390 - RNA, 14 nt, Bordetella pertussis
cguccuugagcgcc

SEQ ID NO: 398391 - RNA, 15 nt, Bordetella pertussis
cguccuugagggcgc

SEQ ID NO: 398392 - RNA, 20 nt, Bordetella pertussis
cgucgaacggccgggcgccc

SEQ ID NO: 398393 - RNA, 15 nt, Bordetella pertussis
cgucgaacuuguucu

SEQ ID NO: 398394 - RNA, 14 nt, Bordetella pertussis
cgucgaaggcgcgc

SEQ ID NO: 398395 - RNA, 16 nt, Bordetella pertussis
cgucgaaggcgcgcuc

SEQ ID NO: 398396 - RNA, 17 nt, Bordetella pertussis
cgucgaaggcggccggc

SEQ ID NO: 398397 - RNA, 22 nt, Bordetella pertussis
cgucgaauacgaaacaggcgcc

SEQ ID NO: 398398 - RNA, 22 nt, Bordetella pertussis
cgucgacagcaugaacggcagc

SEQ ID NO: 398399 - RNA, 20 nt, Bordetella pertussis
cgucgaccacgccggcggcc

SEQ ID NO: 398400 - RNA, 15 nt, Bordetella pertussis
cgucgaccagcagca

SEQ ID NO: 398401 - RNA, 17 nt, Bordetella pertussis
cgucgaccagcagcacg

SEQ ID NO: 398402 - RNA, 15 nt, Bordetella pertussis
cgucgaccagcaucc

SEQ ID NO: 398403 - RNA, 17 nt, Bordetella pertussis
cgucgaccagcauccuc

SEQ ID NO: 398404 - RNA, 15 nt, Bordetella pertussis
cgucgaccgcgaagc

SEQ ID NO: 398405 - RNA, 19 nt, Bordetella pertussis
cgucgaccgcgaagcgcgc

SEQ ID NO: 398406 - RNA, 20 nt, Bordetella pertussis
cgucgaccgcgggcgcgcgc

SEQ ID NO: 398407 - RNA, 17 nt, Bordetella pertussis
cgucgacgcccgcgccc

SEQ ID NO: 398408 - RNA, 12 nt, Bordetella pertussis
cgucgacgccga

SEQ ID NO: 398409 - RNA, 14 nt, Bordetella pertussis
cgucgacgcggccg

SEQ ID NO: 398410 - RNA, 14 nt, Bordetella pertussis
cgucgacguccugg

SEQ ID NO: 398411 - RNA, 15 nt, Bordetella pertussis
cgucgagcaccguga

SEQ ID NO: 398412 - RNA, 21 nt, Bordetella pertussis
cgucgagcacgcggcgcggca

SEQ ID NO: 398413 - RNA, 14 nt, Bordetella pertussis
cgucgaucagcgcg

SEQ ID NO: 398414 - RNA, 22 nt, Bordetella pertussis
cgucgaucaugaugcgcugggc

SEQ ID NO: 398415 - RNA, 19 nt, Bordetella pertussis
cgucgauccggcagcagca

SEQ ID NO: 398416 - RNA, 16 nt, Bordetella pertussis
cgucgaucggcgcgcc

SEQ ID NO: 398417 - RNA, 17 nt, Bordetella pertussis
cgucgaucggcgcgccc

SEQ ID NO: 398418 - RNA, 12 nt, Bordetella pertussis
cgucgaugaugc

SEQ ID NO: 398419 - RNA, 17 nt, Bordetella pertussis
cgucgaugccgaccagg

SEQ ID NO: 398420 - RNA, 16 nt, Bordetella pertussis
cgucgaugcgcgcgcg

SEQ ID NO: 398421 - RNA, 20 nt, Bordetella pertussis
cgucgauggcguacagcagg

SEQ ID NO: 398422 - RNA, 17 nt, Bordetella pertussis
cgucgcaaaccugccgu

SEQ ID NO: 398423 - RNA, 18 nt, Bordetella pertussis
cgucgccaaagcgcagcg

SEQ ID NO: 398424 - RNA, 20 nt, Bordetella pertussis
cgucgccgaagcaaugcagc

SEQ ID NO: 398425 - RNA, 16 nt, Bordetella pertussis
cgucgccgcccacggc

SEQ ID NO: 398426 - RNA, 17 nt, Bordetella pertussis
cgucgccgcccacggcg

SEQ ID NO: 398427 - RNA, 18 nt, Bordetella pertussis
cgucgccgcccugcugcc

SEQ ID NO: 398428 - RNA, 14 nt, Bordetella pertussis
cgucgccgcgcggc

SEQ ID NO: 398429 - RNA, 15 nt, Bordetella pertussis
cgucgccgcgcggcg

SEQ ID NO: 398430 - RNA, 13 nt, Bordetella pertussis
cgucgccggcgcu

SEQ ID NO: 398431 - RNA, 20 nt, Bordetella pertussis
cgucgccuggucgacgccgg

SEQ ID NO: 398432 - RNA, 17 nt, Bordetella pertussis
cgucgccuucggcggcg

SEQ ID NO: 398433 - RNA, 19 nt, Bordetella pertussis
cgucgcgaaacccucccac

SEQ ID NO: 398434 - RNA, 16 nt, Bordetella pertussis
cgucgcgaugcgccag

SEQ ID NO: 398435 - RNA, 17 nt, Bordetella pertussis
cgucgcgaugcgccagg

SEQ ID NO: 398436 - RNA, 21 nt, Bordetella pertussis
cgucgcgaugcgccaggcgcu

SEQ ID NO: 398437 - RNA, 14 nt, Bordetella pertussis
cgucgcgcagcagg

SEQ ID NO: 398438 - RNA, 15 nt, Bordetella pertussis
cgucgcgcggcggca

SEQ ID NO: 398439 - RNA, 21 nt, Bordetella pertussis
cgucgcgcggcggcaccagca

SEQ ID NO: 398440 - RNA, 19 nt, Bordetella pertussis
cgucgcgcugcgacagcag

SEQ ID NO: 398441 - RNA, 21 nt, Bordetella pertussis
cgucgcgcugcgacagcagca

SEQ ID NO: 398442 - RNA, 15 nt, Bordetella pertussis
cgucgcgcuggcccc

SEQ ID NO: 398443 - RNA, 17 nt, Bordetella pertussis
cgucgcgcuggccccag

SEQ ID NO: 398444 - RNA, 14 nt, Bordetella pertussis
cgucgcgcuggggc

SEQ ID NO: 398445 - RNA, 16 nt, Bordetella pertussis
cgucgcgcuggggcag

SEQ ID NO: 398446 - RNA, 21 nt, Bordetella pertussis
cgucgcgcuucuuguccuuga

SEQ ID NO: 398447 - RNA, 14 nt, Bordetella pertussis
cgucgcugccgcgc

SEQ ID NO: 398448 - RNA, 15 nt, Bordetella pertussis
cgucgcugccgcgcg

SEQ ID NO: 398449 - RNA, 23 nt, Bordetella pertussis
cgucgcugcgcggcgggaccgug

SEQ ID NO: 398450 - RNA, 15 nt, Bordetella pertussis
cgucgcuggcagccu

SEQ ID NO: 398451 - RNA, 18 nt, Bordetella pertussis
cgucgcuggcagccuuga

SEQ ID NO: 398452 - RNA, 12 nt, Bordetella pertussis
cgucggacgcgc

SEQ ID NO: 398453 - RNA, 18 nt, Bordetella pertussis
cgucggacgcgcgccgca

SEQ ID NO: 398454 - RNA, 19 nt, Bordetella pertussis
cgucggcaaccgucgccag

SEQ ID NO: 398455 - RNA, 19 nt, Bordetella pertussis
cgucggcaccuucgcgcag

SEQ ID NO: 398456 - RNA, 21 nt, Bordetella pertussis
cgucggcaccuucgcgcagcg

SEQ ID NO: 398457 - RNA, 21 nt, Bordetella pertussis
cgucggccacgcccuguugcu

SEQ ID NO: 398458 - RNA, 15 nt, Bordetella pertussis
cgucggccagcuugc

SEQ ID NO: 398459 - RNA, 17 nt, Bordetella pertussis
cgucggccaggcgccag

SEQ ID NO: 398460 - RNA, 18 nt, Bordetella pertussis
cgucggccaugcgcgcca

SEQ ID NO: 398461 - RNA, 19 nt, Bordetella pertussis
cgucggccaugcgcgccag

SEQ ID NO: 398462 - RNA, 14 nt, Bordetella pertussis
cgucggccgccagc

SEQ ID NO: 398463 - RNA, 15 nt, Bordetella pertussis
cgucggccgccgccg

SEQ ID NO: 398464 - RNA, 16 nt, Bordetella pertussis
cgucggccucgcgcag

SEQ ID NO: 398465 - RNA, 12 nt, Bordetella pertussis
cgucggccugga

SEQ ID NO: 398466 - RNA, 15 nt, Bordetella pertussis
cgucggcgacgugau

SEQ ID NO: 398467 - RNA, 17 nt, Bordetella pertussis
cgucggcgcccggcgcc

SEQ ID NO: 398468 - RNA, 13 nt, Bordetella pertussis
cgucggcgccgau

SEQ ID NO: 398469 - RNA, 16 nt, Bordetella pertussis
cgucggcgcgcgccag

SEQ ID NO: 398470 - RNA, 16 nt, Bordetella pertussis
cgucggcgcucuuggg

SEQ ID NO: 398471 - RNA, 14 nt, Bordetella pertussis
cgucggcgcugcag

SEQ ID NO: 398472 - RNA, 17 nt, Bordetella pertussis
cgucggcgcuggcgcgc

SEQ ID NO: 398473 - RNA, 17 nt, Bordetella pertussis
cgucggcggcccacagc

SEQ ID NO: 398474 - RNA, 14 nt, Bordetella pertussis
cgucggcggccgcc

SEQ ID NO: 398475 - RNA, 20 nt, Bordetella pertussis
cgucggcguaaggccgccgg

SEQ ID NO: 398476 - RNA, 13 nt, Bordetella pertussis
cgucggcuuccau

SEQ ID NO: 398477 - RNA, 16 nt, Bordetella pertussis
cgucgggaccggcgcg

SEQ ID NO: 398478 - RNA, 11 nt, Bordetella pertussis
cgucgggcagc

SEQ ID NO: 398479 - RNA, 13 nt, Bordetella pertussis
cgucgggcgccgc

SEQ ID NO: 398480 - RNA, 14 nt, Bordetella pertussis
cgucgggggcggcc

SEQ ID NO: 398481 - RNA, 14 nt, Bordetella pertussis
cgucgguggggcag

SEQ ID NO: 398482 - RNA, 22 nt, Bordetella pertussis
cgucgguggggcaggucgccag

SEQ ID NO: 398483 - RNA, 17 nt, Bordetella pertussis
cgucguagugcgcgccg

SEQ ID NO: 398484 - RNA, 19 nt, Bordetella pertussis
cgucguagugcgcgccgcu

SEQ ID NO: 398485 - RNA, 15 nt, Bordetella pertussis
cgucguagcgccagc

SEQ ID NO: 398486 - RNA, 20 nt, Bordetella pertussis
cgucguccguccuggccacu

SEQ ID NO: 398487 - RNA, 15 nt, Bordetella pertussis
cgucgucgccgucgc

SEQ ID NO: 398488 - RNA, 16 nt, Bordetella pertussis
cgucgucgguggggca

SEQ ID NO: 398489 - RNA, 22 nt, Bordetella pertussis
cgucgucguggucgucccgcag

SEQ ID NO: 398490 - RNA, 18 nt, Bordetella pertussis
cgucguggggcgcggcgg

SEQ ID NO: 398491 - RNA, 15 nt, Bordetella pertussis
cgucguugcgccgau

SEQ ID NO: 398492 - RNA, 19 nt, Bordetella pertussis
cgucuccagcgccggcagc

SEQ ID NO: 398493 - RNA, 21 nt, Bordetella pertussis
cgucucgaacgccgcgucgcu

SEQ ID NO: 398494 - RNA, 15 nt, Bordetella pertussis
cgucucgcgcgccag

SEQ ID NO: 398495 - RNA, 23 nt, Bordetella pertussis
cgucucgguggaggacgccgacc

SEQ ID NO: 398496 - RNA, 15 nt, Bordetella pertussis
cgucugagcgccggg

SEQ ID NO: 398497 - RNA, 20 nt, Bordetella pertussis
cgucugcgccgccgcguggc

SEQ ID NO: 398498 - RNA, 13 nt, Bordetella pertussis
cgucugcucgccg

SEQ ID NO: 398499 - RNA, 15 nt, Bordetella pertussis
cgucuggcggcagcu

SEQ ID NO: 398500 - RNA, 23 nt, Bordetella pertussis
cgucugggcgugaaaggccagcg

SEQ ID NO: 398501 - RNA, 16 nt, Bordetella pertussis
cgucuucgccgaccag

SEQ ID NO: 398502 - RNA, 17 nt, Bordetella pertussis
cgucuucggcgcggcgg

SEQ ID NO: 398503 - RNA, 22 nt, Bordetella pertussis
cgucuugcccgccagcgcggcu

SEQ ID NO: 398504 - RNA, 11 nt, Bordetella pertussis
cgucuuggccg

SEQ ID NO: 398505 - RNA, 14 nt, Bordetella pertussis
cgugaaagcuccac

SEQ ID NO: 398506 - RNA, 18 nt, Bordetella pertussis
cgugaaaggccagcggcg

SEQ ID NO: 398507 - RNA, 12 nt, Bordetella pertussis
cgugaacggcuc

SEQ ID NO: 398508 - RNA, 23 nt, Bordetella pertussis
cgugaagccguccuugagggcgc

SEQ ID NO: 398509 - RNA, 13 nt, Bordetella pertussis
cgugaagcgccgc

SEQ ID NO: 398510 - RNA, 15 nt, Bordetella pertussis
cgugaccagcugcac

SEQ ID NO: 398511 - RNA, 18 nt, Bordetella pertussis
cgugaccagcugcaccag

SEQ ID NO: 398512 - RNA, 19 nt, Bordetella pertussis
cgugacccggggcaggaag

SEQ ID NO: 398513 - RNA, 17 nt, Bordetella pertussis
cgugaccgacaggccug

SEQ ID NO: 398514 - RNA, 16 nt, Bordetella pertussis
cgugaccgcgacgcgc

SEQ ID NO: 398515 - RNA, 16 nt, Bordetella pertussis
cgugacgcugauggcc

SEQ ID NO: 398516 - RNA, 22 nt, Bordetella pertussis
cgugacgcugauggccgccagc

SEQ ID NO: 398517 - RNA, 13 nt, Bordetella pertussis
cgugacggcggcg

SEQ ID NO: 398518 - RNA, 16 nt, Bordetella pertussis
cgugacguugccgcgc

SEQ ID NO: 398519 - RNA, 17 nt, Bordetella pertussis
cgugacguugccgcgcg

SEQ ID NO: 398520 - RNA, 18 nt, Bordetella pertussis
cgugauauagaccagcag

SEQ ID NO: 398521 - RNA, 20 nt, Bordetella pertussis
cgugaucgaccgccagcagg

SEQ ID NO: 398522 - RNA, 17 nt, Bordetella pertussis
cgugaucuugaugccgc

SEQ ID NO: 398523 - RNA, 12 nt, Bordetella pertussis
cgugaugcccag

SEQ ID NO: 398524 - RNA, 14 nt, Bordetella pertussis
cgugaugccccagg

SEQ ID NO: 398525 - RNA, 22 nt, Bordetella pertussis
cgugaugccgucgagcgcggcc

SEQ ID NO: 398526 - RNA, 14 nt, Bordetella pertussis
cgugaugcgcgccg

SEQ ID NO: 398527 - RNA, 15 nt, Bordetella pertussis
cgugaugcgcgccgc

SEQ ID NO: 398528 - RNA, 16 nt, Bordetella pertussis
cgugaugcgcgccgcu

SEQ ID NO: 398529 - RNA, 12 nt, Bordetella pertussis
cgugcaccagcc

SEQ ID NO: 398530 - RNA, 24 nt, Bordetella pertussis
cgugcaccagcccgaugcgccagg

SEQ ID NO: 398531 - RNA, 21 nt, Bordetella pertussis
cgugcagacggcggcuggacg

SEQ ID NO: 398532 - RNA, 22 nt, Bordetella pertussis
cgugcagagcaccacggcgcgc

SEQ ID NO: 398533 - RNA, 12 nt, Bordetella pertussis
cgugcagaucug

SEQ ID NO: 398534 - RNA, 21 nt, Bordetella pertussis
cgugcagcaagcccaccgggc

SEQ ID NO: 398535 - RNA, 16 nt, Bordetella pertussis
cgugcagcaggggcug

SEQ ID NO: 398536 - RNA, 14 nt, Bordetella pertussis
cgugcagccagcgg

SEQ ID NO: 398537 - RNA, 19 nt, Bordetella pertussis
cgugcagcgccgcgcgcuc

SEQ ID NO: 398538 - RNA, 20 nt, Bordetella pertussis
cgugcaggccaacgggaucc

SEQ ID NO: 398539 - RNA, 16 nt, Bordetella pertussis
cgugcaggccggcggc

SEQ ID NO: 398540 - RNA, 12 nt, Bordetella pertussis
cgugcagguacu

SEQ ID NO: 398541 - RNA, 20 nt, Bordetella pertussis
cgugccagcaggucgcgcac

SEQ ID NO: 398542 - RNA, 14 nt, Bordetella pertussis
cgugccagccgaac

SEQ ID NO: 398543 - RNA, 12 nt, Bordetella pertussis
cgugccagcagg

SEQ ID NO: 398544 - RNA, 23 nt, Bordetella pertussis
cgugccauacagcaaggacaagg

SEQ ID NO: 398545 - RNA, 17 nt, Bordetella pertussis
cgugccauggacgccgg

SEQ ID NO: 398546 - RNA, 14 nt, Bordetella pertussis
cgugcccagcuggc

SEQ ID NO: 398547 - RNA, 15 nt, Bordetella pertussis
cgugcccagcuggca

SEQ ID NO: 398548 - RNA, 15 nt, Bordetella pertussis
cgugcccgagggcgc

SEQ ID NO: 398549 - RNA, 21 nt, Bordetella pertussis
cgugcccgccacccagggcuu

SEQ ID NO: 398550 - RNA, 16 nt, Bordetella pertussis
cgugcccggcgggccg

SEQ ID NO: 398551 - RNA, 21 nt, Bordetella pertussis
cgugcccggcgggccgcacuc

SEQ ID NO: 398552 - RNA, 20 nt, Bordetella pertussis
cgugccgacgaugccgccgc

SEQ ID NO: 398553 - RNA, 14 nt, Bordetella pertussis
cgugccgcccagga

SEQ ID NO: 398554 - RNA, 12 nt, Bordetella pertussis
cgugccgcgcag

SEQ ID NO: 398555 - RNA, 13 nt, Bordetella pertussis
cgugccgcgcagg

SEQ ID NO: 398556 - RNA, 18 nt, Bordetella pertussis
cgugccgcgcgcaccggc

SEQ ID NO: 398557 - RNA, 13 nt, Bordetella pertussis
cgugccgggcagc

SEQ ID NO: 398558 - RNA, 15 nt, Bordetella pertussis
cgugccgucgaugau

SEQ ID NO: 398559 - RNA, 20 nt, Bordetella pertussis
cgugccucaacuggccggcc

SEQ ID NO: 398560 - RNA, 23 nt, Bordetella pertussis
cgugcgcacgcguucgggcggca

SEQ ID NO: 398561 - RNA, 23 nt, Bordetella pertussis
cgugcgccaggcaaaggcccagg

SEQ ID NO: 398562 - RNA, 17 nt, Bordetella pertussis
cgugcgcccauggcgcg

SEQ ID NO: 398563 - RNA, 18 nt, Bordetella pertussis
cgugcgcccauggcgcgc

SEQ ID NO: 398564 - RNA, 20 nt, Bordetella pertussis
cgugcgcccauggcgcgcag

SEQ ID NO: 398565 - RNA, 21 nt, Bordetella pertussis
cgugcgcccauggcgcgcagc

SEQ ID NO: 398566 - RNA, 18 nt, Bordetella pertussis
cgugcgcaggcgcguggc

SEQ ID NO: 398567 - RNA, 15 nt, Bordetella pertussis
cgugcgccccgccuc

SEQ ID NO: 398568 - RNA, 18 nt, Bordetella pertussis
cgugcgcgaccgcgcggc

SEQ ID NO: 398569 - RNA, 14 nt, Bordetella pertussis
cgugcgcgagggcu

SEQ ID NO: 398570 - RNA, 17 nt, Bordetella pertussis
cgugcgcgaucuugccg

SEQ ID NO: 398571 - RNA, 19 nt, Bordetella pertussis
cgugcgcgcccgaugcccc

SEQ ID NO: 398572 - RNA, 20 nt, Bordetella pertussis
cgugcgcggcgagccgcgcg

SEQ ID NO: 398573 - RNA, 13 nt, Bordetella pertussis
cgugcgcuggcug

SEQ ID NO: 398574 - RNA, 16 nt, Bordetella pertussis
cgugcgcuggcugggc

SEQ ID NO: 398575 - RNA, 14 nt, Bordetella pertussis
cgugcggaccagcg

SEQ ID NO: 398576 - RNA, 17 nt, Bordetella pertussis
cgugcggcacgcacagc

SEQ ID NO: 398577 - RNA, 22 nt, Bordetella pertussis
cgugcggcacgcacagcaugcg

SEQ ID NO: 398578 - RNA, 13 nt, Bordetella pertussis
cgugcggcagggc

SEQ ID NO: 398579 - RNA, 12 nt, Bordetella pertussis
cgugcggcgcgc

SEQ ID NO: 398580 - RNA, 15 nt, Bordetella pertussis
cgugcgggccugcag

SEQ ID NO: 398581 - RNA, 22 nt, Bordetella pertussis
cgugcgguucgucagggccgca

SEQ ID NO: 398582 - RNA, 14 nt, Bordetella pertussis
cgugcgugaccacg

SEQ ID NO: 398583 - RNA, 15 nt, Bordetella pertussis
cgugcgugcgccugu

SEQ ID NO: 398584 - RNA, 17 nt, Bordetella pertussis
cgugcuccagaacgcgc

SEQ ID NO: 398585 - RNA, 22 nt, Bordetella pertussis
cgugcugaucgacaugcuggcc

SEQ ID NO: 398586 - RNA, 18 nt, Bordetella pertussis
cgugcuggcgcagcagcg

SEQ ID NO: 398587 - RNA, 23 nt, Bordetella pertussis
cgugcuggucauugaccugcuug

SEQ ID NO: 398588 - RNA, 22 nt, Bordetella pertussis
cgugcuguaccucagccugcug

SEQ ID NO: 398589 - RNA, 16 nt, Bordetella pertussis
cguggacaggcaccug

SEQ ID NO: 398590 - RNA, 21 nt, Bordetella pertussis
cguggaugaugcgcgagccgc

SEQ ID NO: 398591 - RNA, 18 nt, Bordetella pertussis
cguggaugauggucugcc

SEQ ID NO: 398592 - RNA, 18 nt, Bordetella pertussis
cguggcaggugcggccgc

SEQ ID NO: 398593 - RNA, 13 nt, Bordetella pertussis
cguggcaugccau

SEQ ID NO: 398594 - RNA, 18 nt, Bordetella pertussis
cguggccacggccgcgau

SEQ ID NO: 398595 - RNA, 24 nt, Bordetella pertussis
cguggccacggcgucgaugcgcgc

SEQ ID NO: 398596 - RNA, 13 nt, Bordetella pertussis
cguggccaccagg

SEQ ID NO: 398597 - RNA, 14 nt, Bordetella pertussis
cguggcccagccgg

SEQ ID NO: 398598 - RNA, 15 nt, Bordetella pertussis
cguggccgcagucag

SEQ ID NO: 398599 - RNA, 23 nt, Bordetella pertussis
cguggccgcuucggcggccaugg

SEQ ID NO: 398600 - RNA, 13 nt, Bordetella pertussis
cguggccggcggg

SEQ ID NO: 398601 - RNA, 13 nt, Bordetella pertussis
cguggccgggccc

SEQ ID NO: 398602 - RNA, 20 nt, Bordetella pertussis
cguggccgggcccggcgcgc

SEQ ID NO: 398603 - RNA, 21 nt, Bordetella pertussis
cguggccguucggugcgcagc

SEQ ID NO: 398604 - RNA, 17 nt, Bordetella pertussis
cguggccucuugcguga

SEQ ID NO: 398605 - RNA, 23 nt, Bordetella pertussis
cguggcgauccagggccgccagc

SEQ ID NO: 398606 - RNA, 13 nt, Bordetella pertussis
cguggcgcaccag

SEQ ID NO: 398607 - RNA, 19 nt, Bordetella pertussis
cguggcgccgacccugccc

SEQ ID NO: 398608 - RNA, 22 nt, Bordetella pertussis
cguggcgccgacccugcccggc

SEQ ID NO: 398609 - RNA, 17 nt, Bordetella pertussis
cguggcgccgcgggccu

SEQ ID NO: 398610 - RNA, 16 nt, Bordetella pertussis
cguggcggccacaacc

SEQ ID NO: 398611 - RNA, 16 nt, Bordetella pertussis
cguggcggccaggccg

SEQ ID NO: 398612 - RNA, 12 nt, Bordetella pertussis
cguggcggccgc

SEQ ID NO: 398613 - RNA, 17 nt, Bordetella pertussis
cguggcggcgcagcgcc

SEQ ID NO: 398614 - RNA, 16 nt, Bordetella pertussis
cguggcgggaggaagg

SEQ ID NO: 398615 - RNA, 22 nt, Bordetella pertussis
cguggcguccaugcugauccug

SEQ ID NO: 398616 - RNA, 17 nt, Bordetella pertussis
cgugggcacccggccgc

SEQ ID NO: 398617 - RNA, 17 nt, Bordetella pertussis
cgugggccaguccgcag

SEQ ID NO: 398618 - RNA, 23 nt, Bordetella pertussis
cgugggcgagcguuuuggcgagc

SEQ ID NO: 398619 - RNA, 20 nt, Bordetella pertussis
cgugggcgccuacggcggcg

SEQ ID NO: 398620 - RNA, 14 nt, Bordetella pertussis
cgugggcggcggca

SEQ ID NO: 398621 - RNA, 13 nt, Bordetella pertussis
cguggggacaggc

SEQ ID NO: 398622 - RNA, 13 nt, Bordetella pertussis
cguggggccggcc

SEQ ID NO: 398623 - RNA, 15 nt, Bordetella pertussis
cguggggccggccgc

SEQ ID NO: 398624 - RNA, 22 nt, Bordetella pertussis
cguggucgacauagacgcgcag

SEQ ID NO: 398625 - RNA, 20 nt, Bordetella pertussis
cguggugggccacucgaugg

SEQ ID NO: 398626 - RNA, 17 nt, Bordetella pertussis
cgugguggggccgggcu

SEQ ID NO: 398627 - RNA, 19 nt, Bordetella pertussis
cgugguggugcgggccgcg

SEQ ID NO: 398628 - RNA, 17 nt, Bordetella pertussis
cguguccagcggcgcca

SEQ ID NO: 398629 - RNA, 19 nt, Bordetella pertussis
cguguccagcggcgccagc

SEQ ID NO: 398630 - RNA, 13 nt, Bordetella pertussis
cgugucccagccg

SEQ ID NO: 398631 - RNA, 16 nt, Bordetella pertussis
cgugucggccaccacg

SEQ ID NO: 398632 - RNA, 17 nt, Bordetella pertussis
cgugugccuguccccgc

SEQ ID NO: 398633 - RNA, 12 nt, Bordetella pertussis
cgugugguuggc

SEQ ID NO: 398634 - RNA, 13 nt, Bordetella pertussis
cgugugucccggc

SEQ ID NO: 398635 - RNA, 16 nt, Bordetella pertussis
cgugugucccggcggg

SEQ ID NO: 398636 - RNA, 19 nt, Bordetella pertussis
cgugugucccggcggggca

SEQ ID NO: 398637 - RNA, 18 nt, Bordetella pertussis
cguguugcgugcgagcag

SEQ ID NO: 398638 - RNA, 19 nt, Bordetella pertussis
cguguugucuuuuuucauc

SEQ ID NO: 398639 - RNA, 17 nt, Bordetella pertussis
cguucaaucgcgcuucu

SEQ ID NO: 398640 - RNA, 15 nt, Bordetella pertussis
cguucaccaggaagc

SEQ ID NO: 398641 - RNA, 15 nt, Bordetella pertussis
cguucacgcgcagcg

SEQ ID NO: 398642 - RNA, 16 nt, Bordetella pertussis
cguucacgcgcagcgu

SEQ ID NO: 398643 - RNA, 15 nt, Bordetella pertussis
cguucagcagcaggc

SEQ ID NO: 398644 - RNA, 15 nt, Bordetella pertussis
cguucagcgggcgcg

SEQ ID NO: 398645 - RNA, 16 nt, Bordetella pertussis
cguucagcgggcgcgc

SEQ ID NO: 398646 - RNA, 13 nt, Bordetella pertussis
cguuccagcaugu

SEQ ID NO: 398647 - RNA, 15 nt, Bordetella pertussis
cguuccagcugcuuc

SEQ ID NO: 398648 - RNA, 17 nt, Bordetella pertussis
cguuccccaucaucugc

SEQ ID NO: 398649 - RNA, 14 nt, Bordetella pertussis
cguucccgccgggc

SEQ ID NO: 398650 - RNA, 19 nt, Bordetella pertussis
cguucccuacccgccgggc

SEQ ID NO: 398651 - RNA, 15 nt, Bordetella pertussis
cguucgcccgugccg

SEQ ID NO: 398652 - RNA, 13 nt, Bordetella pertussis
cguucgcgccgcg

SEQ ID NO: 398653 - RNA, 17 nt, Bordetella pertussis
cguucggccacuuccug

SEQ ID NO: 398654 - RNA, 19 nt, Bordetella pertussis
cguucggccacuuccuggu

SEQ ID NO: 398655 - RNA, 16 nt, Bordetella pertussis
cguucugggagcgcgg

SEQ ID NO: 398656 - RNA, 18 nt, Bordetella pertussis
cguucuggucagccgugu

SEQ ID NO: 398657 - RNA, 14 nt, Bordetella pertussis
cguuggcaggccag

SEQ ID NO: 398658 - RNA, 19 nt, Bordetella pertussis
cguuggcaggccagcaugg

SEQ ID NO: 398659 - RNA, 15 nt, Bordetella pertussis
cguuggcauggcgcg

SEQ ID NO: 398660 - RNA, 21 nt, Bordetella pertussis
cguuggccaaugcgccgcgcc

SEQ ID NO: 398661 - RNA, 12 nt, Bordetella pertussis
cguuggccagcg

SEQ ID NO: 398662 - RNA, 17 nt, Bordetella pertussis
cguuggccagcgccgcc

SEQ ID NO: 398663 - RNA, 20 nt, Bordetella pertussis
cguuggcgaggacaggccag

SEQ ID NO: 398664 - RNA, 15 nt, Bordetella pertussis
cguuggcgugcagcc

SEQ ID NO: 398665 - RNA, 13 nt, Bordetella pertussis
cguuggucuuggg

SEQ ID NO: 398666 - RNA, 21 nt, Bordetella pertussis
cguuggugucggcggcgagcu

SEQ ID NO: 398667 - RNA, 20 nt, Bordetella pertussis
cguuucccucggugcugcug

SEQ ID NO: 398668 - RNA, 16 nt, Bordetella pertussis
cguuucgucggcgcgc

SEQ ID NO: 398669 - RNA, 18 nt, Bordetella pertussis
cuaaaaggaaauauaugg

SEQ ID NO: 398670 - RNA, 17 nt, Bordetella pertussis
cuaccgcuucccuggca

SEQ ID NO: 398671 - RNA, 18 nt, Bordetella pertussis
cuaccgcuucccuggcaa

SEQ ID NO: 398672 - RNA, 22 nt, Bordetella pertussis
cuaccggcgccgacgcgcuggc

SEQ ID NO: 398673 - RNA, 13 nt, Bordetella pertussis
cuacgacgccugg

SEQ ID NO: 398674 - RNA, 16 nt, Bordetella pertussis
cuacgaguaccgccgc

SEQ ID NO: 398675 - RNA, 13 nt, Bordetella pertussis
cuacgcgcuggcg

SEQ ID NO: 398676 - RNA, 19 nt, Bordetella pertussis
cuaggccguuuccucugga

SEQ ID NO: 398677 - RNA, 19 nt, Bordetella pertussis
cuaggccuugccgccgccg

SEQ ID NO: 398678 - RNA, 14 nt, Bordetella pertussis
cuaggcgcagcagg

SEQ ID NO: 398679 - RNA, 22 nt, Bordetella pertussis
cuauaucgacggcgccuauugc

SEQ ID NO: 398680 - RNA, 14 nt, Bordetella pertussis
cuaucugccgcgca

SEQ ID NO: 398681 - RNA, 21 nt, Bordetella pertussis
cuaugcgguguugcucgugcu

SEQ ID NO: 398682 - RNA, 16 nt, Bordetella pertussis
cuaugcuuuacccuga

SEQ ID NO: 398683 - RNA, 12 nt, Bordetella pertussis
cuauggccugca

SEQ ID NO: 398684 - RNA, 14 nt, Bordetella pertussis
cuauggccuggaug

SEQ ID NO: 398685 - RNA, 11 nt, Bordetella pertussis
cuauuuccagg

SEQ ID NO: 398686 - RNA, 15 nt, Bordetella pertussis
cucaacccgccggcc

SEQ ID NO: 398687 - RNA, 19 nt, Bordetella pertussis
cucaacccgccggccauca

SEQ ID NO: 398688 - RNA, 15 nt, Bordetella pertussis
cucaaggccgaauug

SEQ ID NO: 398689 - RNA, 15 nt, Bordetella pertussis
cucaauucggccuga

SEQ ID NO: 398690 - RNA, 21 nt, Bordetella pertussis
cucagaccaucuuguccuuca

SEQ ID NO: 398691 - RNA, 13 nt, Bordetella pertussis
cucagcaccaggc

SEQ ID NO: 398692 - RNA, 17 nt, Bordetella pertussis
cucagcaccaggccgcc

SEQ ID NO: 398693 - RNA, 21 nt, Bordetella pertussis
cucagcaccaggccgccggcc

SEQ ID NO: 398694 - RNA, 22 nt, Bordetella pertussis
cucagcagcgccagggccaggc

SEQ ID NO: 398695 - RNA, 17 nt, Bordetella pertussis
cucagcaugcgcugggc

SEQ ID NO: 398696 - RNA, 14 nt, Bordetella pertussis
cucagccaucauca

SEQ ID NO: 398697 - RNA, 10 nt, Bordetella pertussis
cucagccccc

SEQ ID NO: 398698 - RNA, 22 nt, Bordetella pertussis
cucagccccccguaggcggccc

SEQ ID NO: 398699 - RNA, 14 nt, Bordetella pertussis
cucagccgcccgcc

SEQ ID NO: 398700 - RNA, 12 nt, Bordetella pertussis
cucagcccggcg

SEQ ID NO: 398701 - RNA, 21 nt, Bordetella pertussis
cucagcccgcguucaggcgcg

SEQ ID NO: 398702 - RNA, 19 nt, Bordetella pertussis
cucagguagaccacgcgcu

SEQ ID NO: 398703 - RNA, 23 nt, Bordetella pertussis
cucaucgagcgccugggcggcca

SEQ ID NO: 398704 - RNA, 21 nt, Bordetella pertussis
cucaucggcaggccggcgcgc

SEQ ID NO: 398705 - RNA, 23 nt, Bordetella pertussis
cucauggcggcacgaaugugguc

SEQ ID NO: 398706 - RNA, 17 nt, Bordetella pertussis
cuccaccgggcugaaca

SEQ ID NO: 398707 - RNA, 19 nt, Bordetella pertussis
cuccaccgggcugaacauc

SEQ ID NO: 398708 - RNA, 22 nt, Bordetella pertussis
cuccacggaauggucaagcggc

SEQ ID NO: 398709 - RNA, 12 nt, Bordetella pertussis
cuccacgugcgg

SEQ ID NO: 398710 - RNA, 15 nt, Bordetella pertussis
cuccacuggccuucu

SEQ ID NO: 398711 - RNA, 14 nt, Bordetella pertussis
cuccagagcgcgca

SEQ ID NO: 398712 - RNA, 13 nt, Bordetella pertussis
cuccagcagggac

SEQ ID NO: 398713 - RNA, 14 nt, Bordetella pertussis
cuccagcagggacu

SEQ ID NO: 398714 - RNA, 14 nt, Bordetella pertussis
cuccagcaucgccg

SEQ ID NO: 398715 - RNA, 16 nt, Bordetella pertussis
cuccagcaucgccgcc

SEQ ID NO: 398716 - RNA, 18 nt, Bordetella pertussis
cuccagcaucgccgccag

SEQ ID NO: 398717 - RNA, 14 nt, Bordetella pertussis
cuccagccaggcgc

SEQ ID NO: 398718 - RNA, 17 nt, Bordetella pertussis
cuccagccaggcgcgca

SEQ ID NO: 398719 - RNA, 18 nt, Bordetella pertussis
cuccagcccuucgcccgc

SEQ ID NO: 398720 - RNA, 17 nt, Bordetella pertussis
cuccagcgccagcacag

SEQ ID NO: 398721 - RNA, 20 nt, Bordetella pertussis
cuccagcgccggcagcccca

SEQ ID NO: 398722 - RNA, 22 nt, Bordetella pertussis
cuccagcgccggcagccccagc

SEQ ID NO: 398723 - RNA, 23 nt, Bordetella pertussis
cuccagcgccggcagccccagcg

SEQ ID NO: 398724 - RNA, 13 nt, Bordetella pertussis
cuccagcgcggcg

SEQ ID NO: 398725 - RNA, 14 nt, Bordetella pertussis
cuccagcgcggcgg

SEQ ID NO: 398726 - RNA, 23 nt, Bordetella pertussis
cuccagcgcggcggacugcgccg

SEQ ID NO: 398727 - RNA, 17 nt, Bordetella pertussis
cuccagcgcgucggcca

SEQ ID NO: 398728 - RNA, 16 nt, Bordetella pertussis
cuccagcgucauggcc

SEQ ID NO: 398729 - RNA, 15 nt, Bordetella pertussis
cuccagcuccagcgc

SEQ ID NO: 398730 - RNA, 16 nt, Bordetella pertussis
cuccagcuccagcgcg

SEQ ID NO: 398731 - RNA, 23 nt, Bordetella pertussis
cuccagcuggcgcaccaggcugg

SEQ ID NO: 398732 - RNA, 16 nt, Bordetella pertussis
cuccaggaaagcgccg

SEQ ID NO: 398733 - RNA, 20 nt, Bordetella pertussis
cuccaggaaagcgccgccgc

SEQ ID NO: 398734 - RNA, 17 nt, Bordetella pertussis
cuccaggaugcgcgaca

SEQ ID NO: 398735 - RNA, 13 nt, Bordetella pertussis
cuccaggcccagg

SEQ ID NO: 398736 - RNA, 20 nt, Bordetella pertussis
cuccaggccggcaugcgccg

SEQ ID NO: 398737 - RNA, 19 nt, Bordetella pertussis
cuccaggcucaggcggcca

SEQ ID NO: 398738 - RNA, 14 nt, Bordetella pertussis
cuccagucccgcac

SEQ ID NO: 398739 - RNA, 13 nt, Bordetella pertussis
cuccauagcgccg

SEQ ID NO: 398740 - RNA, 19 nt, Bordetella pertussis
cuccaucuguucggcgccg

SEQ ID NO: 398741 - RNA, 19 nt, Bordetella pertussis
cuccauggcgccggcggcc

SEQ ID NO: 398742 - RNA, 18 nt, Bordetella pertussis
cucccacgaccugcaacc

SEQ ID NO: 398743 - RNA, 19 nt, Bordetella pertussis
cucccagaccugcgcgccg

SEQ ID NO: 398744 - RNA, 21 nt, Bordetella pertussis
cucccagaccugcgcgccggc

SEQ ID NO: 398745 - RNA, 17 nt, Bordetella pertussis
cucccauugcgcggcca

SEQ ID NO: 398746 - RNA, 16 nt, Bordetella pertussis
cucccccucggccugc

SEQ ID NO: 398747 - RNA, 17 nt, Bordetella pertussis
cucccgcaggcccacaa

SEQ ID NO: 398748 - RNA, 21 nt, Bordetella pertussis
cucccgcaggcccacaaugcc

SEQ ID NO: 398749 - RNA, 17 nt, Bordetella pertussis
cucccgcgccauugcca

SEQ ID NO: 398750 - RNA, 18 nt, Bordetella pertussis
cucccgcgcugccgcugc

SEQ ID NO: 398751 - RNA, 22 nt, Bordetella pertussis
cucccugugggggacaggcacg

SEQ ID NO: 398752 - RNA, 19 nt, Bordetella pertussis
cuccgaacgcgacagcgcu

SEQ ID NO: 398753 - RNA, 15 nt, Bordetella pertussis
cuccggcgccgccuc

SEQ ID NO: 398754 - RNA, 17 nt, Bordetella pertussis
cuccggcugcgcgcgca

SEQ ID NO: 398755 - RNA, 18 nt, Bordetella pertussis
cuccggcugcgcgcgcag

SEQ ID NO: 398756 - RNA, 19 nt, Bordetella pertussis
cuccgggagccuguccccg

SEQ ID NO: 398757 - RNA, 14 nt, Bordetella pertussis
cuccgggucgcggc

SEQ ID NO: 398758 - RNA, 18 nt, Bordetella pertussis
cuccgguacgccugcacc

SEQ ID NO: 398759 - RNA, 16 nt, Bordetella pertussis
cuccucgacgucgccc

SEQ ID NO: 398760 - RNA, 17 nt, Bordetella pertussis
cuccucgacgucgccca

SEQ ID NO: 398761 - RNA, 20 nt, Bordetella pertussis
cuccucgcgcgcggacugcc

SEQ ID NO: 398762 - RNA, 14 nt, Bordetella pertussis
cuccugccggcgga

SEQ ID NO: 398763 - RNA, 15 nt, Bordetella pertussis
cucgacagcagcccg

SEQ ID NO: 398764 - RNA, 16 nt, Bordetella pertussis
cucgaccagcccggcc

SEQ ID NO: 398765 - RNA, 14 nt, Bordetella pertussis
cucgaccagcgcgc

SEQ ID NO: 398766 - RNA, 13 nt, Bordetella pertussis
cucgaccagcgcg

SEQ ID NO: 398767 - RNA, 14 nt, Bordetella pertussis
cucgacggccgccg

SEQ ID NO: 398768 - RNA, 13 nt, Bordetella pertussis
cucgacggcgcgc

SEQ ID NO: 398769 - RNA, 14 nt, Bordetella pertussis
cucgacggcgcgcg

SEQ ID NO: 398770 - RNA, 22 nt, Bordetella pertussis
cucgacguaagugcccaggccc

SEQ ID NO: 398771 - RNA, 23 nt, Bordetella pertussis
cucgaggugcacgugggcacgcc

SEQ ID NO: 398772 - RNA, 18 nt, Bordetella pertussis
cucgaucaccaccggcaa

SEQ ID NO: 398773 - RNA, 20 nt, Bordetella pertussis
cucgauugaccagcaccagc

SEQ ID NO: 398774 - RNA, 15 nt, Bordetella pertussis
cucgccagcggcagc

SEQ ID NO: 398775 - RNA, 16 nt, Bordetella pertussis
cucgcccagcaggucc

SEQ ID NO: 398776 - RNA, 22 nt, Bordetella pertussis
cucgcccagcgagccggccagc

SEQ ID NO: 398777 - RNA, 14 nt, Bordetella pertussis
cucgccgcuccggc

SEQ ID NO: 398778 - RNA, 13 nt, Bordetella pertussis
cucgccggccugg

SEQ ID NO: 398779 - RNA, 12 nt, Bordetella pertussis
cucgccggcgcu

SEQ ID NO: 398780 - RNA, 22 nt, Bordetella pertussis
cucgccguaggcuugcagcuug

SEQ ID NO: 398781 - RNA, 12 nt, Bordetella pertussis
cucgcgcagcag

SEQ ID NO: 398782 - RNA, 13 nt, Bordetella pertussis
cucgcgcagcgug

SEQ ID NO: 398783 - RNA, 15 nt, Bordetella pertussis
cucgcgccagggccc

SEQ ID NO: 398784 - RNA, 14 nt, Bordetella pertussis
cucgcgcgaccacu

SEQ ID NO: 398785 - RNA, 20 nt, Bordetella pertussis
cucgcgcgauguucaggccg

SEQ ID NO: 398786 - RNA, 14 nt, Bordetella pertussis
cucgcgcgccagca

SEQ ID NO: 398787 - RNA, 16 nt, Bordetella pertussis
cucgcgcgccagcagu

SEQ ID NO: 398788 - RNA, 21 nt, Bordetella pertussis
cucgcgcgcgaugcgcaggcu

SEQ ID NO: 398789 - RNA, 14 nt, Bordetella pertussis
cucgcgccaccaug

SEQ ID NO: 398790 - RNA, 13 nt, Bordetella pertussis
cucgcgcucggcc

SEQ ID NO: 398791 - RNA, 14 nt, Bordetella pertussis
cucgcgcucggcca

SEQ ID NO: 398792 - RNA, 17 nt, Bordetella pertussis
cucgcgcucggccagca

SEQ ID NO: 398793 - RNA, 16 nt, Bordetella pertussis
cucgcgcugcagcaug

SEQ ID NO: 398794 - RNA, 20 nt, Bordetella pertussis
cucgcggaaauccgggcgcu

SEQ ID NO: 398795 - RNA, 23 nt, Bordetella pertussis
cucgcggcccuggucgucgcggc

SEQ ID NO: 398796 - RNA, 14 nt, Bordetella pertussis
cucgcgggccuugg

SEQ ID NO: 398797 - RNA, 20 nt, Bordetella pertussis
cucgcuccagcggaccagug

SEQ ID NO: 398798 - RNA, 13 nt, Bordetella pertussis
cucgcugccggcg

SEQ ID NO: 398799 - RNA, 20 nt, Bordetella pertussis
cucggacaggucggcgccca

SEQ ID NO: 398800 - RNA, 15 nt, Bordetella pertussis
cucggacgccgcgcg

SEQ ID NO: 398801 - RNA, 13 nt, Bordetella pertussis
cucggacgccugg

SEQ ID NO: 398802 - RNA, 19 nt, Bordetella pertussis
cucggagggcuccaggcug

SEQ ID NO: 398803 - RNA, 17 nt, Bordetella pertussis
cucggccagcgcgcgcc

SEQ ID NO: 398804 - RNA, 19 nt, Bordetella pertussis
cucggccagcgcgcgccag

SEQ ID NO: 398805 - RNA, 21 nt, Bordetella pertussis
cucggccagcgcgcggccggc

SEQ ID NO: 398806 - RNA, 20 nt, Bordetella pertussis
cucggccagcgcgcggggca

SEQ ID NO: 398807 - RNA, 11 nt, Bordetella pertussis
cucggcaaacg

SEQ ID NO: 398808 - RNA, 21 nt, Bordetella pertussis
cucggccaggugcgccaugcg

SEQ ID NO: 398809 - RNA, 17 nt, Bordetella pertussis
cucggccgcauggcggc

SEQ ID NO: 398810 - RNA, 14 nt, Bordetella pertussis
cucggccggcaggu

SEQ ID NO: 398811 - RNA, 18 nt, Bordetella pertussis
cucggcgcccagcugcuu

SEQ ID NO: 398812 - RNA, 14 nt, Bordetella pertussis
cucggcgccggcgg

SEQ ID NO: 398813 - RNA, 20 nt, Bordetella pertussis
cucggcgccggcggcgcgga

SEQ ID NO: 398814 - RNA, 12 nt, Bordetella pertussis
cucggcggaugc

SEQ ID NO: 398815 - RNA, 13 nt, Bordetella pertussis
cucggucagcacg

SEQ ID NO: 398816 - RNA, 17 nt, Bordetella pertussis
cucggucagcgccaggg

SEQ ID NO: 398817 - RNA, 13 nt, Bordetella pertussis
cucggucagggug

SEQ ID NO: 398818 - RNA, 11 nt, Bordetella pertussis
cucgguccaga

SEQ ID NO: 398819 - RNA, 13 nt, Bordetella pertussis
cucgguccagcgg

SEQ ID NO: 398820 - RNA, 21 nt, Bordetella pertussis
cucguacgaggcauacaggcu

SEQ ID NO: 398821 - RNA, 15 nt, Bordetella pertussis
cucguccaugccggc

SEQ ID NO: 398822 - RNA, 17 nt, Bordetella pertussis
cucguccaugccggcca

SEQ ID NO: 398823 - RNA, 18 nt, Bordetella pertussis
cucguccaucgccugcac

SEQ ID NO: 398824 - RNA, 17 nt, Bordetella pertussis
cucgucccccuacugcc

SEQ ID NO: 398825 - RNA, 22 nt, Bordetella pertussis
cucguccguuucgucggcgcgc

SEQ ID NO: 398826 - RNA, 15 nt, Bordetella pertussis
cucgucgaggaucaa

SEQ ID NO: 398827 - RNA, 15 nt, Bordetella pertussis
cucguuggccagcgc

SEQ ID NO: 398828 - RNA, 13 nt, Bordetella pertussis
cucuacaccauca

SEQ ID NO: 398829 - RNA, 16 nt, Bordetella pertussis
cucuacacggccgcca

SEQ ID NO: 398830 - RNA, 17 nt, Bordetella pertussis
cucuacacggccgccac

SEQ ID NO: 398831 - RNA, 17 nt, Bordetella pertussis
cucuaugucgccggcca

SEQ ID NO: 398832 - RNA, 18 nt, Bordetella pertussis
cucuaugucgccggccag

SEQ ID NO: 398833 - RNA, 15 nt, Bordetella pertussis
cugaggcccgauggc

SEQ ID NO: 398834 - RNA, 22 nt, Bordetella pertussis
cugaggcccgauggcggggaug

SEQ ID NO: 398835 - RNA, 20 nt, Bordetella pertussis
cugaggcuuucgaagcgcuc

SEQ ID NO: 398836 - RNA, 21 nt, Bordetella pertussis
cugaucaucuucgugcuggcc

SEQ ID NO: 398837 - RNA, 17 nt, Bordetella pertussis
cugaucccggcgcuggc

SEQ ID NO: 398838 - RNA, 17 nt, Bordetella pertussis
cugaucgaucgcccgcu

SEQ ID NO: 398839 - RNA, 19 nt, Bordetella pertussis
cugaucggccgacugcugu

SEQ ID NO: 398840 - RNA, 22 nt, Bordetella pertussis
cugaucucgcgcaccgacacca

SEQ ID NO: 398841 - RNA, 17 nt, Bordetella pertussis
cugaucuuccugggcga

SEQ ID NO: 398842 - RNA, 17 nt, Bordetella pertussis
cugaucuugugcaucuc

SEQ ID NO: 398843 - RNA, 21 nt, Bordetella pertussis
cugcaagauuucauggcgucu

SEQ ID NO: 398844 - RNA, 16 nt, Bordetella pertussis
cugcaaggccggcggc

SEQ ID NO: 398845 - RNA, 23 nt, Bordetella pertussis
cugcaaggccggcggcacgcugc

SEQ ID NO: 398846 - RNA, 17 nt, Bordetella pertussis
cugcaaggccugcugca

SEQ ID NO: 398847 - RNA, 17 nt, Bordetella pertussis
cugcaaguccagcgugg

SEQ ID NO: 398848 - RNA, 23 nt, Bordetella pertussis
cugcaagguggcgugcagcaggu

SEQ ID NO: 398849 - RNA, 19 nt, Bordetella pertussis
cugcaauucgccgaugcgg

SEQ ID NO: 398850 - RNA, 20 nt, Bordetella pertussis
cugcaauugcgcggccaugc

SEQ ID NO: 398851 - RNA, 21 nt, Bordetella pertussis
cugcacgcgcgcgggcgcgcc

SEQ ID NO: 398852 - RNA, 14 nt, Bordetella pertussis
cugcacgcgggcgc

SEQ ID NO: 398853 - RNA, 17 nt, Bordetella pertussis
cugcacgcgggcgcuga

SEQ ID NO: 398854 - RNA, 16 nt, Bordetella pertussis
cugcacgcucuugagc

SEQ ID NO: 398855 - RNA, 21 nt, Bordetella pertussis
cugcacggccuugucgcgccc

SEQ ID NO: 398856 - RNA, 20 nt, Bordetella pertussis
cugcacggugggcagcagca

SEQ ID NO: 398857 - RNA, 15 nt, Bordetella pertussis
cugcacgucccaguc

SEQ ID NO: 398858 - RNA, 19 nt, Bordetella pertussis
cugcacgucccagucgccg

SEQ ID NO: 398859 - RNA, 19 nt, Bordetella pertussis
cugcagaucaucggcgcca

SEQ ID NO: 398860 - RNA, 13 nt, Bordetella pertussis
cugcaggcccagc

SEQ ID NO: 398861 - RNA, 21 nt, Bordetella pertussis
cugcaggccgccggccucuuc

SEQ ID NO: 398862 - RNA, 16 nt, Bordetella pertussis
cugcaggcucuugacc

SEQ ID NO: 398863 - RNA, 16 nt, Bordetella pertussis
cugcagggcaugggcc

SEQ ID NO: 398864 - RNA, 22 nt, Bordetella pertussis
cugcagggcaugggcccgggcg

SEQ ID NO: 398865 - RNA, 15 nt, Bordetella pertussis
cugcagggccuggaa

SEQ ID NO: 398866 - RNA, 16 nt, Bordetella pertussis
cugcagggccuggaag

SEQ ID NO: 398867 - RNA, 13 nt, Bordetella pertussis
cugcagggcgucu

SEQ ID NO: 398868 - RNA, 21 nt, Bordetella pertussis
cugcagggcugcgaugcgggc

SEQ ID NO: 398869 - RNA, 14 nt, Bordetella pertussis
cugcaggugccgcc

SEQ ID NO: 398870 - RNA, 20 nt, Bordetella pertussis
cugcaggugccgccggcgcg

SEQ ID NO: 398871 - RNA, 21 nt, Bordetella pertussis
cugcaggucuucgggcgugcg

SEQ ID NO: 398872 - RNA, 20 nt, Bordetella pertussis
cugcaguugcgccacggucu

SEQ ID NO: 398873 - RNA, 15 nt, Bordetella pertussis
cugcaguucggccgc

SEQ ID NO: 398874 - RNA, 17 nt, Bordetella pertussis
cugcaguucggccgcca

SEQ ID NO: 398875 - RNA, 15 nt, Bordetella pertussis
cugccaccagcgcgc

SEQ ID NO: 398876 - RNA, 14 nt, Bordetella pertussis
cugccacuccuggu

SEQ ID NO: 398877 - RNA, 22 nt, Bordetella pertussis
cugccagacggccagcgcgcgu

SEQ ID NO: 398878 - RNA, 15 nt, Bordetella pertussis
cugccaggcgcccca

SEQ ID NO: 398879 - RNA, 16 nt, Bordetella pertussis
cugccaguaggcgccc

SEQ ID NO: 398880 - RNA, 18 nt, Bordetella pertussis
cugccaguaggcgcccca

SEQ ID NO: 398881 - RNA, 21 nt, Bordetella pertussis
cugccaguaggcgccccaggc

SEQ ID NO: 398882 - RNA, 20 nt, Bordetella pertussis
cugccagugguccaucaggu

SEQ ID NO: 398883 - RNA, 14 nt, Bordetella pertussis
cugccaguugccgc

SEQ ID NO: 398884 - RNA, 23 nt, Bordetella pertussis
cugccaguugccgccgccggcgc

SEQ ID NO: 398885 - RNA, 18 nt, Bordetella pertussis
cugccauccucgucgcgg

SEQ ID NO: 398886 - RNA, 14 nt, Bordetella pertussis
cugcccagccacac

SEQ ID NO: 398887 - RNA, 12 nt, Bordetella pertussis
cugcccaggaug

SEQ ID NO: 398888 - RNA, 17 nt, Bordetella pertussis
cugcccaggauggagag

SEQ ID NO: 398889 - RNA, 13 nt, Bordetella pertussis
cugcccauggccu

SEQ ID NO: 398890 - RNA, 15 nt, Bordetella pertussis
cugccccauggcaug

SEQ ID NO: 398891 - RNA, 14 nt, Bordetella pertussis
cugcccgccugguc

SEQ ID NO: 398892 - RNA, 15 nt, Bordetella pertussis
cugcccgccuggucg

SEQ ID NO: 398893 - RNA, 13 nt, Bordetella pertussis
cugcccgcgccgu

SEQ ID NO: 398894 - RNA, 17 nt, Bordetella pertussis
cugcccgggcagcaccg

SEQ ID NO: 398895 - RNA, 19 nt, Bordetella pertussis
cugcccgggcagcaccgcu

SEQ ID NO: 398896 - RNA, 22 nt, Bordetella pertussis
cugcccguacgucaaggccugc

SEQ ID NO: 398897 - RNA, 17 nt, Bordetella pertussis
cugccgaaacgcuggcg

SEQ ID NO: 398898 - RNA, 14 nt, Bordetella pertussis
cugccgaccagcac

SEQ ID NO: 398899 - RNA, 15 nt, Bordetella pertussis
cugccgaccagcacg

SEQ ID NO: 398900 - RNA, 16 nt, Bordetella pertussis
cugccgagacggccgc

SEQ ID NO: 398901 - RNA, 17 nt, Bordetella pertussis
cugccgagacggccgcc

SEQ ID NO: 398902 - RNA, 19 nt, Bordetella pertussis
cugccgaucaagagccugg

SEQ ID NO: 398903 - RNA, 16 nt, Bordetella pertussis
cugccgauacgggcgc

SEQ ID NO: 398904 - RNA, 17 nt, Bordetella pertussis
cugccgcugaccggcgg

SEQ ID NO: 398905 - RNA, 22 nt, Bordetella pertussis
cugccgcugaucuuccugggcg

SEQ ID NO: 398906 - RNA, 17 nt, Bordetella pertussis
cugccgcugcaggcccu

SEQ ID NO: 398907 - RNA, 16 nt, Bordetella pertussis
cugccgcugcccaccu

SEQ ID NO: 398908 - RNA, 13 nt, Bordetella pertussis
cugccggaccugg

SEQ ID NO: 398909 - RNA, 16 nt, Bordetella pertussis
cugccggaccugggca

SEQ ID NO: 398910 - RNA, 21 nt, Bordetella pertussis
cugccggauuggcgcugcaca

SEQ ID NO: 398911 - RNA, 14 nt, Bordetella pertussis
cugccggccuggcu

SEQ ID NO: 398912 - RNA, 14 nt, Bordetella pertussis
cugccggcgcgccu

SEQ ID NO: 398913 - RNA, 16 nt, Bordetella pertussis
cugccggcgcgggcgc

SEQ ID NO: 398914 - RNA, 17 nt, Bordetella pertussis
cugccggcgcgggcgca

SEQ ID NO: 398915 - RNA, 19 nt, Bordetella pertussis
cugccggcguccugcggcg

SEQ ID NO: 398916 - RNA, 21 nt, Bordetella pertussis
cugccgguaaccgacgcagcg

SEQ ID NO: 398917 - RNA, 18 nt, Bordetella pertussis
cugccguagcccaggucc

SEQ ID NO: 398918 - RNA, 19 nt, Bordetella pertussis
cugccguagcccaggucca

SEQ ID NO: 398919 - RNA, 21 nt, Bordetella pertussis
cugccguagcccagguccagc

SEQ ID NO: 398920 - RNA, 17 nt, Bordetella pertussis
cugccguccuugugcca

SEQ ID NO: 398921 - RNA, 15 nt, Bordetella pertussis
cugccgugggacagg

SEQ ID NO: 398922 - RNA, 19 nt, Bordetella pertussis
cugccgugggacaggcacc

SEQ ID NO: 398923 - RNA, 19 nt, Bordetella pertussis
cugccgugggacaggcacu

SEQ ID NO: 398924 - RNA, 22 nt, Bordetella pertussis
cugccguucgcgcugcccaccg

SEQ ID NO: 398925 - RNA, 15 nt, Bordetella pertussis
cugccugaaaccgca

SEQ ID NO: 398926 - RNA, 21 nt, Bordetella pertussis
cugccugaaaccgcaggcaag

SEQ ID NO: 398927 - RNA, 18 nt, Bordetella pertussis
cugccugcagcgcgcgcg

SEQ ID NO: 398928 - RNA, 15 nt, Bordetella pertussis
cugccugccggccgg

SEQ ID NO: 398929 - RNA, 19 nt, Bordetella pertussis
cugccugccggccggccag

SEQ ID NO: 398930 - RNA, 13 nt, Bordetella pertussis
cugcgcagcagcg

SEQ ID NO: 398931 - RNA, 17 nt, Bordetella pertussis
cugcgcaggcgccgcag

SEQ ID NO: 398932 - RNA, 17 nt, Bordetella pertussis
cugcgcaugcgccuguc

SEQ ID NO: 398933 - RNA, 23 nt, Bordetella pertussis
cugcgcaugggcgcaggccgcca

SEQ ID NO: 398934 - RNA, 18 nt, Bordetella pertussis
cugcgccauggcgcgcag

SEQ ID NO: 398935 - RNA, 21 nt, Bordetella pertussis
cugcgcccgcuacgcgggcuu

SEQ ID NO: 398936 - RNA, 23 nt, Bordetella pertussis
cugcgccgaggcgggcagcaugg

SEQ ID NO: 398937 - RNA, 13 nt, Bordetella pertussis
cugcgccuggccg

SEQ ID NO: 398938 - RNA, 21 nt, Bordetella pertussis
cugcgcgaaacccccugggug

SEQ ID NO: 398939 - RNA, 14 nt, Bordetella pertussis
cugcgcgagguggg

SEQ ID NO: 398940 - RNA, 17 nt, Bordetella pertussis
cugcgcgaugcgcgcgc

SEQ ID NO: 398941 - RNA, 17 nt, Bordetella pertussis
cugcgcgaugcgcgcgu

SEQ ID NO: 398942 - RNA, 22 nt, Bordetella pertussis
cugcgcgaugcgcgcgugcagc

SEQ ID NO: 398943 - RNA, 17 nt, Bordetella pertussis
cugcgcgaugagcuggc

SEQ ID NO: 398944 - RNA, 23 nt, Bordetella pertussis
cugcgcgccgccgcgcugugcga

SEQ ID NO: 398945 - RNA, 14 nt, Bordetella pertussis
cugcgcgccgccuc

SEQ ID NO: 398946 - RNA, 17 nt, Bordetella pertussis
cugcgcgccgccucgau

SEQ ID NO: 398947 - RNA, 19 nt, Bordetella pertussis
cugcgcgccuggcacgacg

SEQ ID NO: 398948 - RNA, 15 nt, Bordetella pertussis
cugcgcgcggccugg

SEQ ID NO: 398949 - RNA, 23 nt, Bordetella pertussis
cugcgcggccgagcgggccagcg

SEQ ID NO: 398950 - RNA, 22 nt, Bordetella pertussis
cugcgcggccucguaggccauc

SEQ ID NO: 398951 - RNA, 18 nt, Bordetella pertussis
cugcgcguccuggcgcga

SEQ ID NO: 398952 - RNA, 17 nt, Bordetella pertussis
cugcgcgugcacgaccu

SEQ ID NO: 398953 - RNA, 23 nt, Bordetella pertussis
cugcgcgugcacgaccugccacu

SEQ ID NO: 398954 - RNA, 15 nt, Bordetella pertussis
cugcggacggcgggc

SEQ ID NO: 398955 - RNA, 17 nt, Bordetella pertussis
cugcggacggcgggcgc

SEQ ID NO: 398956 - RNA, 23 nt, Bordetella pertussis
cugcggacggcgggcgccccgau

SEQ ID NO: 398957 - RNA, 16 nt, Bordetella pertussis
cugcgggccggcgccg

SEQ ID NO: 398958 - RNA, 22 nt, Bordetella pertussis
cugcgggcgcagcgccgcuucc

SEQ ID NO: 398959 - RNA, 17 nt, Bordetella pertussis
cugcggggacaggcacc

SEQ ID NO: 398960 - RNA, 18 nt, Bordetella pertussis
cugcggggacaggcaccc

SEQ ID NO: 398961 - RNA, 13 nt, Bordetella pertussis
cugcgggggcagg

SEQ ID NO: 398962 - RNA, 18 nt, Bordetella pertussis
cugcgggggcaggcacgc

SEQ ID NO: 398963 - RNA, 22 nt, Bordetella pertussis
cugcgggucgaguugcgcgcca

SEQ ID NO: 398964 - RNA, 15 nt, Bordetella pertussis
cugcgggugcgccug

SEQ ID NO: 398965 - RNA, 14 nt, Bordetella pertussis
cugcguaggcaggg

SEQ ID NO: 398966 - RNA, 17 nt, Bordetella pertussis
cugcgugccggagcccg

SEQ ID NO: 398967 - RNA, 14 nt, Bordetella pertussis
cugcgugcgcggcg

SEQ ID NO: 398968 - RNA, 17 nt, Bordetella pertussis
cugcguggcgacgcgcu

SEQ ID NO: 398969 - RNA, 16 nt, Bordetella pertussis
cugcguggcgggccgc

SEQ ID NO: 398970 - RNA, 17 nt, Bordetella pertussis
cugcgugguauuggugg

SEQ ID NO: 398971 - RNA, 16 nt, Bordetella pertussis
cugcguuuucuggccu

SEQ ID NO: 398972 - RNA, 15 nt, Bordetella pertussis
cugcuacaccgugcu

SEQ ID NO: 398973 - RNA, 13 nt, Bordetella pertussis
cugcuugaagacg

SEQ ID NO: 398974 - RNA, 19 nt, Bordetella pertussis
cugcuugaagacgcccagg

SEQ ID NO: 398975 - RNA, 20 nt, Bordetella pertussis
cugcuugaagacgcccaggu

SEQ ID NO: 398976 - RNA, 17 nt, Bordetella pertussis
cuggaacaccaugcccg

SEQ ID NO: 398977 - RNA, 20 nt, Bordetella pertussis
cuggaacuugggaucggcca

SEQ ID NO: 398978 - RNA, 18 nt, Bordetella pertussis
cuggaagacguggcccgc

SEQ ID NO: 398979 - RNA, 14 nt, Bordetella pertussis
cuggaagcgcgcca

SEQ ID NO: 398980 - RNA, 19 nt, Bordetella pertussis
cuggaagcgcgccaggcgc

SEQ ID NO: 398981 - RNA, 13 nt, Bordetella pertussis
cuggaaugucacc

SEQ ID NO: 398982 - RNA, 16 nt, Bordetella pertussis
cuggacccgcucgacc

SEQ ID NO: 398983 - RNA, 16 nt, Bordetella pertussis
cuggaccgcgccuggg

SEQ ID NO: 398984 - RNA, 14 nt, Bordetella pertussis
cuggaccgcgcgcg

SEQ ID NO: 398985 - RNA, 23 nt, Bordetella pertussis
cuggaccugagccaggcgcccgg

SEQ ID NO: 398986 - RNA, 15 nt, Bordetella pertussis
cuggaccuggacgag

SEQ ID NO: 398987 - RNA, 21 nt, Bordetella pertussis
cuggacgcgccgaacaccagc

SEQ ID NO: 398988 - RNA, 16 nt, Bordetella pertussis
cuggacgcgcgcggcg

SEQ ID NO: 398989 - RNA, 15 nt, Bordetella pertussis
cuggacgcgcuggcc

SEQ ID NO: 398990 - RNA, 15 nt, Bordetella pertussis
cuggacgcccuggcg

SEQ ID NO: 398991 - RNA, 21 nt, Bordetella pertussis
cuggacgcuuucggggcgcaa

SEQ ID NO: 398992 - RNA, 16 nt, Bordetella pertussis
cuggacgggcuggaga

SEQ ID NO: 398993 - RNA, 18 nt, Bordetella pertussis
cuggacguaguugguggc

SEQ ID NO: 398994 - RNA, 20 nt, Bordetella pertussis
cuggacuauggccuggaugu

SEQ ID NO: 398995 - RNA, 14 nt, Bordetella pertussis
cuggacuugcggca

SEQ ID NO: 398996 - RNA, 23 nt, Bordetella pertussis
cuggagaacgagccggccgcgcc

SEQ ID NO: 398997 - RNA, 18 nt, Bordetella pertussis
cuggagaagcgccgcgcc

SEQ ID NO: 398998 - RNA, 21 nt, Bordetella pertussis
cuggagacuggcaccggccaa

SEQ ID NO: 398999 - RNA, 18 nt, Bordetella pertussis
cuggagaucgccgagcgg

SEQ ID NO: 399000 - RNA, 22 nt, Bordetella pertussis
cuggagauggguacagcgcgcc

SEQ ID NO: 399001 - RNA, 23 nt, Bordetella pertussis
cuggagauggguacagcgcgccc

SEQ ID NO: 399002 - RNA, 16 nt, Bordetella pertussis
cuggagcucggguggg

SEQ ID NO: 399003 - RNA, 15 nt, Bordetella pertussis
cuggagcucuauguc

SEQ ID NO: 399004 - RNA, 21 nt, Bordetella pertussis
cuggagcucuaugucgccggc

SEQ ID NO: 399005 - RNA, 20 nt, Bordetella pertussis
cuggagcuuggccggugcca

SEQ ID NO: 399006 - RNA, 20 nt, Bordetella pertussis
cuggcaaugcguggccggcg

SEQ ID NO: 399007 - RNA, 21 nt, Bordetella pertussis
cuggcaaugcguggccggcgg

SEQ ID NO: 399008 - RNA, 13 nt, Bordetella pertussis
cuggcacccgcaa

SEQ ID NO: 399009 - RNA, 22 nt, Bordetella pertussis
cuggcaccggccaagcuccagg

SEQ ID NO: 399010 - RNA, 18 nt, Bordetella pertussis
cuggcaccggccgacccg

SEQ ID NO: 399011 - RNA, 16 nt, Bordetella pertussis
cuggcagugcgccugg

SEQ ID NO: 399012 - RNA, 15 nt, Bordetella pertussis
cuggcaucagggcga

SEQ ID NO: 399013 - RNA, 15 nt, Bordetella pertussis
cuggccaaugccuau

SEQ ID NO: 399014 - RNA, 22 nt, Bordetella pertussis
cuggccaaugccuauuggcugu

SEQ ID NO: 399015 - RNA, 23 nt, Bordetella pertussis
cuggcccacucggugcgcgcgcc

SEQ ID NO: 399016 - RNA, 22 nt, Bordetella pertussis
cuggcccagaccaagcgccaca

SEQ ID NO: 399017 - RNA, 19 nt, Bordetella pertussis
cuggcccagaucugccgca

SEQ ID NO: 399018 - RNA, 10 nt, Bordetella pertussis
cuggcccagc

SEQ ID NO: 399019 - RNA, 15 nt, Bordetella pertussis
cuggcccagcuccag

SEQ ID NO: 399020 - RNA, 17 nt, Bordetella pertussis
cuggcccagcuccagcu

SEQ ID NO: 399021 - RNA, 17 nt, Bordetella pertussis
cuggcccagcugggcgg

SEQ ID NO: 399022 - RNA, 19 nt, Bordetella pertussis
cuggcccagcugggcggcg

SEQ ID NO: 399023 - RNA, 23 nt, Bordetella pertussis
cuggcccaggccgaaccacagca

SEQ ID NO: 399024 - RNA, 15 nt, Bordetella pertussis
cuggcccaggcgggc

SEQ ID NO: 399025 - RNA, 23 nt, Bordetella pertussis
cuggcccaguucgcgcagcagcu

SEQ ID NO: 399026 - RNA, 18 nt, Bordetella pertussis
cuggcccaugaacaggca

SEQ ID NO: 399027 - RNA, 20 nt, Bordetella pertussis
cuggcccaugaacaggcacg

SEQ ID NO: 399028 - RNA, 23 nt, Bordetella pertussis
cuggcccgaacggcccauccauc

SEQ ID NO: 399029 - RNA, 18 nt, Bordetella pertussis
cuggcccgcgcgagcggc

SEQ ID NO: 399030 - RNA, 17 nt, Bordetella pertussis
cuggcccgucaugggcg

SEQ ID NO: 399031 - RNA, 21 nt, Bordetella pertussis
cuggcccgucaugggcggggc

SEQ ID NO: 399032 - RNA, 23 nt, Bordetella pertussis
cuggcccgucaugggcggggcca

SEQ ID NO: 399033 - RNA, 16 nt, Bordetella pertussis
cuggccugcgccgccg

SEQ ID NO: 399034 - RNA, 18 nt, Bordetella pertussis
cuggccugcgccgccgcg

SEQ ID NO: 399035 - RNA, 13 nt, Bordetella pertussis
cuggccugccgcg

SEQ ID NO: 399036 - RNA, 15 nt, Bordetella pertussis
cuggccugccgcgcc

SEQ ID NO: 399037 - RNA, 14 nt, Bordetella pertussis
cuggccuggccgcc

SEQ ID NO: 399038 - RNA, 16 nt, Bordetella pertussis
cuggccuggccgccgg

SEQ ID NO: 399039 - RNA, 12 nt, Bordetella pertussis
cuggccuuccug

SEQ ID NO: 399040 - RNA, 15 nt, Bordetella pertussis
cuggccuuccugcug

SEQ ID NO: 399041 - RNA, 17 nt, Bordetella pertussis
cuggccuuccugcugac

SEQ ID NO: 399042 - RNA, 18 nt, Bordetella pertussis
cuggccuuccugcugaca

SEQ ID NO: 399043 - RNA, 20 nt, Bordetella pertussis
cuggcgagcacccgcaggcg

SEQ ID NO: 399044 - RNA, 16 nt, Bordetella pertussis
cuggcgaucacggcca

SEQ ID NO: 399045 - RNA, 17 nt, Bordetella pertussis
cuggcgaucaggccgcc

SEQ ID NO: 399046 - RNA, 19 nt, Bordetella pertussis
cuggcgaucaggccgcccc

SEQ ID NO: 399047 - RNA, 17 nt, Bordetella pertussis
cuggcgaugcccaccag

SEQ ID NO: 399048 - RNA, 19 nt, Bordetella pertussis
cuggcgaugcccaccagcc

SEQ ID NO: 399049 - RNA, 16 nt, Bordetella pertussis
cuggcgaugcgggcca

SEQ ID NO: 399050 - RNA, 19 nt, Bordetella pertussis
cuggcgaugcgggccacgc

SEQ ID NO: 399051 - RNA, 20 nt, Bordetella pertussis
cuggcgaugcgggccacgcc

SEQ ID NO: 399052 - RNA, 21 nt, Bordetella pertussis
cuggcgcaaggacgcguccuc

SEQ ID NO: 399053 - RNA, 13 nt, Bordetella pertussis
cuggcgcaaggcg

SEQ ID NO: 399054 - RNA, 19 nt, Bordetella pertussis
cuggcgcaaggcgucgggc

SEQ ID NO: 399055 - RNA, 17 nt, Bordetella pertussis
cuggcgcgcaucggcgc

SEQ ID NO: 399056 - RNA, 22 nt, Bordetella pertussis
cuggcgcgccaggaagcgcgcc

SEQ ID NO: 399057 - RNA, 18 nt, Bordetella pertussis
cuggcgcgccaggcgaug

SEQ ID NO: 399058 - RNA, 20 nt, Bordetella pertussis
cuggcgcgagaaccaggcca

SEQ ID NO: 399059 - RNA, 18 nt, Bordetella pertussis
cuggcgcgagaccacgau

SEQ ID NO: 399060 - RNA, 16 nt, Bordetella pertussis
cuggcgcgcgaccagg

SEQ ID NO: 399061 - RNA, 19 nt, Bordetella pertussis
cuggcgcgcgaccaggcug

SEQ ID NO: 399062 - RNA, 19 nt, Bordetella pertussis
cuggcgcgcggccugggcg

SEQ ID NO: 399063 - RNA, 16 nt, Bordetella pertussis
cuggcgcgcggcuggc

SEQ ID NO: 399064 - RNA, 22 nt, Bordetella pertussis
cuggcgcgcguugaccgccucg

SEQ ID NO: 399065 - RNA, 11 nt, Bordetella pertussis
cuggcgcggcg

SEQ ID NO: 399066 - RNA, 23 nt, Bordetella pertussis
cuggcgcggcgccugcgcgcgcu

SEQ ID NO: 399067 - RNA, 21 nt, Bordetella pertussis
cuggcgcggcggccaggcgua

SEQ ID NO: 399068 - RNA, 11 nt, Bordetella pertussis
cuggcgcggcu

SEQ ID NO: 399069 - RNA, 15 nt, Bordetella pertussis
cuggcgcgggcggcc

SEQ ID NO: 399070 - RNA, 18 nt, Bordetella pertussis
cuggcgcgucggcgcgcg

SEQ ID NO: 399071 - RNA, 15 nt, Bordetella pertussis
cuggcgcgucuggag

SEQ ID NO: 399072 - RNA, 18 nt, Bordetella pertussis
cuggcgcugcagcgucug

SEQ ID NO: 399073 - RNA, 18 nt, Bordetella pertussis
cuggcgcugccgaccagc

SEQ ID NO: 399074 - RNA, 15 nt, Bordetella pertussis
cuggcgcuggccgcc

SEQ ID NO: 399075 - RNA, 19 nt, Bordetella pertussis
cuggcgcuccucgcgcgcg

SEQ ID NO: 399076 - RNA, 21 nt, Bordetella pertussis
cuggcgcuguuucccuuccug

SEQ ID NO: 399077 - RNA, 21 nt, Bordetella pertussis
cuggcgcuguuuccgggccug

SEQ ID NO: 399078 - RNA, 20 nt, Bordetella pertussis
cuggcgcuuggccagcuggc

SEQ ID NO: 399079 - RNA, 21 nt, Bordetella pertussis
cuggcggaucucggccagcag

SEQ ID NO: 399080 - RNA, 18 nt, Bordetella pertussis
cuggcggcagcucgcgcu

SEQ ID NO: 399081 - RNA, 15 nt, Bordetella pertussis
cuggcggcgcagcac

SEQ ID NO: 399082 - RNA, 16 nt, Bordetella pertussis
cuggcggcgcagcacc

SEQ ID NO: 399083 - RNA, 16 nt, Bordetella pertussis
cuggcggcgcgcggcu

SEQ ID NO: 399084 - RNA, 19 nt, Bordetella pertussis
cuggcggcgcgcggcuggg

SEQ ID NO: 399085 - RNA, 13 nt, Bordetella pertussis
cuggcggcgcgcu

SEQ ID NO: 399086 - RNA, 18 nt, Bordetella pertussis
cuggcggcugcgggcgca

SEQ ID NO: 399087 - RNA, 15 nt, Bordetella pertussis
cuggcggcuggucaa

SEQ ID NO: 399088 - RNA, 20 nt, Bordetella pertussis
cuggcggcugucgggcggcg

SEQ ID NO: 399089 - RNA, 21 nt, Bordetella pertussis
cuggcgguuguugcccaccgc

SEQ ID NO: 399090 - RNA, 16 nt, Bordetella pertussis
cuggcguacgcugcug

SEQ ID NO: 399091 - RNA, 15 nt, Bordetella pertussis
cuggcguaugcccac

SEQ ID NO: 399092 - RNA, 13 nt, Bordetella pertussis
cuggcguccaggu

SEQ ID NO: 399093 - RNA, 19 nt, Bordetella pertussis
cugggccucggccagcugg

SEQ ID NO: 399094 - RNA, 21 nt, Bordetella pertussis
cugggccucggccagcugggc

SEQ ID NO: 399095 - RNA, 23 nt, Bordetella pertussis
cugggccucggccagcugggcca

SEQ ID NO: 399096 - RNA, 19 nt, Bordetella pertussis
cugggccuguacuggaugu

SEQ ID NO: 399097 - RNA, 16 nt, Bordetella pertussis
cugggccuucuugucg

SEQ ID NO: 399098 - RNA, 22 nt, Bordetella pertussis
cugggccuucuugucgcuggag

SEQ ID NO: 399099 - RNA, 17 nt, Bordetella pertussis
cugggcgaaacggccag

SEQ ID NO: 399100 - RNA, 20 nt, Bordetella pertussis
cugggcgaaacggccagcgu

SEQ ID NO: 399101 - RNA, 13 nt, Bordetella pertussis
cugggcgccggcg

SEQ ID NO: 399102 - RNA, 14 nt, Bordetella pertussis
cugggcuugccggu

SEQ ID NO: 399103 - RNA, 22 nt, Bordetella pertussis
cugggcuugccggugcucggcc

SEQ ID NO: 399104 - RNA, 14 nt, Bordetella pertussis
cuggggacgggcgc

SEQ ID NO: 399105 - RNA, 12 nt, Bordetella pertussis
cuggggcaggcg

SEQ ID NO: 399106 - RNA, 16 nt, Bordetella pertussis
cuggggcaggcggcuu

SEQ ID NO: 399107 - RNA, 20 nt, Bordetella pertussis
cuggggcaggcggcuuucau

SEQ ID NO: 399108 - RNA, 15 nt, Bordetella pertussis
cuggggccgcgcgcc

SEQ ID NO: 399109 - RNA, 23 nt, Bordetella pertussis
cuggggccgcggcgcgcgcggcg

SEQ ID NO: 399110 - RNA, 13 nt, Bordetella pertussis
cuggggcgcgguc

SEQ ID NO: 399111 - RNA, 17 nt, Bordetella pertussis
cuggggcgggcgggcgc

SEQ ID NO: 399112 - RNA, 18 nt, Bordetella pertussis
cugggucaucagcacgau

SEQ ID NO: 399113 - RNA, 22 nt, Bordetella pertussis
cugggugaagccaagcagggca

SEQ ID NO: 399114 - RNA, 23 nt, Bordetella pertussis
cugggugacgcuggagcgcggcg

SEQ ID NO: 399115 - RNA, 17 nt, Bordetella pertussis
cugggugcuggccaacg

SEQ ID NO: 399116 - RNA, 14 nt, Bordetella pertussis
cuggguggccagcg

SEQ ID NO: 399117 - RNA, 16 nt, Bordetella pertussis
cuggguggcggggcgc

SEQ ID NO: 399118 - RNA, 19 nt, Bordetella pertussis
cugguaagaaaccuggccc

SEQ ID NO: 399119 - RNA, 18 nt, Bordetella pertussis
cugguagaucagcgcguc

SEQ ID NO: 399120 - RNA, 23 nt, Bordetella pertussis
cugguagaucagcgcgucggcgc

SEQ ID NO: 399121 - RNA, 20 nt, Bordetella pertussis
cugguaguaaucgcgcgcca

SEQ ID NO: 399122 - RNA, 21 nt, Bordetella pertussis
cugguaguagagcgaauccau

SEQ ID NO: 399123 - RNA, 17 nt, Bordetella pertussis
cugguaguaggccacug

SEQ ID NO: 399124 - RNA, 20 nt, Bordetella pertussis
cugguagugcaggccgcgca

SEQ ID NO: 399125 - RNA, 15 nt, Bordetella pertussis
cugguaguuggccag

SEQ ID NO: 399126 - RNA, 18 nt, Bordetella pertussis
cuggucaacucgcccgau

SEQ ID NO: 399127 - RNA, 14 nt, Bordetella pertussis
cuggucagccuggg

SEQ ID NO: 399128 - RNA, 15 nt, Bordetella pertussis
cuggucagccugggc

SEQ ID NO: 399129 - RNA, 17 nt, Bordetella pertussis
cuggucagccugggcgc

SEQ ID NO: 399130 - RNA, 20 nt, Bordetella pertussis
cuggucagccugggcgccug

SEQ ID NO: 399131 - RNA, 16 nt, Bordetella pertussis
cuggucagccuggggc

SEQ ID NO: 399132 - RNA, 17 nt, Bordetella pertussis
cuggucagccuggggca

SEQ ID NO: 399133 - RNA, 13 nt, Bordetella pertussis
cuggucagcgccg

SEQ ID NO: 399134 - RNA, 18 nt, Bordetella pertussis
cuggucagcgccgacgau

SEQ ID NO: 399135 - RNA, 15 nt, Bordetella pertussis
cuggucacguccagu

SEQ ID NO: 399136 - RNA, 20 nt, Bordetella pertussis
cuggucaucuacagcgccug

SEQ ID NO: 399137 - RNA, 14 nt, Bordetella pertussis
cugguccagcagcg

SEQ ID NO: 399138 - RNA, 17 nt, Bordetella pertussis
cugguccgccgccgcgu

SEQ ID NO: 399139 - RNA, 13 nt, Bordetella pertussis
cugguccugggcc

SEQ ID NO: 399140 - RNA, 22 nt, Bordetella pertussis
cuggucgaacgcuuccugggcc

SEQ ID NO: 399141 - RNA, 16 nt, Bordetella pertussis
cuggucgaccaggccg

SEQ ID NO: 399142 - RNA, 16 nt, Bordetella pertussis
cuggucgagcgggcgc

SEQ ID NO: 399143 - RNA, 19 nt, Bordetella pertussis
cuggucgccaucugcugcg

SEQ ID NO: 399144 - RNA, 14 nt, Bordetella pertussis
cuggucgcgggcca

SEQ ID NO: 399145 - RNA, 13 nt, Bordetella pertussis
cuggucgcuggcg

SEQ ID NO: 399146 - RNA, 16 nt, Bordetella pertussis
cuggucgggaugcccc

SEQ ID NO: 399147 - RNA, 23 nt, Bordetella pertussis
cuggucguaucgccgcugaugcu

SEQ ID NO: 399148 - RNA, 22 nt, Bordetella pertussis
cuggucgucgcggcccugggcc

SEQ ID NO: 399149 - RNA, 19 nt, Bordetella pertussis
cuggugaagucggcccugu

SEQ ID NO: 399150 - RNA, 19 nt, Bordetella pertussis
cuggugaucgcgcgggcug

SEQ ID NO: 399151 - RNA, 18 nt, Bordetella pertussis
cuggugauguccugcagg

SEQ ID NO: 399152 - RNA, 18 nt, Bordetella pertussis
cuggugcaccacgcgcuc

SEQ ID NO: 399153 - RNA, 23 nt, Bordetella pertussis
cuggugcacgaugcccagggccg

SEQ ID NO: 399154 - RNA, 15 nt, Bordetella pertussis
cuggugcagcggcuc

SEQ ID NO: 399155 - RNA, 20 nt, Bordetella pertussis
cuggugccaguccccgcaug

SEQ ID NO: 399156 - RNA, 20 nt, Bordetella pertussis
cuggugcccguagcagaugc

SEQ ID NO: 399157 - RNA, 15 nt, Bordetella pertussis
cuggugccgacggcg

SEQ ID NO: 399158 - RNA, 13 nt, Bordetella pertussis
cuguaccagcaug

SEQ ID NO: 399159 - RNA, 13 nt, Bordetella pertussis
cuguaccuggcga

SEQ ID NO: 399160 - RNA, 19 nt, Bordetella pertussis
cuguacggccggcuccgcu

SEQ ID NO: 399161 - RNA, 13 nt, Bordetella pertussis
cuguauuccugac

SEQ ID NO: 399162 - RNA, 16 nt, Bordetella pertussis
cugucaauagguugua

SEQ ID NO: 399163 - RNA, 17 nt, Bordetella pertussis
cugucauacgccaugaa

SEQ ID NO: 399164 - RNA, 18 nt, Bordetella pertussis
cugucauacgccaugaac

SEQ ID NO: 399165 - RNA, 16 nt, Bordetella pertussis
cuguccccgcacgggg

SEQ ID NO: 399166 - RNA, 17 nt, Bordetella pertussis
cuguccccgcacgggga

SEQ ID NO: 399167 - RNA, 17 nt, Bordetella pertussis
cuguccccgcagggaca

SEQ ID NO: 399168 - RNA, 20 nt, Bordetella pertussis
cuguccccgcagggacaggc

SEQ ID NO: 399169 - RNA, 15 nt, Bordetella pertussis
cuguccccgcggagg

SEQ ID NO: 399170 - RNA, 14 nt, Bordetella pertussis
cuguccccgcgggg

SEQ ID NO: 399171 - RNA, 15 nt, Bordetella pertussis
cuguccccgcgggga

SEQ ID NO: 399172 - RNA, 17 nt, Bordetella pertussis
cuguccccgcggggaca

SEQ ID NO: 399173 - RNA, 20 nt, Bordetella pertussis
cuguccccgcggggacaggc

SEQ ID NO: 399174 - RNA, 22 nt, Bordetella pertussis
cuguccccgcggggacaggcac

SEQ ID NO: 399175 - RNA, 14 nt, Bordetella pertussis
cuguccccgcuggg

SEQ ID NO: 399176 - RNA, 20 nt, Bordetella pertussis
cuguccccgcugggacaggc

SEQ ID NO: 399177 - RNA, 23 nt, Bordetella pertussis
cuguccccgcugggacaggcaca

SEQ ID NO: 399178 - RNA, 23 nt, Bordetella pertussis
cuguccccgcugggacaggcacu

SEQ ID NO: 399179 - RNA, 20 nt, Bordetella pertussis
cuguccccgucgggacaggc

SEQ ID NO: 399180 - RNA, 17 nt, Bordetella pertussis
cuguccccguggggaca

SEQ ID NO: 399181 - RNA, 23 nt, Bordetella pertussis
cuguccccguggggacagauacc

SEQ ID NO: 399182 - RNA, 14 nt, Bordetella pertussis
cugucccgacgggg

SEQ ID NO: 399183 - RNA, 15 nt, Bordetella pertussis
cugucccgacgggga

SEQ ID NO: 399184 - RNA, 17 nt, Bordetella pertussis
cugucccgcacgcagcc

SEQ ID NO: 399185 - RNA, 14 nt, Bordetella pertussis
cuguccccacaggg

SEQ ID NO: 399186 - RNA, 17 nt, Bordetella pertussis
cuguccccacaggggga

SEQ ID NO: 399187 - RNA, 14 nt, Bordetella pertussis
cuguccccaccggg

SEQ ID NO: 399188 - RNA, 19 nt, Bordetella pertussis
cuguccccaccgggacagg

SEQ ID NO: 399189 - RNA, 23 nt, Bordetella pertussis
cuguccccaccgggacaggcacc

SEQ ID NO: 399190 - RNA, 14 nt, Bordetella pertussis
cuguccccacgggg

SEQ ID NO: 399191 - RNA, 17 nt, Bordetella pertussis
cuguccccacggggaca

SEQ ID NO: 399192 - RNA, 14 nt, Bordetella pertussis
cuguccccacgugg

SEQ ID NO: 399193 - RNA, 23 nt, Bordetella pertussis
cuguccccacguggacaggcacc

SEQ ID NO: 399194 - RNA, 15 nt, Bordetella pertussis
cuguccccacugggg

SEQ ID NO: 399195 - RNA, 23 nt, Bordetella pertussis
cuguccccacugggggacuggca

SEQ ID NO: 399196 - RNA, 22 nt, Bordetella pertussis
cugucccaaccgggacaggcac

SEQ ID NO: 399197 - RNA, 15 nt, Bordetella pertussis
cugucccggcgggga

SEQ ID NO: 399198 - RNA, 15 nt, Bordetella pertussis
cugucccugcgggga

SEQ ID NO: 399199 - RNA, 23 nt, Bordetella pertussis
cugucccugcgggggcaggcacg

SEQ ID NO: 399200 - RNA, 14 nt, Bordetella pertussis
cugucccagcgggg

SEQ ID NO: 399201 - RNA, 23 nt, Bordetella pertussis
cugucccagcggggacaggcacc

SEQ ID NO: 399202 - RNA, 17 nt, Bordetella pertussis
cuguccgaugcgcugcu

SEQ ID NO: 399203 - RNA, 14 nt, Bordetella pertussis
cugucgccacgggc

SEQ ID NO: 399204 - RNA, 23 nt, Bordetella pertussis
cugucggccgaaccgcgcagccg

SEQ ID NO: 399205 - RNA, 16 nt, Bordetella pertussis
cugucggcgcuggcca

SEQ ID NO: 399206 - RNA, 14 nt, Bordetella pertussis
cuguucgcgcggcc

SEQ ID NO: 399207 - RNA, 20 nt, Bordetella pertussis
cuguucgggcgcggugcgca

SEQ ID NO: 399208 - RNA, 11 nt, Bordetella pertussis
cuguugaggau

SEQ ID NO: 399209 - RNA, 13 nt, Bordetella pertussis
cuguugcccacca

SEQ ID NO: 399210 - RNA, 17 nt, Bordetella pertussis
cuguugcccaccagccg

SEQ ID NO: 399211 - RNA, 23 nt, Bordetella pertussis
cuguugcccaccagccgggcggc

SEQ ID NO: 399212 - RNA, 17 nt, Bordetella pertussis
cuguuucccuuccuggc

SEQ ID NO: 399213 - RNA, 19 nt, Bordetella pertussis
cuguuuccgggccuggccu

SEQ ID NO: 399214 - RNA, 21 nt, Bordetella pertussis
cuguuuuucauuugccgccug

SEQ ID NO: 399215 - RNA, 17 nt, Bordetella pertussis
cuuacgcggcgcgcgcc

SEQ ID NO: 399216 - RNA, 18 nt, Bordetella pertussis
cuuacgcgguccgcagcg

SEQ ID NO: 399217 - RNA, 13 nt, Bordetella pertussis
cuucacguagccg

SEQ ID NO: 399218 - RNA, 17 nt, Bordetella pertussis
cuucacguagccggcca

SEQ ID NO: 399219 - RNA, 17 nt, Bordetella pertussis
cuucagcaccagcuccu

SEQ ID NO: 399220 - RNA, 14 nt, Bordetella pertussis
cuucagccugggcc

SEQ ID NO: 399221 - RNA, 15 nt, Bordetella pertussis
cuucagccugggccu

SEQ ID NO: 399222 - RNA, 14 nt, Bordetella pertussis
cuucagcgggccgg

SEQ ID NO: 399223 - RNA, 17 nt, Bordetella pertussis
cuucagcgggccggcac

SEQ ID NO: 399224 - RNA, 23 nt, Bordetella pertussis
cuucaggaacauguccaccagcc

SEQ ID NO: 399225 - RNA, 16 nt, Bordetella pertussis
cuucaggcgcgcggca

SEQ ID NO: 399226 - RNA, 15 nt, Bordetella pertussis
cuucaggcgccgcag

SEQ ID NO: 399227 - RNA, 21 nt, Bordetella pertussis
cuucagguagguggacacgcc

SEQ ID NO: 399228 - RNA, 15 nt, Bordetella pertussis
cuucagguuccaggu

SEQ ID NO: 399229 - RNA, 15 nt, Bordetella pertussis
cuucaguuccaggcg

SEQ ID NO: 399230 - RNA, 18 nt, Bordetella pertussis
cuucaguugacgccggcg

SEQ ID NO: 399231 - RNA, 23 nt, Bordetella pertussis
cuucauggcgucguccagcuugg

SEQ ID NO: 399232 - RNA, 18 nt, Bordetella pertussis
cuuccaguucgcuuucca

SEQ ID NO: 399233 - RNA, 21 nt, Bordetella pertussis
cuuccaguucgcuuuccaggg

SEQ ID NO: 399234 - RNA, 19 nt, Bordetella pertussis
cuucccaggcgaggcuggc

SEQ ID NO: 399235 - RNA, 15 nt, Bordetella pertussis
cuuccgagauggccu

SEQ ID NO: 399236 - RNA, 17 nt, Bordetella pertussis
cuuccgcacgccgaccu

SEQ ID NO: 399237 - RNA, 17 nt, Bordetella pertussis
cuuccgccaccgcgccg

SEQ ID NO: 399238 - RNA, 18 nt, Bordetella pertussis
cuuccggcagcggccagc

SEQ ID NO: 399239 - RNA, 17 nt, Bordetella pertussis
cuuccgggcccgcgccg

SEQ ID NO: 399240 - RNA, 22 nt, Bordetella pertussis
cuuccucgacccgcgccucggc

SEQ ID NO: 399241 - RNA, 14 nt, Bordetella pertussis
cuuccucggcgcgc

SEQ ID NO: 399242 - RNA, 15 nt, Bordetella pertussis
cuuccugcaccucag

SEQ ID NO: 399243 - RNA, 15 nt, Bordetella pertussis
cuucgaucgccuggg

SEQ ID NO: 399244 - RNA, 21 nt, Bordetella pertussis
cuucgaucuucucgccgcgcg

SEQ ID NO: 399245 - RNA, 18 nt, Bordetella pertussis
cuucgaugaugagcgcgc

SEQ ID NO: 399246 - RNA, 20 nt, Bordetella pertussis
cuucgaugaugagcgcgccg

SEQ ID NO: 399247 - RNA, 23 nt, Bordetella pertussis
cuucgaugcuggcgcggaccugc

SEQ ID NO: 399248 - RNA, 13 nt, Bordetella pertussis
cuucgccuggccg

SEQ ID NO: 399249 - RNA, 18 nt, Bordetella pertussis
cuucgcgcacauccagcc

SEQ ID NO: 399250 - RNA, 20 nt, Bordetella pertussis
cuucgcgcacauccagccga

SEQ ID NO: 399251 - RNA, 22 nt, Bordetella pertussis
cuucgcggcuggucgccgucag

SEQ ID NO: 399252 - RNA, 21 nt, Bordetella pertussis
cuucgcgguacgcccagcugg

SEQ ID NO: 399253 - RNA, 20 nt, Bordetella pertussis
cuucucggugcgccgccgcc

SEQ ID NO: 399254 - RNA, 12 nt, Bordetella pertussis
cuucucuuucuc

SEQ ID NO: 399255 - RNA, 19 nt, Bordetella pertussis
cuucugccagacggccagc

SEQ ID NO: 399256 - RNA, 22 nt, Bordetella pertussis
cuucugcgcguucaugucgguc

SEQ ID NO: 399257 - RNA, 18 nt, Bordetella pertussis
cuucugguaguuggccag

SEQ ID NO: 399258 - RNA, 12 nt, Bordetella pertussis
cuucugggucag

SEQ ID NO: 399259 - RNA, 21 nt, Bordetella pertussis
cuucuucacguagccggccag

SEQ ID NO: 399260 - RNA, 14 nt, Bordetella pertussis
cuucuucagcuugg

SEQ ID NO: 399261 - RNA, 18 nt, Bordetella pertussis
cuucuucuuugcccuggc

SEQ ID NO: 399262 - RNA, 20 nt, Bordetella pertussis
cuucuugaacagcucggccc

SEQ ID NO: 399263 - RNA, 12 nt, Bordetella pertussis
cuugaaagaggc

SEQ ID NO: 399264 - RNA, 16 nt, Bordetella pertussis
cuugagcagccacugc

SEQ ID NO: 399265 - RNA, 13 nt, Bordetella pertussis
cuugagcgcggcc

SEQ ID NO: 399266 - RNA, 14 nt, Bordetella pertussis
cuugagcggcccgg

SEQ ID NO: 399267 - RNA, 14 nt, Bordetella pertussis
cuugaggccgcgcg

SEQ ID NO: 399268 - RNA, 17 nt, Bordetella pertussis
cuugaggccgcgcgccu

SEQ ID NO: 399269 - RNA, 15 nt, Bordetella pertussis
cuugagguaccacag

SEQ ID NO: 399270 - RNA, 12 nt, Bordetella pertussis
cuugaugcccag

SEQ ID NO: 399271 - RNA, 14 nt, Bordetella pertussis
cuugaugcccagcu

SEQ ID NO: 399272 - RNA, 14 nt, Bordetella pertussis
cuugcaggcgccag

SEQ ID NO: 399273 - RNA, 12 nt, Bordetella pertussis
cuugccggccca

SEQ ID NO: 399274 - RNA, 13 nt, Bordetella pertussis
cuugccggcccgg

SEQ ID NO: 399275 - RNA, 15 nt, Bordetella pertussis
cuugccggccuggcg

SEQ ID NO: 399276 - RNA, 18 nt, Bordetella pertussis
cuugccggccuggcgggc

SEQ ID NO: 399277 - RNA, 16 nt, Bordetella pertussis
cuugccggccuguucu

SEQ ID NO: 399278 - RNA, 21 nt, Bordetella pertussis
cuugccguaggguucgccgcu

SEQ ID NO: 399279 - RNA, 13 nt, Bordetella pertussis
cuugccguucagg

SEQ ID NO: 399280 - RNA, 20 nt, Bordetella pertussis
cuugccguucagguucauca

SEQ ID NO: 399281 - RNA, 13 nt, Bordetella pertussis
cuugccguugagc

SEQ ID NO: 399282 - RNA, 15 nt, Bordetella pertussis
cuugccguugagcac

SEQ ID NO: 399283 - RNA, 20 nt, Bordetella pertussis
cuugcgcgaaggccgccccc

SEQ ID NO: 399284 - RNA, 15 nt, Bordetella pertussis
cuugcgcgacagcag

SEQ ID NO: 399285 - RNA, 19 nt, Bordetella pertussis
cuugcgcgcccccacgccg

SEQ ID NO: 399286 - RNA, 21 nt, Bordetella pertussis
cuugcgcgcccccacgccgcu

SEQ ID NO: 399287 - RNA, 15 nt, Bordetella pertussis
cuugcgcgccugcug

SEQ ID NO: 399288 - RNA, 19 nt, Bordetella pertussis
cuugcgcuggcgcgcggcc

SEQ ID NO: 399289 - RNA, 22 nt, Bordetella pertussis
cuugcgcuuuuuucuccagcgc

SEQ ID NO: 399290 - RNA, 17 nt, Bordetella pertussis
cuugcgggccggcuggg

SEQ ID NO: 399291 - RNA, 18 nt, Bordetella pertussis
cuugcgggccggcugggc

SEQ ID NO: 399292 - RNA, 14 nt, Bordetella pertussis
cuugcguucaugcc

SEQ ID NO: 399293 - RNA, 22 nt, Bordetella pertussis
cuugcucagucgggcagcgccc

SEQ ID NO: 399294 - RNA, 18 nt, Bordetella pertussis
cuugcucgcccauggcau

SEQ ID NO: 399295 - RNA, 22 nt, Bordetella pertussis
cuugcugauuucgaucaugcgc

SEQ ID NO: 399296 - RNA, 14 nt, Bordetella pertussis
cuugucuucgauuu

SEQ ID NO: 399297 - RNA, 21 nt, Bordetella pertussis
cuuguugcucuugaccugggc

SEQ ID NO: 399298 - RNA, 15 nt, Bordetella pertussis
cuuguuggcgccggc

SEQ ID NO: 399299 - RNA, 18 nt, Bordetella pertussis
cuuguuuuccaucagcuc

SEQ ID NO: 399300 - RNA, 14 nt, Bordetella pertussis
cuuucaccgacagg

SEQ ID NO: 399301 - RNA, 17 nt, Bordetella pertussis
cuuucgaagccgcccca

SEQ ID NO: 399302 - RNA, 22 nt, Bordetella pertussis
cuuucgaccagcgacagcacgg

SEQ ID NO: 399303 - RNA, 20 nt, Bordetella pertussis
cuuucgaucacgaagcccag

SEQ ID NO: 399304 - RNA, 16 nt, Bordetella pertussis
cuuucgauuugcagca

SEQ ID NO: 399305 - RNA, 16 nt, Bordetella pertussis
cuuucgccgcgcgcuc

SEQ ID NO: 399306 - RNA, 11 nt, Bordetella pertussis
cuuucgccgga

SEQ ID NO: 399307 - RNA, 21 nt, Bordetella pertussis
cuuucgcgcgcgccugccccg

SEQ ID NO: 399308 - RNA, 22 nt, Bordetella pertussis
cuuucuugagcaacgugcgcac

SEQ ID NO: 399309 - RNA, 15 nt, Bordetella pertussis
cuuuuccacgcccgc

SEQ ID NO: 399310 - RNA, 19 nt, Bordetella pertussis
cuuuuccacgcccgccuuc

SEQ ID NO: 399311 - RNA, 16 nt, Bordetella pertussis
cuuuugcggcgcggcg

SEQ ID NO: 399312 - RNA, 19 nt, Bordetella pertussis
cuuuuuccuugcgggccua

SEQ ID NO: 399313 - RNA, 21 nt, Bordetella pertussis
cuuuuucgagccgcagaacag

SEQ ID NO: 399314 - RNA, 19 nt, Bordetella pertussis
cuuuuuucaucguuacagc

SEQ ID NO: 399315 - RNA, 16 nt, Bordetella pertussis
gaaaacagcaccagca

SEQ ID NO: 399316 - RNA, 16 nt, Bordetella pertussis
gaaaaccggcgccugg

SEQ ID NO: 399317 - RNA, 23 nt, Bordetella pertussis
gaaaagccggcggccggucaggg

SEQ ID NO: 399318 - RNA, 22 nt, Bordetella pertussis
gaaaaucggcgaucgccuguau

SEQ ID NO: 399319 - RNA, 21 nt, Bordetella pertussis
gaaaaugccgcggcaugcugg

SEQ ID NO: 399320 - RNA, 14 nt, Bordetella pertussis
gaaacacgaugccu

SEQ ID NO: 399321 - RNA, 12 nt, Bordetella pertussis
gaaacagcagcg

SEQ ID NO: 399322 - RNA, 13 nt, Bordetella pertussis
gaaacagcaucag

SEQ ID NO: 399323 - RNA, 15 nt, Bordetella pertussis
gaaacagcgaaagca

SEQ ID NO: 399324 - RNA, 22 nt, Bordetella pertussis
gaaacaggcgccgucgaagccg

SEQ ID NO: 399325 - RNA, 18 nt, Bordetella pertussis
gaaacauaagucugcgcc

SEQ ID NO: 399326 - RNA, 19 nt, Bordetella pertussis
gaaacccgcugggccagca

SEQ ID NO: 399327 - RNA, 21 nt, Bordetella pertussis
gaaacccuucgcgcagcaacc

SEQ ID NO: 399328 - RNA, 22 nt, Bordetella pertussis
gaaaccgaccugaucgcgcagc

SEQ ID NO: 399329 - RNA, 21 nt, Bordetella pertussis
gaaaccggugaucagcaggcc

SEQ ID NO: 399330 - RNA, 15 nt, Bordetella pertussis
gaaacgcgcagcacc

SEQ ID NO: 399331 - RNA, 22 nt, Bordetella pertussis
gaaacgcgcguccuuggcggcc

SEQ ID NO: 399332 - RNA, 14 nt, Bordetella pertussis
gaaacggccaagca

SEQ ID NO: 399333 - RNA, 21 nt, Bordetella pertussis
gaaacggcgggcgcgcaggcc

SEQ ID NO: 399334 - RNA, 15 nt, Bordetella pertussis
gaaagaagcccccgc

SEQ ID NO: 399335 - RNA, 19 nt, Bordetella pertussis
gaaagaagcccccgcgcug

SEQ ID NO: 399336 - RNA, 13 nt, Bordetella pertussis
gaaagaggccagg

SEQ ID NO: 399337 - RNA, 15 nt, Bordetella pertussis
gaaagaggccaggcc

SEQ ID NO: 399338 - RNA, 12 nt, Bordetella pertussis
gaaagcacgcca

SEQ ID NO: 399339 - RNA, 19 nt, Bordetella pertussis
gaaagcaucagcccuaccc

SEQ ID NO: 399340 - RNA, 13 nt, Bordetella pertussis
gaaagccagcgcc

SEQ ID NO: 399341 - RNA, 18 nt, Bordetella pertussis
gaaagcgcgucgagcagg

SEQ ID NO: 399342 - RNA, 19 nt, Bordetella pertussis
gaaagcgcgucgagcaggc

SEQ ID NO: 399343 - RNA, 20 nt, Bordetella pertussis
gaaagcgcgucgagcaggcc

SEQ ID NO: 399344 - RNA, 21 nt, Bordetella pertussis
gaaagcgcgucgagcaggccg

SEQ ID NO: 399345 - RNA, 21 nt, Bordetella pertussis
gaaagcggcgugugcccagca

SEQ ID NO: 399346 - RNA, 19 nt, Bordetella pertussis
gaaaguccgauguuacaga

SEQ ID NO: 399347 - RNA, 17 nt, Bordetella pertussis
gaaauauugggcugguc

SEQ ID NO: 399348 - RNA, 21 nt, Bordetella pertussis
gaaaucaggcgcaucgacagc

SEQ ID NO: 399349 - RNA, 20 nt, Bordetella pertussis
gaaauccguaguccagcagc

SEQ ID NO: 399350 - RNA, 22 nt, Bordetella pertussis
gaaauccguaguccagcagcag

SEQ ID NO: 399351 - RNA, 14 nt, Bordetella pertussis
gaaaucgugcuaga

SEQ ID NO: 399352 - RNA, 14 nt, Bordetella pertussis
gaaaugccggcggc

SEQ ID NO: 399353 - RNA, 14 nt, Bordetella pertussis
gaaaugccgcagca

SEQ ID NO: 399354 - RNA, 19 nt, Bordetella pertussis
gaaaugccgcgcgcagggc

SEQ ID NO: 399355 - RNA, 19 nt, Bordetella pertussis
gaaaugcgcguuggccuga

SEQ ID NO: 399356 - RNA, 23 nt, Bordetella pertussis
gaacaaaccgucgaugaccagcg

SEQ ID NO: 399357 - RNA, 23 nt, Bordetella pertussis
gaacaacacgaugaucgcgccga

SEQ ID NO: 399358 - RNA, 17 nt, Bordetella pertussis
gaacaagguccaggccc

SEQ ID NO: 399359 - RNA, 20 nt, Bordetella pertussis
gaacaccaccgagggccgga

SEQ ID NO: 399360 - RNA, 21 nt, Bordetella pertussis
gaacaccaggguggcgccggc

SEQ ID NO: 399361 - RNA, 22 nt, Bordetella pertussis
gaacaccaggguggcgccggcc

SEQ ID NO: 399362 - RNA, 17 nt, Bordetella pertussis
gaacaccccggucagca

SEQ ID NO: 399363 - RNA, 15 nt, Bordetella pertussis
gaacaccggcaggcc

SEQ ID NO: 399364 - RNA, 16 nt, Bordetella pertussis
gaacaccggcaggccg

SEQ ID NO: 399365 - RNA, 20 nt, Bordetella pertussis
gaacaccgugugaucgccga

SEQ ID NO: 399366 - RNA, 17 nt, Bordetella pertussis
gaacaccguuuccaagc

SEQ ID NO: 399367 - RNA, 14 nt, Bordetella pertussis
gaacacgacgaagg

SEQ ID NO: 399368 - RNA, 13 nt, Bordetella pertussis
gaacagccagggc

SEQ ID NO: 399369 - RNA, 18 nt, Bordetella pertussis
gaacagccagggcagggc

SEQ ID NO: 399370 - RNA, 14 nt, Bordetella pertussis
gaacagcgccaggc

SEQ ID NO: 399371 - RNA, 18 nt, Bordetella pertussis
gaacagcguccagccgcc

SEQ ID NO: 399372 - RNA, 19 nt, Bordetella pertussis
gaacagcguccagccgccc

SEQ ID NO: 399373 - RNA, 20 nt, Bordetella pertussis
gaacagcuugcuguccaguc

SEQ ID NO: 399374 - RNA, 16 nt, Bordetella pertussis
gaacaggcacaggaac

SEQ ID NO: 399375 - RNA, 14 nt, Bordetella pertussis
gaacaggcaguggu

SEQ ID NO: 399376 - RNA, 14 nt, Bordetella pertussis
gaacaggccgccgu

SEQ ID NO: 399377 - RNA, 21 nt, Bordetella pertussis
gaacaggcggcugaagaagcc

SEQ ID NO: 399378 - RNA, 22 nt, Bordetella pertussis
gaacaggcggcugaagaagccc

SEQ ID NO: 399379 - RNA, 14 nt, Bordetella pertussis
gaacaggcggucuu

SEQ ID NO: 399380 - RNA, 15 nt, Bordetella pertussis
gaacaggcugcgcag

SEQ ID NO: 399381 - RNA, 14 nt, Bordetella pertussis
gaacaggcgcgcca

SEQ ID NO: 399382 - RNA, 17 nt, Bordetella pertussis
gaacagggugccgcccu

SEQ ID NO: 399383 - RNA, 22 nt, Bordetella pertussis
gaacagguacccccagcggcgc

SEQ ID NO: 399384 - RNA, 16 nt, Bordetella pertussis
gaacagguugaagccg

SEQ ID NO: 399385 - RNA, 23 nt, Bordetella pertussis
gaacauauccacgccacuggccu

SEQ ID NO: 399386 - RNA, 16 nt, Bordetella pertussis
gaacaucggcagcgag

SEQ ID NO: 399387 - RNA, 21 nt, Bordetella pertussis
gaacauggcccgguugguggc

SEQ ID NO: 399388 - RNA, 19 nt, Bordetella pertussis
gaacauggccgagaugccg

SEQ ID NO: 399389 - RNA, 22 nt, Bordetella pertussis
gaaccagcgcaccaccagcacc

SEQ ID NO: 399390 - RNA, 15 nt, Bordetella pertussis
gaaccagcggcuggc

SEQ ID NO: 399391 - RNA, 18 nt, Bordetella pertussis
gaaccaggccgccagggc

SEQ ID NO: 399392 - RNA, 17 nt, Bordetella pertussis
gaaccauugcagggugu

SEQ ID NO: 399393 - RNA, 13 nt, Bordetella pertussis
gaacccaugcagu

SEQ ID NO: 399394 - RNA, 19 nt, Bordetella pertussis
gaaccgaauuccggcucgg

SEQ ID NO: 399395 - RNA, 20 nt, Bordetella pertussis
gaaccgcaacgccagcaggc

SEQ ID NO: 399396 - RNA, 19 nt, Bordetella pertussis
gaaccgcagaagcagccgc

SEQ ID NO: 399397 - RNA, 13 nt, Bordetella pertussis
gaaccgcgcagcc

SEQ ID NO: 399398 - RNA, 14 nt, Bordetella pertussis
gaaccgcggcgcag

SEQ ID NO: 399399 - RNA, 23 nt, Bordetella pertussis
gaaccgcggcgcagguccaccgc

SEQ ID NO: 399400 - RNA, 14 nt, Bordetella pertussis
gaaccggugcuggu

SEQ ID NO: 399401 - RNA, 16 nt, Bordetella pertussis
gaaccgguuggccagc

SEQ ID NO: 399402 - RNA, 14 nt, Bordetella pertussis
gaaccugcuggccg

SEQ ID NO: 399403 - RNA, 18 nt, Bordetella pertussis
gaaccugcuggccgccgg

SEQ ID NO: 399404 - RNA, 21 nt, Bordetella pertussis
gaacgaauaaucgccgguggg

SEQ ID NO: 399405 - RNA, 16 nt, Bordetella pertussis
gaacgacgguacaccu

SEQ ID NO: 399406 - RNA, 12 nt, Bordetella pertussis
gaacgccagcag

SEQ ID NO: 399407 - RNA, 13 nt, Bordetella pertussis
gaacgccagcagc

SEQ ID NO: 399408 - RNA, 14 nt, Bordetella pertussis
gaacgccagcagca

SEQ ID NO: 399409 - RNA, 17 nt, Bordetella pertussis
gaacgccgcgcccgccc

SEQ ID NO: 399410 - RNA, 19 nt, Bordetella pertussis
gaacgccgcgcucagcacc

SEQ ID NO: 399411 - RNA, 22 nt, Bordetella pertussis
gaacgccgcgucgcuggccgga

SEQ ID NO: 399412 - RNA, 13 nt, Bordetella pertussis
gaacgccugccag

SEQ ID NO: 399413 - RNA, 16 nt, Bordetella pertussis
gaacgcgccgcuggcg

SEQ ID NO: 399414 - RNA, 13 nt, Bordetella pertussis
gaacgcgccggcc

SEQ ID NO: 399415 - RNA, 18 nt, Bordetella pertussis
gaacgcgccggcccaggc

SEQ ID NO: 399416 - RNA, 21 nt, Bordetella pertussis
gaacgcgccggcccaggcgcg

SEQ ID NO: 399417 - RNA, 16 nt, Bordetella pertussis
gaacgcgcgcaacagg

SEQ ID NO: 399418 - RNA, 15 nt, Bordetella pertussis
gaacgcggccagacc

SEQ ID NO: 399419 - RNA, 16 nt, Bordetella pertussis
gaacgcggccaugcgg

SEQ ID NO: 399420 - RNA, 22 nt, Bordetella pertussis
gaacgcgucgcucauggagggg

SEQ ID NO: 399421 - RNA, 21 nt, Bordetella pertussis
gaacgcguucaagucgcccug

SEQ ID NO: 399422 - RNA, 19 nt, Bordetella pertussis
gaacgcuuccugggccugc

SEQ ID NO: 399423 - RNA, 22 nt, Bordetella pertussis
gaacgcuuccugggccugcggc

SEQ ID NO: 399424 - RNA, 14 nt, Bordetella pertussis
gaacggcagcagcg

SEQ ID NO: 399425 - RNA, 21 nt, Bordetella pertussis
gaacggccggucagcccaggc

SEQ ID NO: 399426 - RNA, 20 nt, Bordetella pertussis
gaacggccgcccggcauggg

SEQ ID NO: 399427 - RNA, 13 nt, Bordetella pertussis
gaacggcucgagc

SEQ ID NO: 399428 - RNA, 13 nt, Bordetella pertussis
gaacgggcguggc

SEQ ID NO: 399429 - RNA, 14 nt, Bordetella pertussis
gaacguggcggcga

SEQ ID NO: 399430 - RNA, 18 nt, Bordetella pertussis
gaacuccaggaaagcgcc

SEQ ID NO: 399431 - RNA, 13 nt, Bordetella pertussis
gaacuccggcggc

SEQ ID NO: 399432 - RNA, 13 nt, Bordetella pertussis
gaacuccugcagc

SEQ ID NO: 399433 - RNA, 19 nt, Bordetella pertussis
gaacucgauccgggccugg

SEQ ID NO: 399434 - RNA, 20 nt, Bordetella pertussis
gaacucgauccgggccuggc

SEQ ID NO: 399435 - RNA, 19 nt, Bordetella pertussis
gaacucgcgcucggccagc

SEQ ID NO: 399436 - RNA, 15 nt, Bordetella pertussis
gaacucggccagcag

SEQ ID NO: 399437 - RNA, 15 nt, Bordetella pertussis
gaacugaugccgacc

SEQ ID NO: 399438 - RNA, 16 nt, Bordetella pertussis
gaacugaugccgaccg

SEQ ID NO: 399439 - RNA, 21 nt, Bordetella pertussis
gaacugcuggaacaccaugcc

SEQ ID NO: 399440 - RNA, 23 nt, Bordetella pertussis
gaacugcuugcgcgugcgcaggu

SEQ ID NO: 399441 - RNA, 18 nt, Bordetella pertussis
gaacuggacggcgcuggg

SEQ ID NO: 399442 - RNA, 13 nt, Bordetella pertussis
gaacugggcgcgu

SEQ ID NO: 399443 - RNA, 21 nt, Bordetella pertussis
gaacugggcgucguccugcag

SEQ ID NO: 399444 - RNA, 11 nt, Bordetella pertussis
gaacugucauu

SEQ ID NO: 399445 - RNA, 20 nt, Bordetella pertussis
gaacuucagcccgggcaugc

SEQ ID NO: 399446 - RNA, 14 nt, Bordetella pertussis
gaacuuggcgcggu

SEQ ID NO: 399447 - RNA, 21 nt, Bordetella pertussis
gaacuugggaucggccaggcc

SEQ ID NO: 399448 - RNA, 19 nt, Bordetella pertussis
gaacuuguucuuguugcuc

SEQ ID NO: 399449 - RNA, 13 nt, Bordetella pertussis
gaagaaccgccgc

SEQ ID NO: 399450 - RNA, 15 nt, Bordetella pertussis
gaagaagcagccgcg

SEQ ID NO: 399451 - RNA, 22 nt, Bordetella pertussis
gaagacaugcugcgacagcagg

SEQ ID NO: 399452 - RNA, 17 nt, Bordetella pertussis
gaagacgaagucccagc

SEQ ID NO: 399453 - RNA, 18 nt, Bordetella pertussis
gaagacgccgucgacccc

SEQ ID NO: 399454 - RNA, 14 nt, Bordetella pertussis
gaagacggaaagag

SEQ ID NO: 399455 - RNA, 17 nt, Bordetella pertussis
gaagacguggcccgcgu

SEQ ID NO: 399456 - RNA, 22 nt, Bordetella pertussis
gaagaggguuauuuccggccgc

SEQ ID NO: 399457 - RNA, 14 nt, Bordetella pertussis
gaagagggcggggc

SEQ ID NO: 399458 - RNA, 18 nt, Bordetella pertussis
gaagaugccgaaccagau

SEQ ID NO: 399459 - RNA, 21 nt, Bordetella pertussis
gaagauuucccagagcugggg

SEQ ID NO: 399460 - RNA, 18 nt, Bordetella pertussis
gaagcaaacaggcugcug

SEQ ID NO: 399461 - RNA, 14 nt, Bordetella pertussis
gaagcacugcaggc

SEQ ID NO: 399462 - RNA, 14 nt, Bordetella pertussis
gaagcagcccagca

SEQ ID NO: 399463 - RNA, 13 nt, Bordetella pertussis
gaagcagccgcgc

SEQ ID NO: 399464 - RNA, 13 nt, Bordetella pertussis
gaagcagccggcc

SEQ ID NO: 399465 - RNA, 14 nt, Bordetella pertussis
gaagccaagcaggg

SEQ ID NO: 399466 - RNA, 20 nt, Bordetella pertussis
gaagccacggcccgccagga

SEQ ID NO: 399467 - RNA, 20 nt, Bordetella pertussis
gaagccagauaaaggccgca

SEQ ID NO: 399468 - RNA, 18 nt, Bordetella pertussis
gaagccaucgacaagcgc

SEQ ID NO: 399469 - RNA, 22 nt, Bordetella pertussis
gaagcccaguucgguguugaga

SEQ ID NO: 399470 - RNA, 13 nt, Bordetella pertussis
gaagcccauggcg

SEQ ID NO: 399471 - RNA, 20 nt, Bordetella pertussis
gaagccgaugcgccgcgcuu

SEQ ID NO: 399472 - RNA, 22 nt, Bordetella pertussis
gaagccgccccacgagaagccg

SEQ ID NO: 399473 - RNA, 18 nt, Bordetella pertussis
gaagccuaggcugcagcc

SEQ ID NO: 399474 - RNA, 19 nt, Bordetella pertussis
gaagccguaguugaugcuu

SEQ ID NO: 399475 - RNA, 15 nt, Bordetella pertussis
gaagccuucuucugc

SEQ ID NO: 399476 - RNA, 19 nt, Bordetella pertussis
gaagccuugcgcggccagc

SEQ ID NO: 399477 - RNA, 20 nt, Bordetella pertussis
gaagccuugcgcggccagca

SEQ ID NO: 399478 - RNA, 22 nt, Bordetella pertussis
gaagcgagugcgccccgccacg

SEQ ID NO: 399479 - RNA, 13 nt, Bordetella pertussis
gaagcgcagcacc

SEQ ID NO: 399480 - RNA, 13 nt, Bordetella pertussis
gaagcgcagcaga

SEQ ID NO: 399481 - RNA, 15 nt, Bordetella pertussis
gaagcgcgccagcag

SEQ ID NO: 399482 - RNA, 17 nt, Bordetella pertussis
gaagcgcgccagcagcg

SEQ ID NO: 399483 - RNA, 17 nt, Bordetella pertussis
gaagcgcgcgugcaggu

SEQ ID NO: 399484 - RNA, 24 nt, Bordetella pertussis
gaagcggcccgggugggcggcauc

SEQ ID NO: 399485 - RNA, 14 nt, Bordetella pertussis
gaagcggcgcacca

SEQ ID NO: 399486 - RNA, 14 nt, Bordetella pertussis
gaagcgggccugcc

SEQ ID NO: 399487 - RNA, 20 nt, Bordetella pertussis
gaagcggucgauguccagcg

SEQ ID NO: 399488 - RNA, 22 nt, Bordetella pertussis
gaagcuggccagcgguacgccg

SEQ ID NO: 399489 - RNA, 18 nt, Bordetella pertussis
gaagcugucggcgcuggc

SEQ ID NO: 399490 - RNA, 20 nt, Bordetella pertussis
gaaggcagcgcggccggcac

SEQ ID NO: 399491 - RNA, 22 nt, Bordetella pertussis
gaaggcccgcgucuuggcgggc

SEQ ID NO: 399492 - RNA, 18 nt, Bordetella pertussis
gaaggccgcgccgcggca

SEQ ID NO: 399493 - RNA, 20 nt, Bordetella pertussis
gaaggcgcccgggcugccgu

SEQ ID NO: 399494 - RNA, 12 nt, Bordetella pertussis
gaaggcgcggcc

SEQ ID NO: 399495 - RNA, 14 nt, Bordetella pertussis
gaaggcggccggca

SEQ ID NO: 399496 - RNA, 18 nt, Bordetella pertussis
gaaggcggccggcaggcc

SEQ ID NO: 399497 - RNA, 19 nt, Bordetella pertussis
gaaggcgguguagaccacc

SEQ ID NO: 399498 - RNA, 21 nt, Bordetella pertussis
gaaggcgugcgugacgcugga

SEQ ID NO: 399499 - RNA, 12 nt, Bordetella pertussis
gaagggcagcag

SEQ ID NO: 399500 - RNA, 23 nt, Bordetella pertussis
gaagggcuggccggccaacagcu

SEQ ID NO: 399501 - RNA, 22 nt, Bordetella pertussis
gaaggggacguguugccaggcg

SEQ ID NO: 399502 - RNA, 19 nt, Bordetella pertussis
gaaggggacuggcucccgc

SEQ ID NO: 399503 - RNA, 13 nt, Bordetella pertussis
gaaggggcggcuu

SEQ ID NO: 399504 - RNA, 16 nt, Bordetella pertussis
gaaggguugcaguucg

SEQ ID NO: 399505 - RNA, 22 nt, Bordetella pertussis
gaagguccacggcauggccagc

SEQ ID NO: 399506 - RNA, 22 nt, Bordetella pertussis
gaaggucggcacgacgcugaug

SEQ ID NO: 399507 - RNA, 23 nt, Bordetella pertussis
gaagguguugaccacgcccugga

SEQ ID NO: 399508 - RNA, 23 nt, Bordetella pertussis
gaagguuucguagccgccgacga

SEQ ID NO: 399509 - RNA, 13 nt, Bordetella pertussis
gaaguacacggcc

SEQ ID NO: 399510 - RNA, 14 nt, Bordetella pertussis
gaaguacagcuuga

SEQ ID NO: 399511 - RNA, 17 nt, Bordetella pertussis
gaaguagaacgccggcu

SEQ ID NO: 399512 - RNA, 20 nt, Bordetella pertussis
gaaguagaacgccggcuugg

SEQ ID NO: 399513 - RNA, 18 nt, Bordetella pertussis
gaaguccugcaucgccau

SEQ ID NO: 399514 - RNA, 13 nt, Bordetella pertussis
gaaguccuucagc

SEQ ID NO: 399515 - RNA, 22 nt, Bordetella pertussis
gaagugcgcccccauguccagg

SEQ ID NO: 399516 - RNA, 17 nt, Bordetella pertussis
gaaguggucgcgcaggc

SEQ ID NO: 399517 - RNA, 23 nt, Bordetella pertussis
gaagugucagguuagcggcagug

SEQ ID NO: 399518 - RNA, 13 nt, Bordetella pertussis
gaauccaccggcg

SEQ ID NO: 399519 - RNA, 19 nt, Bordetella pertussis
gaauccgcaacccagcagc

SEQ ID NO: 399520 - RNA, 20 nt, Bordetella pertussis
gaauccgcaacccagcagcg

SEQ ID NO: 399521 - RNA, 21 nt, Bordetella pertussis
gaauccgcaacccagcagcgg

SEQ ID NO: 399522 - RNA, 18 nt, Bordetella pertussis
gaauccggccagcacgcc

SEQ ID NO: 399523 - RNA, 18 nt, Bordetella pertussis
gaauccggggugccuguc

SEQ ID NO: 399524 - RNA, 20 nt, Bordetella pertussis
gaauccggggugccuguccu

SEQ ID NO: 399525 - RNA, 18 nt, Bordetella pertussis
gaauccguaagcgcugga

SEQ ID NO: 399526 - RNA, 13 nt, Bordetella pertussis
gaauccuggcgac

SEQ ID NO: 399527 - RNA, 17 nt, Bordetella pertussis
gaaucucccggcgcccu

SEQ ID NO: 399528 - RNA, 20 nt, Bordetella pertussis
gaaugaagcgcgacaugacg

SEQ ID NO: 399529 - RNA, 19 nt, Bordetella pertussis
gaaugaugcagcuguagcc

SEQ ID NO: 399530 - RNA, 18 nt, Bordetella pertussis
gaaugccugguaggcgag

SEQ ID NO: 399531 - RNA, 14 nt, Bordetella pertussis
gaaugcggguguug

SEQ ID NO: 399532 - RNA, 15 nt, Bordetella pertussis
gaauggcgcgaucca

SEQ ID NO: 399533 - RNA, 12 nt, Bordetella pertussis
gaauggcgcggu

SEQ ID NO: 399534 - RNA, 19 nt, Bordetella pertussis
gaauguauuggcccaguug

SEQ ID NO: 399535 - RNA, 17 nt, Bordetella pertussis
gaauuccgguucaccau

SEQ ID NO: 399536 - RNA, 21 nt, Bordetella pertussis
gaauugcuggagcgccacgcc

SEQ ID NO: 399537 - RNA, 13 nt, Bordetella pertussis
gaauuggcggcga

SEQ ID NO: 399538 - RNA, 19 nt, Bordetella pertussis
gaauuucucggccagcgcc

SEQ ID NO: 399539 - RNA, 13 nt, Bordetella pertussis
gagucgugcagga

SEQ ID NO: 399540 - RNA, 23 nt, Bordetella pertussis
gaguucgcugcgaaacagcagcg

SEQ ID NO: 399541 - RNA, 18 nt, Bordetella pertussis
gaguucggcgcgcccgcc

SEQ ID NO: 399542 - RNA, 23 nt, Bordetella pertussis
gaguucgucgucgccaccgccca

SEQ ID NO: 399543 - RNA, 21 nt, Bordetella pertussis
gauaaaggccgcaacccaccc

SEQ ID NO: 399544 - RNA, 21 nt, Bordetella pertussis
gauacugcgcaugggcgcagg

SEQ ID NO: 399545 - RNA, 23 nt, Bordetella pertussis
gauacugcgcaugggcgcaggcc

SEQ ID NO: 399546 - RNA, 21 nt, Bordetella pertussis
gauacuguucgccgcaccagg

SEQ ID NO: 399547 - RNA, 16 nt, Bordetella pertussis
gauauccagguaggcg

SEQ ID NO: 399548 - RNA, 15 nt, Bordetella pertussis
gauauccaucuggcc

SEQ ID NO: 399549 - RNA, 18 nt, Bordetella pertussis
gauauccuugcgcucgcc

SEQ ID NO: 399550 - RNA, 19 nt, Bordetella pertussis
gauaucgccauccagguac

SEQ ID NO: 399551 - RNA, 14 nt, Bordetella pertussis
gauaugcagccgca

SEQ ID NO: 399552 - RNA, 16 nt, Bordetella pertussis
gauaugccgauugugc

SEQ ID NO: 399553 - RNA, 12 nt, Bordetella pertussis
gauauggccagg

SEQ ID NO: 399554 - RNA, 15 nt, Bordetella pertussis
gauauggccaggguc

SEQ ID NO: 399555 - RNA, 13 nt, Bordetella pertussis
gauaugggccuga

SEQ ID NO: 399556 - RNA, 13 nt, Bordetella pertussis
gaucagcaggccc

SEQ ID NO: 399557 - RNA, 21 nt, Bordetella pertussis
gaucagcaggcccaccaggga

SEQ ID NO: 399558 - RNA, 21 nt, Bordetella pertussis
gaucagcaggucggcgcggcc

SEQ ID NO: 399559 - RNA, 15 nt, Bordetella pertussis
gaucagccagccggc

SEQ ID NO: 399560 - RNA, 19 nt, Bordetella pertussis
gaucagccgcugcagcacg

SEQ ID NO: 399561 - RNA, 15 nt, Bordetella pertussis
gaucagcgcccaggu

SEQ ID NO: 399562 - RNA, 13 nt, Bordetella pertussis
gaucagcgcggcc

SEQ ID NO: 399563 - RNA, 19 nt, Bordetella pertussis
gaucagcgcgggccacugc

SEQ ID NO: 399564 - RNA, 13 nt, Bordetella pertussis
gaucagcgcgucg

SEQ ID NO: 399565 - RNA, 14 nt, Bordetella pertussis
gaucagcggcggca

SEQ ID NO: 399566 - RNA, 17 nt, Bordetella pertussis
gaucagcgggcuggcca

SEQ ID NO: 399567 - RNA, 15 nt, Bordetella pertussis
gaucagcugcggccc

SEQ ID NO: 399568 - RNA, 18 nt, Bordetella pertussis
gaucaggcccuggggccg

SEQ ID NO: 399569 - RNA, 15 nt, Bordetella pertussis
gaucaggcggcugcc

SEQ ID NO: 399570 - RNA, 20 nt, Bordetella pertussis
gaucaggcugucgcgcgggu

SEQ ID NO: 399571 - RNA, 16 nt, Bordetella pertussis
gaucagggcgcggacu

SEQ ID NO: 399572 - RNA, 16 nt, Bordetella pertussis
gaucagggccgccagg

SEQ ID NO: 399573 - RNA, 22 nt, Bordetella pertussis
gaucagggccgccagggcggcu

SEQ ID NO: 399574 - RNA, 17 nt, Bordetella pertussis
gaucaguccgacgacaa

SEQ ID NO: 399575 - RNA, 11 nt, Bordetella pertussis
gauccacggcc

SEQ ID NO: 399576 - RNA, 20 nt, Bordetella pertussis
gauccacgccgccggccagc

SEQ ID NO: 399577 - RNA, 16 nt, Bordetella pertussis
gauccacucggccagc

SEQ ID NO: 399578 - RNA, 21 nt, Bordetella pertussis
gauccacucggccagcgcgcg

SEQ ID NO: 399579 - RNA, 18 nt, Bordetella pertussis
gauccagaagauauuggg

SEQ ID NO: 399580 - RNA, 12 nt, Bordetella pertussis
gauccagcagcg

SEQ ID NO: 399581 - RNA, 22 nt, Bordetella pertussis
gauccagccauggaagcggcag

SEQ ID NO: 399582 - RNA, 12 nt, Bordetella pertussis
gauccagccgcu

SEQ ID NO: 399583 - RNA, 22 nt, Bordetella pertussis
gauccagccguuggcgcccagc

SEQ ID NO: 399584 - RNA, 15 nt, Bordetella pertussis
gaucccggcgcuggc

SEQ ID NO: 399585 - RNA, 16 nt, Bordetella pertussis
gaucccggcgcuggcc

SEQ ID NO: 399586 - RNA, 20 nt, Bordetella pertussis
gaucccggcgcuggccgcca

SEQ ID NO: 399587 - RNA, 16 nt, Bordetella pertussis
gauccgccgcggccag

SEQ ID NO: 399588 - RNA, 14 nt, Bordetella pertussis
gauccgcgggcggg

SEQ ID NO: 399589 - RNA, 14 nt, Bordetella pertussis
gauccggcgcuggc

SEQ ID NO: 399590 - RNA, 18 nt, Bordetella pertussis
gauccgguaugccugcca

SEQ ID NO: 399591 - RNA, 23 nt, Bordetella pertussis
gauccggugaucaucgugccggg

SEQ ID NO: 399592 - RNA, 18 nt, Bordetella pertussis
gauccucgccagcggcag

SEQ ID NO: 399593 - RNA, 21 nt, Bordetella pertussis
gaucgacgcgauguccagcuc

SEQ ID NO: 399594 - RNA, 22 nt, Bordetella pertussis
gaucgacugccccauggcaugc

SEQ ID NO: 399595 - RNA, 17 nt, Bordetella pertussis
gaucgaguaggccggca

SEQ ID NO: 399596 - RNA, 15 nt, Bordetella pertussis
gaucgauccagaaga

SEQ ID NO: 399597 - RNA, 16 nt, Bordetella pertussis
gaucgccaccagcguc

SEQ ID NO: 399598 - RNA, 19 nt, Bordetella pertussis
gaucgccaugacgcugguc

SEQ ID NO: 399599 - RNA, 15 nt, Bordetella pertussis
gaucgcccgcgugcg

SEQ ID NO: 399600 - RNA, 12 nt, Bordetella pertussis
gaucgccgccgc

SEQ ID NO: 399601 - RNA, 19 nt, Bordetella pertussis
gaucgccgccuucaucguc

SEQ ID NO: 399602 - RNA, 15 nt, Bordetella pertussis
gaucgccgacaggau

SEQ ID NO: 399603 - RNA, 19 nt, Bordetella pertussis
gaucgccgguagcgcuggg

SEQ ID NO: 399604 - RNA, 16 nt, Bordetella pertussis
gaucgccucggggcuc

SEQ ID NO: 399605 - RNA, 18 nt, Bordetella pertussis
gaucgccuggggcgggcg

SEQ ID NO: 399606 - RNA, 16 nt, Bordetella pertussis
gaucgcgauggcccga

SEQ ID NO: 399607 - RNA, 22 nt, Bordetella pertussis
gaucgcgcagcaccgccagcgc

SEQ ID NO: 399608 - RNA, 14 nt, Bordetella pertussis
gaucgcgcagcgcc

SEQ ID NO: 399609 - RNA, 16 nt, Bordetella pertussis
gaucgcggcgcuggcg

SEQ ID NO: 399610 - RNA, 17 nt, Bordetella pertussis
gaucggauagcggugca

SEQ ID NO: 399611 - RNA, 16 nt, Bordetella pertussis
gaucggcgcaaccggc

SEQ ID NO: 399612 - RNA, 20 nt, Bordetella pertussis
gaucggcgcaaccggcccga

SEQ ID NO: 399613 - RNA, 14 nt, Bordetella pertussis
gaucggcgcuggcc

SEQ ID NO: 399614 - RNA, 18 nt, Bordetella pertussis
gaucggcggccugggcca

SEQ ID NO: 399615 - RNA, 19 nt, Bordetella pertussis
gaucgggagccucuggaag

SEQ ID NO: 399616 - RNA, 16 nt, Bordetella pertussis
gaucgggcagcuuggc

SEQ ID NO: 399617 - RNA, 15 nt, Bordetella pertussis
gaucgucagcagcac

SEQ ID NO: 399618 - RNA, 19 nt, Bordetella pertussis
gaugaauuccagccaggcc

SEQ ID NO: 399619 - RNA, 21 nt, Bordetella pertussis
gaugagacacggcaguaugac

SEQ ID NO: 399620 - RNA, 14 nt, Bordetella pertussis
gaugaucaugauga

SEQ ID NO: 399621 - RNA, 13 nt, Bordetella pertussis
gaugauccugcug

SEQ ID NO: 399622 - RNA, 16 nt, Bordetella pertussis
gaugauccugcuggug

SEQ ID NO: 399623 - RNA, 15 nt, Bordetella pertussis
gaugaucgcgcagca

SEQ ID NO: 399624 - RNA, 23 nt, Bordetella pertussis
gaugaucgcgcagcaccgccagc

SEQ ID NO: 399625 - RNA, 13 nt, Bordetella pertussis
gaugaugagcgcg

SEQ ID NO: 399626 - RNA, 16 nt, Bordetella pertussis
gaugaugaucggcgcc

SEQ ID NO: 399627 - RNA, 13 nt, Bordetella pertussis
gaugaugcagcac

SEQ ID NO: 399628 - RNA, 12 nt, Bordetella pertussis
gaugaugcccag

SEQ ID NO: 399629 - RNA, 18 nt, Bordetella pertussis
gaugcccgggaucugcga

SEQ ID NO: 399630 - RNA, 19 nt, Bordetella pertussis
gaugcccugcgccagcgcc

SEQ ID NO: 399631 - RNA, 20 nt, Bordetella pertussis
gaugcccuggguggcggggc

SEQ ID NO: 399632 - RNA, 17 nt, Bordetella pertussis
gaugcccuucggcaugc

SEQ ID NO: 399633 - RNA, 16 nt, Bordetella pertussis
gaugccgaacagccag

SEQ ID NO: 399634 - RNA, 19 nt, Bordetella pertussis
gaugccgaacagccagggc

SEQ ID NO: 399635 - RNA, 14 nt, Bordetella pertussis
gaugccgaccaggc

SEQ ID NO: 399636 - RNA, 20 nt, Bordetella pertussis
gaugccgcagauggccagca

SEQ ID NO: 399637 - RNA, 21 nt, Bordetella pertussis
gaugccgcagauggccagcag

SEQ ID NO: 399638 - RNA, 21 nt, Bordetella pertussis
gaugccgccaugcgccagcag

SEQ ID NO: 399639 - RNA, 17 nt, Bordetella pertussis
gaugccgcccgcaugca

SEQ ID NO: 399640 - RNA, 19 nt, Bordetella pertussis
gaugccgccgaaccagcgc

SEQ ID NO: 399641 - RNA, 19 nt, Bordetella pertussis
gaugcgacuggcggcugcg

SEQ ID NO: 399642 - RNA, 21 nt, Bordetella pertussis
gaugcgcaccggccaggggcg

SEQ ID NO: 399643 - RNA, 14 nt, Bordetella pertussis
gaugcgcagcagca

SEQ ID NO: 399644 - RNA, 19 nt, Bordetella pertussis
gaugcgcagcagcagcgca

SEQ ID NO: 399645 - RNA, 15 nt, Bordetella pertussis
gaugcgccaggcgcu

SEQ ID NO: 399646 - RNA, 13 nt, Bordetella pertussis
gaugcgccaggcu

SEQ ID NO: 399647 - RNA, 16 nt, Bordetella pertussis
gaugcgguaccacgcg

SEQ ID NO: 399648 - RNA, 17 nt, Bordetella pertussis
gaugcgguacugcggcg

SEQ ID NO: 399649 - RNA, 18 nt, Bordetella pertussis
gaugcuggcgcggaccug

SEQ ID NO: 399650 - RNA, 23 nt, Bordetella pertussis
gaugcuugcuugccagcucgacg

SEQ ID NO: 399651 - RNA, 21 nt, Bordetella pertussis
gauggaaucgucgaccagcag

SEQ ID NO: 399652 - RNA, 19 nt, Bordetella pertussis
gauggaguucagcagcucg

SEQ ID NO: 399653 - RNA, 19 nt, Bordetella pertussis
gauggauuucgaccgcaug

SEQ ID NO: 399654 - RNA, 21 nt, Bordetella pertussis
gauggcgaucaggaaaagcag

SEQ ID NO: 399655 - RNA, 21 nt, Bordetella pertussis
gauggcgccgauuucgccgcc

SEQ ID NO: 399656 - RNA, 19 nt, Bordetella pertussis
gauggcgcgcggcuggggc

SEQ ID NO: 399657 - RNA, 14 nt, Bordetella pertussis
gauggcggccaggg

SEQ ID NO: 399658 - RNA, 18 nt, Bordetella pertussis
gauggcggccgccagcgc

SEQ ID NO: 399659 - RNA, 19 nt, Bordetella pertussis
gauggcggccgccagcgcc

SEQ ID NO: 399660 - RNA, 11 nt, Bordetella pertussis
gauggcggcgc

SEQ ID NO: 399661 - RNA, 12 nt, Bordetella pertussis
gaugggccaccc

SEQ ID NO: 399662 - RNA, 21 nt, Bordetella pertussis
gaugggccguccggccgugcc

SEQ ID NO: 399663 - RNA, 23 nt, Bordetella pertussis
gaugggccugcccauggccugca

SEQ ID NO: 399664 - RNA, 16 nt, Bordetella pertussis
gaugggcgcgcgcauc

SEQ ID NO: 399665 - RNA, 18 nt, Bordetella pertussis
gaugggcgcggcgcgcgc

SEQ ID NO: 399666 - RNA, 13 nt, Bordetella pertussis
gaugggcggccuu

SEQ ID NO: 399667 - RNA, 15 nt, Bordetella pertussis
gauggguacagcgcg

SEQ ID NO: 399668 - RNA, 20 nt, Bordetella pertussis
gauggucacgcccaggcgcu

SEQ ID NO: 399669 - RNA, 18 nt, Bordetella pertussis
gauggucgugcggcacgc

SEQ ID NO: 399670 - RNA, 14 nt, Bordetella pertussis
gauggugcgggcga

SEQ ID NO: 399671 - RNA, 16 nt, Bordetella pertussis
gauguagcccauggcc

SEQ ID NO: 399672 - RNA, 20 nt, Bordetella pertussis
gauguagcccauggccaggg

SEQ ID NO: 399673 - RNA, 21 nt, Bordetella pertussis
gauguagcccauggccaggga

SEQ ID NO: 399674 - RNA, 14 nt, Bordetella pertussis
gauguagccgaccc

SEQ ID NO: 399675 - RNA, 13 nt, Bordetella pertussis
gauguaggccagg

SEQ ID NO: 399676 - RNA, 20 nt, Bordetella pertussis
gauguccgcgucggccgcgu

SEQ ID NO: 399677 - RNA, 18 nt, Bordetella pertussis
gaugucgaacagcugcag

SEQ ID NO: 399678 - RNA, 16 nt, Bordetella pertussis
gaugucgcgcaccgcc

SEQ ID NO: 399679 - RNA, 16 nt, Bordetella pertussis
gaugucgcgcgcgcuc

SEQ ID NO: 399680 - RNA, 21 nt, Bordetella pertussis
gauucugcugcaugccggacg

SEQ ID NO: 399681 - RNA, 15 nt, Bordetella pertussis
gauugaggccagcac

SEQ ID NO: 399682 - RNA, 14 nt, Bordetella pertussis
gauuugccgcagcc

SEQ ID NO: 399683 - RNA, 15 nt, Bordetella pertussis
gcaaacaggcugcug

SEQ ID NO: 399684 - RNA, 21 nt, Bordetella pertussis
gcaaacccggcgaagccggca

SEQ ID NO: 399685 - RNA, 17 nt, Bordetella pertussis
gcaaacggcggcaggcc

SEQ ID NO: 399686 - RNA, 18 nt, Bordetella pertussis
gcaaacgggggcaggccg

SEQ ID NO: 399687 - RNA, 18 nt, Bordetella pertussis
gcaaacuuccccgcgugc

SEQ ID NO: 399688 - RNA, 19 nt, Bordetella pertussis
gcaaacuuccccgcgugcc

SEQ ID NO: 399689 - RNA, 20 nt, Bordetella pertussis
gcaaacuuccccgcgugccu

SEQ ID NO: 399690 - RNA, 12 nt, Bordetella pertussis
gcaaagcccagc

SEQ ID NO: 399691 - RNA, 12 nt, Bordetella pertussis
gcaaagcgcggc

SEQ ID NO: 399692 - RNA, 17 nt, Bordetella pertussis
gcaaagcgguccccaga

SEQ ID NO: 399693 - RNA, 14 nt, Bordetella pertussis
gcaaaggcccaggc

SEQ ID NO: 399694 - RNA, 14 nt, Bordetella pertussis
gcaaauggggcggc

SEQ ID NO: 399695 - RNA, 20 nt, Bordetella pertussis
gcaagauuucauggcgucug

SEQ ID NO: 399696 - RNA, 15 nt, Bordetella pertussis
gcaagcaccgccugc

SEQ ID NO: 399697 - RNA, 12 nt, Bordetella pertussis
gcaagccagggc

SEQ ID NO: 399698 - RNA, 16 nt, Bordetella pertussis
gcaagcccaccgggcc

SEQ ID NO: 399699 - RNA, 20 nt, Bordetella pertussis
gcaagcccaccgggccggcc

SEQ ID NO: 399700 - RNA, 14 nt, Bordetella pertussis
gcaagccccaggca

SEQ ID NO: 399701 - RNA, 21 nt, Bordetella pertussis
gcaagccccaggcaggcgggc

SEQ ID NO: 399702 - RNA, 15 nt, Bordetella pertussis
gcaagccgcccgcgg

SEQ ID NO: 399703 - RNA, 16 nt, Bordetella pertussis
gcaagccgcccgcggc

SEQ ID NO: 399704 - RNA, 12 nt, Bordetella pertussis
gcaagccgccgc

SEQ ID NO: 399705 - RNA, 15 nt, Bordetella pertussis
gcaagccggccgcgc

SEQ ID NO: 399706 - RNA, 16 nt, Bordetella pertussis
gcaagcggccccaguc

SEQ ID NO: 399707 - RNA, 14 nt, Bordetella pertussis
gcaagcggccggcc

SEQ ID NO: 399708 - RNA, 16 nt, Bordetella pertussis
gcaagcggccggccug

SEQ ID NO: 399709 - RNA, 21 nt, Bordetella pertussis
gcaagcggcguggggccggcc

SEQ ID NO: 399710 - RNA, 17 nt, Bordetella pertussis
gcaaggggccagccugg

SEQ ID NO: 399711 - RNA, 19 nt, Bordetella pertussis
gcaaggggccagccuggcg

SEQ ID NO: 399712 - RNA, 16 nt, Bordetella pertussis
gcaagggggacuggca

SEQ ID NO: 399713 - RNA, 22 nt, Bordetella pertussis
gcaagggguccguggcggccgc

SEQ ID NO: 399714 - RNA, 23 nt, Bordetella pertussis
gcaagguagccgaugaccggcca

SEQ ID NO: 399715 - RNA, 21 nt, Bordetella pertussis
gcaagguggcgugcagcaggu

SEQ ID NO: 399716 - RNA, 17 nt, Bordetella pertussis
gcaagucagcccgcguc

SEQ ID NO: 399717 - RNA, 17 nt, Bordetella pertussis
gcaaguccagcguggug

SEQ ID NO: 399718 - RNA, 18 nt, Bordetella pertussis
gcaagucuucuucagcau

SEQ ID NO: 399719 - RNA, 21 nt, Bordetella pertussis
gcaagucuucuucagcaugga

SEQ ID NO: 399720 - RNA, 15 nt, Bordetella pertussis
gcaaucaagggccuu

SEQ ID NO: 399721 - RNA, 14 nt, Bordetella pertussis
gcaaucuugccgcc

SEQ ID NO: 399722 - RNA, 16 nt, Bordetella pertussis
gcaaucuugccgccgg

SEQ ID NO: 399723 - RNA, 19 nt, Bordetella pertussis
gcaaucuugccgccgggca

SEQ ID NO: 399724 - RNA, 17 nt, Bordetella pertussis
gcaaugcguggccggcg

SEQ ID NO: 399725 - RNA, 14 nt, Bordetella pertussis
gcaaugguccagca

SEQ ID NO: 399726 - RNA, 16 nt, Bordetella pertussis
gcaaugguccagcagg

SEQ ID NO: 399727 - RNA, 17 nt, Bordetella pertussis
gcaaugguccagcaggg

SEQ ID NO: 399728 - RNA, 14 nt, Bordetella pertussis
gcaauugccccagc

SEQ ID NO: 399729 - RNA, 16 nt, Bordetella pertussis
gcacaccaucagcugg

SEQ ID NO: 399730 - RNA, 23 nt, Bordetella pertussis
gcacacgccgauugaggccagca

SEQ ID NO: 399731 - RNA, 21 nt, Bordetella pertussis
gcacacggucagcaaccccag

SEQ ID NO: 399732 - RNA, 16 nt, Bordetella pertussis
gcacacuggccagcaa

SEQ ID NO: 399733 - RNA, 17 nt, Bordetella pertussis
gcacacuggccagcaag

SEQ ID NO: 399734 - RNA, 20 nt, Bordetella pertussis
gcacaguucgugcaccagcc

SEQ ID NO: 399735 - RNA, 15 nt, Bordetella pertussis
gcacaguugcaggcc

SEQ ID NO: 399736 - RNA, 17 nt, Bordetella pertussis
gcacaguugcaggccau

SEQ ID NO: 399737 - RNA, 18 nt, Bordetella pertussis
gcacauagcgcaagcccg

SEQ ID NO: 399738 - RNA, 20 nt, Bordetella pertussis
gcacaucagcgugccgccgg

SEQ ID NO: 399739 - RNA, 21 nt, Bordetella pertussis
gcacaucaggucgaccugcuu

SEQ ID NO: 399740 - RNA, 19 nt, Bordetella pertussis
gcacauuggaguaguggcc

SEQ ID NO: 399741 - RNA, 22 nt, Bordetella pertussis
gcaccaacugguagugcggcgc

SEQ ID NO: 399742 - RNA, 14 nt, Bordetella pertussis
gcaccaccgccgau

SEQ ID NO: 399743 - RNA, 12 nt, Bordetella pertussis
gcaccaccuggc

SEQ ID NO: 399744 - RNA, 20 nt, Bordetella pertussis
gcaccacgggcucgcugacc

SEQ ID NO: 399745 - RNA, 22 nt, Bordetella pertussis
gcaccacguccuggggcgcggu

SEQ ID NO: 399746 - RNA, 23 nt, Bordetella pertussis
gcaccagcggcgauaccaguagc

SEQ ID NO: 399747 - RNA, 16 nt, Bordetella pertussis
gcaccagcuuggccug

SEQ ID NO: 399748 - RNA, 18 nt, Bordetella pertussis
gcaccaggaacagcaacg

SEQ ID NO: 399749 - RNA, 19 nt, Bordetella pertussis
gcaccaggauccccagcac

SEQ ID NO: 399750 - RNA, 14 nt, Bordetella pertussis
gcaccaggcccaug

SEQ ID NO: 399751 - RNA, 13 nt, Bordetella pertussis
gcaccaggccgcc

SEQ ID NO: 399752 - RNA, 15 nt, Bordetella pertussis
gcaccaggccgccgg

SEQ ID NO: 399753 - RNA, 16 nt, Bordetella pertussis
gcaccaggccgccggc

SEQ ID NO: 399754 - RNA, 17 nt, Bordetella pertussis
gcaccaggccgccggcc

SEQ ID NO: 399755 - RNA, 15 nt, Bordetella pertussis
gcaccaggccgcggc

SEQ ID NO: 399756 - RNA, 16 nt, Bordetella pertussis
gcaccaggcgcacggc

SEQ ID NO: 399757 - RNA, 19 nt, Bordetella pertussis
gcaccaggcgcacggcggc

SEQ ID NO: 399758 - RNA, 14 nt, Bordetella pertussis
gcaccaggcgcggc

SEQ ID NO: 399759 - RNA, 20 nt, Bordetella pertussis
gcaccaggcuggggccgagc

SEQ ID NO: 399760 - RNA, 19 nt, Bordetella pertussis
gcacccgucccugguccag

SEQ ID NO: 399761 - RNA, 21 nt, Bordetella pertussis
gcacccgucccugguccagca

SEQ ID NO: 399762 - RNA, 20 nt, Bordetella pertussis
gcacccugcaggccgggcag

SEQ ID NO: 399763 - RNA, 23 nt, Bordetella pertussis
gcaccgaggccgaguggccgcug

SEQ ID NO: 399764 - RNA, 17 nt, Bordetella pertussis
gcaccgcaugggccagg

SEQ ID NO: 399765 - RNA, 18 nt, Bordetella pertussis
gcaccgcaugggccaggc

SEQ ID NO: 399766 - RNA, 19 nt, Bordetella pertussis
gcaccgcaugggccaggcg

SEQ ID NO: 399767 - RNA, 11 nt, Bordetella pertussis
gcaccgcaagg

SEQ ID NO: 399768 - RNA, 19 nt, Bordetella pertussis
gcaccgccaugugcgccgc

SEQ ID NO: 399769 - RNA, 11 nt, Bordetella pertussis
gcaccgcccgc

SEQ ID NO: 399770 - RNA, 16 nt, Bordetella pertussis
gcaccgccgcacagcc

SEQ ID NO: 399771 - RNA, 15 nt, Bordetella pertussis
gcaccgccgccggcc

SEQ ID NO: 399772 - RNA, 16 nt, Bordetella pertussis
gcaccgccgccggccc

SEQ ID NO: 399773 - RNA, 15 nt, Bordetella pertussis
gcaccgccgcgcggu

SEQ ID NO: 399774 - RNA, 14 nt, Bordetella pertussis
gcaccggccgaccc

SEQ ID NO: 399775 - RNA, 20 nt, Bordetella pertussis
gcaccggccgacccgcggcc

SEQ ID NO: 399776 - RNA, 13 nt, Bordetella pertussis
gcaccggccggcc

SEQ ID NO: 399777 - RNA, 14 nt, Bordetella pertussis
gcaccggccggccg

SEQ ID NO: 399778 - RNA, 18 nt, Bordetella pertussis
gcaccggcgugcgcuggc

SEQ ID NO: 399779 - RNA, 19 nt, Bordetella pertussis
gcaccggcgugcgcuggcu

SEQ ID NO: 399780 - RNA, 21 nt, Bordetella pertussis
gcaccggcgugcgcuggcugg

SEQ ID NO: 399781 - RNA, 19 nt, Bordetella pertussis
gcaccggcugccagggccg

SEQ ID NO: 399782 - RNA, 22 nt, Bordetella pertussis
gcaccggcuuggggcgcgccgc

SEQ ID NO: 399783 - RNA, 18 nt, Bordetella pertussis
gcaccgggcggcccggcg

SEQ ID NO: 399784 - RNA, 15 nt, Bordetella pertussis
gcaccggggcagggc

SEQ ID NO: 399785 - RNA, 16 nt, Bordetella pertussis
gcaccggggcagggcg

SEQ ID NO: 399786 - RNA, 17 nt, Bordetella pertussis
gcaccgucaggugcagc

SEQ ID NO: 399787 - RNA, 12 nt, Bordetella pertussis
gcaccgugaccu

SEQ ID NO: 399788 - RNA, 19 nt, Bordetella pertussis
gcaccgugaugcgcgccgc

SEQ ID NO: 399789 - RNA, 20 nt, Bordetella pertussis
gcaccgugaugcgcgccgcu

SEQ ID NO: 399790 - RNA, 23 nt, Bordetella pertussis
gcaccgugaugcgcgccgcucuu

SEQ ID NO: 399791 - RNA, 17 nt, Bordetella pertussis
gcaccucgacgcagccu

SEQ ID NO: 399792 - RNA, 23 nt, Bordetella pertussis
gcaccucggacgagacaggcgcg

SEQ ID NO: 399793 - RNA, 18 nt, Bordetella pertussis
gcaccucggggcgcggcc

SEQ ID NO: 399794 - RNA, 19 nt, Bordetella pertussis
gcaccucggggcgcggccg

SEQ ID NO: 399795 - RNA, 22 nt, Bordetella pertussis
gcaccucguaaguggcggcggg

SEQ ID NO: 399796 - RNA, 22 nt, Bordetella pertussis
gcaccugaacaccggcgcgccu

SEQ ID NO: 399797 - RNA, 17 nt, Bordetella pertussis
gcaccugcaccgaagca

SEQ ID NO: 399798 - RNA, 18 nt, Bordetella pertussis
gcaccugguggcgcuggc

SEQ ID NO: 399799 - RNA, 20 nt, Bordetella pertussis
gcaccugguggcgcuggccc

SEQ ID NO: 399800 - RNA, 14 nt, Bordetella pertussis
gcaccugcaggccg

SEQ ID NO: 399801 - RNA, 18 nt, Bordetella pertussis
gcaccuucgcgcagcggc

SEQ ID NO: 399802 - RNA, 15 nt, Bordetella pertussis
gcaccuugccugcaa

SEQ ID NO: 399803 - RNA, 16 nt, Bordetella pertussis
gcaccuuucugcugcu

SEQ ID NO: 399804 - RNA, 17 nt, Bordetella pertussis
gcaccuuucugcugcuc

SEQ ID NO: 399805 - RNA, 13 nt, Bordetella pertussis
gcacgaccaggcc

SEQ ID NO: 399806 - RNA, 19 nt, Bordetella pertussis
gcacgacgcgaaccaggcc

SEQ ID NO: 399807 - RNA, 21 nt, Bordetella pertussis
gcacgacgcgaaccaggccac

SEQ ID NO: 399808 - RNA, 20 nt, Bordetella pertussis
gcacgagaucgccuggggca

SEQ ID NO: 399809 - RNA, 18 nt, Bordetella pertussis
gcacgaggcgcucggccu

SEQ ID NO: 399810 - RNA, 21 nt, Bordetella pertussis
gcacgccauucauccagcgcg

SEQ ID NO: 399811 - RNA, 12 nt, Bordetella pertussis
gcacgcccagcc

SEQ ID NO: 399812 - RNA, 18 nt, Bordetella pertussis
gcacgcccagccgcagca

SEQ ID NO: 399813 - RNA, 18 nt, Bordetella pertussis
gcacgcccgccugcagca

SEQ ID NO: 399814 - RNA, 21 nt, Bordetella pertussis
gcacgcccgccugcagcagcg

SEQ ID NO: 399815 - RNA, 15 nt, Bordetella pertussis
gcacgccgaccuggc

SEQ ID NO: 399816 - RNA, 18 nt, Bordetella pertussis
gcacgccgaccuggcgcc

SEQ ID NO: 399817 - RNA, 17 nt, Bordetella pertussis
gcacgccgcgccaggca

SEQ ID NO: 399818 - RNA, 18 nt, Bordetella pertussis
gcacgccgcgccaggcau

SEQ ID NO: 399819 - RNA, 13 nt, Bordetella pertussis
gcacgccggacca

SEQ ID NO: 399820 - RNA, 18 nt, Bordetella pertussis
gcacgcucugcaccuugg

SEQ ID NO: 399821 - RNA, 20 nt, Bordetella pertussis
gcacgcucuugagcgcggcc

SEQ ID NO: 399822 - RNA, 21 nt, Bordetella pertussis
gcacgcucuugagcgcggccu

SEQ ID NO: 399823 - RNA, 22 nt, Bordetella pertussis
gcacgcugcugauccucgccag

SEQ ID NO: 399824 - RNA, 13 nt, Bordetella pertussis
gcacgcuggcgcc

SEQ ID NO: 399825 - RNA, 17 nt, Bordetella pertussis
gcacgcuggcgcccgcc

SEQ ID NO: 399826 - RNA, 23 nt, Bordetella pertussis
gcacgcugggcgaggcgcuggcc

SEQ ID NO: 399827 - RNA, 24 nt, Bordetella pertussis
gcacgcugggcgaggcgcuggccg

SEQ ID NO: 399828 - RNA, 17 nt, Bordetella pertussis
gcacggacagcccgcgc

SEQ ID NO: 399829 - RNA, 14 nt, Bordetella pertussis
gcacggccagcacc

SEQ ID NO: 399830 - RNA, 15 nt, Bordetella pertussis
gcacggccagcacca

SEQ ID NO: 399831 - RNA, 17 nt, Bordetella pertussis
gcacggccggccaggcg

SEQ ID NO: 399832 - RNA, 13 nt, Bordetella pertussis
gcacggcgcggcu

SEQ ID NO: 399833 - RNA, 14 nt, Bordetella pertussis
gcacggcgcggcug

SEQ ID NO: 399834 - RNA, 22 nt, Bordetella pertussis
gcacggcuugcgcgccugcugg

SEQ ID NO: 399835 - RNA, 17 nt, Bordetella pertussis
gcacgggcgagggcugc

SEQ ID NO: 399836 - RNA, 13 nt, Bordetella pertussis
gcacgggcgccug

SEQ ID NO: 399837 - RNA, 20 nt, Bordetella pertussis
gcacgggccgacggccucgg

SEQ ID NO: 399838 - RNA, 12 nt, Bordetella pertussis
gcacggggacag

SEQ ID NO: 399839 - RNA, 15 nt, Bordetella pertussis
gcacggggacaggca

SEQ ID NO: 399840 - RNA, 17 nt, Bordetella pertussis
gcacggggacaggcacg

SEQ ID NO: 399841 - RNA, 23 nt, Bordetella pertussis
gcacggggacuggcaccggccga

SEQ ID NO: 399842 - RNA, 17 nt, Bordetella pertussis
gcacggggcugucgagg

SEQ ID NO: 399843 - RNA, 16 nt, Bordetella pertussis
gcacgggucaggcugc

SEQ ID NO: 399844 - RNA, 18 nt, Bordetella pertussis
gcacggugccgcgcgcuu

SEQ ID NO: 399845 - RNA, 21 nt, Bordetella pertussis
gcacggugcgcacgauggggc

SEQ ID NO: 399846 - RNA, 22 nt, Bordetella pertussis
gcacgguggcgcccggcggcgc

SEQ ID NO: 399847 - RNA, 17 nt, Bordetella pertussis
gcacggugggcagcagc

SEQ ID NO: 399848 - RNA, 18 nt, Bordetella pertussis
gcacggugggcagcagca

SEQ ID NO: 399849 - RNA, 17 nt, Bordetella pertussis
gcacguaguacagcagc

SEQ ID NO: 399850 - RNA, 22 nt, Bordetella pertussis
gcacguaguacagcagcagcac

SEQ ID NO: 399851 - RNA, 20 nt, Bordetella pertussis
gcacgucauccugggcgcgc

SEQ ID NO: 399852 - RNA, 23 nt, Bordetella pertussis
gcacgucauccugggcgcgcgcc

SEQ ID NO: 399853 - RNA, 19 nt, Bordetella pertussis
gcacguccaaugccagggu

SEQ ID NO: 399854 - RNA, 12 nt, Bordetella pertussis
gcacguccagcg

SEQ ID NO: 399855 - RNA, 15 nt, Bordetella pertussis
gcacgucgggcagga

SEQ ID NO: 399856 - RNA, 21 nt, Bordetella pertussis
gcacgucggucgaguagaagu

SEQ ID NO: 399857 - RNA, 21 nt, Bordetella pertussis
gcacgucguagcgcugcagcc

SEQ ID NO: 399858 - RNA, 16 nt, Bordetella pertussis
gcacgugacgccggcg

SEQ ID NO: 399859 - RNA, 18 nt, Bordetella pertussis
gcacgugcgacgugaccc

SEQ ID NO: 399860 - RNA, 19 nt, Bordetella pertussis
gcacucccgaaaaccgcuc

SEQ ID NO: 399861 - RNA, 19 nt, Bordetella pertussis
gcacuccggauaccgccgc

SEQ ID NO: 399862 - RNA, 23 nt, Bordetella pertussis
gcacuccguaaagaugcgcgccg

SEQ ID NO: 399863 - RNA, 17 nt, Bordetella pertussis
gcacucggccauggugc

SEQ ID NO: 399864 - RNA, 22 nt, Bordetella pertussis
gcacugagaaaggccgccacga

SEQ ID NO: 399865 - RNA, 17 nt, Bordetella pertussis
gcacugaugcuggucag

SEQ ID NO: 399866 - RNA, 15 nt, Bordetella pertussis
gcacuggguggccag

SEQ ID NO: 399867 - RNA, 16 nt, Bordetella pertussis
gcacuggguggccagc

SEQ ID NO: 399868 - RNA, 17 nt, Bordetella pertussis
gcacuggguggccagcg

SEQ ID NO: 399869 - RNA, 21 nt, Bordetella pertussis
gcacuggguggccagcgccgc

SEQ ID NO: 399870 - RNA, 20 nt, Bordetella pertussis
gcacugggugacgcuggagc

SEQ ID NO: 399871 - RNA, 21 nt, Bordetella pertussis
gcacugggugacgcuggagcg

SEQ ID NO: 399872 - RNA, 15 nt, Bordetella pertussis
gcagcaaccggaaca

SEQ ID NO: 399873 - RNA, 22 nt, Bordetella pertussis
gcagcaccacaucgccggcggc

SEQ ID NO: 399874 - RNA, 17 nt, Bordetella pertussis
gcagcaccgccaugugc

SEQ ID NO: 399875 - RNA, 19 nt, Bordetella pertussis
gcagcagaucggcggccug

SEQ ID NO: 399876 - RNA, 18 nt, Bordetella pertussis
gcagcagauugccgcgcg

SEQ ID NO: 399877 - RNA, 16 nt, Bordetella pertussis
gcagcagcagcgcggu

SEQ ID NO: 399878 - RNA, 15 nt, Bordetella pertussis
gcagcagcagggcca

SEQ ID NO: 399879 - RNA, 15 nt, Bordetella pertussis
gcagcagcgacagga

SEQ ID NO: 399880 - RNA, 14 nt, Bordetella pertussis
gcagcagcgccggc

SEQ ID NO: 399881 - RNA, 18 nt, Bordetella pertussis
gcagcagcgccggcaggc

SEQ ID NO: 399882 - RNA, 20 nt, Bordetella pertussis
gcagcagcgccuugcggcgc

SEQ ID NO: 399883 - RNA, 20 nt, Bordetella pertussis
gcagcaguucggcgucggug

SEQ ID NO: 399884 - RNA, 22 nt, Bordetella pertussis
gcagcaguucggucagcgcggc

SEQ ID NO: 399885 - RNA, 18 nt, Bordetella pertussis
gcagcaucuugcgccgcu

SEQ ID NO: 399886 - RNA, 18 nt, Bordetella pertussis
gcagcaugccgcgguggc

SEQ ID NO: 399887 - RNA, 16 nt, Bordetella pertussis
gcagcauggcgccaug

SEQ ID NO: 399888 - RNA, 15 nt, Bordetella pertussis
gcagcauggcgggcg

SEQ ID NO: 399889 - RNA, 21 nt, Bordetella pertussis
gcagcauucuggugcagcggc

SEQ ID NO: 399890 - RNA, 22 nt, Bordetella pertussis
gcagcauucuggugcagcggcu

SEQ ID NO: 399891 - RNA, 14 nt, Bordetella pertussis
gcagcaugugcucg

SEQ ID NO: 399892 - RNA, 13 nt, Bordetella pertussis
gcagccacaggcc

SEQ ID NO: 399893 - RNA, 17 nt, Bordetella pertussis
gcagccacaggcccaug

SEQ ID NO: 399894 - RNA, 22 nt, Bordetella pertussis
gcagcccgcgcgccugcauguc

SEQ ID NO: 399895 - RNA, 14 nt, Bordetella pertussis
gcagcccgcuggcc

SEQ ID NO: 399896 - RNA, 12 nt, Bordetella pertussis
gcagcccggcgu

SEQ ID NO: 399897 - RNA, 18 nt, Bordetella pertussis
gcagcccggcgugcccag

SEQ ID NO: 399898 - RNA, 22 nt, Bordetella pertussis
gcagcccggcgugcccagggcc

SEQ ID NO: 399899 - RNA, 19 nt, Bordetella pertussis
gcagcccuucggagccagu

SEQ ID NO: 399900 - RNA, 13 nt, Bordetella pertussis
gcagccgcgcggc

SEQ ID NO: 399901 - RNA, 14 nt, Bordetella pertussis
gcagccgcgcggcc

SEQ ID NO: 399902 - RNA, 19 nt, Bordetella pertussis
gcagccgcuccagccacca

SEQ ID NO: 399903 - RNA, 20 nt, Bordetella pertussis
gcagccgcuccagccaccac

SEQ ID NO: 399904 - RNA, 21 nt, Bordetella pertussis
gcagcgaggcgcagcgcagcu

SEQ ID NO: 399905 - RNA, 21 nt, Bordetella pertussis
gcagcgaguagacgcagccgc

SEQ ID NO: 399906 - RNA, 14 nt, Bordetella pertussis
gcagcgcaccacca

SEQ ID NO: 399907 - RNA, 20 nt, Bordetella pertussis
gcagcgcaccgacggcagcc

SEQ ID NO: 399908 - RNA, 22 nt, Bordetella pertussis
gcagcgcaccgacggcagcccc

SEQ ID NO: 399909 - RNA, 22 nt, Bordetella pertussis
gcagcgcaccgucgccagggcg

SEQ ID NO: 399910 - RNA, 13 nt, Bordetella pertussis
gcagcgcagcgcc

SEQ ID NO: 399911 - RNA, 21 nt, Bordetella pertussis
gcagcgcaggaugggcagcuc

SEQ ID NO: 399912 - RNA, 20 nt, Bordetella pertussis
gcagcgcaucgcgcgcgccg

SEQ ID NO: 399913 - RNA, 17 nt, Bordetella pertussis
gcagcgccaccggcugg

SEQ ID NO: 399914 - RNA, 20 nt, Bordetella pertussis
gcagcgccaccguggccacg

SEQ ID NO: 399915 - RNA, 13 nt, Bordetella pertussis
gcagcgccagggc

SEQ ID NO: 399916 - RNA, 13 nt, Bordetella pertussis
gcagcgcccgcgc

SEQ ID NO: 399917 - RNA, 14 nt, Bordetella pertussis
gcagcgccgccacc

SEQ ID NO: 399918 - RNA, 15 nt, Bordetella pertussis
gcagcgccgccagca

SEQ ID NO: 399919 - RNA, 18 nt, Bordetella pertussis
gcagcgccggggggcgca

SEQ ID NO: 399920 - RNA, 15 nt, Bordetella pertussis
gcagcgccggcuggg

SEQ ID NO: 399921 - RNA, 21 nt, Bordetella pertussis
gcagcgccucgggauuagccu

SEQ ID NO: 399922 - RNA, 14 nt, Bordetella pertussis
gcagcgccugcagg

SEQ ID NO: 399923 - RNA, 15 nt, Bordetella pertussis
gcagcgccugcaggc

SEQ ID NO: 399924 - RNA, 13 nt, Bordetella pertussis
gcagcgccugccg

SEQ ID NO: 399925 - RNA, 19 nt, Bordetella pertussis
gcagcgccugccgcgugcc

SEQ ID NO: 399926 - RNA, 18 nt, Bordetella pertussis
gcagcgccuggccgagcg

SEQ ID NO: 399927 - RNA, 23 nt, Bordetella pertussis
gcagcgccuggccgagcgcggca

SEQ ID NO: 399928 - RNA, 19 nt, Bordetella pertussis
gcagcgcgaacggcgggcg

SEQ ID NO: 399929 - RNA, 17 nt, Bordetella pertussis
gcagcgcgccgccgaug

SEQ ID NO: 399930 - RNA, 15 nt, Bordetella pertussis
gcagcgcgccgggcg

SEQ ID NO: 399931 - RNA, 22 nt, Bordetella pertussis
gcagcgcggccggcaccaggau

SEQ ID NO: 399932 - RNA, 13 nt, Bordetella pertussis
gcagcgcggcggc

SEQ ID NO: 399933 - RNA, 18 nt, Bordetella pertussis
gcagcgcgguggccagcg

SEQ ID NO: 399934 - RNA, 15 nt, Bordetella pertussis
gcagcgcguccugcc

SEQ ID NO: 399935 - RNA, 19 nt, Bordetella pertussis
gcagcgcgugugguuggcg

SEQ ID NO: 399936 - RNA, 14 nt, Bordetella pertussis
gcagcggacucaua

SEQ ID NO: 399937 - RNA, 20 nt, Bordetella pertussis
gcagcggacucauaauccgu

SEQ ID NO: 399938 - RNA, 15 nt, Bordetella pertussis
gcagcggagcgacgg

SEQ ID NO: 399939 - RNA, 20 nt, Bordetella pertussis
gcagcggcagcauggcgcgc

SEQ ID NO: 399940 - RNA, 13 nt, Bordetella pertussis
gcagcggcaggcg

SEQ ID NO: 399941 - RNA, 16 nt, Bordetella pertussis
gcagcggcaggcggcu

SEQ ID NO: 399942 - RNA, 20 nt, Bordetella pertussis
gcagcggcaggcggcugacg

SEQ ID NO: 399943 - RNA, 13 nt, Bordetella pertussis
gcagcggccgcgc

SEQ ID NO: 399944 - RNA, 18 nt, Bordetella pertussis
gcagcggccagcgcggcg

SEQ ID NO: 399945 - RNA, 23 nt, Bordetella pertussis
gcagcgggcccgucgcgccaggc

SEQ ID NO: 399946 - RNA, 15 nt, Bordetella pertussis
gcagcgggccgcagc

SEQ ID NO: 399947 - RNA, 13 nt, Bordetella pertussis
gcagcgggcuggg

SEQ ID NO: 399948 - RNA, 14 nt, Bordetella pertussis
gcagcggggacagg

SEQ ID NO: 399949 - RNA, 23 nt, Bordetella pertussis
gcagcgucaauccgccgccagca

SEQ ID NO: 399950 - RNA, 14 nt, Bordetella pertussis
gcagcgucugcgca

SEQ ID NO: 399951 - RNA, 18 nt, Bordetella pertussis
gcagcgucugcgcaucga

SEQ ID NO: 399952 - RNA, 19 nt, Bordetella pertussis
gcagcgugaccgacaggcc

SEQ ID NO: 399953 - RNA, 19 nt, Bordetella pertussis
gcagcucggugcagcccag

SEQ ID NO: 399954 - RNA, 20 nt, Bordetella pertussis
gcagcucguggcgcgccucc

SEQ ID NO: 399955 - RNA, 14 nt, Bordetella pertussis
gcagcugccugagc

SEQ ID NO: 399956 - RNA, 15 nt, Bordetella pertussis
gcagcugccugagca

SEQ ID NO: 399957 - RNA, 15 nt, Bordetella pertussis
gcagcugcgccagcc

SEQ ID NO: 399958 - RNA, 23 nt, Bordetella pertussis
gcagcuggauggccugcucgccc

SEQ ID NO: 399959 - RNA, 20 nt, Bordetella pertussis
gcagcuucuugaacucggcc

SEQ ID NO: 399960 - RNA, 21 nt, Bordetella pertussis
gcagcuugaccgccuccagga

SEQ ID NO: 399961 - RNA, 17 nt, Bordetella pertussis
gcagcuugcgcgccagu

SEQ ID NO: 399962 - RNA, 15 nt, Bordetella pertussis
gcagcuugcgcgccc

SEQ ID NO: 399963 - RNA, 18 nt, Bordetella pertussis
gcagcuuggcgcgccgga

SEQ ID NO: 399964 - RNA, 20 nt, Bordetella pertussis
gcagcuuggugaagcccucg

SEQ ID NO: 399965 - RNA, 20 nt, Bordetella pertussis
gcagcuugucgaucgccacc

SEQ ID NO: 399966 - RNA, 15 nt, Bordetella pertussis
gcaggcacuggcgcg

SEQ ID NO: 399967 - RNA, 19 nt, Bordetella pertussis
gcaggcacuggcgcggcgc

SEQ ID NO: 399968 - RNA, 22 nt, Bordetella pertussis
gcaggcauucgaacaacagcgc

SEQ ID NO: 399969 - RNA, 22 nt, Bordetella pertussis
gcaggccaccgacggcgcggcg

SEQ ID NO: 399970 - RNA, 13 nt, Bordetella pertussis
gcaggccagcaug

SEQ ID NO: 399971 - RNA, 15 nt, Bordetella pertussis
gcaggccagcauggc

SEQ ID NO: 399972 - RNA, 13 nt, Bordetella pertussis
gcaggccagcgcc

SEQ ID NO: 399973 - RNA, 19 nt, Bordetella pertussis
gcaggccagcgccgcggug

SEQ ID NO: 399974 - RNA, 20 nt, Bordetella pertussis
gcaggccaggcucagcaggg

SEQ ID NO: 399975 - RNA, 14 nt, Bordetella pertussis
gcaggcccaccagg

SEQ ID NO: 399976 - RNA, 16 nt, Bordetella pertussis
gcaggcccaccaggga

SEQ ID NO: 399977 - RNA, 17 nt, Bordetella pertussis
gcaggcccaccagggac

SEQ ID NO: 399978 - RNA, 20 nt, Bordetella pertussis
gcaggcccaccagggccagc

SEQ ID NO: 399979 - RNA, 12 nt, Bordetella pertussis
gcaggcccagcc

SEQ ID NO: 399980 - RNA, 20 nt, Bordetella pertussis
gcaggcccaugauccgcacc

SEQ ID NO: 399981 - RNA, 17 nt, Bordetella pertussis
gcaggcccaugccgcgc

SEQ ID NO: 399982 - RNA, 21 nt, Bordetella pertussis
gcaggccccggcccggcgggc

SEQ ID NO: 399983 - RNA, 17 nt, Bordetella pertussis
gcaggcccgacaggaac

SEQ ID NO: 399984 - RNA, 13 nt, Bordetella pertussis
gcaggcccgggcg

SEQ ID NO: 399985 - RNA, 11 nt, Bordetella pertussis
gcaggccuggu

SEQ ID NO: 399986 - RNA, 13 nt, Bordetella pertussis
gcaggccuggucg

SEQ ID NO: 399987 - RNA, 17 nt, Bordetella pertussis
gcaggcgaaacgccagc

SEQ ID NO: 399988 - RNA, 14 nt, Bordetella pertussis
gcaggcgcaccagc

SEQ ID NO: 399989 - RNA, 16 nt, Bordetella pertussis
gcaggcgcacgccgcc

SEQ ID NO: 399990 - RNA, 23 nt, Bordetella pertussis
gcaggcggcggccuccagcaggg

SEQ ID NO: 399991 - RNA, 14 nt, Bordetella pertussis
gcaggcggcuggug

SEQ ID NO: 399992 - RNA, 16 nt, Bordetella pertussis
gcaggcgggccaggcc

SEQ ID NO: 399993 - RNA, 17 nt, Bordetella pertussis
gcaggcggugcggaggc

SEQ ID NO: 399994 - RNA, 17 nt, Bordetella pertussis
gcaggcguuucgccagg

SEQ ID NO: 399995 - RNA, 18 nt, Bordetella pertussis
gcaggcguuucgccagga

SEQ ID NO: 399996 - RNA, 17 nt, Bordetella pertussis
gcaggcuuugcuggcca

SEQ ID NO: 399997 - RNA, 16 nt, Bordetella pertussis
gcaggcuuucgcacag

SEQ ID NO: 399998 - RNA, 22 nt, Bordetella pertussis
gcaggcuuucgcacagccgggg

SEQ ID NO: 399999 - RNA, 13 nt, Bordetella pertussis
gcagggacaggcu

SEQ ID NO: 400000 - RNA, 17 nt, Bordetella pertussis
gcagggacuugggcagg

SEQ ID NO: 400001 - RNA, 20 nt, Bordetella pertussis
gcagggacuugggcaggccu

SEQ ID NO: 400002 - RNA, 22 nt, Bordetella pertussis
gcagggcaucguuggaccccag

SEQ ID NO: 400003 - RNA, 23 nt, Bordetella pertussis
gcaggucggagucggcgccgcgc

SEQ ID NO: 400004 - RNA, 21 nt, Bordetella pertussis
gcaggucgggauaguccagca

SEQ ID NO: 400005 - RNA, 21 nt, Bordetella pertussis
gcaggucgggcagggugggca

SEQ ID NO: 400006 - RNA, 20 nt, Bordetella pertussis
gcaggucggugcacacgccu

SEQ ID NO: 400007 - RNA, 15 nt, Bordetella pertussis
gcaggugcacgcacg

SEQ ID NO: 400008 - RNA, 15 nt, Bordetella pertussis
gcaggugccgccggc

SEQ ID NO: 400009 - RNA, 16 nt, Bordetella pertussis
gcaggugccgccggcg

SEQ ID NO: 400010 - RNA, 18 nt, Bordetella pertussis
gcaggugccccacgccga

SEQ ID NO: 400011 - RNA, 15 nt, Bordetella pertussis
gcaggugcgccagca

SEQ ID NO: 400012 - RNA, 17 nt, Bordetella pertussis
gcaggugcggccgcagc

SEQ ID NO: 400013 - RNA, 20 nt, Bordetella pertussis
gcaguaugcaaccggcacgu

SEQ ID NO: 400014 - RNA, 14 nt, Bordetella pertussis
gcagucccaguccg

SEQ ID NO: 400015 - RNA, 22 nt, Bordetella pertussis
gcagucccaguccggcagcacc

SEQ ID NO: 400016 - RNA, 21 nt, Bordetella pertussis
gcaguccucguugcccgcggu

SEQ ID NO: 400017 - RNA, 13 nt, Bordetella pertussis
gcagucggcagga

SEQ ID NO: 400018 - RNA, 21 nt, Bordetella pertussis
gcagugcgcgcgcccccagcg

SEQ ID NO: 400019 - RNA, 15 nt, Bordetella pertussis
gcauacucgaugccc

SEQ ID NO: 400020 - RNA, 17 nt, Bordetella pertussis
gcauagacgccgaccgc

SEQ ID NO: 400021 - RNA, 17 nt, Bordetella pertussis
gcauauggagccaggcg

SEQ ID NO: 400022 - RNA, 23 nt, Bordetella pertussis
gcaucaccagcucgcggcccugg

SEQ ID NO: 400023 - RNA, 13 nt, Bordetella pertussis
gcaucaccuucaa

SEQ ID NO: 400024 - RNA, 20 nt, Bordetella pertussis
gcaucacgccgguguucucg

SEQ ID NO: 400025 - RNA, 19 nt, Bordetella pertussis
gcaucacgcuggccgcgcc

SEQ ID NO: 400026 - RNA, 12 nt, Bordetella pertussis
gcaucagcggca

SEQ ID NO: 400027 - RNA, 17 nt, Bordetella pertussis
gcaucagcggcagcacg

SEQ ID NO: 400028 - RNA, 18 nt, Bordetella pertussis
gcaucaugaggcggcggu

SEQ ID NO: 400029 - RNA, 14 nt, Bordetella pertussis
gcaucauggcgcgc

SEQ ID NO: 400030 - RNA, 23 nt, Bordetella pertussis
gcaucccaauuggccgcccuggc

SEQ ID NO: 400031 - RNA, 19 nt, Bordetella pertussis
gcaucccgacaugccgccc

SEQ ID NO: 400032 - RNA, 16 nt, Bordetella pertussis
gcaucccgcccccgcc

SEQ ID NO: 400033 - RNA, 20 nt, Bordetella pertussis
gcaucccgcccccgccgcac

SEQ ID NO: 400034 - RNA, 14 nt, Bordetella pertussis
gcaucccggcgcuc

SEQ ID NO: 400035 - RNA, 15 nt, Bordetella pertussis
gcaucccugcuugcg

SEQ ID NO: 400036 - RNA, 19 nt, Bordetella pertussis
gcauccggcccggugcagc

SEQ ID NO: 400037 - RNA, 22 nt, Bordetella pertussis
gcauccggcccggugcagccgc

SEQ ID NO: 400038 - RNA, 19 nt, Bordetella pertussis
gcaucgaccacgcgcgcgc

SEQ ID NO: 400039 - RNA, 19 nt, Bordetella pertussis
gcaucgccaugccggcccc

SEQ ID NO: 400040 - RNA, 13 nt, Bordetella pertussis
gcaucgcccugcu

SEQ ID NO: 400041 - RNA, 15 nt, Bordetella pertussis
gcaucgccgcgggcg

SEQ ID NO: 400042 - RNA, 16 nt, Bordetella pertussis
gcaucggccacgcugc

SEQ ID NO: 400043 - RNA, 19 nt, Bordetella pertussis
gcaucggccauggcgguga

SEQ ID NO: 400044 - RNA, 16 nt, Bordetella pertussis
gcaucggccugcaccg

SEQ ID NO: 400045 - RNA, 15 nt, Bordetella pertussis
gcaucggcgccgcgc

SEQ ID NO: 400046 - RNA, 13 nt, Bordetella pertussis
gcaucggcggcag

SEQ ID NO: 400047 - RNA, 22 nt, Bordetella pertussis
gcaucggcggcaggucggugca

SEQ ID NO: 400048 - RNA, 13 nt, Bordetella pertussis
gcaucggcggcuu

SEQ ID NO: 400049 - RNA, 19 nt, Bordetella pertussis
gcaucggcguaccaggcag

SEQ ID NO: 400050 - RNA, 15 nt, Bordetella pertussis
gcaucggcuggcgca

SEQ ID NO: 400051 - RNA, 20 nt, Bordetella pertussis
gcaucguaguugggcgccuu

SEQ ID NO: 400052 - RNA, 22 nt, Bordetella pertussis
gcaucguauggcggggugccug

SEQ ID NO: 400053 - RNA, 18 nt, Bordetella pertussis
gcaucgucauuacccaug

SEQ ID NO: 400054 - RNA, 16 nt, Bordetella pertussis
gcaucguucagucgag

SEQ ID NO: 400055 - RNA, 22 nt, Bordetella pertussis
gcaucuccaggaugcgcgacac

SEQ ID NO: 400056 - RNA, 14 nt, Bordetella pertussis
gcaucugccccagc

SEQ ID NO: 400057 - RNA, 23 nt, Bordetella pertussis
gcaucugccccagcuugucggcc

SEQ ID NO: 400058 - RNA, 18 nt, Bordetella pertussis
gcaucuuggccgccacgc

SEQ ID NO: 400059 - RNA, 18 nt, Bordetella pertussis
gcaugaagcgcagcagau

SEQ ID NO: 400060 - RNA, 19 nt, Bordetella pertussis
gcaugaagcugcccagcaa

SEQ ID NO: 400061 - RNA, 13 nt, Bordetella pertussis
gcaugaccgccgg

SEQ ID NO: 400062 - RNA, 15 nt, Bordetella pertussis
gcaugacggccagga

SEQ ID NO: 400063 - RNA, 20 nt, Bordetella pertussis
gcaugacggccaggauggcg

SEQ ID NO: 400064 - RNA, 15 nt, Bordetella pertussis
gcaugacggggucgg

SEQ ID NO: 400065 - RNA, 15 nt, Bordetella pertussis
gcaugacgaccgcga

SEQ ID NO: 400066 - RNA, 15 nt, Bordetella pertussis
gcaugauggccggcc

SEQ ID NO: 400067 - RNA, 17 nt, Bordetella pertussis
gcaugauggccggccug

SEQ ID NO: 400068 - RNA, 24 nt, Bordetella pertussis
gcaugaugucgcgggcccgcucgg

SEQ ID NO: 400069 - RNA, 23 nt, Bordetella pertussis
gcaugccagcuugcaggcgccuu

SEQ ID NO: 400070 - RNA, 20 nt, Bordetella pertussis
gcaugccauggacgagggcc

SEQ ID NO: 400071 - RNA, 20 nt, Bordetella pertussis
gcaugccgaccaccagcacc

SEQ ID NO: 400072 - RNA, 17 nt, Bordetella pertussis
gcaugccgaucagcggg

SEQ ID NO: 400073 - RNA, 18 nt, Bordetella pertussis
gcaugccgaucagcgggc

SEQ ID NO: 400074 - RNA, 19 nt, Bordetella pertussis
gcaugccgcgguggcgggc

SEQ ID NO: 400075 - RNA, 23 nt, Bordetella pertussis
gcaugccguccacgcccagcgcc

SEQ ID NO: 400076 - RNA, 12 nt, Bordetella pertussis
gcaugccgucgc

SEQ ID NO: 400077 - RNA, 16 nt, Bordetella pertussis
gcaugcgacaugagcu

SEQ ID NO: 400078 - RNA, 16 nt, Bordetella pertussis
gcaugcgccagccagc

SEQ ID NO: 400079 - RNA, 19 nt, Bordetella pertussis
gcaugcgccagccagcgca

SEQ ID NO: 400080 - RNA, 15 nt, Bordetella pertussis
gcaugcgccagcgcc

SEQ ID NO: 400081 - RNA, 17 nt, Bordetella pertussis
gcaugcgccagcgccug

SEQ ID NO: 400082 - RNA, 12 nt, Bordetella pertussis
gcaugcgcgcca

SEQ ID NO: 400083 - RNA, 21 nt, Bordetella pertussis
gcaugcgcuggucgcgcagca

SEQ ID NO: 400084 - RNA, 19 nt, Bordetella pertussis
gcaugcggcacaaccuggc

SEQ ID NO: 400085 - RNA, 14 nt, Bordetella pertussis
gcaugcggcggcug

SEQ ID NO: 400086 - RNA, 15 nt, Bordetella pertussis
gcaugcggcguccug

SEQ ID NO: 400087 - RNA, 17 nt, Bordetella pertussis
gcaugcggcguccugcc

SEQ ID NO: 400088 - RNA, 13 nt, Bordetella pertussis
gcaugcuggucau

SEQ ID NO: 400089 - RNA, 15 nt, Bordetella pertussis
gcauggacugcaggc

SEQ ID NO: 400090 - RNA, 16 nt, Bordetella pertussis
gcauggacugcaggcg

SEQ ID NO: 400091 - RNA, 14 nt, Bordetella pertussis
gcauggagaccggc

SEQ ID NO: 400092 - RNA, 14 nt, Bordetella pertussis
gcauggcagcagau

SEQ ID NO: 400093 - RNA, 23 nt, Bordetella pertussis
gcauggccaccagguagggcagc

SEQ ID NO: 400094 - RNA, 15 nt, Bordetella pertussis
gcauggcgccagcug

SEQ ID NO: 400095 - RNA, 17 nt, Bordetella pertussis
gcauggcgccgcgcgcc

SEQ ID NO: 400096 - RNA, 14 nt, Bordetella pertussis
gcauggcgcgugcg

SEQ ID NO: 400097 - RNA, 16 nt, Bordetella pertussis
gcauggcggccaggcg

SEQ ID NO: 400098 - RNA, 16 nt, Bordetella pertussis
gcauggcggcgcccgc

SEQ ID NO: 400099 - RNA, 17 nt, Bordetella pertussis
gcauggcgguggccagc

SEQ ID NO: 400100 - RNA, 20 nt, Bordetella pertussis
gcaugggagaguucauccac

SEQ ID NO: 400101 - RNA, 17 nt, Bordetella pertussis
gcaugggcacauacagc

SEQ ID NO: 400102 - RNA, 14 nt, Bordetella pertussis
gcaugggccaggcg

SEQ ID NO: 400103 - RNA, 20 nt, Bordetella pertussis
gcaugggcgcaggccgccac

SEQ ID NO: 400104 - RNA, 18 nt, Bordetella pertussis
gcaugggcgcgcccggcg

SEQ ID NO: 400105 - RNA, 20 nt, Bordetella pertussis
gcaugguagcgguccagcug

SEQ ID NO: 400106 - RNA, 22 nt, Bordetella pertussis
gcaugguggcgcaggcaaagcc

SEQ ID NO: 400107 - RNA, 16 nt, Bordetella pertussis
gcauggugagggccac

SEQ ID NO: 400108 - RNA, 23 nt, Bordetella pertussis
gcaugucccgcaugaccugcagg

SEQ ID NO: 400109 - RNA, 14 nt, Bordetella pertussis
gcauguccgccaug

SEQ ID NO: 400110 - RNA, 20 nt, Bordetella pertussis
gcauguccguaucgcggccg

SEQ ID NO: 400111 - RNA, 14 nt, Bordetella pertussis
gcauuaccagcaac

SEQ ID NO: 400112 - RNA, 21 nt, Bordetella pertussis
gcauucccgcccagcgacgag

SEQ ID NO: 400113 - RNA, 14 nt, Bordetella pertussis
gcauucgcagaagg

SEQ ID NO: 400114 - RNA, 17 nt, Bordetella pertussis
gcauucgcgccugagcu

SEQ ID NO: 400115 - RNA, 18 nt, Bordetella pertussis
gcauucgcgccugagcug

SEQ ID NO: 400116 - RNA, 19 nt, Bordetella pertussis
gcauucgcgccugagcugc

SEQ ID NO: 400117 - RNA, 17 nt, Bordetella pertussis
gcauucggcggccggcu

SEQ ID NO: 400118 - RNA, 15 nt, Bordetella pertussis
gcauucgucgcugcc

SEQ ID NO: 400119 - RNA, 15 nt, Bordetella pertussis
gcauucgugaugccc

SEQ ID NO: 400120 - RNA, 18 nt, Bordetella pertussis
gcauugagcacuuucgac

SEQ ID NO: 400121 - RNA, 19 nt, Bordetella pertussis
gcauugccgccgcccugcc

SEQ ID NO: 400122 - RNA, 14 nt, Bordetella pertussis
gcauugccgcggca

SEQ ID NO: 400123 - RNA, 20 nt, Bordetella pertussis
gcauugccggagcagcagcg

SEQ ID NO: 400124 - RNA, 23 nt, Bordetella pertussis
gcauugcggcugggugcggucag

SEQ ID NO: 400125 - RNA, 18 nt, Bordetella pertussis
gcauuggcccugcugggg

SEQ ID NO: 400126 - RNA, 12 nt, Bordetella pertussis
gcauuggcggcg

SEQ ID NO: 400127 - RNA, 21 nt, Bordetella pertussis
gcauuggcggcggcguucagg

SEQ ID NO: 400128 - RNA, 12 nt, Bordetella pertussis
gcauuggugagc

SEQ ID NO: 400129 - RNA, 14 nt, Bordetella pertussis
gcauuucgcgugcg

SEQ ID NO: 400130 - RNA, 17 nt, Bordetella pertussis
gcauuucucggccuggg

SEQ ID NO: 400131 - RNA, 14 nt, Bordetella pertussis
gcauuucuuccagu

SEQ ID NO: 400132 - RNA, 22 nt, Bordetella pertussis
gcauuucuuccaguugcgggcg

SEQ ID NO: 400133 - RNA, 13 nt, Bordetella pertussis
gccaaagcacagg

SEQ ID NO: 400134 - RNA, 17 nt, Bordetella pertussis
gccaacagcucgcgcca

SEQ ID NO: 400135 - RNA, 21 nt, Bordetella pertussis
gccaacagcucgcgccagggc

SEQ ID NO: 400136 - RNA, 20 nt, Bordetella pertussis
gccaaccccgagggcgcggc

SEQ ID NO: 400137 - RNA, 13 nt, Bordetella pertussis
gccaacccucgca

SEQ ID NO: 400138 - RNA, 18 nt, Bordetella pertussis
gccaacgcggcgcgugca

SEQ ID NO: 400139 - RNA, 22 nt, Bordetella pertussis
gccaacggcuggcugggcgcgc

SEQ ID NO: 400140 - RNA, 14 nt, Bordetella pertussis
gccaacgucggcag

SEQ ID NO: 400141 - RNA, 15 nt, Bordetella pertussis
gccaagauccagcuu

SEQ ID NO: 400142 - RNA, 17 nt, Bordetella pertussis
gccaagauccagcuuca

SEQ ID NO: 400143 - RNA, 14 nt, Bordetella pertussis
gccaagcgccgcgg

SEQ ID NO: 400144 - RNA, 18 nt, Bordetella pertussis
gccaagcggcaggcggca

SEQ ID NO: 400145 - RNA, 21 nt, Bordetella pertussis
gccaaggccggcgcgucgcgc

SEQ ID NO: 400146 - RNA, 19 nt, Bordetella pertussis
gccaaggcauuggcgccgc

SEQ ID NO: 400147 - RNA, 12 nt, Bordetella pertussis
gccaagggcgcc

SEQ ID NO: 400148 - RNA, 22 nt, Bordetella pertussis
gccaagggcgugcgcuugcgca

SEQ ID NO: 400149 - RNA, 21 nt, Bordetella pertussis
gccaaucaugcgcugcuggcc

SEQ ID NO: 400150 - RNA, 18 nt, Bordetella pertussis
gccaaucggccugcuggu

SEQ ID NO: 400151 - RNA, 21 nt, Bordetella pertussis
gccaaucugccgcugaccggc

SEQ ID NO: 400152 - RNA, 17 nt, Bordetella pertussis
gccaaugccauuggugc

SEQ ID NO: 400153 - RNA, 16 nt, Bordetella pertussis
gccaauugcuugccug

SEQ ID NO: 400154 - RNA, 18 nt, Bordetella pertussis
gccaauuguccuggucga

SEQ ID NO: 400155 - RNA, 13 nt, Bordetella pertussis
gccacaagcggcc

SEQ ID NO: 400156 - RNA, 14 nt, Bordetella pertussis
gccacaagcggccc

SEQ ID NO: 400157 - RNA, 16 nt, Bordetella pertussis
gccacaagcggcccca

SEQ ID NO: 400158 - RNA, 18 nt, Bordetella pertussis
gccacaagcggccccagg

SEQ ID NO: 400159 - RNA, 22 nt, Bordetella pertussis
gccacacauagggugccugucc

SEQ ID NO: 400160 - RNA, 23 nt, Bordetella pertussis
gccacaccagguugucggcgcca

SEQ ID NO: 400161 - RNA, 13 nt, Bordetella pertussis
gccacacgaucag

SEQ ID NO: 400162 - RNA, 18 nt, Bordetella pertussis
gccacacgcugaagcgcc

SEQ ID NO: 400163 - RNA, 20 nt, Bordetella pertussis
gccacacgcugaagcgccgc

SEQ ID NO: 400164 - RNA, 18 nt, Bordetella pertussis
gccacacgggcgccugcc

SEQ ID NO: 400165 - RNA, 21 nt, Bordetella pertussis
gccacacgggcgccugccgca

SEQ ID NO: 400166 - RNA, 20 nt, Bordetella pertussis
gccacagcaugaccucggcc

SEQ ID NO: 400167 - RNA, 21 nt, Bordetella pertussis
gccacagcaugaccucggccu

SEQ ID NO: 400168 - RNA, 15 nt, Bordetella pertussis
gccacagcgccgcgg

SEQ ID NO: 400169 - RNA, 14 nt, Bordetella pertussis
gccacagcgcgugg

SEQ ID NO: 400170 - RNA, 20 nt, Bordetella pertussis
gccacagcgugacggcggcg

SEQ ID NO: 400171 - RNA, 21 nt, Bordetella pertussis
gccaccaacgaaggcauccag

SEQ ID NO: 400172 - RNA, 22 nt, Bordetella pertussis
gccaccacaaggauggacuggc

SEQ ID NO: 400173 - RNA, 15 nt, Bordetella pertussis
gccaccaugucccug

SEQ ID NO: 400174 - RNA, 12 nt, Bordetella pertussis
gccacccagcuc

SEQ ID NO: 400175 - RNA, 17 nt, Bordetella pertussis
gccacccagcucagcgg

SEQ ID NO: 400176 - RNA, 14 nt, Bordetella pertussis
gccacccaggcggc

SEQ ID NO: 400177 - RNA, 20 nt, Bordetella pertussis
gccacccaggcggcaggcgc

SEQ ID NO: 400178 - RNA, 22 nt, Bordetella pertussis
gccacccaggcggcaggcgccg

SEQ ID NO: 400179 - RNA, 18 nt, Bordetella pertussis
gccaccccgucaucgccg

SEQ ID NO: 400180 - RNA, 12 nt, Bordetella pertussis
gccacccgccgu

SEQ ID NO: 400181 - RNA, 22 nt, Bordetella pertussis
gccaccgccugugccagcuggc

SEQ ID NO: 400182 - RNA, 23 nt, Bordetella pertussis
gccaccgccugugccagcuggcc

SEQ ID NO: 400183 - RNA, 19 nt, Bordetella pertussis
gccaccgacaagccggucg

SEQ ID NO: 400184 - RNA, 14 nt, Bordetella pertussis
gccaccgcggcgga

SEQ ID NO: 400185 - RNA, 19 nt, Bordetella pertussis
gccaccgcggugccgcgcg

SEQ ID NO: 400186 - RNA, 19 nt, Bordetella pertussis
gccaccgcguugagcgccg

SEQ ID NO: 400187 - RNA, 16 nt, Bordetella pertussis
gccacugcguccuuga

SEQ ID NO: 400188 - RNA, 14 nt, Bordetella pertussis
gccacuggccuugu

SEQ ID NO: 400189 - RNA, 21 nt, Bordetella pertussis
gccacuuccuggugggcggca

SEQ ID NO: 400190 - RNA, 16 nt, Bordetella pertussis
gccagaaagcgcggcc

SEQ ID NO: 400191 - RNA, 15 nt, Bordetella pertussis
gccagcaagcgcgcc

SEQ ID NO: 400192 - RNA, 13 nt, Bordetella pertussis
gccagcaagcgcu

SEQ ID NO: 400193 - RNA, 19 nt, Bordetella pertussis
gccagcacauacgccgccg

SEQ ID NO: 400194 - RNA, 24 nt, Bordetella pertussis
gccagcacauacgccgccgaggcg

SEQ ID NO: 400195 - RNA, 16 nt, Bordetella pertussis
gccagcaccggcccga

SEQ ID NO: 400196 - RNA, 15 nt, Bordetella pertussis
gccagcaccggccgc

SEQ ID NO: 400197 - RNA, 18 nt, Bordetella pertussis
gccagcacgaucacgaac

SEQ ID NO: 400198 - RNA, 19 nt, Bordetella pertussis
gccagcagcgacggcccca

SEQ ID NO: 400199 - RNA, 15 nt, Bordetella pertussis
gccagcagcgccgcc

SEQ ID NO: 400200 - RNA, 16 nt, Bordetella pertussis
gccagcagcgccgcca

SEQ ID NO: 400201 - RNA, 18 nt, Bordetella pertussis
gccagcagcgccgccagc

SEQ ID NO: 400202 - RNA, 20 nt, Bordetella pertussis
gccagcagcgccggaaagcu

SEQ ID NO: 400203 - RNA, 19 nt, Bordetella pertussis
gccagcagcgcgugcagcc

SEQ ID NO: 400204 - RNA, 14 nt, Bordetella pertussis
gccagcagcgggcu

SEQ ID NO: 400205 - RNA, 17 nt, Bordetella pertussis
gccagcagcgggcuggg

SEQ ID NO: 400206 - RNA, 20 nt, Bordetella pertussis
gccagcagcgggcuggggca

SEQ ID NO: 400207 - RNA, 15 nt, Bordetella pertussis
gccagcagcucggcc

SEQ ID NO: 400208 - RNA, 18 nt, Bordetella pertussis
gccagcagcucggcgacc

SEQ ID NO: 400209 - RNA, 22 nt, Bordetella pertussis
gccagcagcucggcgaccaggc

SEQ ID NO: 400210 - RNA, 17 nt, Bordetella pertussis
gccagcauacccugcgc

SEQ ID NO: 400211 - RNA, 14 nt, Bordetella pertussis
gccagcauccagcc

SEQ ID NO: 400212 - RNA, 22 nt, Bordetella pertussis
gccagcaucggcacccagccgg

SEQ ID NO: 400213 - RNA, 19 nt, Bordetella pertussis
gccagcaucggcucgagca

SEQ ID NO: 400214 - RNA, 22 nt, Bordetella pertussis
gccagcaucguaucgggcguca

SEQ ID NO: 400215 - RNA, 22 nt, Bordetella pertussis
gccagcaugacggggucggggc

SEQ ID NO: 400216 - RNA, 23 nt, Bordetella pertussis
gccagcaugacggggucggggca

SEQ ID NO: 400217 - RNA, 19 nt, Bordetella pertussis
gccagcaugcgcgcggccu

SEQ ID NO: 400218 - RNA, 16 nt, Bordetella pertussis
gccagccacgccggcg

SEQ ID NO: 400219 - RNA, 21 nt, Bordetella pertussis
gccagccacgcgcgcuggcgc

SEQ ID NO: 400220 - RNA, 13 nt, Bordetella pertussis
gccagccagcgca

SEQ ID NO: 400221 - RNA, 18 nt, Bordetella pertussis
gccagccagcgccgcagc

SEQ ID NO: 400222 - RNA, 14 nt, Bordetella pertussis
gccagccccaccuu

SEQ ID NO: 400223 - RNA, 17 nt, Bordetella pertussis
gccagccccaccuugcc

SEQ ID NO: 400224 - RNA, 22 nt, Bordetella pertussis
gccagccccaccuugcccagca

SEQ ID NO: 400225 - RNA, 18 nt, Bordetella pertussis
gccagccccggcgcgccg

SEQ ID NO: 400226 - RNA, 15 nt, Bordetella pertussis
gccagcccgacggcc

SEQ ID NO: 400227 - RNA, 16 nt, Bordetella pertussis
gccagcccgacggcca

SEQ ID NO: 400228 - RNA, 18 nt, Bordetella pertussis
gccagcccgacggccagc

SEQ ID NO: 400229 - RNA, 22 nt, Bordetella pertussis
gccagcccgacggccagcgcga

SEQ ID NO: 400230 - RNA, 13 nt, Bordetella pertussis
gccagcccgcccg

SEQ ID NO: 400231 - RNA, 14 nt, Bordetella pertussis
gccagcccgcccgc

SEQ ID NO: 400232 - RNA, 12 nt, Bordetella pertussis
gccagcccgccg

SEQ ID NO: 400233 - RNA, 13 nt, Bordetella pertussis
gccagcccgccgc

SEQ ID NO: 400234 - RNA, 13 nt, Bordetella pertussis
gccagcccgcugc

SEQ ID NO: 400235 - RNA, 15 nt, Bordetella pertussis
gccagcccgcugccg

SEQ ID NO: 400236 - RNA, 15 nt, Bordetella pertussis
gccagcccuggccca

SEQ ID NO: 400237 - RNA, 14 nt, Bordetella pertussis
gccagccgccgcgc

SEQ ID NO: 400238 - RNA, 15 nt, Bordetella pertussis
gccagccgccgcgcg

SEQ ID NO: 400239 - RNA, 17 nt, Bordetella pertussis
gccagccgccgcgcggc

SEQ ID NO: 400240 - RNA, 18 nt, Bordetella pertussis
gccagccgcgccugcagc

SEQ ID NO: 400241 - RNA, 15 nt, Bordetella pertussis
gccagccgcgcgacc

SEQ ID NO: 400242 - RNA, 12 nt, Bordetella pertussis
gccagccugccc

SEQ ID NO: 400243 - RNA, 20 nt, Bordetella pertussis
gccagccugccgcggccgcc

SEQ ID NO: 400244 - RNA, 21 nt, Bordetella pertussis
gccagccugccgcggccgccc

SEQ ID NO: 400245 - RNA, 17 nt, Bordetella pertussis
gccagccugugcgccau

SEQ ID NO: 400246 - RNA, 14 nt, Bordetella pertussis
gccagccuggcgcc

SEQ ID NO: 400247 - RNA, 21 nt, Bordetella pertussis
gccagccuuggcccacucaug

SEQ ID NO: 400248 - RNA, 23 nt, Bordetella pertussis
gccagcgacccgcaaaaccgggc

SEQ ID NO: 400249 - RNA, 12 nt, Bordetella pertussis
gccagcgccgcc

SEQ ID NO: 400250 - RNA, 18 nt, Bordetella pertussis
gccagcgccgccagccgc

SEQ ID NO: 400251 - RNA, 13 nt, Bordetella pertussis
gccagcgccgcga

SEQ ID NO: 400252 - RNA, 14 nt, Bordetella pertussis
gccagcgccgcgcg

SEQ ID NO: 400253 - RNA, 13 nt, Bordetella pertussis
gccagcgccggcg

SEQ ID NO: 400254 - RNA, 16 nt, Bordetella pertussis
gccagcgccggcgcgu

SEQ ID NO: 400255 - RNA, 18 nt, Bordetella pertussis
gccagcgccggcgcgucc

SEQ ID NO: 400256 - RNA, 13 nt, Bordetella pertussis
gccagcgccgggg

SEQ ID NO: 400257 - RNA, 18 nt, Bordetella pertussis
gccagcgccugcgcggcc

SEQ ID NO: 400258 - RNA, 19 nt, Bordetella pertussis
gccagcgccugcgcggccu

SEQ ID NO: 400259 - RNA, 21 nt, Bordetella pertussis
gccagcgccugcgcggccucg

SEQ ID NO: 400260 - RNA, 12 nt, Bordetella pertussis
gccagcgccugg

SEQ ID NO: 400261 - RNA, 22 nt, Bordetella pertussis
gccagcgccuccaucagcagca

SEQ ID NO: 400262 - RNA, 15 nt, Bordetella pertussis
gccagcgccugggcg

SEQ ID NO: 400263 - RNA, 18 nt, Bordetella pertussis
gccagcgcgacgggcacc

SEQ ID NO: 400264 - RNA, 19 nt, Bordetella pertussis
gccagcgcgacgggcaccg

SEQ ID NO: 400265 - RNA, 18 nt, Bordetella pertussis
gccagcgcuguccaggcc

SEQ ID NO: 400266 - RNA, 20 nt, Bordetella pertussis
gccagcgcuguccaggccgg

SEQ ID NO: 400267 - RNA, 14 nt, Bordetella pertussis
gccagcggcaggcc

SEQ ID NO: 400268 - RNA, 16 nt, Bordetella pertussis
gccagcggcaggggcu

SEQ ID NO: 400269 - RNA, 23 nt, Bordetella pertussis
gccagcggcaggggcucgcgccc

SEQ ID NO: 400270 - RNA, 20 nt, Bordetella pertussis
gccagcggcagcgcgcagga

SEQ ID NO: 400271 - RNA, 14 nt, Bordetella pertussis
gccagcggcgcagc

SEQ ID NO: 400272 - RNA, 16 nt, Bordetella pertussis
gccagcgugcccagcg

SEQ ID NO: 400273 - RNA, 18 nt, Bordetella pertussis
gccagcgugcccagcgag

SEQ ID NO: 400274 - RNA, 23 nt, Bordetella pertussis
gccagcguucggccacccggccc

SEQ ID NO: 400275 - RNA, 21 nt, Bordetella pertussis
gccagcucuucgagcgcggcg

SEQ ID NO: 400276 - RNA, 20 nt, Bordetella pertussis
gccagcugaccucgcccagg

SEQ ID NO: 400277 - RNA, 20 nt, Bordetella pertussis
gccagcugcaugcgcacgga

SEQ ID NO: 400278 - RNA, 12 nt, Bordetella pertussis
gccagcugcgca

SEQ ID NO: 400279 - RNA, 14 nt, Bordetella pertussis
gccagcugcgcccc

SEQ ID NO: 400280 - RNA, 13 nt, Bordetella pertussis
gccagcugcgcag

SEQ ID NO: 400281 - RNA, 13 nt, Bordetella pertussis
gccagcuggccca

SEQ ID NO: 400282 - RNA, 14 nt, Bordetella pertussis
gccagcuggcggcg

SEQ ID NO: 400283 - RNA, 19 nt, Bordetella pertussis
gccagcuggcggcgcagca

SEQ ID NO: 400284 - RNA, 20 nt, Bordetella pertussis
gccagcuggaccgccuggcc

SEQ ID NO: 400285 - RNA, 21 nt, Bordetella pertussis
gccaggaucgcggccagccgg

SEQ ID NO: 400286 - RNA, 11 nt, Bordetella pertussis
gccaggaugag

SEQ ID NO: 400287 - RNA, 20 nt, Bordetella pertussis
gccaggcaaaggcccaggca

SEQ ID NO: 400288 - RNA, 22 nt, Bordetella pertussis
gccaggccgauuucggccgccg

SEQ ID NO: 400289 - RNA, 12 nt, Bordetella pertussis
gccaggccggcc

SEQ ID NO: 400290 - RNA, 12 nt, Bordetella pertussis
gccaggccgcau

SEQ ID NO: 400291 - RNA, 14 nt, Bordetella pertussis
gccaggccggcggc

SEQ ID NO: 400292 - RNA, 14 nt, Bordetella pertussis
gccaggccggggcc

SEQ ID NO: 400293 - RNA, 21 nt, Bordetella pertussis
gccaggccuucgacguccagc

SEQ ID NO: 400294 - RNA, 16 nt, Bordetella pertussis
gccaggcgagcgccgc

SEQ ID NO: 400295 - RNA, 15 nt, Bordetella pertussis
gccaggcgcccggcg

SEQ ID NO: 400296 - RNA, 14 nt, Bordetella pertussis
gccaggcgccgcgu

SEQ ID NO: 400297 - RNA, 17 nt, Bordetella pertussis
gccaggcgccgcucagc

SEQ ID NO: 400298 - RNA, 14 nt, Bordetella pertussis
gccaggcgccggcg

SEQ ID NO: 400299 - RNA, 14 nt, Bordetella pertussis
gccaggcgccgggc

SEQ ID NO: 400300 - RNA, 18 nt, Bordetella pertussis
gccaggcgccgggccgcu

SEQ ID NO: 400301 - RNA, 16 nt, Bordetella pertussis
gccaggcgcaguaucu

SEQ ID NO: 400302 - RNA, 22 nt, Bordetella pertussis
gccaggcgcauguccgccacgc

SEQ ID NO: 400303 - RNA, 13 nt, Bordetella pertussis
gccaggcgcgccg

SEQ ID NO: 400304 - RNA, 13 nt, Bordetella pertussis
gccaggcgcucgg

SEQ ID NO: 400305 - RNA, 14 nt, Bordetella pertussis
gccaggcgcugcgc

SEQ ID NO: 400306 - RNA, 23 nt, Bordetella pertussis
gccaggcgguacaggccggcggc

SEQ ID NO: 400307 - RNA, 17 nt, Bordetella pertussis
gccaggcgguggccucg

SEQ ID NO: 400308 - RNA, 19 nt, Bordetella pertussis
gccaggcguagaccaccug

SEQ ID NO: 400309 - RNA, 21 nt, Bordetella pertussis
gccaggcggcggcgcggcgcc

SEQ ID NO: 400310 - RNA, 16 nt, Bordetella pertussis
gccaggcugaccagcg

SEQ ID NO: 400311 - RNA, 22 nt, Bordetella pertussis
gccaggcugucccagauggcgc

SEQ ID NO: 400312 - RNA, 12 nt, Bordetella pertussis
gccagggcggcg

SEQ ID NO: 400313 - RNA, 20 nt, Bordetella pertussis
gccagggcggcgacuucgcc

SEQ ID NO: 400314 - RNA, 17 nt, Bordetella pertussis
gccaggggcgcuggucg

SEQ ID NO: 400315 - RNA, 18 nt, Bordetella pertussis
gccagggucugcuggucg

SEQ ID NO: 400316 - RNA, 19 nt, Bordetella pertussis
gccagggugaccuggcgcg

SEQ ID NO: 400317 - RNA, 12 nt, Bordetella pertussis
gccagggugcac

SEQ ID NO: 400318 - RNA, 17 nt, Bordetella pertussis
gccagggugccccgccg

SEQ ID NO: 400319 - RNA, 13 nt, Bordetella pertussis
gccaggugcuugc

SEQ ID NO: 400320 - RNA, 13 nt, Bordetella pertussis
gccaggugggcca

SEQ ID NO: 400321 - RNA, 17 nt, Bordetella pertussis
gccagguucgccuggcg

SEQ ID NO: 400322 - RNA, 15 nt, Bordetella pertussis
gccagguucuggucg

SEQ ID NO: 400323 - RNA, 20 nt, Bordetella pertussis
gccagguugggugcgccgcc

SEQ ID NO: 400324 - RNA, 21 nt, Bordetella pertussis
gccagguugggugcgccgccg

SEQ ID NO: 400325 - RNA, 14 nt, Bordetella pertussis
gccaguagcgugug

SEQ ID NO: 400326 - RNA, 18 nt, Bordetella pertussis
gccaguagcgugugcagg

SEQ ID NO: 400327 - RNA, 14 nt, Bordetella pertussis
gccaguaggcgccc

SEQ ID NO: 400328 - RNA, 18 nt, Bordetella pertussis
gccaguaggcgccccagg

SEQ ID NO: 400329 - RNA, 12 nt, Bordetella pertussis
gccaguccagcg

SEQ ID NO: 400330 - RNA, 20 nt, Bordetella pertussis
gccaguccagcgcgccgcga

SEQ ID NO: 400331 - RNA, 19 nt, Bordetella pertussis
gccaguccccaugcggccc

SEQ ID NO: 400332 - RNA, 18 nt, Bordetella pertussis
gccagucccccgcgggga

SEQ ID NO: 400333 - RNA, 17 nt, Bordetella pertussis
gccaguccccgcaggga

SEQ ID NO: 400334 - RNA, 18 nt, Bordetella pertussis
gccaguccccgcagggac

SEQ ID NO: 400335 - RNA, 19 nt, Bordetella pertussis
gccaguccccgcaugggga

SEQ ID NO: 400336 - RNA, 21 nt, Bordetella pertussis
gccaguccccgcauggggacu

SEQ ID NO: 400337 - RNA, 22 nt, Bordetella pertussis
gccaguccccguucggggacag

SEQ ID NO: 400338 - RNA, 21 nt, Bordetella pertussis
gccaguccccugcggggacag

SEQ ID NO: 400339 - RNA, 15 nt, Bordetella pertussis
gccaguccgcagcgc

SEQ ID NO: 400340 - RNA, 20 nt, Bordetella pertussis
gccaucacaucgcuaugcag

SEQ ID NO: 400341 - RNA, 15 nt, Bordetella pertussis
gccaucaccgccucc

SEQ ID NO: 400342 - RNA, 16 nt, Bordetella pertussis
gccaucaggugcaggg

SEQ ID NO: 400343 - RNA, 18 nt, Bordetella pertussis
gccaucaggugcaggguu

SEQ ID NO: 400344 - RNA, 23 nt, Bordetella pertussis
gccaucauccuggucgacgcgac

SEQ ID NO: 400345 - RNA, 16 nt, Bordetella pertussis
gccauccggcgcauga

SEQ ID NO: 400346 - RNA, 22 nt, Bordetella pertussis
gccauccggccgcacgcggccg

SEQ ID NO: 400347 - RNA, 15 nt, Bordetella pertussis
gccauccugaacgcc

SEQ ID NO: 400348 - RNA, 16 nt, Bordetella pertussis
gccaucgaacuccugc

SEQ ID NO: 400349 - RNA, 17 nt, Bordetella pertussis
gccaucgaacuccugca

SEQ ID NO: 400350 - RNA, 21 nt, Bordetella pertussis
gccaucgaacuccugcaacca

SEQ ID NO: 400351 - RNA, 22 nt, Bordetella pertussis
gccaucgaacuccugcaaccag

SEQ ID NO: 400352 - RNA, 18 nt, Bordetella pertussis
gccaucgacgggcggcug

SEQ ID NO: 400353 - RNA, 22 nt, Bordetella pertussis
gccaucgauaugggcggccucg

SEQ ID NO: 400354 - RNA, 22 nt, Bordetella pertussis
gccaucuugcaggcgccagucc

SEQ ID NO: 400355 - RNA, 18 nt, Bordetella pertussis
gccaucuuggugcgcgcc

SEQ ID NO: 400356 - RNA, 20 nt, Bordetella pertussis
gccaugaccacgucgaccag

SEQ ID NO: 400357 - RNA, 18 nt, Bordetella pertussis
gccaugagccacaaucca

SEQ ID NO: 400358 - RNA, 21 nt, Bordetella pertussis
gccaugauacccauggccgug

SEQ ID NO: 400359 - RNA, 14 nt, Bordetella pertussis
gccaugcugggcca

SEQ ID NO: 400360 - RNA, 19 nt, Bordetella pertussis
gccauggacgagggccggc

SEQ ID NO: 400361 - RNA, 21 nt, Bordetella pertussis
gccauggacgaguugcucgga

SEQ ID NO: 400362 - RNA, 12 nt, Bordetella pertussis
gccauggaggcg

SEQ ID NO: 400363 - RNA, 14 nt, Bordetella pertussis
gccauggcacaggc

SEQ ID NO: 400364 - RNA, 22 nt, Bordetella pertussis
gccauggccacgacgagaguuu

SEQ ID NO: 400365 - RNA, 16 nt, Bordetella pertussis
gccauggccgcgcggc

SEQ ID NO: 400366 - RNA, 17 nt, Bordetella pertussis
gccauggcggccgccgc

SEQ ID NO: 400367 - RNA, 18 nt, Bordetella pertussis
gccauggcggccgccgcc

SEQ ID NO: 400368 - RNA, 14 nt, Bordetella pertussis
gccauggcggcggc

SEQ ID NO: 400369 - RNA, 18 nt, Bordetella pertussis
gccauggcggcggccacg

SEQ ID NO: 400370 - RNA, 22 nt, Bordetella pertussis
gccauggcgcgcagauugcgcu

SEQ ID NO: 400371 - RNA, 17 nt, Bordetella pertussis
gccauggucucccccuc

SEQ ID NO: 400372 - RNA, 20 nt, Bordetella pertussis
gccauggugaacggccccgc

SEQ ID NO: 400373 - RNA, 23 nt, Bordetella pertussis
gccauggugaacggccccgccag

SEQ ID NO: 400374 - RNA, 19 nt, Bordetella pertussis
gccauggugccgcgcaggc

SEQ ID NO: 400375 - RNA, 16 nt, Bordetella pertussis
gccauguucagcuuca

SEQ ID NO: 400376 - RNA, 15 nt, Bordetella pertussis
gccauguucgaccag

SEQ ID NO: 400377 - RNA, 17 nt, Bordetella pertussis
gccauguucgaccagga

SEQ ID NO: 400378 - RNA, 20 nt, Bordetella pertussis
gccauguucuucaggcucca

SEQ ID NO: 400379 - RNA, 17 nt, Bordetella pertussis
gccauucagaccggguu

SEQ ID NO: 400380 - RNA, 16 nt, Bordetella pertussis
gccauuccagcuccgg

SEQ ID NO: 400381 - RNA, 15 nt, Bordetella pertussis
gccauuccggcuggu

SEQ ID NO: 400382 - RNA, 17 nt, Bordetella pertussis
gccauucgauggcggcg

SEQ ID NO: 400383 - RNA, 15 nt, Bordetella pertussis
gccauugaaagcgcg

SEQ ID NO: 400384 - RNA, 14 nt, Bordetella pertussis
gccauugcgcggcc

SEQ ID NO: 400385 - RNA, 22 nt, Bordetella pertussis
gcccaacgaggacaaccaggaa

SEQ ID NO: 400386 - RNA, 18 nt, Bordetella pertussis
gcccaaggccccgcgacc

SEQ ID NO: 400387 - RNA, 22 nt, Bordetella pertussis
gcccaagucgaguucggcgcgc

SEQ ID NO: 400388 - RNA, 19 nt, Bordetella pertussis
gcccaauccgaucagcacg

SEQ ID NO: 400389 - RNA, 16 nt, Bordetella pertussis
gcccaaucgggcagca

SEQ ID NO: 400390 - RNA, 18 nt, Bordetella pertussis
gcccaaucgggcagcacg

SEQ ID NO: 400391 - RNA, 17 nt, Bordetella pertussis
gcccacaggaacaggcc

SEQ ID NO: 400392 - RNA, 20 nt, Bordetella pertussis
gcccacaggaacaggccggc

SEQ ID NO: 400393 - RNA, 21 nt, Bordetella pertussis
gcccacaggaacaggccggcc

SEQ ID NO: 400394 - RNA, 15 nt, Bordetella pertussis
gcccacagcgccccc

SEQ ID NO: 400395 - RNA, 19 nt, Bordetella pertussis
gcccacauagaccggcugc

SEQ ID NO: 400396 - RNA, 18 nt, Bordetella pertussis
gcccacauagcggccggc

SEQ ID NO: 400397 - RNA, 15 nt, Bordetella pertussis
gcccacauggcggcg

SEQ ID NO: 400398 - RNA, 13 nt, Bordetella pertussis
gcccaccaccagc

SEQ ID NO: 400399 - RNA, 22 nt, Bordetella pertussis
gcccaccaccagcgcggccagc

SEQ ID NO: 400400 - RNA, 18 nt, Bordetella pertussis
gcccaccagccgggcggc

SEQ ID NO: 400401 - RNA, 13 nt, Bordetella pertussis
gcccaccagcgcc

SEQ ID NO: 400402 - RNA, 19 nt, Bordetella pertussis
gcccaccaugagcacgccc

SEQ ID NO: 400403 - RNA, 21 nt, Bordetella pertussis
gcccaccaugagcacgcccca

SEQ ID NO: 400404 - RNA, 23 nt, Bordetella pertussis
gcccaccaugagcacgccccaau

SEQ ID NO: 400405 - RNA, 19 nt, Bordetella pertussis
gcccacccggcacgcgccg

SEQ ID NO: 400406 - RNA, 23 nt, Bordetella pertussis
gcccaccgacaugaccgcguccg

SEQ ID NO: 400407 - RNA, 13 nt, Bordetella pertussis
gcccaccgccagg

SEQ ID NO: 400408 - RNA, 14 nt, Bordetella pertussis
gcccaccgccagga

SEQ ID NO: 400409 - RNA, 14 nt, Bordetella pertussis
gcccaccgccgccc

SEQ ID NO: 400410 - RNA, 16 nt, Bordetella pertussis
gcccaccgccgcccgc

SEQ ID NO: 400411 - RNA, 12 nt, Bordetella pertussis
gcccaccgcauc

SEQ ID NO: 400412 - RNA, 18 nt, Bordetella pertussis
gcccaccgcaucgcgcag

SEQ ID NO: 400413 - RNA, 19 nt, Bordetella pertussis
gcccaccgcgaaccaggcc

SEQ ID NO: 400414 - RNA, 16 nt, Bordetella pertussis
gcccaccgggccggcc

SEQ ID NO: 400415 - RNA, 16 nt, Bordetella pertussis
gcccaccgugaccagc

SEQ ID NO: 400416 - RNA, 18 nt, Bordetella pertussis
gcccaccuuccugcugga

SEQ ID NO: 400417 - RNA, 19 nt, Bordetella pertussis
gcccacgacgaacaacacg

SEQ ID NO: 400418 - RNA, 21 nt, Bordetella pertussis
gcccacgaucaccacgcccgc

SEQ ID NO: 400419 - RNA, 13 nt, Bordetella pertussis
gcccacgccgccg

SEQ ID NO: 400420 - RNA, 14 nt, Bordetella pertussis
gcccacgccgccga

SEQ ID NO: 400421 - RNA, 13 nt, Bordetella pertussis
gcccacgccgccu

SEQ ID NO: 400422 - RNA, 17 nt, Bordetella pertussis
gcccacgccgccuggcc

SEQ ID NO: 400423 - RNA, 18 nt, Bordetella pertussis
gcccacgccgccuggccc

SEQ ID NO: 400424 - RNA, 22 nt, Bordetella pertussis
gcccacgccgcguucguucuug

SEQ ID NO: 400425 - RNA, 19 nt, Bordetella pertussis
gcccacgccuuccggcccc

SEQ ID NO: 400426 - RNA, 22 nt, Bordetella pertussis
gcccacgcgcacgacgucgcgc

SEQ ID NO: 400427 - RNA, 14 nt, Bordetella pertussis
gcccacgcgccgcc

SEQ ID NO: 400428 - RNA, 15 nt, Bordetella pertussis
gcccacgcgccgcca

SEQ ID NO: 400429 - RNA, 21 nt, Bordetella pertussis
gcccacgcgccgccaggcgcg

SEQ ID NO: 400430 - RNA, 16 nt, Bordetella pertussis
gcccacgcggcgcugc

SEQ ID NO: 400431 - RNA, 20 nt, Bordetella pertussis
gcccacgcggcgcugcuggc

SEQ ID NO: 400432 - RNA, 22 nt, Bordetella pertussis
gcccacggcaucgccgcgggcg

SEQ ID NO: 400433 - RNA, 14 nt, Bordetella pertussis
gcccacggccagca

SEQ ID NO: 400434 - RNA, 16 nt, Bordetella pertussis
gcccacggccagcacu

SEQ ID NO: 400435 - RNA, 14 nt, Bordetella pertussis
gcccagcagcgcca

SEQ ID NO: 400436 - RNA, 14 nt, Bordetella pertussis
gcccagcagcuccu

SEQ ID NO: 400437 - RNA, 15 nt, Bordetella pertussis
gcccagcagcuccuc

SEQ ID NO: 400438 - RNA, 17 nt, Bordetella pertussis
gcccagcagcuccucgg

SEQ ID NO: 400439 - RNA, 18 nt, Bordetella pertussis
gcccagcagcuccucggc

SEQ ID NO: 400440 - RNA, 14 nt, Bordetella pertussis
gcccagcagguccu

SEQ ID NO: 400441 - RNA, 17 nt, Bordetella pertussis
gcccagccacaccaggu

SEQ ID NO: 400442 - RNA, 15 nt, Bordetella pertussis
gcccagccagcccug

SEQ ID NO: 400443 - RNA, 16 nt, Bordetella pertussis
gcccagccagcccugg

SEQ ID NO: 400444 - RNA, 21 nt, Bordetella pertussis
gcccagccagcccuggcccag

SEQ ID NO: 400445 - RNA, 17 nt, Bordetella pertussis
gcccagccccgcggccg

SEQ ID NO: 400446 - RNA, 17 nt, Bordetella pertussis
gcccagcgagcugguga

SEQ ID NO: 400447 - RNA, 22 nt, Bordetella pertussis
gcccagcgcauaggacgccacc

SEQ ID NO: 400448 - RNA, 23 nt, Bordetella pertussis
gcccagcgcauaggacgccacca

SEQ ID NO: 400449 - RNA, 14 nt, Bordetella pertussis
gcccagcgccagca

SEQ ID NO: 400450 - RNA, 17 nt, Bordetella pertussis
gcccagcgccagcagca

SEQ ID NO: 400451 - RNA, 20 nt, Bordetella pertussis
gcccagcgccagcagcaggc

SEQ ID NO: 400452 - RNA, 14 nt, Bordetella pertussis
gcccagcgccaggg

SEQ ID NO: 400453 - RNA, 14 nt, Bordetella pertussis
gcccagcgccgccg

SEQ ID NO: 400454 - RNA, 15 nt, Bordetella pertussis
gcccagcgccgccga

SEQ ID NO: 400455 - RNA, 22 nt, Bordetella pertussis
gcccagcgccugcaaguccagc

SEQ ID NO: 400456 - RNA, 15 nt, Bordetella pertussis
gcccagcgcggccuu

SEQ ID NO: 400457 - RNA, 19 nt, Bordetella pertussis
gcccagcucugguccaggc

SEQ ID NO: 400458 - RNA, 21 nt, Bordetella pertussis
gcccagcucugguccaggcgg

SEQ ID NO: 400459 - RNA, 11 nt, Bordetella pertussis
gcccagcugca

SEQ ID NO: 400460 - RNA, 18 nt, Bordetella pertussis
gcccagcuggcgccccuu

SEQ ID NO: 400461 - RNA, 17 nt, Bordetella pertussis
gcccagcugggccacag

SEQ ID NO: 400462 - RNA, 18 nt, Bordetella pertussis
gcccagcugggccacagg

SEQ ID NO: 400463 - RNA, 19 nt, Bordetella pertussis
gcccagcugggccacaggg

SEQ ID NO: 400464 - RNA, 16 nt, Bordetella pertussis
gcccagcugggcggcg

SEQ ID NO: 400465 - RNA, 20 nt, Bordetella pertussis
gcccagcuguccaagcgcgu

SEQ ID NO: 400466 - RNA, 19 nt, Bordetella pertussis
gcccagcuugaacaggcag

SEQ ID NO: 400467 - RNA, 19 nt, Bordetella pertussis
gcccagcuugaugccgccg

SEQ ID NO: 400468 - RNA, 20 nt, Bordetella pertussis
gcccagcuugaugccgccga

SEQ ID NO: 400469 - RNA, 16 nt, Bordetella pertussis
gcccaggaugcccuug

SEQ ID NO: 400470 - RNA, 14 nt, Bordetella pertussis
gcccaggauggaga

SEQ ID NO: 400471 - RNA, 22 nt, Bordetella pertussis
gcccaggauggagagggccugg

SEQ ID NO: 400472 - RNA, 18 nt, Bordetella pertussis
gcccaggauggcgccagc

SEQ ID NO: 400473 - RNA, 21 nt, Bordetella pertussis
gcccaggauggcgccagcccg

SEQ ID NO: 400474 - RNA, 19 nt, Bordetella pertussis
gcccaggcaaugcgcaggc

SEQ ID NO: 400475 - RNA, 20 nt, Bordetella pertussis
gccccgugccgcggcgcggc

SEQ ID NO: 400476 - RNA, 21 nt, Bordetella pertussis
gccccguugucgccgcggccg

SEQ ID NO: 400477 - RNA, 20 nt, Bordetella pertussis
gccccguuucguaaggcugc

SEQ ID NO: 400478 - RNA, 14 nt, Bordetella pertussis
gccccucgcggggc

SEQ ID NO: 400479 - RNA, 16 nt, Bordetella pertussis
gcccgaaacgcgcagc

SEQ ID NO: 400480 - RNA, 18 nt, Bordetella pertussis
gcccgaaacgcgcagcac

SEQ ID NO: 400481 - RNA, 20 nt, Bordetella pertussis
gcccgaaacgcgcagcaccg

SEQ ID NO: 400482 - RNA, 18 nt, Bordetella pertussis
gcccgaaccggcaucccu

SEQ ID NO: 400483 - RNA, 20 nt, Bordetella pertussis
gcccgaaccggcaucccugc

SEQ ID NO: 400484 - RNA, 14 nt, Bordetella pertussis
gcccgaagcgcagc

SEQ ID NO: 400485 - RNA, 16 nt, Bordetella pertussis
gcccgaagcgcagcac

SEQ ID NO: 400486 - RNA, 14 nt, Bordetella pertussis
gcccgaagcggccc

SEQ ID NO: 400487 - RNA, 16 nt, Bordetella pertussis
gcccgaaggcagcggc

SEQ ID NO: 400488 - RNA, 21 nt, Bordetella pertussis
gcccgaagauuuccucgcgca

SEQ ID NO: 400489 - RNA, 17 nt, Bordetella pertussis
gcccgaauuccagcucu

SEQ ID NO: 400490 - RNA, 13 nt, Bordetella pertussis
gcccgagcggcgc

SEQ ID NO: 400491 - RNA, 16 nt, Bordetella pertussis
gcccgagcggcgccag

SEQ ID NO: 400492 - RNA, 13 nt, Bordetella pertussis
gcccgaggcgcgc

SEQ ID NO: 400493 - RNA, 17 nt, Bordetella pertussis
gcccgaggcggcgcggg

SEQ ID NO: 400494 - RNA, 15 nt, Bordetella pertussis
gcccgagggcgcguc

SEQ ID NO: 400495 - RNA, 17 nt, Bordetella pertussis
gcccgagugggaagacu

SEQ ID NO: 400496 - RNA, 21 nt, Bordetella pertussis
gcccgauaugcagccgcacca

SEQ ID NO: 400497 - RNA, 23 nt, Bordetella pertussis
gcccgaucgacggccgcaagcug

SEQ ID NO: 400498 - RNA, 17 nt, Bordetella pertussis
gcccgaucggccggccg

SEQ ID NO: 400499 - RNA, 20 nt, Bordetella pertussis
gcccgaucggccggccgggc

SEQ ID NO: 400500 - RNA, 15 nt, Bordetella pertussis
gcccgaugccgccau

SEQ ID NO: 400501 - RNA, 16 nt, Bordetella pertussis
gcccgaugccgccaug

SEQ ID NO: 400502 - RNA, 15 nt, Bordetella pertussis
gcccgaugcucgccg

SEQ ID NO: 400503 - RNA, 16 nt, Bordetella pertussis
gcccgcaacgccgccc

SEQ ID NO: 400504 - RNA, 15 nt, Bordetella pertussis
gcccgcaacgggccg

SEQ ID NO: 400505 - RNA, 18 nt, Bordetella pertussis
gcccgcaacgggccggcc

SEQ ID NO: 400506 - RNA, 18 nt, Bordetella pertussis
gcccgcacauacaaggcg

SEQ ID NO: 400507 - RNA, 15 nt, Bordetella pertussis
gcccgccagcgcggc

SEQ ID NO: 400508 - RNA, 19 nt, Bordetella pertussis
gcccgccaggaagcgggcc

SEQ ID NO: 400509 - RNA, 14 nt, Bordetella pertussis
gcccgccaggccag

SEQ ID NO: 400510 - RNA, 15 nt, Bordetella pertussis
gcccgccagggccau

SEQ ID NO: 400511 - RNA, 17 nt, Bordetella pertussis
gcccgccaucgccagga

SEQ ID NO: 400512 - RNA, 19 nt, Bordetella pertussis
gcccgccauugcacgcgca

SEQ ID NO: 400513 - RNA, 17 nt, Bordetella pertussis
gcccgcccacauggcgg

SEQ ID NO: 400514 - RNA, 19 nt, Bordetella pertussis
gcccgcccacauggcggcg

SEQ ID NO: 400515 - RNA, 21 nt, Bordetella pertussis
gcccgccccauugggacgcca

SEQ ID NO: 400516 - RNA, 23 nt, Bordetella pertussis
gcccgccccauugggacgccagc

SEQ ID NO: 400517 - RNA, 15 nt, Bordetella pertussis
gcccgccccggcgca

SEQ ID NO: 400518 - RNA, 13 nt, Bordetella pertussis
gcccgcccgccgc

SEQ ID NO: 400519 - RNA, 15 nt, Bordetella pertussis
gcccgcccgccgccu

SEQ ID NO: 400520 - RNA, 18 nt, Bordetella pertussis
gcccgcccgcgcccagcu

SEQ ID NO: 400521 - RNA, 13 nt, Bordetella pertussis
gcccgcccgcgga

SEQ ID NO: 400522 - RNA, 11 nt, Bordetella pertussis
gcccgcccugg

SEQ ID NO: 400523 - RNA, 22 nt, Bordetella pertussis
gcccgccggcgcgcgcgcgccg

SEQ ID NO: 400524 - RNA, 13 nt, Bordetella pertussis
gcccgccgggccg

SEQ ID NO: 400525 - RNA, 13 nt, Bordetella pertussis
gcccgccugcagc

SEQ ID NO: 400526 - RNA, 14 nt, Bordetella pertussis
gcccgccugcagca

SEQ ID NO: 400527 - RNA, 14 nt, Bordetella pertussis
gcccgccugccggc

SEQ ID NO: 400528 - RNA, 17 nt, Bordetella pertussis
gcccgccugcgccagcc

SEQ ID NO: 400529 - RNA, 16 nt, Bordetella pertussis
gcccgccuggcgccgc

SEQ ID NO: 400530 - RNA, 21 nt, Bordetella pertussis
gcccgccuggcgccgcgcccg

SEQ ID NO: 400531 - RNA, 17 nt, Bordetella pertussis
gcccgccuucagcgggc

SEQ ID NO: 400532 - RNA, 19 nt, Bordetella pertussis
gcccgccuucagcgggccg

SEQ ID NO: 400533 - RNA, 20 nt, Bordetella pertussis
gcccgccuucggcggcgggc

SEQ ID NO: 400534 - RNA, 24 nt, Bordetella pertussis
gcccgccuucuugaacagcucggc

SEQ ID NO: 400535 - RNA, 14 nt, Bordetella pertussis
gcccgcgcgagcgg

SEQ ID NO: 400536 - RNA, 15 nt, Bordetella pertussis
gcccgcgcggccagc

SEQ ID NO: 400537 - RNA, 23 nt, Bordetella pertussis
gcccgcgcggccagcgccggcgc

SEQ ID NO: 400538 - RNA, 14 nt, Bordetella pertussis
gcccgcgcgcgagc

SEQ ID NO: 400539 - RNA, 13 nt, Bordetella pertussis
gcccgcgcggcca

SEQ ID NO: 400540 - RNA, 13 nt, Bordetella pertussis
gcccgcgcuggcg

SEQ ID NO: 400541 - RNA, 15 nt, Bordetella pertussis
gcccgcgcuggcgca

SEQ ID NO: 400542 - RNA, 19 nt, Bordetella pertussis
gcccgcgcuggcgcagcag

SEQ ID NO: 400543 - RNA, 22 nt, Bordetella pertussis
gcccgcgcuggcgcagcaggcg

SEQ ID NO: 400544 - RNA, 22 nt, Bordetella pertussis
gcccgcgcuguugcuccaggcc

SEQ ID NO: 400545 - RNA, 22 nt, Bordetella pertussis
gcccgcggccagccacgccggc

SEQ ID NO: 400546 - RNA, 14 nt, Bordetella pertussis
gcccgcggccuugg

SEQ ID NO: 400547 - RNA, 15 nt, Bordetella pertussis
gcccgcggcgccagc

SEQ ID NO: 400548 - RNA, 23 nt, Bordetella pertussis
gcccgcggcgcccagcuggcgcc

SEQ ID NO: 400549 - RNA, 20 nt, Bordetella pertussis
gcccgcgggcgcccggccgg

SEQ ID NO: 400550 - RNA, 22 nt, Bordetella pertussis
gcccgcuucucacugcccgcgc

SEQ ID NO: 400551 - RNA, 19 nt, Bordetella pertussis
gcccggaauaccgccagcu

SEQ ID NO: 400552 - RNA, 19 nt, Bordetella pertussis
gcccggaucaguccgggcg

SEQ ID NO: 400553 - RNA, 16 nt, Bordetella pertussis
gcccggcaacaucucc

SEQ ID NO: 400554 - RNA, 22 nt, Bordetella pertussis
gcccggcaacaucuccaccagc

SEQ ID NO: 400555 - RNA, 22 nt, Bordetella pertussis
gcccggcaccaugcgcaccagg

SEQ ID NO: 400556 - RNA, 17 nt, Bordetella pertussis
gcccggcaccguccagc

SEQ ID NO: 400557 - RNA, 14 nt, Bordetella pertussis
gcccggcaggcaca

SEQ ID NO: 400558 - RNA, 14 nt, Bordetella pertussis
gcccggccaccagc

SEQ ID NO: 400559 - RNA, 15 nt, Bordetella pertussis
gcccggccaccagcg

SEQ ID NO: 400560 - RNA, 22 nt, Bordetella pertussis
gcccggcaugggcgugccgcgc

SEQ ID NO: 400561 - RNA, 23 nt, Bordetella pertussis
gcccggcgaaagcgucggcuucc

SEQ ID NO: 400562 - RNA, 23 nt, Bordetella pertussis
gcccggcgagguugcaggccagg

SEQ ID NO: 400563 - RNA, 14 nt, Bordetella pertussis
gcccggcgccgcgc

SEQ ID NO: 400564 - RNA, 18 nt, Bordetella pertussis
gcccggcgccgcgcgcug

SEQ ID NO: 400565 - RNA, 17 nt, Bordetella pertussis
gcccggcgccggugggc

SEQ ID NO: 400566 - RNA, 13 nt, Bordetella pertussis
gcccggcgcgccu

SEQ ID NO: 400567 - RNA, 14 nt, Bordetella pertussis
gcccggcgcgccuu

SEQ ID NO: 400568 - RNA, 19 nt, Bordetella pertussis
gcccggcuccaggccgccc

SEQ ID NO: 400569 - RNA, 12 nt, Bordetella pertussis
gcccggcucgcu

SEQ ID NO: 400570 - RNA, 21 nt, Bordetella pertussis
gcccggcucgccgagccgggc

SEQ ID NO: 400571 - RNA, 12 nt, Bordetella pertussis
gcccggcugcuc

SEQ ID NO: 400572 - RNA, 13 nt, Bordetella pertussis
gcccggcugcucg

SEQ ID NO: 400573 - RNA, 17 nt, Bordetella pertussis
gcccgggaaacucgcgc

SEQ ID NO: 400574 - RNA, 20 nt, Bordetella pertussis
gcccgggaaacucgcgcagc

SEQ ID NO: 400575 - RNA, 18 nt, Bordetella pertussis
gcccgggcaccagguccu

SEQ ID NO: 400576 - RNA, 17 nt, Bordetella pertussis
gcccgggcaggcucagc

SEQ ID NO: 400577 - RNA, 19 nt, Bordetella pertussis
gcccggugcagccgccgca

SEQ ID NO: 400578 - RNA, 21 nt, Bordetella pertussis
gcccgguucgugccgggcagc

SEQ ID NO: 400579 - RNA, 16 nt, Bordetella pertussis
gcccgguucugcggcg

SEQ ID NO: 400580 - RNA, 17 nt, Bordetella pertussis
gcccgguucugcggcgc

SEQ ID NO: 400581 - RNA, 22 nt, Bordetella pertussis
gcccguacgucaaggccugccc

SEQ ID NO: 400582 - RNA, 22 nt, Bordetella pertussis
gcccgucgcgccaggccggcgg

SEQ ID NO: 400583 - RNA, 15 nt, Bordetella pertussis
gcccgugcgggccug

SEQ ID NO: 400584 - RNA, 18 nt, Bordetella pertussis
gcccgugcgggccugcag

SEQ ID NO: 400585 - RNA, 20 nt, Bordetella pertussis
gcccgugcgggugccugucc

SEQ ID NO: 400586 - RNA, 21 nt, Bordetella pertussis
gcccgugcgggugccuguccc

SEQ ID NO: 400587 - RNA, 20 nt, Bordetella pertussis
gcccgugcgugcgccugucc

SEQ ID NO: 400588 - RNA, 17 nt, Bordetella pertussis
gcccgugcgugugccug

SEQ ID NO: 400589 - RNA, 19 nt, Bordetella pertussis
gcccgugcgcaacgcgcgc

SEQ ID NO: 400590 - RNA, 24 nt, Bordetella pertussis
gcccgugcgcgguucaggcuugca

SEQ ID NO: 400591 - RNA, 14 nt, Bordetella pertussis
gcccgugggcggcg

SEQ ID NO: 400592 - RNA, 20 nt, Bordetella pertussis
gcccuacccugaucaaucug

SEQ ID NO: 400593 - RNA, 14 nt, Bordetella pertussis
gcccucgcccagga

SEQ ID NO: 400594 - RNA, 16 nt, Bordetella pertussis
gcccucgcgccaccau

SEQ ID NO: 400595 - RNA, 22 nt, Bordetella pertussis
gcccucgcgccaccaugccuug

SEQ ID NO: 400596 - RNA, 21 nt, Bordetella pertussis
gcccugcaccgucacgcgcug

SEQ ID NO: 400597 - RNA, 15 nt, Bordetella pertussis
gcccugcagcggcca

SEQ ID NO: 400598 - RNA, 13 nt, Bordetella pertussis
gcccugcccggcg

SEQ ID NO: 400599 - RNA, 16 nt, Bordetella pertussis
gcccugcccggcgagc

SEQ ID NO: 400600 - RNA, 16 nt, Bordetella pertussis
gcccugcuggcgcagu

SEQ ID NO: 400601 - RNA, 18 nt, Bordetella pertussis
gcccugcugggguggagc

SEQ ID NO: 400602 - RNA, 18 nt, Bordetella pertussis
gcccuggagaucgccgcc

SEQ ID NO: 400603 - RNA, 20 nt, Bordetella pertussis
gcccuggagaucgccgccga

SEQ ID NO: 400604 - RNA, 17 nt, Bordetella pertussis
gcccuggauggcggccg

SEQ ID NO: 400605 - RNA, 24 nt, Bordetella pertussis
gcccuggauggcggccgccagcgc

SEQ ID NO: 400606 - RNA, 14 nt, Bordetella pertussis
gcccuggcagacgu

SEQ ID NO: 400607 - RNA, 16 nt, Bordetella pertussis
gcccuggcagcuggcg

SEQ ID NO: 400608 - RNA, 19 nt, Bordetella pertussis
gcccuggcaugugccaccg

SEQ ID NO: 400609 - RNA, 11 nt, Bordetella pertussis
gcccuggccac

SEQ ID NO: 400610 - RNA, 16 nt, Bordetella pertussis
gcccuggccacgcugc

SEQ ID NO: 400611 - RNA, 18 nt, Bordetella pertussis
gcccuggccacgcugcug

SEQ ID NO: 400612 - RNA, 14 nt, Bordetella pertussis
gcccuggcgcaggc

SEQ ID NO: 400613 - RNA, 20 nt, Bordetella pertussis
gcccuggccuucgaccugcc

SEQ ID NO: 400614 - RNA, 21 nt, Bordetella pertussis
gcccugucggugaugauccug

SEQ ID NO: 400615 - RNA, 21 nt, Bordetella pertussis
gcccuguguccacgaacgcga

SEQ ID NO: 400616 - RNA, 17 nt, Bordetella pertussis
gcccuucggcaugcugc

SEQ ID NO: 400617 - RNA, 14 nt, Bordetella pertussis
gcccuugaccgacg

SEQ ID NO: 400618 - RNA, 16 nt, Bordetella pertussis
gcccuugaucagcggc

SEQ ID NO: 400619 - RNA, 19 nt, Bordetella pertussis
gcccuugaucagcggcggc

SEQ ID NO: 400620 - RNA, 18 nt, Bordetella pertussis
gcccuugaucaggcgcau

SEQ ID NO: 400621 - RNA, 19 nt, Bordetella pertussis
gcccuugagcaaucaaggg

SEQ ID NO: 400622 - RNA, 17 nt, Bordetella pertussis
gcccuugcgcgaacggc

SEQ ID NO: 400623 - RNA, 14 nt, Bordetella pertussis
gcccuugcggcgag

SEQ ID NO: 400624 - RNA, 17 nt, Bordetella pertussis
gcccuugcucccaguuc

SEQ ID NO: 400625 - RNA, 13 nt, Bordetella pertussis
gcccuuggcggcc

SEQ ID NO: 400626 - RNA, 15 nt, Bordetella pertussis
gcccuuggcggccuu

SEQ ID NO: 400627 - RNA, 18 nt, Bordetella pertussis
gcccuugggggcccacau

SEQ ID NO: 400628 - RNA, 17 nt, Bordetella pertussis
gcccuugugcugccaug

SEQ ID NO: 400629 - RNA, 18 nt, Bordetella pertussis
gcccuuugcauugcggcu

SEQ ID NO: 400630 - RNA, 16 nt, Bordetella pertussis
gccgaaaccgccgcgg

SEQ ID NO: 400631 - RNA, 17 nt, Bordetella pertussis
gccgaaaccgccgcggc

SEQ ID NO: 400632 - RNA, 15 nt, Bordetella pertussis
gccgaacagcauggc

SEQ ID NO: 400633 - RNA, 19 nt, Bordetella pertussis
gccgaacagcauggcggcg

SEQ ID NO: 400634 - RNA, 12 nt, Bordetella pertussis
gccgaaccacag

SEQ ID NO: 400635 - RNA, 15 nt, Bordetella pertussis
gccgaaccacagcau

SEQ ID NO: 400636 - RNA, 15 nt, Bordetella pertussis
gccgaacgaggcgcg

SEQ ID NO: 400637 - RNA, 14 nt, Bordetella pertussis
gccgaacgccgccg

SEQ ID NO: 400638 - RNA, 18 nt, Bordetella pertussis
gccgaacgcgcagcgaac

SEQ ID NO: 400639 - RNA, 16 nt, Bordetella pertussis
gccgaacggcagcagc

SEQ ID NO: 400640 - RNA, 22 nt, Bordetella pertussis
gccgaacucgcgcucggccagc

SEQ ID NO: 400641 - RNA, 19 nt, Bordetella pertussis
gccgaacuucagcccgggc

SEQ ID NO: 400642 - RNA, 21 nt, Bordetella pertussis
gccgaagaucuccucgcgcgc

SEQ ID NO: 400643 - RNA, 21 nt, Bordetella pertussis
gccgaagauucccgcgcacgc

SEQ ID NO: 400644 - RNA, 14 nt, Bordetella pertussis
gccgaagcgcaggc

SEQ ID NO: 400645 - RNA, 15 nt, Bordetella pertussis
gccgaaggcggcgcc

SEQ ID NO: 400646 - RNA, 22 nt, Bordetella pertussis
gccgaaggguugcaguucgccg

SEQ ID NO: 400647 - RNA, 21 nt, Bordetella pertussis
gccgaaguacacggccagcac

SEQ ID NO: 400648 - RNA, 23 nt, Bordetella pertussis
gccgaaguaguuggucgagcgcu

SEQ ID NO: 400649 - RNA, 20 nt, Bordetella pertussis
gccgaaguugcggccgugcg

SEQ ID NO: 400650 - RNA, 16 nt, Bordetella pertussis
gccgaauugccgccgc

SEQ ID NO: 400651 - RNA, 19 nt, Bordetella pertussis
gccgaauugccgccgcugc

SEQ ID NO: 400652 - RNA, 19 nt, Bordetella pertussis
gccgaauugcuggagcgcc

SEQ ID NO: 400653 - RNA, 23 nt, Bordetella pertussis
gccgaauugcuggagcgccacgc

SEQ ID NO: 400654 - RNA, 21 nt, Bordetella pertussis
gccgaaucggccccugcccug

SEQ ID NO: 400655 - RNA, 18 nt, Bordetella pertussis
gccgacaggaaggcgagc

SEQ ID NO: 400656 - RNA, 14 nt, Bordetella pertussis
gccgacaggcgcgc

SEQ ID NO: 400657 - RNA, 13 nt, Bordetella pertussis
gccgaccaccagc

SEQ ID NO: 400658 - RNA, 15 nt, Bordetella pertussis
gccgaccaccagcac

SEQ ID NO: 400659 - RNA, 15 nt, Bordetella pertussis
gccgaccacccgcgc

SEQ ID NO: 400660 - RNA, 23 nt, Bordetella pertussis
gccgaccaccugcaccgccgcgu

SEQ ID NO: 400661 - RNA, 14 nt, Bordetella pertussis
gccgaccagcgagu

SEQ ID NO: 400662 - RNA, 11 nt, Bordetella pertussis
gccgaccaggc

SEQ ID NO: 400663 - RNA, 13 nt, Bordetella pertussis
gccgaccaggccc

SEQ ID NO: 400664 - RNA, 15 nt, Bordetella pertussis
gccgaccaggcccgc

SEQ ID NO: 400665 - RNA, 19 nt, Bordetella pertussis
gccgaccaggccggcggcg

SEQ ID NO: 400666 - RNA, 22 nt, Bordetella pertussis
gccgaccaggcugcgcgccggc

SEQ ID NO: 400667 - RNA, 13 nt, Bordetella pertussis
gccgacccgcggc

SEQ ID NO: 400668 - RNA, 16 nt, Bordetella pertussis
gccgaccggccccacc

SEQ ID NO: 400669 - RNA, 13 nt, Bordetella pertussis
gccgaccgcgcgc

SEQ ID NO: 400670 - RNA, 14 nt, Bordetella pertussis
gccgaccggcgcgc

SEQ ID NO: 400671 - RNA, 19 nt, Bordetella pertussis
gccgaccgggccgaccagg

SEQ ID NO: 400672 - RNA, 12 nt, Bordetella pertussis
gccgaccuccag

SEQ ID NO: 400673 - RNA, 17 nt, Bordetella pertussis
gccgaccuggcgcccga

SEQ ID NO: 400674 - RNA, 17 nt, Bordetella pertussis
gccgacgaugccgccgc

SEQ ID NO: 400675 - RNA, 18 nt, Bordetella pertussis
gccgacgaugccgccgcc

SEQ ID NO: 400676 - RNA, 19 nt, Bordetella pertussis
gccgacgaugucgccgccg

SEQ ID NO: 400677 - RNA, 21 nt, Bordetella pertussis
gccgacgccggcucaggccag

SEQ ID NO: 400678 - RNA, 15 nt, Bordetella pertussis
gccgacgcgccgggc

SEQ ID NO: 400679 - RNA, 22 nt, Bordetella pertussis
gccgacgcgccgggccacgagc

SEQ ID NO: 400680 - RNA, 16 nt, Bordetella pertussis
gccgacgcgcuggucc

SEQ ID NO: 400681 - RNA, 22 nt, Bordetella pertussis
gccgacgcgcugguccgccgcc

SEQ ID NO: 400682 - RNA, 17 nt, Bordetella pertussis
gccgacggcaagaucgc

SEQ ID NO: 400683 - RNA, 14 nt, Bordetella pertussis
gccgacggcauggc

SEQ ID NO: 400684 - RNA, 19 nt, Bordetella pertussis
gccgacggcauggccggca

SEQ ID NO: 400685 - RNA, 22 nt, Bordetella pertussis
gccgacggcauggcggccagcu

SEQ ID NO: 400686 - RNA, 16 nt, Bordetella pertussis
gccgacggcgcccugc

SEQ ID NO: 400687 - RNA, 19 nt, Bordetella pertussis
gccgacggcgcccugcagg

SEQ ID NO: 400688 - RNA, 17 nt, Bordetella pertussis
gccgacggcgcuggcga

SEQ ID NO: 400689 - RNA, 18 nt, Bordetella pertussis
gccgacggcgcuggcgag

SEQ ID NO: 400690 - RNA, 17 nt, Bordetella pertussis
gccgacggcggcgcggc

SEQ ID NO: 400691 - RNA, 16 nt, Bordetella pertussis
gccgacgggcggcugc

SEQ ID NO: 400692 - RNA, 17 nt, Bordetella pertussis
gccgacguggaccgcgc

SEQ ID NO: 400693 - RNA, 22 nt, Bordetella pertussis
gccgacuggaugaagcguucgg

SEQ ID NO: 400694 - RNA, 22 nt, Bordetella pertussis
gccgacugggcuugccggugcu

SEQ ID NO: 400695 - RNA, 18 nt, Bordetella pertussis
gccgacugggugcgccug

SEQ ID NO: 400696 - RNA, 19 nt, Bordetella pertussis
gccgagaaauccagcgcgc

SEQ ID NO: 400697 - RNA, 20 nt, Bordetella pertussis
gccgagacggccgccgacgc

SEQ ID NO: 400698 - RNA, 14 nt, Bordetella pertussis
gccgagcccgcguc

SEQ ID NO: 400699 - RNA, 22 nt, Bordetella pertussis
gccgagcccgcgucggcgcggu

SEQ ID NO: 400700 - RNA, 23 nt, Bordetella pertussis
gccgagccgccccggcgcggcgc

SEQ ID NO: 400701 - RNA, 23 nt, Bordetella pertussis
gccgagccgcugucgcaggcgcu

SEQ ID NO: 400702 - RNA, 14 nt, Bordetella pertussis
gccgagcgcugcgc

SEQ ID NO: 400703 - RNA, 21 nt, Bordetella pertussis
gccgagcggcaucugcaguuu

SEQ ID NO: 400704 - RNA, 12 nt, Bordetella pertussis
gccgagcuccuc

SEQ ID NO: 400705 - RNA, 12 nt, Bordetella pertussis
gccgaggccagg

SEQ ID NO: 400706 - RNA, 14 nt, Bordetella pertussis
gccgaggcgccgcc

SEQ ID NO: 400707 - RNA, 15 nt, Bordetella pertussis
gccgaggcgccgccg

SEQ ID NO: 400708 - RNA, 12 nt, Bordetella pertussis
gccgaggcugcg

SEQ ID NO: 400709 - RNA, 21 nt, Bordetella pertussis
gccgaggcuucgauggcggcg

SEQ ID NO: 400710 - RNA, 14 nt, Bordetella pertussis
gccgagggccgcgc

SEQ ID NO: 400711 - RNA, 15 nt, Bordetella pertussis
gccgagggccgcgcg

SEQ ID NO: 400712 - RNA, 22 nt, Bordetella pertussis
gccgaggucggcgguccacagc

SEQ ID NO: 400713 - RNA, 15 nt, Bordetella pertussis
gccgaggugcccauc

SEQ ID NO: 400714 - RNA, 13 nt, Bordetella pertussis
gccgaguccuggu

SEQ ID NO: 400715 - RNA, 16 nt, Bordetella pertussis
gccgaguagcggcgca

SEQ ID NO: 400716 - RNA, 14 nt, Bordetella pertussis
gccgaucagcgggc

SEQ ID NO: 400717 - RNA, 23 nt, Bordetella pertussis
gccgauccacucggccagcgcgc

SEQ ID NO: 400718 - RNA, 17 nt, Bordetella pertussis
gccgauccagggccgca

SEQ ID NO: 400719 - RNA, 19 nt, Bordetella pertussis
gccgauccagggccgcagc

SEQ ID NO: 400720 - RNA, 18 nt, Bordetella pertussis
gccgauguugaacagcug

SEQ ID NO: 400721 - RNA, 18 nt, Bordetella pertussis
gccgauuccagcgccgcc

SEQ ID NO: 400722 - RNA, 23 nt, Bordetella pertussis
gccgauucgccguggcuggucac

SEQ ID NO: 400723 - RNA, 15 nt, Bordetella pertussis
gccgauuucgccgcc

SEQ ID NO: 400724 - RNA, 17 nt, Bordetella pertussis
gccgauuucgcgcgcca

SEQ ID NO: 400725 - RNA, 16 nt, Bordetella pertussis
gccgauuucggccgcc

SEQ ID NO: 400726 - RNA, 19 nt, Bordetella pertussis
gccgauuucggccgccggc

SEQ ID NO: 400727 - RNA, 22 nt, Bordetella pertussis
gccgauuucggccgccggcgag

SEQ ID NO: 400728 - RNA, 15 nt, Bordetella pertussis
gccgcaacaggcagc

SEQ ID NO: 400729 - RNA, 18 nt, Bordetella pertussis
gccgcaaccagggagccg

SEQ ID NO: 400730 - RNA, 20 nt, Bordetella pertussis
gccgcaacccacccccagca

SEQ ID NO: 400731 - RNA, 22 nt, Bordetella pertussis
gccgcaacccacccccagcagc

SEQ ID NO: 400732 - RNA, 14 nt, Bordetella pertussis
gccgcaagcuggcc

SEQ ID NO: 400733 - RNA, 16 nt, Bordetella pertussis
gccgcaagcuggcggc

SEQ ID NO: 400734 - RNA, 20 nt, Bordetella pertussis
gccgcaagcuggcggcgcgc

SEQ ID NO: 400735 - RNA, 20 nt, Bordetella pertussis
gccgcaagcaagccccaggc

SEQ ID NO: 400736 - RNA, 20 nt, Bordetella pertussis
gccgccgaaccagcgcacca

SEQ ID NO: 400737 - RNA, 17 nt, Bordetella pertussis
gccgccgaacggcagca

SEQ ID NO: 400738 - RNA, 16 nt, Bordetella pertussis
gccgccgaacggggcc

SEQ ID NO: 400739 - RNA, 16 nt, Bordetella pertussis
gccgccgaagccgccg

SEQ ID NO: 400740 - RNA, 17 nt, Bordetella pertussis
gccgccgaagggcaccg

SEQ ID NO: 400741 - RNA, 16 nt, Bordetella pertussis
gccgccgacgccgcca

SEQ ID NO: 400742 - RNA, 18 nt, Bordetella pertussis
gccgccgaggcggugggc

SEQ ID NO: 400743 - RNA, 14 nt, Bordetella pertussis
gccgccgccgcggc

SEQ ID NO: 400744 - RNA, 14 nt, Bordetella pertussis
gccgccgcgcagga

SEQ ID NO: 400745 - RNA, 18 nt, Bordetella pertussis
gccgccgcgcccagcagc

SEQ ID NO: 400746 - RNA, 16 nt, Bordetella pertussis
gccgccgcgcccagcc

SEQ ID NO: 400747 - RNA, 20 nt, Bordetella pertussis
gccgccgcgcgccgcgccuu

SEQ ID NO: 400748 - RNA, 16 nt, Bordetella pertussis
gccgccgcgcgcggca

SEQ ID NO: 400749 - RNA, 20 nt, Bordetella pertussis
gccgccgcgcgcuggcugug

SEQ ID NO: 400750 - RNA, 18 nt, Bordetella pertussis
gccgccgcgcaccaccga

SEQ ID NO: 400751 - RNA, 14 nt, Bordetella pertussis
gccgccgcgcggcg

SEQ ID NO: 400752 - RNA, 23 nt, Bordetella pertussis
gccgccgcgcucggcgcugccgg

SEQ ID NO: 400753 - RNA, 12 nt, Bordetella pertussis
gccgccgcgggc

SEQ ID NO: 400754 - RNA, 13 nt, Bordetella pertussis
gccgccgcggccu

SEQ ID NO: 400755 - RNA, 16 nt, Bordetella pertussis
gccgccgcgggcgccg

SEQ ID NO: 400756 - RNA, 16 nt, Bordetella pertussis
gccgccgcucgucccc

SEQ ID NO: 400757 - RNA, 13 nt, Bordetella pertussis
gccgccgcgugga

SEQ ID NO: 400758 - RNA, 18 nt, Bordetella pertussis
gccgccggacggcgccuu

SEQ ID NO: 400759 - RNA, 23 nt, Bordetella pertussis
gccgccggcaaucgaaaagcccg

SEQ ID NO: 400760 - RNA, 14 nt, Bordetella pertussis
gccgccggcagggc

SEQ ID NO: 400761 - RNA, 14 nt, Bordetella pertussis
gccgccggccagcc

SEQ ID NO: 400762 - RNA, 16 nt, Bordetella pertussis
gccgccgggccugccc

SEQ ID NO: 400763 - RNA, 17 nt, Bordetella pertussis
gccgccgggcgcgcgcc

SEQ ID NO: 400764 - RNA, 13 nt, Bordetella pertussis
gccgccgggcgcg

SEQ ID NO: 400765 - RNA, 20 nt, Bordetella pertussis
gccgccggucaccgccgccg

SEQ ID NO: 400766 - RNA, 23 nt, Bordetella pertussis
gccgccggucaccgccgccgcca

SEQ ID NO: 400767 - RNA, 19 nt, Bordetella pertussis
gccgccggugcaccaggcc

SEQ ID NO: 400768 - RNA, 12 nt, Bordetella pertussis
gccgccugcugc

SEQ ID NO: 400769 - RNA, 15 nt, Bordetella pertussis
gccgccuucaccggc

SEQ ID NO: 400770 - RNA, 19 nt, Bordetella pertussis
gccgccuucaccggcccca

SEQ ID NO: 400771 - RNA, 22 nt, Bordetella pertussis
gccgccuugacgguggccgcgg

SEQ ID NO: 400772 - RNA, 18 nt, Bordetella pertussis
gccgcgaaacguccccac

SEQ ID NO: 400773 - RNA, 13 nt, Bordetella pertussis
gccgcgagcgccg

SEQ ID NO: 400774 - RNA, 16 nt, Bordetella pertussis
gccgcgaggcgcaggc

SEQ ID NO: 400775 - RNA, 22 nt, Bordetella pertussis
gccgcgagguauuggccuugcc

SEQ ID NO: 400776 - RNA, 23 nt, Bordetella pertussis
gccgcgauauugaaggccgaggc

SEQ ID NO: 400777 - RNA, 18 nt, Bordetella pertussis
gccgcgaugcaugaaccg

SEQ ID NO: 400778 - RNA, 21 nt, Bordetella pertussis
gccgcgauggcgccggccagc

SEQ ID NO: 400779 - RNA, 16 nt, Bordetella pertussis
gccgcgaugucgcgcg

SEQ ID NO: 400780 - RNA, 22 nt, Bordetella pertussis
gccgcgauugcagguggccagc

SEQ ID NO: 400781 - RNA, 23 nt, Bordetella pertussis
gccgcgauugcagguggccagcc

SEQ ID NO: 400782 - RNA, 13 nt, Bordetella pertussis
gccgcgcaaggcg

SEQ ID NO: 400783 - RNA, 17 nt, Bordetella pertussis
gccgcgcaaggcggccc

SEQ ID NO: 400784 - RNA, 18 nt, Bordetella pertussis
gccgcgcacacauggcgc

SEQ ID NO: 400785 - RNA, 21 nt, Bordetella pertussis
gccgcgcacacauggcgcauc

SEQ ID NO: 400786 - RNA, 15 nt, Bordetella pertussis
gccgcgcccgcaacg

SEQ ID NO: 400787 - RNA, 14 nt, Bordetella pertussis
gccgcgcccgccgc

SEQ ID NO: 400788 - RNA, 14 nt, Bordetella pertussis
gccgcgcccgccuu

SEQ ID NO: 400789 - RNA, 15 nt, Bordetella pertussis
gccgcgcccgccuuc

SEQ ID NO: 400790 - RNA, 14 nt, Bordetella pertussis
gccgcgcccgcggg

SEQ ID NO: 400791 - RNA, 19 nt, Bordetella pertussis
gccgcgccccuagcgccgc

SEQ ID NO: 400792 - RNA, 13 nt, Bordetella pertussis
gccgcgcccuggc

SEQ ID NO: 400793 - RNA, 14 nt, Bordetella pertussis
gccgcgccgcccgc

SEQ ID NO: 400794 - RNA, 17 nt, Bordetella pertussis
gccgcgccgcccgcggc

SEQ ID NO: 400795 - RNA, 13 nt, Bordetella pertussis
gccgcgccgccgc

SEQ ID NO: 400796 - RNA, 14 nt, Bordetella pertussis
gccgcgccgccgcc

SEQ ID NO: 400797 - RNA, 12 nt, Bordetella pertussis
gccgcgccgcgg

SEQ ID NO: 400798 - RNA, 17 nt, Bordetella pertussis
gccgcgccgcggcacgg

SEQ ID NO: 400799 - RNA, 16 nt, Bordetella pertussis
gccgcgccgcguugca

SEQ ID NO: 400800 - RNA, 15 nt, Bordetella pertussis
gccgcgccgcuggcg

SEQ ID NO: 400801 - RNA, 17 nt, Bordetella pertussis
gccgcgccggggcggcg

SEQ ID NO: 400802 - RNA, 17 nt, Bordetella pertussis
gccgcgccggggcggcu

SEQ ID NO: 400803 - RNA, 18 nt, Bordetella pertussis
gccgcgcgacagccgcgc

SEQ ID NO: 400804 - RNA, 19 nt, Bordetella pertussis
gccgcgcgauccuggggca

SEQ ID NO: 400805 - RNA, 19 nt, Bordetella pertussis
gccgcgcgaugcgcggccc

SEQ ID NO: 400806 - RNA, 16 nt, Bordetella pertussis
gccgcgcgcauccagg

SEQ ID NO: 400807 - RNA, 18 nt, Bordetella pertussis
gccgcgcgcggccccggc

SEQ ID NO: 400808 - RNA, 17 nt, Bordetella pertussis
gccgcgcgcggccggcg

SEQ ID NO: 400809 - RNA, 13 nt, Bordetella pertussis
gccgcgcgcgggc

SEQ ID NO: 400810 - RNA, 23 nt, Bordetella pertussis
gccgcgcgcguauggcggcgccg

SEQ ID NO: 400811 - RNA, 17 nt, Bordetella pertussis
gccgcgcgcgucgccgc

SEQ ID NO: 400812 - RNA, 14 nt, Bordetella pertussis
gccgcgcgcuggcu

SEQ ID NO: 400813 - RNA, 13 nt, Bordetella pertussis
gccgcgcgcuggu

SEQ ID NO: 400814 - RNA, 14 nt, Bordetella pertussis
gccgcgcgcugguc

SEQ ID NO: 400815 - RNA, 20 nt, Bordetella pertussis
gccgcgcgcuucaggcgccg

SEQ ID NO: 400816 - RNA, 12 nt, Bordetella pertussis
gccgcgcggccg

SEQ ID NO: 400817 - RNA, 16 nt, Bordetella pertussis
gccgcgcggcgccugc

SEQ ID NO: 400818 - RNA, 18 nt, Bordetella pertussis
gccgcgcggcgccugccu

SEQ ID NO: 400819 - RNA, 17 nt, Bordetella pertussis
gccgcgcggcgcguuca

SEQ ID NO: 400820 - RNA, 13 nt, Bordetella pertussis
gccgcgcggcgga

SEQ ID NO: 400821 - RNA, 23 nt, Bordetella pertussis
gccgcgcgccuuccugggcgccg

SEQ ID NO: 400822 - RNA, 13 nt, Bordetella pertussis
gccgcgcgcgcca

SEQ ID NO: 400823 - RNA, 15 nt, Bordetella pertussis
gccgcgcgggcggcc

SEQ ID NO: 400824 - RNA, 22 nt, Bordetella pertussis
gccgcgcguaugcaccgggccg

SEQ ID NO: 400825 - RNA, 12 nt, Bordetella pertussis
gccgcgcgugcg

SEQ ID NO: 400826 - RNA, 16 nt, Bordetella pertussis
gccgcgcucaccgagg

SEQ ID NO: 400827 - RNA, 18 nt, Bordetella pertussis
gccgcgcucaccgagggc

SEQ ID NO: 400828 - RNA, 13 nt, Bordetella pertussis
gccgcgcucagca

SEQ ID NO: 400829 - RNA, 19 nt, Bordetella pertussis
gccgcgcucagcaccaggc

SEQ ID NO: 400830 - RNA, 13 nt, Bordetella pertussis
gccgcgcucaggc

SEQ ID NO: 400831 - RNA, 22 nt, Bordetella pertussis
gccgcgcuccagggcgucggcg

SEQ ID NO: 400832 - RNA, 15 nt, Bordetella pertussis
gccgcgcugccagcc

SEQ ID NO: 400833 - RNA, 21 nt, Bordetella pertussis
gccgcgcugcccgagaagggc

SEQ ID NO: 400834 - RNA, 14 nt, Bordetella pertussis
gccgcgcuggcgcu

SEQ ID NO: 400835 - RNA, 15 nt, Bordetella pertussis
gccgcgcuggcggcg

SEQ ID NO: 400836 - RNA, 21 nt, Bordetella pertussis
gccgcgcuggcggcgcaggcc

SEQ ID NO: 400837 - RNA, 17 nt, Bordetella pertussis
gccgcgcugggcgcugc

SEQ ID NO: 400838 - RNA, 17 nt, Bordetella pertussis
gccgcgcuucgucggcg

SEQ ID NO: 400839 - RNA, 15 nt, Bordetella pertussis
gccgcggacccaggc

SEQ ID NO: 400840 - RNA, 17 nt, Bordetella pertussis
gccgcggacccaggccu

SEQ ID NO: 400841 - RNA, 20 nt, Bordetella pertussis
gccgcggauugccguccugg

SEQ ID NO: 400842 - RNA, 22 nt, Bordetella pertussis
gccgcggauugccguccuggcg

SEQ ID NO: 400843 - RNA, 22 nt, Bordetella pertussis
gccgcggcaaauggggcggccg

SEQ ID NO: 400844 - RNA, 19 nt, Bordetella pertussis
gccgcggcaagccgcggcg

SEQ ID NO: 400845 - RNA, 19 nt, Bordetella pertussis
gccgcggccagcgccgcgc

SEQ ID NO: 400846 - RNA, 14 nt, Bordetella pertussis
gccgcggccaggcc

SEQ ID NO: 400847 - RNA, 13 nt, Bordetella pertussis
gccgcggccgccc

SEQ ID NO: 400848 - RNA, 15 nt, Bordetella pertussis
gccgcggccgccccc

SEQ ID NO: 400849 - RNA, 13 nt, Bordetella pertussis
gccgcggccggca

SEQ ID NO: 400850 - RNA, 13 nt, Bordetella pertussis
gccgcggccggcg

SEQ ID NO: 400851 - RNA, 17 nt, Bordetella pertussis
gccgcggccggcgcagu

SEQ ID NO: 400852 - RNA, 14 nt, Bordetella pertussis
gccgcggccgggug

SEQ ID NO: 400853 - RNA, 19 nt, Bordetella pertussis
gccgcggcccagcgcggcg

SEQ ID NO: 400854 - RNA, 14 nt, Bordetella pertussis
gccgcggcgcccgg

SEQ ID NO: 400855 - RNA, 14 nt, Bordetella pertussis
gccgcggcgcgcgc

SEQ ID NO: 400856 - RNA, 17 nt, Bordetella pertussis
gccgcggcgcgcgcggc

SEQ ID NO: 400857 - RNA, 18 nt, Bordetella pertussis
gccgcggcgcgcgcggcg

SEQ ID NO: 400858 - RNA, 14 nt, Bordetella pertussis
gccgcggcgcggcc

SEQ ID NO: 400859 - RNA, 15 nt, Bordetella pertussis
gccgcggcgcggccc

SEQ ID NO: 400860 - RNA, 20 nt, Bordetella pertussis
gccgcggcgcggcccgccac

SEQ ID NO: 400861 - RNA, 22 nt, Bordetella pertussis
gccgcggcgcggcccgccacgc

SEQ ID NO: 400862 - RNA, 11 nt, Bordetella pertussis
gccgcggcggc

SEQ ID NO: 400863 - RNA, 12 nt, Bordetella pertussis
gccgcguccgcc

SEQ ID NO: 400864 - RNA, 18 nt, Bordetella pertussis
gccgcguccggcgcccgc

SEQ ID NO: 400865 - RNA, 21 nt, Bordetella pertussis
gccgcguccggcgcccgccgc

SEQ ID NO: 400866 - RNA, 17 nt, Bordetella pertussis
gccgcguccucggccug

SEQ ID NO: 400867 - RNA, 19 nt, Bordetella pertussis
gccgcguccagcgcgcggc

SEQ ID NO: 400868 - RNA, 20 nt, Bordetella pertussis
gccgcguccagcgcgcggcc

SEQ ID NO: 400869 - RNA, 23 nt, Bordetella pertussis
gccgcgucccgugccggccggac

SEQ ID NO: 400870 - RNA, 15 nt, Bordetella pertussis
gccgcgucggcgccg

SEQ ID NO: 400871 - RNA, 17 nt, Bordetella pertussis
gccgcgucuucggcgcg

SEQ ID NO: 400872 - RNA, 16 nt, Bordetella pertussis
gccgcgugcccgcguc

SEQ ID NO: 400873 - RNA, 19 nt, Bordetella pertussis
gccgcguggccgcgcugcu

SEQ ID NO: 400874 - RNA, 16 nt, Bordetella pertussis
gccgcgugguggcgca

SEQ ID NO: 400875 - RNA, 14 nt, Bordetella pertussis
gccgcuccagagcg

SEQ ID NO: 400876 - RNA, 23 nt, Bordetella pertussis
gccgcugauggcggucaccaacg

SEQ ID NO: 400877 - RNA, 12 nt, Bordetella pertussis
gccgcugcaugg

SEQ ID NO: 400878 - RNA, 20 nt, Bordetella pertussis
gccgcugcccaccuuccugc

SEQ ID NO: 400879 - RNA, 15 nt, Bordetella pertussis
gccgcugccgcgcgc

SEQ ID NO: 400880 - RNA, 22 nt, Bordetella pertussis
gccgcugcgaaaaagcccgcgc

SEQ ID NO: 400881 - RNA, 14 nt, Bordetella pertussis
gccgcugcgcagca

SEQ ID NO: 400882 - RNA, 16 nt, Bordetella pertussis
gccgcugcgcgcggcc

SEQ ID NO: 400883 - RNA, 15 nt, Bordetella pertussis
gccgcugcgcuggcc

SEQ ID NO: 400884 - RNA, 17 nt, Bordetella pertussis
gccgcuguggacgccgc

SEQ ID NO: 400885 - RNA, 15 nt, Bordetella pertussis
gccgcuguggcgcgc

SEQ ID NO: 400886 - RNA, 16 nt, Bordetella pertussis
gccgcuguggcgcgcc

SEQ ID NO: 400887 - RNA, 17 nt, Bordetella pertussis
gccgcuguugcccacca

SEQ ID NO: 400888 - RNA, 19 nt, Bordetella pertussis
gccgcuguugcccaccagc

SEQ ID NO: 400889 - RNA, 15 nt, Bordetella pertussis
gccgcuuccggcaug

SEQ ID NO: 400890 - RNA, 14 nt, Bordetella pertussis
gccgcuucggccug

SEQ ID NO: 400891 - RNA, 16 nt, Bordetella pertussis
gccgcuucggcggccg

SEQ ID NO: 400892 - RNA, 19 nt, Bordetella pertussis
gccgcuucgugcggccgca

SEQ ID NO: 400893 - RNA, 21 nt, Bordetella pertussis
gccgcuucgugcggccgcagc

SEQ ID NO: 400894 - RNA, 22 nt, Bordetella pertussis
gccgcuucgugcggccgcagca

SEQ ID NO: 400895 - RNA, 18 nt, Bordetella pertussis
gccgcuugcggccaggcg

SEQ ID NO: 400896 - RNA, 13 nt, Bordetella pertussis
gccgcuuggccug

SEQ ID NO: 400897 - RNA, 22 nt, Bordetella pertussis
gccggacuggauauggcgccgc

SEQ ID NO: 400898 - RNA, 14 nt, Bordetella pertussis
gccggacuggcgcg

SEQ ID NO: 400899 - RNA, 19 nt, Bordetella pertussis
gccggagcagucgcgcagc

SEQ ID NO: 400900 - RNA, 22 nt, Bordetella pertussis
gccggaugcgcaggacggcgcc

SEQ ID NO: 400901 - RNA, 16 nt, Bordetella pertussis
gccggcacgcccagcc

SEQ ID NO: 400902 - RNA, 18 nt, Bordetella pertussis
gccggcacgcccagccgc

SEQ ID NO: 400903 - RNA, 21 nt, Bordetella pertussis
gccggcacgcccagccgcagc

SEQ ID NO: 400904 - RNA, 14 nt, Bordetella pertussis
gccggcacgcgcgg

SEQ ID NO: 400905 - RNA, 13 nt, Bordetella pertussis
gccggcacgcuga

SEQ ID NO: 400906 - RNA, 13 nt, Bordetella pertussis
gccggcagcccca

SEQ ID NO: 400907 - RNA, 23 nt, Bordetella pertussis
gccggccaaggcaagcagcgaga

SEQ ID NO: 400908 - RNA, 13 nt, Bordetella pertussis
gccggccaccagc

SEQ ID NO: 400909 - RNA, 16 nt, Bordetella pertussis
gccggccaccagcggc

SEQ ID NO: 400910 - RNA, 17 nt, Bordetella pertussis
gccggccaccagcggcg

SEQ ID NO: 400911 - RNA, 22 nt, Bordetella pertussis
gccggccaccgagauguuccug

SEQ ID NO: 400912 - RNA, 12 nt, Bordetella pertussis
gccggccacgaa

SEQ ID NO: 400913 - RNA, 11 nt, Bordetella pertussis
gccggccagca

SEQ ID NO: 400914 - RNA, 13 nt, Bordetella pertussis
gccggccagcagc

SEQ ID NO: 400915 - RNA, 23 nt, Bordetella pertussis
gccggccacgcgcugcagcagca

SEQ ID NO: 400916 - RNA, 21 nt, Bordetella pertussis
gccggccagccauugccgcac

SEQ ID NO: 400917 - RNA, 13 nt, Bordetella pertussis
gccggccagccug

SEQ ID NO: 400918 - RNA, 14 nt, Bordetella pertussis
gccggccagccugu

SEQ ID NO: 400919 - RNA, 14 nt, Bordetella pertussis
gccggccagcgcca

SEQ ID NO: 400920 - RNA, 17 nt, Bordetella pertussis
gccggccagcgccacca

SEQ ID NO: 400921 - RNA, 14 nt, Bordetella pertussis
gccggccagcgcgc

SEQ ID NO: 400922 - RNA, 16 nt, Bordetella pertussis
gccggccagcgcgccg

SEQ ID NO: 400923 - RNA, 12 nt, Bordetella pertussis
gccggccaggcc

SEQ ID NO: 400924 - RNA, 15 nt, Bordetella pertussis
gccggccaggcgccg

SEQ ID NO: 400925 - RNA, 20 nt, Bordetella pertussis
gccggcgccgggcagcccgc

SEQ ID NO: 400926 - RNA, 14 nt, Bordetella pertussis
gccggcgccguuca

SEQ ID NO: 400927 - RNA, 22 nt, Bordetella pertussis
gccggcgccguuuucagcgcag

SEQ ID NO: 400928 - RNA, 17 nt, Bordetella pertussis
gccggcgccuggggcgg

SEQ ID NO: 400929 - RNA, 19 nt, Bordetella pertussis
gccggcgccuuggccuggg

SEQ ID NO: 400930 - RNA, 21 nt, Bordetella pertussis
gccggcgcgaaccccuccggc

SEQ ID NO: 400931 - RNA, 21 nt, Bordetella pertussis
gccggcgcgaccgccuccagc

SEQ ID NO: 400932 - RNA, 14 nt, Bordetella pertussis
gccggcgcgccgcg

SEQ ID NO: 400933 - RNA, 20 nt, Bordetella pertussis
gccggcgcgccgcgccgccc

SEQ ID NO: 400934 - RNA, 14 nt, Bordetella pertussis
gccggcgcgccggc

SEQ ID NO: 400935 - RNA, 15 nt, Bordetella pertussis
gccggcgcgccgggc

SEQ ID NO: 400936 - RNA, 16 nt, Bordetella pertussis
gccggcgcgccgggcc

SEQ ID NO: 400937 - RNA, 14 nt, Bordetella pertussis
gccggcgcgccugc

SEQ ID NO: 400938 - RNA, 12 nt, Bordetella pertussis
gccggcgcgcgc

SEQ ID NO: 400939 - RNA, 14 nt, Bordetella pertussis
gccggcgcgcgcgc

SEQ ID NO: 400940 - RNA, 14 nt, Bordetella pertussis
gccggcgcgcggcc

SEQ ID NO: 400941 - RNA, 15 nt, Bordetella pertussis
gccggcgcgcggccg

SEQ ID NO: 400942 - RNA, 20 nt, Bordetella pertussis
gccggcggccuaugugcagg

SEQ ID NO: 400943 - RNA, 16 nt, Bordetella pertussis
gccggcggccugcagg

SEQ ID NO: 400944 - RNA, 17 nt, Bordetella pertussis
gccggcggccugcaggc

SEQ ID NO: 400945 - RNA, 19 nt, Bordetella pertussis
gccggcggccugcaggccg

SEQ ID NO: 400946 - RNA, 13 nt, Bordetella pertussis
gccggcggcgagc

SEQ ID NO: 400947 - RNA, 12 nt, Bordetella pertussis
gccggcggcgca

SEQ ID NO: 400948 - RNA, 13 nt, Bordetella pertussis
gccggcggcgcug

SEQ ID NO: 400949 - RNA, 15 nt, Bordetella pertussis
gccggcggcgcuggc

SEQ ID NO: 400950 - RNA, 17 nt, Bordetella pertussis
gccggcggcgcuggcga

SEQ ID NO: 400951 - RNA, 14 nt, Bordetella pertussis
gccggcgcgcucgc

SEQ ID NO: 400952 - RNA, 21 nt, Bordetella pertussis
gccggcggcgugcccugcggc

SEQ ID NO: 400953 - RNA, 16 nt, Bordetella pertussis
gccggcggcguggccg

SEQ ID NO: 400954 - RNA, 14 nt, Bordetella pertussis
gccggcgggcggcu

SEQ ID NO: 400955 - RNA, 19 nt, Bordetella pertussis
gccggcgguaagcguccgc

SEQ ID NO: 400956 - RNA, 22 nt, Bordetella pertussis
gccggcggucccgagcgcuccc

SEQ ID NO: 400957 - RNA, 16 nt, Bordetella pertussis
gccggcggucgcgcug

SEQ ID NO: 400958 - RNA, 15 nt, Bordetella pertussis
gccggcguauuccug

SEQ ID NO: 400959 - RNA, 18 nt, Bordetella pertussis
gccggcgucaaaccaagc

SEQ ID NO: 400960 - RNA, 15 nt, Bordetella pertussis
gccggcggugaugac

SEQ ID NO: 400961 - RNA, 16 nt, Bordetella pertussis
gccggcguccugcggc

SEQ ID NO: 400962 - RNA, 22 nt, Bordetella pertussis
gccggcguccugcggcggcagc

SEQ ID NO: 400963 - RNA, 17 nt, Bordetella pertussis
gccggcguggccugccc

SEQ ID NO: 400964 - RNA, 15 nt, Bordetella pertussis
gccggcguggcgcgc

SEQ ID NO: 400965 - RNA, 21 nt, Bordetella pertussis
gccggcguguucagcgcgcgc

SEQ ID NO: 400966 - RNA, 20 nt, Bordetella pertussis
gccggcguucuggucagccg

SEQ ID NO: 400967 - RNA, 18 nt, Bordetella pertussis
gccggcguucuucagcgc

SEQ ID NO: 400968 - RNA, 22 nt, Bordetella pertussis
gccggcuacagcucgccggcga

SEQ ID NO: 400969 - RNA, 14 nt, Bordetella pertussis
gccggcucagcccc

SEQ ID NO: 400970 - RNA, 13 nt, Bordetella pertussis
gccgggaaaaaga

SEQ ID NO: 400971 - RNA, 12 nt, Bordetella pertussis
gccgggacaggc

SEQ ID NO: 400972 - RNA, 13 nt, Bordetella pertussis
gccgggacaggca

SEQ ID NO: 400973 - RNA, 15 nt, Bordetella pertussis
gccgggacaggcacc

SEQ ID NO: 400974 - RNA, 18 nt, Bordetella pertussis
gccgggacaggcacccgc

SEQ ID NO: 400975 - RNA, 20 nt, Bordetella pertussis
gccgggacaggcacccgcgc

SEQ ID NO: 400976 - RNA, 21 nt, Bordetella pertussis
gccgggaccuuggcggcuggc

SEQ ID NO: 400977 - RNA, 19 nt, Bordetella pertussis
gccgggacggaaguccugc

SEQ ID NO: 400978 - RNA, 23 nt, Bordetella pertussis
gccgggagccuguccccgccggg

SEQ ID NO: 400979 - RNA, 16 nt, Bordetella pertussis
gccgggagcggccagc

SEQ ID NO: 400980 - RNA, 20 nt, Bordetella pertussis
gccgggagcggccagcaagc

SEQ ID NO: 400981 - RNA, 20 nt, Bordetella pertussis
gccgggauccacgccgccgg

SEQ ID NO: 400982 - RNA, 22 nt, Bordetella pertussis
gccgggaugcugcucggccaug

SEQ ID NO: 400983 - RNA, 14 nt, Bordetella pertussis
gccgggcgccggcg

SEQ ID NO: 400984 - RNA, 16 nt, Bordetella pertussis
gccgggcgccggcggc

SEQ ID NO: 400985 - RNA, 14 nt, Bordetella pertussis
gccgggcgcgcgcc

SEQ ID NO: 400986 - RNA, 17 nt, Bordetella pertussis
gccgggcgcggccaggc

SEQ ID NO: 400987 - RNA, 19 nt, Bordetella pertussis
gccgggcgcggcccggcgu

SEQ ID NO: 400988 - RNA, 21 nt, Bordetella pertussis
gccgggcgcggcgcccgccug

SEQ ID NO: 400989 - RNA, 11 nt, Bordetella pertussis
gccgggcgcgu

SEQ ID NO: 400990 - RNA, 18 nt, Bordetella pertussis
gccgggcgcguggcccgc

SEQ ID NO: 400991 - RNA, 20 nt, Bordetella pertussis
gccgggcgcguggcccgcgc

SEQ ID NO: 400992 - RNA, 16 nt, Bordetella pertussis
gccgggcgcgccggcg

SEQ ID NO: 400993 - RNA, 13 nt, Bordetella pertussis
gccgggcgcgcgc

SEQ ID NO: 400994 - RNA, 11 nt, Bordetella pertussis
gccgggcggcg

SEQ ID NO: 400995 - RNA, 17 nt, Bordetella pertussis
gccgggcggcgccgucg

SEQ ID NO: 400996 - RNA, 16 nt, Bordetella pertussis
gccgggcugccggcag

SEQ ID NO: 400997 - RNA, 21 nt, Bordetella pertussis
gccgggcugccggcagcaggg

SEQ ID NO: 400998 - RNA, 18 nt, Bordetella pertussis
gccgggcuggauccggcg

SEQ ID NO: 400999 - RNA, 22 nt, Bordetella pertussis
gccgguagcgcugggcgccagc

SEQ ID NO: 401000 - RNA, 23 nt, Bordetella pertussis
gccgguaucgguguggugcugcg

SEQ ID NO: 401001 - RNA, 16 nt, Bordetella pertussis
gccgguaucgacgcgc

SEQ ID NO: 401002 - RNA, 16 nt, Bordetella pertussis
gccgguaucgcggcgc

SEQ ID NO: 401003 - RNA, 20 nt, Bordetella pertussis
gccgguaucgcggcgcaggc

SEQ ID NO: 401004 - RNA, 14 nt, Bordetella pertussis
gccggucacgcugg

SEQ ID NO: 401005 - RNA, 21 nt, Bordetella pertussis
gccggucacugccgaaacgcu

SEQ ID NO: 401006 - RNA, 20 nt, Bordetella pertussis
gccggucagcccaggcgggc

SEQ ID NO: 401007 - RNA, 20 nt, Bordetella pertussis
gccggucaugcaccugcagg

SEQ ID NO: 401008 - RNA, 17 nt, Bordetella pertussis
gccgguccagcgcccga

SEQ ID NO: 401009 - RNA, 19 nt, Bordetella pertussis
gccgguccgccucgcacag

SEQ ID NO: 401010 - RNA, 18 nt, Bordetella pertussis
gccgguccgcucgaggcc

SEQ ID NO: 401011 - RNA, 21 nt, Bordetella pertussis
gccgguccgcucgaggccagg

SEQ ID NO: 401012 - RNA, 22 nt, Bordetella pertussis
gccgguccgcucgaggccaggc

SEQ ID NO: 401013 - RNA, 14 nt, Bordetella pertussis
gccggucgccgcgg

SEQ ID NO: 401014 - RNA, 13 nt, Bordetella pertussis
gccggucgcggcg

SEQ ID NO: 401015 - RNA, 15 nt, Bordetella pertussis
gccggucugggcgcg

SEQ ID NO: 401016 - RNA, 15 nt, Bordetella pertussis
gccggucuggucggc

SEQ ID NO: 401017 - RNA, 20 nt, Bordetella pertussis
gccggugaccgccagcaggc

SEQ ID NO: 401018 - RNA, 22 nt, Bordetella pertussis
gccggugauaugcgccaggccc

SEQ ID NO: 401019 - RNA, 14 nt, Bordetella pertussis
gccggugcaccagg

SEQ ID NO: 401020 - RNA, 22 nt, Bordetella pertussis
gccggugcaggucaucgcgcug

SEQ ID NO: 401021 - RNA, 19 nt, Bordetella pertussis
gccggugcaucggccggcg

SEQ ID NO: 401022 - RNA, 18 nt, Bordetella pertussis
gccggugcgcggcgcccc

SEQ ID NO: 401023 - RNA, 16 nt, Bordetella pertussis
gccggugcgcggcuug

SEQ ID NO: 401024 - RNA, 22 nt, Bordetella pertussis
gccggugcgcagcaccagcaug

SEQ ID NO: 401025 - RNA, 17 nt, Bordetella pertussis
gccggugcucggccagc

SEQ ID NO: 401026 - RNA, 23 nt, Bordetella pertussis
gccggugcucggccagcgcgcgc

SEQ ID NO: 401027 - RNA, 16 nt, Bordetella pertussis
gccgguggaccagggc

SEQ ID NO: 401028 - RNA, 17 nt, Bordetella pertussis
gccgguggacggccagc

SEQ ID NO: 401029 - RNA, 15 nt, Bordetella pertussis
gccgguggccagcag

SEQ ID NO: 401030 - RNA, 18 nt, Bordetella pertussis
gccgguguagcugcccgc

SEQ ID NO: 401031 - RNA, 13 nt, Bordetella pertussis
gccggugucgggg

SEQ ID NO: 401032 - RNA, 20 nt, Bordetella pertussis
gccgguuuuuuugcgccgcu

SEQ ID NO: 401033 - RNA, 22 nt, Bordetella pertussis
gccguaaccggccagucccagg

SEQ ID NO: 401034 - RNA, 16 nt, Bordetella pertussis
gccguacagccgcggc

SEQ ID NO: 401035 - RNA, 21 nt, Bordetella pertussis
gccguacagcgaaggggcgca

SEQ ID NO: 401036 - RNA, 16 nt, Bordetella pertussis
gccguaccccagcaug

SEQ ID NO: 401037 - RNA, 13 nt, Bordetella pertussis
gccguacugggca

SEQ ID NO: 401038 - RNA, 23 nt, Bordetella pertussis
gccguacuuggcgauggccgcca

SEQ ID NO: 401039 - RNA, 13 nt, Bordetella pertussis
gccguagcccagg

SEQ ID NO: 401040 - RNA, 16 nt, Bordetella pertussis
gccguagccgcugcgc

SEQ ID NO: 401041 - RNA, 17 nt, Bordetella pertussis
gccguagcgcgccagcc

SEQ ID NO: 401042 - RNA, 14 nt, Bordetella pertussis
gccguaggacagcc

SEQ ID NO: 401043 - RNA, 15 nt, Bordetella pertussis
gccguaggcgccggc

SEQ ID NO: 401044 - RNA, 21 nt, Bordetella pertussis
gccgucaagcguucauggcgc

SEQ ID NO: 401045 - RNA, 21 nt, Bordetella pertussis
gccgucaagcguucauggcgu

SEQ ID NO: 401046 - RNA, 19 nt, Bordetella pertussis
gccgucaccgccgccgcgc

SEQ ID NO: 401047 - RNA, 13 nt, Bordetella pertussis
gccgucagcagca

SEQ ID NO: 401048 - RNA, 13 nt, Bordetella pertussis
gccgucagcagcg

SEQ ID NO: 401049 - RNA, 20 nt, Bordetella pertussis
gccgucagcagcgcggcgcc

SEQ ID NO: 401050 - RNA, 16 nt, Bordetella pertussis
gccgucagcagcaggc

SEQ ID NO: 401051 - RNA, 20 nt, Bordetella pertussis
gccguccacgaaggcagcac

SEQ ID NO: 401052 - RNA, 21 nt, Bordetella pertussis
gccguccacgaaggcagcacc

SEQ ID NO: 401053 - RNA, 22 nt, Bordetella pertussis
gccguccaggaagcagcccagc

SEQ ID NO: 401054 - RNA, 18 nt, Bordetella pertussis
gccguccaggcgccgcac

SEQ ID NO: 401055 - RNA, 18 nt, Bordetella pertussis
gccguccagucccguggc

SEQ ID NO: 401056 - RNA, 19 nt, Bordetella pertussis
gccguccagucccguggcg

SEQ ID NO: 401057 - RNA, 17 nt, Bordetella pertussis
gccguccucgcgggccu

SEQ ID NO: 401058 - RNA, 21 nt, Bordetella pertussis
gccguccuugagggcgcgggc

SEQ ID NO: 401059 - RNA, 15 nt, Bordetella pertussis
gccgucgaacuccuc

SEQ ID NO: 401060 - RNA, 18 nt, Bordetella pertussis
gccgucgaacuccugcag

SEQ ID NO: 401061 - RNA, 15 nt, Bordetella pertussis
gccgucgaaggccgc

SEQ ID NO: 401062 - RNA, 18 nt, Bordetella pertussis
gccguccuuggcgccggc

SEQ ID NO: 401063 - RNA, 16 nt, Bordetella pertussis
gccguccuugugccag

SEQ ID NO: 401064 - RNA, 18 nt, Bordetella pertussis
gccgucgaccgacagcac

SEQ ID NO: 401065 - RNA, 22 nt, Bordetella pertussis
gccgucgagcgcgaaauccagc

SEQ ID NO: 401066 - RNA, 17 nt, Bordetella pertussis
gccgucgagcgcggcca

SEQ ID NO: 401067 - RNA, 18 nt, Bordetella pertussis
gccgucgcccuggcggcg

SEQ ID NO: 401068 - RNA, 18 nt, Bordetella pertussis
gccgucgccgcccacggc

SEQ ID NO: 401069 - RNA, 16 nt, Bordetella pertussis
gccgucgccgcccugc

SEQ ID NO: 401070 - RNA, 23 nt, Bordetella pertussis
gccgucgccgcccugcugcccgc

SEQ ID NO: 401071 - RNA, 20 nt, Bordetella pertussis
gccgucgcgauuuccaugac

SEQ ID NO: 401072 - RNA, 15 nt, Bordetella pertussis
gccgucgcuggggcg

SEQ ID NO: 401073 - RNA, 17 nt, Bordetella pertussis
gccgucuggcggcagcu

SEQ ID NO: 401074 - RNA, 22 nt, Bordetella pertussis
gccgucugugcgccccgcuggc

SEQ ID NO: 401075 - RNA, 19 nt, Bordetella pertussis
gccgugaaugcgccuggcg

SEQ ID NO: 401076 - RNA, 20 nt, Bordetella pertussis
gccgugacuucggccgccag

SEQ ID NO: 401077 - RNA, 14 nt, Bordetella pertussis
gccgugagcgccgc

SEQ ID NO: 401078 - RNA, 22 nt, Bordetella pertussis
gccgugcgaggcgaacaggcac

SEQ ID NO: 401079 - RNA, 19 nt, Bordetella pertussis
gccgugcgccagcgccagc

SEQ ID NO: 401080 - RNA, 19 nt, Bordetella pertussis
gccgugcugguuguccacc

SEQ ID NO: 401081 - RNA, 21 nt, Bordetella pertussis
gccguggacgugcgcgaccgc

SEQ ID NO: 401082 - RNA, 23 nt, Bordetella pertussis
gccguggacgugcgcgaccgcgc

SEQ ID NO: 401083 - RNA, 20 nt, Bordetella pertussis
gccguggccaagggcgccgc

SEQ ID NO: 401084 - RNA, 15 nt, Bordetella pertussis
gccguggcccagccg

SEQ ID NO: 401085 - RNA, 12 nt, Bordetella pertussis
gccguucaggga

SEQ ID NO: 401086 - RNA, 23 nt, Bordetella pertussis
gccguucagguucaucagccgga

SEQ ID NO: 401087 - RNA, 14 nt, Bordetella pertussis
gccguucaugccga

SEQ ID NO: 401088 - RNA, 22 nt, Bordetella pertussis
gccguucagggacgggccagcc

SEQ ID NO: 401089 - RNA, 17 nt, Bordetella pertussis
gccguuccaguccagcg

SEQ ID NO: 401090 - RNA, 14 nt, Bordetella pertussis
gccguucccgccgg

SEQ ID NO: 401091 - RNA, 17 nt, Bordetella pertussis
gccguucccgccgggcu

SEQ ID NO: 401092 - RNA, 17 nt, Bordetella pertussis
gccguuguccuggcgcg

SEQ ID NO: 401093 - RNA, 19 nt, Bordetella pertussis
gccguuucaggccugcggc

SEQ ID NO: 401094 - RNA, 20 nt, Bordetella pertussis
gccguuucucaacccgccgg

SEQ ID NO: 401095 - RNA, 20 nt, Bordetella pertussis
gccguuuucgaucagggcga

SEQ ID NO: 401096 - RNA, 23 nt, Bordetella pertussis
gcgaaacccucccacgaccugca

SEQ ID NO: 401097 - RNA, 18 nt, Bordetella pertussis
gcgaaacggcgggcgcgc

SEQ ID NO: 401098 - RNA, 21 nt, Bordetella pertussis
gcgaaagcgcgucgagcaggc

SEQ ID NO: 401099 - RNA, 23 nt, Bordetella pertussis
gcgaaccaggccaccgcggugcc

SEQ ID NO: 401100 - RNA, 15 nt, Bordetella pertussis
gcgaacccgccgcga

SEQ ID NO: 401101 - RNA, 21 nt, Bordetella pertussis
gcgaaccgaaaugccgcagca

SEQ ID NO: 401102 - RNA, 19 nt, Bordetella pertussis
gcgaagaacaccgccgcgc

SEQ ID NO: 401103 - RNA, 16 nt, Bordetella pertussis
gcgaagaucccgccgg

SEQ ID NO: 401104 - RNA, 21 nt, Bordetella pertussis
gcgaagcagccggccaaggca

SEQ ID NO: 401105 - RNA, 22 nt, Bordetella pertussis
gcgaagccacggcccgccagga

SEQ ID NO: 401106 - RNA, 21 nt, Bordetella pertussis
gcgaauccgcaacccagcagc

SEQ ID NO: 401107 - RNA, 22 nt, Bordetella pertussis
gcgaauccaucaucagcauggc

SEQ ID NO: 401108 - RNA, 15 nt, Bordetella pertussis
gcgaauggccacggc

SEQ ID NO: 401109 - RNA, 19 nt, Bordetella pertussis
gcgaauuccguuugagaca

SEQ ID NO: 401110 - RNA, 22 nt, Bordetella pertussis
gcgacagcuugaugggcgaggc

SEQ ID NO: 401111 - RNA, 18 nt, Bordetella pertussis
gcgacaggcgcagcucga

SEQ ID NO: 401112 - RNA, 13 nt, Bordetella pertussis
gcgacaggcgcgc

SEQ ID NO: 401113 - RNA, 16 nt, Bordetella pertussis
gcgacaggcccgcggc

SEQ ID NO: 401114 - RNA, 14 nt, Bordetella pertussis
gcgacaugagcugc

SEQ ID NO: 401115 - RNA, 16 nt, Bordetella pertussis
gcgacaugagcugcgc

SEQ ID NO: 401116 - RNA, 15 nt, Bordetella pertussis
gcgaccacuggcaga

SEQ ID NO: 401117 - RNA, 13 nt, Bordetella pertussis
gcgaccgccgccu

SEQ ID NO: 401118 - RNA, 17 nt, Bordetella pertussis
gcgaccgccuccagcgc

SEQ ID NO: 401119 - RNA, 13 nt, Bordetella pertussis
gcgaccgcgcggc

SEQ ID NO: 401120 - RNA, 17 nt, Bordetella pertussis
gcgaccgcgcggcgcug

SEQ ID NO: 401121 - RNA, 21 nt, Bordetella pertussis
gcgaccgcgcggcgcugcacg

SEQ ID NO: 401122 - RNA, 15 nt, Bordetella pertussis
gcgaccggcgccggc

SEQ ID NO: 401123 - RNA, 15 nt, Bordetella pertussis
gcgacgcagcacggc

SEQ ID NO: 401124 - RNA, 15 nt, Bordetella pertussis
gcgacgcaugucagc

SEQ ID NO: 401125 - RNA, 17 nt, Bordetella pertussis
gcgacgccagcgcgcca

SEQ ID NO: 401126 - RNA, 16 nt, Bordetella pertussis
gcgacgcgacgcgggc

SEQ ID NO: 401127 - RNA, 17 nt, Bordetella pertussis
gcgacgcgacgcgggcg

SEQ ID NO: 401128 - RNA, 18 nt, Bordetella pertussis
gcgacgcgacgcgggcgg

SEQ ID NO: 401129 - RNA, 17 nt, Bordetella pertussis
gcgacgcgcccucaguc

SEQ ID NO: 401130 - RNA, 15 nt, Bordetella pertussis
gcgacgcgccugcgc

SEQ ID NO: 401131 - RNA, 20 nt, Bordetella pertussis
gcgacggaugggcgccgugc

SEQ ID NO: 401132 - RNA, 17 nt, Bordetella pertussis
gcgacggccucccgccg

SEQ ID NO: 401133 - RNA, 16 nt, Bordetella pertussis
gcgacggcgccuggcg

SEQ ID NO: 401134 - RNA, 13 nt, Bordetella pertussis
gcgacggcggccu

SEQ ID NO: 401135 - RNA, 19 nt, Bordetella pertussis
gcgacgguccugcgcgccg

SEQ ID NO: 401136 - RNA, 16 nt, Bordetella pertussis
gcgacgucccaggccg

SEQ ID NO: 401137 - RNA, 16 nt, Bordetella pertussis
gcgacuccggccgggc

SEQ ID NO: 401138 - RNA, 17 nt, Bordetella pertussis
gcgacuccggccgggcc

SEQ ID NO: 401139 - RNA, 22 nt, Bordetella pertussis
gcgacucgaacaccggcuuggc

SEQ ID NO: 401140 - RNA, 16 nt, Bordetella pertussis
gcgagaaccaggccac

SEQ ID NO: 401141 - RNA, 21 nt, Bordetella pertussis
gcgagaccacgauggccggcg

SEQ ID NO: 401142 - RNA, 23 nt, Bordetella pertussis
gcgagaccagcggaucgccgggc

SEQ ID NO: 401143 - RNA, 20 nt, Bordetella pertussis
gcgagacgaaggcgccggcc

SEQ ID NO: 401144 - RNA, 23 nt, Bordetella pertussis
gcgagacgucggcgauggcccgg

SEQ ID NO: 401145 - RNA, 15 nt, Bordetella pertussis
gcgagcacccgcagg

SEQ ID NO: 401146 - RNA, 22 nt, Bordetella pertussis
gcgagcacggcguggcgcgcac

SEQ ID NO: 401147 - RNA, 16 nt, Bordetella pertussis
gcgagcagaugcaccg

SEQ ID NO: 401148 - RNA, 17 nt, Bordetella pertussis
gcgagcauggcgguggc

SEQ ID NO: 401149 - RNA, 20 nt, Bordetella pertussis
gcgagcauggcgguggccag

SEQ ID NO: 401150 - RNA, 17 nt, Bordetella pertussis
gcgagcgcggcgcgcgc

SEQ ID NO: 401151 - RNA, 16 nt, Bordetella pertussis
gcgagcgcggcgggug

SEQ ID NO: 401152 - RNA, 15 nt, Bordetella pertussis
gcgagcggggcuggu

SEQ ID NO: 401153 - RNA, 15 nt, Bordetella pertussis
gcgagcugcgcgacc

SEQ ID NO: 401154 - RNA, 13 nt, Bordetella pertussis
gcgagcuggcccu

SEQ ID NO: 401155 - RNA, 18 nt, Bordetella pertussis
gcgaguaucccuaccgcc

SEQ ID NO: 401156 - RNA, 15 nt, Bordetella pertussis
gcgagugcgccccgc

SEQ ID NO: 401157 - RNA, 18 nt, Bordetella pertussis
gcgaguuguccuggccgg

SEQ ID NO: 401158 - RNA, 13 nt, Bordetella pertussis
gcgauauggccag

SEQ ID NO: 401159 - RNA, 14 nt, Bordetella pertussis
gcgauauggccagg

SEQ ID NO: 401160 - RNA, 20 nt, Bordetella pertussis
gcgaucaccgagugggcggc

SEQ ID NO: 401161 - RNA, 14 nt, Bordetella pertussis
gcgaucagcgcggc

SEQ ID NO: 401162 - RNA, 15 nt, Bordetella pertussis
gcgaucagcgcggcc

SEQ ID NO: 401163 - RNA, 23 nt, Bordetella pertussis
gcgaucggagaaaucgccgccgg

SEQ ID NO: 401164 - RNA, 16 nt, Bordetella pertussis
gcgaucggcccgggcg

SEQ ID NO: 401165 - RNA, 16 nt, Bordetella pertussis
gcgaucugggccucgg

SEQ ID NO: 401166 - RNA, 21 nt, Bordetella pertussis
gcgaucugggccucggccagc

SEQ ID NO: 401167 - RNA, 17 nt, Bordetella pertussis
gcgaucugcggcguggc

SEQ ID NO: 401168 - RNA, 22 nt, Bordetella pertussis
gcgaugcccuggauggccuggg

SEQ ID NO: 401169 - RNA, 18 nt, Bordetella pertussis
gcgaugccggccagcagc

SEQ ID NO: 401170 - RNA, 15 nt, Bordetella pertussis
gcgaugcgccaggcg

SEQ ID NO: 401171 - RNA, 16 nt, Bordetella pertussis
gcgaugcgcgcgugca

SEQ ID NO: 401172 - RNA, 18 nt, Bordetella pertussis
gcgaugcgcgcgugcagc

SEQ ID NO: 401173 - RNA, 17 nt, Bordetella pertussis
gcgaugcgcggcccggc

SEQ ID NO: 401174 - RNA, 19 nt, Bordetella pertussis
gcgaugcgggccacgccgg

SEQ ID NO: 401175 - RNA, 20 nt, Bordetella pertussis
gcgaugcgggccacgccggc

SEQ ID NO: 401176 - RNA, 22 nt, Bordetella pertussis
gcgaugcgggccacgccggccg

SEQ ID NO: 401177 - RNA, 16 nt, Bordetella pertussis
gcgaugcgggcggcgg

SEQ ID NO: 401178 - RNA, 17 nt, Bordetella pertussis
gcgaugcgggcggcggu

SEQ ID NO: 401179 - RNA, 22 nt, Bordetella pertussis
gcgaugcucacgcccaguccca

SEQ ID NO: 401180 - RNA, 15 nt, Bordetella pertussis
gcgaugcugcgcaag

SEQ ID NO: 401181 - RNA, 20 nt, Bordetella pertussis
gcgcaagcagggaugccggu

SEQ ID NO: 401182 - RNA, 17 nt, Bordetella pertussis
gcgcaagccgcccgcgg

SEQ ID NO: 401183 - RNA, 16 nt, Bordetella pertussis
gcgcaagccgccgccc

SEQ ID NO: 401184 - RNA, 20 nt, Bordetella pertussis
gcgcaagccggccgcgcggc

SEQ ID NO: 401185 - RNA, 21 nt, Bordetella pertussis
gcgcaagccggccgcgcggcc

SEQ ID NO: 401186 - RNA, 13 nt, Bordetella pertussis
gcgcaagcggccc

SEQ ID NO: 401187 - RNA, 16 nt, Bordetella pertussis
gcgcaagcggccccag

SEQ ID NO: 401188 - RNA, 23 nt, Bordetella pertussis
gcgcaaggacgcguccucggcca

SEQ ID NO: 401189 - RNA, 13 nt, Bordetella pertussis
gcgcaagcgcgcc

SEQ ID NO: 401190 - RNA, 14 nt, Bordetella pertussis
gcgcaaggcgggcu

SEQ ID NO: 401191 - RNA, 20 nt, Bordetella pertussis
gcgcacacuggccagcaagc

SEQ ID NO: 401192 - RNA, 14 nt, Bordetella pertussis
gcgcacagcgcggc

SEQ ID NO: 401193 - RNA, 15 nt, Bordetella pertussis
gcgcacaggcggcgc

SEQ ID NO: 401194 - RNA, 15 nt, Bordetella pertussis
gcgcacagggcgucg

SEQ ID NO: 401195 - RNA, 15 nt, Bordetella pertussis
gcgcacaggucgccg

SEQ ID NO: 401196 - RNA, 16 nt, Bordetella pertussis
gcgcacaggcgcucgc

SEQ ID NO: 401197 - RNA, 14 nt, Bordetella pertussis
gcgcacauccagcc

SEQ ID NO: 401198 - RNA, 22 nt, Bordetella pertussis
gcgcaccaaucuugccaggccc

SEQ ID NO: 401199 - RNA, 20 nt, Bordetella pertussis
gcgcaccagcccgcccgcgc

SEQ ID NO: 401200 - RNA, 22 nt, Bordetella pertussis
gcgcaccagcccgcccgcgccc

SEQ ID NO: 401201 - RNA, 23 nt, Bordetella pertussis
gcgcaccagcgaguuguccuggc

SEQ ID NO: 401202 - RNA, 16 nt, Bordetella pertussis
gcgcaccagcgcgccg

SEQ ID NO: 401203 - RNA, 15 nt, Bordetella pertussis
gcgcaccaggccugc

SEQ ID NO: 401204 - RNA, 14 nt, Bordetella pertussis
gcgcaccaggcgcg

SEQ ID NO: 401205 - RNA, 16 nt, Bordetella pertussis
gcgcaccaggcgcggc

SEQ ID NO: 401206 - RNA, 17 nt, Bordetella pertussis
gcgcaccaggcgcucgc

SEQ ID NO: 401207 - RNA, 18 nt, Bordetella pertussis
gcgcaccaggcgcucgcg

SEQ ID NO: 401208 - RNA, 20 nt, Bordetella pertussis
gcgcaccaugcggugcgccc

SEQ ID NO: 401209 - RNA, 13 nt, Bordetella pertussis
gcgcaccauggcg

SEQ ID NO: 401210 - RNA, 14 nt, Bordetella pertussis
gcgcaccauggcgc

SEQ ID NO: 401211 - RNA, 17 nt, Bordetella pertussis
gcgcaccaugggcgucg

SEQ ID NO: 401212 - RNA, 15 nt, Bordetella pertussis
gcgcacccgcaggcc

SEQ ID NO: 401213 - RNA, 13 nt, Bordetella pertussis
gcgcacccgccug

SEQ ID NO: 401214 - RNA, 21 nt, Bordetella pertussis
gcgcacccgccuggacggcga

SEQ ID NO: 401215 - RNA, 12 nt, Bordetella pertussis
gcgcacccgcgg

SEQ ID NO: 401216 - RNA, 13 nt, Bordetella pertussis
gcgcacccgcggc

SEQ ID NO: 401217 - RNA, 19 nt, Bordetella pertussis
gcgcacccguuccagcaug

SEQ ID NO: 401218 - RNA, 20 nt, Bordetella pertussis
gcgcacccguuccagcaugu

SEQ ID NO: 401219 - RNA, 20 nt, Bordetella pertussis
gcgcacccugcaggccgggc

SEQ ID NO: 401220 - RNA, 18 nt, Bordetella pertussis
gcgcaccgacggcagccc

SEQ ID NO: 401221 - RNA, 21 nt, Bordetella pertussis
gcgcaccgacggcagccccgg

SEQ ID NO: 401222 - RNA, 14 nt, Bordetella pertussis
gcgcaccgccugcu

SEQ ID NO: 401223 - RNA, 18 nt, Bordetella pertussis
gcgcaccggccaggggcg

SEQ ID NO: 401224 - RNA, 14 nt, Bordetella pertussis
gcgcaccggccggc

SEQ ID NO: 401225 - RNA, 18 nt, Bordetella pertussis
gcgcaccggccggccggg

SEQ ID NO: 401226 - RNA, 21 nt, Bordetella pertussis
gcgcaccggcuuggggcgcgc

SEQ ID NO: 401227 - RNA, 23 nt, Bordetella pertussis
gcgcaccggcuuggggcgcgccg

SEQ ID NO: 401228 - RNA, 16 nt, Bordetella pertussis
gcgcaccugcugcggc

SEQ ID NO: 401229 - RNA, 20 nt, Bordetella pertussis
gcgcaccugggaggggccgg

SEQ ID NO: 401230 - RNA, 21 nt, Bordetella pertussis
gcgcaccugggaggggccggc

SEQ ID NO: 401231 - RNA, 18 nt, Bordetella pertussis
gcgcaccuguucggcggc

SEQ ID NO: 401232 - RNA, 22 nt, Bordetella pertussis
gcgcaccuguucggcggcgccc

SEQ ID NO: 401233 - RNA, 21 nt, Bordetella pertussis
gcgcacgaaguacucgccggc

SEQ ID NO: 401234 - RNA, 22 nt, Bordetella pertussis
gcgcagaaaccgccacagcgcc

SEQ ID NO: 401235 - RNA, 12 nt, Bordetella pertussis
gcgcagacgcgc

SEQ ID NO: 401236 - RNA, 17 nt, Bordetella pertussis
gcgcagaucccaggcgc

SEQ ID NO: 401237 - RNA, 17 nt, Bordetella pertussis
gcgcagaugggcggcga

SEQ ID NO: 401238 - RNA, 17 nt, Bordetella pertussis
gcgcagauugcgcucgg

SEQ ID NO: 401239 - RNA, 22 nt, Bordetella pertussis
gcgcagccgggcugccggcagc

SEQ ID NO: 401240 - RNA, 13 nt, Bordetella pertussis
gcgcagcgccgcu

SEQ ID NO: 401241 - RNA, 19 nt, Bordetella pertussis
gcgcagcgccugcaggcgg

SEQ ID NO: 401242 - RNA, 16 nt, Bordetella pertussis
gcgcagcgccuggccg

SEQ ID NO: 401243 - RNA, 15 nt, Bordetella pertussis
gcgcaggcgcgcggg

SEQ ID NO: 401244 - RNA, 17 nt, Bordetella pertussis
gcgcaggcgugcgcggg

SEQ ID NO: 401245 - RNA, 13 nt, Bordetella pertussis
gcgcagggcggcc

SEQ ID NO: 401246 - RNA, 15 nt, Bordetella pertussis
gcgcagggcggccgg

SEQ ID NO: 401247 - RNA, 22 nt, Bordetella pertussis
gcgcagggcggccggcacgccg

SEQ ID NO: 401248 - RNA, 14 nt, Bordetella pertussis
gcgcagggcggccu

SEQ ID NO: 401249 - RNA, 14 nt, Bordetella pertussis
gcgcagggcgggcg

SEQ ID NO: 401250 - RNA, 16 nt, Bordetella pertussis
gcgcagggcgggcggu

SEQ ID NO: 401251 - RNA, 13 nt, Bordetella pertussis
gcgcagguccacc

SEQ ID NO: 401252 - RNA, 20 nt, Bordetella pertussis
gcgcaggucguggccgugcg

SEQ ID NO: 401253 - RNA, 20 nt, Bordetella pertussis
gcgcaggugugccagccgcu

SEQ ID NO: 401254 - RNA, 21 nt, Bordetella pertussis
gcgcaguaucuggugcgcguc

SEQ ID NO: 401255 - RNA, 22 nt, Bordetella pertussis
gcgcaguaucuggugcgcgucc

SEQ ID NO: 401256 - RNA, 19 nt, Bordetella pertussis
gcgcaguuccggcgggccg

SEQ ID NO: 401257 - RNA, 20 nt, Bordetella pertussis
gcgcauacagggcggugcgc

SEQ ID NO: 401258 - RNA, 14 nt, Bordetella pertussis
gcgcaucagcuugg

SEQ ID NO: 401259 - RNA, 20 nt, Bordetella pertussis
gcgcaucaugaggcggcggu

SEQ ID NO: 401260 - RNA, 16 nt, Bordetella pertussis
gcgcaucccagacagc

SEQ ID NO: 401261 - RNA, 18 nt, Bordetella pertussis
gcgcaucgacagcgcgcc

SEQ ID NO: 401262 - RNA, 19 nt, Bordetella pertussis
gcgcaucgacagcgcgccc

SEQ ID NO: 401263 - RNA, 16 nt, Bordetella pertussis
gcgcaucgagcuccug

SEQ ID NO: 401264 - RNA, 13 nt, Bordetella pertussis
gcgcaucgaucag

SEQ ID NO: 401265 - RNA, 19 nt, Bordetella pertussis
gcgcaucgaucagcgcgcc

SEQ ID NO: 401266 - RNA, 19 nt, Bordetella pertussis
gcgcaucgaucucggccuc

SEQ ID NO: 401267 - RNA, 17 nt, Bordetella pertussis
gcgcaucgaugcggccu

SEQ ID NO: 401268 - RNA, 19 nt, Bordetella pertussis
gcgcaucgaugcggccuuc

SEQ ID NO: 401269 - RNA, 19 nt, Bordetella pertussis
gcgcaucgcgaugcgcagc

SEQ ID NO: 401270 - RNA, 15 nt, Bordetella pertussis
gcgcaucgcgcaccc

SEQ ID NO: 401271 - RNA, 19 nt, Bordetella pertussis
gcgcaucgcgcgcgccggc

SEQ ID NO: 401272 - RNA, 20 nt, Bordetella pertussis
gcgcaucgcgcgcgccggca

SEQ ID NO: 401273 - RNA, 15 nt, Bordetella pertussis
gcgcaucgcgcggca

SEQ ID NO: 401274 - RNA, 14 nt, Bordetella pertussis
gcgcaucggcggca

SEQ ID NO: 401275 - RNA, 19 nt, Bordetella pertussis
gcgcaucggcgccaguagc

SEQ ID NO: 401276 - RNA, 22 nt, Bordetella pertussis
gcgcaugacgaggugccugucc

SEQ ID NO: 401277 - RNA, 23 nt, Bordetella pertussis
gcgcaugacgaggugccuguccc

SEQ ID NO: 401278 - RNA, 22 nt, Bordetella pertussis
gcgcaugacggggugccugucc

SEQ ID NO: 401279 - RNA, 19 nt, Bordetella pertussis
gcgcaugauggccggccug

SEQ ID NO: 401280 - RNA, 12 nt, Bordetella pertussis
gcgcaugccagc

SEQ ID NO: 401281 - RNA, 16 nt, Bordetella pertussis
gcgcaugccagcuugc

SEQ ID NO: 401282 - RNA, 22 nt, Bordetella pertussis
gcgcaugccauggccgcgcggc

SEQ ID NO: 401283 - RNA, 18 nt, Bordetella pertussis
gcgcauggacgccgccgc

SEQ ID NO: 401284 - RNA, 20 nt, Bordetella pertussis
gcgcauggacugcaggcgcu

SEQ ID NO: 401285 - RNA, 17 nt, Bordetella pertussis
gcgcauggccagcgcgc

SEQ ID NO: 401286 - RNA, 14 nt, Bordetella pertussis
gcgcauggcgauga

SEQ ID NO: 401287 - RNA, 18 nt, Bordetella pertussis
gcgcauggcuggucccug

SEQ ID NO: 401288 - RNA, 20 nt, Bordetella pertussis
gcgcaugggcgcaggccgcc

SEQ ID NO: 401289 - RNA, 15 nt, Bordetella pertussis
gcgcauucgcgccug

SEQ ID NO: 401290 - RNA, 17 nt, Bordetella pertussis
gcgcauugccgccgccc

SEQ ID NO: 401291 - RNA, 16 nt, Bordetella pertussis
gcgcauuggcccugcu

SEQ ID NO: 401292 - RNA, 14 nt, Bordetella pertussis
gcgcauuugccgcg

SEQ ID NO: 401293 - RNA, 15 nt, Bordetella pertussis
gcgccaacgcgucga

SEQ ID NO: 401294 - RNA, 16 nt, Bordetella pertussis
gcgccaagcggcaggc

SEQ ID NO: 401295 - RNA, 21 nt, Bordetella pertussis
gcgccaaucagauggcgcagc

SEQ ID NO: 401296 - RNA, 14 nt, Bordetella pertussis
gcgccacaaagggc

SEQ ID NO: 401297 - RNA, 21 nt, Bordetella pertussis
gcgccacaauugccagccuug

SEQ ID NO: 401298 - RNA, 17 nt, Bordetella pertussis
gcgccacacgggcgccu

SEQ ID NO: 401299 - RNA, 17 nt, Bordetella pertussis
gcgccacagggccugac

SEQ ID NO: 401300 - RNA, 18 nt, Bordetella pertussis
gcgccaccaccucggugc

SEQ ID NO: 401301 - RNA, 20 nt, Bordetella pertussis
gcgccaccagcagcgccagg

SEQ ID NO: 401302 - RNA, 21 nt, Bordetella pertussis
gcgccaccagcagcgccagga

SEQ ID NO: 401303 - RNA, 22 nt, Bordetella pertussis
gcgccaccaccggcacgccggc

SEQ ID NO: 401304 - RNA, 15 nt, Bordetella pertussis
gcgccaccccgccgc

SEQ ID NO: 401305 - RNA, 15 nt, Bordetella pertussis
gcgccaccggcugga

SEQ ID NO: 401306 - RNA, 22 nt, Bordetella pertussis
gcgccaccggucgccguccagg

SEQ ID NO: 401307 - RNA, 19 nt, Bordetella pertussis
gcgccaccuggcgcccggc

SEQ ID NO: 401308 - RNA, 22 nt, Bordetella pertussis
gcgccaccuggcgcccggcggc

SEQ ID NO: 401309 - RNA, 13 nt, Bordetella pertussis
gcgccacgccagc

SEQ ID NO: 401310 - RNA, 17 nt, Bordetella pertussis
gcgccacgcccacuucc

SEQ ID NO: 401311 - RNA, 14 nt, Bordetella pertussis
gcgccacgccggcc

SEQ ID NO: 401312 - RNA, 18 nt, Bordetella pertussis
gcgccacgccggccagcu

SEQ ID NO: 401313 - RNA, 17 nt, Bordetella pertussis
gcgccacgcgagcccgc

SEQ ID NO: 401314 - RNA, 15 nt, Bordetella pertussis
gcgccacgcccaggc

SEQ ID NO: 401315 - RNA, 15 nt, Bordetella pertussis
gcgccacggcgguga

SEQ ID NO: 401316 - RNA, 20 nt, Bordetella pertussis
gcgccacggcuucgcccagc

SEQ ID NO: 401317 - RNA, 21 nt, Bordetella pertussis
gcgccacggcuucgcccagcg

SEQ ID NO: 401318 - RNA, 22 nt, Bordetella pertussis
gcgccacggcuucgcccagcgc

SEQ ID NO: 401319 - RNA, 16 nt, Bordetella pertussis
gcgccacguccagcac

SEQ ID NO: 401320 - RNA, 19 nt, Bordetella pertussis
gcgccacguccagcacggc

SEQ ID NO: 401321 - RNA, 17 nt, Bordetella pertussis
gcgccagcacgguggcg

SEQ ID NO: 401322 - RNA, 23 nt, Bordetella pertussis
gcgccagcacgguggcgcccggc

SEQ ID NO: 401323 - RNA, 11 nt, Bordetella pertussis
gcgccagcagc

SEQ ID NO: 401324 - RNA, 15 nt, Bordetella pertussis
gcgccagcagcgccg

SEQ ID NO: 401325 - RNA, 13 nt, Bordetella pertussis
gcgccagcacggc

SEQ ID NO: 401326 - RNA, 20 nt, Bordetella pertussis
gcgccagcaugacggggucg

SEQ ID NO: 401327 - RNA, 23 nt, Bordetella pertussis
gcgccagcaugacggggucgggg

SEQ ID NO: 401328 - RNA, 18 nt, Bordetella pertussis
gcgccagcaugcgcgcgg

SEQ ID NO: 401329 - RNA, 19 nt, Bordetella pertussis
gcgccagcaugcgcgcggc

SEQ ID NO: 401330 - RNA, 23 nt, Bordetella pertussis
gcgccagcccgcccgcgagcggc

SEQ ID NO: 401331 - RNA, 13 nt, Bordetella pertussis
gcgccagccgcgc

SEQ ID NO: 401332 - RNA, 21 nt, Bordetella pertussis
gcgccagcucgcgcagcaggc

SEQ ID NO: 401333 - RNA, 23 nt, Bordetella pertussis
gcgccagcucgcguugcaccgcg

SEQ ID NO: 401334 - RNA, 21 nt, Bordetella pertussis
gcgccagcucggccaaggcau

SEQ ID NO: 401335 - RNA, 23 nt, Bordetella pertussis
gcgccagcugaccucgcccaggc

SEQ ID NO: 401336 - RNA, 14 nt, Bordetella pertussis
gcgccagcugcgca

SEQ ID NO: 401337 - RNA, 16 nt, Bordetella pertussis
gcgccagcugcgcagc

SEQ ID NO: 401338 - RNA, 18 nt, Bordetella pertussis
gcgccagcuuggccaggc

SEQ ID NO: 401339 - RNA, 19 nt, Bordetella pertussis
gcgccagcuuggccaggcu

SEQ ID NO: 401340 - RNA, 18 nt, Bordetella pertussis
gcgccaggaagcgcgccg

SEQ ID NO: 401341 - RNA, 22 nt, Bordetella pertussis
gcgccaggcaaaggcccaggca

SEQ ID NO: 401342 - RNA, 10 nt, Bordetella pertussis
gcgccaggcc

SEQ ID NO: 401343 - RNA, 17 nt, Bordetella pertussis
gcgccaguugcgcaccg

SEQ ID NO: 401344 - RNA, 18 nt, Bordetella pertussis
gcgccaguugcgcaccgc

SEQ ID NO: 401345 - RNA, 19 nt, Bordetella pertussis
gcgccaguugcgcaccgcu

SEQ ID NO: 401346 - RNA, 17 nt, Bordetella pertussis
gcgccaguugcggggcg

SEQ ID NO: 401347 - RNA, 23 nt, Bordetella pertussis
gcgccaguugcggggcgcccagc

SEQ ID NO: 401348 - RNA, 15 nt, Bordetella pertussis
gcgccauacugccau

SEQ ID NO: 401349 - RNA, 21 nt, Bordetella pertussis
gcgccauauugaugcagcacg

SEQ ID NO: 401350 - RNA, 12 nt, Bordetella pertussis
gcgccaucaucg

SEQ ID NO: 401351 - RNA, 19 nt, Bordetella pertussis
gcgccaucgacgggcggcu

SEQ ID NO: 401352 - RNA, 20 nt, Bordetella pertussis
gcgccaucuaccugucgggc

SEQ ID NO: 401353 - RNA, 22 nt, Bordetella pertussis
gcgccaugaacucgcgcucggc

SEQ ID NO: 401354 - RNA, 15 nt, Bordetella pertussis
gcgccaugaucgccg

SEQ ID NO: 401355 - RNA, 17 nt, Bordetella pertussis
gcgccaugaucgccggc

SEQ ID NO: 401356 - RNA, 20 nt, Bordetella pertussis
gcgccaugaugucgcgcgcc

SEQ ID NO: 401357 - RNA, 23 nt, Bordetella pertussis
gcgcccacgcacaugaugcccag

SEQ ID NO: 401358 - RNA, 22 nt, Bordetella pertussis
gcgcccacuggggacaugcaug

SEQ ID NO: 401359 - RNA, 20 nt, Bordetella pertussis
gcgcccagcggcaggcuggc

SEQ ID NO: 401360 - RNA, 14 nt, Bordetella pertussis
gcgcccagcugucc

SEQ ID NO: 401361 - RNA, 19 nt, Bordetella pertussis
gcgcccagcuguccaagcg

SEQ ID NO: 401362 - RNA, 17 nt, Bordetella pertussis
gcgcccagcgcggccuu

SEQ ID NO: 401363 - RNA, 17 nt, Bordetella pertussis
gcgcccagcgcgucggc

SEQ ID NO: 401364 - RNA, 21 nt, Bordetella pertussis
gcgcccagcgcgucggccagc

SEQ ID NO: 401365 - RNA, 13 nt, Bordetella pertussis
gcgcccagcgcca

SEQ ID NO: 401366 - RNA, 14 nt, Bordetella pertussis
gcgcccaggccagc

SEQ ID NO: 401367 - RNA, 14 nt, Bordetella pertussis
gcgccgccgacggc

SEQ ID NO: 401368 - RNA, 13 nt, Bordetella pertussis
gcgccgccgccau

SEQ ID NO: 401369 - RNA, 12 nt, Bordetella pertussis
gcgccgccgccc

SEQ ID NO: 401370 - RNA, 15 nt, Bordetella pertussis
gcgccgccgcccggc

SEQ ID NO: 401371 - RNA, 16 nt, Bordetella pertussis
gcgccgccgcccuggc

SEQ ID NO: 401372 - RNA, 23 nt, Bordetella pertussis
gcgccgccgccgcggccuggccg

SEQ ID NO: 401373 - RNA, 21 nt, Bordetella pertussis
gcgccgccgccggcccgccac

SEQ ID NO: 401374 - RNA, 15 nt, Bordetella pertussis
gcgccgccgccuggc

SEQ ID NO: 401375 - RNA, 18 nt, Bordetella pertussis
gcgccgccgcguggcggc

SEQ ID NO: 401376 - RNA, 16 nt, Bordetella pertussis
gcgccgccgcgcgcug

SEQ ID NO: 401377 - RNA, 15 nt, Bordetella pertussis
gcgccgccggccagc

SEQ ID NO: 401378 - RNA, 17 nt, Bordetella pertussis
gcgccgccggcggccug

SEQ ID NO: 401379 - RNA, 14 nt, Bordetella pertussis
gcgccgccgggccu

SEQ ID NO: 401380 - RNA, 19 nt, Bordetella pertussis
gcgccgccgggccugcccg

SEQ ID NO: 401381 - RNA, 17 nt, Bordetella pertussis
gcgccgccgugcgcggg

SEQ ID NO: 401382 - RNA, 17 nt, Bordetella pertussis
gcgccgccuaccaggug

SEQ ID NO: 401383 - RNA, 19 nt, Bordetella pertussis
gcgccgccucgggcacggc

SEQ ID NO: 401384 - RNA, 14 nt, Bordetella pertussis
gcgccgcgagcgcc

SEQ ID NO: 401385 - RNA, 19 nt, Bordetella pertussis
gcgccgcgauggcgccggc

SEQ ID NO: 401386 - RNA, 13 nt, Bordetella pertussis
gcgccgcgcacgc

SEQ ID NO: 401387 - RNA, 17 nt, Bordetella pertussis
gcgccgcgcagcagcaa

SEQ ID NO: 401388 - RNA, 14 nt, Bordetella pertussis
gcgccgcgccaggu

SEQ ID NO: 401389 - RNA, 15 nt, Bordetella pertussis
gcgccgcgcccgcuu

SEQ ID NO: 401390 - RNA, 17 nt, Bordetella pertussis
gcgccgcgcccggccgg

SEQ ID NO: 401391 - RNA, 15 nt, Bordetella pertussis
gcgccgcgccgggcg

SEQ ID NO: 401392 - RNA, 14 nt, Bordetella pertussis
gcgccgcgccgggg

SEQ ID NO: 401393 - RNA, 16 nt, Bordetella pertussis
gcgccgcgccggggcg

SEQ ID NO: 401394 - RNA, 12 nt, Bordetella pertussis
gcgccgcgccuc

SEQ ID NO: 401395 - RNA, 16 nt, Bordetella pertussis
gcgccgcgcgcacggc

SEQ ID NO: 401396 - RNA, 14 nt, Bordetella pertussis
gcgccgcgcgcggc

SEQ ID NO: 401397 - RNA, 22 nt, Bordetella pertussis
gcgccgcgcgcgugccgcaggc

SEQ ID NO: 401398 - RNA, 16 nt, Bordetella pertussis
gcgccgcugcagcgcu

SEQ ID NO: 401399 - RNA, 18 nt, Bordetella pertussis
gcgccgcuggcguccagg

SEQ ID NO: 401400 - RNA, 22 nt, Bordetella pertussis
gcgccgcuguggacgccgccgg

SEQ ID NO: 401401 - RNA, 21 nt, Bordetella pertussis
gcgccgcuguugcccaccagc

SEQ ID NO: 401402 - RNA, 14 nt, Bordetella pertussis
gcgccgcuuccggc

SEQ ID NO: 401403 - RNA, 23 nt, Bordetella pertussis
gcgccgcuuccggccggaacuga

SEQ ID NO: 401404 - RNA, 19 nt, Bordetella pertussis
gcgccgcuuucucccgccg

SEQ ID NO: 401405 - RNA, 17 nt, Bordetella pertussis
gcgccggaacauggcgg

SEQ ID NO: 401406 - RNA, 12 nt, Bordetella pertussis
gcgccggcggca

SEQ ID NO: 401407 - RNA, 13 nt, Bordetella pertussis
gcgccggcggccu

SEQ ID NO: 401408 - RNA, 18 nt, Bordetella pertussis
gcgccggcggccugcagg

SEQ ID NO: 401409 - RNA, 12 nt, Bordetella pertussis
gcgccggcggcg

SEQ ID NO: 401410 - RNA, 20 nt, Bordetella pertussis
gcgccggcgucacgcggccg

SEQ ID NO: 401411 - RNA, 17 nt, Bordetella pertussis
gcgccggcguccacggc

SEQ ID NO: 401412 - RNA, 14 nt, Bordetella pertussis
gcgccggcucccgc

SEQ ID NO: 401413 - RNA, 20 nt, Bordetella pertussis
gcgccggcucccgcgcugcc

SEQ ID NO: 401414 - RNA, 12 nt, Bordetella pertussis
gcgccggcuggc

SEQ ID NO: 401415 - RNA, 16 nt, Bordetella pertussis
gcgccggcucagcccc

SEQ ID NO: 401416 - RNA, 20 nt, Bordetella pertussis
gcgccgggaaaaagagccug

SEQ ID NO: 401417 - RNA, 15 nt, Bordetella pertussis
gcgccgggcccggcc

SEQ ID NO: 401418 - RNA, 20 nt, Bordetella pertussis
gcgccgggcccggccacggc

SEQ ID NO: 401419 - RNA, 14 nt, Bordetella pertussis
gcgccgggccgcua

SEQ ID NO: 401420 - RNA, 22 nt, Bordetella pertussis
gcgccgggccgcuaggccuugc

SEQ ID NO: 401421 - RNA, 14 nt, Bordetella pertussis
gcgccgggccggcg

SEQ ID NO: 401422 - RNA, 18 nt, Bordetella pertussis
gcgccgggcgaaccggug

SEQ ID NO: 401423 - RNA, 15 nt, Bordetella pertussis
gcgccgggcgacggc

SEQ ID NO: 401424 - RNA, 14 nt, Bordetella pertussis
gcgccgggcgccgc

SEQ ID NO: 401425 - RNA, 15 nt, Bordetella pertussis
gcgccgggcgcgccg

SEQ ID NO: 401426 - RNA, 17 nt, Bordetella pertussis
gcgccgggcgcgccggc

SEQ ID NO: 401427 - RNA, 13 nt, Bordetella pertussis
gcgccgggcgcgg

SEQ ID NO: 401428 - RNA, 15 nt, Bordetella pertussis
gcgccgggcgcggcc

SEQ ID NO: 401429 - RNA, 19 nt, Bordetella pertussis
gcgccgggcgcggccaggc

SEQ ID NO: 401430 - RNA, 13 nt, Bordetella pertussis
gcgccggggcggc

SEQ ID NO: 401431 - RNA, 19 nt, Bordetella pertussis
gcgccggggcggcucggcc

SEQ ID NO: 401432 - RNA, 16 nt, Bordetella pertussis
gcgccggggggcgcac

SEQ ID NO: 401433 - RNA, 18 nt, Bordetella pertussis
gcgccggggggcgcacgc

SEQ ID NO: 401434 - RNA, 20 nt, Bordetella pertussis
gcgccggggggcgcacgccg

SEQ ID NO: 401435 - RNA, 16 nt, Bordetella pertussis
gcgccgguccagcgcc

SEQ ID NO: 401436 - RNA, 14 nt, Bordetella pertussis
gcgccuccagcucc

SEQ ID NO: 401437 - RNA, 17 nt, Bordetella pertussis
gcgccuccagcuccagc

SEQ ID NO: 401438 - RNA, 18 nt, Bordetella pertussis
gcgccuccaucagcagca

SEQ ID NO: 401439 - RNA, 15 nt, Bordetella pertussis
gcgccucgcaucggc

SEQ ID NO: 401440 - RNA, 17 nt, Bordetella pertussis
gcgccucgcaucggccu

SEQ ID NO: 401441 - RNA, 22 nt, Bordetella pertussis
gcgccucgcgacggccucccgc

SEQ ID NO: 401442 - RNA, 17 nt, Bordetella pertussis
gcgccucggacgccugg

SEQ ID NO: 401443 - RNA, 19 nt, Bordetella pertussis
gcgccucguccucggugcu

SEQ ID NO: 401444 - RNA, 21 nt, Bordetella pertussis
gcgccucguccugcaggcggc

SEQ ID NO: 401445 - RNA, 12 nt, Bordetella pertussis
gcgccugagcug

SEQ ID NO: 401446 - RNA, 15 nt, Bordetella pertussis
gcgccugcagcagcg

SEQ ID NO: 401447 - RNA, 16 nt, Bordetella pertussis
gcgccugcagcgccgc

SEQ ID NO: 401448 - RNA, 17 nt, Bordetella pertussis
gcgccugcaggcggucg

SEQ ID NO: 401449 - RNA, 22 nt, Bordetella pertussis
gcgccugcauccggcccagcgc

SEQ ID NO: 401450 - RNA, 14 nt, Bordetella pertussis
gcgccugcccaggc

SEQ ID NO: 401451 - RNA, 18 nt, Bordetella pertussis
gcgccugcccaggccagc

SEQ ID NO: 401452 - RNA, 16 nt, Bordetella pertussis
gcgccugccccgccgg

SEQ ID NO: 401453 - RNA, 20 nt, Bordetella pertussis
gcgccugccccgccgggaca

SEQ ID NO: 401454 - RNA, 12 nt, Bordetella pertussis
gcgccugcccug

SEQ ID NO: 401455 - RNA, 21 nt, Bordetella pertussis
gcgccugccgcgugcccgcgu

SEQ ID NO: 401456 - RNA, 17 nt, Bordetella pertussis
gcgccugcgcgccgccu

SEQ ID NO: 401457 - RNA, 23 nt, Bordetella pertussis
gcgccugcgcgcgcuggggcagc

SEQ ID NO: 401458 - RNA, 13 nt, Bordetella pertussis
gcgccugcgcggc

SEQ ID NO: 401459 - RNA, 15 nt, Bordetella pertussis
gcgccugcgcggccu

SEQ ID NO: 401460 - RNA, 16 nt, Bordetella pertussis
gcgccugcgcggccuc

SEQ ID NO: 401461 - RNA, 20 nt, Bordetella pertussis
gcgccugcucacgccccgcc

SEQ ID NO: 401462 - RNA, 23 nt, Bordetella pertussis
gcgccugcucgaccugcucgggc

SEQ ID NO: 401463 - RNA, 16 nt, Bordetella pertussis
gcgccugcuggucggc

SEQ ID NO: 401464 - RNA, 17 nt, Bordetella pertussis
gcgccuggaccuggacg

SEQ ID NO: 401465 - RNA, 22 nt, Bordetella pertussis
gcgccuggccgcccagcgccug

SEQ ID NO: 401466 - RNA, 14 nt, Bordetella pertussis
gcgccuggccgcgc

SEQ ID NO: 401467 - RNA, 17 nt, Bordetella pertussis
gcgccuggcgcgcccac

SEQ ID NO: 401468 - RNA, 14 nt, Bordetella pertussis
gcgccuggcgggcc

SEQ ID NO: 401469 - RNA, 14 nt, Bordetella pertussis
gcgccugggcggcc

SEQ ID NO: 401470 - RNA, 17 nt, Bordetella pertussis
gcgccuggggcgggcgg

SEQ ID NO: 401471 - RNA, 17 nt, Bordetella pertussis
gcgccugguacgacagc

SEQ ID NO: 401472 - RNA, 18 nt, Bordetella pertussis
gcgccuggucgcgcgccu

SEQ ID NO: 401473 - RNA, 19 nt, Bordetella pertussis
gcgccuguccccgcugcgg

SEQ ID NO: 401474 - RNA, 16 nt, Bordetella pertussis
gcgccuuacgcggcgc

SEQ ID NO: 401475 - RNA, 20 nt, Bordetella pertussis
gcgccuuccugggcgccggc

SEQ ID NO: 401476 - RNA, 19 nt, Bordetella pertussis
gcgccuucggcgcgcacgc

SEQ ID NO: 401477 - RNA, 16 nt, Bordetella pertussis
gcgccuucggcgcggc

SEQ ID NO: 401478 - RNA, 15 nt, Bordetella pertussis
gcgccuuccggcagc

SEQ ID NO: 401479 - RNA, 18 nt, Bordetella pertussis
gcgccuuccggcagcggc

SEQ ID NO: 401480 - RNA, 16 nt, Bordetella pertussis
gcgccuucuacccgcu

SEQ ID NO: 401481 - RNA, 19 nt, Bordetella pertussis
gcgccuugcccgucagggu

SEQ ID NO: 401482 - RNA, 15 nt, Bordetella pertussis
gcgccuugccgccgu

SEQ ID NO: 401483 - RNA, 21 nt, Bordetella pertussis
gcgcgaaacccccugggugag

SEQ ID NO: 401484 - RNA, 15 nt, Bordetella pertussis
gcgcgaucgccagca

SEQ ID NO: 401485 - RNA, 16 nt, Bordetella pertussis
gcgcgaucgccgcaug

SEQ ID NO: 401486 - RNA, 22 nt, Bordetella pertussis
gcgcgaucucgcgcaggguggc

SEQ ID NO: 401487 - RNA, 18 nt, Bordetella pertussis
gcgcgaucucgggcaggu

SEQ ID NO: 401488 - RNA, 19 nt, Bordetella pertussis
gcgcgaucucgggcagguc

SEQ ID NO: 401489 - RNA, 15 nt, Bordetella pertussis
gcgcgaugggccugc

SEQ ID NO: 401490 - RNA, 19 nt, Bordetella pertussis
gcgcgauucccuggcgcgc

SEQ ID NO: 401491 - RNA, 21 nt, Bordetella pertussis
gcgcgauucccuggcgcgcca

SEQ ID NO: 401492 - RNA, 21 nt, Bordetella pertussis
gcgcgcaaaccgacgcggcca

SEQ ID NO: 401493 - RNA, 22 nt, Bordetella pertussis
gcgcgcaaaccgacgcggccag

SEQ ID NO: 401494 - RNA, 19 nt, Bordetella pertussis
gcgcgcaaccaggggcggc

SEQ ID NO: 401495 - RNA, 20 nt, Bordetella pertussis
gcgcgcaaccaggggcggcg

SEQ ID NO: 401496 - RNA, 16 nt, Bordetella pertussis
gcgcgcaacccacggc

SEQ ID NO: 401497 - RNA, 16 nt, Bordetella pertussis
gcgcgcaagagcgugu

SEQ ID NO: 401498 - RNA, 20 nt, Bordetella pertussis
gcgcgcaagccgccgcccuc

SEQ ID NO: 401499 - RNA, 17 nt, Bordetella pertussis
gcgcgcaccagcccgcc

SEQ ID NO: 401500 - RNA, 17 nt, Bordetella pertussis
gcgcgcacggcgcccug

SEQ ID NO: 401501 - RNA, 14 nt, Bordetella pertussis
gcgcgcagcacaua

SEQ ID NO: 401502 - RNA, 12 nt, Bordetella pertussis
gcgcgcagcagc

SEQ ID NO: 401503 - RNA, 15 nt, Bordetella pertussis
gcgcgcagcaggccc

SEQ ID NO: 401504 - RNA, 15 nt, Bordetella pertussis
gcgcgcagcgcgacc

SEQ ID NO: 401505 - RNA, 15 nt, Bordetella pertussis
gcgcgcagcgcgccg

SEQ ID NO: 401506 - RNA, 23 nt, Bordetella pertussis
gcgcgcagcucccccacgccgcc

SEQ ID NO: 401507 - RNA, 23 nt, Bordetella pertussis
gcgcgcaggacaaggcgcgcgcc

SEQ ID NO: 401508 - RNA, 14 nt, Bordetella pertussis
gcgcgcagggcggc

SEQ ID NO: 401509 - RNA, 16 nt, Bordetella pertussis
gcgcgcagggcggccg

SEQ ID NO: 401510 - RNA, 18 nt, Bordetella pertussis
gcgcgcaggucguggccg

SEQ ID NO: 401511 - RNA, 22 nt, Bordetella pertussis
gcgcgcaggucguggccgugcg

SEQ ID NO: 401512 - RNA, 21 nt, Bordetella pertussis
gcgcgcaggugugccagccgc

SEQ ID NO: 401513 - RNA, 23 nt, Bordetella pertussis
gcgcgcauccgguggugcugggc

SEQ ID NO: 401514 - RNA, 14 nt, Bordetella pertussis
gcgcgcccagcccc

SEQ ID NO: 401515 - RNA, 12 nt, Bordetella pertussis
gcgcgcccagcg

SEQ ID NO: 401516 - RNA, 15 nt, Bordetella pertussis
gcgcgcccagcgcgc

SEQ ID NO: 401517 - RNA, 14 nt, Bordetella pertussis
gcgcgcccagcggc

SEQ ID NO: 401518 - RNA, 19 nt, Bordetella pertussis
gcgcgcccaggggccggcg

SEQ ID NO: 401519 - RNA, 23 nt, Bordetella pertussis
gcgcgcccccagcgccgucagca

SEQ ID NO: 401520 - RNA, 14 nt, Bordetella pertussis
gcgcgccccgucgg

SEQ ID NO: 401521 - RNA, 15 nt, Bordetella pertussis
gcgcgcccgaggcgc

SEQ ID NO: 401522 - RNA, 22 nt, Bordetella pertussis
gcgcgcccgcaggcggcggccu

SEQ ID NO: 401523 - RNA, 23 nt, Bordetella pertussis
gcgcgcccgcaggcggcggccuc

SEQ ID NO: 401524 - RNA, 15 nt, Bordetella pertussis
gcgcgcccgccccgc

SEQ ID NO: 401525 - RNA, 14 nt, Bordetella pertussis
gcgcgcccgcuucc

SEQ ID NO: 401526 - RNA, 24 nt, Bordetella pertussis
gcgcgcccggcgaaagcgucggcu

SEQ ID NO: 401527 - RNA, 16 nt, Bordetella pertussis
gcgcgccgaugcgcca

SEQ ID NO: 401528 - RNA, 17 nt, Bordetella pertussis
gcgcgccguacagccgc

SEQ ID NO: 401529 - RNA, 18 nt, Bordetella pertussis
gcgcgccgucgcuggggc

SEQ ID NO: 401530 - RNA, 14 nt, Bordetella pertussis
gcgcgccgucggcg

SEQ ID NO: 401531 - RNA, 14 nt, Bordetella pertussis
gcgcgccgucgggg

SEQ ID NO: 401532 - RNA, 14 nt, Bordetella pertussis
gcgcgccguggcug

SEQ ID NO: 401533 - RNA, 24 nt, Bordetella pertussis
gcgcgccucggcgcgcgcggcgcc

SEQ ID NO: 401534 - RNA, 17 nt, Bordetella pertussis
gcgcgccugcagcagcg

SEQ ID NO: 401535 - RNA, 23 nt, Bordetella pertussis
gcgcgccugcauguccagcggcg

SEQ ID NO: 401536 - RNA, 16 nt, Bordetella pertussis
gcgcgccugcccaggc

SEQ ID NO: 401537 - RNA, 13 nt, Bordetella pertussis
gcgcgccugcccc

SEQ ID NO: 401538 - RNA, 16 nt, Bordetella pertussis
gcgcgccugcgagaga

SEQ ID NO: 401539 - RNA, 15 nt, Bordetella pertussis
gcgcgccuggcgcgc

SEQ ID NO: 401540 - RNA, 17 nt, Bordetella pertussis
gcgcgccuuacgcggcg

SEQ ID NO: 401541 - RNA, 20 nt, Bordetella pertussis
gcgcgccuuacgcggcgcgc

SEQ ID NO: 401542 - RNA, 23 nt, Bordetella pertussis
gcgcgccuuacgcggcgcgcgcc

SEQ ID NO: 401543 - RNA, 21 nt, Bordetella pertussis
gcgcgccuuacuccggcugcu

SEQ ID NO: 401544 - RNA, 20 nt, Bordetella pertussis
gcgcgccuucggcaggcgcc

SEQ ID NO: 401545 - RNA, 23 nt, Bordetella pertussis
gcgcgccuugaaccccggcugcg

SEQ ID NO: 401546 - RNA, 17 nt, Bordetella pertussis
gcgcgccuugcgcggcg

SEQ ID NO: 401547 - RNA, 20 nt, Bordetella pertussis
gcgcgccuuccugggcgccg

SEQ ID NO: 401548 - RNA, 23 nt, Bordetella pertussis
gcgcgccuuccugggcgccggcg

SEQ ID NO: 401549 - RNA, 20 nt, Bordetella pertussis
gcgcgcgacuucgccgaucg

SEQ ID NO: 401550 - RNA, 19 nt, Bordetella pertussis
gcgcgcgagcggcggccgc

SEQ ID NO: 401551 - RNA, 14 nt, Bordetella pertussis
gcgcgcgaggcggc

SEQ ID NO: 401552 - RNA, 19 nt, Bordetella pertussis
gcgcgcgaggcggcggccg

SEQ ID NO: 401553 - RNA, 15 nt, Bordetella pertussis
gcgcgcgaucgccag

SEQ ID NO: 401554 - RNA, 16 nt, Bordetella pertussis
gcgcgcgaucgccagc

SEQ ID NO: 401555 - RNA, 14 nt, Bordetella pertussis
gcgcgcgcacaggc

SEQ ID NO: 401556 - RNA, 12 nt, Bordetella pertussis
gcgcgcgcacgc

SEQ ID NO: 401557 - RNA, 15 nt, Bordetella pertussis
gcgcgcgcagccgcg

SEQ ID NO: 401558 - RNA, 13 nt, Bordetella pertussis
gcgcgcgccaggc

SEQ ID NO: 401559 - RNA, 14 nt, Bordetella pertussis
gcgcgcgccaggcc

SEQ ID NO: 401560 - RNA, 20 nt, Bordetella pertussis
gcgcgcgccaucgacgggcg

SEQ ID NO: 401561 - RNA, 17 nt, Bordetella pertussis
gcgcgcgcccugcacgc

SEQ ID NO: 401562 - RNA, 18 nt, Bordetella pertussis
gcgcgcgcaagccgccgc

SEQ ID NO: 401563 - RNA, 18 nt, Bordetella pertussis
gcgcgcgccgcgccgggg

SEQ ID NO: 401564 - RNA, 12 nt, Bordetella pertussis
gcgcgcgccggc

SEQ ID NO: 401565 - RNA, 16 nt, Bordetella pertussis
gcgcgcgcgccgacgc

SEQ ID NO: 401566 - RNA, 15 nt, Bordetella pertussis
gcgcgcgcgccgcac

SEQ ID NO: 401567 - RNA, 14 nt, Bordetella pertussis
gcgcgcgcgcggau

SEQ ID NO: 401568 - RNA, 12 nt, Bordetella pertussis
gcgcgcgcggcc

SEQ ID NO: 401569 - RNA, 14 nt, Bordetella pertussis
gcgcgcgcggccag

SEQ ID NO: 401570 - RNA, 15 nt, Bordetella pertussis
gcgcgcgcggcgccg

SEQ ID NO: 401571 - RNA, 16 nt, Bordetella pertussis
gcgcgcgcggcgccgc

SEQ ID NO: 401572 - RNA, 14 nt, Bordetella pertussis
gcgcgcggacugcc

SEQ ID NO: 401573 - RNA, 22 nt, Bordetella pertussis
gcgcgcggauauucgucggccg

SEQ ID NO: 401574 - RNA, 22 nt, Bordetella pertussis
gcgcgcggcagggcgucggccg

SEQ ID NO: 401575 - RNA, 20 nt, Bordetella pertussis
gcgcgcggcauggcagcaca

SEQ ID NO: 401576 - RNA, 18 nt, Bordetella pertussis
gcgcgcggccagcgcggu

SEQ ID NO: 401577 - RNA, 13 nt, Bordetella pertussis
gcgcgcggccggc

SEQ ID NO: 401578 - RNA, 15 nt, Bordetella pertussis
gcgcgcggccggccg

SEQ ID NO: 401579 - RNA, 14 nt, Bordetella pertussis
gcgcgcggccggcg

SEQ ID NO: 401580 - RNA, 15 nt, Bordetella pertussis
gcgcgcggccggcgc

SEQ ID NO: 401581 - RNA, 13 nt, Bordetella pertussis
gcgcgcggccucg

SEQ ID NO: 401582 - RNA, 14 nt, Bordetella pertussis
gcgcgcggccuggc

SEQ ID NO: 401583 - RNA, 15 nt, Bordetella pertussis
gcgcgcggccuggcg

SEQ ID NO: 401584 - RNA, 12 nt, Bordetella pertussis
gcgcgcggcggc

SEQ ID NO: 401585 - RNA, 13 nt, Bordetella pertussis
gcgcgcggcggcc

SEQ ID NO: 401586 - RNA, 14 nt, Bordetella pertussis
gcgcgcggcggccu

SEQ ID NO: 401587 - RNA, 17 nt, Bordetella pertussis
gcgcgcggcgccgcgcg

SEQ ID NO: 401588 - RNA, 16 nt, Bordetella pertussis
gcgcgcggcucgccgc

SEQ ID NO: 401589 - RNA, 13 nt, Bordetella pertussis
gcgcgcggcuggg

SEQ ID NO: 401590 - RNA, 15 nt, Bordetella pertussis
gcgcgcggcuggggc

SEQ ID NO: 401591 - RNA, 16 nt, Bordetella pertussis
gcgcgcgggcccuggc

SEQ ID NO: 401592 - RNA, 14 nt, Bordetella pertussis
gcgcgcgggcgccc

SEQ ID NO: 401593 - RNA, 13 nt, Bordetella pertussis
gcgcgcgggcgcg

SEQ ID NO: 401594 - RNA, 18 nt, Bordetella pertussis
gcgcgcgggcgcgccguc

SEQ ID NO: 401595 - RNA, 20 nt, Bordetella pertussis
gcgcgcgggcgcgccgucgc

SEQ ID NO: 401596 - RNA, 14 nt, Bordetella pertussis
gcgcgcgggggugc

SEQ ID NO: 401597 - RNA, 17 nt, Bordetella pertussis
gcgcgcggugucgccgc

SEQ ID NO: 401598 - RNA, 19 nt, Bordetella pertussis
gcgcgcguacagccgggug

SEQ ID NO: 401599 - RNA, 18 nt, Bordetella pertussis
gcgcgcgugcagcgccgc

SEQ ID NO: 401600 - RNA, 14 nt, Bordetella pertussis
gcgcgcgugcaggg

SEQ ID NO: 401601 - RNA, 16 nt, Bordetella pertussis
gcgcgcgugcagguag

SEQ ID NO: 401602 - RNA, 15 nt, Bordetella pertussis
gcgcgcgugccgcgc

SEQ ID NO: 401603 - RNA, 14 nt, Bordetella pertussis
gcgcgcgugcuggg

SEQ ID NO: 401604 - RNA, 19 nt, Bordetella pertussis
gcgcgcguucaggucgccg

SEQ ID NO: 401605 - RNA, 20 nt, Bordetella pertussis
gcgcgcguucguggaugggc

SEQ ID NO: 401606 - RNA, 14 nt, Bordetella pertussis
gcgcgcucggccuc

SEQ ID NO: 401607 - RNA, 17 nt, Bordetella pertussis
gcgcgcucggcgccggg

SEQ ID NO: 401608 - RNA, 15 nt, Bordetella pertussis
gcgcggccaggcgcu

SEQ ID NO: 401609 - RNA, 16 nt, Bordetella pertussis
gcgcggccagggcugc

SEQ ID NO: 401610 - RNA, 20 nt, Bordetella pertussis
gcgcggccagggcugcggcg

SEQ ID NO: 401611 - RNA, 22 nt, Bordetella pertussis
gcgcgcucggagggcuccaggc

SEQ ID NO: 401612 - RNA, 13 nt, Bordetella pertussis
gcgcggccgagcg

SEQ ID NO: 401613 - RNA, 17 nt, Bordetella pertussis
gcgcggccgagcgggcc

SEQ ID NO: 401614 - RNA, 20 nt, Bordetella pertussis
gcgcggccgagcgggccagc

SEQ ID NO: 401615 - RNA, 19 nt, Bordetella pertussis
gcgcggccccggcucccgc

SEQ ID NO: 401616 - RNA, 14 nt, Bordetella pertussis
gcgcggccgccgcc

SEQ ID NO: 401617 - RNA, 19 nt, Bordetella pertussis
gcgcggccgccgcccgccu

SEQ ID NO: 401618 - RNA, 12 nt, Bordetella pertussis
gcgcggccgcuu

SEQ ID NO: 401619 - RNA, 12 nt, Bordetella pertussis
gcgcggccggcc

SEQ ID NO: 401620 - RNA, 14 nt, Bordetella pertussis
gcgcggccggcgcg

SEQ ID NO: 401621 - RNA, 15 nt, Bordetella pertussis
gcgcggccggcgcgc

SEQ ID NO: 401622 - RNA, 16 nt, Bordetella pertussis
gcgcggccggcgcgcc

SEQ ID NO: 401623 - RNA, 18 nt, Bordetella pertussis
gcgcggccggcgcgccgg

SEQ ID NO: 401624 - RNA, 14 nt, Bordetella pertussis
gcgcggccgcgcgc

SEQ ID NO: 401625 - RNA, 21 nt, Bordetella pertussis
gcgcggccguguucgagcagg

SEQ ID NO: 401626 - RNA, 22 nt, Bordetella pertussis
gcgcggccuauuuggcggccug

SEQ ID NO: 401627 - RNA, 13 nt, Bordetella pertussis
gcgcggccucgcc

SEQ ID NO: 401628 - RNA, 14 nt, Bordetella pertussis
gcgcggccucgccg

SEQ ID NO: 401629 - RNA, 15 nt, Bordetella pertussis
gcgcggccucgccgg

SEQ ID NO: 401630 - RNA, 16 nt, Bordetella pertussis
gcgcggccucgccggc

SEQ ID NO: 401631 - RNA, 17 nt, Bordetella pertussis
gcgcggccugggcggcg

SEQ ID NO: 401632 - RNA, 15 nt, Bordetella pertussis
gcgcggcggccaggc

SEQ ID NO: 401633 - RNA, 16 nt, Bordetella pertussis
gcgcggcggccaggcg

SEQ ID NO: 401634 - RNA, 14 nt, Bordetella pertussis
gcgcggcggccaug

SEQ ID NO: 401635 - RNA, 13 nt, Bordetella pertussis
gcgcggcggccug

SEQ ID NO: 401636 - RNA, 15 nt, Bordetella pertussis
gcgcggcggccuggg

SEQ ID NO: 401637 - RNA, 13 nt, Bordetella pertussis
gcgcggcggccuu

SEQ ID NO: 401638 - RNA, 12 nt, Bordetella pertussis
gcgcggcggcgg

SEQ ID NO: 401639 - RNA, 13 nt, Bordetella pertussis
gcgcggcggccag

SEQ ID NO: 401640 - RNA, 15 nt, Bordetella pertussis
gcgcggcgggcggcg

SEQ ID NO: 401641 - RNA, 14 nt, Bordetella pertussis
gcgcggcgggcuca

SEQ ID NO: 401642 - RNA, 17 nt, Bordetella pertussis
gcgcggcgggugccgcg

SEQ ID NO: 401643 - RNA, 19 nt, Bordetella pertussis
gcgcggcgguccucgccgg

SEQ ID NO: 401644 - RNA, 16 nt, Bordetella pertussis
gcgcggcucgccgcgc

SEQ ID NO: 401645 - RNA, 15 nt, Bordetella pertussis
gcgcggcucgccggc

SEQ ID NO: 401646 - RNA, 22 nt, Bordetella pertussis
gcgcggcucgccggccgcgccc

SEQ ID NO: 401647 - RNA, 15 nt, Bordetella pertussis
gcgcggcugcgggcc

SEQ ID NO: 401648 - RNA, 16 nt, Bordetella pertussis
gcgcggcugcgggccg

SEQ ID NO: 401649 - RNA, 16 nt, Bordetella pertussis
gcgcggcugcugggca

SEQ ID NO: 401650 - RNA, 14 nt, Bordetella pertussis
gcgcggcuggcugu

SEQ ID NO: 401651 - RNA, 17 nt, Bordetella pertussis
gcgcggcuggggcugcu

SEQ ID NO: 401652 - RNA, 23 nt, Bordetella pertussis
gcgcggcuggggcugcugggccg

SEQ ID NO: 401653 - RNA, 22 nt, Bordetella pertussis
gcgcggcuuucgccggaggcgc

SEQ ID NO: 401654 - RNA, 20 nt, Bordetella pertussis
gcgcgggaagcgcucgcgca

SEQ ID NO: 401655 - RNA, 21 nt, Bordetella pertussis
gcgcgggaagcugucggcgcu

SEQ ID NO: 401656 - RNA, 13 nt, Bordetella pertussis
gcgcggggggcug

SEQ ID NO: 401657 - RNA, 16 nt, Bordetella pertussis
gcgcgguacgcaccgc

SEQ ID NO: 401658 - RNA, 21 nt, Bordetella pertussis
gcgcgguacgcaccgccgccg

SEQ ID NO: 401659 - RNA, 17 nt, Bordetella pertussis
gcgcgguagcgccccuc

SEQ ID NO: 401660 - RNA, 21 nt, Bordetella pertussis
gcgcgguauggccgcccagca

SEQ ID NO: 401661 - RNA, 20 nt, Bordetella pertussis
gcgcgguauugcgccacccc

SEQ ID NO: 401662 - RNA, 15 nt, Bordetella pertussis
gcgcgguccaccucg

SEQ ID NO: 401663 - RNA, 21 nt, Bordetella pertussis
gcgcgguccacgcccuggcug

SEQ ID NO: 401664 - RNA, 22 nt, Bordetella pertussis
gcgcgguccacgcccuggcugg

SEQ ID NO: 401665 - RNA, 23 nt, Bordetella pertussis
gcgcgguccacgcccuggcuggc

SEQ ID NO: 401666 - RNA, 13 nt, Bordetella pertussis
gcgcgguccagca

SEQ ID NO: 401667 - RNA, 22 nt, Bordetella pertussis
gcgcggugacguaaucgagcug

SEQ ID NO: 401668 - RNA, 21 nt, Bordetella pertussis
gcgcggugcgggugggcgcgc

SEQ ID NO: 401669 - RNA, 15 nt, Bordetella pertussis
gcgcggugcucggcg

SEQ ID NO: 401670 - RNA, 23 nt, Bordetella pertussis
gcgcgguggccgccgcgcgccgc

SEQ ID NO: 401671 - RNA, 17 nt, Bordetella pertussis
gcgcgguucaucgccuc

SEQ ID NO: 401672 - RNA, 16 nt, Bordetella pertussis
gcgcgguugggcgcac

SEQ ID NO: 401673 - RNA, 22 nt, Bordetella pertussis
gcgcguaauaguggucgccggc

SEQ ID NO: 401674 - RNA, 15 nt, Bordetella pertussis
gcgcguacgcggcgc

SEQ ID NO: 401675 - RNA, 19 nt, Bordetella pertussis
gcgcguacguggcgcggcu

SEQ ID NO: 401676 - RNA, 22 nt, Bordetella pertussis
gcgcguaguccgagcccgggcg

SEQ ID NO: 401677 - RNA, 16 nt, Bordetella pertussis
gcgcguauccagcauc

SEQ ID NO: 401678 - RNA, 20 nt, Bordetella pertussis
gcgcguaucggcgcgagcga

SEQ ID NO: 401679 - RNA, 18 nt, Bordetella pertussis
gcgcguaugcaccgggcc

SEQ ID NO: 401680 - RNA, 19 nt, Bordetella pertussis
gcgcguaugcaccgggccg

SEQ ID NO: 401681 - RNA, 21 nt, Bordetella pertussis
gcgcguauuccggguccagcc

SEQ ID NO: 401682 - RNA, 18 nt, Bordetella pertussis
gcgcgucaggccgggcag

SEQ ID NO: 401683 - RNA, 21 nt, Bordetella pertussis
gcgcguccaggugcggcggcg

SEQ ID NO: 401684 - RNA, 18 nt, Bordetella pertussis
gcgcucgagcgccugcag

SEQ ID NO: 401685 - RNA, 17 nt, Bordetella pertussis
gcgcucgaggcgcuggc

SEQ ID NO: 401686 - RNA, 18 nt, Bordetella pertussis
gcgcucgaggcgcuggcg

SEQ ID NO: 401687 - RNA, 22 nt, Bordetella pertussis
gcgcucgaucaagggguggcug

SEQ ID NO: 401688 - RNA, 14 nt, Bordetella pertussis
gcgcucgcccagca

SEQ ID NO: 401689 - RNA, 15 nt, Bordetella pertussis
gcgcucgcccagcac

SEQ ID NO: 401690 - RNA, 14 nt, Bordetella pertussis
gcgcucgcccagcc

SEQ ID NO: 401691 - RNA, 16 nt, Bordetella pertussis
gcgcucgcccagccgc

SEQ ID NO: 401692 - RNA, 19 nt, Bordetella pertussis
gcgcucgcccagccgccug

SEQ ID NO: 401693 - RNA, 14 nt, Bordetella pertussis
gcgcucgccccggc

SEQ ID NO: 401694 - RNA, 13 nt, Bordetella pertussis
gcgcucgcccggc

SEQ ID NO: 401695 - RNA, 20 nt, Bordetella pertussis
gcgcucgcccucgcgccacc

SEQ ID NO: 401696 - RNA, 18 nt, Bordetella pertussis
gcgcucgcgcgccagcag

SEQ ID NO: 401697 - RNA, 16 nt, Bordetella pertussis
gcgcucgcgcugcagg

SEQ ID NO: 401698 - RNA, 15 nt, Bordetella pertussis
gcgcucgcugccggc

SEQ ID NO: 401699 - RNA, 16 nt, Bordetella pertussis
gcgcucgcugccggcg

SEQ ID NO: 401700 - RNA, 16 nt, Bordetella pertussis
gcgcucggagggcucc

SEQ ID NO: 401701 - RNA, 19 nt, Bordetella pertussis
gcgcucggagggcuccagg

SEQ ID NO: 401702 - RNA, 20 nt, Bordetella pertussis
gcgcucuugguggugccugc

SEQ ID NO: 401703 - RNA, 22 nt, Bordetella pertussis
gcgcucuugguggugccugcuu

SEQ ID NO: 401704 - RNA, 14 nt, Bordetella pertussis
gcgcugacagcgcu

SEQ ID NO: 401705 - RNA, 16 nt, Bordetella pertussis
gcgcugaccugcacga

SEQ ID NO: 401706 - RNA, 16 nt, Bordetella pertussis
gcgcugacgccgaugu

SEQ ID NO: 401707 - RNA, 18 nt, Bordetella pertussis
gcgcugcugcaggccggc

SEQ ID NO: 401708 - RNA, 19 nt, Bordetella pertussis
gcgcugcugcaggccggcg

SEQ ID NO: 401709 - RNA, 21 nt, Bordetella pertussis
gcgcugcugcaggccggcgcg

SEQ ID NO: 401710 - RNA, 18 nt, Bordetella pertussis
gcgcugcugccgucggcg

SEQ ID NO: 401711 - RNA, 13 nt, Bordetella pertussis
gcgcugcugcugg

SEQ ID NO: 401712 - RNA, 18 nt, Bordetella pertussis
gcgcugcugcuggcugcc

SEQ ID NO: 401713 - RNA, 20 nt, Bordetella pertussis
gcgcugcuggccaagcgcgc

SEQ ID NO: 401714 - RNA, 20 nt, Bordetella pertussis
gcgcugcugucgcgcugccc

SEQ ID NO: 401715 - RNA, 22 nt, Bordetella pertussis
gcgcuggaacguuugcggacgg

SEQ ID NO: 401716 - RNA, 16 nt, Bordetella pertussis
gcgcuggacgcccugg

SEQ ID NO: 401717 - RNA, 17 nt, Bordetella pertussis
gcgcuggacgcccuggc

SEQ ID NO: 401718 - RNA, 22 nt, Bordetella pertussis
gcgcuggacgcccuggcgcagg

SEQ ID NO: 401719 - RNA, 19 nt, Bordetella pertussis
gcgcuggaauauggcgucc

SEQ ID NO: 401720 - RNA, 22 nt, Bordetella pertussis
gcgcuggaggccuuccaccagc

SEQ ID NO: 401721 - RNA, 21 nt, Bordetella pertussis
gcgcuggauggcucgggcagc

SEQ ID NO: 401722 - RNA, 16 nt, Bordetella pertussis
gcgcuggccgccaugg

SEQ ID NO: 401723 - RNA, 13 nt, Bordetella pertussis
gcgcuggccgccc

SEQ ID NO: 401724 - RNA, 15 nt, Bordetella pertussis
gcgcuggccgcccgc

SEQ ID NO: 401725 - RNA, 17 nt, Bordetella pertussis
gcgcuggccgcccgcgg

SEQ ID NO: 401726 - RNA, 18 nt, Bordetella pertussis
gcgcuggccggcgugccc

SEQ ID NO: 401727 - RNA, 13 nt, Bordetella pertussis
gcgcuggccugcc

SEQ ID NO: 401728 - RNA, 13 nt, Bordetella pertussis
gcgcuggccuggc

SEQ ID NO: 401729 - RNA, 18 nt, Bordetella pertussis
gcgcuggcgaugcgggcc

SEQ ID NO: 401730 - RNA, 18 nt, Bordetella pertussis
gcgcuggcgcaaggacgc

SEQ ID NO: 401731 - RNA, 18 nt, Bordetella pertussis
gcgcuggccaucaccgcc

SEQ ID NO: 401732 - RNA, 20 nt, Bordetella pertussis
gcgcuggcccgcgcgagcgg

SEQ ID NO: 401733 - RNA, 18 nt, Bordetella pertussis
gcgcuggcgcagcaggcg

SEQ ID NO: 401734 - RNA, 13 nt, Bordetella pertussis
gcgcuggcgcagg

SEQ ID NO: 401735 - RNA, 11 nt, Bordetella pertussis
gcgcuggcgcg

SEQ ID NO: 401736 - RNA, 17 nt, Bordetella pertussis
gcgcuggcgcgcgacgg

SEQ ID NO: 401737 - RNA, 16 nt, Bordetella pertussis
gcgcuggcgcgcggcc

SEQ ID NO: 401738 - RNA, 16 nt, Bordetella pertussis
gcgcuggcgcgcggcu

SEQ ID NO: 401739 - RNA, 16 nt, Bordetella pertussis
gcgcuggcgcuggccg

SEQ ID NO: 401740 - RNA, 15 nt, Bordetella pertussis
gcgcuggcggcugcg

SEQ ID NO: 401741 - RNA, 12 nt, Bordetella pertussis
gcgcuggcugga

SEQ ID NO: 401742 - RNA, 22 nt, Bordetella pertussis
gcgcuggcuggacgcgcgcggc

SEQ ID NO: 401743 - RNA, 16 nt, Bordetella pertussis
gcgcuggcugggccug

SEQ ID NO: 401744 - RNA, 17 nt, Bordetella pertussis
gcgcuggcugggccugc

SEQ ID NO: 401745 - RNA, 11 nt, Bordetella pertussis
gcgcuggcugu

SEQ ID NO: 401746 - RNA, 17 nt, Bordetella pertussis
gcgcuggcggcgcaggc

SEQ ID NO: 401747 - RNA, 17 nt, Bordetella pertussis
gcgcugggcaggcuggc

SEQ ID NO: 401748 - RNA, 21 nt, Bordetella pertussis
gcgcugggcaugggcggcccg

SEQ ID NO: 401749 - RNA, 15 nt, Bordetella pertussis
gcgcugggccaggcc

SEQ ID NO: 401750 - RNA, 22 nt, Bordetella pertussis
gcgcugggcgcauuggcccugc

SEQ ID NO: 401751 - RNA, 13 nt, Bordetella pertussis
gcgcuuccaggag

SEQ ID NO: 401752 - RNA, 14 nt, Bordetella pertussis
gcgcuucgagccgg

SEQ ID NO: 401753 - RNA, 14 nt, Bordetella pertussis
gcgcuucgggcagc

SEQ ID NO: 401754 - RNA, 14 nt, Bordetella pertussis
gcgcuucuuggcga

SEQ ID NO: 401755 - RNA, 15 nt, Bordetella pertussis
gcgcuugaccgccuc

SEQ ID NO: 401756 - RNA, 15 nt, Bordetella pertussis
gcgcuugcgcagggc

SEQ ID NO: 401757 - RNA, 15 nt, Bordetella pertussis
gcgcuugcgcauggc

SEQ ID NO: 401758 - RNA, 20 nt, Bordetella pertussis
gcgcuugcgcauggccgguu

SEQ ID NO: 401759 - RNA, 15 nt, Bordetella pertussis
gcgcuugcgcgccac

SEQ ID NO: 401760 - RNA, 13 nt, Bordetella pertussis
gcgcuugcggccg

SEQ ID NO: 401761 - RNA, 15 nt, Bordetella pertussis
gcgcuuggcccugca

SEQ ID NO: 401762 - RNA, 17 nt, Bordetella pertussis
gcgcuuggcccugcagc

SEQ ID NO: 401763 - RNA, 18 nt, Bordetella pertussis
gcggaaaacagcaccagc

SEQ ID NO: 401764 - RNA, 22 nt, Bordetella pertussis
gcggaaaacagcaccagcaugc

SEQ ID NO: 401765 - RNA, 18 nt, Bordetella pertussis
gcgcuuuuuucuccagcg

SEQ ID NO: 401766 - RNA, 23 nt, Bordetella pertussis
gcggaaauccguaguccagcagc

SEQ ID NO: 401767 - RNA, 13 nt, Bordetella pertussis
gcggaaggcuugu

SEQ ID NO: 401768 - RNA, 19 nt, Bordetella pertussis
gcggaagucgggcaccagc

SEQ ID NO: 401769 - RNA, 21 nt, Bordetella pertussis
gcggaaugaugguggggcugg

SEQ ID NO: 401770 - RNA, 23 nt, Bordetella pertussis
gcggaaugcggcgacagggcguc

SEQ ID NO: 401771 - RNA, 23 nt, Bordetella pertussis
gcggacccaguucggccgccagg

SEQ ID NO: 401772 - RNA, 17 nt, Bordetella pertussis
gcggaccgaacggccgg

SEQ ID NO: 401773 - RNA, 17 nt, Bordetella pertussis
gcggaccugcucgagcg

SEQ ID NO: 401774 - RNA, 21 nt, Bordetella pertussis
gcggaccugcucgagcggcgg

SEQ ID NO: 401775 - RNA, 21 nt, Bordetella pertussis
gcggacgaagccuaggcugca

SEQ ID NO: 401776 - RNA, 22 nt, Bordetella pertussis
gcggacgaagccuaggcugcag

SEQ ID NO: 401777 - RNA, 18 nt, Bordetella pertussis
gcggacgccagcccuggg

SEQ ID NO: 401778 - RNA, 15 nt, Bordetella pertussis
gcggacgccauggcg

SEQ ID NO: 401779 - RNA, 19 nt, Bordetella pertussis
gcggacgccauggcggcgg

SEQ ID NO: 401780 - RNA, 20 nt, Bordetella pertussis
gcggacgccauggcggcggc

SEQ ID NO: 401781 - RNA, 17 nt, Bordetella pertussis
gcggacggcgggcgccc

SEQ ID NO: 401782 - RNA, 16 nt, Bordetella pertussis
gcggacgggccaggcc

SEQ ID NO: 401783 - RNA, 18 nt, Bordetella pertussis
gcggaggugucgccgccc

SEQ ID NO: 401784 - RNA, 22 nt, Bordetella pertussis
gcggauacgaaaccaggccggg

SEQ ID NO: 401785 - RNA, 16 nt, Bordetella pertussis
gcggaucaagcggccc

SEQ ID NO: 401786 - RNA, 21 nt, Bordetella pertussis
gcggaucacgcuaaauacgcu

SEQ ID NO: 401787 - RNA, 15 nt, Bordetella pertussis
gcggauccagccaug

SEQ ID NO: 401788 - RNA, 16 nt, Bordetella pertussis
gcggauccagcgaggc

SEQ ID NO: 401789 - RNA, 15 nt, Bordetella pertussis
gcggauccuugacga

SEQ ID NO: 401790 - RNA, 22 nt, Bordetella pertussis
gcggaucgaaaccggcgcgcgc

SEQ ID NO: 401791 - RNA, 19 nt, Bordetella pertussis
gcggaucgccgggcaggca

SEQ ID NO: 401792 - RNA, 14 nt, Bordetella pertussis
gcggaucgcggcgc

SEQ ID NO: 401793 - RNA, 18 nt, Bordetella pertussis
gcggaucucggccagcag

SEQ ID NO: 401794 - RNA, 18 nt, Bordetella pertussis
gcggaucuucccgccaug

SEQ ID NO: 401795 - RNA, 18 nt, Bordetella pertussis
gcggaugagcaggccggg

SEQ ID NO: 401796 - RNA, 13 nt, Bordetella pertussis
gcggaugccgccc

SEQ ID NO: 401797 - RNA, 22 nt, Bordetella pertussis
gcggaugccguccacgccgcgc

SEQ ID NO: 401798 - RNA, 23 nt, Bordetella pertussis
gcggaugccguccacgccgcgcg

SEQ ID NO: 401799 - RNA, 14 nt, Bordetella pertussis
gcggaugcgccgcc

SEQ ID NO: 401800 - RNA, 19 nt, Bordetella pertussis
gcggaugcgccgccccagu

SEQ ID NO: 401801 - RNA, 14 nt, Bordetella pertussis
gcggaugcgcgccu

SEQ ID NO: 401802 - RNA, 19 nt, Bordetella pertussis
gcggauggucgagcgccug

SEQ ID NO: 401803 - RNA, 23 nt, Bordetella pertussis
gcggauggucgagcgccugcgcc

SEQ ID NO: 401804 - RNA, 21 nt, Bordetella pertussis
gcggauguccggcgcgaacgg

SEQ ID NO: 401805 - RNA, 13 nt, Bordetella pertussis
gcggauuugcucg

SEQ ID NO: 401806 - RNA, 15 nt, Bordetella pertussis
gcggcaaagccgcug

SEQ ID NO: 401807 - RNA, 16 nt, Bordetella pertussis
gcggcaaauggggcgg

SEQ ID NO: 401808 - RNA, 17 nt, Bordetella pertussis
gcggcaaauggggcggc

SEQ ID NO: 401809 - RNA, 20 nt, Bordetella pertussis
gcggcaaauggggcggccgg

SEQ ID NO: 401810 - RNA, 13 nt, Bordetella pertussis
gcggcaagccgcg

SEQ ID NO: 401811 - RNA, 18 nt, Bordetella pertussis
gcggcaagccgcggcggu

SEQ ID NO: 401812 - RNA, 20 nt, Bordetella pertussis
gcggcaauaccuucugcaag

SEQ ID NO: 401813 - RNA, 14 nt, Bordetella pertussis
gcggcaccagcagg

SEQ ID NO: 401814 - RNA, 13 nt, Bordetella pertussis
gcggcaccgcgca

SEQ ID NO: 401815 - RNA, 22 nt, Bordetella pertussis
gcggcaccgcgcagcccggcgu

SEQ ID NO: 401816 - RNA, 15 nt, Bordetella pertussis
gcggcaccugcugcu

SEQ ID NO: 401817 - RNA, 20 nt, Bordetella pertussis
gcggcacgaaaagccgcggc

SEQ ID NO: 401818 - RNA, 21 nt, Bordetella pertussis
gcggcacgaaaagccgcggcc

SEQ ID NO: 401819 - RNA, 15 nt, Bordetella pertussis
gcggcacgcacagca

SEQ ID NO: 401820 - RNA, 14 nt, Bordetella pertussis
gcggcacgccggcg

SEQ ID NO: 401821 - RNA, 18 nt, Bordetella pertussis
gcggcacgcugcgcaggc

SEQ ID NO: 401822 - RNA, 14 nt, Bordetella pertussis
gcggcacggcuggg

SEQ ID NO: 401823 - RNA, 10 nt, Bordetella pertussis
gcggcacggg

SEQ ID NO: 401824 - RNA, 14 nt, Bordetella pertussis
gcggcacggccagc

SEQ ID NO: 401825 - RNA, 23 nt, Bordetella pertussis
gcggcgcaccagcgaggcggcaa

SEQ ID NO: 401826 - RNA, 16 nt, Bordetella pertussis
gcggcgcagcaccagg

SEQ ID NO: 401827 - RNA, 22 nt, Bordetella pertussis
gcggcgcagcaucuugcgccgc

SEQ ID NO: 401828 - RNA, 22 nt, Bordetella pertussis
gcggcgcagcauuucggcgccg

SEQ ID NO: 401829 - RNA, 19 nt, Bordetella pertussis
gcggcgcagcccagcgcga

SEQ ID NO: 401830 - RNA, 16 nt, Bordetella pertussis
gcggcgcagccggccg

SEQ ID NO: 401831 - RNA, 15 nt, Bordetella pertussis
gcggcgcagcgcguc

SEQ ID NO: 401832 - RNA, 21 nt, Bordetella pertussis
gcggcgcaggaugcgcuggcc

SEQ ID NO: 401833 - RNA, 21 nt, Bordetella pertussis
gcggcgcaggccugcggcgau

SEQ ID NO: 401834 - RNA, 16 nt, Bordetella pertussis
gcggcgcaggcgggcg

SEQ ID NO: 401835 - RNA, 14 nt, Bordetella pertussis
gcggcgcaugcugc

SEQ ID NO: 401836 - RNA, 17 nt, Bordetella pertussis
gcggcgcauugccgucg

SEQ ID NO: 401837 - RNA, 19 nt, Bordetella pertussis
gcggcgccacugccaggcg

SEQ ID NO: 401838 - RNA, 16 nt, Bordetella pertussis
gcggcgccagcugggc

SEQ ID NO: 401839 - RNA, 21 nt, Bordetella pertussis
gcggcgccaugccgcgcccgc

SEQ ID NO: 401840 - RNA, 22 nt, Bordetella pertussis
gcggcgccaugcgcaccaccgc

SEQ ID NO: 401841 - RNA, 24 nt, Bordetella pertussis
gcggcgccauucuucgccgaugcg

SEQ ID NO: 401842 - RNA, 13 nt, Bordetella pertussis
gcggcgcccaggc

SEQ ID NO: 401843 - RNA, 19 nt, Bordetella pertussis
gcggcgcccaggcccagcg

SEQ ID NO: 401844 - RNA, 16 nt, Bordetella pertussis
gcggcgcccgcaugga

SEQ ID NO: 401845 - RNA, 13 nt, Bordetella pertussis
gcggcgcccgccu

SEQ ID NO: 401846 - RNA, 18 nt, Bordetella pertussis
gcggcgcccgcgcaugca

SEQ ID NO: 401847 - RNA, 13 nt, Bordetella pertussis
gcggcgccgccgg

SEQ ID NO: 401848 - RNA, 12 nt, Bordetella pertussis
gcggcgccgaga

SEQ ID NO: 401849 - RNA, 13 nt, Bordetella pertussis
gcggcgccggccu

SEQ ID NO: 401850 - RNA, 15 nt, Bordetella pertussis
gcggcgccguccagc

SEQ ID NO: 401851 - RNA, 20 nt, Bordetella pertussis
gcggcgccuggucgcgcgcc

SEQ ID NO: 401852 - RNA, 20 nt, Bordetella pertussis
gcggcgccugcgcgcgcugg

SEQ ID NO: 401853 - RNA, 14 nt, Bordetella pertussis
gcggcggauucagg

SEQ ID NO: 401854 - RNA, 14 nt, Bordetella pertussis
gcggcggaucgaac

SEQ ID NO: 401855 - RNA, 14 nt, Bordetella pertussis
gcggcggcaccagc

SEQ ID NO: 401856 - RNA, 21 nt, Bordetella pertussis
gcggcggcaccagcaggccgg

SEQ ID NO: 401857 - RNA, 16 nt, Bordetella pertussis
gcggcggcacgcgcgc

SEQ ID NO: 401858 - RNA, 14 nt, Bordetella pertussis
gcggcggccaggcg

SEQ ID NO: 401859 - RNA, 15 nt, Bordetella pertussis
gcggcggccgaagcg

SEQ ID NO: 401860 - RNA, 18 nt, Bordetella pertussis
gcggcgggcgcuggcgcg

SEQ ID NO: 401861 - RNA, 17 nt, Bordetella pertussis
gcggcgggcggccggcg

SEQ ID NO: 401862 - RNA, 13 nt, Bordetella pertussis
gcggcgggcggcg

SEQ ID NO: 401863 - RNA, 14 nt, Bordetella pertussis
gcggcgggcggcgc

SEQ ID NO: 401864 - RNA, 18 nt, Bordetella pertussis
gcggcggguucgcagggc

SEQ ID NO: 401865 - RNA, 19 nt, Bordetella pertussis
gcggcggguucgcagggcg

SEQ ID NO: 401866 - RNA, 17 nt, Bordetella pertussis
gcggcgguaccaggccg

SEQ ID NO: 401867 - RNA, 14 nt, Bordetella pertussis
gcggcggugccugu

SEQ ID NO: 401868 - RNA, 17 nt, Bordetella pertussis
gcggcguagagcgccgc

SEQ ID NO: 401869 - RNA, 16 nt, Bordetella pertussis
gcggcguauaggccac

SEQ ID NO: 401870 - RNA, 19 nt, Bordetella pertussis
gcggcguauaggccacccc

SEQ ID NO: 401871 - RNA, 17 nt, Bordetella pertussis
gcggcgucaggccgucg

SEQ ID NO: 401872 - RNA, 19 nt, Bordetella pertussis
gcggcguccgaauacgcca

SEQ ID NO: 401873 - RNA, 17 nt, Bordetella pertussis
gcggcgucgacgcccgc

SEQ ID NO: 401874 - RNA, 21 nt, Bordetella pertussis
gcggcgucgacgcccgcgccc

SEQ ID NO: 401875 - RNA, 15 nt, Bordetella pertussis
gcggcgucgccgcgc

SEQ ID NO: 401876 - RNA, 19 nt, Bordetella pertussis
gcggcgucgcuggcagccu

SEQ ID NO: 401877 - RNA, 19 nt, Bordetella pertussis
gcggcgucggcgcccggcg

SEQ ID NO: 401878 - RNA, 20 nt, Bordetella pertussis
gcggcgucgaucggcgcgcc

SEQ ID NO: 401879 - RNA, 23 nt, Bordetella pertussis
gcggcgucgaucggcgcgcccgc

SEQ ID NO: 401880 - RNA, 14 nt, Bordetella pertussis
gcggcgucugguac

SEQ ID NO: 401881 - RNA, 15 nt, Bordetella pertussis
gcggcgugcccugcg

SEQ ID NO: 401882 - RNA, 23 nt, Bordetella pertussis
gcggcgugcccugcggcgcggcc

SEQ ID NO: 401883 - RNA, 14 nt, Bordetella pertussis
gcggcgugcggccc

SEQ ID NO: 401884 - RNA, 22 nt, Bordetella pertussis
gcggcgugcggcccagccgcuc

SEQ ID NO: 401885 - RNA, 22 nt, Bordetella pertussis
gcggcguggccgugcuggucau

SEQ ID NO: 401886 - RNA, 17 nt, Bordetella pertussis
gcggcguggcggccagg

SEQ ID NO: 401887 - RNA, 16 nt, Bordetella pertussis
gcggcguggcggcggg

SEQ ID NO: 401888 - RNA, 16 nt, Bordetella pertussis
gcggcguggcggggcg

SEQ ID NO: 401889 - RNA, 17 nt, Bordetella pertussis
gcggcguggggccggcc

SEQ ID NO: 401890 - RNA, 18 nt, Bordetella pertussis
gcggcguggggccggccg

SEQ ID NO: 401891 - RNA, 18 nt, Bordetella pertussis
gcggcguuccugggcacg

SEQ ID NO: 401892 - RNA, 22 nt, Bordetella pertussis
gcggcguuccugggcacgccgg

SEQ ID NO: 401893 - RNA, 18 nt, Bordetella pertussis
gcggcguugaccuggucg

SEQ ID NO: 401894 - RNA, 15 nt, Bordetella pertussis
gcggcucgacgccgu

SEQ ID NO: 401895 - RNA, 21 nt, Bordetella pertussis
gcggcucgaggaaccagccgu

SEQ ID NO: 401896 - RNA, 20 nt, Bordetella pertussis
gcggcuccccuggucagggc

SEQ ID NO: 401897 - RNA, 18 nt, Bordetella pertussis
gcggcucgccgcgcacgg

SEQ ID NO: 401898 - RNA, 15 nt, Bordetella pertussis
gcggcucgccggccg

SEQ ID NO: 401899 - RNA, 13 nt, Bordetella pertussis
gcggcugcgggcg

SEQ ID NO: 401900 - RNA, 15 nt, Bordetella pertussis
gcggcuggccacugg

SEQ ID NO: 401901 - RNA, 15 nt, Bordetella pertussis
gcggcuggcgcggcc

SEQ ID NO: 401902 - RNA, 13 nt, Bordetella pertussis
gcggcuggcuguu

SEQ ID NO: 401903 - RNA, 15 nt, Bordetella pertussis
gcggcuggcuguucg

SEQ ID NO: 401904 - RNA, 15 nt, Bordetella pertussis
gcggcuggucgccgu

SEQ ID NO: 401905 - RNA, 18 nt, Bordetella pertussis
gcggcuggugccgacggc

SEQ ID NO: 401906 - RNA, 20 nt, Bordetella pertussis
gcggcuggugccgacggcgc

SEQ ID NO: 401907 - RNA, 19 nt, Bordetella pertussis
gcggcuggggcugcugggc

SEQ ID NO: 401908 - RNA, 22 nt, Bordetella pertussis
gcggcugggugcggucagucgg

SEQ ID NO: 401909 - RNA, 18 nt, Bordetella pertussis
gcggcuuucaugggccug

SEQ ID NO: 401910 - RNA, 22 nt, Bordetella pertussis
gcggcuuucaugggccugggcg

SEQ ID NO: 401911 - RNA, 22 nt, Bordetella pertussis
gcggcuuucgauuugcagcagc

SEQ ID NO: 401912 - RNA, 16 nt, Bordetella pertussis
gcgggaacaggcaccg

SEQ ID NO: 401913 - RNA, 15 nt, Bordetella pertussis
gcgggaagcgcucgc

SEQ ID NO: 401914 - RNA, 21 nt, Bordetella pertussis
gcgggaagcgcucgcgcaggc

SEQ ID NO: 401915 - RNA, 19 nt, Bordetella pertussis
gcgggaaugucccacaggc

SEQ ID NO: 401916 - RNA, 16 nt, Bordetella pertussis
gcgggaauugggcgag

SEQ ID NO: 401917 - RNA, 13 nt, Bordetella pertussis
gcgggacgcaggc

SEQ ID NO: 401918 - RNA, 23 nt, Bordetella pertussis
gcgggacggccaggggcagcucg

SEQ ID NO: 401919 - RNA, 21 nt, Bordetella pertussis
gcgggacuggcgagcacccgc

SEQ ID NO: 401920 - RNA, 19 nt, Bordetella pertussis
gcgggaggaagggugcggc

SEQ ID NO: 401921 - RNA, 22 nt, Bordetella pertussis
gcgggcccgcaucgcgcgccgc

SEQ ID NO: 401922 - RNA, 15 nt, Bordetella pertussis
gcgggcccgucgcgc

SEQ ID NO: 401923 - RNA, 17 nt, Bordetella pertussis
gcgggcccuggcguucg

SEQ ID NO: 401924 - RNA, 13 nt, Bordetella pertussis
gcgggccgcagca

SEQ ID NO: 401925 - RNA, 14 nt, Bordetella pertussis
gcgggccgcgcugg

SEQ ID NO: 401926 - RNA, 15 nt, Bordetella pertussis
gcgggccgcgcugga

SEQ ID NO: 401927 - RNA, 11 nt, Bordetella pertussis
gcgggccgcgg

SEQ ID NO: 401928 - RNA, 14 nt, Bordetella pertussis
gcgggccgcgccgc

SEQ ID NO: 401929 - RNA, 18 nt, Bordetella pertussis
gcgggccgcgccgcggca

SEQ ID NO: 401930 - RNA, 15 nt, Bordetella pertussis
gcgggccggcgcgcc

SEQ ID NO: 401931 - RNA, 15 nt, Bordetella pertussis
gcgggccggcugggc

SEQ ID NO: 401932 - RNA, 14 nt, Bordetella pertussis
gcgggccgggcagg

SEQ ID NO: 401933 - RNA, 23 nt, Bordetella pertussis
gcgggccggaaacgcggucaccg

SEQ ID NO: 401934 - RNA, 18 nt, Bordetella pertussis
gcgggccguugcgccugc

SEQ ID NO: 401935 - RNA, 22 nt, Bordetella pertussis
gcgggccuacuugccggcgcuc

SEQ ID NO: 401936 - RNA, 12 nt, Bordetella pertussis
gcgggcgcccgc

SEQ ID NO: 401937 - RNA, 13 nt, Bordetella pertussis
gcgggcgccgcgc

SEQ ID NO: 401938 - RNA, 15 nt, Bordetella pertussis
gcgggcgccgcgccc

SEQ ID NO: 401939 - RNA, 17 nt, Bordetella pertussis
gcgggcgcgcaggccuc

SEQ ID NO: 401940 - RNA, 19 nt, Bordetella pertussis
gcgggcgcgcccggcgcgc

SEQ ID NO: 401941 - RNA, 15 nt, Bordetella pertussis
gcgggcgcgccgucg

SEQ ID NO: 401942 - RNA, 14 nt, Bordetella pertussis
gcgggcgcgcgccc

SEQ ID NO: 401943 - RNA, 12 nt, Bordetella pertussis
gcgggcgcgcuu

SEQ ID NO: 401944 - RNA, 15 nt, Bordetella pertussis
gcgggcgcggcaggc

SEQ ID NO: 401945 - RNA, 21 nt, Bordetella pertussis
gcgggcgcugccugccggccg

SEQ ID NO: 401946 - RNA, 12 nt, Bordetella pertussis
gcgggcgcuggc

SEQ ID NO: 401947 - RNA, 19 nt, Bordetella pertussis
gcgggcggcgccggccgcc

SEQ ID NO: 401948 - RNA, 16 nt, Bordetella pertussis
gcgggcgggccgcgga

SEQ ID NO: 401949 - RNA, 13 nt, Bordetella pertussis
gcgggcggucggc

SEQ ID NO: 401950 - RNA, 20 nt, Bordetella pertussis
gcgggcggucggcgcggcgc

SEQ ID NO: 401951 - RNA, 23 nt, Bordetella pertussis
gcgggcguagaaagccagugccu

SEQ ID NO: 401952 - RNA, 17 nt, Bordetella pertussis
gcgggcucggcgccggc

SEQ ID NO: 401953 - RNA, 14 nt, Bordetella pertussis
gcgggcugcgcggg

SEQ ID NO: 401954 - RNA, 16 nt, Bordetella pertussis
gcgggcugcgcggguc

SEQ ID NO: 401955 - RNA, 22 nt, Bordetella pertussis
gcgggguuggccgccaggacuu

SEQ ID NO: 401956 - RNA, 22 nt, Bordetella pertussis
gcgggguuuuuuuuugggaagg

SEQ ID NO: 401957 - RNA, 15 nt, Bordetella pertussis
gcgggugaugcugca

SEQ ID NO: 401958 - RNA, 19 nt, Bordetella pertussis
gcgggugccaguccccaug

SEQ ID NO: 401959 - RNA, 13 nt, Bordetella pertussis
gcgggugccgcga

SEQ ID NO: 401960 - RNA, 14 nt, Bordetella pertussis
gcgggugcgccugc

SEQ ID NO: 401961 - RNA, 14 nt, Bordetella pertussis
gcgggugcugcagc

SEQ ID NO: 401962 - RNA, 15 nt, Bordetella pertussis
gcggguggccucgcc

SEQ ID NO: 401963 - RNA, 20 nt, Bordetella pertussis
gcggguggccucgcccuggc

SEQ ID NO: 401964 - RNA, 16 nt, Bordetella pertussis
gcgguaaggucgggua

SEQ ID NO: 401965 - RNA, 20 nt, Bordetella pertussis
gcgguaaugacgcagccgcc

SEQ ID NO: 401966 - RNA, 15 nt, Bordetella pertussis
gcgguacaggccggc

SEQ ID NO: 401967 - RNA, 20 nt, Bordetella pertussis
gcgguacaggccggcggcga

SEQ ID NO: 401968 - RNA, 13 nt, Bordetella pertussis
gcgguacaggucg

SEQ ID NO: 401969 - RNA, 18 nt, Bordetella pertussis
gcgguacgcaccgccgcc

SEQ ID NO: 401970 - RNA, 15 nt, Bordetella pertussis
gcgguacgcccagcu

SEQ ID NO: 401971 - RNA, 18 nt, Bordetella pertussis
gcgguagacgccgggacg

SEQ ID NO: 401972 - RNA, 13 nt, Bordetella pertussis
gcgguagccggcg

SEQ ID NO: 401973 - RNA, 17 nt, Bordetella pertussis
gcgguaggacggcagca

SEQ ID NO: 401974 - RNA, 15 nt, Bordetella pertussis
gcgguaggcccagca

SEQ ID NO: 401975 - RNA, 16 nt, Bordetella pertussis
gcgguaguucagcagc

SEQ ID NO: 401976 - RNA, 13 nt, Bordetella pertussis
gcgguccagcaag

SEQ ID NO: 401977 - RNA, 14 nt, Bordetella pertussis
gcgguccagccccu

SEQ ID NO: 401978 - RNA, 19 nt, Bordetella pertussis
gcgguccagcugcgcgcga

SEQ ID NO: 401979 - RNA, 17 nt, Bordetella pertussis
gcgguccggggcgggcg

SEQ ID NO: 401980 - RNA, 18 nt, Bordetella pertussis
gcgguccgguucgcccac

SEQ ID NO: 401981 - RNA, 20 nt, Bordetella pertussis
gcgguccugaccggcggcgc

SEQ ID NO: 401982 - RNA, 21 nt, Bordetella pertussis
gcggucgaagaaggccuuggc

SEQ ID NO: 401983 - RNA, 14 nt, Bordetella pertussis
gcggucgaggcgca

SEQ ID NO: 401984 - RNA, 15 nt, Bordetella pertussis
gcggucuggucuggc

SEQ ID NO: 401985 - RNA, 20 nt, Bordetella pertussis
gcggucuucacauagcccgg

SEQ ID NO: 401986 - RNA, 21 nt, Bordetella pertussis
gcggucuucgaugcuggcgcg

SEQ ID NO: 401987 - RNA, 18 nt, Bordetella pertussis
gcggucuugaccgaggug

SEQ ID NO: 401988 - RNA, 14 nt, Bordetella pertussis
gcggugaggcggcc

SEQ ID NO: 401989 - RNA, 16 nt, Bordetella pertussis
gcggugaucugcucgc

SEQ ID NO: 401990 - RNA, 22 nt, Bordetella pertussis
gcggugaucugcucgccgcgcg

SEQ ID NO: 401991 - RNA, 16 nt, Bordetella pertussis
gcggugcaagcggccg

SEQ ID NO: 401992 - RNA, 22 nt, Bordetella pertussis
gcguagauccaggcggccacca

SEQ ID NO: 401993 - RNA, 23 nt, Bordetella pertussis
gcguagcgauccgaugcccgguu

SEQ ID NO: 401994 - RNA, 20 nt, Bordetella pertussis
gcguaggcaggggcuccagg

SEQ ID NO: 401995 - RNA, 14 nt, Bordetella pertussis
gcguaggcgcgcgc

SEQ ID NO: 401996 - RNA, 12 nt, Bordetella pertussis
gcguaggcgcgc

SEQ ID NO: 401997 - RNA, 17 nt, Bordetella pertussis
gcguaggucaggcccac

SEQ ID NO: 401998 - RNA, 13 nt, Bordetella pertussis
gcguauggcggcg

SEQ ID NO: 401999 - RNA, 18 nt, Bordetella pertussis
gcgucaagccagcggcgc

SEQ ID NO: 402000 - RNA, 20 nt, Bordetella pertussis
gcgucaauccgccgccagca

SEQ ID NO: 402001 - RNA, 20 nt, Bordetella pertussis
gcgucacgaaagcgcccagg

SEQ ID NO: 402002 - RNA, 22 nt, Bordetella pertussis
gcgucacgcacagcaccuggug

SEQ ID NO: 402003 - RNA, 16 nt, Bordetella pertussis
gcgucagcgugcgccc

SEQ ID NO: 402004 - RNA, 21 nt, Bordetella pertussis
gcgucaggccgggcagcgaga

SEQ ID NO: 402005 - RNA, 19 nt, Bordetella pertussis
gcgucaggcgagcgcggcg

SEQ ID NO: 402006 - RNA, 20 nt, Bordetella pertussis
gcgucaggcgagcgcggcgg

SEQ ID NO: 402007 - RNA, 18 nt, Bordetella pertussis
gcgucaguugggcgcgcc

SEQ ID NO: 402008 - RNA, 20 nt, Bordetella pertussis
gcgucaguugggcgcgccca

SEQ ID NO: 402009 - RNA, 22 nt, Bordetella pertussis
gcguccaagcagacccgcgccc

SEQ ID NO: 402010 - RNA, 20 nt, Bordetella pertussis
gcguccaccaccaggccggc

SEQ ID NO: 402011 - RNA, 22 nt, Bordetella pertussis
gcguccaccaccaggccggcca

SEQ ID NO: 402012 - RNA, 21 nt, Bordetella pertussis
gcguccacgcggguggugcug

SEQ ID NO: 402013 - RNA, 21 nt, Bordetella pertussis
gcguccacggcaucggccagc

SEQ ID NO: 402014 - RNA, 19 nt, Bordetella pertussis
gcguccagccgagccuggc

SEQ ID NO: 402015 - RNA, 16 nt, Bordetella pertussis
gcguccagcgcgcggc

SEQ ID NO: 402016 - RNA, 15 nt, Bordetella pertussis
gcguccaggcccagc

SEQ ID NO: 402017 - RNA, 16 nt, Bordetella pertussis
gcguccaggcccagcg

SEQ ID NO: 402018 - RNA, 23 nt, Bordetella pertussis
gcguccaggcccuggcggcgcag

SEQ ID NO: 402019 - RNA, 21 nt, Bordetella pertussis
gcguccaggcgcgccagccgc

SEQ ID NO: 402020 - RNA, 16 nt, Bordetella pertussis
gcguccaggugcggcg

SEQ ID NO: 402021 - RNA, 19 nt, Bordetella pertussis
gcguccaggugcggcggcg

SEQ ID NO: 402022 - RNA, 15 nt, Bordetella pertussis
gcguccagguugggc

SEQ ID NO: 402023 - RNA, 22 nt, Bordetella pertussis
gcguccagguugggcaccacca

SEQ ID NO: 402024 - RNA, 19 nt, Bordetella pertussis
gcguccaucuggaccgcgc

SEQ ID NO: 402025 - RNA, 14 nt, Bordetella pertussis
gcguccgcgcgccg

SEQ ID NO: 402026 - RNA, 16 nt, Bordetella pertussis
gcguccgcgucgccgc

SEQ ID NO: 402027 - RNA, 18 nt, Bordetella pertussis
gcguccggcgcccgccgc

SEQ ID NO: 402028 - RNA, 15 nt, Bordetella pertussis
gcguccucgcggucc

SEQ ID NO: 402029 - RNA, 15 nt, Bordetella pertussis
gcguccucggccagc

SEQ ID NO: 402030 - RNA, 13 nt, Bordetella pertussis
gcguccugcgcca

SEQ ID NO: 402031 - RNA, 16 nt, Bordetella pertussis
gcguccuuggcggccu

SEQ ID NO: 402032 - RNA, 15 nt, Bordetella pertussis
gcgucgaaggcggcc

SEQ ID NO: 402033 - RNA, 17 nt, Bordetella pertussis
gcgucgaaggcggccgg

SEQ ID NO: 402034 - RNA, 18 nt, Bordetella pertussis
gcgucgaaggcggccggc

SEQ ID NO: 402035 - RNA, 22 nt, Bordetella pertussis
gcgucgaaggcggccggcaggc

SEQ ID NO: 402036 - RNA, 18 nt, Bordetella pertussis
gcgucgaaugcacgggcg

SEQ ID NO: 402037 - RNA, 21 nt, Bordetella pertussis
gcgucgacgcccgcgcccagu

SEQ ID NO: 402038 - RNA, 16 nt, Bordetella pertussis
gcgucgaccgcgggcg

SEQ ID NO: 402039 - RNA, 15 nt, Bordetella pertussis
gcgucgacgaagcgc

SEQ ID NO: 402040 - RNA, 14 nt, Bordetella pertussis
gcgucgagcagcgc

SEQ ID NO: 402041 - RNA, 17 nt, Bordetella pertussis
gcgucgagcaggccggc

SEQ ID NO: 402042 - RNA, 20 nt, Bordetella pertussis
gcgucgacuuuguaucuguu

SEQ ID NO: 402043 - RNA, 13 nt, Bordetella pertussis
gcgucgagcacgc

SEQ ID NO: 402044 - RNA, 16 nt, Bordetella pertussis
gcgucgaucggcgcgc

SEQ ID NO: 402045 - RNA, 19 nt, Bordetella pertussis
gcgucgaucuucgccugca

SEQ ID NO: 402046 - RNA, 16 nt, Bordetella pertussis
gcgucgaugcgcgcgc

SEQ ID NO: 402047 - RNA, 19 nt, Bordetella pertussis
gcgucgcccggggcggcgu

SEQ ID NO: 402048 - RNA, 16 nt, Bordetella pertussis
gcgucgccgcuggcca

SEQ ID NO: 402049 - RNA, 16 nt, Bordetella pertussis
gcgucgccggccaggc

SEQ ID NO: 402050 - RNA, 19 nt, Bordetella pertussis
gcgucgcgaugcgccaggc

SEQ ID NO: 402051 - RNA, 16 nt, Bordetella pertussis
gcgucgcgcgccaggc

SEQ ID NO: 402052 - RNA, 14 nt, Bordetella pertussis
gcgucgcgcggcgg

SEQ ID NO: 402053 - RNA, 18 nt, Bordetella pertussis
gcgucgcguagcgcggcc

SEQ ID NO: 402054 - RNA, 20 nt, Bordetella pertussis
gcgucgcguagcgcggccgg

SEQ ID NO: 402055 - RNA, 21 nt, Bordetella pertussis
gcgucgcucaggguacggcga

SEQ ID NO: 402056 - RNA, 18 nt, Bordetella pertussis
gcgucggccaaggccggc

SEQ ID NO: 402057 - RNA, 14 nt, Bordetella pertussis
gcgucggccgccgu

SEQ ID NO: 402058 - RNA, 21 nt, Bordetella pertussis
gcgucggccaggccgaugaau

SEQ ID NO: 402059 - RNA, 14 nt, Bordetella pertussis
gcgucggccaggcg

SEQ ID NO: 402060 - RNA, 22 nt, Bordetella pertussis
gcgucggccucaucgagcgccu

SEQ ID NO: 402061 - RNA, 14 nt, Bordetella pertussis
gcgucggccugcca

SEQ ID NO: 402062 - RNA, 22 nt, Bordetella pertussis
gcgucggcguaaggccgccggc

SEQ ID NO: 402063 - RNA, 23 nt, Bordetella pertussis
gcgucggcguaaggccgccggcc

SEQ ID NO: 402064 - RNA, 19 nt, Bordetella pertussis
gcgucgggcagcaggcgca

SEQ ID NO: 402065 - RNA, 21 nt, Bordetella pertussis
gcgucgggcagcaggcgcauc

SEQ ID NO: 402066 - RNA, 15 nt, Bordetella pertussis
gcgucgggggcggcc

SEQ ID NO: 402067 - RNA, 21 nt, Bordetella pertussis
gcgucgguggccagccaggcg

SEQ ID NO: 402068 - RNA, 22 nt, Bordetella pertussis
gcgucgucgccgucgcccuggc

SEQ ID NO: 402069 - RNA, 18 nt, Bordetella pertussis
gcgucguggggcgcggcg

SEQ ID NO: 402070 - RNA, 20 nt, Bordetella pertussis
gcgucguggggcgcggcggc

SEQ ID NO: 402071 - RNA, 20 nt, Bordetella pertussis
gcgugaccagcugcaccagg

SEQ ID NO: 402072 - RNA, 14 nt, Bordetella pertussis
gcgugacggcggcg

SEQ ID NO: 402073 - RNA, 13 nt, Bordetella pertussis
gcgugccgccggc

SEQ ID NO: 402074 - RNA, 14 nt, Bordetella pertussis
gcgugccgccggcg

SEQ ID NO: 402075 - RNA, 17 nt, Bordetella pertussis
gcgugccgcgcaguucg

SEQ ID NO: 402076 - RNA, 17 nt, Bordetella pertussis
gcgugccgcgcugggcg

SEQ ID NO: 402077 - RNA, 15 nt, Bordetella pertussis
gcgugccggagcccg

SEQ ID NO: 402078 - RNA, 20 nt, Bordetella pertussis
gcgugcgagcagaugcaccg

SEQ ID NO: 402079 - RNA, 14 nt, Bordetella pertussis
gcgugcgccccgcc

SEQ ID NO: 402080 - RNA, 13 nt, Bordetella pertussis
gcgugcgcggccg

SEQ ID NO: 402081 - RNA, 16 nt, Bordetella pertussis
gcgugcgcuggcuggg

SEQ ID NO: 402082 - RNA, 15 nt, Bordetella pertussis
gcgugcggcccagcc

SEQ ID NO: 402083 - RNA, 18 nt, Bordetella pertussis
gcguggcaggugcggccg

SEQ ID NO: 402084 - RNA, 19 nt, Bordetella pertussis
gcguggcaggugcggccgc

SEQ ID NO: 402085 - RNA, 21 nt, Bordetella pertussis
gcguggccaccaggcgcgcgc

SEQ ID NO: 402086 - RNA, 17 nt, Bordetella pertussis
gcguggccgccaccagc

SEQ ID NO: 402087 - RNA, 15 nt, Bordetella pertussis
gcguggccgccacgc

SEQ ID NO: 402088 - RNA, 16 nt, Bordetella pertussis
gcguggccgcgcugcu

SEQ ID NO: 402089 - RNA, 14 nt, Bordetella pertussis
gcguggccggcggg

SEQ ID NO: 402090 - RNA, 13 nt, Bordetella pertussis
gcguggccguucg

SEQ ID NO: 402091 - RNA, 17 nt, Bordetella pertussis
gcguggcgcgccagcgc

SEQ ID NO: 402092 - RNA, 13 nt, Bordetella pertussis
gcguggcgcgccc

SEQ ID NO: 402093 - RNA, 11 nt, Bordetella pertussis
gcguggcggcg

SEQ ID NO: 402094 - RNA, 17 nt, Bordetella pertussis
gcguggcggggcguucg

SEQ ID NO: 402095 - RNA, 14 nt, Bordetella pertussis
gcguggcgguacgg

SEQ ID NO: 402096 - RNA, 15 nt, Bordetella pertussis
gcguggcguccaugc

SEQ ID NO: 402097 - RNA, 20 nt, Bordetella pertussis
gcgugucgccgacccgggcg

SEQ ID NO: 402098 - RNA, 14 nt, Bordetella pertussis
gcgugugcccagca

SEQ ID NO: 402099 - RNA, 22 nt, Bordetella pertussis
gcguguggugaaagccgccggc

SEQ ID NO: 402100 - RNA, 17 nt, Bordetella pertussis
gcguguuccagcgccug

SEQ ID NO: 402101 - RNA, 20 nt, Bordetella pertussis
gcguucaccaggaagcgcgc

SEQ ID NO: 402102 - RNA, 23 nt, Bordetella pertussis
gcguuccagcagaucgcggcggg

SEQ ID NO: 402103 - RNA, 21 nt, Bordetella pertussis
gcguugcaccgcgucggccug

SEQ ID NO: 402104 - RNA, 19 nt, Bordetella pertussis
gcguugcagccacaggccc

SEQ ID NO: 402105 - RNA, 14 nt, Bordetella pertussis
gcguugccagccca

SEQ ID NO: 402106 - RNA, 23 nt, Bordetella pertussis
gcguuggcauggcgcgugcgcgc

SEQ ID NO: 402107 - RNA, 12 nt, Bordetella pertussis
gcguuggcggcc

SEQ ID NO: 402108 - RNA, 16 nt, Bordetella pertussis
gcuauaccgggcuggu

SEQ ID NO: 402109 - RNA, 19 nt, Bordetella pertussis
gcuaugcgggcuugcugcc

SEQ ID NO: 402110 - RNA, 20 nt, Bordetella pertussis
gcuaugcgggcuugcugccc

SEQ ID NO: 402111 - RNA, 13 nt, Bordetella pertussis
gcuauuuuucgac

SEQ ID NO: 402112 - RNA, 17 nt, Bordetella pertussis
gcucaaggauuucaccu

SEQ ID NO: 402113 - RNA, 15 nt, Bordetella pertussis
gcucagcccggcgag

SEQ ID NO: 402114 - RNA, 18 nt, Bordetella pertussis
gcucagcgacgcgcgccg

SEQ ID NO: 402115 - RNA, 15 nt, Bordetella pertussis
gcucagcgggcugcu

SEQ ID NO: 402116 - RNA, 22 nt, Bordetella pertussis
gcucagcuuggcguacggcugc

SEQ ID NO: 402117 - RNA, 23 nt, Bordetella pertussis
gcucagcuuggcguacggcugca

SEQ ID NO: 402118 - RNA, 17 nt, Bordetella pertussis
gcucagcuuguagcccu

SEQ ID NO: 402119 - RNA, 19 nt, Bordetella pertussis
gcucagcuuguagcccucg

SEQ ID NO: 402120 - RNA, 15 nt, Bordetella pertussis
gcucaucggcaggcc

SEQ ID NO: 402121 - RNA, 22 nt, Bordetella pertussis
gcucaucggcaggccggcgcgc

SEQ ID NO: 402122 - RNA, 21 nt, Bordetella pertussis
gcucaggaaccagcggcuggc

SEQ ID NO: 402123 - RNA, 19 nt, Bordetella pertussis
gcucaugcaaaacgcgccc

SEQ ID NO: 402124 - RNA, 17 nt, Bordetella pertussis
gcucaugccggcaagca

SEQ ID NO: 402125 - RNA, 19 nt, Bordetella pertussis
gcucauggaggggcgcagg

SEQ ID NO: 402126 - RNA, 15 nt, Bordetella pertussis
gcuccacagccacug

SEQ ID NO: 402127 - RNA, 21 nt, Bordetella pertussis
gcuccacagccacugcggccc

SEQ ID NO: 402128 - RNA, 21 nt, Bordetella pertussis
gcuccaccaccaucugcgagc

SEQ ID NO: 402129 - RNA, 14 nt, Bordetella pertussis
gcuccaccagcacc

SEQ ID NO: 402130 - RNA, 15 nt, Bordetella pertussis
gcuccaccagcaccg

SEQ ID NO: 402131 - RNA, 17 nt, Bordetella pertussis
gcuccaccagcaccggc

SEQ ID NO: 402132 - RNA, 14 nt, Bordetella pertussis
gcuccagaacgcgc

SEQ ID NO: 402133 - RNA, 17 nt, Bordetella pertussis
gcuccagaacgcgccgu

SEQ ID NO: 402134 - RNA, 20 nt, Bordetella pertussis
gcuccagcgcuucgugcagc

SEQ ID NO: 402135 - RNA, 19 nt, Bordetella pertussis
gcuccaggaaaaccuccuc

SEQ ID NO: 402136 - RNA, 12 nt, Bordetella pertussis
gcuccaggccgc

SEQ ID NO: 402137 - RNA, 14 nt, Bordetella pertussis
gcuccaggccgccc

SEQ ID NO: 402138 - RNA, 13 nt, Bordetella pertussis
gcuccaggccggc

SEQ ID NO: 402139 - RNA, 20 nt, Bordetella pertussis
gcuccaggccggcaugcgcc

SEQ ID NO: 402140 - RNA, 15 nt, Bordetella pertussis
gcuccaggcggccag

SEQ ID NO: 402141 - RNA, 18 nt, Bordetella pertussis
gcuccagggcgucggcga

SEQ ID NO: 402142 - RNA, 16 nt, Bordetella pertussis
gcuccagucccgcacc

SEQ ID NO: 402143 - RNA, 17 nt, Bordetella pertussis
gcuccagucccgcaccg

SEQ ID NO: 402144 - RNA, 19 nt, Bordetella pertussis
gcuccauggcgccggcggc

SEQ ID NO: 402145 - RNA, 17 nt, Bordetella pertussis
gcucccaguucugcagc

SEQ ID NO: 402146 - RNA, 13 nt, Bordetella pertussis
gcucccccacgcc

SEQ ID NO: 402147 - RNA, 16 nt, Bordetella pertussis
gcucccgcgcugccgc

SEQ ID NO: 402148 - RNA, 15 nt, Bordetella pertussis
gcucccgcuggcggc

SEQ ID NO: 402149 - RNA, 21 nt, Bordetella pertussis
gcuccgccauggaggcgcagc

SEQ ID NO: 402150 - RNA, 12 nt, Bordetella pertussis
gcuccggcggca

SEQ ID NO: 402151 - RNA, 21 nt, Bordetella pertussis
gcucgacgccaucucgcgcgc

SEQ ID NO: 402152 - RNA, 22 nt, Bordetella pertussis
gcucgacuucgucgggcucggg

SEQ ID NO: 402153 - RNA, 15 nt, Bordetella pertussis
gcucgagcgcggcgc

SEQ ID NO: 402154 - RNA, 19 nt, Bordetella pertussis
gcucgagcgcggcgcgcgc

SEQ ID NO: 402155 - RNA, 17 nt, Bordetella pertussis
gcucgagcggcagcagc

SEQ ID NO: 402156 - RNA, 14 nt, Bordetella pertussis
gcucgagcggcgga

SEQ ID NO: 402157 - RNA, 16 nt, Bordetella pertussis
gcucgagcuggcuggc

SEQ ID NO: 402158 - RNA, 18 nt, Bordetella pertussis
gcucgaggaaccagccgu

SEQ ID NO: 402159 - RNA, 22 nt, Bordetella pertussis
gcucgaggugcacgugggcacg

SEQ ID NO: 402160 - RNA, 21 nt, Bordetella pertussis
gcucgauaugcagcaccggau

SEQ ID NO: 402161 - RNA, 20 nt, Bordetella pertussis
gcucgaucgccgccggcacg

SEQ ID NO: 402162 - RNA, 16 nt, Bordetella pertussis
gcucgaucaggcgcuc

SEQ ID NO: 402163 - RNA, 20 nt, Bordetella pertussis
gcucgcccacauagcggccg

SEQ ID NO: 402164 - RNA, 14 nt, Bordetella pertussis
gcucgcccagccgc

SEQ ID NO: 402165 - RNA, 16 nt, Bordetella pertussis
gcucgcccagccgccu

SEQ ID NO: 402166 - RNA, 13 nt, Bordetella pertussis
gcucgccgcgcac

SEQ ID NO: 402167 - RNA, 17 nt, Bordetella pertussis
gcucgccggccagcgcg

SEQ ID NO: 402168 - RNA, 14 nt, Bordetella pertussis
gcucgccggcgcgc

SEQ ID NO: 402169 - RNA, 21 nt, Bordetella pertussis
gcucgguguugggaguucugg

SEQ ID NO: 402170 - RNA, 13 nt, Bordetella pertussis
gcucguagcuguc

SEQ ID NO: 402171 - RNA, 14 nt, Bordetella pertussis
gcucguagucggug

SEQ ID NO: 402172 - RNA, 13 nt, Bordetella pertussis
gcucguccccacg

SEQ ID NO: 402173 - RNA, 19 nt, Bordetella pertussis
gcucgucgccaugcggcug

SEQ ID NO: 402174 - RNA, 15 nt, Bordetella pertussis
gcucgugcagcaggg

SEQ ID NO: 402175 - RNA, 16 nt, Bordetella pertussis
gcucguguagggccug

SEQ ID NO: 402176 - RNA, 19 nt, Bordetella pertussis
gcucguucugcgcgcccgu

SEQ ID NO: 402177 - RNA, 20 nt, Bordetella pertussis
gcucucgaagaagcagccgc

SEQ ID NO: 402178 - RNA, 18 nt, Bordetella pertussis
gcucugaucgcgcuggac

SEQ ID NO: 402179 - RNA, 15 nt, Bordetella pertussis
gcucuggcacaccag

SEQ ID NO: 402180 - RNA, 19 nt, Bordetella pertussis
gcucuggcacaccagcgcc

SEQ ID NO: 402181 - RNA, 15 nt, Bordetella pertussis
gcucuggcugacgau

SEQ ID NO: 402182 - RNA, 17 nt, Bordetella pertussis
gcucuugaccugggcca

SEQ ID NO: 402183 - RNA, 16 nt, Bordetella pertussis
gcucuugagcgcggcc

SEQ ID NO: 402184 - RNA, 17 nt, Bordetella pertussis
gcucuugagcgcggccu

SEQ ID NO: 402185 - RNA, 20 nt, Bordetella pertussis
gcucuugcgcgcgccggacg

SEQ ID NO: 402186 - RNA, 23 nt, Bordetella pertussis
gcucuuggcgugcuugccgccgg

SEQ ID NO: 402187 - RNA, 13 nt, Bordetella pertussis
gcugaccagcagc

SEQ ID NO: 402188 - RNA, 14 nt, Bordetella pertussis
gcugaccgaagcgc

SEQ ID NO: 402189 - RNA, 17 nt, Bordetella pertussis
gcugaccgaagcgggcg

SEQ ID NO: 402190 - RNA, 15 nt, Bordetella pertussis
gcugaccgagggcgc

SEQ ID NO: 402191 - RNA, 18 nt, Bordetella pertussis
gcugaccgagggcgcguc

SEQ ID NO: 402192 - RNA, 20 nt, Bordetella pertussis
gcugaccggcuucccguggc

SEQ ID NO: 402193 - RNA, 14 nt, Bordetella pertussis
gcugacgcccggcu

SEQ ID NO: 402194 - RNA, 21 nt, Bordetella pertussis
gcugagaucguccagcgacuc

SEQ ID NO: 402195 - RNA, 15 nt, Bordetella pertussis
gcugagcaccagcag

SEQ ID NO: 402196 - RNA, 16 nt, Bordetella pertussis
gcugagcaccagcagc

SEQ ID NO: 402197 - RNA, 19 nt, Bordetella pertussis
gcugagcaccagcagcccc

SEQ ID NO: 402198 - RNA, 22 nt, Bordetella pertussis
gcugagcgacaugucgccgcgg

SEQ ID NO: 402199 - RNA, 19 nt, Bordetella pertussis
gcugaucacccacagcagc

SEQ ID NO: 402200 - RNA, 13 nt, Bordetella pertussis
gcugauccgcacc

SEQ ID NO: 402201 - RNA, 15 nt, Bordetella pertussis
gcugauccucgccag

SEQ ID NO: 402202 - RNA, 19 nt, Bordetella pertussis
gcugauccucgccagcggc

SEQ ID NO: 402203 - RNA, 13 nt, Bordetella pertussis
gcugauccuggcu

SEQ ID NO: 402204 - RNA, 19 nt, Bordetella pertussis
gcugaucgacaugcuggcc

SEQ ID NO: 402205 - RNA, 15 nt, Bordetella pertussis
gcugaucucggccug

SEQ ID NO: 402206 - RNA, 16 nt, Bordetella pertussis
gcugaucuuccugggc

SEQ ID NO: 402207 - RNA, 19 nt, Bordetella pertussis
gcugaucuugaugcggccg

SEQ ID NO: 402208 - RNA, 16 nt, Bordetella pertussis
gcugaugcgcggcggg

SEQ ID NO: 402209 - RNA, 13 nt, Bordetella pertussis
gcugaugcgcguc

SEQ ID NO: 402210 - RNA, 15 nt, Bordetella pertussis
gcugauggcggucac

SEQ ID NO: 402211 - RNA, 14 nt, Bordetella pertussis
gcugauggccuugg

SEQ ID NO: 402212 - RNA, 16 nt, Bordetella pertussis
gcugauggccuuggag

SEQ ID NO: 402213 - RNA, 16 nt, Bordetella pertussis
gcugcaaggcagccug

SEQ ID NO: 402214 - RNA, 17 nt, Bordetella pertussis
gcugcaauugcgcggcc

SEQ ID NO: 402215 - RNA, 17 nt, Bordetella pertussis
gcugcaccagcgcgccg

SEQ ID NO: 402216 - RNA, 22 nt, Bordetella pertussis
gcugcacgcgcgcgggcgcgcc

SEQ ID NO: 402217 - RNA, 17 nt, Bordetella pertussis
gcugcacgugaugcagg

SEQ ID NO: 402218 - RNA, 17 nt, Bordetella pertussis
gcugcagcaauccaucg

SEQ ID NO: 402219 - RNA, 15 nt, Bordetella pertussis
gcugcagcgcugguu

SEQ ID NO: 402220 - RNA, 16 nt, Bordetella pertussis
gcugcagcgucuggca

SEQ ID NO: 402221 - RNA, 21 nt, Bordetella pertussis
gcugcagcgucuggcacgcuu

SEQ ID NO: 402222 - RNA, 17 nt, Bordetella pertussis
gcugcagcgcaucgccg

SEQ ID NO: 402223 - RNA, 16 nt, Bordetella pertussis
gcugcaggaaguccuu

SEQ ID NO: 402224 - RNA, 22 nt, Bordetella pertussis
gcugcaggaaguccuucagccg

SEQ ID NO: 402225 - RNA, 17 nt, Bordetella pertussis
gcugcaggaucgcggcc

SEQ ID NO: 402226 - RNA, 19 nt, Bordetella pertussis
gcugcaggaucgcggccag

SEQ ID NO: 402227 - RNA, 20 nt, Bordetella pertussis
gcugcaggaucgcggccagc

SEQ ID NO: 402228 - RNA, 23 nt, Bordetella pertussis
gcugcaggaucgcggccagcggc

SEQ ID NO: 402229 - RNA, 20 nt, Bordetella pertussis
gcugcaggccggcgcgcauc

SEQ ID NO: 402230 - RNA, 15 nt, Bordetella pertussis
gcugcaggcgcgggu

SEQ ID NO: 402231 - RNA, 13 nt, Bordetella pertussis
gcugcagggcugc

SEQ ID NO: 402232 - RNA, 23 nt, Bordetella pertussis
gcugcaggucgggauaguccagc

SEQ ID NO: 402233 - RNA, 17 nt, Bordetella pertussis
gcugcaguugcgccacg

SEQ ID NO: 402234 - RNA, 19 nt, Bordetella pertussis
gcugcauacgccgcugaug

SEQ ID NO: 402235 - RNA, 16 nt, Bordetella pertussis
gcugcaugcgcacgga

SEQ ID NO: 402236 - RNA, 18 nt, Bordetella pertussis
gcugcaugcgcacggaca

SEQ ID NO: 402237 - RNA, 22 nt, Bordetella pertussis
gcugcaugcgcgaacgcgcgcc

SEQ ID NO: 402238 - RNA, 19 nt, Bordetella pertussis
gcugcaugggcggcccgcu

SEQ ID NO: 402239 - RNA, 17 nt, Bordetella pertussis
gcugcauguccugcagg

SEQ ID NO: 402240 - RNA, 23 nt, Bordetella pertussis
gcugccaggcuaucguggcuggc

SEQ ID NO: 402241 - RNA, 15 nt, Bordetella pertussis
gcugccaugccgcgc

SEQ ID NO: 402242 - RNA, 20 nt, Bordetella pertussis
gcugccaugccgcgcgccuu

SEQ ID NO: 402243 - RNA, 23 nt, Bordetella pertussis
gcugccauuccagcuccggcggc

SEQ ID NO: 402244 - RNA, 19 nt, Bordetella pertussis
gcugcccaccgccguggcc

SEQ ID NO: 402245 - RNA, 17 nt, Bordetella pertussis
gcugcccaccuuccugc

SEQ ID NO: 402246 - RNA, 20 nt, Bordetella pertussis
gcugcccaccuuccugcugg

SEQ ID NO: 402247 - RNA, 21 nt, Bordetella pertussis
gcugcccaggauggagagggc

SEQ ID NO: 402248 - RNA, 15 nt, Bordetella pertussis
gcugcccagccacac

SEQ ID NO: 402249 - RNA, 14 nt, Bordetella pertussis
gcugccccccgagg

SEQ ID NO: 402250 - RNA, 20 nt, Bordetella pertussis
gcugccccccgagggggcuu

SEQ ID NO: 402251 - RNA, 23 nt, Bordetella pertussis
gcugcccgaagcgcagcaccagg

SEQ ID NO: 402252 - RNA, 17 nt, Bordetella pertussis
gcugcccgagaagggcu

SEQ ID NO: 402253 - RNA, 16 nt, Bordetella pertussis
gcugcccgucgcuggc

SEQ ID NO: 402254 - RNA, 13 nt, Bordetella pertussis
gcugcccugcugc

SEQ ID NO: 402255 - RNA, 18 nt, Bordetella pertussis
gcugcccugcugcugcag

SEQ ID NO: 402256 - RNA, 15 nt, Bordetella pertussis
gcugcccuggcgcug

SEQ ID NO: 402257 - RNA, 19 nt, Bordetella pertussis
gcugccgagacggccgccg

SEQ ID NO: 402258 - RNA, 23 nt, Bordetella pertussis
gcugccgagacggccgccgacgc

SEQ ID NO: 402259 - RNA, 14 nt, Bordetella pertussis
gcugccgcugcagg

SEQ ID NO: 402260 - RNA, 18 nt, Bordetella pertussis
gcugccgcugcccaccuu

SEQ ID NO: 402261 - RNA, 21 nt, Bordetella pertussis
gcugccggaccugggcaucaa

SEQ ID NO: 402262 - RNA, 18 nt, Bordetella pertussis
gcugccggauuggcgcug

SEQ ID NO: 402263 - RNA, 15 nt, Bordetella pertussis
gcugccggcagcagg

SEQ ID NO: 402264 - RNA, 20 nt, Bordetella pertussis
gcugccggcauugcccacca

SEQ ID NO: 402265 - RNA, 15 nt, Bordetella pertussis
gcugccggcguccug

SEQ ID NO: 402266 - RNA, 22 nt, Bordetella pertussis
gcugccgucgccaaagcgcagc

SEQ ID NO: 402267 - RNA, 16 nt, Bordetella pertussis
gcugccgugaggcagc

SEQ ID NO: 402268 - RNA, 20 nt, Bordetella pertussis
gcugccgugguacguggacu

SEQ ID NO: 402269 - RNA, 19 nt, Bordetella pertussis
gcugccugaaaccgcaggc

SEQ ID NO: 402270 - RNA, 23 nt, Bordetella pertussis
gcugccugaaaccgcaggcaagc

SEQ ID NO: 402271 - RNA, 15 nt, Bordetella pertussis
gcugcgaaacagcag

SEQ ID NO: 402272 - RNA, 16 nt, Bordetella pertussis
gcugcgaaacagcagc

SEQ ID NO: 402273 - RNA, 16 nt, Bordetella pertussis
gcugcgaaagcgcguc

SEQ ID NO: 402274 - RNA, 16 nt, Bordetella pertussis
gcugcgagacgcgcuc

SEQ ID NO: 402275 - RNA, 18 nt, Bordetella pertussis
gcugcgacagcagggcca

SEQ ID NO: 402276 - RNA, 17 nt, Bordetella pertussis
gcugcgacaggcgcagc

SEQ ID NO: 402277 - RNA, 16 nt, Bordetella pertussis
gcugcgcacgcuggcg

SEQ ID NO: 402278 - RNA, 14 nt, Bordetella pertussis
gcugcgcagcaggg

SEQ ID NO: 402279 - RNA, 18 nt, Bordetella pertussis
gcugcgcagcagggcggc

SEQ ID NO: 402280 - RNA, 19 nt, Bordetella pertussis
gcugcgcagcagggcggcg

SEQ ID NO: 402281 - RNA, 14 nt, Bordetella pertussis
gcugcgcagcgacu

SEQ ID NO: 402282 - RNA, 15 nt, Bordetella pertussis
gcugcgcaggcgccg

SEQ ID NO: 402283 - RNA, 13 nt, Bordetella pertussis
gcugcgccagccc

SEQ ID NO: 402284 - RNA, 21 nt, Bordetella pertussis
gcugcgcccgcuacgcgggcu

SEQ ID NO: 402285 - RNA, 17 nt, Bordetella pertussis
gcugcgccgaggccugc

SEQ ID NO: 402286 - RNA, 13 nt, Bordetella pertussis
gcugcgccgccuc

SEQ ID NO: 402287 - RNA, 17 nt, Bordetella pertussis
gcugcgcgaacgcggcc

SEQ ID NO: 402288 - RNA, 20 nt, Bordetella pertussis
gcugcgcgaacgcggccaug

SEQ ID NO: 402289 - RNA, 15 nt, Bordetella pertussis
gcugcgcgaggacca

SEQ ID NO: 402290 - RNA, 14 nt, Bordetella pertussis
gcugcgcgccggcg

SEQ ID NO: 402291 - RNA, 23 nt, Bordetella pertussis
gcugcgcgccggcgccuuggccu

SEQ ID NO: 402292 - RNA, 13 nt, Bordetella pertussis
gcugcgcgcgagc

SEQ ID NO: 402293 - RNA, 18 nt, Bordetella pertussis
gcugcgcgcgccagcgcc

SEQ ID NO: 402294 - RNA, 20 nt, Bordetella pertussis
gcugcgcgcgccagcgccug

SEQ ID NO: 402295 - RNA, 17 nt, Bordetella pertussis
gcugcgcgcggccuggc

SEQ ID NO: 402296 - RNA, 16 nt, Bordetella pertussis
gcugcgcggcggcuug

SEQ ID NO: 402297 - RNA, 14 nt, Bordetella pertussis
gcugcggcgcggcg

SEQ ID NO: 402298 - RNA, 12 nt, Bordetella pertussis
gcugcggcggga

SEQ ID NO: 402299 - RNA, 21 nt, Bordetella pertussis
gcugcgggcgcaagccagcac

SEQ ID NO: 402300 - RNA, 15 nt, Bordetella pertussis
gcugcgggcggccug

SEQ ID NO: 402301 - RNA, 16 nt, Bordetella pertussis
gcugcgggucgaguug

SEQ ID NO: 402302 - RNA, 20 nt, Bordetella pertussis
gcugcguaucaacuuccagc

SEQ ID NO: 402303 - RNA, 15 nt, Bordetella pertussis
gcugcguccaccacc

SEQ ID NO: 402304 - RNA, 16 nt, Bordetella pertussis
gcugcucaacggccac

SEQ ID NO: 402305 - RNA, 19 nt, Bordetella pertussis
gcugcucgaaacgcuggac

SEQ ID NO: 402306 - RNA, 14 nt, Bordetella pertussis
gcugcucgagcaug

SEQ ID NO: 402307 - RNA, 16 nt, Bordetella pertussis
gcugcugaccgacggc

SEQ ID NO: 402308 - RNA, 16 nt, Bordetella pertussis
gcugcugauccucgcc

SEQ ID NO: 402309 - RNA, 15 nt, Bordetella pertussis
gcugcugcaggcgcg

SEQ ID NO: 402310 - RNA, 14 nt, Bordetella pertussis
gcugcugcuggcug

SEQ ID NO: 402311 - RNA, 21 nt, Bordetella pertussis
gcugcuggccggccccauccu

SEQ ID NO: 402312 - RNA, 14 nt, Bordetella pertussis
gcugcuggcgcgcc

SEQ ID NO: 402313 - RNA, 13 nt, Bordetella pertussis
gcugcuggcggcg

SEQ ID NO: 402314 - RNA, 19 nt, Bordetella pertussis
gcugcugggcauggaccug

SEQ ID NO: 402315 - RNA, 14 nt, Bordetella pertussis
gcugcugggcgcca

SEQ ID NO: 402316 - RNA, 19 nt, Bordetella pertussis
gcugcugggcgccaugcgc

SEQ ID NO: 402317 - RNA, 15 nt, Bordetella pertussis
gcugcuugcccagcg

SEQ ID NO: 402318 - RNA, 22 nt, Bordetella pertussis
gcuggaaacuaaaucgcggcuc

SEQ ID NO: 402319 - RNA, 21 nt, Bordetella pertussis
gcuggaagacguggcccgcgu

SEQ ID NO: 402320 - RNA, 14 nt, Bordetella pertussis
gcuggaagcgcgcc

SEQ ID NO: 402321 - RNA, 20 nt, Bordetella pertussis
gcuggaccccuugcggccgc

SEQ ID NO: 402322 - RNA, 23 nt, Bordetella pertussis
gcuggaccccuugcggccgccga

SEQ ID NO: 402323 - RNA, 23 nt, Bordetella pertussis
gcuggaccgcgccugggggcugg

SEQ ID NO: 402324 - RNA, 21 nt, Bordetella pertussis
gcuggacgcccuggcgcaggc

SEQ ID NO: 402325 - RNA, 23 nt, Bordetella pertussis
gcuggacguaguugguggcaggc

SEQ ID NO: 402326 - RNA, 18 nt, Bordetella pertussis
gcuggacuauggccugga

SEQ ID NO: 402327 - RNA, 18 nt, Bordetella pertussis
gcuggagaacaggcggcu

SEQ ID NO: 402328 - RNA, 19 nt, Bordetella pertussis
gcuggagaacaggcggcug

SEQ ID NO: 402329 - RNA, 20 nt, Bordetella pertussis
gcuggagaacaggcggcuga

SEQ ID NO: 402330 - RNA, 21 nt, Bordetella pertussis
gcuggagaacgagccggccgc

SEQ ID NO: 402331 - RNA, 18 nt, Bordetella pertussis
gcuggagaucgccgagcg

SEQ ID NO: 402332 - RNA, 17 nt, Bordetella pertussis
gcuggagaccggguugc

SEQ ID NO: 402333 - RNA, 14 nt, Bordetella pertussis
gcuggagcgcggcg

SEQ ID NO: 402334 - RNA, 19 nt, Bordetella pertussis
gcuggauccggcgcuggcg

SEQ ID NO: 402335 - RNA, 22 nt, Bordetella pertussis
gcuggaucuggugaaacagcau

SEQ ID NO: 402336 - RNA, 15 nt, Bordetella pertussis
gcuggauggcucggg

SEQ ID NO: 402337 - RNA, 13 nt, Bordetella pertussis
gcuggauggucac

SEQ ID NO: 402338 - RNA, 21 nt, Bordetella pertussis
gcuggauggucacgcccaggc

SEQ ID NO: 402339 - RNA, 18 nt, Bordetella pertussis
gcuggcaaagcgcgcguc

SEQ ID NO: 402340 - RNA, 13 nt, Bordetella pertussis
gcuggcagccuug

SEQ ID NO: 402341 - RNA, 18 nt, Bordetella pertussis
gcuggcaugcggcggacu

SEQ ID NO: 402342 - RNA, 16 nt, Bordetella pertussis
gcuggcauggcggucu

SEQ ID NO: 402343 - RNA, 15 nt, Bordetella pertussis
gcuggccacccgaca

SEQ ID NO: 402344 - RNA, 14 nt, Bordetella pertussis
gcuggcauugacga

SEQ ID NO: 402345 - RNA, 17 nt, Bordetella pertussis
gcuggcauugacgacgc

SEQ ID NO: 402346 - RNA, 13 nt, Bordetella pertussis
gcuggccagccgc

SEQ ID NO: 402347 - RNA, 14 nt, Bordetella pertussis
gcuggccagccgcu

SEQ ID NO: 402348 - RNA, 15 nt, Bordetella pertussis
gcuggccagccgcuc

SEQ ID NO: 402349 - RNA, 16 nt, Bordetella pertussis
gcuggccagccggccc

SEQ ID NO: 402350 - RNA, 12 nt, Bordetella pertussis
gcuggccaggcu

SEQ ID NO: 402351 - RNA, 12 nt, Bordetella pertussis
gcuggccacguu

SEQ ID NO: 402352 - RNA, 18 nt, Bordetella pertussis
gcuggccacuggccgcgc

SEQ ID NO: 402353 - RNA, 17 nt, Bordetella pertussis
gcuggcccacucggugc

SEQ ID NO: 402354 - RNA, 20 nt, Bordetella pertussis
gcuggcccgccagcaaggcg

SEQ ID NO: 402355 - RNA, 20 nt, Bordetella pertussis
gcuggccgaaccauugcagg

SEQ ID NO: 402356 - RNA, 22 nt, Bordetella pertussis
gcuggccgaaccauugcagggu

SEQ ID NO: 402357 - RNA, 20 nt, Bordetella pertussis
gcuggccgaucugcugggcc

SEQ ID NO: 402358 - RNA, 15 nt, Bordetella pertussis
gcuggccgcccgcgg

SEQ ID NO: 402359 - RNA, 14 nt, Bordetella pertussis
gcuggccgccgcgg

SEQ ID NO: 402360 - RNA, 18 nt, Bordetella pertussis
gcuggccgccgcggccuc

SEQ ID NO: 402361 - RNA, 15 nt, Bordetella pertussis
gcuggccgcgcccgc

SEQ ID NO: 402362 - RNA, 12 nt, Bordetella pertussis
gcuggccggcca

SEQ ID NO: 402363 - RNA, 14 nt, Bordetella pertussis
gcuggccggccagc

SEQ ID NO: 402364 - RNA, 16 nt, Bordetella pertussis
gcuggccggccccauc

SEQ ID NO: 402365 - RNA, 19 nt, Bordetella pertussis
gcuggccggccccauccuc

SEQ ID NO: 402366 - RNA, 17 nt, Bordetella pertussis
gcuggccggcgacuucc

SEQ ID NO: 402367 - RNA, 21 nt, Bordetella pertussis
gcuggccggcguggccugccc

SEQ ID NO: 402368 - RNA, 21 nt, Bordetella pertussis
gcuggccugccgcgccgaccg

SEQ ID NO: 402369 - RNA, 16 nt, Bordetella pertussis
gcuggccuggccgccg

SEQ ID NO: 402370 - RNA, 17 nt, Bordetella pertussis
gcuggcgaagaccguga

SEQ ID NO: 402371 - RNA, 21 nt, Bordetella pertussis
gcuggcgaucacggccaaccc

SEQ ID NO: 402372 - RNA, 17 nt, Bordetella pertussis
gcuggcgaucaggccgc

SEQ ID NO: 402373 - RNA, 15 nt, Bordetella pertussis
gcuggcgcccggccu

SEQ ID NO: 402374 - RNA, 16 nt, Bordetella pertussis
gcuggcgccgcgcgcc

SEQ ID NO: 402375 - RNA, 19 nt, Bordetella pertussis
gcuggcgccgcgcgccauc

SEQ ID NO: 402376 - RNA, 15 nt, Bordetella pertussis
gcuggcgcgccaggc

SEQ ID NO: 402377 - RNA, 22 nt, Bordetella pertussis
gcuggcgcgccgccucgcgcuc

SEQ ID NO: 402378 - RNA, 16 nt, Bordetella pertussis
gcuggcgcgcuguucg

SEQ ID NO: 402379 - RNA, 17 nt, Bordetella pertussis
gcuggcgcggaccugcu

SEQ ID NO: 402380 - RNA, 14 nt, Bordetella pertussis
gcuggcgcggccgu

SEQ ID NO: 402381 - RNA, 13 nt, Bordetella pertussis
gcuggcgcggcug

SEQ ID NO: 402382 - RNA, 16 nt, Bordetella pertussis
gcuggcgcgggcggcc

SEQ ID NO: 402383 - RNA, 12 nt, Bordetella pertussis
gcuggcgcgcug

SEQ ID NO: 402384 - RNA, 19 nt, Bordetella pertussis
gcuggcgcuggccgcccgc

SEQ ID NO: 402385 - RNA, 15 nt, Bordetella pertussis
gcuggcggcgcaggc

SEQ ID NO: 402386 - RNA, 18 nt, Bordetella pertussis
gcuggcggcgcaggccgc

SEQ ID NO: 402387 - RNA, 15 nt, Bordetella pertussis
gcuggcggcgcuggu

SEQ ID NO: 402388 - RNA, 14 nt, Bordetella pertussis
gcuggcggcccugc

SEQ ID NO: 402389 - RNA, 14 nt, Bordetella pertussis
gcuggcggcgcagc

SEQ ID NO: 402390 - RNA, 19 nt, Bordetella pertussis
gcuggcguugacguggcug

SEQ ID NO: 402391 - RNA, 18 nt, Bordetella pertussis
gcuggcugcccuggcgcu

SEQ ID NO: 402392 - RNA, 13 nt, Bordetella pertussis
gcuggcugggccu

SEQ ID NO: 402393 - RNA, 17 nt, Bordetella pertussis
gcuggcugggccugcug

SEQ ID NO: 402394 - RNA, 22 nt, Bordetella pertussis
gcuggcugggccugcugucgcu

SEQ ID NO: 402395 - RNA, 20 nt, Bordetella pertussis
gcuggcuucggcgcugggcg

SEQ ID NO: 402396 - RNA, 22 nt, Bordetella pertussis
gcuggcuucggcgcugggcgca

SEQ ID NO: 402397 - RNA, 12 nt, Bordetella pertussis
gcugggacaggc

SEQ ID NO: 402398 - RNA, 14 nt, Bordetella pertussis
gcugggacaggcac

SEQ ID NO: 402399 - RNA, 20 nt, Bordetella pertussis
gcugggacaggcacucugcc

SEQ ID NO: 402400 - RNA, 16 nt, Bordetella pertussis
gcugggcacauccagc

SEQ ID NO: 402401 - RNA, 19 nt, Bordetella pertussis
gcugggcacauccagcgcc

SEQ ID NO: 402402 - RNA, 12 nt, Bordetella pertussis
gcugggccaggc

SEQ ID NO: 402403 - RNA, 14 nt, Bordetella pertussis
gcugggccgcgcuc

SEQ ID NO: 402404 - RNA, 18 nt, Bordetella pertussis
gcugggcgaggcgcuggc

SEQ ID NO: 402405 - RNA, 15 nt, Bordetella pertussis
gcugggcgccagcag

SEQ ID NO: 402406 - RNA, 16 nt, Bordetella pertussis
gcugggcgccagcagc

SEQ ID NO: 402407 - RNA, 20 nt, Bordetella pertussis
gcugggcgccaugcgcccgg

SEQ ID NO: 402408 - RNA, 17 nt, Bordetella pertussis
gcugggcggccaggcgg

SEQ ID NO: 402409 - RNA, 13 nt, Bordetella pertussis
gcugggcggccuu

SEQ ID NO: 402410 - RNA, 23 nt, Bordetella pertussis
gcugggcggccuuggccgcagcc

SEQ ID NO: 402411 - RNA, 13 nt, Bordetella pertussis
gcugggcggcggg

SEQ ID NO: 402412 - RNA, 14 nt, Bordetella pertussis
gcugggcggcgggc

SEQ ID NO: 402413 - RNA, 14 nt, Bordetella pertussis
gcugggcgggcugg

SEQ ID NO: 402414 - RNA, 22 nt, Bordetella pertussis
gcugggcuacgacccgcugaag

SEQ ID NO: 402415 - RNA, 16 nt, Bordetella pertussis
gcuggggcaggcacug

SEQ ID NO: 402416 - RNA, 17 nt, Bordetella pertussis
gcuggggcaggcacugg

SEQ ID NO: 402417 - RNA, 23 nt, Bordetella pertussis
gcuggggcaggcacuggcgcggc

SEQ ID NO: 402418 - RNA, 15 nt, Bordetella pertussis
gcuggggccgcgcgc

SEQ ID NO: 402419 - RNA, 20 nt, Bordetella pertussis
gcugggguggagcgcggcgc

SEQ ID NO: 402420 - RNA, 20 nt, Bordetella pertussis
gcugggguuguauugcauga

SEQ ID NO: 402421 - RNA, 13 nt, Bordetella pertussis
gcugggucagguc

SEQ ID NO: 402422 - RNA, 14 nt, Bordetella pertussis
gcugggucaggucg

SEQ ID NO: 402423 - RNA, 15 nt, Bordetella pertussis
gcuggucaccgcccc

SEQ ID NO: 402424 - RNA, 22 nt, Bordetella pertussis
gcuggucgccaucugcugcgag

SEQ ID NO: 402425 - RNA, 16 nt, Bordetella pertussis
gcuggucgcgcagcac

SEQ ID NO: 402426 - RNA, 20 nt, Bordetella pertussis
gcuggucguaucgccgcuga

SEQ ID NO: 402427 - RNA, 22 nt, Bordetella pertussis
gcuggucguaucgccgcugaug

SEQ ID NO: 402428 - RNA, 13 nt, Bordetella pertussis
gcuggugcagcuu

SEQ ID NO: 402429 - RNA, 15 nt, Bordetella pertussis
gcuggugccaguccc

SEQ ID NO: 402430 - RNA, 20 nt, Bordetella pertussis
gcuggugccgacggcgcggg

SEQ ID NO: 402431 - RNA, 17 nt, Bordetella pertussis
gcugguggccaccagcc

SEQ ID NO: 402432 - RNA, 13 nt, Bordetella pertussis
gcugguggccaga

SEQ ID NO: 402433 - RNA, 14 nt, Bordetella pertussis
gcugguugggcucg

SEQ ID NO: 402434 - RNA, 21 nt, Bordetella pertussis
gcugguuuucggacgcagcuu

SEQ ID NO: 402435 - RNA, 20 nt, Bordetella pertussis
gcuguaccgguagcccgcgu

SEQ ID NO: 402436 - RNA, 17 nt, Bordetella pertussis
gcuguaccucagccugc

SEQ ID NO: 402437 - RNA, 18 nt, Bordetella pertussis
gcuguagaggcgcggcuc

SEQ ID NO: 402438 - RNA, 16 nt, Bordetella pertussis
gcuguaucuggccugu

SEQ ID NO: 402439 - RNA, 19 nt, Bordetella pertussis
gcuguccaagcgcguggcc

SEQ ID NO: 402440 - RNA, 17 nt, Bordetella pertussis
gcugucgcaacagcccc

SEQ ID NO: 402441 - RNA, 21 nt, Bordetella pertussis
gcugucgcagucggggccgca

SEQ ID NO: 402442 - RNA, 22 nt, Bordetella pertussis
gcugucgcgcuacagcguggug

SEQ ID NO: 402443 - RNA, 17 nt, Bordetella pertussis
gcugucgcugaucugcu

SEQ ID NO: 402444 - RNA, 18 nt, Bordetella pertussis
gcugucgucgucggcacc

SEQ ID NO: 402445 - RNA, 15 nt, Bordetella pertussis
gcugucgugccgcac

SEQ ID NO: 402446 - RNA, 15 nt, Bordetella pertussis
gcugugcgauggcac

SEQ ID NO: 402447 - RNA, 12 nt, Bordetella pertussis
gcuguuccagcc

SEQ ID NO: 402448 - RNA, 22 nt, Bordetella pertussis
gcuguugcccaccagccgggcg

SEQ ID NO: 402449 - RNA, 22 nt, Bordetella pertussis
gcuguuuuucauuugccgccug

SEQ ID NO: 402450 - RNA, 18 nt, Bordetella pertussis
gcuuauaggcuuucagau

SEQ ID NO: 402451 - RNA, 16 nt, Bordetella pertussis
gcuucagccugggccu

SEQ ID NO: 402452 - RNA, 23 nt, Bordetella pertussis
gcuucagugcucgggcugcggcu

SEQ ID NO: 402453 - RNA, 13 nt, Bordetella pertussis
gcuucaggcgcgc

SEQ ID NO: 402454 - RNA, 14 nt, Bordetella pertussis
gcuucaucaccuuc

SEQ ID NO: 402455 - RNA, 16 nt, Bordetella pertussis
gcuuccaccgucuggc

SEQ ID NO: 402456 - RNA, 13 nt, Bordetella pertussis
gcuuccagcagca

SEQ ID NO: 402457 - RNA, 20 nt, Bordetella pertussis
gcuuccagaucgaccaggac

SEQ ID NO: 402458 - RNA, 21 nt, Bordetella pertussis
gcuuccaggaguucccagcgc

SEQ ID NO: 402459 - RNA, 18 nt, Bordetella pertussis
gcuuccagguacaggggc

SEQ ID NO: 402460 - RNA, 21 nt, Bordetella pertussis
gcuuccaguugcuguuucucc

SEQ ID NO: 402461 - RNA, 15 nt, Bordetella pertussis
gcuuccggccgggcc

SEQ ID NO: 402462 - RNA, 16 nt, Bordetella pertussis
gcuuccucgaccaggu

SEQ ID NO: 402463 - RNA, 19 nt, Bordetella pertussis
gcuuccugcugcgccuggc

SEQ ID NO: 402464 - RNA, 18 nt, Bordetella pertussis
gcuuccugggccugcggc

SEQ ID NO: 402465 - RNA, 13 nt, Bordetella pertussis
gcuuccuggucac

SEQ ID NO: 402466 - RNA, 17 nt, Bordetella pertussis
gcuucgauggcggcggc

SEQ ID NO: 402467 - RNA, 15 nt, Bordetella pertussis
gcuucgcccagcgcu

SEQ ID NO: 402468 - RNA, 15 nt, Bordetella pertussis
gcuucggcgcugggc

SEQ ID NO: 402469 - RNA, 15 nt, Bordetella pertussis
gcuucggcggccaug

SEQ ID NO: 402470 - RNA, 13 nt, Bordetella pertussis
gcuucggcggccg

SEQ ID NO: 402471 - RNA, 16 nt, Bordetella pertussis
gcuucggcggccgcgu

SEQ ID NO: 402472 - RNA, 21 nt, Bordetella pertussis
gcuucggcguacugcugcaag

SEQ ID NO: 402473 - RNA, 13 nt, Bordetella pertussis
gcuucgggcagcu

SEQ ID NO: 402474 - RNA, 17 nt, Bordetella pertussis
gcuucggucagcugcug

SEQ ID NO: 402475 - RNA, 16 nt, Bordetella pertussis
gcuucgucauggucga

SEQ ID NO: 402476 - RNA, 21 nt, Bordetella pertussis
gcuucgucgccggcguuggug

SEQ ID NO: 402477 - RNA, 21 nt, Bordetella pertussis
gcuucgucggccgccagccac

SEQ ID NO: 402478 - RNA, 14 nt, Bordetella pertussis
gcuucgucgggcag

SEQ ID NO: 402479 - RNA, 14 nt, Bordetella pertussis
gcuucgugcggccg

SEQ ID NO: 402480 - RNA, 16 nt, Bordetella pertussis
gcuucgugcggccgca

SEQ ID NO: 402481 - RNA, 22 nt, Bordetella pertussis
gcuucguucaagcguugccgca

SEQ ID NO: 402482 - RNA, 21 nt, Bordetella pertussis
gcuucucgaccaggcgggcau

SEQ ID NO: 402483 - RNA, 20 nt, Bordetella pertussis
gcuucucggugcgccgccgc

SEQ ID NO: 402484 - RNA, 13 nt, Bordetella pertussis
gcuucugcgccug

SEQ ID NO: 402485 - RNA, 18 nt, Bordetella pertussis
gcuucugguaguuggcca

SEQ ID NO: 402486 - RNA, 20 nt, Bordetella pertussis
gcuucuuccuugcgaugcca

SEQ ID NO: 402487 - RNA, 20 nt, Bordetella pertussis
gcuucuucuuugcccuggcc

SEQ ID NO: 402488 - RNA, 23 nt, Bordetella pertussis
gcuucuugaacucggccagcagc

SEQ ID NO: 402489 - RNA, 14 nt, Bordetella pertussis
gcuugaacaggcag

SEQ ID NO: 402490 - RNA, 13 nt, Bordetella pertussis
gcuugaagacgcc

SEQ ID NO: 402491 - RNA, 20 nt, Bordetella pertussis
gcuugaccacggccagcagc

SEQ ID NO: 402492 - RNA, 22 nt, Bordetella pertussis
gcuugacccguuugcgcagcuc

SEQ ID NO: 402493 - RNA, 17 nt, Bordetella pertussis
gcuugaccgccagcauc

SEQ ID NO: 402494 - RNA, 12 nt, Bordetella pertussis
gcuugaccgccu

SEQ ID NO: 402495 - RNA, 22 nt, Bordetella pertussis
gcuugacgccgccgaagggcac

SEQ ID NO: 402496 - RNA, 18 nt, Bordetella pertussis
gcuugacguccagcgacu

SEQ ID NO: 402497 - RNA, 15 nt, Bordetella pertussis
gcuugagcagccacu

SEQ ID NO: 402498 - RNA, 21 nt, Bordetella pertussis
gcuugagcaggcgcgagcgcc

SEQ ID NO: 402499 - RNA, 22 nt, Bordetella pertussis
gcuugagcgaaauggcggccuc

SEQ ID NO: 402500 - RNA, 19 nt, Bordetella pertussis
gcuugcacgccggccacga

SEQ ID NO: 402501 - RNA, 18 nt, Bordetella pertussis
gcuugcagcuugcgcgcc

SEQ ID NO: 402502 - RNA, 21 nt, Bordetella pertussis
gcuugccauaggccagcgccu

SEQ ID NO: 402503 - RNA, 19 nt, Bordetella pertussis
gcuugcccgucaugcgccg

SEQ ID NO: 402504 - RNA, 20 nt, Bordetella pertussis
gcuugccgaccuccaggccc

SEQ ID NO: 402505 - RNA, 22 nt, Bordetella pertussis
gcuugccgaccuccaggcccag

SEQ ID NO: 402506 - RNA, 15 nt, Bordetella pertussis
gcuugccgcagcggc

SEQ ID NO: 402507 - RNA, 23 nt, Bordetella pertussis
gcuugccguacgagugcaggccc

SEQ ID NO: 402508 - RNA, 20 nt, Bordetella pertussis
gcuugccguagcgcguggcc

SEQ ID NO: 402509 - RNA, 23 nt, Bordetella pertussis
gcuugccguagcgcguggccagc

SEQ ID NO: 402510 - RNA, 15 nt, Bordetella pertussis
gcuugccguucaggu

SEQ ID NO: 402511 - RNA, 17 nt, Bordetella pertussis
gcuugccuguccccacu

SEQ ID NO: 402512 - RNA, 18 nt, Bordetella pertussis
gcuugcgcaagccggccg

SEQ ID NO: 402513 - RNA, 15 nt, Bordetella pertussis
gcuugcggccaggcg

SEQ ID NO: 402514 - RNA, 21 nt, Bordetella pertussis
gcuugcggccaggcggggugg

SEQ ID NO: 402515 - RNA, 14 nt, Bordetella pertussis
gcuugcggccggcg

SEQ ID NO: 402516 - RNA, 16 nt, Bordetella pertussis
gcuugcggcgcuggcu

SEQ ID NO: 402517 - RNA, 17 nt, Bordetella pertussis
gcuugcggcgcuggcug

SEQ ID NO: 402518 - RNA, 14 nt, Bordetella pertussis
gcuugcggcugucc

SEQ ID NO: 402519 - RNA, 14 nt, Bordetella pertussis
gcuuggccagcugg

SEQ ID NO: 402520 - RNA, 14 nt, Bordetella pertussis
gcuuggccaggcug

SEQ ID NO: 402521 - RNA, 17 nt, Bordetella pertussis
gcuuggccugcggaugc

SEQ ID NO: 402522 - RNA, 21 nt, Bordetella pertussis
gcuuggcgaacaccagggugg

SEQ ID NO: 402523 - RNA, 18 nt, Bordetella pertussis
gcuuggcgcgcagcagcg

SEQ ID NO: 402524 - RNA, 13 nt, Bordetella pertussis
gcuuggcggucug

SEQ ID NO: 402525 - RNA, 21 nt, Bordetella pertussis
gcuuggcggucugggcguccc

SEQ ID NO: 402526 - RNA, 14 nt, Bordetella pertussis
gcuugggcccggcg

SEQ ID NO: 402527 - RNA, 15 nt, Bordetella pertussis
gcuugggcccggcgu

SEQ ID NO: 402528 - RNA, 16 nt, Bordetella pertussis
gcuugggccgcgccug

SEQ ID NO: 402529 - RNA, 19 nt, Bordetella pertussis
gcuugggccgcgccugcag

SEQ ID NO: 402530 - RNA, 17 nt, Bordetella pertussis
gcuugggcgugcccuug

SEQ ID NO: 402531 - RNA, 19 nt, Bordetella pertussis
gcuugggcuugauggccag

SEQ ID NO: 402532 - RNA, 16 nt, Bordetella pertussis
gcuuggggcgcgccgc

SEQ ID NO: 402533 - RNA, 19 nt, Bordetella pertussis
gcuuguaccccauaguccu

SEQ ID NO: 402534 - RNA, 14 nt, Bordetella pertussis
gcuugucgaugacg

SEQ ID NO: 402535 - RNA, 15 nt, Bordetella pertussis
gcuugucggccgcgc

SEQ ID NO: 402536 - RNA, 17 nt, Bordetella pertussis
gcuuucagauccuuggu

SEQ ID NO: 402537 - RNA, 17 nt, Bordetella pertussis
gcuuucaugggccuggg

SEQ ID NO: 402538 - RNA, 17 nt, Bordetella pertussis
gcuuucgaccagcgaca

SEQ ID NO: 402539 - RNA, 21 nt, Bordetella pertussis
gcuuucgaccagcgacagcac

SEQ ID NO: 402540 - RNA, 18 nt, Bordetella pertussis
gcuuuggucuauuuccga

SEQ ID NO: 402541 - RNA, 13 nt, Bordetella pertussis
gcuuuuuccugcu

SEQ ID NO: 402542 - RNA, 14 nt, Bordetella pertussis
gcuuuuuccugcug

SEQ ID NO: 402543 - RNA, 12 nt, Bordetella pertussis
gcuuuuuccugu

SEQ ID NO: 402544 - RNA, 11 nt, Bordetella pertussis
gcuuuuugccu

SEQ ID NO: 402545 - RNA, 14 nt, Bordetella pertussis
gcuuuuuugccuug

SEQ ID NO: 402546 - RNA, 14 nt, Bordetella pertussis
ggaaaaagagccug

SEQ ID NO: 402547 - RNA, 18 nt, Bordetella pertussis
ggaaaaagagccuguccc

SEQ ID NO: 402548 - RNA, 16 nt, Bordetella pertussis
ggaaagaggccaggcc

SEQ ID NO: 402549 - RNA, 19 nt, Bordetella pertussis
ggaaagcaucagcccuacc

SEQ ID NO: 402550 - RNA, 21 nt, Bordetella pertussis
ggaaagcccggccccaggccg

SEQ ID NO: 402551 - RNA, 22 nt, Bordetella pertussis
ggaaagcccggccccaggccgg

SEQ ID NO: 402552 - RNA, 20 nt, Bordetella pertussis
ggaaauccguaguccagcag

SEQ ID NO: 402553 - RNA, 20 nt, Bordetella pertussis
ggaaaucgugccgucgauga

SEQ ID NO: 402554 - RNA, 23 nt, Bordetella pertussis
ggaacaccaccuccaccgccagc

SEQ ID NO: 402555 - RNA, 15 nt, Bordetella pertussis
ggaacauggcgguga

SEQ ID NO: 402556 - RNA, 22 nt, Bordetella pertussis
ggaacauggcggugaaggcgcc

SEQ ID NO: 402557 - RNA, 18 nt, Bordetella pertussis
ggaaccgguuggccagcu

SEQ ID NO: 402558 - RNA, 14 nt, Bordetella pertussis
ggaacgccagcagc

SEQ ID NO: 402559 - RNA, 18 nt, Bordetella pertussis
ggaacggcaccagccggg

SEQ ID NO: 402560 - RNA, 20 nt, Bordetella pertussis
ggaacggcaccagccgggcu

SEQ ID NO: 402561 - RNA, 22 nt, Bordetella pertussis
ggaacguuugcggacgggccag

SEQ ID NO: 402562 - RNA, 20 nt, Bordetella pertussis
ggaacucguuggccagcgcg

SEQ ID NO: 402563 - RNA, 11 nt, Bordetella pertussis
ggaacuuggga

SEQ ID NO: 402564 - RNA, 21 nt, Bordetella pertussis
ggaagaacaccguuuccaagc

SEQ ID NO: 402565 - RNA, 20 nt, Bordetella pertussis
ggaagacauggcgcgcgcca

SEQ ID NO: 402566 - RNA, 15 nt, Bordetella pertussis
ggaagcagcccagca

SEQ ID NO: 402567 - RNA, 21 nt, Bordetella pertussis
ggaagcagcccagcacgacga

SEQ ID NO: 402568 - RNA, 18 nt, Bordetella pertussis
ggaagcgcgccaggcgca

SEQ ID NO: 402569 - RNA, 15 nt, Bordetella pertussis
ggaagcuggccagcg

SEQ ID NO: 402570 - RNA, 17 nt, Bordetella pertussis
ggaagcugucggcgcug

SEQ ID NO: 402571 - RNA, 23 nt, Bordetella pertussis
ggaaggccgccgcgugcgccggg

SEQ ID NO: 402572 - RNA, 12 nt, Bordetella pertussis
ggaauccacagc

SEQ ID NO: 402573 - RNA, 20 nt, Bordetella pertussis
ggaauggucaagcggcugcc

SEQ ID NO: 402574 - RNA, 22 nt, Bordetella pertussis
ggaauggucaagcggcugcccu

SEQ ID NO: 402575 - RNA, 18 nt, Bordetella pertussis
ggaauucugaacaagggc

SEQ ID NO: 402576 - RNA, 15 nt, Bordetella pertussis
ggacaccgcaggugc

SEQ ID NO: 402577 - RNA, 20 nt, Bordetella pertussis
ggacaggaacuccggcggcg

SEQ ID NO: 402578 - RNA, 14 nt, Bordetella pertussis
ggacaggcaccccu

SEQ ID NO: 402579 - RNA, 16 nt, Bordetella pertussis
ggacaggcaccugcga

SEQ ID NO: 402580 - RNA, 22 nt, Bordetella pertussis
ggacaggcaccugcgaccgagc

SEQ ID NO: 402581 - RNA, 11 nt, Bordetella pertussis
ggacaggcacg

SEQ ID NO: 402582 - RNA, 14 nt, Bordetella pertussis
ggacaggggccuca

SEQ ID NO: 402583 - RNA, 18 nt, Bordetella pertussis
ggacgccgccggcccagg

SEQ ID NO: 402584 - RNA, 22 nt, Bordetella pertussis
ggacgcgcuguaggcgccggcg

SEQ ID NO: 402585 - RNA, 23 nt, Bordetella pertussis
ggacgcguccucggccagccggg

SEQ ID NO: 402586 - RNA, 21 nt, Bordetella pertussis
ggacgcugaccgagggcgcgu

SEQ ID NO: 402587 - RNA, 12 nt, Bordetella pertussis
ggacggccagca

SEQ ID NO: 402588 - RNA, 15 nt, Bordetella pertussis
ggacggccagcagga

SEQ ID NO: 402589 - RNA, 18 nt, Bordetella pertussis
ggacggccaggggcagcu

SEQ ID NO: 402590 - RNA, 22 nt, Bordetella pertussis
ggagaccggguugcccggcagg

SEQ ID NO: 402591 - RNA, 18 nt, Bordetella pertussis
ggagcaugcccuuugcag

SEQ ID NO: 402592 - RNA, 15 nt, Bordetella pertussis
ggagccaggcggcgu

SEQ ID NO: 402593 - RNA, 20 nt, Bordetella pertussis
ggagccaguccccgcgggga

SEQ ID NO: 402594 - RNA, 15 nt, Bordetella pertussis
ggagcccgcugccga

SEQ ID NO: 402595 - RNA, 21 nt, Bordetella pertussis
ggagccgcgcacacauggcgc

SEQ ID NO: 402596 - RNA, 13 nt, Bordetella pertussis
ggagccggcgggc

SEQ ID NO: 402597 - RNA, 19 nt, Bordetella pertussis
ggagccggcgggcggcugc

SEQ ID NO: 402598 - RNA, 15 nt, Bordetella pertussis
ggagccuguccccgc

SEQ ID NO: 402599 - RNA, 16 nt, Bordetella pertussis
ggagcugcacaagguc

SEQ ID NO: 402600 - RNA, 18 nt, Bordetella pertussis
ggagcugcugugcgccgg

SEQ ID NO: 402601 - RNA, 20 nt, Bordetella pertussis
ggagcugcugugcgccgggg

SEQ ID NO: 402602 - RNA, 21 nt, Bordetella pertussis
ggagcugcugugcgccggggc

SEQ ID NO: 402603 - RNA, 22 nt, Bordetella pertussis
ggagcugcugugcgccggggcg

SEQ ID NO: 402604 - RNA, 14 nt, Bordetella pertussis
ggaggggcgcaggc

SEQ ID NO: 402605 - RNA, 15 nt, Bordetella pertussis
ggagggugcgcaaug

SEQ ID NO: 402606 - RNA, 22 nt, Bordetella pertussis
ggagguaugcacgaccaggccg

SEQ ID NO: 402607 - RNA, 16 nt, Bordetella pertussis
ggauaauugggcggca

SEQ ID NO: 402608 - RNA, 17 nt, Bordetella pertussis
ggauaauugggcggcau

SEQ ID NO: 402609 - RNA, 19 nt, Bordetella pertussis
ggauaccgcuggccaggcu

SEQ ID NO: 402610 - RNA, 16 nt, Bordetella pertussis
ggauaucggccaggcg

SEQ ID NO: 402611 - RNA, 17 nt, Bordetella pertussis
ggaucaggaugggcgcg

SEQ ID NO: 402612 - RNA, 18 nt, Bordetella pertussis
ggaucaggaugggcgcgg

SEQ ID NO: 402613 - RNA, 14 nt, Bordetella pertussis
ggaucaggccggcg

SEQ ID NO: 402614 - RNA, 20 nt, Bordetella pertussis
ggaucaugucguccucggcc

SEQ ID NO: 402615 - RNA, 20 nt, Bordetella pertussis
ggauccacgccgccggccag

SEQ ID NO: 402616 - RNA, 11 nt, Bordetella pertussis
ggauccagcug

SEQ ID NO: 402617 - RNA, 12 nt, Bordetella pertussis
ggaucccaggcc

SEQ ID NO: 402618 - RNA, 23 nt, Bordetella pertussis
ggaucccgagcgggcaugggccc

SEQ ID NO: 402619 - RNA, 13 nt, Bordetella pertussis
ggaucccggcgcc

SEQ ID NO: 402620 - RNA, 18 nt, Bordetella pertussis
ggaucccggcgccagcca

SEQ ID NO: 402621 - RNA, 13 nt, Bordetella pertussis
ggauccggcagca

SEQ ID NO: 402622 - RNA, 13 nt, Bordetella pertussis
ggauccggcgcug

SEQ ID NO: 402623 - RNA, 17 nt, Bordetella pertussis
ggaucgacaggaacagc

SEQ ID NO: 402624 - RNA, 20 nt, Bordetella pertussis
ggaucgccgguagcgcuggg

SEQ ID NO: 402625 - RNA, 14 nt, Bordetella pertussis
ggaucgcgccaggc

SEQ ID NO: 402626 - RNA, 17 nt, Bordetella pertussis
ggaucgcggccagcggc

SEQ ID NO: 402627 - RNA, 16 nt, Bordetella pertussis
ggaucgggcagcuugg

SEQ ID NO: 402628 - RNA, 19 nt, Bordetella pertussis
ggaugaagcguucggccuu

SEQ ID NO: 402629 - RNA, 17 nt, Bordetella pertussis
ggaugaccugcgccagg

SEQ ID NO: 402630 - RNA, 18 nt, Bordetella pertussis
ggaugaccuggugcacca

SEQ ID NO: 402631 - RNA, 21 nt, Bordetella pertussis
ggaugcgcaccggccaggggc

SEQ ID NO: 402632 - RNA, 12 nt, Bordetella pertussis
ggaugggcggcc

SEQ ID NO: 402633 - RNA, 13 nt, Bordetella pertussis
ggaugggcggccu

SEQ ID NO: 402634 - RNA, 17 nt, Bordetella pertussis
ggauguacgucagcaug

SEQ ID NO: 402635 - RNA, 21 nt, Bordetella pertussis
ggauguccacggucgccggca

SEQ ID NO: 402636 - RNA, 23 nt, Bordetella pertussis
ggauguccacggucgccggcaug

SEQ ID NO: 402637 - RNA, 12 nt, Bordetella pertussis
ggaugugcagcg

SEQ ID NO: 402638 - RNA, 12 nt, Bordetella pertussis
ggaugugcaggc

SEQ ID NO: 402639 - RNA, 17 nt, Bordetella pertussis
ggauuccugcgaggaca

SEQ ID NO: 402640 - RNA, 20 nt, Bordetella pertussis
ggauuccugggugcugccgc

SEQ ID NO: 402641 - RNA, 15 nt, Bordetella pertussis
ggauugaccagcgcg

SEQ ID NO: 402642 - RNA, 22 nt, Bordetella pertussis
ggcaaacccggcgaagccggca

SEQ ID NO: 402643 - RNA, 16 nt, Bordetella pertussis
ggcaaacggcggcagg

SEQ ID NO: 402644 - RNA, 17 nt, Bordetella pertussis
ggcaaacggcggcaggc

SEQ ID NO: 402645 - RNA, 16 nt, Bordetella pertussis
ggcacaccagcgccag

SEQ ID NO: 402646 - RNA, 20 nt, Bordetella pertussis
ggcacacgaccggcuugccg

SEQ ID NO: 402647 - RNA, 16 nt, Bordetella pertussis
ggcacaggaacagccu

SEQ ID NO: 402648 - RNA, 19 nt, Bordetella pertussis
ggcacaggccaucggcgcc

SEQ ID NO: 402649 - RNA, 18 nt, Bordetella pertussis
ggcacauccagcgccagc

SEQ ID NO: 402650 - RNA, 20 nt, Bordetella pertussis
ggcacaucagcgugccgccg

SEQ ID NO: 402651 - RNA, 15 nt, Bordetella pertussis
ggcaccaccaccgcc

SEQ ID NO: 402652 - RNA, 19 nt, Bordetella pertussis
ggcaccaggauccccagca

SEQ ID NO: 402653 - RNA, 16 nt, Bordetella pertussis
ggcaccagguccuggc

SEQ ID NO: 402654 - RNA, 19 nt, Bordetella pertussis
ggcaccaucugcgucgcgu

SEQ ID NO: 402655 - RNA, 13 nt, Bordetella pertussis
ggcaccaugcgca

SEQ ID NO: 402656 - RNA, 15 nt, Bordetella pertussis
ggcaccgagcacagc

SEQ ID NO: 402657 - RNA, 17 nt, Bordetella pertussis
ggcaccgagcacagcaa

SEQ ID NO: 402658 - RNA, 18 nt, Bordetella pertussis
ggcaccgagcacagcaac

SEQ ID NO: 402659 - RNA, 16 nt, Bordetella pertussis
ggcaccgaggccgagu

SEQ ID NO: 402660 - RNA, 16 nt, Bordetella pertussis
ggcaccgccaggcaga

SEQ ID NO: 402661 - RNA, 16 nt, Bordetella pertussis
ggcaccgccgcacagc

SEQ ID NO: 402662 - RNA, 17 nt, Bordetella pertussis
ggcacgaucaccgccgc

SEQ ID NO: 402663 - RNA, 21 nt, Bordetella pertussis
ggcacgaucaccgccgcggcg

SEQ ID NO: 402664 - RNA, 22 nt, Bordetella pertussis
ggcacgaucaccgccgcggcga

SEQ ID NO: 402665 - RNA, 20 nt, Bordetella pertussis
ggcacgauuucgccgauccg

SEQ ID NO: 402666 - RNA, 13 nt, Bordetella pertussis
ggcacgcccagcc

SEQ ID NO: 402667 - RNA, 22 nt, Bordetella pertussis
ggcacgcccagccgcagcaggc

SEQ ID NO: 402668 - RNA, 13 nt, Bordetella pertussis
ggcacgccgauga

SEQ ID NO: 402669 - RNA, 14 nt, Bordetella pertussis
ggcacgccggccuu

SEQ ID NO: 402670 - RNA, 15 nt, Bordetella pertussis
ggcacgccggcggcc

SEQ ID NO: 402671 - RNA, 16 nt, Bordetella pertussis
ggcacgccggcggcgc

SEQ ID NO: 402672 - RNA, 17 nt, Bordetella pertussis
ggcacguaccaggcgcu

SEQ ID NO: 402673 - RNA, 19 nt, Bordetella pertussis
ggcacguaguacagcagca

SEQ ID NO: 402674 - RNA, 15 nt, Bordetella pertussis
ggcacgucgggcagg

SEQ ID NO: 402675 - RNA, 17 nt, Bordetella pertussis
ggcacucggccauggug

SEQ ID NO: 402676 - RNA, 21 nt, Bordetella pertussis
ggcacucugccgugggacagg

SEQ ID NO: 402677 - RNA, 23 nt, Bordetella pertussis
ggcacucugccgugggacaggca

SEQ ID NO: 402678 - RNA, 22 nt, Bordetella pertussis
ggcagacgaucauccaggccgu

SEQ ID NO: 402679 - RNA, 13 nt, Bordetella pertussis
ggcagaccgagcg

SEQ ID NO: 402680 - RNA, 18 nt, Bordetella pertussis
ggcagaccgagcgcgccc

SEQ ID NO: 402681 - RNA, 20 nt, Bordetella pertussis
ggcagagggcgacggcggcg

SEQ ID NO: 402682 - RNA, 16 nt, Bordetella pertussis
ggcagaucggcgcugg

SEQ ID NO: 402683 - RNA, 19 nt, Bordetella pertussis
ggcagaucggcgcuggccu

SEQ ID NO: 402684 - RNA, 22 nt, Bordetella pertussis
ggcagaugaucuacgcgcgcgc

SEQ ID NO: 402685 - RNA, 16 nt, Bordetella pertussis
ggcagcacaagggccc

SEQ ID NO: 402686 - RNA, 18 nt, Bordetella pertussis
ggcagcacccagcguucg

SEQ ID NO: 402687 - RNA, 17 nt, Bordetella pertussis
ggcagcagaucggcggc

SEQ ID NO: 402688 - RNA, 18 nt, Bordetella pertussis
ggcagcagaucggcggcc

SEQ ID NO: 402689 - RNA, 12 nt, Bordetella pertussis
ggcagcagcagg

SEQ ID NO: 402690 - RNA, 18 nt, Bordetella pertussis
ggcagcaggccggcggcg

SEQ ID NO: 402691 - RNA, 14 nt, Bordetella pertussis
ggcagcaggcgcgu

SEQ ID NO: 402692 - RNA, 13 nt, Bordetella pertussis
ggcagcaggcugc

SEQ ID NO: 402693 - RNA, 15 nt, Bordetella pertussis
ggcagcaggcugccg

SEQ ID NO: 402694 - RNA, 13 nt, Bordetella pertussis
ggcagcagggcca

SEQ ID NO: 402695 - RNA, 17 nt, Bordetella pertussis
ggcagcauggcgcgcgg

SEQ ID NO: 402696 - RNA, 20 nt, Bordetella pertussis
ggcagccauccucgcccagc

SEQ ID NO: 402697 - RNA, 21 nt, Bordetella pertussis
ggcagccauccucgcccagcg

SEQ ID NO: 402698 - RNA, 12 nt, Bordetella pertussis
ggcagccgauga

SEQ ID NO: 402699 - RNA, 13 nt, Bordetella pertussis
ggcagccggcccc

SEQ ID NO: 402700 - RNA, 18 nt, Bordetella pertussis
ggcagccuugaaagaggc

SEQ ID NO: 402701 - RNA, 19 nt, Bordetella pertussis
ggcagcgaccgcggcgguc

SEQ ID NO: 402702 - RNA, 15 nt, Bordetella pertussis
ggcagcgacucgccg

SEQ ID NO: 402703 - RNA, 16 nt, Bordetella pertussis
ggcagcgcgcaggaca

SEQ ID NO: 402704 - RNA, 16 nt, Bordetella pertussis
ggcagcgcgcgcguga

SEQ ID NO: 402705 - RNA, 12 nt, Bordetella pertussis
ggcagcgcggcg

SEQ ID NO: 402706 - RNA, 14 nt, Bordetella pertussis
ggcagcgcggcggc

SEQ ID NO: 402707 - RNA, 16 nt, Bordetella pertussis
ggcagcgcggcggcga

SEQ ID NO: 402708 - RNA, 14 nt, Bordetella pertussis
ggcagcggccagau

SEQ ID NO: 402709 - RNA, 14 nt, Bordetella pertussis
ggcagcggccagcg

SEQ ID NO: 402710 - RNA, 21 nt, Bordetella pertussis
ggcagcggccagcgcggcggc

SEQ ID NO: 402711 - RNA, 18 nt, Bordetella pertussis
ggcagcggcgacggcgcc

SEQ ID NO: 402712 - RNA, 12 nt, Bordetella pertussis
ggcagcggcgcc

SEQ ID NO: 402713 - RNA, 17 nt, Bordetella pertussis
ggcagcggcgccaugcg

SEQ ID NO: 402714 - RNA, 19 nt, Bordetella pertussis
ggcagcgggccgcagcaug

SEQ ID NO: 402715 - RNA, 17 nt, Bordetella pertussis
ggcagcguaucgcccgc

SEQ ID NO: 402716 - RNA, 15 nt, Bordetella pertussis
ggcagcuggcgcggg

SEQ ID NO: 402717 - RNA, 17 nt, Bordetella pertussis
ggcagcuggcgcgggcg

SEQ ID NO: 402718 - RNA, 20 nt, Bordetella pertussis
ggcagcuggcgcgggcggcc

SEQ ID NO: 402719 - RNA, 18 nt, Bordetella pertussis
ggcagcuugaccgccucc

SEQ ID NO: 402720 - RNA, 19 nt, Bordetella pertussis
ggcagcuugaccgccucca

SEQ ID NO: 402721 - RNA, 16 nt, Bordetella pertussis
ggcagcuuggcgcgcc

SEQ ID NO: 402722 - RNA, 22 nt, Bordetella pertussis
ggcagcuugucgaucgccacca

SEQ ID NO: 402723 - RNA, 19 nt, Bordetella pertussis
ggcaggaagccggcccguu

SEQ ID NO: 402724 - RNA, 16 nt, Bordetella pertussis
ggcaggacgccggcgc

SEQ ID NO: 402725 - RNA, 14 nt, Bordetella pertussis
ggcaggccagcaug

SEQ ID NO: 402726 - RNA, 12 nt, Bordetella pertussis
ggcaggccagcg

SEQ ID NO: 402727 - RNA, 14 nt, Bordetella pertussis
ggcaggccagcgcc

SEQ ID NO: 402728 - RNA, 16 nt, Bordetella pertussis
ggcaggcccagccagc

SEQ ID NO: 402729 - RNA, 15 nt, Bordetella pertussis
ggcaggcccagcuug

SEQ ID NO: 402730 - RNA, 14 nt, Bordetella pertussis
ggcaggccgcagcg

SEQ ID NO: 402731 - RNA, 17 nt, Bordetella pertussis
ggcaggccgcagcgggc

SEQ ID NO: 402732 - RNA, 15 nt, Bordetella pertussis
ggcaggccgcgccac

SEQ ID NO: 402733 - RNA, 14 nt, Bordetella pertussis
ggcaggccggcgcg

SEQ ID NO: 402734 - RNA, 17 nt, Bordetella pertussis
ggcaggccggcgcgcgc

SEQ ID NO: 402735 - RNA, 12 nt, Bordetella pertussis
ggcaggccggcg

SEQ ID NO: 402736 - RNA, 18 nt, Bordetella pertussis
ggcaggccuggucgagcg

SEQ ID NO: 402737 - RNA, 15 nt, Bordetella pertussis
ggcaggcgcagcggc

SEQ ID NO: 402738 - RNA, 15 nt, Bordetella pertussis
ggcaggcgccgccgc

SEQ ID NO: 402739 - RNA, 17 nt, Bordetella pertussis
ggcaggcggcagaaggc

SEQ ID NO: 402740 - RNA, 15 nt, Bordetella pertussis
ggcaggcgcgccggg

SEQ ID NO: 402741 - RNA, 20 nt, Bordetella pertussis
ggcaggcgggccaggccggu

SEQ ID NO: 402742 - RNA, 14 nt, Bordetella pertussis
ggcaggcgucggcc

SEQ ID NO: 402743 - RNA, 15 nt, Bordetella pertussis
ggcaggcuccacagc

SEQ ID NO: 402744 - RNA, 18 nt, Bordetella pertussis
ggcaguacgagcggcggc

SEQ ID NO: 402745 - RNA, 22 nt, Bordetella pertussis
ggcaguacguacgcccggccgc

SEQ ID NO: 402746 - RNA, 23 nt, Bordetella pertussis
ggcaguacguacgcccggccgcc

SEQ ID NO: 402747 - RNA, 14 nt, Bordetella pertussis
ggcagucagccguu

SEQ ID NO: 402748 - RNA, 16 nt, Bordetella pertussis
ggcaguccuggcuggg

SEQ ID NO: 402749 - RNA, 22 nt, Bordetella pertussis
ggcauagcccaggccgccggcg

SEQ ID NO: 402750 - RNA, 15 nt, Bordetella pertussis
ggcauagcguuuugu

SEQ ID NO: 402751 - RNA, 20 nt, Bordetella pertussis
ggcauagcguuuuguacucu

SEQ ID NO: 402752 - RNA, 14 nt, Bordetella pertussis
ggcaucgcccacca

SEQ ID NO: 402753 - RNA, 12 nt, Bordetella pertussis
ggcaucgcccug

SEQ ID NO: 402754 - RNA, 16 nt, Bordetella pertussis
ggcaucgcccugcucg

SEQ ID NO: 402755 - RNA, 18 nt, Bordetella pertussis
ggcaucggccacgcugcc

SEQ ID NO: 402756 - RNA, 13 nt, Bordetella pertussis
ggcaucggccagc

SEQ ID NO: 402757 - RNA, 14 nt, Bordetella pertussis
ggcaucggccagca

SEQ ID NO: 402758 - RNA, 13 nt, Bordetella pertussis
ggcaucggcggcu

SEQ ID NO: 402759 - RNA, 19 nt, Bordetella pertussis
ggcaucgggcagggcuucc

SEQ ID NO: 402760 - RNA, 19 nt, Bordetella pertussis
ggcaucgggguuccacagc

SEQ ID NO: 402761 - RNA, 21 nt, Bordetella pertussis
ggcaucguaguugggcgccuu

SEQ ID NO: 402762 - RNA, 22 nt, Bordetella pertussis
ggcaugccggcauaggcggcgc

SEQ ID NO: 402763 - RNA, 16 nt, Bordetella pertussis
ggcaugcgcaugcugg

SEQ ID NO: 402764 - RNA, 22 nt, Bordetella pertussis
ggcaugcugcguaggcaggggc

SEQ ID NO: 402765 - RNA, 14 nt, Bordetella pertussis
ggcauggccagcuu

SEQ ID NO: 402766 - RNA, 15 nt, Bordetella pertussis
ggcauggcggccagc

SEQ ID NO: 402767 - RNA, 16 nt, Bordetella pertussis
ggcauggcggccagcu

SEQ ID NO: 402768 - RNA, 15 nt, Bordetella pertussis
ggcauggccggcagg

SEQ ID NO: 402769 - RNA, 18 nt, Bordetella pertussis
ggcaugggcccgggcgcg

SEQ ID NO: 402770 - RNA, 19 nt, Bordetella pertussis
ggcaugggcccgggcgcgc

SEQ ID NO: 402771 - RNA, 22 nt, Bordetella pertussis
ggcauggggcaggcgcagcggc

SEQ ID NO: 402772 - RNA, 20 nt, Bordetella pertussis
ggcauggguaaagcgccggc

SEQ ID NO: 402773 - RNA, 20 nt, Bordetella pertussis
ggcauggucggcauggccau

SEQ ID NO: 402774 - RNA, 20 nt, Bordetella pertussis
ggcaugucgcggcccacggc

SEQ ID NO: 402775 - RNA, 23 nt, Bordetella pertussis
ggccaccacgcccaucugccagg

SEQ ID NO: 402776 - RNA, 14 nt, Bordetella pertussis
ggccaccagcgugu

SEQ ID NO: 402777 - RNA, 13 nt, Bordetella pertussis
ggccaccaggcug

SEQ ID NO: 402778 - RNA, 23 nt, Bordetella pertussis
ggccaccccguugcagcccagcg

SEQ ID NO: 402779 - RNA, 17 nt, Bordetella pertussis
ggccacccgccgccggc

SEQ ID NO: 402780 - RNA, 21 nt, Bordetella pertussis
ggccaccgaagcggcguucug

SEQ ID NO: 402781 - RNA, 18 nt, Bordetella pertussis
ggccaccgacggcgcggc

SEQ ID NO: 402782 - RNA, 20 nt, Bordetella pertussis
ggccaccgccugugccagcu

SEQ ID NO: 402783 - RNA, 21 nt, Bordetella pertussis
ggccaccgccugugccagcug

SEQ ID NO: 402784 - RNA, 22 nt, Bordetella pertussis
ggccaccgccugugccagcugg

SEQ ID NO: 402785 - RNA, 15 nt, Bordetella pertussis
ggccaccgcggcgga

SEQ ID NO: 402786 - RNA, 16 nt, Bordetella pertussis
ggccaccgcggcggac

SEQ ID NO: 402787 - RNA, 21 nt, Bordetella pertussis
ggccaccgcguugagcgccga

SEQ ID NO: 402788 - RNA, 13 nt, Bordetella pertussis
ggccacgcccaag

SEQ ID NO: 402789 - RNA, 14 nt, Bordetella pertussis
ggccacgcccaggc

SEQ ID NO: 402790 - RNA, 14 nt, Bordetella pertussis
ggccacgcgcgggc

SEQ ID NO: 402791 - RNA, 16 nt, Bordetella pertussis
ggccacgcgcgggcug

SEQ ID NO: 402792 - RNA, 16 nt, Bordetella pertussis
ggccacgcgcugcagc

SEQ ID NO: 402793 - RNA, 21 nt, Bordetella pertussis
ggccacgcucacgcccguguc

SEQ ID NO: 402794 - RNA, 18 nt, Bordetella pertussis
ggccacgcugcccugcug

SEQ ID NO: 402795 - RNA, 19 nt, Bordetella pertussis
ggccacgcugcccugcugc

SEQ ID NO: 402796 - RNA, 16 nt, Bordetella pertussis
ggccacgcugcugccg

SEQ ID NO: 402797 - RNA, 15 nt, Bordetella pertussis
ggccacggccugccc

SEQ ID NO: 402798 - RNA, 17 nt, Bordetella pertussis
ggccacggccugcccgg

SEQ ID NO: 402799 - RNA, 22 nt, Bordetella pertussis
ggccacggccugcccgggcggg

SEQ ID NO: 402800 - RNA, 17 nt, Bordetella pertussis
ggccagauagucgcgga

SEQ ID NO: 402801 - RNA, 18 nt, Bordetella pertussis
ggccagcaagcgcucggc

SEQ ID NO: 402802 - RNA, 21 nt, Bordetella pertussis
ggccagcacauacgccgccga

SEQ ID NO: 402803 - RNA, 17 nt, Bordetella pertussis
ggccagcaccggccgcc

SEQ ID NO: 402804 - RNA, 20 nt, Bordetella pertussis
ggccagcagcuggcgcagca

SEQ ID NO: 402805 - RNA, 14 nt, Bordetella pertussis
ggccagcaugcugg

SEQ ID NO: 402806 - RNA, 16 nt, Bordetella pertussis
ggccagccacgccggc

SEQ ID NO: 402807 - RNA, 21 nt, Bordetella pertussis
ggccagccacgccggcgcgcc

SEQ ID NO: 402808 - RNA, 14 nt, Bordetella pertussis
ggccagccaggcgg

SEQ ID NO: 402809 - RNA, 19 nt, Bordetella pertussis
ggccagccaggcgguggcc

SEQ ID NO: 402810 - RNA, 12 nt, Bordetella pertussis
ggccagccagcg

SEQ ID NO: 402811 - RNA, 19 nt, Bordetella pertussis
ggccagccccggcgcgccg

SEQ ID NO: 402812 - RNA, 22 nt, Bordetella pertussis
ggccagcgcgaaguaccagcgc

SEQ ID NO: 402813 - RNA, 15 nt, Bordetella pertussis
ggccagcgcgacggc

SEQ ID NO: 402814 - RNA, 16 nt, Bordetella pertussis
ggccagcgcgacggcc

SEQ ID NO: 402815 - RNA, 16 nt, Bordetella pertussis
ggccagcgcgccggcc

SEQ ID NO: 402816 - RNA, 21 nt, Bordetella pertussis
ggccagcgcgccggccagggc

SEQ ID NO: 402817 - RNA, 14 nt, Bordetella pertussis
ggccagcgcgccuu

SEQ ID NO: 402818 - RNA, 14 nt, Bordetella pertussis
ggccagcgcgcggc

SEQ ID NO: 402819 - RNA, 15 nt, Bordetella pertussis
ggccagcgcgcggcc

SEQ ID NO: 402820 - RNA, 20 nt, Bordetella pertussis
ggccagcgcgcggggcaggc

SEQ ID NO: 402821 - RNA, 15 nt, Bordetella pertussis
ggccagcgcgcgugc

SEQ ID NO: 402822 - RNA, 13 nt, Bordetella pertussis
ggccagcgcggcc

SEQ ID NO: 402823 - RNA, 22 nt, Bordetella pertussis
ggccagcgcggcggcagcgcgu

SEQ ID NO: 402824 - RNA, 21 nt, Bordetella pertussis
ggccagcggaugaugcggcgc

SEQ ID NO: 402825 - RNA, 22 nt, Bordetella pertussis
ggccagcggaugaugcggcgcc

SEQ ID NO: 402826 - RNA, 13 nt, Bordetella pertussis
ggccagcggcagg

SEQ ID NO: 402827 - RNA, 12 nt, Bordetella pertussis
ggccagcuggcg

SEQ ID NO: 402828 - RNA, 17 nt, Bordetella pertussis
ggccagcuggcgcgugg

SEQ ID NO: 402829 - RNA, 20 nt, Bordetella pertussis
ggccagcuggcggcgcagca

SEQ ID NO: 402830 - RNA, 18 nt, Bordetella pertussis
ggccagcuugacguccag

SEQ ID NO: 402831 - RNA, 23 nt, Bordetella pertussis
ggccagcuugacguccagccagg

SEQ ID NO: 402832 - RNA, 16 nt, Bordetella pertussis
ggccagcuugagcagg

SEQ ID NO: 402833 - RNA, 20 nt, Bordetella pertussis
ggccagcuugagcaggcgcg

SEQ ID NO: 402834 - RNA, 18 nt, Bordetella pertussis
ggccaggacgaucccggc

SEQ ID NO: 402835 - RNA, 15 nt, Bordetella pertussis
ggccaggcccacggc

SEQ ID NO: 402836 - RNA, 23 nt, Bordetella pertussis
ggccaggcccacggcgccaaagc

SEQ ID NO: 402837 - RNA, 17 nt, Bordetella pertussis
ggccagggccucgcggg

SEQ ID NO: 402838 - RNA, 17 nt, Bordetella pertussis
ggccagggccugcgggc

SEQ ID NO: 402839 - RNA, 14 nt, Bordetella pertussis
ggccagggcggcga

SEQ ID NO: 402840 - RNA, 16 nt, Bordetella pertussis
ggccaggggcgcuggu

SEQ ID NO: 402841 - RNA, 22 nt, Bordetella pertussis
ggccagggucgguugcaguccu

SEQ ID NO: 402842 - RNA, 19 nt, Bordetella pertussis
ggccagguacaggccgccg

SEQ ID NO: 402843 - RNA, 19 nt, Bordetella pertussis
ggccagggucaggggcagg

SEQ ID NO: 402844 - RNA, 21 nt, Bordetella pertussis
ggccagguagucgucgaaggc

SEQ ID NO: 402845 - RNA, 19 nt, Bordetella pertussis
ggccagguauugcggggcg

SEQ ID NO: 402846 - RNA, 19 nt, Bordetella pertussis
ggccagguauugcucggcg

SEQ ID NO: 402847 - RNA, 22 nt, Bordetella pertussis
ggccagguauugcucggcgguc

SEQ ID NO: 402848 - RNA, 20 nt, Bordetella pertussis
ggccaggucgcgcaucaccu

SEQ ID NO: 402849 - RNA, 16 nt, Bordetella pertussis
ggccaggucggcggcc

SEQ ID NO: 402850 - RNA, 20 nt, Bordetella pertussis
ggccaggucggcggccagcg

SEQ ID NO: 402851 - RNA, 21 nt, Bordetella pertussis
ggccaggucggcggccagcgc

SEQ ID NO: 402852 - RNA, 23 nt, Bordetella pertussis
ggccaggucggcggccagcgcgc

SEQ ID NO: 402853 - RNA, 18 nt, Bordetella pertussis
ggccaggucggcgucguc

SEQ ID NO: 402854 - RNA, 20 nt, Bordetella pertussis
ggccaguuccgugcgcgccc

SEQ ID NO: 402855 - RNA, 15 nt, Bordetella pertussis
ggccaguucgcggcg

SEQ ID NO: 402856 - RNA, 15 nt, Bordetella pertussis
ggccaucaccgccuc

SEQ ID NO: 402857 - RNA, 22 nt, Bordetella pertussis
ggccaucacgccgaucuucugg

SEQ ID NO: 402858 - RNA, 17 nt, Bordetella pertussis
ggccaucaggugcaggg

SEQ ID NO: 402859 - RNA, 18 nt, Bordetella pertussis
ggccaucaggugcagggu

SEQ ID NO: 402860 - RNA, 22 nt, Bordetella pertussis
ggccaucagguuguccagcgcg

SEQ ID NO: 402861 - RNA, 18 nt, Bordetella pertussis
ggccaugcccaggcccag

SEQ ID NO: 402862 - RNA, 22 nt, Bordetella pertussis
ggccaugcccaggcccaguucg

SEQ ID NO: 402863 - RNA, 22 nt, Bordetella pertussis
ggccaugccguccugcugcggc

SEQ ID NO: 402864 - RNA, 16 nt, Bordetella pertussis
ggccaugcucagcagc

SEQ ID NO: 402865 - RNA, 17 nt, Bordetella pertussis
ggccaugcucagcagca

SEQ ID NO: 402866 - RNA, 21 nt, Bordetella pertussis
ggccauggacgaguugcucgg

SEQ ID NO: 402867 - RNA, 18 nt, Bordetella pertussis
ggccauggcagggcgccg

SEQ ID NO: 402868 - RNA, 16 nt, Bordetella pertussis
ggccauggcggccggc

SEQ ID NO: 402869 - RNA, 20 nt, Bordetella pertussis
ggccaugucagucguccucc

SEQ ID NO: 402870 - RNA, 15 nt, Bordetella pertussis
ggccauguccuggca

SEQ ID NO: 402871 - RNA, 15 nt, Bordetella pertussis
ggccauguucuucag

SEQ ID NO: 402872 - RNA, 17 nt, Bordetella pertussis
ggccauucagaccgggu

SEQ ID NO: 402873 - RNA, 20 nt, Bordetella pertussis
ggccauugaaagcgcgagcu

SEQ ID NO: 402874 - RNA, 17 nt, Bordetella pertussis
ggcccacggcaucgccg

SEQ ID NO: 402875 - RNA, 17 nt, Bordetella pertussis
ggcccacggccagcacu

SEQ ID NO: 402876 - RNA, 22 nt, Bordetella pertussis
ggcccacguaggcaaagcgcgg

SEQ ID NO: 402877 - RNA, 23 nt, Bordetella pertussis
ggcccagcaccgccgccaguucg

SEQ ID NO: 402878 - RNA, 14 nt, Bordetella pertussis
ggcccagcacgccg

SEQ ID NO: 402879 - RNA, 18 nt, Bordetella pertussis
ggcccagcacgccgcgcu

SEQ ID NO: 402880 - RNA, 18 nt, Bordetella pertussis
ggcccagccagcccuggc

SEQ ID NO: 402881 - RNA, 21 nt, Bordetella pertussis
ggcccagccagcggugcgcgg

SEQ ID NO: 402882 - RNA, 20 nt, Bordetella pertussis
ggcccagcgcauagacccac

SEQ ID NO: 402883 - RNA, 17 nt, Bordetella pertussis
ggcccagcgccagcagc

SEQ ID NO: 402884 - RNA, 17 nt, Bordetella pertussis
ggcccagcgcggcggcc

SEQ ID NO: 402885 - RNA, 14 nt, Bordetella pertussis
ggcccagcuccagc

SEQ ID NO: 402886 - RNA, 15 nt, Bordetella pertussis
ggcccagcuccagcu

SEQ ID NO: 402887 - RNA, 16 nt, Bordetella pertussis
ggcccagcuccagcug

SEQ ID NO: 402888 - RNA, 20 nt, Bordetella pertussis
ggcccagcucugguccaggc

SEQ ID NO: 402889 - RNA, 17 nt, Bordetella pertussis
ggcccagcugggcggcg

SEQ ID NO: 402890 - RNA, 20 nt, Bordetella pertussis
ggcccagcugggcggcguga

SEQ ID NO: 402891 - RNA, 21 nt, Bordetella pertussis
ggcccaggauggcgccagccc

SEQ ID NO: 402892 - RNA, 22 nt, Bordetella pertussis
ggcccaggcaaugcgcaggccc

SEQ ID NO: 402893 - RNA, 14 nt, Bordetella pertussis
ggcccaggccgggc

SEQ ID NO: 402894 - RNA, 15 nt, Bordetella pertussis
ggcccagggcagcgg

SEQ ID NO: 402895 - RNA, 16 nt, Bordetella pertussis
ggcccagggcagcggc

SEQ ID NO: 402896 - RNA, 17 nt, Bordetella pertussis
ggcccagggcagcggcc

SEQ ID NO: 402897 - RNA, 17 nt, Bordetella pertussis
ggcccaguacggccugc

SEQ ID NO: 402898 - RNA, 13 nt, Bordetella pertussis
ggcccaguccagg

SEQ ID NO: 402899 - RNA, 17 nt, Bordetella pertussis
ggcccaguccagggugu

SEQ ID NO: 402900 - RNA, 22 nt, Bordetella pertussis
ggcccaggcguccaggcugccg

SEQ ID NO: 402901 - RNA, 21 nt, Bordetella pertussis
ggcccaggucaucgccaggcg

SEQ ID NO: 402902 - RNA, 22 nt, Bordetella pertussis
ggcccaggucaucgccaggcgc

SEQ ID NO: 402903 - RNA, 19 nt, Bordetella pertussis
ggcccaguucgcgcagcag

SEQ ID NO: 402904 - RNA, 20 nt, Bordetella pertussis
ggcccaguugaaucggcgcg

SEQ ID NO: 402905 - RNA, 16 nt, Bordetella pertussis
ggcccauaugccgccg

SEQ ID NO: 402906 - RNA, 18 nt, Bordetella pertussis
ggcccauaugccgccggc

SEQ ID NO: 402907 - RNA, 19 nt, Bordetella pertussis
ggcccauaugccgccggcc

SEQ ID NO: 402908 - RNA, 12 nt, Bordetella pertussis
ggcccaugaagg

SEQ ID NO: 402909 - RNA, 17 nt, Bordetella pertussis
ggcccaugaaggcggcc

SEQ ID NO: 402910 - RNA, 20 nt, Bordetella pertussis
ggcccaugaaggcggccagc

SEQ ID NO: 402911 - RNA, 17 nt, Bordetella pertussis
ggcccaugccgcggacc

SEQ ID NO: 402912 - RNA, 21 nt, Bordetella pertussis
ggcccaugccgcggacccagg

SEQ ID NO: 402913 - RNA, 15 nt, Bordetella pertussis
ggcccauugcggcac

SEQ ID NO: 402914 - RNA, 12 nt, Bordetella pertussis
ggccccagcauc

SEQ ID NO: 402915 - RNA, 15 nt, Bordetella pertussis
ggccccaggccgggu

SEQ ID NO: 402916 - RNA, 12 nt, Bordetella pertussis
ggccccagcgcc

SEQ ID NO: 402917 - RNA, 12 nt, Bordetella pertussis
ggcccccagccc

SEQ ID NO: 402918 - RNA, 22 nt, Bordetella pertussis
ggccccgcaaggggccggcgcc

SEQ ID NO: 402919 - RNA, 19 nt, Bordetella pertussis
ggccccgccgggccgcgcc

SEQ ID NO: 402920 - RNA, 19 nt, Bordetella pertussis
ggccccgcgaggggcccuu

SEQ ID NO: 402921 - RNA, 15 nt, Bordetella pertussis
ggccccgcgucggcg

SEQ ID NO: 402922 - RNA, 15 nt, Bordetella pertussis
ggccccggccgcccc

SEQ ID NO: 402923 - RNA, 22 nt, Bordetella pertussis
ggccccggccgguuccugcaag

SEQ ID NO: 402924 - RNA, 14 nt, Bordetella pertussis
ggccccggcucccg

SEQ ID NO: 402925 - RNA, 18 nt, Bordetella pertussis
ggcccgcaccgggcggcc

SEQ ID NO: 402926 - RNA, 18 nt, Bordetella pertussis
ggcccgcaucgcgcgccg

SEQ ID NO: 402927 - RNA, 16 nt, Bordetella pertussis
ggcccgccacggcgcc

SEQ ID NO: 402928 - RNA, 21 nt, Bordetella pertussis
ggcccgccacggcgcccgagg

SEQ ID NO: 402929 - RNA, 18 nt, Bordetella pertussis
ggcccgccagcaaggcgg

SEQ ID NO: 402930 - RNA, 15 nt, Bordetella pertussis
ggcccgccagggcca

SEQ ID NO: 402931 - RNA, 13 nt, Bordetella pertussis
ggcccgcggcgcc

SEQ ID NO: 402932 - RNA, 23 nt, Bordetella pertussis
ggcccgcgggcgcccggccggcc

SEQ ID NO: 402933 - RNA, 19 nt, Bordetella pertussis
ggcccgcgugacggccgcc

SEQ ID NO: 402934 - RNA, 14 nt, Bordetella pertussis
ggcccgcucggcca

SEQ ID NO: 402935 - RNA, 21 nt, Bordetella pertussis
ggcccggauauggccggcgcg

SEQ ID NO: 402936 - RNA, 13 nt, Bordetella pertussis
ggcccggccgccg

SEQ ID NO: 402937 - RNA, 17 nt, Bordetella pertussis
ggcccggccgccgccgg

SEQ ID NO: 402938 - RNA, 14 nt, Bordetella pertussis
ggcccggccugcgu

SEQ ID NO: 402939 - RNA, 14 nt, Bordetella pertussis
ggcccuccggcgcc

SEQ ID NO: 402940 - RNA, 17 nt, Bordetella pertussis
ggcccuccggcgccagc

SEQ ID NO: 402941 - RNA, 13 nt, Bordetella pertussis
ggcccucgcggcc

SEQ ID NO: 402942 - RNA, 18 nt, Bordetella pertussis
ggcccugcagcggccagu

SEQ ID NO: 402943 - RNA, 16 nt, Bordetella pertussis
ggcccugcaggaacuc

SEQ ID NO: 402944 - RNA, 16 nt, Bordetella pertussis
ggcccugccgcccugg

SEQ ID NO: 402945 - RNA, 20 nt, Bordetella pertussis
ggccgaaccgcgcagccgcu

SEQ ID NO: 402946 - RNA, 21 nt, Bordetella pertussis
ggccgaacgccgccgcagccg

SEQ ID NO: 402947 - RNA, 17 nt, Bordetella pertussis
ggccgaauugccgccgc

SEQ ID NO: 402948 - RNA, 14 nt, Bordetella pertussis
ggccgacagguggu

SEQ ID NO: 402949 - RNA, 23 nt, Bordetella pertussis
ggccgacaggugguagaccgggu

SEQ ID NO: 402950 - RNA, 13 nt, Bordetella pertussis
ggccgaccagcac

SEQ ID NO: 402951 - RNA, 22 nt, Bordetella pertussis
ggccgagcgcgagcagggcauc

SEQ ID NO: 402952 - RNA, 12 nt, Bordetella pertussis
ggccgagcgcgg

SEQ ID NO: 402953 - RNA, 17 nt, Bordetella pertussis
ggccgagcgggccagcg

SEQ ID NO: 402954 - RNA, 19 nt, Bordetella pertussis
ggccgagcgggccagcgcg

SEQ ID NO: 402955 - RNA, 20 nt, Bordetella pertussis
ggccgagcgggccagcgcgg

SEQ ID NO: 402956 - RNA, 15 nt, Bordetella pertussis
ggccgagcuccucga

SEQ ID NO: 402957 - RNA, 16 nt, Bordetella pertussis
ggccgaggaccugcug

SEQ ID NO: 402958 - RNA, 13 nt, Bordetella pertussis
ggccgaggcugcg

SEQ ID NO: 402959 - RNA, 17 nt, Bordetella pertussis
ggccgaggucggcgguc

SEQ ID NO: 402960 - RNA, 22 nt, Bordetella pertussis
ggccgaggucggcgguccacag

SEQ ID NO: 402961 - RNA, 18 nt, Bordetella pertussis
ggccgaggugcccaucag

SEQ ID NO: 402962 - RNA, 20 nt, Bordetella pertussis
ggccgagguggacaagaaag

SEQ ID NO: 402963 - RNA, 17 nt, Bordetella pertussis
ggccgaggccagguugg

SEQ ID NO: 402964 - RNA, 19 nt, Bordetella pertussis
ggccgauagccgcggcgcc

SEQ ID NO: 402965 - RNA, 21 nt, Bordetella pertussis
ggccgauacgcgugcgcggcc

SEQ ID NO: 402966 - RNA, 19 nt, Bordetella pertussis
ggccgaucaccugcaggcc

SEQ ID NO: 402967 - RNA, 19 nt, Bordetella pertussis
ggccgaucagcaccacggc

SEQ ID NO: 402968 - RNA, 22 nt, Bordetella pertussis
ggccgaucagcaccacggcggc

SEQ ID NO: 402969 - RNA, 17 nt, Bordetella pertussis
ggccgaucagcgacagc

SEQ ID NO: 402970 - RNA, 13 nt, Bordetella pertussis
ggccgaugaagac

SEQ ID NO: 402971 - RNA, 18 nt, Bordetella pertussis
ggccgaugcuggucgcca

SEQ ID NO: 402972 - RNA, 23 nt, Bordetella pertussis
ggccgauggcguccagcagcagg

SEQ ID NO: 402973 - RNA, 19 nt, Bordetella pertussis
ggccgauguagcccauggc

SEQ ID NO: 402974 - RNA, 18 nt, Bordetella pertussis
ggccgaugucgccgccug

SEQ ID NO: 402975 - RNA, 19 nt, Bordetella pertussis
ggccgaugucgccgccugc

SEQ ID NO: 402976 - RNA, 16 nt, Bordetella pertussis
ggccgauuccagcgcc

SEQ ID NO: 402977 - RNA, 18 nt, Bordetella pertussis
ggccgauuucgcgcgcca

SEQ ID NO: 402978 - RNA, 19 nt, Bordetella pertussis
ggccgauuucggccgccgg

SEQ ID NO: 402979 - RNA, 20 nt, Bordetella pertussis
ggccgauuucggccgccggc

SEQ ID NO: 402980 - RNA, 21 nt, Bordetella pertussis
ggccgauuucggccgccggcg

SEQ ID NO: 402981 - RNA, 18 nt, Bordetella pertussis
ggccgauggucagcgugu

SEQ ID NO: 402982 - RNA, 19 nt, Bordetella pertussis
ggccgcaagcaagccccag

SEQ ID NO: 402983 - RNA, 15 nt, Bordetella pertussis
ggccgcacagcucgu

SEQ ID NO: 402984 - RNA, 19 nt, Bordetella pertussis
ggccgcacgcgcggcagcg

SEQ ID NO: 402985 - RNA, 21 nt, Bordetella pertussis
ggccgcagcaauugccccagc

SEQ ID NO: 402986 - RNA, 19 nt, Bordetella pertussis
ggccgccagggcggcugcc

SEQ ID NO: 402987 - RNA, 12 nt, Bordetella pertussis
ggccgcccagca

SEQ ID NO: 402988 - RNA, 13 nt, Bordetella pertussis
ggccgcccagcac

SEQ ID NO: 402989 - RNA, 14 nt, Bordetella pertussis
ggccgcccagcacc

SEQ ID NO: 402990 - RNA, 15 nt, Bordetella pertussis
ggccgcccagcaccu

SEQ ID NO: 402991 - RNA, 14 nt, Bordetella pertussis
ggccgcccagcaga

SEQ ID NO: 402992 - RNA, 22 nt, Bordetella pertussis
ggccgcccagccgcgccagggc

SEQ ID NO: 402993 - RNA, 13 nt, Bordetella pertussis
ggccgcccagcgc

SEQ ID NO: 402994 - RNA, 15 nt, Bordetella pertussis
ggccgcccagcgcau

SEQ ID NO: 402995 - RNA, 12 nt, Bordetella pertussis
ggccgcccaggc

SEQ ID NO: 402996 - RNA, 15 nt, Bordetella pertussis
ggccgcccagucguc

SEQ ID NO: 402997 - RNA, 17 nt, Bordetella pertussis
ggccgcccccgacgcca

SEQ ID NO: 402998 - RNA, 17 nt, Bordetella pertussis
ggcuguccaccugcacc

SEQ ID NO: 402999 - RNA, 16 nt, Bordetella pertussis
ggcuguccccgcgcgg

SEQ ID NO: 403000 - RNA, 16 nt, Bordetella pertussis
ggcuucugggucagcu

SEQ ID NO: 403001 - RNA, 16 nt, Bordetella pertussis
ggcuugcacgccggcc

SEQ ID NO: 403002 - RNA, 17 nt, Bordetella pertussis
ggcuugcagcggacggc

SEQ ID NO: 403003 - RNA, 16 nt, Bordetella pertussis
ggcuugauggccagcg

SEQ ID NO: 403004 - RNA, 20 nt, Bordetella pertussis
ggcuugccgcggcgcggccu

SEQ ID NO: 403005 - RNA, 21 nt, Bordetella pertussis
ggcuugccgcggcgcggccuu

SEQ ID NO: 403006 - RNA, 16 nt, Bordetella pertussis
ggcuugcggcgcuggc

SEQ ID NO: 403007 - RNA, 19 nt, Bordetella pertussis
ggcuugcggcgcuggcugg

SEQ ID NO: 403008 - RNA, 12 nt, Bordetella pertussis
ggcuugcugccc

SEQ ID NO: 403009 - RNA, 20 nt, Bordetella pertussis
ggcuuucgccgcgggccugc

SEQ ID NO: 403010 - RNA, 14 nt, Bordetella pertussis
ggcuuugcuggcca

SEQ ID NO: 403011 - RNA, 18 nt, Bordetella pertussis
ggcuuuggcuuggcgaau

SEQ ID NO: 403012 - RNA, 20 nt, Bordetella pertussis
gggaagauguggucggcgcc

SEQ ID NO: 403013 - RNA, 12 nt, Bordetella pertussis
gggaaggggcgg

SEQ ID NO: 403014 - RNA, 22 nt, Bordetella pertussis
gggaaggggcggcuucaggcgc

SEQ ID NO: 403015 - RNA, 21 nt, Bordetella pertussis
gggaaucggcaccucggcgcc

SEQ ID NO: 403016 - RNA, 14 nt, Bordetella pertussis
gggacaggcaccca

SEQ ID NO: 403017 - RNA, 15 nt, Bordetella pertussis
gggacaggcaccccc

SEQ ID NO: 403018 - RNA, 14 nt, Bordetella pertussis
gggacaggcacccu

SEQ ID NO: 403019 - RNA, 16 nt, Bordetella pertussis
gggacaggcacgcgcc

SEQ ID NO: 403020 - RNA, 20 nt, Bordetella pertussis
gggacaggcacgcgccgacu

SEQ ID NO: 403021 - RNA, 13 nt, Bordetella pertussis
gggacaggcccag

SEQ ID NO: 403022 - RNA, 15 nt, Bordetella pertussis
gggacaggcccagcc

SEQ ID NO: 403023 - RNA, 12 nt, Bordetella pertussis
gggacaggcgcc

SEQ ID NO: 403024 - RNA, 22 nt, Bordetella pertussis
gggaccgaacaccaccgagggc

SEQ ID NO: 403025 - RNA, 14 nt, Bordetella pertussis
gggacgaagccggg

SEQ ID NO: 403026 - RNA, 16 nt, Bordetella pertussis
gggacgagcuccugga

SEQ ID NO: 403027 - RNA, 18 nt, Bordetella pertussis
gggacgccggcgggcagg

SEQ ID NO: 403028 - RNA, 12 nt, Bordetella pertussis
gggacggccagg

SEQ ID NO: 403029 - RNA, 22 nt, Bordetella pertussis
gggacggccaggggcagcucgg

SEQ ID NO: 403030 - RNA, 15 nt, Bordetella pertussis
gggacggcgcgggca

SEQ ID NO: 403031 - RNA, 14 nt, Bordetella pertussis
gggacgggccagcc

SEQ ID NO: 403032 - RNA, 14 nt, Bordetella pertussis
gggacuggcaccgg

SEQ ID NO: 403033 - RNA, 19 nt, Bordetella pertussis
gggacuggcuccgaagggc

SEQ ID NO: 403034 - RNA, 23 nt, Bordetella pertussis
gggagaccggguuuccagcccgu

SEQ ID NO: 403035 - RNA, 21 nt, Bordetella pertussis
gggagaucuguaccgccgggu

SEQ ID NO: 403036 - RNA, 22 nt, Bordetella pertussis
gggagcccgcacauacaaggcg

SEQ ID NO: 403037 - RNA, 14 nt, Bordetella pertussis
gggauccggcagca

SEQ ID NO: 403038 - RNA, 13 nt, Bordetella pertussis
gggaucggccagg

SEQ ID NO: 403039 - RNA, 17 nt, Bordetella pertussis
gggaucggccaggccgg

SEQ ID NO: 403040 - RNA, 23 nt, Bordetella pertussis
gggaucgggcagcuuggcgcgcc

SEQ ID NO: 403041 - RNA, 16 nt, Bordetella pertussis
gggauuuuugggcagg

SEQ ID NO: 403042 - RNA, 18 nt, Bordetella pertussis
gggcaaacggcggcaggc

SEQ ID NO: 403043 - RNA, 15 nt, Bordetella pertussis
gggcaaagcccagca

SEQ ID NO: 403044 - RNA, 14 nt, Bordetella pertussis
gggcacgcgcgcgg

SEQ ID NO: 403045 - RNA, 12 nt, Bordetella pertussis
gggcacggccag

SEQ ID NO: 403046 - RNA, 15 nt, Bordetella pertussis
gggcacucggccaug

SEQ ID NO: 403047 - RNA, 20 nt, Bordetella pertussis
gggcacucggccauggugcc

SEQ ID NO: 403048 - RNA, 23 nt, Bordetella pertussis
gggcagaacggaaacgcccagcc

SEQ ID NO: 403049 - RNA, 13 nt, Bordetella pertussis
gggcagcaccgcu

SEQ ID NO: 403050 - RNA, 19 nt, Bordetella pertussis
gggcagcaccggggcaggg

SEQ ID NO: 403051 - RNA, 15 nt, Bordetella pertussis
gggcagcagcagggc

SEQ ID NO: 403052 - RNA, 19 nt, Bordetella pertussis
gggcagcagcagggccagg

SEQ ID NO: 403053 - RNA, 20 nt, Bordetella pertussis
gggcagcagcagggccaggc

SEQ ID NO: 403054 - RNA, 20 nt, Bordetella pertussis
gggcagcaggucacgggcga

SEQ ID NO: 403055 - RNA, 17 nt, Bordetella pertussis
gggcagcgagauggggc

SEQ ID NO: 403056 - RNA, 13 nt, Bordetella pertussis
gggcagcgcggcg

SEQ ID NO: 403057 - RNA, 12 nt, Bordetella pertussis
gggcagcggcca

SEQ ID NO: 403058 - RNA, 19 nt, Bordetella pertussis
gggcagcggcgacggcgcc

SEQ ID NO: 403059 - RNA, 22 nt, Bordetella pertussis
gggcagcggcgacggcgccugg

SEQ ID NO: 403060 - RNA, 16 nt, Bordetella pertussis
gggcagcgggccgcag

SEQ ID NO: 403061 - RNA, 22 nt, Bordetella pertussis
gggccagcaucggcacccagcc

SEQ ID NO: 403062 - RNA, 18 nt, Bordetella pertussis
gggccagccagcgccgca

SEQ ID NO: 403063 - RNA, 14 nt, Bordetella pertussis
gggccagccccggc

SEQ ID NO: 403064 - RNA, 21 nt, Bordetella pertussis
gggccagccccggcgcgccgg

SEQ ID NO: 403065 - RNA, 18 nt, Bordetella pertussis
gggccagcgccagcacga

SEQ ID NO: 403066 - RNA, 12 nt, Bordetella pertussis
gggccagcgcgg

SEQ ID NO: 403067 - RNA, 21 nt, Bordetella pertussis
gggccagcuccccgggcguga

SEQ ID NO: 403068 - RNA, 18 nt, Bordetella pertussis
gggccaggccgccgccgg

SEQ ID NO: 403069 - RNA, 22 nt, Bordetella pertussis
gggccaggccggcccaguccag

SEQ ID NO: 403070 - RNA, 21 nt, Bordetella pertussis
gggccagguauucggcgguga

SEQ ID NO: 403071 - RNA, 15 nt, Bordetella pertussis
gggccaguccgcagc

SEQ ID NO: 403072 - RNA, 16 nt, Bordetella pertussis
gggccaguccgcagcg

SEQ ID NO: 403073 - RNA, 18 nt, Bordetella pertussis
gggccaguccgcagcgca

SEQ ID NO: 403074 - RNA, 21 nt, Bordetella pertussis
gggccaguagcgugugcagga

SEQ ID NO: 403075 - RNA, 19 nt, Bordetella pertussis
gggccauccguccgccagg

SEQ ID NO: 403076 - RNA, 20 nt, Bordetella pertussis
gggccaugcgggucaggccg

SEQ ID NO: 403077 - RNA, 20 nt, Bordetella pertussis
gggccaugcguaucggcagc

SEQ ID NO: 403078 - RNA, 21 nt, Bordetella pertussis
gggccaugcguaucggcagcg

SEQ ID NO: 403079 - RNA, 16 nt, Bordetella pertussis
gggccauggcacaggc

SEQ ID NO: 403080 - RNA, 14 nt, Bordetella pertussis
gggccauggcaggg

SEQ ID NO: 403081 - RNA, 19 nt, Bordetella pertussis
gggccauggcagggcgccg

SEQ ID NO: 403082 - RNA, 23 nt, Bordetella pertussis
gggccaugccguccugcugcggc

SEQ ID NO: 403083 - RNA, 23 nt, Bordetella pertussis
gggccgaccaggccggcggcggg

SEQ ID NO: 403084 - RNA, 22 nt, Bordetella pertussis
gggccgacggccucggccagga

SEQ ID NO: 403085 - RNA, 15 nt, Bordetella pertussis
gggccgagcgcgcca

SEQ ID NO: 403086 - RNA, 17 nt, Bordetella pertussis
gggccgagcgcgccagc

SEQ ID NO: 403087 - RNA, 13 nt, Bordetella pertussis
gggccgaggcuuc

SEQ ID NO: 403088 - RNA, 23 nt, Bordetella pertussis
gggccgaggcuucgauggcggcg

SEQ ID NO: 403089 - RNA, 21 nt, Bordetella pertussis
gggccgaguuggcagaguggc

SEQ ID NO: 403090 - RNA, 23 nt, Bordetella pertussis
gggccgaucccuugugcgcgcca

SEQ ID NO: 403091 - RNA, 15 nt, Bordetella pertussis
gggccgauggucagc

SEQ ID NO: 403092 - RNA, 21 nt, Bordetella pertussis
gggccgcacgcgcggcagcgc

SEQ ID NO: 403093 - RNA, 19 nt, Bordetella pertussis
gggccgcagcauggcgcca

SEQ ID NO: 403094 - RNA, 11 nt, Bordetella pertussis
gggccgcagcg

SEQ ID NO: 403095 - RNA, 16 nt, Bordetella pertussis
gggccgcagcgaacgg

SEQ ID NO: 403096 - RNA, 14 nt, Bordetella pertussis
gggccgcagcugga

SEQ ID NO: 403097 - RNA, 18 nt, Bordetella pertussis
gggccgccagcaccugcu

SEQ ID NO: 403098 - RNA, 13 nt, Bordetella pertussis
gggccgccagggc

SEQ ID NO: 403099 - RNA, 12 nt, Bordetella pertussis
gggccgcccagc

SEQ ID NO: 403100 - RNA, 13 nt, Bordetella pertussis
gggccgcccagca

SEQ ID NO: 403101 - RNA, 21 nt, Bordetella pertussis
gggccgccgcgcccagccgcg

SEQ ID NO: 403102 - RNA, 13 nt, Bordetella pertussis
gggccgccugcug

SEQ ID NO: 403103 - RNA, 12 nt, Bordetella pertussis
gggccgcgccgg

SEQ ID NO: 403104 - RNA, 14 nt, Bordetella pertussis
gggccgcgccggcu

SEQ ID NO: 403105 - RNA, 14 nt, Bordetella pertussis
gggccggcgcgcgc

SEQ ID NO: 403106 - RNA, 18 nt, Bordetella pertussis
gggccggcgcgcgcaggc

SEQ ID NO: 403107 - RNA, 19 nt, Bordetella pertussis
gggccggcgcgcgcaggcg

SEQ ID NO: 403108 - RNA, 23 nt, Bordetella pertussis
gggccgcgcgaugcgcggcccgg

SEQ ID NO: 403109 - RNA, 14 nt, Bordetella pertussis
gggccggcggcagc

SEQ ID NO: 403110 - RNA, 13 nt, Bordetella pertussis
gggccgggcaggc

SEQ ID NO: 403111 - RNA, 12 nt, Bordetella pertussis
gggccgggccgg

SEQ ID NO: 403112 - RNA, 17 nt, Bordetella pertussis
gggccgggccggcgggc

SEQ ID NO: 403113 - RNA, 13 nt, Bordetella pertussis
gggccggcugccg

SEQ ID NO: 403114 - RNA, 23 nt, Bordetella pertussis
gggccgucgugcgccuggcggcu

SEQ ID NO: 403115 - RNA, 14 nt, Bordetella pertussis
gggccgugcgccgg

SEQ ID NO: 403116 - RNA, 22 nt, Bordetella pertussis
gggccguuuuauuuggcaaggc

SEQ ID NO: 403117 - RNA, 18 nt, Bordetella pertussis
gggccuagcccggcgcca

SEQ ID NO: 403118 - RNA, 12 nt, Bordetella pertussis
gggccuccugca

SEQ ID NO: 403119 - RNA, 17 nt, Bordetella pertussis
gggccuccugcagcagg

SEQ ID NO: 403120 - RNA, 20 nt, Bordetella pertussis
gggccucgaagcccggcagg

SEQ ID NO: 403121 - RNA, 12 nt, Bordetella pertussis
gggccugcagca

SEQ ID NO: 403122 - RNA, 22 nt, Bordetella pertussis
gggccugcaguucggccgccag

SEQ ID NO: 403123 - RNA, 23 nt, Bordetella pertussis
gggccugcaguucggccgccagg

SEQ ID NO: 403124 - RNA, 21 nt, Bordetella pertussis
gggccugcccauggccugcaa

SEQ ID NO: 403125 - RNA, 15 nt, Bordetella pertussis
gggcgcugcccagga

SEQ ID NO: 403126 - RNA, 20 nt, Bordetella pertussis
gggcgcugccugccggccgg

SEQ ID NO: 403127 - RNA, 16 nt, Bordetella pertussis
gggcgcugcgccggcg

SEQ ID NO: 403128 - RNA, 22 nt, Bordetella pertussis
gggcgcuugccguagcgcgugg

SEQ ID NO: 403129 - RNA, 21 nt, Bordetella pertussis
gggcgcuuggcccugcagcgg

SEQ ID NO: 403130 - RNA, 19 nt, Bordetella pertussis
gggcggaugagcaggccgg

SEQ ID NO: 403131 - RNA, 23 nt, Bordetella pertussis
gggcggaugagcaggccgggucg

SEQ ID NO: 403132 - RNA, 14 nt, Bordetella pertussis
gggcggcaggugcg

SEQ ID NO: 403133 - RNA, 18 nt, Bordetella pertussis
gggcggcaucucgcggcg

SEQ ID NO: 403134 - RNA, 14 nt, Bordetella pertussis
gggcggccacggcg

SEQ ID NO: 403135 - RNA, 17 nt, Bordetella pertussis
gggcggccacggcggug

SEQ ID NO: 403136 - RNA, 13 nt, Bordetella pertussis
gggcggccaggcc

SEQ ID NO: 403137 - RNA, 20 nt, Bordetella pertussis
gggcggccccggccgccccc

SEQ ID NO: 403138 - RNA, 13 nt, Bordetella pertussis
gggcggcccggcg

SEQ ID NO: 403139 - RNA, 16 nt, Bordetella pertussis
gggcggcccggcggca

SEQ ID NO: 403140 - RNA, 17 nt, Bordetella pertussis
gggcggccgggagccug

SEQ ID NO: 403141 - RNA, 18 nt, Bordetella pertussis
gggcggccgggagccugu

SEQ ID NO: 403142 - RNA, 12 nt, Bordetella pertussis
gggcggccgggg

SEQ ID NO: 403143 - RNA, 12 nt, Bordetella pertussis
gggcggccggca

SEQ ID NO: 403144 - RNA, 14 nt, Bordetella pertussis
gggcggcgagccga

SEQ ID NO: 403145 - RNA, 16 nt, Bordetella pertussis
gggcggcgcgcccagc

SEQ ID NO: 403146 - RNA, 16 nt, Bordetella pertussis
gggcggcgcggccaac

SEQ ID NO: 403147 - RNA, 11 nt, Bordetella pertussis
gggcggcggca

SEQ ID NO: 403148 - RNA, 12 nt, Bordetella pertussis
gggcggcggcga

SEQ ID NO: 403149 - RNA, 18 nt, Bordetella pertussis
gggcggcguagagcgccg

SEQ ID NO: 403150 - RNA, 14 nt, Bordetella pertussis
gggcggcgucgccg

SEQ ID NO: 403151 - RNA, 15 nt, Bordetella pertussis
gggcggcuaggcgca

SEQ ID NO: 403152 - RNA, 20 nt, Bordetella pertussis
gggcggcuaggcgcagcagg

SEQ ID NO: 403153 - RNA, 17 nt, Bordetella pertussis
gggcggcucggcccuag

SEQ ID NO: 403154 - RNA, 14 nt, Bordetella pertussis
gggcggcugcccgg

SEQ ID NO: 403155 - RNA, 16 nt, Bordetella pertussis
gggcggcugcccgggc

SEQ ID NO: 403156 - RNA, 13 nt, Bordetella pertussis
gggcggcugcugg

SEQ ID NO: 403157 - RNA, 22 nt, Bordetella pertussis
gggcguuuuugcguccggcgcg

SEQ ID NO: 403158 - RNA, 14 nt, Bordetella pertussis
gggcucaggcugcg

SEQ ID NO: 403159 - RNA, 13 nt, Bordetella pertussis
gggcuccaggcug

SEQ ID NO: 403160 - RNA, 19 nt, Bordetella pertussis
gggcuccugugggggcgcg

SEQ ID NO: 403161 - RNA, 18 nt, Bordetella pertussis
gggcucgaccgccgccac

SEQ ID NO: 403162 - RNA, 20 nt, Bordetella pertussis
gggcucgaugaccagcagcg

SEQ ID NO: 403163 - RNA, 13 nt, Bordetella pertussis
gggcucgcugacc

SEQ ID NO: 403164 - RNA, 20 nt, Bordetella pertussis
gggcucgucgacgcggccgu

SEQ ID NO: 403165 - RNA, 23 nt, Bordetella pertussis
gggcucgugguggguuggccuug

SEQ ID NO: 403166 - RNA, 18 nt, Bordetella pertussis
gggcugaacauccugacc

SEQ ID NO: 403167 - RNA, 23 nt, Bordetella pertussis
gggcugauccgcaccggcgugcg

SEQ ID NO: 403168 - RNA, 24 nt, Bordetella pertussis
gggcugauccgcaccggcgugcgc

SEQ ID NO: 403169 - RNA, 16 nt, Bordetella pertussis
gggcuggucagccugg

SEQ ID NO: 403170 - RNA, 12 nt, Bordetella pertussis
gggcugguggug

SEQ ID NO: 403171 - RNA, 19 nt, Bordetella pertussis
gggcuguucgcgcagcagg

SEQ ID NO: 403172 - RNA, 19 nt, Bordetella pertussis
gggcuuccaguucgcgcag

SEQ ID NO: 403173 - RNA, 15 nt, Bordetella pertussis
gggcuugacgcgcgu

SEQ ID NO: 403174 - RNA, 19 nt, Bordetella pertussis
ggggaucaccagcccggcg

SEQ ID NO: 403175 - RNA, 21 nt, Bordetella pertussis
ggggauggcuuccugcggcac

SEQ ID NO: 403176 - RNA, 12 nt, Bordetella pertussis
ggggcacccagg

SEQ ID NO: 403177 - RNA, 13 nt, Bordetella pertussis
ggggcacccaggc

SEQ ID NO: 403178 - RNA, 22 nt, Bordetella pertussis
ggggcagcaggccggcggcgau

SEQ ID NO: 403179 - RNA, 21 nt, Bordetella pertussis
ggggcaggacgccggcgccgg

SEQ ID NO: 403180 - RNA, 22 nt, Bordetella pertussis
ggggcaggccgauguagcccau

SEQ ID NO: 403181 - RNA, 13 nt, Bordetella pertussis
ggggccaggcgca

SEQ ID NO: 403182 - RNA, 13 nt, Bordetella pertussis
ggggccgcagcug

SEQ ID NO: 403183 - RNA, 22 nt, Bordetella pertussis
ggggccgccaacgccaagcugc

SEQ ID NO: 403184 - RNA, 13 nt, Bordetella pertussis
ggggccgcccagc

SEQ ID NO: 403185 - RNA, 13 nt, Bordetella pertussis
ggggccgcccugc

SEQ ID NO: 403186 - RNA, 17 nt, Bordetella pertussis
ggggccgcccuggucau

SEQ ID NO: 403187 - RNA, 13 nt, Bordetella pertussis
ggggccgcgccgg

SEQ ID NO: 403188 - RNA, 14 nt, Bordetella pertussis
ggggccgcgcgcca

SEQ ID NO: 403189 - RNA, 20 nt, Bordetella pertussis
ggggccgcuucggccugcgc

SEQ ID NO: 403190 - RNA, 22 nt, Bordetella pertussis
ggggccggccgcgcgcgccagg

SEQ ID NO: 403191 - RNA, 16 nt, Bordetella pertussis
ggggccgggcgccagg

SEQ ID NO: 403192 - RNA, 18 nt, Bordetella pertussis
ggggccgggcgccaggcu

SEQ ID NO: 403193 - RNA, 17 nt, Bordetella pertussis
ggggccuuugcggcagg

SEQ ID NO: 403194 - RNA, 15 nt, Bordetella pertussis
ggggcgagcgcagcc

SEQ ID NO: 403195 - RNA, 16 nt, Bordetella pertussis
ggggcgagcgcagccg

SEQ ID NO: 403196 - RNA, 18 nt, Bordetella pertussis
ggggcgcaucaugaggcg

SEQ ID NO: 403197 - RNA, 23 nt, Bordetella pertussis
ggggcgcaucaugaggcggcggu

SEQ ID NO: 403198 - RNA, 14 nt, Bordetella pertussis
ggggcgcgccgcgg

SEQ ID NO: 403199 - RNA, 14 nt, Bordetella pertussis
ggggcgcggccggu

SEQ ID NO: 403200 - RNA, 14 nt, Bordetella pertussis
ggggcgcuggucga

SEQ ID NO: 403201 - RNA, 12 nt, Bordetella pertussis
ggggcggcaggu

SEQ ID NO: 403202 - RNA, 13 nt, Bordetella pertussis
ggggcggcccagc

SEQ ID NO: 403203 - RNA, 14 nt, Bordetella pertussis
ggggcggcccagcg

SEQ ID NO: 403204 - RNA, 14 nt, Bordetella pertussis
ggggcggcgcagca

SEQ ID NO: 403205 - RNA, 16 nt, Bordetella pertussis
ggggcggcgcggcgcu

SEQ ID NO: 403206 - RNA, 19 nt, Bordetella pertussis
ggggcggcggguggcggcg

SEQ ID NO: 403207 - RNA, 15 nt, Bordetella pertussis
ggggcguagcucagc

SEQ ID NO: 403208 - RNA, 16 nt, Bordetella pertussis
ggggcguagcucagcc

SEQ ID NO: 403209 - RNA, 14 nt, Bordetella pertussis
ggggcgucgcugcu

SEQ ID NO: 403210 - RNA, 21 nt, Bordetella pertussis
ggggcgucgcugcuggcggcg

SEQ ID NO: 403211 - RNA, 22 nt, Bordetella pertussis
ggggcgucgucgcgguccagca

SEQ ID NO: 403212 - RNA, 20 nt, Bordetella pertussis
ggggcgugcccuugagcgug

SEQ ID NO: 403213 - RNA, 23 nt, Bordetella pertussis
ggggcgugcccuugagcgugggc

SEQ ID NO: 403214 - RNA, 15 nt, Bordetella pertussis
ggggcguggccgcag

SEQ ID NO: 403215 - RNA, 13 nt, Bordetella pertussis
ggggcucggccag

SEQ ID NO: 403216 - RNA, 11 nt, Bordetella pertussis
ggggcuggagg

SEQ ID NO: 403217 - RNA, 14 nt, Bordetella pertussis
ggggcuggaggcgc

SEQ ID NO: 403218 - RNA, 18 nt, Bordetella pertussis
ggggcuggcauggcgguc

SEQ ID NO: 403219 - RNA, 17 nt, Bordetella pertussis
ggggcuggccgccgcgg

SEQ ID NO: 403220 - RNA, 21 nt, Bordetella pertussis
ggggcuuuuuguugcgcgccg

SEQ ID NO: 403221 - RNA, 16 nt, Bordetella pertussis
gggggacuggcacccg

SEQ ID NO: 403222 - RNA, 17 nt, Bordetella pertussis
gggggacuggcacccgc

SEQ ID NO: 403223 - RNA, 15 nt, Bordetella pertussis
gggggacuggcaccg

SEQ ID NO: 403224 - RNA, 14 nt, Bordetella pertussis
gggggauuggugcc

SEQ ID NO: 403225 - RNA, 16 nt, Bordetella pertussis
gggggcauggcgccgc

SEQ ID NO: 403226 - RNA, 12 nt, Bordetella pertussis
gggggcgagcgg

SEQ ID NO: 403227 - RNA, 13 nt, Bordetella pertussis
gggggcgagcggg

SEQ ID NO: 403228 - RNA, 20 nt, Bordetella pertussis
gggggcgguaccguccuggc

SEQ ID NO: 403229 - RNA, 17 nt, Bordetella pertussis
gggggcuggcgcuugcc

SEQ ID NO: 403230 - RNA, 13 nt, Bordetella pertussis
gggggucaggccg

SEQ ID NO: 403231 - RNA, 14 nt, Bordetella pertussis
gggggucaggccgu

SEQ ID NO: 403232 - RNA, 20 nt, Bordetella pertussis
gggggucagggccgcccagu

SEQ ID NO: 403233 - RNA, 15 nt, Bordetella pertussis
ggggguggcggccgu

SEQ ID NO: 403234 - RNA, 18 nt, Bordetella pertussis
ggggguucgugggcgagc

SEQ ID NO: 403235 - RNA, 19 nt, Bordetella pertussis
ggggguucgugggcgagcg

SEQ ID NO: 403236 - RNA, 20 nt, Bordetella pertussis
ggggguucgugggcgagcgu

SEQ ID NO: 403237 - RNA, 21 nt, Bordetella pertussis
ggggguugccagauaaggcgg

SEQ ID NO: 403238 - RNA, 14 nt, Bordetella pertussis
gggguaggcgcggu

SEQ ID NO: 403239 - RNA, 23 nt, Bordetella pertussis
gggguagucggccaccaggccgu

SEQ ID NO: 403240 - RNA, 14 nt, Bordetella pertussis
ggggucagcgccgg

SEQ ID NO: 403241 - RNA, 18 nt, Bordetella pertussis
ggggucaggccguuggcg

SEQ ID NO: 403242 - RNA, 22 nt, Bordetella pertussis
ggggucaggccguuggcgcgcc

SEQ ID NO: 403243 - RNA, 19 nt, Bordetella pertussis
ggggucgaucauggccagc

SEQ ID NO: 403244 - RNA, 18 nt, Bordetella pertussis
ggggucgccgggcagcgg

SEQ ID NO: 403245 - RNA, 16 nt, Bordetella pertussis
ggggucgggccgcgcg

SEQ ID NO: 403246 - RNA, 20 nt, Bordetella pertussis
ggggucgucggcgcugcagc

SEQ ID NO: 403247 - RNA, 20 nt, Bordetella pertussis
ggggugccguucggccagcg

SEQ ID NO: 403248 - RNA, 12 nt, Bordetella pertussis
ggggugccuguc

SEQ ID NO: 403249 - RNA, 19 nt, Bordetella pertussis
ggggugcuccugccaggcg

SEQ ID NO: 403250 - RNA, 22 nt, Bordetella pertussis
gggguggcacagccgcagccgu

SEQ ID NO: 403251 - RNA, 13 nt, Bordetella pertussis
gggguggccggcg

SEQ ID NO: 403252 - RNA, 13 nt, Bordetella pertussis
gggguggcugucc

SEQ ID NO: 403253 - RNA, 22 nt, Bordetella pertussis
gggguggcuguccccgcgcggg

SEQ ID NO: 403254 - RNA, 23 nt, Bordetella pertussis
gggguugggaucgcgccaggcgu

SEQ ID NO: 403255 - RNA, 22 nt, Bordetella pertussis
gggguuuuuuuuugggaaggcc

SEQ ID NO: 403256 - RNA, 15 nt, Bordetella pertussis
ggguacgacggccgg

SEQ ID NO: 403257 - RNA, 17 nt, Bordetella pertussis
ggguacgacggccgggg

SEQ ID NO: 403258 - RNA, 18 nt, Bordetella pertussis
gggucaaggcggggcucc

SEQ ID NO: 403259 - RNA, 21 nt, Bordetella pertussis
gggucacccgccgcaccagcc

SEQ ID NO: 403260 - RNA, 14 nt, Bordetella pertussis
gggucagcggccgg

SEQ ID NO: 403261 - RNA, 21 nt, Bordetella pertussis
gggucagcggccggcccgugc

SEQ ID NO: 403262 - RNA, 14 nt, Bordetella pertussis
gggucaggccguug

SEQ ID NO: 403263 - RNA, 14 nt, Bordetella pertussis
gggucgaugccagu

SEQ ID NO: 403264 - RNA, 15 nt, Bordetella pertussis
gggucgccgguggug

SEQ ID NO: 403265 - RNA, 15 nt, Bordetella pertussis
gggucgcgcagcagg

SEQ ID NO: 403266 - RNA, 21 nt, Bordetella pertussis
gggucgcgcagcagggccugg

SEQ ID NO: 403267 - RNA, 14 nt, Bordetella pertussis
gggucgcuguagcg

SEQ ID NO: 403268 - RNA, 15 nt, Bordetella pertussis
gggugagugcccaug

SEQ ID NO: 403269 - RNA, 19 nt, Bordetella pertussis
gggugaucacggccgucaa

SEQ ID NO: 403270 - RNA, 15 nt, Bordetella pertussis
ggguggcugcgcagg

SEQ ID NO: 403271 - RNA, 12 nt, Bordetella pertussis
gggugggcgcgc

SEQ ID NO: 403272 - RNA, 12 nt, Bordetella pertussis
gggugggcggca

SEQ ID NO: 403273 - RNA, 16 nt, Bordetella pertussis
gggugucgcuccccca

SEQ ID NO: 403274 - RNA, 18 nt, Bordetella pertussis
gggugucgcucccccaug

SEQ ID NO: 403275 - RNA, 14 nt, Bordetella pertussis
gguagccgggucug

SEQ ID NO: 403276 - RNA, 23 nt, Bordetella pertussis
gguagcgccucgcaucggccugc

SEQ ID NO: 403277 - RNA, 12 nt, Bordetella pertussis
gguagcgcucgu

SEQ ID NO: 403278 - RNA, 17 nt, Bordetella pertussis
gguagcgguccagcugc

SEQ ID NO: 403279 - RNA, 19 nt, Bordetella pertussis
gguagcgguccagcugcgc

SEQ ID NO: 403280 - RNA, 18 nt, Bordetella pertussis
gguauagaguugcucggg

SEQ ID NO: 403281 - RNA, 15 nt, Bordetella pertussis
ggucaacgccugcgg

SEQ ID NO: 403282 - RNA, 15 nt, Bordetella pertussis
ggucaaggcgcggcc

SEQ ID NO: 403283 - RNA, 21 nt, Bordetella pertussis
ggucaaggcggggcuccugug

SEQ ID NO: 403284 - RNA, 23 nt, Bordetella pertussis
ggucaccacccgcacgccggccu

SEQ ID NO: 403285 - RNA, 22 nt, Bordetella pertussis
ggucaccacgccuucgagcacc

SEQ ID NO: 403286 - RNA, 23 nt, Bordetella pertussis
ggucagaacgacgaucugguccu

SEQ ID NO: 403287 - RNA, 18 nt, Bordetella pertussis
ggucagcaccucggcgcc

SEQ ID NO: 403288 - RNA, 21 nt, Bordetella pertussis
ggucagcacuugccggccgcc

SEQ ID NO: 403289 - RNA, 17 nt, Bordetella pertussis
ggucaguccgcccagcc

SEQ ID NO: 403290 - RNA, 22 nt, Bordetella pertussis
ggucaguccgcccagccaggcg

SEQ ID NO: 403291 - RNA, 23 nt, Bordetella pertussis
ggucaguccgcccagccaggcgc

SEQ ID NO: 403292 - RNA, 17 nt, Bordetella pertussis
ggucaucaccagggugg

SEQ ID NO: 403293 - RNA, 12 nt, Bordetella pertussis
ggucaucgccag

SEQ ID NO: 403294 - RNA, 13 nt, Bordetella pertussis
ggucaucgccagg

SEQ ID NO: 403295 - RNA, 13 nt, Bordetella pertussis
ggucaucgcgacc

SEQ ID NO: 403296 - RNA, 19 nt, Bordetella pertussis
ggucaugacgggcggcggc

SEQ ID NO: 403297 - RNA, 16 nt, Bordetella pertussis
ggucaugcccuccucg

SEQ ID NO: 403298 - RNA, 17 nt, Bordetella pertussis
ggucaugccgaacagca

SEQ ID NO: 403299 - RNA, 21 nt, Bordetella pertussis
ggucauguccagcgccaggcc

SEQ ID NO: 403300 - RNA, 14 nt, Bordetella pertussis
gguccacagcccgg

SEQ ID NO: 403301 - RNA, 15 nt, Bordetella pertussis
gguccacagcccggc

SEQ ID NO: 403302 - RNA, 23 nt, Bordetella pertussis
gguccaccaccuucagggcgccg

SEQ ID NO: 403303 - RNA, 17 nt, Bordetella pertussis
gguccaccucgucgucc

SEQ ID NO: 403304 - RNA, 23 nt, Bordetella pertussis
gguccaccucgucguccagcguc

SEQ ID NO: 403305 - RNA, 17 nt, Bordetella pertussis
gguccacgaugcccaug

SEQ ID NO: 403306 - RNA, 23 nt, Bordetella pertussis
gguccacgcccuggcuggcggcc

SEQ ID NO: 403307 - RNA, 20 nt, Bordetella pertussis
gguccacggcauggccagcu

SEQ ID NO: 403308 - RNA, 14 nt, Bordetella pertussis
gguccacggcggcg

SEQ ID NO: 403309 - RNA, 20 nt, Bordetella pertussis
gguccagcaccagggcgcgc

SEQ ID NO: 403310 - RNA, 20 nt, Bordetella pertussis
gguccagccccacgccgacc

SEQ ID NO: 403311 - RNA, 17 nt, Bordetella pertussis
gguccagccccugcccg

SEQ ID NO: 403312 - RNA, 21 nt, Bordetella pertussis
gguccagcacggcgaggaugc

SEQ ID NO: 403313 - RNA, 15 nt, Bordetella pertussis
gguccagcagcguga

SEQ ID NO: 403314 - RNA, 13 nt, Bordetella pertussis
gguccaggcgcgc

SEQ ID NO: 403315 - RNA, 20 nt, Bordetella pertussis
gguccaggcgcgcaaggugg

SEQ ID NO: 403316 - RNA, 11 nt, Bordetella pertussis
gguccauggug

SEQ ID NO: 403317 - RNA, 16 nt, Bordetella pertussis
ggucccaaccagggcc

SEQ ID NO: 403318 - RNA, 18 nt, Bordetella pertussis
gguccgccgccgcgugga

SEQ ID NO: 403319 - RNA, 14 nt, Bordetella pertussis
gguccgccgcgacc

SEQ ID NO: 403320 - RNA, 19 nt, Bordetella pertussis
gguccgcucgaggccaggc

SEQ ID NO: 403321 - RNA, 22 nt, Bordetella pertussis
gguccgcucgaggccaggcuga

SEQ ID NO: 403322 - RNA, 20 nt, Bordetella pertussis
gguccgggccauccguccgc

SEQ ID NO: 403323 - RNA, 17 nt, Bordetella pertussis
gguccggucgcgcgugc

SEQ ID NO: 403324 - RNA, 20 nt, Bordetella pertussis
gguccggucgcgcgugcagg

SEQ ID NO: 403325 - RNA, 14 nt, Bordetella pertussis
gguccgugaagccg

SEQ ID NO: 403326 - RNA, 14 nt, Bordetella pertussis
gguccguggcggcc

SEQ ID NO: 403327 - RNA, 16 nt, Bordetella pertussis
gguccugaggccaggc

SEQ ID NO: 403328 - RNA, 17 nt, Bordetella pertussis
gguccugaggccaggcc

SEQ ID NO: 403329 - RNA, 17 nt, Bordetella pertussis
gguccugcacgcgggcc

SEQ ID NO: 403330 - RNA, 18 nt, Bordetella pertussis
gguccugcucggugcucu

SEQ ID NO: 403331 - RNA, 11 nt, Bordetella pertussis
gguccugcuga

SEQ ID NO: 403332 - RNA, 14 nt, Bordetella pertussis
ggucgcgcaccagg

SEQ ID NO: 403333 - RNA, 22 nt, Bordetella pertussis
ggucgcgcaccuguucggcggc

SEQ ID NO: 403334 - RNA, 15 nt, Bordetella pertussis
ggucgcgcacgcugg

SEQ ID NO: 403335 - RNA, 21 nt, Bordetella pertussis
ggucgcgaucgucgaccgcga

SEQ ID NO: 403336 - RNA, 16 nt, Bordetella pertussis
ggucgcgcagcugccu

SEQ ID NO: 403337 - RNA, 16 nt, Bordetella pertussis
ggucgcgcgugcaggc

SEQ ID NO: 403338 - RNA, 17 nt, Bordetella pertussis
ggucgcggccgaggcca

SEQ ID NO: 403339 - RNA, 15 nt, Bordetella pertussis
ggucggcgcggcgcc

SEQ ID NO: 403340 - RNA, 17 nt, Bordetella pertussis
ggucggcggccagcgcg

SEQ ID NO: 403341 - RNA, 13 nt, Bordetella pertussis
ggucggcugaugc

SEQ ID NO: 403342 - RNA, 18 nt, Bordetella pertussis
ggucggggcaggccuggu

SEQ ID NO: 403343 - RNA, 14 nt, Bordetella pertussis
ggucggucgccugu

SEQ ID NO: 403344 - RNA, 16 nt, Bordetella pertussis
ggucguuggucggguu

SEQ ID NO: 403345 - RNA, 22 nt, Bordetella pertussis
ggucuccagcgcgucggccagg

SEQ ID NO: 403346 - RNA, 11 nt, Bordetella pertussis
ggucucggcca

SEQ ID NO: 403347 - RNA, 23 nt, Bordetella pertussis
ggucugcaagguggcgugcagca

SEQ ID NO: 403348 - RNA, 20 nt, Bordetella pertussis
ggucugcaggcucuggcuga

SEQ ID NO: 403349 - RNA, 13 nt, Bordetella pertussis
ggucugccccaug

SEQ ID NO: 403350 - RNA, 23 nt, Bordetella pertussis
ggucugccccauggccugggugc

SEQ ID NO: 403351 - RNA, 16 nt, Bordetella pertussis
ggugaccaccaggccg

SEQ ID NO: 403352 - RNA, 16 nt, Bordetella pertussis
ggugaccacggcgcgc

SEQ ID NO: 403353 - RNA, 22 nt, Bordetella pertussis
ggugaccacggcgcgcccgcag

SEQ ID NO: 403354 - RNA, 16 nt, Bordetella pertussis
ggugagcaagcgcugg

SEQ ID NO: 403355 - RNA, 16 nt, Bordetella pertussis
ggugaugauggccagg

SEQ ID NO: 403356 - RNA, 21 nt, Bordetella pertussis
ggugaugauggccagguccac

SEQ ID NO: 403357 - RNA, 16 nt, Bordetella pertussis
ggugaugauggccgag

SEQ ID NO: 403358 - RNA, 15 nt, Bordetella pertussis
ggugaugcggcgcgc

SEQ ID NO: 403359 - RNA, 22 nt, Bordetella pertussis
ggugauggauuucgaccgcaug

SEQ ID NO: 403360 - RNA, 16 nt, Bordetella pertussis
ggugauguccugcagg

SEQ ID NO: 403361 - RNA, 17 nt, Bordetella pertussis
ggugcaucggccggcgg

SEQ ID NO: 403362 - RNA, 16 nt, Bordetella pertussis
ggugcauucguccagg

SEQ ID NO: 403363 - RNA, 17 nt, Bordetella pertussis
ggugccagucccccugc

SEQ ID NO: 403364 - RNA, 15 nt, Bordetella pertussis
ggugccaguccccgc

SEQ ID NO: 403365 - RNA, 14 nt, Bordetella pertussis
ggugccaguccccu

SEQ ID NO: 403366 - RNA, 21 nt, Bordetella pertussis
ggugccagucuccaggcucag

SEQ ID NO: 403367 - RNA, 20 nt, Bordetella pertussis
ggugcccaguucgcggccgg

SEQ ID NO: 403368 - RNA, 15 nt, Bordetella pertussis
ggugccccggccucg

SEQ ID NO: 403369 - RNA, 14 nt, Bordetella pertussis
ggugcccgcgaagc

SEQ ID NO: 403370 - RNA, 16 nt, Bordetella pertussis
ggugcucuggcccgcc

SEQ ID NO: 403371 - RNA, 14 nt, Bordetella pertussis
ggugcugaacgccu

SEQ ID NO: 403372 - RNA, 16 nt, Bordetella pertussis
ggugcugggcggcggg

SEQ ID NO: 403373 - RNA, 17 nt, Bordetella pertussis
gguggccagccaggcgg

SEQ ID NO: 403374 - RNA, 17 nt, Bordetella pertussis
gguggccaugcugggcg

SEQ ID NO: 403375 - RNA, 17 nt, Bordetella pertussis
gguggccauggacagca

SEQ ID NO: 403376 - RNA, 11 nt, Bordetella pertussis
gguggccgcgg

SEQ ID NO: 403377 - RNA, 21 nt, Bordetella pertussis
gguggccgcuccagagcgcgc

SEQ ID NO: 403378 - RNA, 23 nt, Bordetella pertussis
gguggccuggguggccagcugcg

SEQ ID NO: 403379 - RNA, 17 nt, Bordetella pertussis
ggugggucucggcgucg

SEQ ID NO: 403380 - RNA, 17 nt, Bordetella pertussis
gguuauuuccggccgca

SEQ ID NO: 403381 - RNA, 19 nt, Bordetella pertussis
gguucagcgcgccagcgcg

SEQ ID NO: 403382 - RNA, 16 nt, Bordetella pertussis
gguucagucgucgccg

SEQ ID NO: 403383 - RNA, 20 nt, Bordetella pertussis
gguucaucgggccggcggca

SEQ ID NO: 403384 - RNA, 20 nt, Bordetella pertussis
gguucaugcguucggccagc

SEQ ID NO: 403385 - RNA, 19 nt, Bordetella pertussis
gguuccugcaaggccggcg

SEQ ID NO: 403386 - RNA, 16 nt, Bordetella pertussis
gguuccugcccauggc

SEQ ID NO: 403387 - RNA, 22 nt, Bordetella pertussis
gguucgaugaccugggccuggu

SEQ ID NO: 403388 - RNA, 19 nt, Bordetella pertussis
gguucgccgugcagggcca

SEQ ID NO: 403389 - RNA, 17 nt, Bordetella pertussis
gguucgcgccugcccgc

SEQ ID NO: 403390 - RNA, 20 nt, Bordetella pertussis
gguucgucagggccgcagca

SEQ ID NO: 403391 - RNA, 18 nt, Bordetella pertussis
gguucguccucgucggcc

SEQ ID NO: 403392 - RNA, 18 nt, Bordetella pertussis
gguucgugccgggcagca

SEQ ID NO: 403393 - RNA, 17 nt, Bordetella pertussis
gguucugcgcguccugg

SEQ ID NO: 403394 - RNA, 16 nt, Bordetella pertussis
gguugagcagcaccug

SEQ ID NO: 403395 - RNA, 16 nt, Bordetella pertussis
gguugcaguccugugu

SEQ ID NO: 403396 - RNA, 20 nt, Bordetella pertussis
gguugcaguucgccggcgcc

SEQ ID NO: 403397 - RNA, 21 nt, Bordetella pertussis
gguugccaagauggcccaggg

SEQ ID NO: 403398 - RNA, 16 nt, Bordetella pertussis
gguugccgcugcaugg

SEQ ID NO: 403399 - RNA, 17 nt, Bordetella pertussis
gguugcgguaguucagc

SEQ ID NO: 403400 - RNA, 13 nt, Bordetella pertussis
gguuggccacgaa

SEQ ID NO: 403401 - RNA, 23 nt, Bordetella pertussis
gguugugcccgcccggggugugc

SEQ ID NO: 403402 - RNA, 13 nt, Bordetella pertussis
gguuucucggccu

SEQ ID NO: 403403 - RNA, 19 nt, Bordetella pertussis
gguuuuccacagccaggcc

SEQ ID NO: 403404 - RNA, 16 nt, Bordetella pertussis
guacacggccagcacg

SEQ ID NO: 403405 - RNA, 12 nt, Bordetella pertussis
guacagcagcag

SEQ ID NO: 403406 - RNA, 13 nt, Bordetella pertussis
guacagcagcagc

SEQ ID NO: 403407 - RNA, 19 nt, Bordetella pertussis
guacagcagcagcacggcc

SEQ ID NO: 403408 - RNA, 23 nt, Bordetella pertussis
guacagccaggccagcagcucgg

SEQ ID NO: 403409 - RNA, 13 nt, Bordetella pertussis
guacagccgccug

SEQ ID NO: 403410 - RNA, 22 nt, Bordetella pertussis
guacaggcgcguggcgcccagc

SEQ ID NO: 403411 - RNA, 21 nt, Bordetella pertussis
guacaggcugccgucggccag

SEQ ID NO: 403412 - RNA, 24 nt, Bordetella pertussis
guaccagcccaguugcuggcccag

SEQ ID NO: 403413 - RNA, 16 nt, Bordetella pertussis
guaccugcagcaggcg

SEQ ID NO: 403414 - RNA, 15 nt, Bordetella pertussis
guacgaagcaaacag

SEQ ID NO: 403415 - RNA, 18 nt, Bordetella pertussis
guacgacagcucggggaa

SEQ ID NO: 403416 - RNA, 22 nt, Bordetella pertussis
guacgagaacgcgucgcucaug

SEQ ID NO: 403417 - RNA, 14 nt, Bordetella pertussis
guacgagcggcggc

SEQ ID NO: 403418 - RNA, 11 nt, Bordetella pertussis
guacgaggacc

SEQ ID NO: 403419 - RNA, 16 nt, Bordetella pertussis
guacgauagcggauga

SEQ ID NO: 403420 - RNA, 14 nt, Bordetella pertussis
guacgcaccgccgc

SEQ ID NO: 403421 - RNA, 23 nt, Bordetella pertussis
guacgccaugcgauacagcuugg

SEQ ID NO: 403422 - RNA, 19 nt, Bordetella pertussis
guacgcgcaguccgcacag

SEQ ID NO: 403423 - RNA, 15 nt, Bordetella pertussis
guacucgaucgccau

SEQ ID NO: 403424 - RNA, 22 nt, Bordetella pertussis
guacucgccguugucgacgauc

SEQ ID NO: 403425 - RNA, 13 nt, Bordetella pertussis
guacucggccagg

SEQ ID NO: 403426 - RNA, 16 nt, Bordetella pertussis
guacucguacgaggca

SEQ ID NO: 403427 - RNA, 13 nt, Bordetella pertussis
guacugcugcaag

SEQ ID NO: 403428 - RNA, 18 nt, Bordetella pertussis
guacugcugcaaggacac

SEQ ID NO: 403429 - RNA, 15 nt, Bordetella pertussis
guagaacgccagggu

SEQ ID NO: 403430 - RNA, 18 nt, Bordetella pertussis
guagaaguaggcggccag

SEQ ID NO: 403431 - RNA, 16 nt, Bordetella pertussis
guagaccaccagcagg

SEQ ID NO: 403432 - RNA, 15 nt, Bordetella pertussis
guagauggccgccuu

SEQ ID NO: 403433 - RNA, 14 nt, Bordetella pertussis
guagcaggcgcgcu

SEQ ID NO: 403434 - RNA, 17 nt, Bordetella pertussis
guagcaggcgcgcucag

SEQ ID NO: 403435 - RNA, 19 nt, Bordetella pertussis
guagcccagguccagcgcc

SEQ ID NO: 403436 - RNA, 17 nt, Bordetella pertussis
guagcccauggccaggg

SEQ ID NO: 403437 - RNA, 24 nt, Bordetella pertussis
guagcccauguugaacugcaggcc

SEQ ID NO: 403438 - RNA, 19 nt, Bordetella pertussis
guagcccuuguggccgccg

SEQ ID NO: 403439 - RNA, 21 nt, Bordetella pertussis
guagccgccgacgaugaccau

SEQ ID NO: 403440 - RNA, 13 nt, Bordetella pertussis
guagccggccagg

SEQ ID NO: 403441 - RNA, 16 nt, Bordetella pertussis
guagcgguagccggcg

SEQ ID NO: 403442 - RNA, 16 nt, Bordetella pertussis
guagcgguccagcugc

SEQ ID NO: 403443 - RNA, 16 nt, Bordetella pertussis
guagcgguccggggcg

SEQ ID NO: 403444 - RNA, 20 nt, Bordetella pertussis
guagcgguccggggcgggcg

SEQ ID NO: 403445 - RNA, 20 nt, Bordetella pertussis
guaggacagccccagcagca

SEQ ID NO: 403446 - RNA, 15 nt, Bordetella pertussis
guaucagcgccugca

SEQ ID NO: 403447 - RNA, 17 nt, Bordetella pertussis
guaucagcgccugcagg

SEQ ID NO: 403448 - RNA, 18 nt, Bordetella pertussis
guaucagcgccugcaggu

SEQ ID NO: 403449 - RNA, 18 nt, Bordetella pertussis
guaucccggccaggcgcc

SEQ ID NO: 403450 - RNA, 22 nt, Bordetella pertussis
guaucgcggccgagcuccucga

SEQ ID NO: 403451 - RNA, 20 nt, Bordetella pertussis
guaucucggcgcccgcggcc

SEQ ID NO: 403452 - RNA, 23 nt, Bordetella pertussis
guaucugucccggcggggacagg

SEQ ID NO: 403453 - RNA, 19 nt, Bordetella pertussis
guaugaccggcgcggccug

SEQ ID NO: 403454 - RNA, 14 nt, Bordetella pertussis
guaugcccacuccc

SEQ ID NO: 403455 - RNA, 15 nt, Bordetella pertussis
guaugcgcagcgagu

SEQ ID NO: 403456 - RNA, 17 nt, Bordetella pertussis
guaugcggcagcagggc

SEQ ID NO: 403457 - RNA, 17 nt, Bordetella pertussis
guauggccguuggccag

SEQ ID NO: 403458 - RNA, 16 nt, Bordetella pertussis
guaugguuggccacga

SEQ ID NO: 403459 - RNA, 23 nt, Bordetella pertussis
guauucaucacgggcgccagcag

SEQ ID NO: 403460 - RNA, 18 nt, Bordetella pertussis
guauuccggguccagccc

SEQ ID NO: 403461 - RNA, 19 nt, Bordetella pertussis
guauucgggaugggccacc

SEQ ID NO: 403462 - RNA, 19 nt, Bordetella pertussis
guauugcccuucggggcag

SEQ ID NO: 403463 - RNA, 18 nt, Bordetella pertussis
gucaauccgccgccagca

SEQ ID NO: 403464 - RNA, 22 nt, Bordetella pertussis
gucaauccgccgccagcacgcc

SEQ ID NO: 403465 - RNA, 19 nt, Bordetella pertussis
gucacacugucgccacggg

SEQ ID NO: 403466 - RNA, 20 nt, Bordetella pertussis
gucaucgccaggcgcgugca

SEQ ID NO: 403467 - RNA, 23 nt, Bordetella pertussis
gucaucggugcggccgguggcga

SEQ ID NO: 403468 - RNA, 17 nt, Bordetella pertussis
gucaugcgcaccuuguc

SEQ ID NO: 403469 - RNA, 17 nt, Bordetella pertussis
gucauggaaaaucuggg

SEQ ID NO: 403470 - RNA, 20 nt, Bordetella pertussis
gucauggucgaccagcagcc

SEQ ID NO: 403471 - RNA, 14 nt, Bordetella pertussis
guccaaggaaagcc

SEQ ID NO: 403472 - RNA, 15 nt, Bordetella pertussis
guccaauucgagcag

SEQ ID NO: 403473 - RNA, 15 nt, Bordetella pertussis
guccaccaccaggcc

SEQ ID NO: 403474 - RNA, 18 nt, Bordetella pertussis
guccaccaccaggccggc

SEQ ID NO: 403475 - RNA, 22 nt, Bordetella pertussis
guccaccaccaggccggccagg

SEQ ID NO: 403476 - RNA, 21 nt, Bordetella pertussis
guccacauccgcgcugcugcc

SEQ ID NO: 403477 - RNA, 16 nt, Bordetella pertussis
guccaccauccugccc

SEQ ID NO: 403478 - RNA, 13 nt, Bordetella pertussis
guccaccgccacg

SEQ ID NO: 403479 - RNA, 14 nt, Bordetella pertussis
guccacgcccagcg

SEQ ID NO: 403480 - RNA, 23 nt, Bordetella pertussis
guccacgccgcgcgcgucgccgc

SEQ ID NO: 403481 - RNA, 23 nt, Bordetella pertussis
guccacgccguggcgcaaggcau

SEQ ID NO: 403482 - RNA, 14 nt, Bordetella pertussis
guccacggcauggc

SEQ ID NO: 403483 - RNA, 20 nt, Bordetella pertussis
guccacggcauggccagcuu

SEQ ID NO: 403484 - RNA, 12 nt, Bordetella pertussis
guccacggcggc

SEQ ID NO: 403485 - RNA, 13 nt, Bordetella pertussis
guccacggcggcg

SEQ ID NO: 403486 - RNA, 15 nt, Bordetella pertussis
guccacggucgccgg

SEQ ID NO: 403487 - RNA, 23 nt, Bordetella pertussis
guccacuucaccgcugaucaggu

SEQ ID NO: 403488 - RNA, 22 nt, Bordetella pertussis
guccagcaaaugggccgcagcg

SEQ ID NO: 403489 - RNA, 11 nt, Bordetella pertussis
guccagcaagg

SEQ ID NO: 403490 - RNA, 19 nt, Bordetella pertussis
guccagcacggccgcggcc

SEQ ID NO: 403491 - RNA, 20 nt, Bordetella pertussis
guccagcacgcggcgcagca

SEQ ID NO: 403492 - RNA, 13 nt, Bordetella pertussis
guccagccgagcc

SEQ ID NO: 403493 - RNA, 18 nt, Bordetella pertussis
guccagcgagcgaaagcc

SEQ ID NO: 403494 - RNA, 15 nt, Bordetella pertussis
guccagcgccaggcc

SEQ ID NO: 403495 - RNA, 19 nt, Bordetella pertussis
guccagcggcagcgggucg

SEQ ID NO: 403496 - RNA, 21 nt, Bordetella pertussis
guccagcggcguauaggccac

SEQ ID NO: 403497 - RNA, 23 nt, Bordetella pertussis
guccagcgucaugcgcaccuugu

SEQ ID NO: 403498 - RNA, 16 nt, Bordetella pertussis
guccagcuccagcgcu

SEQ ID NO: 403499 - RNA, 19 nt, Bordetella pertussis
guccagcuggcccuggcag

SEQ ID NO: 403500 - RNA, 18 nt, Bordetella pertussis
guccagcuuggacagcgc

SEQ ID NO: 403501 - RNA, 16 nt, Bordetella pertussis
guccaggcccagcgcg

SEQ ID NO: 403502 - RNA, 20 nt, Bordetella pertussis
guccaggccgaucagcgaca

SEQ ID NO: 403503 - RNA, 14 nt, Bordetella pertussis
guccaggcgguccu

SEQ ID NO: 403504 - RNA, 15 nt, Bordetella pertussis
guccaggcggugcgu

SEQ ID NO: 403505 - RNA, 15 nt, Bordetella pertussis
guccaggcgguuggc

SEQ ID NO: 403506 - RNA, 15 nt, Bordetella pertussis
guccaggcccuggcg

SEQ ID NO: 403507 - RNA, 14 nt, Bordetella pertussis
guccaggcugccgg

SEQ ID NO: 403508 - RNA, 16 nt, Bordetella pertussis
guccaggugcggcggc

SEQ ID NO: 403509 - RNA, 18 nt, Bordetella pertussis
guccagguggcccgcacc

SEQ ID NO: 403510 - RNA, 20 nt, Bordetella pertussis
guccagguugggcaccacca

SEQ ID NO: 403511 - RNA, 21 nt, Bordetella pertussis
guccaugcgaaagcggccagc

SEQ ID NO: 403512 - RNA, 16 nt, Bordetella pertussis
guccauggccugcagg

SEQ ID NO: 403513 - RNA, 21 nt, Bordetella pertussis
gucccaaccgggacaggcacc

SEQ ID NO: 403514 - RNA, 15 nt, Bordetella pertussis
gucccggcggggaca

SEQ ID NO: 403515 - RNA, 20 nt, Bordetella pertussis
gucccggcugggacaggcac

SEQ ID NO: 403516 - RNA, 20 nt, Bordetella pertussis
gucccggugaucguccugaa

SEQ ID NO: 403517 - RNA, 15 nt, Bordetella pertussis
gucccugccgggaca

SEQ ID NO: 403518 - RNA, 19 nt, Bordetella pertussis
gucccugcgggggcaggca

SEQ ID NO: 403519 - RNA, 20 nt, Bordetella pertussis
gucccugcgggggcaggcac

SEQ ID NO: 403520 - RNA, 21 nt, Bordetella pertussis
gucccugcgggggcaggcacg

SEQ ID NO: 403521 - RNA, 23 nt, Bordetella pertussis
gucccuggccauuccuuccgggc

SEQ ID NO: 403522 - RNA, 19 nt, Bordetella pertussis
guccgccgcgaccaccagc

SEQ ID NO: 403523 - RNA, 20 nt, Bordetella pertussis
guccgccgcgaccaccagca

SEQ ID NO: 403524 - RNA, 21 nt, Bordetella pertussis
guccgccgugcaggcccgggc

SEQ ID NO: 403525 - RNA, 17 nt, Bordetella pertussis
guccgcgcucgcccagc

SEQ ID NO: 403526 - RNA, 14 nt, Bordetella pertussis
guccgcgucgccgc

SEQ ID NO: 403527 - RNA, 17 nt, Bordetella pertussis
guccgcgugggcauggu

SEQ ID NO: 403528 - RNA, 18 nt, Bordetella pertussis
guccgcucgaggccaggc

SEQ ID NO: 403529 - RNA, 12 nt, Bordetella pertussis
guccgggcggcg

SEQ ID NO: 403530 - RNA, 20 nt, Bordetella pertussis
guccguaucgcggccgagcu

SEQ ID NO: 403531 - RNA, 16 nt, Bordetella pertussis
guccgucgggcaagcg

SEQ ID NO: 403532 - RNA, 19 nt, Bordetella pertussis
guccguggccaagugggca

SEQ ID NO: 403533 - RNA, 18 nt, Bordetella pertussis
guccuccccgcugaccug

SEQ ID NO: 403534 - RNA, 17 nt, Bordetella pertussis
guccucgcgggccuggc

SEQ ID NO: 403535 - RNA, 18 nt, Bordetella pertussis
guccucgcgggccuggcg

SEQ ID NO: 403536 - RNA, 14 nt, Bordetella pertussis
guccucgcgguccu

SEQ ID NO: 403537 - RNA, 13 nt, Bordetella pertussis
guccucggccacg

SEQ ID NO: 403538 - RNA, 14 nt, Bordetella pertussis
guccucggccacgu

SEQ ID NO: 403539 - RNA, 17 nt, Bordetella pertussis
guccucggccagccggg

SEQ ID NO: 403540 - RNA, 11 nt, Bordetella pertussis
guccucggccu

SEQ ID NO: 403541 - RNA, 13 nt, Bordetella pertussis
guccucggccugg

SEQ ID NO: 403542 - RNA, 17 nt, Bordetella pertussis
guccuuggaguucuucu

SEQ ID NO: 403543 - RNA, 18 nt, Bordetella pertussis
guccuuggaguucuucuu

SEQ ID NO: 403544 - RNA, 15 nt, Bordetella pertussis
guccuuggcggccuu

SEQ ID NO: 403545 - RNA, 16 nt, Bordetella pertussis
gucgaacguggcggcg

SEQ ID NO: 403546 - RNA, 16 nt, Bordetella pertussis
gucgaacuuguucuug

SEQ ID NO: 403547 - RNA, 16 nt, Bordetella pertussis
gucgaagcacugcagg

SEQ ID NO: 403548 - RNA, 13 nt, Bordetella pertussis
gucgaagccggcg

SEQ ID NO: 403549 - RNA, 19 nt, Bordetella pertussis
gucgacauagacgcgcagc

SEQ ID NO: 403550 - RNA, 18 nt, Bordetella pertussis
gucgacagguagcggucg

SEQ ID NO: 403551 - RNA, 14 nt, Bordetella pertussis
gucgaccagcagcc

SEQ ID NO: 403552 - RNA, 17 nt, Bordetella pertussis
gucgaccagcagccggu

SEQ ID NO: 403553 - RNA, 23 nt, Bordetella pertussis
gucgaccaguucggccagcagcu

SEQ ID NO: 403554 - RNA, 14 nt, Bordetella pertussis
gucgaccgcgggcg

SEQ ID NO: 403555 - RNA, 16 nt, Bordetella pertussis
gucgaccgcgggcgcg

SEQ ID NO: 403556 - RNA, 20 nt, Bordetella pertussis
gucgaccugcuugcccagca

SEQ ID NO: 403557 - RNA, 21 nt, Bordetella pertussis
gucgacgaggggguguucucc

SEQ ID NO: 403558 - RNA, 16 nt, Bordetella pertussis
gucgacgaucaggccc

SEQ ID NO: 403559 - RNA, 18 nt, Bordetella pertussis
gucgacgaucaggcccug

SEQ ID NO: 403560 - RNA, 14 nt, Bordetella pertussis
gucgacgcccgcgc

SEQ ID NO: 403561 - RNA, 14 nt, Bordetella pertussis
gucgagaccagcag

SEQ ID NO: 403562 - RNA, 21 nt, Bordetella pertussis
gucgagagccugggcgcgcgc

SEQ ID NO: 403563 - RNA, 20 nt, Bordetella pertussis
gucgagauauagccggucug

SEQ ID NO: 403564 - RNA, 17 nt, Bordetella pertussis
gucgagcaccgcgcggg

SEQ ID NO: 403565 - RNA, 18 nt, Bordetella pertussis
gucgagcgcgacgcgcuc

SEQ ID NO: 403566 - RNA, 15 nt, Bordetella pertussis
gucgagcgcucgcuc

SEQ ID NO: 403567 - RNA, 12 nt, Bordetella pertussis
gucgaugaaguu

SEQ ID NO: 403568 - RNA, 21 nt, Bordetella pertussis
gucgaugaccagcgccggcgc

SEQ ID NO: 403569 - RNA, 13 nt, Bordetella pertussis
gucgaugacgcgc

SEQ ID NO: 403570 - RNA, 13 nt, Bordetella pertussis
gucgaugcaaccg

SEQ ID NO: 403571 - RNA, 11 nt, Bordetella pertussis
gucgaugccag

SEQ ID NO: 403572 - RNA, 22 nt, Bordetella pertussis
gucgaugccgaccaggcugcgc

SEQ ID NO: 403573 - RNA, 21 nt, Bordetella pertussis
gucgauggggucgggccgcgc

SEQ ID NO: 403574 - RNA, 23 nt, Bordetella pertussis
gucgaugucgugaucgccagcgc

SEQ ID NO: 403575 - RNA, 18 nt, Bordetella pertussis
gucgcgaccucggcggcg

SEQ ID NO: 403576 - RNA, 20 nt, Bordetella pertussis
gucgcgcaauacgccgccgg

SEQ ID NO: 403577 - RNA, 13 nt, Bordetella pertussis
gucgcgcaccgcc

SEQ ID NO: 403578 - RNA, 18 nt, Bordetella pertussis
gucgcgcaccgccugcug

SEQ ID NO: 403579 - RNA, 22 nt, Bordetella pertussis
gucgcgcaccuguucggcggcg

SEQ ID NO: 403580 - RNA, 14 nt, Bordetella pertussis
gucgcgcagcaggg

SEQ ID NO: 403581 - RNA, 14 nt, Bordetella pertussis
gucgcgcagcgagu

SEQ ID NO: 403582 - RNA, 13 nt, Bordetella pertussis
gucgcgccaggcc

SEQ ID NO: 403583 - RNA, 20 nt, Bordetella pertussis
gucgcgcgaucaggcggugc

SEQ ID NO: 403584 - RNA, 14 nt, Bordetella pertussis
gucgcggguggugg

SEQ ID NO: 403585 - RNA, 16 nt, Bordetella pertussis
gucgcgguccagcacc

SEQ ID NO: 403586 - RNA, 20 nt, Bordetella pertussis
gucgcucaugaccagcggcg

SEQ ID NO: 403587 - RNA, 22 nt, Bordetella pertussis
gucgcucccccaugcggggaca

SEQ ID NO: 403588 - RNA, 12 nt, Bordetella pertussis
gucgcucggccu

SEQ ID NO: 403589 - RNA, 18 nt, Bordetella pertussis
gucggacagggccccggc

SEQ ID NO: 403590 - RNA, 17 nt, Bordetella pertussis
gucggagucggcgccgc

SEQ ID NO: 403591 - RNA, 21 nt, Bordetella pertussis
gucggcaaccgucgccagcgc

SEQ ID NO: 403592 - RNA, 17 nt, Bordetella pertussis
gucggcacgucgggcag

SEQ ID NO: 403593 - RNA, 16 nt, Bordetella pertussis
gucggccaaggccggc

SEQ ID NO: 403594 - RNA, 15 nt, Bordetella pertussis
gucggccaccaggcc

SEQ ID NO: 403595 - RNA, 12 nt, Bordetella pertussis
gucggccaggcg

SEQ ID NO: 403596 - RNA, 21 nt, Bordetella pertussis
gucggcccaggucaucgccag

SEQ ID NO: 403597 - RNA, 14 nt, Bordetella pertussis
gucggccgcgccgc

SEQ ID NO: 403598 - RNA, 22 nt, Bordetella pertussis
gucggccgcuccgccauggagg

SEQ ID NO: 403599 - RNA, 16 nt, Bordetella pertussis
gucggccggaugcgca

SEQ ID NO: 403600 - RNA, 14 nt, Bordetella pertussis
gucggccgccguga

SEQ ID NO: 403601 - RNA, 20 nt, Bordetella pertussis
gucggccuggcgcuccucgc

SEQ ID NO: 403602 - RNA, 20 nt, Bordetella pertussis
gucggcgaacagcgcguucg

SEQ ID NO: 403603 - RNA, 14 nt, Bordetella pertussis
gucggcgaccgugc

SEQ ID NO: 403604 - RNA, 13 nt, Bordetella pertussis
gucggcgacguga

SEQ ID NO: 403605 - RNA, 15 nt, Bordetella pertussis
gucggcgaucaccug

SEQ ID NO: 403606 - RNA, 18 nt, Bordetella pertussis
gucggcgauggcgcgcgc

SEQ ID NO: 403607 - RNA, 18 nt, Bordetella pertussis
gucggcgcagauggcggc

SEQ ID NO: 403608 - RNA, 17 nt, Bordetella pertussis
gucggcgccgaggcggu

SEQ ID NO: 403609 - RNA, 19 nt, Bordetella pertussis
gucggcgccgaucagcagg

SEQ ID NO: 403610 - RNA, 16 nt, Bordetella pertussis
gucggcgccaugcugg

SEQ ID NO: 403611 - RNA, 18 nt, Bordetella pertussis
gucggcgcgcgccaggcc

SEQ ID NO: 403612 - RNA, 21 nt, Bordetella pertussis
gucggcgcggcgccguccagc

SEQ ID NO: 403613 - RNA, 12 nt, Bordetella pertussis
gucggcgcggca

SEQ ID NO: 403614 - RNA, 21 nt, Bordetella pertussis
gucggcggcccacagcgcccc

SEQ ID NO: 403615 - RNA, 19 nt, Bordetella pertussis
gucggcguaaggccgccgg

SEQ ID NO: 403616 - RNA, 22 nt, Bordetella pertussis
gucggcguugugccggcgcagg

SEQ ID NO: 403617 - RNA, 19 nt, Bordetella pertussis
gucggcguuccuggcgcug

SEQ ID NO: 403618 - RNA, 16 nt, Bordetella pertussis
gucggcuuccaucagg

SEQ ID NO: 403619 - RNA, 12 nt, Bordetella pertussis
gucgggacaggc

SEQ ID NO: 403620 - RNA, 16 nt, Bordetella pertussis
gucgggcagcgcccgc

SEQ ID NO: 403621 - RNA, 14 nt, Bordetella pertussis
gucgggcggcggcg

SEQ ID NO: 403622 - RNA, 12 nt, Bordetella pertussis
gucgggcugcug

SEQ ID NO: 403623 - RNA, 17 nt, Bordetella pertussis
gucgggcuugccguuca

SEQ ID NO: 403624 - RNA, 17 nt, Bordetella pertussis
gucggggccgcagcugg

SEQ ID NO: 403625 - RNA, 16 nt, Bordetella pertussis
gucggguccagcacgc

SEQ ID NO: 403626 - RNA, 15 nt, Bordetella pertussis
gucggguagcugcug

SEQ ID NO: 403627 - RNA, 17 nt, Bordetella pertussis
gucggugaaggccacgc

SEQ ID NO: 403628 - RNA, 13 nt, Bordetella pertussis
gucgguggccagc

SEQ ID NO: 403629 - RNA, 19 nt, Bordetella pertussis
gucgguggccagccaggcg

SEQ ID NO: 403630 - RNA, 18 nt, Bordetella pertussis
gucguagcgcugcagcca

SEQ ID NO: 403631 - RNA, 13 nt, Bordetella pertussis
gucguagcgggcg

SEQ ID NO: 403632 - RNA, 14 nt, Bordetella pertussis
gucguagcgggcgg

SEQ ID NO: 403633 - RNA, 18 nt, Bordetella pertussis
gucguccaauucgagcag

SEQ ID NO: 403634 - RNA, 21 nt, Bordetella pertussis
gucguccaauucgagcaggcg

SEQ ID NO: 403635 - RNA, 14 nt, Bordetella pertussis
gucgugcuggcgcg

SEQ ID NO: 403636 - RNA, 16 nt, Bordetella pertussis
gucguggggcgcggcg

SEQ ID NO: 403637 - RNA, 20 nt, Bordetella pertussis
gucguugccggccagcacgg

SEQ ID NO: 403638 - RNA, 23 nt, Bordetella pertussis
gucuacaggcccagcgccagcag

SEQ ID NO: 403639 - RNA, 16 nt, Bordetella pertussis
gucuaugucgaggacc

SEQ ID NO: 403640 - RNA, 20 nt, Bordetella pertussis
gucuccagcgccggcagccc

SEQ ID NO: 403641 - RNA, 12 nt, Bordetella pertussis
gucuccagcgcg

SEQ ID NO: 403642 - RNA, 19 nt, Bordetella pertussis
gucuccaggcucaggcggc

SEQ ID NO: 403643 - RNA, 15 nt, Bordetella pertussis
gucucccccucggcc

SEQ ID NO: 403644 - RNA, 20 nt, Bordetella pertussis
gucucccccucggccugcgc

SEQ ID NO: 403645 - RNA, 21 nt, Bordetella pertussis
gucucgcccaggcccagcauc

SEQ ID NO: 403646 - RNA, 20 nt, Bordetella pertussis
gucucgcccaugaucagggc

SEQ ID NO: 403647 - RNA, 13 nt, Bordetella pertussis
gucucgcgcggcc

SEQ ID NO: 403648 - RNA, 20 nt, Bordetella pertussis
gucucggaaaacuggcgggu

SEQ ID NO: 403649 - RNA, 17 nt, Bordetella pertussis
gucucgugccccgcaug

SEQ ID NO: 403650 - RNA, 15 nt, Bordetella pertussis
gucucguuccagaug

SEQ ID NO: 403651 - RNA, 21 nt, Bordetella pertussis
gucugcauguaguucacccag

SEQ ID NO: 403652 - RNA, 18 nt, Bordetella pertussis
gucugcgugugccgccag

SEQ ID NO: 403653 - RNA, 22 nt, Bordetella pertussis
gucugcuacaccgugcuggccg

SEQ ID NO: 403654 - RNA, 16 nt, Bordetella pertussis
gucugcuucauccagg

SEQ ID NO: 403655 - RNA, 15 nt, Bordetella pertussis
gucuggaggacgagc

SEQ ID NO: 403656 - RNA, 20 nt, Bordetella pertussis
gucuggcacgcuugccgcaa

SEQ ID NO: 403657 - RNA, 12 nt, Bordetella pertussis
gucuggcggccg

SEQ ID NO: 403658 - RNA, 22 nt, Bordetella pertussis
gucugggcgcggaacagccugg

SEQ ID NO: 403659 - RNA, 20 nt, Bordetella pertussis
gucuggucgcacgacagcau

SEQ ID NO: 403660 - RNA, 15 nt, Bordetella pertussis
gucuggucuggcaac

SEQ ID NO: 403661 - RNA, 23 nt, Bordetella pertussis
gucugguggcgauccauguggcc

SEQ ID NO: 403662 - RNA, 20 nt, Bordetella pertussis
gucugguuuuucgaagagca

SEQ ID NO: 403663 - RNA, 22 nt, Bordetella pertussis
gucuucaguugacgccggcggc

SEQ ID NO: 403664 - RNA, 14 nt, Bordetella pertussis
gucuuccaggcgca

SEQ ID NO: 403665 - RNA, 17 nt, Bordetella pertussis
gucuucgagcgcgagca

SEQ ID NO: 403666 - RNA, 23 nt, Bordetella pertussis
gucuucgaugcuggcgcggaccu

SEQ ID NO: 403667 - RNA, 16 nt, Bordetella pertussis
gucuucgguggcccgc

SEQ ID NO: 403668 - RNA, 22 nt, Bordetella pertussis
gucuugaggauaucggccaggc

SEQ ID NO: 403669 - RNA, 17 nt, Bordetella pertussis
gucuuugaagggcggcg

SEQ ID NO: 403670 - RNA, 19 nt, Bordetella pertussis
gugaaagguucggagcacg

SEQ ID NO: 403671 - RNA, 19 nt, Bordetella pertussis
gugaagccaagcagggcau

SEQ ID NO: 403672 - RNA, 15 nt, Bordetella pertussis
gugaagcccauggcg

SEQ ID NO: 403673 - RNA, 16 nt, Bordetella pertussis
gugaagccguccuuga

SEQ ID NO: 403674 - RNA, 15 nt, Bordetella pertussis
gugaaggcgcccggg

SEQ ID NO: 403675 - RNA, 13 nt, Bordetella pertussis
gugacaugcacga

SEQ ID NO: 403676 - RNA, 13 nt, Bordetella pertussis
gugaccagcugca

SEQ ID NO: 403677 - RNA, 13 nt, Bordetella pertussis
gugacccggggca

SEQ ID NO: 403678 - RNA, 14 nt, Bordetella pertussis
gugaccgacaggcc

SEQ ID NO: 403679 - RNA, 16 nt, Bordetella pertussis
gugaccgccagcaggc

SEQ ID NO: 403680 - RNA, 17 nt, Bordetella pertussis
gugaccggguggcugcg

SEQ ID NO: 403681 - RNA, 21 nt, Bordetella pertussis
gugaccugcucgucgccaugc

SEQ ID NO: 403682 - RNA, 23 nt, Bordetella pertussis
gugaccuuggucggguccagcac

SEQ ID NO: 403683 - RNA, 17 nt, Bordetella pertussis
gugacgcuggagcgcgg

SEQ ID NO: 403684 - RNA, 23 nt, Bordetella pertussis
gugacggaccuuguauuccaucu

SEQ ID NO: 403685 - RNA, 19 nt, Bordetella pertussis
gugacggauucccagcucc

SEQ ID NO: 403686 - RNA, 21 nt, Bordetella pertussis
gugacguugagcgccggggcg

SEQ ID NO: 403687 - RNA, 16 nt, Bordetella pertussis
gugacguugccgcgcg

SEQ ID NO: 403688 - RNA, 13 nt, Bordetella pertussis
gugacuuccuggu

SEQ ID NO: 403689 - RNA, 23 nt, Bordetella pertussis
gugagcaagcgcuggauggucac

SEQ ID NO: 403690 - RNA, 20 nt, Bordetella pertussis
gugagcacgacguugggcau

SEQ ID NO: 403691 - RNA, 11 nt, Bordetella pertussis
gugagcgccac

SEQ ID NO: 403692 - RNA, 22 nt, Bordetella pertussis
gugaggcgacgguggcuggggc

SEQ ID NO: 403693 - RNA, 16 nt, Bordetella pertussis
gugaggggccagccug

SEQ ID NO: 403694 - RNA, 17 nt, Bordetella pertussis
gugaggggccagccugg

SEQ ID NO: 403695 - RNA, 15 nt, Bordetella pertussis
gugagugcagcgcuc

SEQ ID NO: 403696 - RNA, 20 nt, Bordetella pertussis
gugauagcacugcaccugcu

SEQ ID NO: 403697 - RNA, 23 nt, Bordetella pertussis
gugauagcacugcaccugcucca

SEQ ID NO: 403698 - RNA, 19 nt, Bordetella pertussis
gugauauagaccagcagcu

SEQ ID NO: 403699 - RNA, 23 nt, Bordetella pertussis
gugaucaugccgcugaccagcac

SEQ ID NO: 403700 - RNA, 17 nt, Bordetella pertussis
gugauccacugcagcag

SEQ ID NO: 403701 - RNA, 17 nt, Bordetella pertussis
gugaucgacaacaagcc

SEQ ID NO: 403702 - RNA, 22 nt, Bordetella pertussis
gugaucgacaacaagccgggcg

SEQ ID NO: 403703 - RNA, 20 nt, Bordetella pertussis
gugaucgaguaggccggcac

SEQ ID NO: 403704 - RNA, 17 nt, Bordetella pertussis
gugaucugguccacggc

SEQ ID NO: 403705 - RNA, 20 nt, Bordetella pertussis
gugcacgcguaugcccugcg

SEQ ID NO: 403706 - RNA, 17 nt, Bordetella pertussis
gugcagccgccgcaggc

SEQ ID NO: 403707 - RNA, 13 nt, Bordetella pertussis
gugcagcggcagc

SEQ ID NO: 403708 - RNA, 21 nt, Bordetella pertussis
gugcaggaccuuguugugcuu

SEQ ID NO: 403709 - RNA, 23 nt, Bordetella pertussis
gugcaggccaacgggauccggca

SEQ ID NO: 403710 - RNA, 22 nt, Bordetella pertussis
gugcaggccaccgacggcgcgg

SEQ ID NO: 403711 - RNA, 13 nt, Bordetella pertussis
gugcaggcccggg

SEQ ID NO: 403712 - RNA, 19 nt, Bordetella pertussis
gugcaggggguggcggccg

SEQ ID NO: 403713 - RNA, 20 nt, Bordetella pertussis
gugcaggggguggcggccgu

SEQ ID NO: 403714 - RNA, 16 nt, Bordetella pertussis
gugcagguaggacggc

SEQ ID NO: 403715 - RNA, 15 nt, Bordetella pertussis
gugcaucaucugggc

SEQ ID NO: 403716 - RNA, 21 nt, Bordetella pertussis
gugcaucccaauuggccgccc

SEQ ID NO: 403717 - RNA, 13 nt, Bordetella pertussis
gugcaucgugaca

SEQ ID NO: 403718 - RNA, 23 nt, Bordetella pertussis
gugccagucccccgcggggacag

SEQ ID NO: 403719 - RNA, 16 nt, Bordetella pertussis
gugccaguccccugcg

SEQ ID NO: 403720 - RNA, 24 nt, Bordetella pertussis
gugccauacagcaaggacaaggcg

SEQ ID NO: 403721 - RNA, 13 nt, Bordetella pertussis
gugcccagcgagc

SEQ ID NO: 403722 - RNA, 18 nt, Bordetella pertussis
gugcccagcgagcggggc

SEQ ID NO: 403723 - RNA, 12 nt, Bordetella pertussis
gugccgacggcg

SEQ ID NO: 403724 - RNA, 16 nt, Bordetella pertussis
gugcccagcaccaggc

SEQ ID NO: 403725 - RNA, 13 nt, Bordetella pertussis
gugccgcaggcca

SEQ ID NO: 403726 - RNA, 14 nt, Bordetella pertussis
gugccgccagcggg

SEQ ID NO: 403727 - RNA, 14 nt, Bordetella pertussis
gugccgcuggcggc

SEQ ID NO: 403728 - RNA, 17 nt, Bordetella pertussis
gugccgcuggcggcccu

SEQ ID NO: 403729 - RNA, 20 nt, Bordetella pertussis
gugccgcuggcggcccugcc

SEQ ID NO: 403730 - RNA, 21 nt, Bordetella pertussis
gugccgggaugcugcucggcc

SEQ ID NO: 403731 - RNA, 16 nt, Bordetella pertussis
gugccguucccgccgg

SEQ ID NO: 403732 - RNA, 18 nt, Bordetella pertussis
gugccguucggccagcgc

SEQ ID NO: 403733 - RNA, 15 nt, Bordetella pertussis
gugccugccccugcg

SEQ ID NO: 403734 - RNA, 21 nt, Bordetella pertussis
gugccugccccugcggggaca

SEQ ID NO: 403735 - RNA, 23 nt, Bordetella pertussis
gugccugccccugcggggacagg

SEQ ID NO: 403736 - RNA, 21 nt, Bordetella pertussis
gugccugcuuguacaggcgcg

SEQ ID NO: 403737 - RNA, 14 nt, Bordetella pertussis
gugccuggacgcgc

SEQ ID NO: 403738 - RNA, 20 nt, Bordetella pertussis
gugccuggacgcgcuggccg

SEQ ID NO: 403739 - RNA, 24 nt, Bordetella pertussis
gugccuggacgcgcuggccgacaa

SEQ ID NO: 403740 - RNA, 15 nt, Bordetella pertussis
gugccuguccccaca

SEQ ID NO: 403741 - RNA, 21 nt, Bordetella pertussis
gugccuguccccacaugggga

SEQ ID NO: 403742 - RNA, 17 nt, Bordetella pertussis
gugccuguccccaccgg

SEQ ID NO: 403743 - RNA, 23 nt, Bordetella pertussis
gugccuguccccaccgggacagg

SEQ ID NO: 403744 - RNA, 15 nt, Bordetella pertussis
gugccuguccccacg

SEQ ID NO: 403745 - RNA, 19 nt, Bordetella pertussis
gugccuguccccacgggga

SEQ ID NO: 403746 - RNA, 21 nt, Bordetella pertussis
gugccuguccccacggggaca

SEQ ID NO: 403747 - RNA, 21 nt, Bordetella pertussis
gugccuguccccacguggaca

SEQ ID NO: 403748 - RNA, 13 nt, Bordetella pertussis
gugccuguccccg

SEQ ID NO: 403749 - RNA, 23 nt, Bordetella pertussis
gugccuguccccgcacggggaca

SEQ ID NO: 403750 - RNA, 19 nt, Bordetella pertussis
gugccuguccccgcaggga

SEQ ID NO: 403751 - RNA, 23 nt, Bordetella pertussis
gugccuguccccgcagggacagg

SEQ ID NO: 403752 - RNA, 19 nt, Bordetella pertussis
gugccuguccccgccggga

SEQ ID NO: 403753 - RNA, 23 nt, Bordetella pertussis
gugccuguccccgccgggacagg

SEQ ID NO: 403754 - RNA, 17 nt, Bordetella pertussis
gugccuguccccgcggg

SEQ ID NO: 403755 - RNA, 19 nt, Bordetella pertussis
gugccuguccccgcgggga

SEQ ID NO: 403756 - RNA, 22 nt, Bordetella pertussis
gugccuguccccgcggggacag

SEQ ID NO: 403757 - RNA, 23 nt, Bordetella pertussis
gugccuguccccgcggggacaga

SEQ ID NO: 403758 - RNA, 15 nt, Bordetella pertussis
gugcgauggcacggc

SEQ ID NO: 403759 - RNA, 22 nt, Bordetella pertussis
gugcgcaacgcgcgcgcgcaca

SEQ ID NO: 403760 - RNA, 15 nt, Bordetella pertussis
gugcgcaccaggccc

SEQ ID NO: 403761 - RNA, 16 nt, Bordetella pertussis
gugcgcacgauggggc

SEQ ID NO: 403762 - RNA, 23 nt, Bordetella pertussis
gugcgcagcagguggaucgacga

SEQ ID NO: 403763 - RNA, 13 nt, Bordetella pertussis
gugcgcagccggg

SEQ ID NO: 403764 - RNA, 21 nt, Bordetella pertussis
gugcgcagccgggcugccggc

SEQ ID NO: 403765 - RNA, 18 nt, Bordetella pertussis
gugcgcaggcgcguggcc

SEQ ID NO: 403766 - RNA, 16 nt, Bordetella pertussis
gugcgcaucagcgcau

SEQ ID NO: 403767 - RNA, 18 nt, Bordetella pertussis
guggaaaugccggcggcg

SEQ ID NO: 403768 - RNA, 10 nt, Bordetella pertussis
guggacaggc

SEQ ID NO: 403769 - RNA, 16 nt, Bordetella pertussis
guggacagcgccagcc

SEQ ID NO: 403770 - RNA, 23 nt, Bordetella pertussis
guggaccugccguucgcgcugcc

SEQ ID NO: 403771 - RNA, 20 nt, Bordetella pertussis
guggacgaauacgcuggcgc

SEQ ID NO: 403772 - RNA, 16 nt, Bordetella pertussis
guggacggccagcagg

SEQ ID NO: 403773 - RNA, 19 nt, Bordetella pertussis
guggacgccaagaccgcgg

SEQ ID NO: 403774 - RNA, 13 nt, Bordetella pertussis
guggcacagccgc

SEQ ID NO: 403775 - RNA, 17 nt, Bordetella pertussis
guggcagagggcgacgg

SEQ ID NO: 403776 - RNA, 20 nt, Bordetella pertussis
guggccgcagucaggaaaau

SEQ ID NO: 403777 - RNA, 20 nt, Bordetella pertussis
guggccgccgggucgcugug

SEQ ID NO: 403778 - RNA, 23 nt, Bordetella pertussis
guggccgcuguucggcgagccgg

SEQ ID NO: 403779 - RNA, 19 nt, Bordetella pertussis
guggccggaucgagcgcgg

SEQ ID NO: 403780 - RNA, 14 nt, Bordetella pertussis
guggccggcgacgg

SEQ ID NO: 403781 - RNA, 22 nt, Bordetella pertussis
guggccguucggugcgcagcgg

SEQ ID NO: 403782 - RNA, 12 nt, Bordetella pertussis
guggcggcggca

SEQ ID NO: 403783 - RNA, 17 nt, Bordetella pertussis
guggcgggccagcuccc

SEQ ID NO: 403784 - RNA, 22 nt, Bordetella pertussis
guggcguaguagcccaggccca

SEQ ID NO: 403785 - RNA, 20 nt, Bordetella pertussis
guggcguccacgcggguggu

SEQ ID NO: 403786 - RNA, 14 nt, Bordetella pertussis
guggcgugcagcag

SEQ ID NO: 403787 - RNA, 16 nt, Bordetella pertussis
guggcgugcaggccgg

SEQ ID NO: 403788 - RNA, 21 nt, Bordetella pertussis
gugggcaccgugaugcgcgcc

SEQ ID NO: 403789 - RNA, 13 nt, Bordetella pertussis
gugggcagcagca

SEQ ID NO: 403790 - RNA, 20 nt, Bordetella pertussis
gugggcauagcguuuuguac

SEQ ID NO: 403791 - RNA, 20 nt, Bordetella pertussis
gugggccacucgaugggcgc

SEQ ID NO: 403792 - RNA, 13 nt, Bordetella pertussis
gugggccagcaac

SEQ ID NO: 403793 - RNA, 16 nt, Bordetella pertussis
gugggccucgcuggag

SEQ ID NO: 403794 - RNA, 16 nt, Bordetella pertussis
gugggcgacgcggcgu

SEQ ID NO: 403795 - RNA, 14 nt, Bordetella pertussis
gugggcugcggcgu

SEQ ID NO: 403796 - RNA, 22 nt, Bordetella pertussis
gugggcuccguuccgaugcugg

SEQ ID NO: 403797 - RNA, 14 nt, Bordetella pertussis
guggucgccagcac

SEQ ID NO: 403798 - RNA, 17 nt, Bordetella pertussis
guggucgcgcccgccgu

SEQ ID NO: 403799 - RNA, 14 nt, Bordetella pertussis
guggucgugcagga

SEQ ID NO: 403800 - RNA, 16 nt, Bordetella pertussis
guggucgugcuggcgc

SEQ ID NO: 403801 - RNA, 15 nt, Bordetella pertussis
guggucuuccaggcg

SEQ ID NO: 403802 - RNA, 19 nt, Bordetella pertussis
guggucuuccaggcgcagg

SEQ ID NO: 403803 - RNA, 15 nt, Bordetella pertussis
guguagaccaccagc

SEQ ID NO: 403804 - RNA, 23 nt, Bordetella pertussis
guguagguaucguucgcgcgcgc

SEQ ID NO: 403805 - RNA, 17 nt, Bordetella pertussis
gugucccagcuccagua

SEQ ID NO: 403806 - RNA, 22 nt, Bordetella pertussis
guguccugccggggcacccagg

SEQ ID NO: 403807 - RNA, 13 nt, Bordetella pertussis
gugucgcaccgca

SEQ ID NO: 403808 - RNA, 14 nt, Bordetella pertussis
gugucggccagggc

SEQ ID NO: 403809 - RNA, 13 nt, Bordetella pertussis
gugucggggccgg

SEQ ID NO: 403810 - RNA, 13 nt, Bordetella pertussis
gugucuccgggcg

SEQ ID NO: 403811 - RNA, 20 nt, Bordetella pertussis
guguggccaugcaccagcac

SEQ ID NO: 403812 - RNA, 17 nt, Bordetella pertussis
guguuccagcgccuggc

SEQ ID NO: 403813 - RNA, 16 nt, Bordetella pertussis
guguucgauggcggcc

SEQ ID NO: 403814 - RNA, 23 nt, Bordetella pertussis
guucacccagguaucggccagca

SEQ ID NO: 403815 - RNA, 14 nt, Bordetella pertussis
guucacgcccagga

SEQ ID NO: 403816 - RNA, 23 nt, Bordetella pertussis
guucacgcccgagauggcgcagg

SEQ ID NO: 403817 - RNA, 20 nt, Bordetella pertussis
guucaucgcccauuuccugu

SEQ ID NO: 403818 - RNA, 18 nt, Bordetella pertussis
guucaucgggccggcggc

SEQ ID NO: 403819 - RNA, 20 nt, Bordetella pertussis
guucaugaccgccgcgccgg

SEQ ID NO: 403820 - RNA, 20 nt, Bordetella pertussis
guucaugacguccggcgggc

SEQ ID NO: 403821 - RNA, 19 nt, Bordetella pertussis
guuccagaugcgcagcagg

SEQ ID NO: 403822 - RNA, 23 nt, Bordetella pertussis
guuccagcacgacgacggccggc

SEQ ID NO: 403823 - RNA, 19 nt, Bordetella pertussis
guuccagccaguacaggcu

SEQ ID NO: 403824 - RNA, 16 nt, Bordetella pertussis
guuccgcgucuaccug

SEQ ID NO: 403825 - RNA, 12 nt, Bordetella pertussis
guuccggcgcgc

SEQ ID NO: 403826 - RNA, 18 nt, Bordetella pertussis
guuccggcgcgcgguggc

SEQ ID NO: 403827 - RNA, 15 nt, Bordetella pertussis
guucgaccugaaggu

SEQ ID NO: 403828 - RNA, 17 nt, Bordetella pertussis
guucgacgggcaggccc

SEQ ID NO: 403829 - RNA, 17 nt, Bordetella pertussis
guucggccacuuccugg

SEQ ID NO: 403830 - RNA, 15 nt, Bordetella pertussis
guucggccagcggca

SEQ ID NO: 403831 - RNA, 14 nt, Bordetella pertussis
guucggccggcggc

SEQ ID NO: 403832 - RNA, 21 nt, Bordetella pertussis
guucggcgagccgggcaccga

SEQ ID NO: 403833 - RNA, 15 nt, Bordetella pertussis
guucggcgcggccuu

SEQ ID NO: 403834 - RNA, 13 nt, Bordetella pertussis
guucggcgcgugc

SEQ ID NO: 403835 - RNA, 20 nt, Bordetella pertussis
guucgggcaugucgcggccc

SEQ ID NO: 403836 - RNA, 13 nt, Bordetella pertussis
guucuccagcgcc

SEQ ID NO: 403837 - RNA, 12 nt, Bordetella pertussis
guucucgacccg

SEQ ID NO: 403838 - RNA, 19 nt, Bordetella pertussis
guucucgacccgcucggcc

SEQ ID NO: 403839 - RNA, 20 nt, Bordetella pertussis
guucucgauguggcgcuggc

SEQ ID NO: 403840 - RNA, 16 nt, Bordetella pertussis
guucugcguggcggcg

SEQ ID NO: 403841 - RNA, 18 nt, Bordetella pertussis
guucuggcagugcgccug

SEQ ID NO: 403842 - RNA, 13 nt, Bordetella pertussis
guucuucaggcuc

SEQ ID NO: 403843 - RNA, 21 nt, Bordetella pertussis
guuguccgccugcggacggcg

SEQ ID NO: 403844 - RNA, 14 nt, Bordetella pertussis
guuguccuggccgg

SEQ ID NO: 403845 - RNA, 19 nt, Bordetella pertussis
guuguccuggcgcgccagg

SEQ ID NO: 403846 - RNA, 17 nt, Bordetella pertussis
guugucggcgccacagg

SEQ ID NO: 403847 - RNA, 16 nt, Bordetella pertussis
guuguucagguuggca

SEQ ID NO: 403848 - RNA, 23 nt, Bordetella pertussis
guuuccaagcgcacgcgcagcac

SEQ ID NO: 403849 - RNA, 18 nt, Bordetella pertussis
guuucggccugcaggccc

SEQ ID NO: 403850 - RNA, 23 nt, Bordetella pertussis
guuucggccugcaggcccagcac

SEQ ID NO: 403851 - RNA, 12 nt, Bordetella pertussis
guuucggugcgg

SEQ ID NO: 403852 - RNA, 15 nt, Bordetella pertussis
guuucggugcugccc

SEQ ID NO: 403853 - RNA, 16 nt, Bordetella pertussis
guuucguagccgccga

SEQ ID NO: 403854 - RNA, 16 nt, Bordetella pertussis
guuuuccacagccagg

SEQ ID NO: 403855 - RNA, 21 nt, Bordetella pertussis
guuuucgcccgcccacauggc

SEQ ID NO: 403856 - RNA, 19 nt, Bordetella pertussis
guuuucuggccuuccugcu

SEQ ID NO: 403857 - RNA, 15 nt, Bordetella pertussis
guuuuggcaggcugg

SEQ ID NO: 403858 - RNA, 21 nt, Bordetella pertussis
guuuuuccggcucuuccaucu

SEQ ID NO: 403859 - RNA, 20 nt, Bordetella pertussis
guuuuuuuuuggugccuguc

SEQ ID NO: 403860 - RNA, 23 nt, Bordetella pertussis
uaaagcggugcuugaugcccagc

SEQ ID NO: 403861 - RNA, 17 nt, Bordetella pertussis
uaauggcgcuccagccc

SEQ ID NO: 403862 - RNA, 22 nt, Bordetella pertussis
uaauuaaugaaacugcaaaauu

SEQ ID NO: 403863 - RNA, 15 nt, Bordetella pertussis
uacagccaggccagc

SEQ ID NO: 403864 - RNA, 15 nt, Bordetella pertussis
uacagcuugagagug

SEQ ID NO: 403865 - RNA, 15 nt, Bordetella pertussis
uaccacguggucugg

SEQ ID NO: 403866 - RNA, 17 nt, Bordetella pertussis
uaccaggugggcgcgcu

SEQ ID NO: 403867 - RNA, 23 nt, Bordetella pertussis
uaccgccuugccuugcgcggcca

SEQ ID NO: 403868 - RNA, 15 nt, Bordetella pertussis
uaccgggcuggucag

SEQ ID NO: 403869 - RNA, 13 nt, Bordetella pertussis
uaccgguccagau

SEQ ID NO: 403870 - RNA, 16 nt, Bordetella pertussis
uacgaaaaccaggcug

SEQ ID NO: 403871 - RNA, 13 nt, Bordetella pertussis
uacgaaaccaggc

SEQ ID NO: 403872 - RNA, 17 nt, Bordetella pertussis
uacgaaaccaggccggg

SEQ ID NO: 403873 - RNA, 18 nt, Bordetella pertussis
uacgaaacucccacgcuc

SEQ ID NO: 403874 - RNA, 22 nt, Bordetella pertussis
uacgaaggggcggaaagcgauu

SEQ ID NO: 403875 - RNA, 20 nt, Bordetella pertussis
uacgcgggcuugcugccccc

SEQ ID NO: 403876 - RNA, 14 nt, Bordetella pertussis
uacggccagcgcca

SEQ ID NO: 403877 - RNA, 16 nt, Bordetella pertussis
uacggccggcuccgcu

SEQ ID NO: 403878 - RNA, 15 nt, Bordetella pertussis
uacggguaugcgcag

SEQ ID NO: 403879 - RNA, 13 nt, Bordetella pertussis
uacucggccaggc

SEQ ID NO: 403880 - RNA, 14 nt, Bordetella pertussis
uacugcccucgccu

SEQ ID NO: 403881 - RNA, 21 nt, Bordetella pertussis
uacugcgcaugggcgcaggcc

SEQ ID NO: 403882 - RNA, 12 nt, Bordetella pertussis
uacugcggcgcc

SEQ ID NO: 403883 - RNA, 16 nt, Bordetella pertussis
uacugcugcaaggaca

SEQ ID NO: 403884 - RNA, 22 nt, Bordetella pertussis
uacuggcaacgggucgcgcagc

SEQ ID NO: 403885 - RNA, 21 nt, Bordetella pertussis
uacuggucgcgcagcugccug

SEQ ID NO: 403886 - RNA, 20 nt, Bordetella pertussis
uacuuccucgaccagcccgg

SEQ ID NO: 403887 - RNA, 19 nt, Bordetella pertussis
uacuucguggcgcagcucc

SEQ ID NO: 403888 - RNA, 20 nt, Bordetella pertussis
uacuuguacgacgucuugcu

SEQ ID NO: 403889 - RNA, 22 nt, Bordetella pertussis
uacuuguacgacgucuugcugc

SEQ ID NO: 403890 - RNA, 19 nt, Bordetella pertussis
uagaugcgcggggccaggc

SEQ ID NO: 403891 - RNA, 13 nt, Bordetella pertussis
uagauggccaggu

SEQ ID NO: 403892 - RNA, 14 nt, Bordetella pertussis
uagauggccgccuu

SEQ ID NO: 403893 - RNA, 14 nt, Bordetella pertussis
uagaugggcaggcc

SEQ ID NO: 403894 - RNA, 16 nt, Bordetella pertussis
uagcccauggccaggg

SEQ ID NO: 403895 - RNA, 18 nt, Bordetella pertussis
uagcccuggcgcugcagc

SEQ ID NO: 403896 - RNA, 21 nt, Bordetella pertussis
uagcccuugaucagcggcggc

SEQ ID NO: 403897 - RNA, 14 nt, Bordetella pertussis
uagcgcaagcccgu

SEQ ID NO: 403898 - RNA, 16 nt, Bordetella pertussis
uagcgcagcagcgaca

SEQ ID NO: 403899 - RNA, 22 nt, Bordetella pertussis
uagcgcaucgcgaugcgcagca

SEQ ID NO: 403900 - RNA, 20 nt, Bordetella pertussis
uagcgccggcuugcgccagc

SEQ ID NO: 403901 - RNA, 16 nt, Bordetella pertussis
uagcgcguggccagca

SEQ ID NO: 403902 - RNA, 17 nt, Bordetella pertussis
uagcgcugggcgccagc

SEQ ID NO: 403903 - RNA, 23 nt, Bordetella pertussis
uagcgcugggcgccagcagcacg

SEQ ID NO: 403904 - RNA, 18 nt, Bordetella pertussis
uagcgcucuucgcgguac

SEQ ID NO: 403905 - RNA, 12 nt, Bordetella pertussis
uagcgcuugccu

SEQ ID NO: 403906 - RNA, 18 nt, Bordetella pertussis
uagcgguggcgggccagc

SEQ ID NO: 403907 - RNA, 21 nt, Bordetella pertussis
uaggacagccccagcagcacg

SEQ ID NO: 403908 - RNA, 19 nt, Bordetella pertussis
uaggagacggucaccgcgc

SEQ ID NO: 403909 - RNA, 13 nt, Bordetella pertussis
uaggcggccaggc

SEQ ID NO: 403910 - RNA, 15 nt, Bordetella pertussis
uaggcugcagccagu

SEQ ID NO: 403911 - RNA, 18 nt, Bordetella pertussis
uagguggucagcaugguc

SEQ ID NO: 403912 - RNA, 13 nt, Bordetella pertussis
uaguacagcagca

SEQ ID NO: 403913 - RNA, 18 nt, Bordetella pertussis
uaguacagcagcagcacg

SEQ ID NO: 403914 - RNA, 14 nt, Bordetella pertussis
uaguagcccaggcc

SEQ ID NO: 403915 - RNA, 13 nt, Bordetella pertussis
uaguccagcagca

SEQ ID NO: 403916 - RNA, 15 nt, Bordetella pertussis
uaguccugccacucc

SEQ ID NO: 403917 - RNA, 15 nt, Bordetella pertussis
uagucgagccaggug

SEQ ID NO: 403918 - RNA, 20 nt, Bordetella pertussis
uagucgccggcuuccagcag

SEQ ID NO: 403919 - RNA, 18 nt, Bordetella pertussis
uagugcaggccgcgcagc

SEQ ID NO: 403920 - RNA, 13 nt, Bordetella pertussis
uaguuggccaggg

SEQ ID NO: 403921 - RNA, 14 nt, Bordetella pertussis
uauccacgccacug

SEQ ID NO: 403922 - RNA, 22 nt, Bordetella pertussis
uaucccaccugcagccagaucu

SEQ ID NO: 403923 - RNA, 23 nt, Bordetella pertussis
uaucggccucgaaccagugcagg

SEQ ID NO: 403924 - RNA, 17 nt, Bordetella pertussis
uaucugcguuuucuggc

SEQ ID NO: 403925 - RNA, 20 nt, Bordetella pertussis
uaucuuucgggcgcgggagc

SEQ ID NO: 403926 - RNA, 16 nt, Bordetella pertussis
uaugaccggcgcggcc

SEQ ID NO: 403927 - RNA, 16 nt, Bordetella pertussis
uaugcacgaccaggcc

SEQ ID NO: 403928 - RNA, 18 nt, Bordetella pertussis
uaugccgcccgcaaggac

SEQ ID NO: 403929 - RNA, 13 nt, Bordetella pertussis
uaugccugccagc

SEQ ID NO: 403930 - RNA, 14 nt, Bordetella pertussis
uaugcgcagcgagu

SEQ ID NO: 403931 - RNA, 16 nt, Bordetella pertussis
uaugcggcagcagggc

SEQ ID NO: 403932 - RNA, 11 nt, Bordetella pertussis
uaugcggcgcc

SEQ ID NO: 403933 - RNA, 18 nt, Bordetella pertussis
uaugcgggcuugcugccc

SEQ ID NO: 403934 - RNA, 19 nt, Bordetella pertussis
uauggccguuggccagcgc

SEQ ID NO: 403935 - RNA, 21 nt, Bordetella pertussis
uauggccuggaugugcaggcc

SEQ ID NO: 403936 - RNA, 21 nt, Bordetella pertussis
uauggcggcaacgugcaggcc

SEQ ID NO: 403937 - RNA, 15 nt, Bordetella pertussis
uauucgaaggcagca

SEQ ID NO: 403938 - RNA, 22 nt, Bordetella pertussis
uauucgcgcggcgacaccccca

SEQ ID NO: 403939 - RNA, 22 nt, Bordetella pertussis
uauucggccaacggcuggcugg

SEQ ID NO: 403940 - RNA, 21 nt, Bordetella pertussis
uauugaaggccgaggccaggu

SEQ ID NO: 403941 - RNA, 15 nt, Bordetella pertussis
uauugcugcugcugg

SEQ ID NO: 403942 - RNA, 19 nt, Bordetella pertussis
uauuggcuguaucuggccu

SEQ ID NO: 403943 - RNA, 22 nt, Bordetella pertussis
uauuuccggccgcacuggguga

SEQ ID NO: 403944 - RNA, 14 nt, Bordetella pertussis
uauuuguccagguu

SEQ ID NO: 403945 - RNA, 14 nt, Bordetella pertussis
uauuuuuccaugca

SEQ ID NO: 403946 - RNA, 18 nt, Bordetella pertussis
ucaaacgcggcgccgccg

SEQ ID NO: 403947 - RNA, 12 nt, Bordetella pertussis
ucaacaaggcga

SEQ ID NO: 403948 - RNA, 12 nt, Bordetella pertussis
ucaaccuugaau

SEQ ID NO: 403949 - RNA, 14 nt, Bordetella pertussis
ucaacggcaagaag

SEQ ID NO: 403950 - RNA, 21 nt, Bordetella pertussis
ucaaggcccggauauggccgg

SEQ ID NO: 403951 - RNA, 23 nt, Bordetella pertussis
ucaagggccuuuuucuuuugcgg

SEQ ID NO: 403952 - RNA, 16 nt, Bordetella pertussis
ucaauacgaaaaccag

SEQ ID NO: 403953 - RNA, 19 nt, Bordetella pertussis
ucaaucugaucaucuucgu

SEQ ID NO: 403954 - RNA, 24 nt, Bordetella pertussis
ucaaucuucgucuucgaccagguc

SEQ ID NO: 403955 - RNA, 19 nt, Bordetella pertussis
ucaauguauuuggcggcuu

SEQ ID NO: 403956 - RNA, 17 nt, Bordetella pertussis
ucacagggucaaggcgc

SEQ ID NO: 403957 - RNA, 22 nt, Bordetella pertussis
ucaccacgccuucgagcaccau

SEQ ID NO: 403958 - RNA, 18 nt, Bordetella pertussis
ucaccagcagguggcgcu

SEQ ID NO: 403959 - RNA, 21 nt, Bordetella pertussis
ucacccaggguguagaccugc

SEQ ID NO: 403960 - RNA, 15 nt, Bordetella pertussis
ucaccccgcccugcc

SEQ ID NO: 403961 - RNA, 15 nt, Bordetella pertussis
ucaccgacagcgcca

SEQ ID NO: 403962 - RNA, 19 nt, Bordetella pertussis
ucaccgagcugagcaccag

SEQ ID NO: 403963 - RNA, 20 nt, Bordetella pertussis
ucaccgagcugagcaccagc

SEQ ID NO: 403964 - RNA, 18 nt, Bordetella pertussis
ucaccgccauggcggccg

SEQ ID NO: 403965 - RNA, 15 nt, Bordetella pertussis
ucaccgccccgaccc

SEQ ID NO: 403966 - RNA, 12 nt, Bordetella pertussis
ucaccgccgccc

SEQ ID NO: 403967 - RNA, 14 nt, Bordetella pertussis
ucaccgccgcgccg

SEQ ID NO: 403968 - RNA, 14 nt, Bordetella pertussis
ucaccggccccauc

SEQ ID NO: 403969 - RNA, 21 nt, Bordetella pertussis
ucaccgugaugggcgcaucca

SEQ ID NO: 403970 - RNA, 14 nt, Bordetella pertussis
ucacgcaaggccga

SEQ ID NO: 403971 - RNA, 15 nt, Bordetella pertussis
ucacgcacagcaccu

SEQ ID NO: 403972 - RNA, 17 nt, Bordetella pertussis
ucacgccccgcacgauc

SEQ ID NO: 403973 - RNA, 16 nt, Bordetella pertussis
ucacgccggcgcgccg

SEQ ID NO: 403974 - RNA, 18 nt, Bordetella pertussis
ucacgcgcaagccgcugg

SEQ ID NO: 403975 - RNA, 15 nt, Bordetella pertussis
ucacgcgcaaggcgg

SEQ ID NO: 403976 - RNA, 16 nt, Bordetella pertussis
ucacgcgcaaggcggg

SEQ ID NO: 403977 - RNA, 15 nt, Bordetella pertussis
ucacgcuuccccgaa

SEQ ID NO: 403978 - RNA, 16 nt, Bordetella pertussis
ucacggcaagacggcg

SEQ ID NO: 403979 - RNA, 18 nt, Bordetella pertussis
ucacggcaagacggcgcu

SEQ ID NO: 403980 - RNA, 23 nt, Bordetella pertussis
ucacggccaacccucgcacggcc

SEQ ID NO: 403981 - RNA, 16 nt, Bordetella pertussis
ucacgggcgccagcag

SEQ ID NO: 403982 - RNA, 18 nt, Bordetella pertussis
ucacguagccggccaggu

SEQ ID NO: 403983 - RNA, 15 nt, Bordetella pertussis
ucagaacgacgaucu

SEQ ID NO: 403984 - RNA, 23 nt, Bordetella pertussis
ucagaagcgccauggcagggucc

SEQ ID NO: 403985 - RNA, 21 nt, Bordetella pertussis
ucagaccacgacggucugggc

SEQ ID NO: 403986 - RNA, 17 nt, Bordetella pertussis
ucagaccaucuuguccu

SEQ ID NO: 403987 - RNA, 13 nt, Bordetella pertussis
ucagacugcugcc

SEQ ID NO: 403988 - RNA, 22 nt, Bordetella pertussis
ucagauacaaaauacuuguccg

SEQ ID NO: 403989 - RNA, 15 nt, Bordetella pertussis
ucagcaaccccagca

SEQ ID NO: 403990 - RNA, 17 nt, Bordetella pertussis
ucagcaagggccccagc

SEQ ID NO: 403991 - RNA, 18 nt, Bordetella pertussis
ucagcacaucgcccggca

SEQ ID NO: 403992 - RNA, 14 nt, Bordetella pertussis
ucagcaccagcucc

SEQ ID NO: 403993 - RNA, 18 nt, Bordetella pertussis
ucagcaccgcggcgggcu

SEQ ID NO: 403994 - RNA, 16 nt, Bordetella pertussis
ucagcacuugccggcc

SEQ ID NO: 403995 - RNA, 14 nt, Bordetella pertussis
ucagcagcaggccc

SEQ ID NO: 403996 - RNA, 16 nt, Bordetella pertussis
ucagcagcgccagggc

SEQ ID NO: 403997 - RNA, 12 nt, Bordetella pertussis
ucagcagcgcgg

SEQ ID NO: 403998 - RNA, 15 nt, Bordetella pertussis
ucagcaggcccacca

SEQ ID NO: 403999 - RNA, 13 nt, Bordetella pertussis
ucagcagggcgcc

SEQ ID NO: 404000 - RNA, 19 nt, Bordetella pertussis
ucagcaggucggcgcggcc

SEQ ID NO: 404001 - RNA, 17 nt, Bordetella pertussis
ucagccaucaucaucgu

SEQ ID NO: 404002 - RNA, 23 nt, Bordetella pertussis
ucagcccggcgacguugcauacc

SEQ ID NO: 404003 - RNA, 23 nt, Bordetella pertussis
ucagcccggcgagguugcaggcc

SEQ ID NO: 404004 - RNA, 17 nt, Bordetella pertussis
ucagccgcuuggccugc

SEQ ID NO: 404005 - RNA, 22 nt, Bordetella pertussis
ucagccugggcgccuggcugca

SEQ ID NO: 404006 - RNA, 14 nt, Bordetella pertussis
ucagccuggggcag

SEQ ID NO: 404007 - RNA, 18 nt, Bordetella pertussis
ucagccugauucccaggc

SEQ ID NO: 404008 - RNA, 19 nt, Bordetella pertussis
ucagccugauucccaggcc

SEQ ID NO: 404009 - RNA, 20 nt, Bordetella pertussis
ucagccugauucccaggccc

SEQ ID NO: 404010 - RNA, 15 nt, Bordetella pertussis
uccugcacgcgggcc

SEQ ID NO: 404011 - RNA, 20 nt, Bordetella pertussis
uccugcagcacgcuggccuu

SEQ ID NO: 404012 - RNA, 10 nt, Bordetella pertussis
uccugcaggc

SEQ ID NO: 404013 - RNA, 19 nt, Bordetella pertussis
uccugcucgauccgggcac

SEQ ID NO: 404014 - RNA, 14 nt, Bordetella pertussis
uccugcugacaggc

SEQ ID NO: 404015 - RNA, 17 nt, Bordetella pertussis
uccugcugcgccuggcg

SEQ ID NO: 404016 - RNA, 19 nt, Bordetella pertussis
uccugcuggaccugcuguu

SEQ ID NO: 404017 - RNA, 13 nt, Bordetella pertussis
uccugcugguggc

SEQ ID NO: 404018 - RNA, 15 nt, Bordetella pertussis
uccugcugugcccca

SEQ ID NO: 404019 - RNA, 13 nt, Bordetella pertussis
uccuggacagugc

SEQ ID NO: 404020 - RNA, 16 nt, Bordetella pertussis
uccuggagacguagcc

SEQ ID NO: 404021 - RNA, 11 nt, Bordetella pertussis
uccuggagcuu

SEQ ID NO: 404022 - RNA, 17 nt, Bordetella pertussis
uccuggcaggccgcuuc

SEQ ID NO: 404023 - RNA, 13 nt, Bordetella pertussis
uccuggcagucag

SEQ ID NO: 404024 - RNA, 15 nt, Bordetella pertussis
uccuggcagucagcc

SEQ ID NO: 404025 - RNA, 13 nt, Bordetella pertussis
uccuucagcuuga

SEQ ID NO: 404026 - RNA, 17 nt, Bordetella pertussis
uccuucugggucggcau

SEQ ID NO: 404027 - RNA, 21 nt, Bordetella pertussis
uccuucugggucggcaugucg

SEQ ID NO: 404028 - RNA, 15 nt, Bordetella pertussis
uccuugacgccgccg

SEQ ID NO: 404029 - RNA, 16 nt, Bordetella pertussis
uccuugacgccgccga

SEQ ID NO: 404030 - RNA, 18 nt, Bordetella pertussis
uccuugccauccagccag

SEQ ID NO: 404031 - RNA, 15 nt, Bordetella pertussis
uccuugcgaugccag

SEQ ID NO: 404032 - RNA, 17 nt, Bordetella pertussis
uccuuggaguucuucuu

SEQ ID NO: 404033 - RNA, 18 nt, Bordetella pertussis
uccuuggugccguaaucc

SEQ ID NO: 404034 - RNA, 16 nt, Bordetella pertussis
uccuuuugcgcggccg

SEQ ID NO: 404035 - RNA, 13 nt, Bordetella pertussis
ucgaacguggcgg

SEQ ID NO: 404036 - RNA, 18 nt, Bordetella pertussis
ucgaacucgauggccucg

SEQ ID NO: 404037 - RNA, 20 nt, Bordetella pertussis
ucgacaccuacauccuggau

SEQ ID NO: 404038 - RNA, 18 nt, Bordetella pertussis
ucgacagcagcccgcugg

SEQ ID NO: 404039 - RNA, 19 nt, Bordetella pertussis
ucgacccgaaggcgcggcc

SEQ ID NO: 404040 - RNA, 21 nt, Bordetella pertussis
ucgacccggacaacgcgcgcc

SEQ ID NO: 404041 - RNA, 16 nt, Bordetella pertussis
ucgaccgacagcacau

SEQ ID NO: 404042 - RNA, 21 nt, Bordetella pertussis
ucgaccgccgggacaggcacc

SEQ ID NO: 404043 - RNA, 18 nt, Bordetella pertussis
ucgaccgcgaagcgcgcc

SEQ ID NO: 404044 - RNA, 15 nt, Bordetella pertussis
ucgaccucgagcacc

SEQ ID NO: 404045 - RNA, 22 nt, Bordetella pertussis
ucgacgcgaugcccgcgcacca

SEQ ID NO: 404046 - RNA, 16 nt, Bordetella pertussis
ucgacgcggccgaccc

SEQ ID NO: 404047 - RNA, 22 nt, Bordetella pertussis
ucgacgcugaucucggccugcc

SEQ ID NO: 404048 - RNA, 12 nt, Bordetella pertussis
ucgagcuggcug

SEQ ID NO: 404049 - RNA, 14 nt, Bordetella pertussis
ucgaggaaagcggc

SEQ ID NO: 404050 - RNA, 12 nt, Bordetella pertussis
ucgaggccaggc

SEQ ID NO: 404051 - RNA, 13 nt, Bordetella pertussis
ucgaggcgcuggc

SEQ ID NO: 404052 - RNA, 13 nt, Bordetella pertussis
ucgaggcggcgca

SEQ ID NO: 404053 - RNA, 13 nt, Bordetella pertussis
ucgagguggcgca

SEQ ID NO: 404054 - RNA, 23 nt, Bordetella pertussis
ucgaguagaaguaggcggccagg

SEQ ID NO: 404055 - RNA, 16 nt, Bordetella pertussis
ucgaguucggcgcgcc

SEQ ID NO: 404056 - RNA, 21 nt, Bordetella pertussis
ucgaguuugcgguccaugucg

SEQ ID NO: 404057 - RNA, 16 nt, Bordetella pertussis
ucgaucacgaagccca

SEQ ID NO: 404058 - RNA, 18 nt, Bordetella pertussis
ucgaucgucuugaccagc

SEQ ID NO: 404059 - RNA, 14 nt, Bordetella pertussis
ucgaucuggcucac

SEQ ID NO: 404060 - RNA, 13 nt, Bordetella pertussis
ucgaugaccagca

SEQ ID NO: 404061 - RNA, 13 nt, Bordetella pertussis
ucgaugaccagcc

SEQ ID NO: 404062 - RNA, 19 nt, Bordetella pertussis
ucgauuucggcggccaggc

SEQ ID NO: 404063 - RNA, 24 nt, Bordetella pertussis
ucgcacagccggggcgagcgcagc

SEQ ID NO: 404064 - RNA, 21 nt, Bordetella pertussis
ucgcaccgcaaggaaguggcc

SEQ ID NO: 404065 - RNA, 22 nt, Bordetella pertussis
ucgcacggcaauguccggggcg

SEQ ID NO: 404066 - RNA, 18 nt, Bordetella pertussis
ucgcacuggguggccagc

SEQ ID NO: 404067 - RNA, 22 nt, Bordetella pertussis
ucgcacuggguuuuuccggcuc

SEQ ID NO: 404068 - RNA, 18 nt, Bordetella pertussis
ucgcagacgaugaagacg

SEQ ID NO: 404069 - RNA, 19 nt, Bordetella pertussis
ucgccaacgucggcagcca

SEQ ID NO: 404070 - RNA, 16 nt, Bordetella pertussis
ucgccauccagguacg

SEQ ID NO: 404071 - RNA, 15 nt, Bordetella pertussis
ucgccaucggccggc

SEQ ID NO: 404072 - RNA, 15 nt, Bordetella pertussis
ucgccaugccggccc

SEQ ID NO: 404073 - RNA, 15 nt, Bordetella pertussis
ucgcccaacgaggac

SEQ ID NO: 404074 - RNA, 21 nt, Bordetella pertussis
ucgcccagccgccugagcaca

SEQ ID NO: 404075 - RNA, 23 nt, Bordetella pertussis
ucgcccagcgagccggccagcgc

SEQ ID NO: 404076 - RNA, 13 nt, Bordetella pertussis
ucgcccagcggcg

SEQ ID NO: 404077 - RNA, 16 nt, Bordetella pertussis
ucgcccauugcggcgg

SEQ ID NO: 404078 - RNA, 19 nt, Bordetella pertussis
ucgccccccgaggccaccu

SEQ ID NO: 404079 - RNA, 20 nt, Bordetella pertussis
ucgcccccgauccccugccc

SEQ ID NO: 404080 - RNA, 15 nt, Bordetella pertussis
ucgcccgaccugcug

SEQ ID NO: 404081 - RNA, 17 nt, Bordetella pertussis
ucgcccgaccugcuggc

SEQ ID NO: 404082 - RNA, 22 nt, Bordetella pertussis
ucgcccugcuuguuccacgagg

SEQ ID NO: 404083 - RNA, 12 nt, Bordetella pertussis
ucgcccuggaug

SEQ ID NO: 404084 - RNA, 18 nt, Bordetella pertussis
ucgcccuugagcacggcg

SEQ ID NO: 404085 - RNA, 17 nt, Bordetella pertussis
ucgccgacaggaugaag

SEQ ID NO: 404086 - RNA, 16 nt, Bordetella pertussis
ucgccgagccgggcca

SEQ ID NO: 404087 - RNA, 16 nt, Bordetella pertussis
ucgccgcaggcgugcc

SEQ ID NO: 404088 - RNA, 16 nt, Bordetella pertussis
ucgccgcugcgcagca

SEQ ID NO: 404089 - RNA, 17 nt, Bordetella pertussis
ucgccgcugucgcagua

SEQ ID NO: 404090 - RNA, 13 nt, Bordetella pertussis
ucgccuggccggc

SEQ ID NO: 404091 - RNA, 23 nt, Bordetella pertussis
ucgccuggggcaguuuccagggc

SEQ ID NO: 404092 - RNA, 19 nt, Bordetella pertussis
ucgccuggggcgggcgcug

SEQ ID NO: 404093 - RNA, 20 nt, Bordetella pertussis
ucgccuggggggucaaccag

SEQ ID NO: 404094 - RNA, 18 nt, Bordetella pertussis
ucgccuguaucagcgccu

SEQ ID NO: 404095 - RNA, 15 nt, Bordetella pertussis
ucgcgcaccgaggug

SEQ ID NO: 404096 - RNA, 22 nt, Bordetella pertussis
ucgcgcaccgaggugccggcgg

SEQ ID NO: 404097 - RNA, 21 nt, Bordetella pertussis
ucgcgcaccgcaugggccagg

SEQ ID NO: 404098 - RNA, 22 nt, Bordetella pertussis
ucgcgcaccgcaugggccaggc

SEQ ID NO: 404099 - RNA, 17 nt, Bordetella pertussis
ucgcgcaccgccugcgg

SEQ ID NO: 404100 - RNA, 21 nt, Bordetella pertussis
ucgcgcaccgccugcgggaac

SEQ ID NO: 404101 - RNA, 15 nt, Bordetella pertussis
ucgcgcacgcuggca

SEQ ID NO: 404102 - RNA, 22 nt, Bordetella pertussis
ucgcgcagcaccgccagcgcgu

SEQ ID NO: 404103 - RNA, 23 nt, Bordetella pertussis
ucgcgcagcaggccguugccgcu

SEQ ID NO: 404104 - RNA, 15 nt, Bordetella pertussis
ucgcgcagcggcgcg

SEQ ID NO: 404105 - RNA, 23 nt, Bordetella pertussis
ucgcgcagcgugcggaccagcgg

SEQ ID NO: 404106 - RNA, 21 nt, Bordetella pertussis
ucgcgcaggcgugcgcgggcg

SEQ ID NO: 404107 - RNA, 13 nt, Bordetella pertussis
ucgcgcagggugg

SEQ ID NO: 404108 - RNA, 14 nt, Bordetella pertussis
ucgcugcgcggaaa

SEQ ID NO: 404109 - RNA, 15 nt, Bordetella pertussis
ucgcugcuggccgcg

SEQ ID NO: 404110 - RNA, 17 nt, Bordetella pertussis
ucgcugcuggcggcgcu

SEQ ID NO: 404111 - RNA, 13 nt, Bordetella pertussis
ucgcuggcagccu

SEQ ID NO: 404112 - RNA, 19 nt, Bordetella pertussis
ucgcuggugaagucggccc

SEQ ID NO: 404113 - RNA, 15 nt, Bordetella pertussis
ucggagcacggaaga

SEQ ID NO: 404114 - RNA, 18 nt, Bordetella pertussis
ucggagccaguccccgca

SEQ ID NO: 404115 - RNA, 15 nt, Bordetella pertussis
ucggagcccaguguc

SEQ ID NO: 404116 - RNA, 20 nt, Bordetella pertussis
ucggccacccggcccaugac

SEQ ID NO: 404117 - RNA, 23 nt, Bordetella pertussis
ucggccaccgccguggcauagaa

SEQ ID NO: 404118 - RNA, 13 nt, Bordetella pertussis
ucggccacgcccu

SEQ ID NO: 404119 - RNA, 14 nt, Bordetella pertussis
ucggccacgcugcc

SEQ ID NO: 404120 - RNA, 21 nt, Bordetella pertussis
ucggccacuuucgcgcgcgcc

SEQ ID NO: 404121 - RNA, 13 nt, Bordetella pertussis
ucggccagcagcg

SEQ ID NO: 404122 - RNA, 13 nt, Bordetella pertussis
ucggccagcagcu

SEQ ID NO: 404123 - RNA, 17 nt, Bordetella pertussis
ucggccagccccaccuu

SEQ ID NO: 404124 - RNA, 14 nt, Bordetella pertussis
ucggccagcggcag

SEQ ID NO: 404125 - RNA, 15 nt, Bordetella pertussis
ucggccagcgcgaag

SEQ ID NO: 404126 - RNA, 10 nt, Bordetella pertussis
ucggccagga

SEQ ID NO: 404127 - RNA, 15 nt, Bordetella pertussis
ucggccaggcgcugc

SEQ ID NO: 404128 - RNA, 13 nt, Bordetella pertussis
ucggccauggugc

SEQ ID NO: 404129 - RNA, 22 nt, Bordetella pertussis
ucggcccgcccgcccugggcag

SEQ ID NO: 404130 - RNA, 21 nt, Bordetella pertussis
ucggccgccagccggcccagc

SEQ ID NO: 404131 - RNA, 23 nt, Bordetella pertussis
ucggccggaugcgcaggacggcg

SEQ ID NO: 404132 - RNA, 21 nt, Bordetella pertussis
ucggccggcggucgcgcuggc

SEQ ID NO: 404133 - RNA, 16 nt, Bordetella pertussis
ucggccgucagcagca

SEQ ID NO: 404134 - RNA, 13 nt, Bordetella pertussis
ucggccucgccca

SEQ ID NO: 404135 - RNA, 22 nt, Bordetella pertussis
ucggccucgcgcagggcggccu

SEQ ID NO: 404136 - RNA, 16 nt, Bordetella pertussis
ucggccugcaccggcg

SEQ ID NO: 404137 - RNA, 15 nt, Bordetella pertussis
ucggccugccagccu

SEQ ID NO: 404138 - RNA, 14 nt, Bordetella pertussis
ucggccugccggcg

SEQ ID NO: 404139 - RNA, 16 nt, Bordetella pertussis
ucggccugcgccacca

SEQ ID NO: 404140 - RNA, 21 nt, Bordetella pertussis
ucggccugcggcucgaggaac

SEQ ID NO: 404141 - RNA, 23 nt, Bordetella pertussis
ucggccugcucgcaggccugcug

SEQ ID NO: 404142 - RNA, 18 nt, Bordetella pertussis
ucggccugcuggugcagc

SEQ ID NO: 404143 - RNA, 13 nt, Bordetella pertussis
ucggccuggcccc

SEQ ID NO: 404144 - RNA, 15 nt, Bordetella pertussis
ucggccuggcgcucc

SEQ ID NO: 404145 - RNA, 17 nt, Bordetella pertussis
ucggccuggcgcuccuc

SEQ ID NO: 404146 - RNA, 22 nt, Bordetella pertussis
ucggccugggcgcgaugggccu

SEQ ID NO: 404147 - RNA, 23 nt, Bordetella pertussis
ucggccuugccguuggucuuggg

SEQ ID NO: 404148 - RNA, 22 nt, Bordetella pertussis
ucggcgaagccuugcgcggcca

SEQ ID NO: 404149 - RNA, 22 nt, Bordetella pertussis
ucggcgacgacuacgcgcuggc

SEQ ID NO: 404150 - RNA, 16 nt, Bordetella pertussis
ucggcgagccgggcac

SEQ ID NO: 404151 - RNA, 18 nt, Bordetella pertussis
ucggcgaucugcgcggcg

SEQ ID NO: 404152 - RNA, 23 nt, Bordetella pertussis
ucggcgaucugcgcggcggugcc

SEQ ID NO: 404153 - RNA, 17 nt, Bordetella pertussis
ucggcgcaaccggcccg

SEQ ID NO: 404154 - RNA, 20 nt, Bordetella pertussis
ucggcgccaagcggcaggcg

SEQ ID NO: 404155 - RNA, 22 nt, Bordetella pertussis
ucggcgccacaggugcgcggcg

SEQ ID NO: 404156 - RNA, 17 nt, Bordetella pertussis
ucggcgccaugaccacg

SEQ ID NO: 404157 - RNA, 13 nt, Bordetella pertussis
ucggcgccaugau

SEQ ID NO: 404158 - RNA, 19 nt, Bordetella pertussis
ucggcgccgggcgacggcg

SEQ ID NO: 404159 - RNA, 14 nt, Bordetella pertussis
ucggcgccuggccg

SEQ ID NO: 404160 - RNA, 14 nt, Bordetella pertussis
ucggcgcgcgugcc

SEQ ID NO: 404161 - RNA, 15 nt, Bordetella pertussis
ucggcgcgcucggcg

SEQ ID NO: 404162 - RNA, 14 nt, Bordetella pertussis
ucggcgcgcgcugc

SEQ ID NO: 404163 - RNA, 13 nt, Bordetella pertussis
ucggcgcggcgcc

SEQ ID NO: 404164 - RNA, 20 nt, Bordetella pertussis
ucggcgcggcgggcgcuggc

SEQ ID NO: 404165 - RNA, 23 nt, Bordetella pertussis
ucggcggcgagcuggcccugggc

SEQ ID NO: 404166 - RNA, 15 nt, Bordetella pertussis
ucggcgggcggcgcc

SEQ ID NO: 404167 - RNA, 20 nt, Bordetella pertussis
ucggcggguuucucggccuu

SEQ ID NO: 404168 - RNA, 13 nt, Bordetella pertussis
ucggcgugcagca

SEQ ID NO: 404169 - RNA, 17 nt, Bordetella pertussis
ucggcguuccuggcgcu

SEQ ID NO: 404170 - RNA, 17 nt, Bordetella pertussis
ucggcguugugccggcg

SEQ ID NO: 404171 - RNA, 22 nt, Bordetella pertussis
ucggcucggugaugauggccag

SEQ ID NO: 404172 - RNA, 22 nt, Bordetella pertussis
ucggcuggcgcaagacgcggca

SEQ ID NO: 404173 - RNA, 17 nt, Bordetella pertussis
ucggcuuccugccgcac

SEQ ID NO: 404174 - RNA, 16 nt, Bordetella pertussis
ucggcuuuuuugcguu

SEQ ID NO: 404175 - RNA, 18 nt, Bordetella pertussis
ucgggaaugaugcagcug

SEQ ID NO: 404176 - RNA, 20 nt, Bordetella pertussis
ucgggauaccgcuggccagg

SEQ ID NO: 404177 - RNA, 21 nt, Bordetella pertussis
ucgggauaccgcuggccaggc

SEQ ID NO: 404178 - RNA, 18 nt, Bordetella pertussis
ucgggauaguccagcacc

SEQ ID NO: 404179 - RNA, 19 nt, Bordetella pertussis
ucgggcacgaucaccgccg

SEQ ID NO: 404180 - RNA, 19 nt, Bordetella pertussis
ucgggcagcacgcgcacca

SEQ ID NO: 404181 - RNA, 12 nt, Bordetella pertussis
ucgggcagcgcc

SEQ ID NO: 404182 - RNA, 19 nt, Bordetella pertussis
ucgggcagcuuggcgcgcc

SEQ ID NO: 404183 - RNA, 18 nt, Bordetella pertussis
ucgggcaugucgcggccc

SEQ ID NO: 404184 - RNA, 18 nt, Bordetella pertussis
ucgggccggcggcagccg

SEQ ID NO: 404185 - RNA, 14 nt, Bordetella pertussis
ucgggccggcugcc

SEQ ID NO: 404186 - RNA, 18 nt, Bordetella pertussis
ucgggcgacuccagcccg

SEQ ID NO: 404187 - RNA, 12 nt, Bordetella pertussis
ucgggcggcgcc

SEQ ID NO: 404188 - RNA, 13 nt, Bordetella pertussis
ucggggccaagau

SEQ ID NO: 404189 - RNA, 17 nt, Bordetella pertussis
ucggggccgggccggcg

SEQ ID NO: 404190 - RNA, 19 nt, Bordetella pertussis
ucggggucggccaccacca

SEQ ID NO: 404191 - RNA, 13 nt, Bordetella pertussis
ucggggugcagcu

SEQ ID NO: 404192 - RNA, 18 nt, Bordetella pertussis
ucgggguuccacagcgcc

SEQ ID NO: 404193 - RNA, 14 nt, Bordetella pertussis
ucggguagcugcug

SEQ ID NO: 404194 - RNA, 16 nt, Bordetella pertussis
ucgggugcugcggguc

SEQ ID NO: 404195 - RNA, 16 nt, Bordetella pertussis
ucggguuucuugcugc

SEQ ID NO: 404196 - RNA, 18 nt, Bordetella pertussis
ucggguugcaaauucugc

SEQ ID NO: 404197 - RNA, 15 nt, Bordetella pertussis
ucggucagcgcggcg

SEQ ID NO: 404198 - RNA, 21 nt, Bordetella pertussis
ucggucagggcgaagcgcgcc

SEQ ID NO: 404199 - RNA, 18 nt, Bordetella pertussis
ucggucauguccagcgcc

SEQ ID NO: 404200 - RNA, 16 nt, Bordetella pertussis
ucggucgcuuccagcg

SEQ ID NO: 404201 - RNA, 17 nt, Bordetella pertussis
ucggugaugauccugcu

SEQ ID NO: 404202 - RNA, 19 nt, Bordetella pertussis
ucggugaugauggccaggu

SEQ ID NO: 404203 - RNA, 15 nt, Bordetella pertussis
ucggugcagcccagc

SEQ ID NO: 404204 - RNA, 21 nt, Bordetella pertussis
ucggugccguccagcgcggcg

SEQ ID NO: 404205 - RNA, 14 nt, Bordetella pertussis
ucggugccuguccc

SEQ ID NO: 404206 - RNA, 12 nt, Bordetella pertussis
ucggugcugcug

SEQ ID NO: 404207 - RNA, 12 nt, Bordetella pertussis
ucgguggccagc

SEQ ID NO: 404208 - RNA, 14 nt, Bordetella pertussis
ucguacagccugcc

SEQ ID NO: 404209 - RNA, 17 nt, Bordetella pertussis
ucguacaugucgaggua

SEQ ID NO: 404210 - RNA, 14 nt, Bordetella pertussis
ucguacgaagcaua

SEQ ID NO: 404211 - RNA, 21 nt, Bordetella pertussis
ucguacgagccgacgcuccag

SEQ ID NO: 404212 - RNA, 22 nt, Bordetella pertussis
ucguauggcggggugccugucc

SEQ ID NO: 404213 - RNA, 16 nt, Bordetella pertussis
ucguauugcugcugcu

SEQ ID NO: 404214 - RNA, 12 nt, Bordetella pertussis
ucguccagcacg

SEQ ID NO: 404215 - RNA, 16 nt, Bordetella pertussis
ucguccagcgucaugc

SEQ ID NO: 404216 - RNA, 23 nt, Bordetella pertussis
ucguccaucgccugcacgaccug

SEQ ID NO: 404217 - RNA, 15 nt, Bordetella pertussis
ucgucccagcgcacg

SEQ ID NO: 404218 - RNA, 15 nt, Bordetella pertussis
ucguccgcuucgucg

SEQ ID NO: 404219 - RNA, 21 nt, Bordetella pertussis
ucguccgcuucgucgggcagc

SEQ ID NO: 404220 - RNA, 21 nt, Bordetella pertussis
ucguccguccuggccacugcc

SEQ ID NO: 404221 - RNA, 20 nt, Bordetella pertussis
ucgucgccaugcggcuggcc

SEQ ID NO: 404222 - RNA, 14 nt, Bordetella pertussis
ucgucgccggcguu

SEQ ID NO: 404223 - RNA, 18 nt, Bordetella pertussis
ucgucgccucccauugcg

SEQ ID NO: 404224 - RNA, 23 nt, Bordetella pertussis
ucgucgcgcugcgacagcagcau

SEQ ID NO: 404225 - RNA, 20 nt, Bordetella pertussis
ucgucgcgcuggccccagau

SEQ ID NO: 404226 - RNA, 15 nt, Bordetella pertussis
ucgucggccacgccc

SEQ ID NO: 404227 - RNA, 18 nt, Bordetella pertussis
ucgucggccaugcgcgcc

SEQ ID NO: 404228 - RNA, 20 nt, Bordetella pertussis
ucgucggcgcgcgccaggcc

SEQ ID NO: 404229 - RNA, 14 nt, Bordetella pertussis
ucgucggcgcugca

SEQ ID NO: 404230 - RNA, 18 nt, Bordetella pertussis
ucgucguagcgccagcgu

SEQ ID NO: 404231 - RNA, 16 nt, Bordetella pertussis
ucguucaagcguugcc

SEQ ID NO: 404232 - RNA, 12 nt, Bordetella pertussis
ucguuccagaac

SEQ ID NO: 404233 - RNA, 13 nt, Bordetella pertussis
ucguuccagaugc

SEQ ID NO: 404234 - RNA, 13 nt, Bordetella pertussis
ucguucgcgcgcg

SEQ ID NO: 404235 - RNA, 20 nt, Bordetella pertussis
ucguucguauugcugcugcu

SEQ ID NO: 404236 - RNA, 14 nt, Bordetella pertussis
ucguucugcgcgcc

SEQ ID NO: 404237 - RNA, 12 nt, Bordetella pertussis
ucguuucccagc

SEQ ID NO: 404238 - RNA, 15 nt, Bordetella pertussis
ucguuucccagcaag

SEQ ID NO: 404239 - RNA, 22 nt, Bordetella pertussis
ucuccagcgcgucggccaggcg

SEQ ID NO: 404240 - RNA, 23 nt, Bordetella pertussis
ucuccaggcucaggcggccaggg

SEQ ID NO: 404241 - RNA, 23 nt, Bordetella pertussis
ucuccgccucuucgaugaugagc

SEQ ID NO: 404242 - RNA, 17 nt, Bordetella pertussis
ucuccggcgccuggccg

SEQ ID NO: 404243 - RNA, 16 nt, Bordetella pertussis
ucuccgggagccuguc

SEQ ID NO: 404244 - RNA, 23 nt, Bordetella pertussis
ucucggccacggucggcacgucg

SEQ ID NO: 404245 - RNA, 15 nt, Bordetella pertussis
ucucggcgcccgcgg

SEQ ID NO: 404246 - RNA, 21 nt, Bordetella pertussis
ucucgggauaggccucggcca

SEQ ID NO: 404247 - RNA, 21 nt, Bordetella pertussis
ucucgggcaggucggccagcg

SEQ ID NO: 404248 - RNA, 22 nt, Bordetella pertussis
ucucggugcgccgccgccgcgg

SEQ ID NO: 404249 - RNA, 22 nt, Bordetella pertussis
ucucgguggaggacgccgaccu

SEQ ID NO: 404250 - RNA, 16 nt, Bordetella pertussis
ucugcaaggccugcug

SEQ ID NO: 404251 - RNA, 18 nt, Bordetella pertussis
ucugcaccggcgccacgg

SEQ ID NO: 404252 - RNA, 19 nt, Bordetella pertussis
ucugcacccccuuggcuuc

SEQ ID NO: 404253 - RNA, 14 nt, Bordetella pertussis
ucugcgccugcugg

SEQ ID NO: 404254 - RNA, 14 nt, Bordetella pertussis
ucugcgugccggag

SEQ ID NO: 404255 - RNA, 20 nt, Bordetella pertussis
ucugcgugugccgccagcgg

SEQ ID NO: 404256 - RNA, 24 nt, Bordetella pertussis
ucugcuacaccgugcuggccgacg

SEQ ID NO: 404257 - RNA, 11 nt, Bordetella pertussis
ucugcuggcuc

SEQ ID NO: 404258 - RNA, 13 nt, Bordetella pertussis
ucuggcggcagcu

SEQ ID NO: 404259 - RNA, 23 nt, Bordetella pertussis
ucugguggcgauccauguggcca

SEQ ID NO: 404260 - RNA, 16 nt, Bordetella pertussis
ucugguugagcagcac

SEQ ID NO: 404261 - RNA, 15 nt, Bordetella pertussis
ucuguccccgcgggg

SEQ ID NO: 404262 - RNA, 13 nt, Bordetella pertussis
ucuucagcaccag

SEQ ID NO: 404263 - RNA, 19 nt, Bordetella pertussis
ucuucagcaccagcuccuc

SEQ ID NO: 404264 - RNA, 21 nt, Bordetella pertussis
ucuucagcauggagcuggggc

SEQ ID NO: 404265 - RNA, 13 nt, Bordetella pertussis
ucuuggccuguuc

SEQ ID NO: 404266 - RNA, 17 nt, Bordetella pertussis
ucuuggcgaccaggccc

SEQ ID NO: 404267 - RNA, 21 nt, Bordetella pertussis
ucuugugcaucucgaagcgcu

SEQ ID NO: 404268 - RNA, 13 nt, Bordetella pertussis
ucuuugcccuggc

SEQ ID NO: 404269 - RNA, 13 nt, Bordetella pertussis
ucuuuggccgcgc

SEQ ID NO: 404270 - RNA, 15 nt, Bordetella pertussis
ucuuuuuacaggcag

SEQ ID NO: 404271 - RNA, 23 nt, Bordetella pertussis
ugaaacagcaucagcggcagcac

SEQ ID NO: 404272 - RNA, 14 nt, Bordetella pertussis
ugaaacugcaaaau

SEQ ID NO: 404273 - RNA, 18 nt, Bordetella pertussis
ugaaaucgacguggcugg

SEQ ID NO: 404274 - RNA, 17 nt, Bordetella pertussis
ugaacaagguacccgcg

SEQ ID NO: 404275 - RNA, 18 nt, Bordetella pertussis
ugaacaccccggucagca

SEQ ID NO: 404276 - RNA, 20 nt, Bordetella pertussis
ugaacaccccggucagcagg

SEQ ID NO: 404277 - RNA, 22 nt, Bordetella pertussis
ugaacaccggcgcgccuggcgc

SEQ ID NO: 404278 - RNA, 18 nt, Bordetella pertussis
ugaacagcgagaagcaac

SEQ ID NO: 404279 - RNA, 20 nt, Bordetella pertussis
ugaacagcuggaagcgcgcc

SEQ ID NO: 404280 - RNA, 21 nt, Bordetella pertussis
ugaacaguucgcccauuuccg

SEQ ID NO: 404281 - RNA, 19 nt, Bordetella pertussis
ugaaccaggccgccagggc

SEQ ID NO: 404282 - RNA, 20 nt, Bordetella pertussis
ugaaccgcagcgccaccggc

SEQ ID NO: 404283 - RNA, 18 nt, Bordetella pertussis
ugaacgccaccaggccga

SEQ ID NO: 404284 - RNA, 15 nt, Bordetella pertussis
ugaacgccgcgcccg

SEQ ID NO: 404285 - RNA, 20 nt, Bordetella pertussis
ugaacgcgcauucgucgcug

SEQ ID NO: 404286 - RNA, 21 nt, Bordetella pertussis
ugaacgcuugacggccaggac

SEQ ID NO: 404287 - RNA, 22 nt, Bordetella pertussis
ugaacugcaggccgccggccuc

SEQ ID NO: 404288 - RNA, 15 nt, Bordetella pertussis
ugaacugcuggaaca

SEQ ID NO: 404289 - RNA, 20 nt, Bordetella pertussis
ugaagcguucggccuugcca

SEQ ID NO: 404290 - RNA, 15 nt, Bordetella pertussis
ugaagcugcccagca

SEQ ID NO: 404291 - RNA, 21 nt, Bordetella pertussis
ugaaggccacgcgggcguggu

SEQ ID NO: 404292 - RNA, 17 nt, Bordetella pertussis
ugaaggccgaggccagg

SEQ ID NO: 404293 - RNA, 19 nt, Bordetella pertussis
ugaaggcgcccgggcugcc

SEQ ID NO: 404294 - RNA, 19 nt, Bordetella pertussis
ugaagggcugcaaggcagc

SEQ ID NO: 404295 - RNA, 16 nt, Bordetella pertussis
ugaagggcuggccggc

SEQ ID NO: 404296 - RNA, 23 nt, Bordetella pertussis
ugaagggcuggccggccaacagc

SEQ ID NO: 404297 - RNA, 20 nt, Bordetella pertussis
ugaauccggggugccugucc

SEQ ID NO: 404298 - RNA, 18 nt, Bordetella pertussis
ugacaucgccgcugcgca

SEQ ID NO: 404299 - RNA, 12 nt, Bordetella pertussis
ugacaugcacga

SEQ ID NO: 404300 - RNA, 12 nt, Bordetella pertussis
ugaccagcacca

SEQ ID NO: 404301 - RNA, 18 nt, Bordetella pertussis
ugaccagcaccagcgccu

SEQ ID NO: 404302 - RNA, 22 nt, Bordetella pertussis
ugaccagcacgauggucagcgg

SEQ ID NO: 404303 - RNA, 15 nt, Bordetella pertussis
ugaccagcagcaccg

SEQ ID NO: 404304 - RNA, 12 nt, Bordetella pertussis
ugaccagcagcg

SEQ ID NO: 404305 - RNA, 15 nt, Bordetella pertussis
ugaccagcagcgccg

SEQ ID NO: 404306 - RNA, 18 nt, Bordetella pertussis
ugaccagcagcgccgggg

SEQ ID NO: 404307 - RNA, 21 nt, Bordetella pertussis
ugaccagcugcaccaggcuuu

SEQ ID NO: 404308 - RNA, 18 nt, Bordetella pertussis
ugaccagggcgccgaccg

SEQ ID NO: 404309 - RNA, 21 nt, Bordetella pertussis
ugacccugcgcacccgccugg

SEQ ID NO: 404310 - RNA, 15 nt, Bordetella pertussis
ugaccgaagcgcggg

SEQ ID NO: 404311 - RNA, 14 nt, Bordetella pertussis
ugaccgacaggccu

SEQ ID NO: 404312 - RNA, 16 nt, Bordetella pertussis
ugaccgacaggccugg

SEQ ID NO: 404313 - RNA, 14 nt, Bordetella pertussis
ugaccgagcccggc

SEQ ID NO: 404314 - RNA, 20 nt, Bordetella pertussis
ugaccgagcccggcaccaug

SEQ ID NO: 404315 - RNA, 15 nt, Bordetella pertussis
ugaccgcaugcugca

SEQ ID NO: 404316 - RNA, 21 nt, Bordetella pertussis
ugaccgcaugcugcagcugcu

SEQ ID NO: 404317 - RNA, 21 nt, Bordetella pertussis
ugaccgccucgaugcccucgc

SEQ ID NO: 404318 - RNA, 17 nt, Bordetella pertussis
ugaccgccuccaggaug

SEQ ID NO: 404319 - RNA, 19 nt, Bordetella pertussis
ugaccgcguccgcgacgcu

SEQ ID NO: 404320 - RNA, 18 nt, Bordetella pertussis
ugaccugcgacagcaccg

SEQ ID NO: 404321 - RNA, 14 nt, Bordetella pertussis
ugaccugggccagc

SEQ ID NO: 404322 - RNA, 20 nt, Bordetella pertussis
ugacgaccuugcggccgcgc

SEQ ID NO: 404323 - RNA, 23 nt, Bordetella pertussis
ugacgaccuugcggccgcgcacc

SEQ ID NO: 404324 - RNA, 22 nt, Bordetella pertussis
ugacgacgcguuguucgggccg

SEQ ID NO: 404325 - RNA, 21 nt, Bordetella pertussis
ugacgccgccgaacggggccg

SEQ ID NO: 404326 - RNA, 19 nt, Bordetella pertussis
ugacgccggcggcgugcgc

SEQ ID NO: 404327 - RNA, 23 nt, Bordetella pertussis
ugacgcgcgcggugucgccgccg

SEQ ID NO: 404328 - RNA, 17 nt, Bordetella pertussis
ugacgcgcggguccagg

SEQ ID NO: 404329 - RNA, 22 nt, Bordetella pertussis
ugacggcuucgaccacgcggcg

SEQ ID NO: 404330 - RNA, 13 nt, Bordetella pertussis
ugacgggcugggc

SEQ ID NO: 404331 - RNA, 19 nt, Bordetella pertussis
ugacgggcugggccgaggc

SEQ ID NO: 404332 - RNA, 13 nt, Bordetella pertussis
ugacggggcggcg

SEQ ID NO: 404333 - RNA, 19 nt, Bordetella pertussis
ugacggggucggggcaggc

SEQ ID NO: 404334 - RNA, 22 nt, Bordetella pertussis
ugacggggucggggcaggccug

SEQ ID NO: 404335 - RNA, 16 nt, Bordetella pertussis
ugacguccagcgccac

SEQ ID NO: 404336 - RNA, 21 nt, Bordetella pertussis
ugacguccagcgccaccagca

SEQ ID NO: 404337 - RNA, 21 nt, Bordetella pertussis
ugacguggcaguccucguugc

SEQ ID NO: 404338 - RNA, 18 nt, Bordetella pertussis
ugagcaagcgcuggaugg

SEQ ID NO: 404339 - RNA, 13 nt, Bordetella pertussis
ugagcaggccggg

SEQ ID NO: 404340 - RNA, 16 nt, Bordetella pertussis
ugagcaggccgggucg

SEQ ID NO: 404341 - RNA, 14 nt, Bordetella pertussis
ugagcaggcgcugg

SEQ ID NO: 404342 - RNA, 18 nt, Bordetella pertussis
ugagucuggagaugggua

SEQ ID NO: 404343 - RNA, 19 nt, Bordetella pertussis
ugaguucuggcaucagggc

SEQ ID NO: 404344 - RNA, 21 nt, Bordetella pertussis
ugauacguucagauacaaaau

SEQ ID NO: 404345 - RNA, 23 nt, Bordetella pertussis
ugauagcacugcaccugcuccag

SEQ ID NO: 404346 - RNA, 16 nt, Bordetella pertussis
ugaucaccaaacacca

SEQ ID NO: 404347 - RNA, 21 nt, Bordetella pertussis
ugaucacccacagcagcgcgc

SEQ ID NO: 404348 - RNA, 20 nt, Bordetella pertussis
ugaucagggccacggcgcuu

SEQ ID NO: 404349 - RNA, 12 nt, Bordetella pertussis
ugaucaggucca

SEQ ID NO: 404350 - RNA, 15 nt, Bordetella pertussis
ugaucaugaugauga

SEQ ID NO: 404351 - RNA, 15 nt, Bordetella pertussis
ugaucucgcgcaccg

SEQ ID NO: 404352 - RNA, 21 nt, Bordetella pertussis
ugaucugcauguacucggcca

SEQ ID NO: 404353 - RNA, 18 nt, Bordetella pertussis
ugaucugcuugaggccgc

SEQ ID NO: 404354 - RNA, 11 nt, Bordetella pertussis
ugaugcccagc

SEQ ID NO: 404355 - RNA, 19 nt, Bordetella pertussis
ugaugcccagcucauggca

SEQ ID NO: 404356 - RNA, 14 nt, Bordetella pertussis
ugaugcccaggauc

SEQ ID NO: 404357 - RNA, 10 nt, Bordetella pertussis
ugaugauggc

SEQ ID NO: 404358 - RNA, 16 nt, Bordetella pertussis
ugaugccgaccaggcc

SEQ ID NO: 404359 - RNA, 13 nt, Bordetella pertussis
ugaugccgcccag

SEQ ID NO: 404360 - RNA, 22 nt, Bordetella pertussis
ugaugccgccgaaccagcgcac

SEQ ID NO: 404361 - RNA, 17 nt, Bordetella pertussis
ugaugccgccggcgggc

SEQ ID NO: 404362 - RNA, 19 nt, Bordetella pertussis
ugaugccgucgagcgcggc

SEQ ID NO: 404363 - RNA, 17 nt, Bordetella pertussis
ugauuccgcuggcgauc

SEQ ID NO: 404364 - RNA, 20 nt, Bordetella pertussis
ugcaacacgaccagcaggcc

SEQ ID NO: 404365 - RNA, 19 nt, Bordetella pertussis
ugcaacuccacgcccugca

SEQ ID NO: 404366 - RNA, 17 nt, Bordetella pertussis
ugcaagacaggccgcua

SEQ ID NO: 404367 - RNA, 16 nt, Bordetella pertussis
ugcaauucgccgaugc

SEQ ID NO: 404368 - RNA, 16 nt, Bordetella pertussis
ugcaccacgcgcucca

SEQ ID NO: 404369 - RNA, 12 nt, Bordetella pertussis
ugcaccagcaca

SEQ ID NO: 404370 - RNA, 15 nt, Bordetella pertussis
ugcaccagcgcgccg

SEQ ID NO: 404371 - RNA, 21 nt, Bordetella pertussis
ugcaccaguuuucucauggcc

SEQ ID NO: 404372 - RNA, 21 nt, Bordetella pertussis
ugcaccugcagggucagcccg

SEQ ID NO: 404373 - RNA, 16 nt, Bordetella pertussis
ugcaccugccugccgc

SEQ ID NO: 404374 - RNA, 20 nt, Bordetella pertussis
ugcaccugcgucugcacgcu

SEQ ID NO: 404375 - RNA, 14 nt, Bordetella pertussis
ugcaccugcuccag

SEQ ID NO: 404376 - RNA, 12 nt, Bordetella pertussis
ugcacgccggcc

SEQ ID NO: 404377 - RNA, 21 nt, Bordetella pertussis
ugcacgccgggcgcgcugccc

SEQ ID NO: 404378 - RNA, 16 nt, Bordetella pertussis
ugcaguucggccgcca

SEQ ID NO: 404379 - RNA, 15 nt, Bordetella pertussis
ugcauacccauggcc

SEQ ID NO: 404380 - RNA, 14 nt, Bordetella pertussis
ugcaucgccaugcc

SEQ ID NO: 404381 - RNA, 15 nt, Bordetella pertussis
ugcaucggccggcgg

SEQ ID NO: 404382 - RNA, 14 nt, Bordetella pertussis
ugcaucuccaggau

SEQ ID NO: 404383 - RNA, 22 nt, Bordetella pertussis
ugcaucucgaagcgcucguccu

SEQ ID NO: 404384 - RNA, 15 nt, Bordetella pertussis
ugcaugacggccagg

SEQ ID NO: 404385 - RNA, 16 nt, Bordetella pertussis
ugcaugacggccagga

SEQ ID NO: 404386 - RNA, 18 nt, Bordetella pertussis
ugcaugcgcacggacagc

SEQ ID NO: 404387 - RNA, 15 nt, Bordetella pertussis
ugcaugggagaguuc

SEQ ID NO: 404388 - RNA, 15 nt, Bordetella pertussis
ugcauguccugcagg

SEQ ID NO: 404389 - RNA, 11 nt, Bordetella pertussis
ugcauguccag

SEQ ID NO: 404390 - RNA, 15 nt, Bordetella pertussis
ugccacggcgggccg

SEQ ID NO: 404391 - RNA, 19 nt, Bordetella pertussis
ugccagacggccagcgcgc

SEQ ID NO: 404392 - RNA, 21 nt, Bordetella pertussis
ugccagauuaagacagauguc

SEQ ID NO: 404393 - RNA, 20 nt, Bordetella pertussis
ugccagcccccugcgggguc

SEQ ID NO: 404394 - RNA, 15 nt, Bordetella pertussis
ugccagccugccaca

SEQ ID NO: 404395 - RNA, 18 nt, Bordetella pertussis
ugccaggcgccgcguccg

SEQ ID NO: 404396 - RNA, 22 nt, Bordetella pertussis
ugccauccagccaggccgcaua

SEQ ID NO: 404397 - RNA, 18 nt, Bordetella pertussis
ugccaucgauaugggcgg

SEQ ID NO: 404398 - RNA, 16 nt, Bordetella pertussis
ugccauggccgcgcgg

SEQ ID NO: 404399 - RNA, 20 nt, Bordetella pertussis
ugccauggccgcgcggcgcc

SEQ ID NO: 404400 - RNA, 21 nt, Bordetella pertussis
ugccauggccgcgcggcgccu

SEQ ID NO: 404401 - RNA, 20 nt, Bordetella pertussis
ugccauuccagcuccggcgg

SEQ ID NO: 404402 - RNA, 17 nt, Bordetella pertussis
ugccauugcgcggccug

SEQ ID NO: 404403 - RNA, 21 nt, Bordetella pertussis
ugccauucgguggucugccag

SEQ ID NO: 404404 - RNA, 17 nt, Bordetella pertussis
ugccccacacgcgcgca

SEQ ID NO: 404405 - RNA, 13 nt, Bordetella pertussis
ugccccagguccg

SEQ ID NO: 404406 - RNA, 19 nt, Bordetella pertussis
ugccccagguccgccggca

SEQ ID NO: 404407 - RNA, 15 nt, Bordetella pertussis
ugccccaucccaucc

SEQ ID NO: 404408 - RNA, 21 nt, Bordetella pertussis
ugccccauuuuuuugccugcu

SEQ ID NO: 404409 - RNA, 21 nt, Bordetella pertussis
ugcccccacgcugcgcccgcu

SEQ ID NO: 404410 - RNA, 22 nt, Bordetella pertussis
ugcccccacgcugcgcccgcua

SEQ ID NO: 404411 - RNA, 16 nt, Bordetella pertussis
ugccccccgagggggc

SEQ ID NO: 404412 - RNA, 19 nt, Bordetella pertussis
ugcccgaagcgcagcacca

SEQ ID NO: 404413 - RNA, 22 nt, Bordetella pertussis
ugcccgaagcggcccggguggg

SEQ ID NO: 404414 - RNA, 16 nt, Bordetella pertussis
ugcccgaaggcagcgg

SEQ ID NO: 404415 - RNA, 22 nt, Bordetella pertussis
ugcccgaaggcagcggcacauc

SEQ ID NO: 404416 - RNA, 23 nt, Bordetella pertussis
ugcccgagcgcgacagcaccaac

SEQ ID NO: 404417 - RNA, 18 nt, Bordetella pertussis
ugcccgcgguccagcacg

SEQ ID NO: 404418 - RNA, 19 nt, Bordetella pertussis
ugcccgcggucgagacgau

SEQ ID NO: 404419 - RNA, 13 nt, Bordetella pertussis
ugcccggcaggca

SEQ ID NO: 404420 - RNA, 14 nt, Bordetella pertussis
ugcccggcaggcac

SEQ ID NO: 404421 - RNA, 15 nt, Bordetella pertussis
ugcccggcaggcaca

SEQ ID NO: 404422 - RNA, 22 nt, Bordetella pertussis
ugcccguuggcgucgagcaccg

SEQ ID NO: 404423 - RNA, 18 nt, Bordetella pertussis
ugcccuccucggccaggu

SEQ ID NO: 404424 - RNA, 17 nt, Bordetella pertussis
ugcccugcgccagcgcc

SEQ ID NO: 404425 - RNA, 18 nt, Bordetella pertussis
ugcccugcgccagcgccu

SEQ ID NO: 404426 - RNA, 19 nt, Bordetella pertussis
ugcccugcgccagcgccuc

SEQ ID NO: 404427 - RNA, 14 nt, Bordetella pertussis
ugcccugcggaccc

SEQ ID NO: 404428 - RNA, 18 nt, Bordetella pertussis
ugcccugcggcgcggcca

SEQ ID NO: 404429 - RNA, 14 nt, Bordetella pertussis
ugcccugcugcugc

SEQ ID NO: 404430 - RNA, 12 nt, Bordetella pertussis
ugcccuggccac

SEQ ID NO: 404431 - RNA, 21 nt, Bordetella pertussis
ugcccuggccacgcugcugcc

SEQ ID NO: 404432 - RNA, 15 nt, Bordetella pertussis
ugcccuggcccaggc

SEQ ID NO: 404433 - RNA, 16 nt, Bordetella pertussis
ugcccuggcccaggcc

SEQ ID NO: 404434 - RNA, 20 nt, Bordetella pertussis
ugcccuggaucaggaugggc

SEQ ID NO: 404435 - RNA, 19 nt, Bordetella pertussis
ugccgauacgggcgcggcg

SEQ ID NO: 404436 - RNA, 13 nt, Bordetella pertussis
ugccgaucagcgg

SEQ ID NO: 404437 - RNA, 16 nt, Bordetella pertussis
ugccgauccagcgccu

SEQ ID NO: 404438 - RNA, 18 nt, Bordetella pertussis
ugccgcacgaucgcgccg

SEQ ID NO: 404439 - RNA, 21 nt, Bordetella pertussis
ugccgcacgaucgcgccggcc

SEQ ID NO: 404440 - RNA, 22 nt, Bordetella pertussis
ugccgcacgaucgcgccggccu

SEQ ID NO: 404441 - RNA, 17 nt, Bordetella pertussis
ugccgcagauggccagc

SEQ ID NO: 404442 - RNA, 21 nt, Bordetella pertussis
ugccgcagauggccagcagcg

SEQ ID NO: 404443 - RNA, 18 nt, Bordetella pertussis
ugccgcagcccgcgcgcc

SEQ ID NO: 404444 - RNA, 16 nt, Bordetella pertussis
ugccgcagcggggaca

SEQ ID NO: 404445 - RNA, 12 nt, Bordetella pertussis
ugccgcaggcca

SEQ ID NO: 404446 - RNA, 15 nt, Bordetella pertussis
ugccgcaggccagcc

SEQ ID NO: 404447 - RNA, 19 nt, Bordetella pertussis
ugccgcaucccgcccccgc

SEQ ID NO: 404448 - RNA, 16 nt, Bordetella pertussis
ugccgcccgcaaggac

SEQ ID NO: 404449 - RNA, 15 nt, Bordetella pertussis
ugccgccgaaccagc

SEQ ID NO: 404450 - RNA, 15 nt, Bordetella pertussis
ugccgccgagcaggg

SEQ ID NO: 404451 - RNA, 16 nt, Bordetella pertussis
ugccgccuggccagau

SEQ ID NO: 404452 - RNA, 23 nt, Bordetella pertussis
ugccgcgaggcgcaggccgacgc

SEQ ID NO: 404453 - RNA, 21 nt, Bordetella pertussis
ugccgcgcauuugccgcggcg

SEQ ID NO: 404454 - RNA, 13 nt, Bordetella pertussis
ugccgcgcccggc

SEQ ID NO: 404455 - RNA, 13 nt, Bordetella pertussis
ugccgcgccgacc

SEQ ID NO: 404456 - RNA, 18 nt, Bordetella pertussis
ugccgcgcgcaccggcuu

SEQ ID NO: 404457 - RNA, 11 nt, Bordetella pertussis
ugccgcgcgcg

SEQ ID NO: 404458 - RNA, 15 nt, Bordetella pertussis
ugccgcgcgcggccg

SEQ ID NO: 404459 - RNA, 22 nt, Bordetella pertussis
ugccgcgcggcgcguucagcag

SEQ ID NO: 404460 - RNA, 23 nt, Bordetella pertussis
ugccgcgcggcgcguucagcagc

SEQ ID NO: 404461 - RNA, 16 nt, Bordetella pertussis
ugccgcggcaugcugg

SEQ ID NO: 404462 - RNA, 14 nt, Bordetella pertussis
ugccgcggccgccc

SEQ ID NO: 404463 - RNA, 17 nt, Bordetella pertussis
ugccgcggccgccccca

SEQ ID NO: 404464 - RNA, 21 nt, Bordetella pertussis
ugccgcggccgcccccagcgc

SEQ ID NO: 404465 - RNA, 12 nt, Bordetella pertussis
ugccgcggcgcg

SEQ ID NO: 404466 - RNA, 16 nt, Bordetella pertussis
ugccgcggcgcggccu

SEQ ID NO: 404467 - RNA, 18 nt, Bordetella pertussis
ugccgcgcguacgcggcg

SEQ ID NO: 404468 - RNA, 21 nt, Bordetella pertussis
ugccgcgggcggcgccggccg

SEQ ID NO: 404469 - RNA, 21 nt, Bordetella pertussis
ugccgcgucccgugccggccg

SEQ ID NO: 404470 - RNA, 17 nt, Bordetella pertussis
ugccgcgugcccgcguc

SEQ ID NO: 404471 - RNA, 14 nt, Bordetella pertussis
ugccgcugaccagc

SEQ ID NO: 404472 - RNA, 19 nt, Bordetella pertussis
ugccgcugcaggcccugga

SEQ ID NO: 404473 - RNA, 17 nt, Bordetella pertussis
ugccgcugcccaccuuc

SEQ ID NO: 404474 - RNA, 17 nt, Bordetella pertussis
ugccgcuggacgcgccg

SEQ ID NO: 404475 - RNA, 19 nt, Bordetella pertussis
ugccgcuggcgauggccug

SEQ ID NO: 404476 - RNA, 19 nt, Bordetella pertussis
ugccgcuggugaucugcug

SEQ ID NO: 404477 - RNA, 17 nt, Bordetella pertussis
ugccgcuggugcugaga

SEQ ID NO: 404478 - RNA, 16 nt, Bordetella pertussis
ugccgcuucaggaaca

SEQ ID NO: 404479 - RNA, 13 nt, Bordetella pertussis
ugccggaaaucac

SEQ ID NO: 404480 - RNA, 21 nt, Bordetella pertussis
ugccggccgcccaggcgcagc

SEQ ID NO: 404481 - RNA, 22 nt, Bordetella pertussis
ugccggccgcccaggcgcagcc

SEQ ID NO: 404482 - RNA, 15 nt, Bordetella pertussis
ugccggccggaccgc

SEQ ID NO: 404483 - RNA, 18 nt, Bordetella pertussis
ugccggccuggcgggccg

SEQ ID NO: 404484 - RNA, 19 nt, Bordetella pertussis
ugccggcgaugaugggguc

SEQ ID NO: 404485 - RNA, 15 nt, Bordetella pertussis
ugccggcgcaggaag

SEQ ID NO: 404486 - RNA, 16 nt, Bordetella pertussis
ugccgggauccacgcc

SEQ ID NO: 404487 - RNA, 20 nt, Bordetella pertussis
ugccgggauccacgccgccg

SEQ ID NO: 404488 - RNA, 13 nt, Bordetella pertussis
ugccgggccuggu

SEQ ID NO: 404489 - RNA, 15 nt, Bordetella pertussis
ugccgggccuggugc

SEQ ID NO: 404490 - RNA, 18 nt, Bordetella pertussis
ugccggucuccagcgcgu

SEQ ID NO: 404491 - RNA, 13 nt, Bordetella pertussis
ugccggugcucgg

SEQ ID NO: 404492 - RNA, 22 nt, Bordetella pertussis
ugccggugcucggccagcgcgc

SEQ ID NO: 404493 - RNA, 13 nt, Bordetella pertussis
ugccgugcagaug

SEQ ID NO: 404494 - RNA, 16 nt, Bordetella pertussis
ugccgugggacaggca

SEQ ID NO: 404495 - RNA, 17 nt, Bordetella pertussis
ugccgugggacaggcac

SEQ ID NO: 404496 - RNA, 18 nt, Bordetella pertussis
ugccgugggacaggcacc

SEQ ID NO: 404497 - RNA, 19 nt, Bordetella pertussis
ugccguucggccagcgcgc

SEQ ID NO: 404498 - RNA, 14 nt, Bordetella pertussis
ugccguugcccaga

SEQ ID NO: 404499 - RNA, 20 nt, Bordetella pertussis
ugccucgaagcggcucaggc

SEQ ID NO: 404500 - RNA, 14 nt, Bordetella pertussis
ugccugcucguugc

SEQ ID NO: 404501 - RNA, 21 nt, Bordetella pertussis
ugccugcuugcaggaagcgca

SEQ ID NO: 404502 - RNA, 19 nt, Bordetella pertussis
ugccugcuuguacaggcgc

SEQ ID NO: 404503 - RNA, 19 nt, Bordetella pertussis
ugccuggacgcgcuggccg

SEQ ID NO: 404504 - RNA, 15 nt, Bordetella pertussis
ugccugggugcuggu

SEQ ID NO: 404505 - RNA, 15 nt, Bordetella pertussis
ugccugucccaaucc

SEQ ID NO: 404506 - RNA, 20 nt, Bordetella pertussis
ugccugucccagcggggaca

SEQ ID NO: 404507 - RNA, 20 nt, Bordetella pertussis
ugccuguccccacggggaca

SEQ ID NO: 404508 - RNA, 20 nt, Bordetella pertussis
ugccuguccccacuggggga

SEQ ID NO: 404509 - RNA, 19 nt, Bordetella pertussis
ugccuguccccgcagggac

SEQ ID NO: 404510 - RNA, 20 nt, Bordetella pertussis
ugccuguccccgcagggaca

SEQ ID NO: 404511 - RNA, 20 nt, Bordetella pertussis
ugccuguccccgcggggaca

SEQ ID NO: 404512 - RNA, 13 nt, Bordetella pertussis
ugcgccaccagcu

SEQ ID NO: 404513 - RNA, 18 nt, Bordetella pertussis
ugcgccaccgcauggggc

SEQ ID NO: 404514 - RNA, 16 nt, Bordetella pertussis
ugcgccaccuggcgcc

SEQ ID NO: 404515 - RNA, 17 nt, Bordetella pertussis
ugcgccacgauguagcc

SEQ ID NO: 404516 - RNA, 22 nt, Bordetella pertussis
ugcgccacgauguagccgaccc

SEQ ID NO: 404517 - RNA, 18 nt, Bordetella pertussis
ugcgccacguccagcacg

SEQ ID NO: 404518 - RNA, 22 nt, Bordetella pertussis
ugcgccacguccagcacggccg

SEQ ID NO: 404519 - RNA, 15 nt, Bordetella pertussis
ugcgccagcacggca

SEQ ID NO: 404520 - RNA, 15 nt, Bordetella pertussis
ugcgccagcaggaug

SEQ ID NO: 404521 - RNA, 22 nt, Bordetella pertussis
ugcgccagccacgcgcgcuggc

SEQ ID NO: 404522 - RNA, 17 nt, Bordetella pertussis
ugcgccagccagcgcau

SEQ ID NO: 404523 - RNA, 21 nt, Bordetella pertussis
ugcgccagcgcuguccaggcc

SEQ ID NO: 404524 - RNA, 17 nt, Bordetella pertussis
ugcgccaggcaaaggcc

SEQ ID NO: 404525 - RNA, 15 nt, Bordetella pertussis
ugcgccaggugcuug

SEQ ID NO: 404526 - RNA, 20 nt, Bordetella pertussis
ugcgccaguccagcgcgccg

SEQ ID NO: 404527 - RNA, 17 nt, Bordetella pertussis
ugcgccaguugcggggc

SEQ ID NO: 404528 - RNA, 15 nt, Bordetella pertussis
ugcgcccccaugucc

SEQ ID NO: 404529 - RNA, 16 nt, Bordetella pertussis
ugcgccccgcuggccg

SEQ ID NO: 404530 - RNA, 15 nt, Bordetella pertussis
ugcgcccggccaccg

SEQ ID NO: 404531 - RNA, 18 nt, Bordetella pertussis
ugcgccgcaacgccgccg

SEQ ID NO: 404532 - RNA, 13 nt, Bordetella pertussis
ugcgccgcaugcg

SEQ ID NO: 404533 - RNA, 18 nt, Bordetella pertussis
ugcgccgcaugcggcggc

SEQ ID NO: 404534 - RNA, 19 nt, Bordetella pertussis
ugcgccgccgccgcggccu

SEQ ID NO: 404535 - RNA, 20 nt, Bordetella pertussis
ugcgccgccgccgcggccug

SEQ ID NO: 404536 - RNA, 11 nt, Bordetella pertussis
ugcgccgccgc

SEQ ID NO: 404537 - RNA, 12 nt, Bordetella pertussis
ugcgccgcgccg

SEQ ID NO: 404538 - RNA, 22 nt, Bordetella pertussis
ugcgccgcuuccggccggaacu

SEQ ID NO: 404539 - RNA, 13 nt, Bordetella pertussis
ugcgccggcccgg

SEQ ID NO: 404540 - RNA, 14 nt, Bordetella pertussis
ugcgccggccuggc

SEQ ID NO: 404541 - RNA, 16 nt, Bordetella pertussis
ugcgccggcggcaccg

SEQ ID NO: 404542 - RNA, 17 nt, Bordetella pertussis
ugcgccgggcgcggcca

SEQ ID NO: 404543 - RNA, 20 nt, Bordetella pertussis
ugcgccgggcgcggccaggc

SEQ ID NO: 404544 - RNA, 17 nt, Bordetella pertussis
ugcgccggguccggccg

SEQ ID NO: 404545 - RNA, 15 nt, Bordetella pertussis
ugcgccgugcccggc

SEQ ID NO: 404546 - RNA, 17 nt, Bordetella pertussis
ugcgccgugcccggcgg

SEQ ID NO: 404547 - RNA, 14 nt, Bordetella pertussis
ugcgccguccucag

SEQ ID NO: 404548 - RNA, 15 nt, Bordetella pertussis
ugcgccuuccgggcg

SEQ ID NO: 404549 - RNA, 16 nt, Bordetella pertussis
ugcgcgaacgcgcgcc

SEQ ID NO: 404550 - RNA, 17 nt, Bordetella pertussis
ugcgcgaacgcgcgccg

SEQ ID NO: 404551 - RNA, 16 nt, Bordetella pertussis
ugcgcgaacgcggcca

SEQ ID NO: 404552 - RNA, 15 nt, Bordetella pertussis
ugcgcgaagcgcugg

SEQ ID NO: 404553 - RNA, 15 nt, Bordetella pertussis
ugcgcgacagcaggc

SEQ ID NO: 404554 - RNA, 14 nt, Bordetella pertussis
ugcgcgaccuccag

SEQ ID NO: 404555 - RNA, 12 nt, Bordetella pertussis
ugcgcgagccgc

SEQ ID NO: 404556 - RNA, 21 nt, Bordetella pertussis
ugcgcgaggugggcggcagca

SEQ ID NO: 404557 - RNA, 23 nt, Bordetella pertussis
ugcgcgaggugggcggcagcagg

SEQ ID NO: 404558 - RNA, 17 nt, Bordetella pertussis
ugcgcgcagggcggccg

SEQ ID NO: 404559 - RNA, 12 nt, Bordetella pertussis
ugcgcgccacgu

SEQ ID NO: 404560 - RNA, 13 nt, Bordetella pertussis
ugcgcgccaggcg

SEQ ID NO: 404561 - RNA, 14 nt, Bordetella pertussis
ugcgcgccaugcaa

SEQ ID NO: 404562 - RNA, 21 nt, Bordetella pertussis
ugcgcgccgucggcgucgaag

SEQ ID NO: 404563 - RNA, 14 nt, Bordetella pertussis
ugcgcgcgcgcugg

SEQ ID NO: 404564 - RNA, 21 nt, Bordetella pertussis
ugcgcgcgcgcuggggcuguc

SEQ ID NO: 404565 - RNA, 17 nt, Bordetella pertussis
ugcgcgcgcgggccagc

SEQ ID NO: 404566 - RNA, 12 nt, Bordetella pertussis
ugcgcgcggcca

SEQ ID NO: 404567 - RNA, 12 nt, Bordetella pertussis
ugcgcgcggccg

SEQ ID NO: 404568 - RNA, 14 nt, Bordetella pertussis
ugcgcgccugcugg

SEQ ID NO: 404569 - RNA, 15 nt, Bordetella pertussis
ugcgcgcggccuggc

SEQ ID NO: 404570 - RNA, 14 nt, Bordetella pertussis
ugcgcgcgugcagc

SEQ ID NO: 404571 - RNA, 17 nt, Bordetella pertussis
ugcgcgcgugcagcgcc

SEQ ID NO: 404572 - RNA, 22 nt, Bordetella pertussis
ugcgcgcuugaacuccgcggcg

SEQ ID NO: 404573 - RNA, 12 nt, Bordetella pertussis
ugcgcggccagc

SEQ ID NO: 404574 - RNA, 15 nt, Bordetella pertussis
ugcgcggccagcacc

SEQ ID NO: 404575 - RNA, 19 nt, Bordetella pertussis
ugcgcggccagcaccggcc

SEQ ID NO: 404576 - RNA, 21 nt, Bordetella pertussis
ugcgcggccagcaccggcccg

SEQ ID NO: 404577 - RNA, 13 nt, Bordetella pertussis
ugcgcggccaggg

SEQ ID NO: 404578 - RNA, 16 nt, Bordetella pertussis
ugcgcggccagggcug

SEQ ID NO: 404579 - RNA, 15 nt, Bordetella pertussis
ugcgcggcccggccg

SEQ ID NO: 404580 - RNA, 13 nt, Bordetella pertussis
ugcgcggccgcgc

SEQ ID NO: 404581 - RNA, 14 nt, Bordetella pertussis
ugcgcggcgcgccg

SEQ ID NO: 404582 - RNA, 20 nt, Bordetella pertussis
ugcgcggcgggaccgugccg

SEQ ID NO: 404583 - RNA, 19 nt, Bordetella pertussis
ugcgcggcgggacggccau

SEQ ID NO: 404584 - RNA, 19 nt, Bordetella pertussis
ugcgcgggcgcggcaggcg

SEQ ID NO: 404585 - RNA, 14 nt, Bordetella pertussis
ugcgcggggccagg

SEQ ID NO: 404586 - RNA, 16 nt, Bordetella pertussis
ugcgcggggccaggcg

SEQ ID NO: 404587 - RNA, 13 nt, Bordetella pertussis
ugcgcggugcggg

SEQ ID NO: 404588 - RNA, 16 nt, Bordetella pertussis
ugcgcgguucaggcuu

SEQ ID NO: 404589 - RNA, 22 nt, Bordetella pertussis
ugcgcgucaggcgagcgcggcg

SEQ ID NO: 404590 - RNA, 15 nt, Bordetella pertussis
ugcgcguccugggcc

SEQ ID NO: 404591 - RNA, 16 nt, Bordetella pertussis
ugcgcguccugggccg

SEQ ID NO: 404592 - RNA, 19 nt, Bordetella pertussis
ugcgcgugacgauauccag

SEQ ID NO: 404593 - RNA, 21 nt, Bordetella pertussis
ugcgcgugacgauauccaggc

SEQ ID NO: 404594 - RNA, 16 nt, Bordetella pertussis
ugcgcuugucgccgcu

SEQ ID NO: 404595 - RNA, 19 nt, Bordetella pertussis
ugcggacacugacguggau

SEQ ID NO: 404596 - RNA, 15 nt, Bordetella pertussis
ugcggacgggccagu

SEQ ID NO: 404597 - RNA, 17 nt, Bordetella pertussis
ugcggaggcggccgcgg

SEQ ID NO: 404598 - RNA, 21 nt, Bordetella pertussis
ugcggauacgaaaccaggccg

SEQ ID NO: 404599 - RNA, 19 nt, Bordetella pertussis
ugcggaucaagcggcccgc

SEQ ID NO: 404600 - RNA, 16 nt, Bordetella pertussis
ugcggaugcagcagcg

SEQ ID NO: 404601 - RNA, 23 nt, Bordetella pertussis
ugcggcaggugcgucacgcacag

SEQ ID NO: 404602 - RNA, 12 nt, Bordetella pertussis
ugcggccaggcg

SEQ ID NO: 404603 - RNA, 23 nt, Bordetella pertussis
ugcggcccgcgcuguugcuccag

SEQ ID NO: 404604 - RNA, 16 nt, Bordetella pertussis
ugcggcccgcggccuu

SEQ ID NO: 404605 - RNA, 14 nt, Bordetella pertussis
ugcggccgccgaac

SEQ ID NO: 404606 - RNA, 20 nt, Bordetella pertussis
ugcggccggugaucuugccg

SEQ ID NO: 404607 - RNA, 21 nt, Bordetella pertussis
ugcggccguugcuccagccag

SEQ ID NO: 404608 - RNA, 18 nt, Bordetella pertussis
ugcggcgccacugccagg

SEQ ID NO: 404609 - RNA, 19 nt, Bordetella pertussis
ugcggcgccacugccaggc

SEQ ID NO: 404610 - RNA, 14 nt, Bordetella pertussis
ugcggcgccagcgc

SEQ ID NO: 404611 - RNA, 17 nt, Bordetella pertussis
ugcggcgccagcgccgc

SEQ ID NO: 404612 - RNA, 14 nt, Bordetella pertussis
ugcggcgcccaggc

SEQ ID NO: 404613 - RNA, 17 nt, Bordetella pertussis
ugcggcgcccaggccca

SEQ ID NO: 404614 - RNA, 14 nt, Bordetella pertussis
ugcggcgccugggc

SEQ ID NO: 404615 - RNA, 21 nt, Bordetella pertussis
ugcggcgcgcacgggcgaggc

SEQ ID NO: 404616 - RNA, 13 nt, Bordetella pertussis
ugcggcgcgccgc

SEQ ID NO: 404617 - RNA, 13 nt, Bordetella pertussis
ugcggcgcuggcu

SEQ ID NO: 404618 - RNA, 15 nt, Bordetella pertussis
ugcggcgcggccagc

SEQ ID NO: 404619 - RNA, 15 nt, Bordetella pertussis
ugcgggccgcgcugg

SEQ ID NO: 404620 - RNA, 22 nt, Bordetella pertussis
ugcgggccggcugggcggccuu

SEQ ID NO: 404621 - RNA, 22 nt, Bordetella pertussis
ugcgggccugcaguucggccgc

SEQ ID NO: 404622 - RNA, 13 nt, Bordetella pertussis
ugcgggcggccug

SEQ ID NO: 404623 - RNA, 15 nt, Bordetella pertussis
ugcgggcggccuggg

SEQ ID NO: 404624 - RNA, 16 nt, Bordetella pertussis
ugcgggcuugcugccc

SEQ ID NO: 404625 - RNA, 13 nt, Bordetella pertussis
ugcggggacaggc

SEQ ID NO: 404626 - RNA, 16 nt, Bordetella pertussis
ugcggggacaggcacu

SEQ ID NO: 404627 - RNA, 15 nt, Bordetella pertussis
ugcggggcggcaggu

SEQ ID NO: 404628 - RNA, 13 nt, Bordetella pertussis
ugcgggggcaggc

SEQ ID NO: 404629 - RNA, 14 nt, Bordetella pertussis
ugcgggggcaggca

SEQ ID NO: 404630 - RNA, 13 nt, Bordetella pertussis
ugcgguccaggaa

SEQ ID NO: 404631 - RNA, 18 nt, Bordetella pertussis
ugcgguccaggaagcgca

SEQ ID NO: 404632 - RNA, 19 nt, Bordetella pertussis
ugcgguccaugucggccga

SEQ ID NO: 404633 - RNA, 17 nt, Bordetella pertussis
ugcgguccguacgccac

SEQ ID NO: 404634 - RNA, 20 nt, Bordetella pertussis
ugcggucggccgcgccgccg

SEQ ID NO: 404635 - RNA, 19 nt, Bordetella pertussis
ugcggucuaccgaagccga

SEQ ID NO: 404636 - RNA, 14 nt, Bordetella pertussis
ugcggugccugucc

SEQ ID NO: 404637 - RNA, 19 nt, Bordetella pertussis
ugcgguugaucagggccgc

SEQ ID NO: 404638 - RNA, 21 nt, Bordetella pertussis
ugcgguugaucagggccgcca

SEQ ID NO: 404639 - RNA, 20 nt, Bordetella pertussis
ugcgguugcgaggcggccuu

SEQ ID NO: 404640 - RNA, 19 nt, Bordetella pertussis
ugcgugacacggccauccg

SEQ ID NO: 404641 - RNA, 23 nt, Bordetella pertussis
ugcgugccgacgaugccgccgcc

SEQ ID NO: 404642 - RNA, 15 nt, Bordetella pertussis
ugcgugcgccugucc

SEQ ID NO: 404643 - RNA, 18 nt, Bordetella pertussis
ugcucaacggccaccagg

SEQ ID NO: 404644 - RNA, 16 nt, Bordetella pertussis
ugcucagucgggcagc

SEQ ID NO: 404645 - RNA, 16 nt, Bordetella pertussis
ugcucaucggcaggcc

SEQ ID NO: 404646 - RNA, 14 nt, Bordetella pertussis
ugcuccugccaggc

SEQ ID NO: 404647 - RNA, 17 nt, Bordetella pertussis
ugcuccugccaggcgcc

SEQ ID NO: 404648 - RNA, 19 nt, Bordetella pertussis
ugcucgauaugcagcaccg

SEQ ID NO: 404649 - RNA, 20 nt, Bordetella pertussis
ugcucgcaggccugcugcag

SEQ ID NO: 404650 - RNA, 18 nt, Bordetella pertussis
ugcucgccggcgccgccc

SEQ ID NO: 404651 - RNA, 18 nt, Bordetella pertussis
ugcucggugcucuggccc

SEQ ID NO: 404652 - RNA, 19 nt, Bordetella pertussis
ugcucggugcucuggcccg

SEQ ID NO: 404653 - RNA, 22 nt, Bordetella pertussis
ugcucgugcugggcaugauggu

SEQ ID NO: 404654 - RNA, 14 nt, Bordetella pertussis
ugcugaaccugcug

SEQ ID NO: 404655 - RNA, 23 nt, Bordetella pertussis
ugcugacgcgauacugcgcaugg

SEQ ID NO: 404656 - RNA, 17 nt, Bordetella pertussis
ugcugacggacuggugc

SEQ ID NO: 404657 - RNA, 17 nt, Bordetella pertussis
ugcugacggugccggcc

SEQ ID NO: 404658 - RNA, 15 nt, Bordetella pertussis
ugcugacugugcagc

SEQ ID NO: 404659 - RNA, 18 nt, Bordetella pertussis
ugcugaucgacaugcugg

SEQ ID NO: 404660 - RNA, 22 nt, Bordetella pertussis
ugcugcagcugcuugcccaggc

SEQ ID NO: 404661 - RNA, 14 nt, Bordetella pertussis
ugcugcaggccggc

SEQ ID NO: 404662 - RNA, 14 nt, Bordetella pertussis
ugcugcagcgcauc

SEQ ID NO: 404663 - RNA, 15 nt, Bordetella pertussis
ugcugcccgccgccg

SEQ ID NO: 404664 - RNA, 19 nt, Bordetella pertussis
ugcugcccgccgccgccca

SEQ ID NO: 404665 - RNA, 15 nt, Bordetella pertussis
ugcugccgcugccca

SEQ ID NO: 404666 - RNA, 17 nt, Bordetella pertussis
ugcugccguccuugugc

SEQ ID NO: 404667 - RNA, 13 nt, Bordetella pertussis
ugcugcuggcugc

SEQ ID NO: 404668 - RNA, 13 nt, Bordetella pertussis
ugcugcuugaccu

SEQ ID NO: 404669 - RNA, 20 nt, Bordetella pertussis
ugcuggacccgcugcgaccc

SEQ ID NO: 404670 - RNA, 18 nt, Bordetella pertussis
ugcuggaccgcgccuggg

SEQ ID NO: 404671 - RNA, 15 nt, Bordetella pertussis
ugcuggcgcagcagc

SEQ ID NO: 404672 - RNA, 16 nt, Bordetella pertussis
ugcuggcggccgugcc

SEQ ID NO: 404673 - RNA, 19 nt, Bordetella pertussis
ugcuggcuucggcgcuggg

SEQ ID NO: 404674 - RNA, 13 nt, Bordetella pertussis
ugcugggccgcgc

SEQ ID NO: 404675 - RNA, 12 nt, Bordetella pertussis
ugcugggccggc

SEQ ID NO: 404676 - RNA, 15 nt, Bordetella pertussis
ugcugggcggccagg

SEQ ID NO: 404677 - RNA, 16 nt, Bordetella pertussis
ugcugggcggccaggc

SEQ ID NO: 404678 - RNA, 17 nt, Bordetella pertussis
ugcugggcggcgggcac

SEQ ID NO: 404679 - RNA, 16 nt, Bordetella pertussis
ugcugggcgggcuggu

SEQ ID NO: 404680 - RNA, 23 nt, Bordetella pertussis
ugcugggcgggcugguggugggc

SEQ ID NO: 404681 - RNA, 17 nt, Bordetella pertussis
ugcuguaccucagccug

SEQ ID NO: 404682 - RNA, 21 nt, Bordetella pertussis
ugcuguucgccacgcuguugc

SEQ ID NO: 404683 - RNA, 17 nt, Bordetella pertussis
ugcuguuggccuucggc

SEQ ID NO: 404684 - RNA, 22 nt, Bordetella pertussis
ugcuugacgccgccgaagggca

SEQ ID NO: 404685 - RNA, 22 nt, Bordetella pertussis
ugcuugagcaccacguccuggg

SEQ ID NO: 404686 - RNA, 15 nt, Bordetella pertussis
ugcuugaggccgcgc

SEQ ID NO: 404687 - RNA, 12 nt, Bordetella pertussis
ugcuugaugccc

SEQ ID NO: 404688 - RNA, 15 nt, Bordetella pertussis
ugcuugaugcccagc

SEQ ID NO: 404689 - RNA, 13 nt, Bordetella pertussis
ugcuugcccagcg

SEQ ID NO: 404690 - RNA, 16 nt, Bordetella pertussis
ugcuugcccagcggaa

SEQ ID NO: 404691 - RNA, 12 nt, Bordetella pertussis
ugcuugccuguc

SEQ ID NO: 404692 - RNA, 23 nt, Bordetella pertussis
ugcuugcgauaggugcgcagccg

SEQ ID NO: 404693 - RNA, 21 nt, Bordetella pertussis
uggcgcgauccuucgcggccg

SEQ ID NO: 404694 - RNA, 17 nt, Bordetella pertussis
uggcgcgcaaccagggg

SEQ ID NO: 404695 - RNA, 22 nt, Bordetella pertussis
uggcgcgcaaccaggggcggcg

SEQ ID NO: 404696 - RNA, 20 nt, Bordetella pertussis
uggcgcgcacacuggccagc

SEQ ID NO: 404697 - RNA, 16 nt, Bordetella pertussis
uggcgcgcaccauggg

SEQ ID NO: 404698 - RNA, 17 nt, Bordetella pertussis
uggcgcgcaccugggag

SEQ ID NO: 404699 - RNA, 17 nt, Bordetella pertussis
uggcgcgcggccugggc

SEQ ID NO: 404700 - RNA, 17 nt, Bordetella pertussis
uggcgcgcggcuggcug

SEQ ID NO: 404701 - RNA, 15 nt, Bordetella pertussis
uggcgcgcggcuggg

SEQ ID NO: 404702 - RNA, 17 nt, Bordetella pertussis
uggcgcgcggcuggggc

SEQ ID NO: 404703 - RNA, 14 nt, Bordetella pertussis
uggcgcgccguggc

SEQ ID NO: 404704 - RNA, 15 nt, Bordetella pertussis
uggcgcgccguggcu

SEQ ID NO: 404705 - RNA, 14 nt, Bordetella pertussis
uggcgcgcgccagc

SEQ ID NO: 404706 - RNA, 23 nt, Bordetella pertussis
uggcgcggccggaggccgcccac

SEQ ID NO: 404707 - RNA, 18 nt, Bordetella pertussis
uggcgcggcggccaggcg

SEQ ID NO: 404708 - RNA, 21 nt, Bordetella pertussis
uggcgcgguccacgcccuggc

SEQ ID NO: 404709 - RNA, 18 nt, Bordetella pertussis
uggcgcgucgccgcgccg

SEQ ID NO: 404710 - RNA, 19 nt, Bordetella pertussis
uggcgcugcacagggacca

SEQ ID NO: 404711 - RNA, 21 nt, Bordetella pertussis
uggcgcugcagcgucugcugg

SEQ ID NO: 404712 - RNA, 19 nt, Bordetella pertussis
uggcgcugcugcuggcugc

SEQ ID NO: 404713 - RNA, 15 nt, Bordetella pertussis
uggcgcuggcaggcg

SEQ ID NO: 404714 - RNA, 17 nt, Bordetella pertussis
uggcgcuguccggcgcu

SEQ ID NO: 404715 - RNA, 21 nt, Bordetella pertussis
uggcgcuguuuccgggccugg

SEQ ID NO: 404716 - RNA, 19 nt, Bordetella pertussis
uggcggcgcagcaccaggc

SEQ ID NO: 404717 - RNA, 20 nt, Bordetella pertussis
uggcggcgcagcgcccaggc

SEQ ID NO: 404718 - RNA, 13 nt, Bordetella pertussis
uggcgggcaccau

SEQ ID NO: 404719 - RNA, 20 nt, Bordetella pertussis
uggcggucuugcgcuggauc

SEQ ID NO: 404720 - RNA, 11 nt, Bordetella pertussis
uggcggugcgc

SEQ ID NO: 404721 - RNA, 14 nt, Bordetella pertussis
uggcgguggccagc

SEQ ID NO: 404722 - RNA, 16 nt, Bordetella pertussis
uggcgguggccagcgc

SEQ ID NO: 404723 - RNA, 14 nt, Bordetella pertussis
uggcguacagcagg

SEQ ID NO: 404724 - RNA, 21 nt, Bordetella pertussis
uggcguaguagcccaggccca

SEQ ID NO: 404725 - RNA, 15 nt, Bordetella pertussis
uggcguccagcagca

SEQ ID NO: 404726 - RNA, 21 nt, Bordetella pertussis
uggcguccagccugcccgggc

SEQ ID NO: 404727 - RNA, 20 nt, Bordetella pertussis
uggcguccaggcgcgccagc

SEQ ID NO: 404728 - RNA, 22 nt, Bordetella pertussis
uggcguccgauaucccauggga

SEQ ID NO: 404729 - RNA, 18 nt, Bordetella pertussis
uggcgucgaucaugaugc

SEQ ID NO: 404730 - RNA, 23 nt, Bordetella pertussis
uggcgucgggggcggccggggcc

SEQ ID NO: 404731 - RNA, 23 nt, Bordetella pertussis
uggcgugcagguacgccaugcga

SEQ ID NO: 404732 - RNA, 21 nt, Bordetella pertussis
uggcgugcagguacugggcca

SEQ ID NO: 404733 - RNA, 21 nt, Bordetella pertussis
uggcgugcgcgaccuccggca

SEQ ID NO: 404734 - RNA, 18 nt, Bordetella pertussis
uggcguucucgacccgcu

SEQ ID NO: 404735 - RNA, 18 nt, Bordetella pertussis
uggcguugacggcccagc

SEQ ID NO: 404736 - RNA, 16 nt, Bordetella pertussis
uggcguuggccugcca

SEQ ID NO: 404737 - RNA, 17 nt, Bordetella pertussis
uggcguuggccugccau

SEQ ID NO: 404738 - RNA, 15 nt, Bordetella pertussis
uggcuaaaaggaaau

SEQ ID NO: 404739 - RNA, 14 nt, Bordetella pertussis
uggcucccaccggu

SEQ ID NO: 404740 - RNA, 23 nt, Bordetella pertussis
uggcucguucgcucggcguccuc

SEQ ID NO: 404741 - RNA, 21 nt, Bordetella pertussis
uggcugacgauguucaggcca

SEQ ID NO: 404742 - RNA, 13 nt, Bordetella pertussis
uggcugcccuggc

SEQ ID NO: 404743 - RNA, 12 nt, Bordetella pertussis
uggcuggccagc

SEQ ID NO: 404744 - RNA, 14 nt, Bordetella pertussis
uggcuggcgaggac

SEQ ID NO: 404745 - RNA, 15 nt, Bordetella pertussis
uggcugggccugcug

SEQ ID NO: 404746 - RNA, 15 nt, Bordetella pertussis
uggcuggugccaguc

SEQ ID NO: 404747 - RNA, 15 nt, Bordetella pertussis
uggcuguaucuggcc

SEQ ID NO: 404748 - RNA, 20 nt, Bordetella pertussis
uggcuuccugcaccucagga

SEQ ID NO: 404749 - RNA, 16 nt, Bordetella pertussis
ugggaaauccgccggg

SEQ ID NO: 404750 - RNA, 16 nt, Bordetella pertussis
ugggacaggcacaccg

SEQ ID NO: 404751 - RNA, 15 nt, Bordetella pertussis
ugggacaggcccagc

SEQ ID NO: 404752 - RNA, 21 nt, Bordetella pertussis
ugggaggcgugcugcaccugc

SEQ ID NO: 404753 - RNA, 18 nt, Bordetella pertussis
ugggcauuucccagccgu

SEQ ID NO: 404754 - RNA, 18 nt, Bordetella pertussis
ugggccagcaggcucagc

SEQ ID NO: 404755 - RNA, 16 nt, Bordetella pertussis
ugggccagcaggucgu

SEQ ID NO: 404756 - RNA, 13 nt, Bordetella pertussis
ugggccagcaucg

SEQ ID NO: 404757 - RNA, 16 nt, Bordetella pertussis
ugggccaggcgcucca

SEQ ID NO: 404758 - RNA, 22 nt, Bordetella pertussis
ugggccaggcgcuccagcaccu

SEQ ID NO: 404759 - RNA, 13 nt, Bordetella pertussis
ugggccagggccu

SEQ ID NO: 404760 - RNA, 20 nt, Bordetella pertussis
ugggccagguauugcucggc

SEQ ID NO: 404761 - RNA, 21 nt, Bordetella pertussis
ugggccagguauugcucggcg

SEQ ID NO: 404762 - RNA, 19 nt, Bordetella pertussis
ugggccaugccguccugcu

SEQ ID NO: 404763 - RNA, 20 nt, Bordetella pertussis
ugggccaugccguccugcug

SEQ ID NO: 404764 - RNA, 22 nt, Bordetella pertussis
ugggcgagguagggcgcggcca

SEQ ID NO: 404765 - RNA, 21 nt, Bordetella pertussis
ugggcgaucuucagcaccagc

SEQ ID NO: 404766 - RNA, 14 nt, Bordetella pertussis
ugggcgcaggccgc

SEQ ID NO: 404767 - RNA, 19 nt, Bordetella pertussis
ugggcgcauuggcccugcu

SEQ ID NO: 404768 - RNA, 19 nt, Bordetella pertussis
ugggcgccaugcgcccggc

SEQ ID NO: 404769 - RNA, 18 nt, Bordetella pertussis
ugggcgccugcggggccg

SEQ ID NO: 404770 - RNA, 16 nt, Bordetella pertussis
ugggcgcgcccagccc

SEQ ID NO: 404771 - RNA, 18 nt, Bordetella pertussis
ugggcgcggaacagccug

SEQ ID NO: 404772 - RNA, 20 nt, Bordetella pertussis
ugggcgcgaugggccugccc

SEQ ID NO: 404773 - RNA, 21 nt, Bordetella pertussis
ugggcgcgaugggccugccca

SEQ ID NO: 404774 - RNA, 17 nt, Bordetella pertussis
ugggcgcuuggcccugc

SEQ ID NO: 404775 - RNA, 20 nt, Bordetella pertussis
ugggcgcuuggcccugcagc

SEQ ID NO: 404776 - RNA, 16 nt, Bordetella pertussis
ugggcggcagcaggcg

SEQ ID NO: 404777 - RNA, 13 nt, Bordetella pertussis
ugggcggccaggc

SEQ ID NO: 404778 - RNA, 18 nt, Bordetella pertussis
ugggcggcccggccaagc

SEQ ID NO: 404779 - RNA, 14 nt, Bordetella pertussis
ugggcggccuuggc

SEQ ID NO: 404780 - RNA, 14 nt, Bordetella pertussis
ugggcggugaccau

SEQ ID NO: 404781 - RNA, 14 nt, Bordetella pertussis
ugggcgucccaggc

SEQ ID NO: 404782 - RNA, 16 nt, Bordetella pertussis
ugggcgucgagcggcg

SEQ ID NO: 404783 - RNA, 22 nt, Bordetella pertussis
ugggcgucgaucuucgccugca

SEQ ID NO: 404784 - RNA, 18 nt, Bordetella pertussis
ugggcgugaaaggccagc

SEQ ID NO: 404785 - RNA, 22 nt, Bordetella pertussis
ugggcgugaaaggccagcggcg

SEQ ID NO: 404786 - RNA, 15 nt, Bordetella pertussis
ugggcgugcccucgc

SEQ ID NO: 404787 - RNA, 22 nt, Bordetella pertussis
ugggcgugcccucgcugcgcgu

SEQ ID NO: 404788 - RNA, 16 nt, Bordetella pertussis
uggggacuggcaccug

SEQ ID NO: 404789 - RNA, 13 nt, Bordetella pertussis
uggggagcgcggc

SEQ ID NO: 404790 - RNA, 19 nt, Bordetella pertussis
uggggagcgcggcccgugc

SEQ ID NO: 404791 - RNA, 19 nt, Bordetella pertussis
uggggcugcugggccggcg

SEQ ID NO: 404792 - RNA, 13 nt, Bordetella pertussis
ugggggacaggca

SEQ ID NO: 404793 - RNA, 17 nt, Bordetella pertussis
uggggucgccgggcagc

SEQ ID NO: 404794 - RNA, 14 nt, Bordetella pertussis
uggggucgcgcugg

SEQ ID NO: 404795 - RNA, 14 nt, Bordetella pertussis
ugggggucagcgcc

SEQ ID NO: 404796 - RNA, 20 nt, Bordetella pertussis
ugggguugacguuguccagg

SEQ ID NO: 404797 - RNA, 20 nt, Bordetella pertussis
ugguagcaggcgcgcucagg

SEQ ID NO: 404798 - RNA, 18 nt, Bordetella pertussis
uggucaucuacagcgccu

SEQ ID NO: 404799 - RNA, 20 nt, Bordetella pertussis
uggucaugacgggcggcggc

SEQ ID NO: 404800 - RNA, 22 nt, Bordetella pertussis
uggucgcgaugcgucaggggca

SEQ ID NO: 404801 - RNA, 15 nt, Bordetella pertussis
uggucgcgggccagg

SEQ ID NO: 404802 - RNA, 16 nt, Bordetella pertussis
uggucgcgggccaggc

SEQ ID NO: 404803 - RNA, 17 nt, Bordetella pertussis
uggucgcgcagcugccu

SEQ ID NO: 404804 - RNA, 19 nt, Bordetella pertussis
uggucgcgcccgccguggc

SEQ ID NO: 404805 - RNA, 19 nt, Bordetella pertussis
uggucgcuggcgccggugc

SEQ ID NO: 404806 - RNA, 18 nt, Bordetella pertussis
uggucggcgaccgugcgc

SEQ ID NO: 404807 - RNA, 21 nt, Bordetella pertussis
uggucggcgcggcagugggcg

SEQ ID NO: 404808 - RNA, 18 nt, Bordetella pertussis
uggucuucgagcgcgagc

SEQ ID NO: 404809 - RNA, 13 nt, Bordetella pertussis
uggucuugccgcc

SEQ ID NO: 404810 - RNA, 21 nt, Bordetella pertussis
uggugcaacuccacgcccugc

SEQ ID NO: 404811 - RNA, 20 nt, Bordetella pertussis
uggugcacgaugcccagggc

SEQ ID NO: 404812 - RNA, 15 nt, Bordetella pertussis
uggugcagcggcagc

SEQ ID NO: 404813 - RNA, 21 nt, Bordetella pertussis
uggugcagcggcagcauggcg

SEQ ID NO: 404814 - RNA, 21 nt, Bordetella pertussis
uggugccggaaaaugccgcgg

SEQ ID NO: 404815 - RNA, 17 nt, Bordetella pertussis
uggugccugcuugcagg

SEQ ID NO: 404816 - RNA, 20 nt, Bordetella pertussis
uggugcgcaccuugcccacg

SEQ ID NO: 404817 - RNA, 18 nt, Bordetella pertussis
uggugcuggccgaaccau

SEQ ID NO: 404818 - RNA, 19 nt, Bordetella pertussis
uggugggauccucgcugcc

SEQ ID NO: 404819 - RNA, 17 nt, Bordetella pertussis
uggugggcauagcgcgc

SEQ ID NO: 404820 - RNA, 13 nt, Bordetella pertussis
uggugggcgugcc

SEQ ID NO: 404821 - RNA, 14 nt, Bordetella pertussis
ugguggggccgggc

SEQ ID NO: 404822 - RNA, 16 nt, Bordetella pertussis
ugguggggcuggccgc

SEQ ID NO: 404823 - RNA, 17 nt, Bordetella pertussis
ugguggugcagcggcag

SEQ ID NO: 404824 - RNA, 19 nt, Bordetella pertussis
ugguggugcagcggcagca

SEQ ID NO: 404825 - RNA, 16 nt, Bordetella pertussis
ugguggugccugcuug

SEQ ID NO: 404826 - RNA, 16 nt, Bordetella pertussis
ugguggugcgggccgc

SEQ ID NO: 404827 - RNA, 19 nt, Bordetella pertussis
ugguguacagccgccuggc

SEQ ID NO: 404828 - RNA, 15 nt, Bordetella pertussis
ugguguaccgggccg

SEQ ID NO: 404829 - RNA, 16 nt, Bordetella pertussis
ugguggucuggucgca

SEQ ID NO: 404830 - RNA, 20 nt, Bordetella pertussis
ugguugucgaugugcugauc

SEQ ID NO: 404831 - RNA, 11 nt, Bordetella pertussis
uguaacaacac

SEQ ID NO: 404832 - RNA, 13 nt, Bordetella pertussis
uguaucuggccug

SEQ ID NO: 404833 - RNA, 23 nt, Bordetella pertussis
uguaucuggccugucugguggcg

SEQ ID NO: 404834 - RNA, 23 nt, Bordetella pertussis
ugucaauagguuguauucgucca

SEQ ID NO: 404835 - RNA, 17 nt, Bordetella pertussis
uguccaccacccaggcc

SEQ ID NO: 404836 - RNA, 16 nt, Bordetella pertussis
uguccaccauccugcc

SEQ ID NO: 404837 - RNA, 14 nt, Bordetella pertussis
uguccacgccgaag

SEQ ID NO: 404838 - RNA, 23 nt, Bordetella pertussis
uguccagacccgaaucucccggc

SEQ ID NO: 404839 - RNA, 18 nt, Bordetella pertussis
uguccagcggcagcgggu

SEQ ID NO: 404840 - RNA, 22 nt, Bordetella pertussis
uguccaggccggggccgcccag

SEQ ID NO: 404841 - RNA, 13 nt, Bordetella pertussis
uguccagcuccag

SEQ ID NO: 404842 - RNA, 17 nt, Bordetella pertussis
uguccagguugagucug

SEQ ID NO: 404843 - RNA, 13 nt, Bordetella pertussis
ugucccaaccggg

SEQ ID NO: 404844 - RNA, 15 nt, Bordetella pertussis
ugucccaauccgcga

SEQ ID NO: 404845 - RNA, 13 nt, Bordetella pertussis
ugucccacaggcg

SEQ ID NO: 404846 - RNA, 22 nt, Bordetella pertussis
ugucccagcggggacaggcacc

SEQ ID NO: 404847 - RNA, 12 nt, Bordetella pertussis
ugucccagcucc

SEQ ID NO: 404848 - RNA, 10 nt, Bordetella pertussis
uguccccaca

SEQ ID NO: 404849 - RNA, 22 nt, Bordetella pertussis
uguccccaccgggacaggcacc

SEQ ID NO: 404850 - RNA, 22 nt, Bordetella pertussis
uguccccacggggacaggcacc

SEQ ID NO: 404851 - RNA, 23 nt, Bordetella pertussis
uguccccacugggggacuggcac

SEQ ID NO: 404852 - RNA, 23 nt, Bordetella pertussis
uguccccgaacggggacuggcac

SEQ ID NO: 404853 - RNA, 15 nt, Bordetella pertussis
uguccccgcggggac

SEQ ID NO: 404854 - RNA, 20 nt, Bordetella pertussis
uguccccgcggggacaggca

SEQ ID NO: 404855 - RNA, 17 nt, Bordetella pertussis
uguccccgcugggacag

SEQ ID NO: 404856 - RNA, 20 nt, Bordetella pertussis
uguccccgcugggacaggca

SEQ ID NO: 404857 - RNA, 22 nt, Bordetella pertussis
uguccccgcugggacaggcacu

SEQ ID NO: 404858 - RNA, 16 nt, Bordetella pertussis
uguccccgucgggaca

SEQ ID NO: 404859 - RNA, 22 nt, Bordetella pertussis
uguccccguggggacaggcacc

SEQ ID NO: 404860 - RNA, 16 nt, Bordetella pertussis
ugucccggcggggaca

SEQ ID NO: 404861 - RNA, 20 nt, Bordetella pertussis
ugucccggcggggacaggcg

SEQ ID NO: 404862 - RNA, 14 nt, Bordetella pertussis
ugucccggcggggc

SEQ ID NO: 404863 - RNA, 23 nt, Bordetella pertussis
ugucccggcggggcaggcgccug

SEQ ID NO: 404864 - RNA, 18 nt, Bordetella pertussis
uguccccgcacggggaca

SEQ ID NO: 404865 - RNA, 17 nt, Bordetella pertussis
uguccgaugcgcugcug

SEQ ID NO: 404866 - RNA, 16 nt, Bordetella pertussis
uguccgcgccgggaaa

SEQ ID NO: 404867 - RNA, 20 nt, Bordetella pertussis
uguccggcgcucgccccggc

SEQ ID NO: 404868 - RNA, 17 nt, Bordetella pertussis
uguccguaucgcggccg

SEQ ID NO: 404869 - RNA, 14 nt, Bordetella pertussis
uguccugcaggccc

SEQ ID NO: 404870 - RNA, 14 nt, Bordetella pertussis
ugucgaccaugucc

SEQ ID NO: 404871 - RNA, 19 nt, Bordetella pertussis
ugucgauaucaguccuugu

SEQ ID NO: 404872 - RNA, 17 nt, Bordetella pertussis
ugucgaugccguacacg

SEQ ID NO: 404873 - RNA, 15 nt, Bordetella pertussis
ugucgcaggccgcgg

SEQ ID NO: 404874 - RNA, 21 nt, Bordetella pertussis
ugucgcaggccgcggccaggc

SEQ ID NO: 404875 - RNA, 17 nt, Bordetella pertussis
ugucgcagucggggccg

SEQ ID NO: 404876 - RNA, 16 nt, Bordetella pertussis
ugucgcccaccacgcc

SEQ ID NO: 404877 - RNA, 15 nt, Bordetella pertussis
ugucgcccaugcuga

SEQ ID NO: 404878 - RNA, 12 nt, Bordetella pertussis
ugucgccgaccc

SEQ ID NO: 404879 - RNA, 15 nt, Bordetella pertussis
ugucgccgccgcgca

SEQ ID NO: 404880 - RNA, 15 nt, Bordetella pertussis
ugucgccgccugcgg

SEQ ID NO: 404881 - RNA, 14 nt, Bordetella pertussis
ugucgcgcaccgcc

SEQ ID NO: 404882 - RNA, 19 nt, Bordetella pertussis
ugucgcgcaccgccugcug

SEQ ID NO: 404883 - RNA, 15 nt, Bordetella pertussis
ugucgcgcagcgagu

SEQ ID NO: 404884 - RNA, 23 nt, Bordetella pertussis
ugucgcucccccaugcggggaca

SEQ ID NO: 404885 - RNA, 20 nt, Bordetella pertussis
ugucggccuucugcgccagc

SEQ ID NO: 404886 - RNA, 14 nt, Bordetella pertussis
ugucggcggccagc

SEQ ID NO: 404887 - RNA, 14 nt, Bordetella pertussis
ugucggggccgggc

SEQ ID NO: 404888 - RNA, 18 nt, Bordetella pertussis
ugucggugaaggccacgc

SEQ ID NO: 404889 - RNA, 18 nt, Bordetella pertussis
ugucguccagcuccaggu

SEQ ID NO: 404890 - RNA, 17 nt, Bordetella pertussis
ugucgugaucgccagcg

SEQ ID NO: 404891 - RNA, 19 nt, Bordetella pertussis
ugugauagacauugcccag

SEQ ID NO: 404892 - RNA, 18 nt, Bordetella pertussis
ugugccagcccccugcgg

SEQ ID NO: 404893 - RNA, 15 nt, Bordetella pertussis
ugugccgccagcggg

SEQ ID NO: 404894 - RNA, 14 nt, Bordetella pertussis
uguggcaggccagc

SEQ ID NO: 404895 - RNA, 18 nt, Bordetella pertussis
ugugguuggcgcugcugc

SEQ ID NO: 404896 - RNA, 16 nt, Bordetella pertussis
uguucgccaaucugcc

SEQ ID NO: 404897 - RNA, 18 nt, Bordetella pertussis
uguucgccaaucugccgc

SEQ ID NO: 404898 - RNA, 22 nt, Bordetella pertussis
uguucgccgcaccaggccgcgg

SEQ ID NO: 404899 - RNA, 20 nt, Bordetella pertussis
uguucggggcagggcgccug

SEQ ID NO: 404900 - RNA, 21 nt, Bordetella pertussis
uguucggggcagggcgccugc

SEQ ID NO: 404901 - RNA, 14 nt, Bordetella pertussis
uguucuucaggcuc

SEQ ID NO: 404902 - RNA, 15 nt, Bordetella pertussis
uguucuuguugcucu

SEQ ID NO: 404903 - RNA, 14 nt, Bordetella pertussis
uguugcccaccagc

SEQ ID NO: 404904 - RNA, 15 nt, Bordetella pertussis
uguugcccaccagcc

SEQ ID NO: 404905 - RNA, 20 nt, Bordetella pertussis
uguugcgaaacccgcugggc

SEQ ID NO: 404906 - RNA, 15 nt, Bordetella pertussis
uguugcgccuguccc

SEQ ID NO: 404907 - RNA, 15 nt, Bordetella pertussis
uguugcgugccgccc

SEQ ID NO: 404908 - RNA, 14 nt, Bordetella pertussis
uucaaagaucugcu

SEQ ID NO: 404909 - RNA, 15 nt, Bordetella pertussis
uucaaagaucugcug

SEQ ID NO: 404910 - RNA, 14 nt, Bordetella pertussis
uucaccauugaaac

SEQ ID NO: 404911 - RNA, 22 nt, Bordetella pertussis
uucagacagacgcugacugcgg

SEQ ID NO: 404912 - RNA, 14 nt, Bordetella pertussis
uucagcgccggcau

SEQ ID NO: 404913 - RNA, 16 nt, Bordetella pertussis
uucaggcgcgcggcag

SEQ ID NO: 404914 - RNA, 14 nt, Bordetella pertussis
uucagggguagacg

SEQ ID NO: 404915 - RNA, 23 nt, Bordetella pertussis
uucaugcguucggccagccccac

SEQ ID NO: 404916 - RNA, 23 nt, Bordetella pertussis
uuccaaguugcucauggcggcac

SEQ ID NO: 404917 - RNA, 16 nt, Bordetella pertussis
uuccacagccaggccg

SEQ ID NO: 404918 - RNA, 17 nt, Bordetella pertussis
uuccagaugcgcagcag

SEQ ID NO: 404919 - RNA, 23 nt, Bordetella pertussis
uuccagccuggcaaugcguggcc

SEQ ID NO: 404920 - RNA, 19 nt, Bordetella pertussis
uuccagcgccgccuucacc

SEQ ID NO: 404921 - RNA, 11 nt, Bordetella pertussis
uuccagcgccu

SEQ ID NO: 404922 - RNA, 16 nt, Bordetella pertussis
uuccagcuccggcggc

SEQ ID NO: 404923 - RNA, 17 nt, Bordetella pertussis
uuccagcuccggcggca

SEQ ID NO: 404924 - RNA, 18 nt, Bordetella pertussis
uuccagcuccggcggcag

SEQ ID NO: 404925 - RNA, 22 nt, Bordetella pertussis
uuccaggaaagaggccaggccc

SEQ ID NO: 404926 - RNA, 14 nt, Bordetella pertussis
uuccaggaacucca

SEQ ID NO: 404927 - RNA, 22 nt, Bordetella pertussis
uuccaggacgacaggcaugcag

SEQ ID NO: 404928 - RNA, 18 nt, Bordetella pertussis
uuccaggcauucccgccc

SEQ ID NO: 404929 - RNA, 20 nt, Bordetella pertussis
uuccaggcgcccgccaccag

SEQ ID NO: 404930 - RNA, 20 nt, Bordetella pertussis
uuccaggucaucaccagggu

SEQ ID NO: 404931 - RNA, 16 nt, Bordetella pertussis
uuccaguccagcgucg

SEQ ID NO: 404932 - RNA, 20 nt, Bordetella pertussis
uuccauaugcugaaggucgc

SEQ ID NO: 404933 - RNA, 21 nt, Bordetella pertussis
uuccaucagcucgaccacggc

SEQ ID NO: 404934 - RNA, 13 nt, Bordetella pertussis
uuccccaucaucu

SEQ ID NO: 404935 - RNA, 14 nt, Bordetella pertussis
uucccgaugcuccg

SEQ ID NO: 404936 - RNA, 18 nt, Bordetella pertussis
uuccgcuucggacagcag

SEQ ID NO: 404937 - RNA, 16 nt, Bordetella pertussis
uuccggaauccacagc

SEQ ID NO: 404938 - RNA, 15 nt, Bordetella pertussis
uuccggccccaugaa

SEQ ID NO: 404939 - RNA, 14 nt, Bordetella pertussis
uuccguuugagaca

SEQ ID NO: 404940 - RNA, 21 nt, Bordetella pertussis
uuccucccagaccugcgcgcc

SEQ ID NO: 404941 - RNA, 15 nt, Bordetella pertussis
uuccucgaccagguc

SEQ ID NO: 404942 - RNA, 23 nt, Bordetella pertussis
uuccugaacgacgguacaccuga

SEQ ID NO: 404943 - RNA, 18 nt, Bordetella pertussis
uuccugaacgccgggccg

SEQ ID NO: 404944 - RNA, 19 nt, Bordetella pertussis
uuccugcagcgugcugcgu

SEQ ID NO: 404945 - RNA, 19 nt, Bordetella pertussis
uuccugccgcacuucgggc

SEQ ID NO: 404946 - RNA, 19 nt, Bordetella pertussis
uuccugcuuugagcaggcg

SEQ ID NO: 404947 - RNA, 22 nt, Bordetella pertussis
uuccuggagcuuggccggugcc

SEQ ID NO: 404948 - RNA, 14 nt, Bordetella pertussis
uuccugguucaggc

SEQ ID NO: 404949 - RNA, 14 nt, Bordetella pertussis
uuccuucagcagcu

SEQ ID NO: 404950 - RNA, 13 nt, Bordetella pertussis
uuccuugccaucc

SEQ ID NO: 404951 - RNA, 21 nt, Bordetella pertussis
uuccuugccauccagccaggc

SEQ ID NO: 404952 - RNA, 14 nt, Bordetella pertussis
uucgaacaaggcgg

SEQ ID NO: 404953 - RNA, 13 nt, Bordetella pertussis
uucgaccugcccg

SEQ ID NO: 404954 - RNA, 22 nt, Bordetella pertussis
uucgaccugcccgagaccgccc

SEQ ID NO: 404955 - RNA, 14 nt, Bordetella pertussis
uucgacgccggcag

SEQ ID NO: 404956 - RNA, 15 nt, Bordetella pertussis
uucgacgggcaggcc

SEQ ID NO: 404957 - RNA, 20 nt, Bordetella pertussis
uucgaucaugcccgccacgg

SEQ ID NO: 404958 - RNA, 21 nt, Bordetella pertussis
uucgauggcggccagggcaag

SEQ ID NO: 404959 - RNA, 18 nt, Bordetella pertussis
uucgcagcggaugccgcc

SEQ ID NO: 404960 - RNA, 18 nt, Bordetella pertussis
uucgcauaccggccgcgg

SEQ ID NO: 404961 - RNA, 22 nt, Bordetella pertussis
uucgcauacggacgagcgcagc

SEQ ID NO: 404962 - RNA, 12 nt, Bordetella pertussis
uucgcccgugcc

SEQ ID NO: 404963 - RNA, 23 nt, Bordetella pertussis
uucgccgaugaccagcagcgccg

SEQ ID NO: 404964 - RNA, 17 nt, Bordetella pertussis
uucgccgcgcacagccc

SEQ ID NO: 404965 - RNA, 20 nt, Bordetella pertussis
uucgccguggcuggucacgu

SEQ ID NO: 404966 - RNA, 19 nt, Bordetella pertussis
uucgccuggccggcuugca

SEQ ID NO: 404967 - RNA, 19 nt, Bordetella pertussis
uucgcgcagcaacccgccc

SEQ ID NO: 404968 - RNA, 16 nt, Bordetella pertussis
uucgcgccugagcugc

SEQ ID NO: 404969 - RNA, 16 nt, Bordetella pertussis
uucgcgcugcagauca

SEQ ID NO: 404970 - RNA, 18 nt, Bordetella pertussis
uucgcgcugcccaccgcc

SEQ ID NO: 404971 - RNA, 20 nt, Bordetella pertussis
uucgcgucgucguuucccag

SEQ ID NO: 404972 - RNA, 18 nt, Bordetella pertussis
uucgcugacgcguucuuc

SEQ ID NO: 404973 - RNA, 18 nt, Bordetella pertussis
uucgcugcgaaacagcag

SEQ ID NO: 404974 - RNA, 23 nt, Bordetella pertussis
uucggcagcgaggcgcagcgcag

SEQ ID NO: 404975 - RNA, 21 nt, Bordetella pertussis
uucggccagccccaccuugcc

SEQ ID NO: 404976 - RNA, 17 nt, Bordetella pertussis
uucggccgucagcagca

SEQ ID NO: 404977 - RNA, 18 nt, Bordetella pertussis
uucggccgucagcagcag

SEQ ID NO: 404978 - RNA, 20 nt, Bordetella pertussis
uucguacagccugcccuggu

SEQ ID NO: 404979 - RNA, 20 nt, Bordetella pertussis
uucgucgucggucggcuuga

SEQ ID NO: 404980 - RNA, 18 nt, Bordetella pertussis
uucgugaugccccagguc

SEQ ID NO: 404981 - RNA, 18 nt, Bordetella pertussis
uucgugcggccgcagcag

SEQ ID NO: 404982 - RNA, 17 nt, Bordetella pertussis
uucucgggcgucaugcg

SEQ ID NO: 404983 - RNA, 20 nt, Bordetella pertussis
uucuggaagauguaccagcc

SEQ ID NO: 404984 - RNA, 21 nt, Bordetella pertussis
uucuggaagauguaccagccc

SEQ ID NO: 404985 - RNA, 14 nt, Bordetella pertussis
uucuggacgcugac

SEQ ID NO: 404986 - RNA, 17 nt, Bordetella pertussis
uucuucagcauggagcu

SEQ ID NO: 404987 - RNA, 20 nt, Bordetella pertussis
uucuuccuugcgaugccagu

SEQ ID NO: 404988 - RNA, 20 nt, Bordetella pertussis
uucuugcgcaucggcggcag

SEQ ID NO: 404989 - RNA, 21 nt, Bordetella pertussis
uugaacugcuggaacaccaug

SEQ ID NO: 404990 - RNA, 16 nt, Bordetella pertussis
uugaccuggucggccu

SEQ ID NO: 404991 - RNA, 17 nt, Bordetella pertussis
uugacgcugcucuuggc

SEQ ID NO: 404992 - RNA, 18 nt, Bordetella pertussis
uugagaaugcccaggaug

SEQ ID NO: 404993 - RNA, 22 nt, Bordetella pertussis
uugagcaggucgagguccugcu

SEQ ID NO: 404994 - RNA, 11 nt, Bordetella pertussis
uugcagcggcg

SEQ ID NO: 404995 - RNA, 20 nt, Bordetella pertussis
uugcagggugucggccaggg

SEQ ID NO: 404996 - RNA, 18 nt, Bordetella pertussis
uugccauccagccaggcc

SEQ ID NO: 404997 - RNA, 14 nt, Bordetella pertussis
uugcccaccacggc

SEQ ID NO: 404998 - RNA, 17 nt, Bordetella pertussis
uugcccacgcgcuccug

SEQ ID NO: 404999 - RNA, 17 nt, Bordetella pertussis
uugcccagcaccacggg

SEQ ID NO: 405000 - RNA, 22 nt, Bordetella pertussis
uugcgccagcgcuguccaggcc

SEQ ID NO: 405001 - RNA, 13 nt, Bordetella pertussis
uugcggcacggcu

SEQ ID NO: 405002 - RNA, 14 nt, Bordetella pertussis
uugcggcagcgccg

SEQ ID NO: 405003 - RNA, 13 nt, Bordetella pertussis
uugcggccgccac

SEQ ID NO: 405004 - RNA, 13 nt, Bordetella pertussis
uugcggccgccga

SEQ ID NO: 405005 - RNA, 21 nt, Bordetella pertussis
uugcggcggacacgcaugcag

SEQ ID NO: 405006 - RNA, 14 nt, Bordetella pertussis
uugcgguaguucag

SEQ ID NO: 405007 - RNA, 20 nt, Bordetella pertussis
uugcuccggcgugacguggc

SEQ ID NO: 405008 - RNA, 15 nt, Bordetella pertussis
uugcucgaccagguc

SEQ ID NO: 405009 - RNA, 13 nt, Bordetella pertussis
uugcuggcccagg

SEQ ID NO: 405010 - RNA, 11 nt, Bordetella pertussis
uuggccgccag

SEQ ID NO: 405011 - RNA, 18 nt, Bordetella pertussis
uuggccggcgcgcccuug

SEQ ID NO: 405012 - RNA, 21 nt, Bordetella pertussis
uuggccguccacgaaggcagc

SEQ ID NO: 405013 - RNA, 17 nt, Bordetella pertussis
uuggccgucgccagcga

SEQ ID NO: 405014 - RNA, 18 nt, Bordetella pertussis
uuggccgggucgcgcagc

SEQ ID NO: 405015 - RNA, 22 nt, Bordetella pertussis
uuggccuucggcgaucugggcc

SEQ ID NO: 405016 - RNA, 18 nt, Bordetella pertussis
uuggcuguaucuggccug

SEQ ID NO: 405017 - RNA, 20 nt, Bordetella pertussis
uugggaaggccgcgccgcgg

SEQ ID NO: 405018 - RNA, 16 nt, Bordetella pertussis
uugggacgcggccuuu

SEQ ID NO: 405019 - RNA, 16 nt, Bordetella pertussis
uugggggucagcgccg

SEQ ID NO: 405020 - RNA, 22 nt, Bordetella pertussis
uuggggucccacugccaguagg

SEQ ID NO: 405021 - RNA, 13 nt, Bordetella pertussis
uuggucugcaggc

SEQ ID NO: 405022 - RNA, 22 nt, Bordetella pertussis
uugguuggccugggccaggacc

SEQ ID NO: 405023 - RNA, 19 nt, Bordetella pertussis
uuguagggaaucgucauga

SEQ ID NO: 405024 - RNA, 18 nt, Bordetella pertussis
uuguauuccaucuugccg

SEQ ID NO: 405025 - RNA, 17 nt, Bordetella pertussis
uuguauugcgucagggc

SEQ ID NO: 405026 - RNA, 18 nt, Bordetella pertussis
uuguucaggaaggcccgg

SEQ ID NO: 405027 - RNA, 22 nt, Bordetella pertussis
uuuuccucuaccccguagaacu

SEQ ID NO: 405028 - RNA, 15 nt, Bordetella pertussis
uuuugccuuggggcg

SEQ ID NO: 405029 - RNA, 15 nt, Bordetella pertussis
uuuugcggcacggcu

SEQ ID NO: 405030 - RNA, 19 nt, Bordetella pertussis
aaaaacggcggaaauucau

SEQ ID NO: 405031 - RNA, 15 nt, Bordetella pertussis
aaaaagcccgcgcca

SEQ ID NO: 405032 - RNA, 14 nt, Bordetella pertussis
aaaagcugccggca

SEQ ID NO: 405033 - RNA, 11 nt, Bordetella pertussis
aaacagcagcg

SEQ ID NO: 405034 - RNA, 22 nt, Bordetella pertussis
aaacagcuuccuuuauugaaau

SEQ ID NO: 405035 - RNA, 18 nt, Bordetella pertussis
aaaccaacggggccgcca

SEQ ID NO: 405036 - RNA, 16 nt, Bordetella pertussis
aaagaggccacccgaa

SEQ ID NO: 405037 - RNA, 15 nt, Bordetella pertussis
aaagcaagacagcaa

SEQ ID NO: 405038 - RNA, 18 nt, Bordetella pertussis
aaagccugacggcuacac

SEQ ID NO: 405039 - RNA, 22 nt, Bordetella pertussis
aaagcgcggcugcgggccggcg

SEQ ID NO: 405040 - RNA, 18 nt, Bordetella pertussis
aaagcggcgugugcccag

SEQ ID NO: 405041 - RNA, 20 nt, Bordetella pertussis
aaaucuucugcgccacggcg

SEQ ID NO: 405042 - RNA, 17 nt, Bordetella pertussis
aaauggggcggccggga

SEQ ID NO: 405043 - RNA, 16 nt, Bordetella pertussis
aaauuauuugguggag

SEQ ID NO: 405044 - RNA, 20 nt, Bordetella pertussis
aaauugacggcgcucuuggu

SEQ ID NO: 405045 - RNA, 14 nt, Bordetella pertussis
aacaacggggucau

SEQ ID NO: 405046 - RNA, 23 nt, Bordetella pertussis
aacaaggcgacggucgcaaacag

SEQ ID NO: 405047 - RNA, 13 nt, Bordetella pertussis
aacagcgccugca

SEQ ID NO: 405048 - RNA, 16 nt, Bordetella pertussis
aacagcguccagccgc

SEQ ID NO: 405049 - RNA, 17 nt, Bordetella pertussis
aacagcuucuccaugcg

SEQ ID NO: 405050 - RNA, 11 nt, Bordetella pertussis
aacaggcaccg

SEQ ID NO: 405051 - RNA, 22 nt, Bordetella pertussis
aacaggcacgacgcgaaccagg

SEQ ID NO: 405052 - RNA, 12 nt, Bordetella pertussis
aacaggcggcug

SEQ ID NO: 405053 - RNA, 16 nt, Bordetella pertussis
aacaggcggcugaaga

SEQ ID NO: 405054 - RNA, 16 nt, Bordetella pertussis
aacaucgcccugucgg

SEQ ID NO: 405055 - RNA, 15 nt, Bordetella pertussis
aacaucuccaccagc

SEQ ID NO: 405056 - RNA, 11 nt, Bordetella pertussis
aaccacagcau

SEQ ID NO: 405057 - RNA, 23 nt, Bordetella pertussis
aaccacccggccaucgaagccag

SEQ ID NO: 405058 - RNA, 17 nt, Bordetella pertussis
aaccagcgcaccaccag

SEQ ID NO: 405059 - RNA, 13 nt, Bordetella pertussis
aaccaggccgggg

SEQ ID NO: 405060 - RNA, 14 nt, Bordetella pertussis
aaccccgccaggcg

SEQ ID NO: 405061 - RNA, 14 nt, Bordetella pertussis
aacccgacgaugau

SEQ ID NO: 405062 - RNA, 18 nt, Bordetella pertussis
aacccgccauccuggccg

SEQ ID NO: 405063 - RNA, 16 nt, Bordetella pertussis
aaccggucggccggca

SEQ ID NO: 405064 - RNA, 17 nt, Bordetella pertussis
aaccgucgaugaccagc

SEQ ID NO: 405065 - RNA, 18 nt, Bordetella pertussis
aaccugguuacucuguuc

SEQ ID NO: 405066 - RNA, 11 nt, Bordetella pertussis
aaccuggucaa

SEQ ID NO: 405067 - RNA, 19 nt, Bordetella pertussis
aaccuuccuccgacaggcg

SEQ ID NO: 405068 - RNA, 16 nt, Bordetella pertussis
aacgccaagcugcugg

SEQ ID NO: 405069 - RNA, 22 nt, Bordetella pertussis
aacgccaagcugcuggccggcc

SEQ ID NO: 405070 - RNA, 15 nt, Bordetella pertussis
aacgcgccggcccag

SEQ ID NO: 405071 - RNA, 20 nt, Bordetella pertussis
aacgcgcgccggccagcggc

SEQ ID NO: 405072 - RNA, 17 nt, Bordetella pertussis
aacgcgcguccuuggcg

SEQ ID NO: 405073 - RNA, 13 nt, Bordetella pertussis
aacgcggccagcg

SEQ ID NO: 405074 - RNA, 14 nt, Bordetella pertussis
aacgcggccaugcg

SEQ ID NO: 405075 - RNA, 18 nt, Bordetella pertussis
aacgcggcgccgccggcg

SEQ ID NO: 405076 - RNA, 23 nt, Bordetella pertussis
aacgcggcgccgccggcggccug

SEQ ID NO: 405077 - RNA, 13 nt, Bordetella pertussis
aacggcagcagcg

SEQ ID NO: 405078 - RNA, 13 nt, Bordetella pertussis
aacggccgcccgg

SEQ ID NO: 405079 - RNA, 14 nt, Bordetella pertussis
aacggccgggcgcc

SEQ ID NO: 405080 - RNA, 17 nt, Bordetella pertussis
aacggcgcgaaggugcg

SEQ ID NO: 405081 - RNA, 19 nt, Bordetella pertussis
aacggcgcggccugcucga

SEQ ID NO: 405082 - RNA, 13 nt, Bordetella pertussis
aacggcggcaggc

SEQ ID NO: 405083 - RNA, 16 nt, Bordetella pertussis
aacggggacgggcgcc

SEQ ID NO: 405084 - RNA, 16 nt, Bordetella pertussis
aacucgauccgggccu

SEQ ID NO: 405085 - RNA, 15 nt, Bordetella pertussis
aacucggccagcagc

SEQ ID NO: 405086 - RNA, 22 nt, Bordetella pertussis
aacucgggguggaacugggcug

SEQ ID NO: 405087 - RNA, 18 nt, Bordetella pertussis
aagacaugcugcgacagc

SEQ ID NO: 405088 - RNA, 23 nt, Bordetella pertussis
aagacauggcgcgcgccagcggc

SEQ ID NO: 405089 - RNA, 16 nt, Bordetella pertussis
aagacgaagucccagc

SEQ ID NO: 405090 - RNA, 13 nt, Bordetella pertussis
aagacgcgcucgc

SEQ ID NO: 405091 - RNA, 22 nt, Bordetella pertussis
aagacggcguuucuacugggug

SEQ ID NO: 405092 - RNA, 13 nt, Bordetella pertussis
aagacguggcccg

SEQ ID NO: 405093 - RNA, 21 nt, Bordetella pertussis
aagacuuccgugccauacagc

SEQ ID NO: 405094 - RNA, 13 nt, Bordetella pertussis
aagagccuguccc

SEQ ID NO: 405095 - RNA, 22 nt, Bordetella pertussis
aagagccugucccgacggggac

SEQ ID NO: 405096 - RNA, 19 nt, Bordetella pertussis
aagaggagcugcacaaggu

SEQ ID NO: 405097 - RNA, 14 nt, Bordetella pertussis
aagaggccaggccc

SEQ ID NO: 405098 - RNA, 22 nt, Bordetella pertussis
aagaucaggcggcugcccaccu

SEQ ID NO: 405099 - RNA, 21 nt, Bordetella pertussis
aagauccagcuucaucaccuu

SEQ ID NO: 405100 - RNA, 22 nt, Bordetella pertussis
aagauccgccauaugcgcgaag

SEQ ID NO: 405101 - RNA, 22 nt, Bordetella pertussis
aagccggcccguuggcaggcca

SEQ ID NO: 405102 - RNA, 14 nt, Bordetella pertussis
aagccguccuugag

SEQ ID NO: 405103 - RNA, 21 nt, Bordetella pertussis
aagccguccuuggcgccggcg

SEQ ID NO: 405104 - RNA, 22 nt, Bordetella pertussis
aagccucacaugucacacgaag

SEQ ID NO: 405105 - RNA, 22 nt, Bordetella pertussis
aagcgcaccaguuucucggcca

SEQ ID NO: 405106 - RNA, 14 nt, Bordetella pertussis
aagcgcagcaccag

SEQ ID NO: 405107 - RNA, 14 nt, Bordetella pertussis
aagcgcgccaggcg

SEQ ID NO: 405108 - RNA, 21 nt, Bordetella pertussis
aagcgcggcugcgggccggcg

SEQ ID NO: 405109 - RNA, 17 nt, Bordetella pertussis
aagcggcaggcggcaga

SEQ ID NO: 405110 - RNA, 12 nt, Bordetella pertussis
aagcggccggcc

SEQ ID NO: 405111 - RNA, 21 nt, Bordetella pertussis
aagcggugcgcuggaauaugg

SEQ ID NO: 405112 - RNA, 17 nt, Bordetella pertussis
aagcuggcgcuuggcca

SEQ ID NO: 405113 - RNA, 14 nt, Bordetella pertussis
aaggcagcaggcug

SEQ ID NO: 405114 - RNA, 15 nt, Bordetella pertussis
aaggcagccugucgu

SEQ ID NO: 405115 - RNA, 16 nt, Bordetella pertussis
aaggcaugcgccagcg

SEQ ID NO: 405116 - RNA, 17 nt, Bordetella pertussis
aaggcaugcgccagcgc

SEQ ID NO: 405117 - RNA, 22 nt, Bordetella pertussis
aaggccgccgcgcccagcagcg

SEQ ID NO: 405118 - RNA, 23 nt, Bordetella pertussis
aaggccgcgccgcggcaagccgc

SEQ ID NO: 405119 - RNA, 19 nt, Bordetella pertussis
aaggcuucgucgaccagca

SEQ ID NO: 405120 - RNA, 22 nt, Bordetella pertussis
aagggccugucacaccccacca

SEQ ID NO: 405121 - RNA, 16 nt, Bordetella pertussis
aagggcgugucucuuc

SEQ ID NO: 405122 - RNA, 22 nt, Bordetella pertussis
aagggcugcgugcgggacaggc

SEQ ID NO: 405123 - RNA, 18 nt, Bordetella pertussis
aaguacacggccagcacg

SEQ ID NO: 405124 - RNA, 15 nt, Bordetella pertussis
aaguacucgccggcg

SEQ ID NO: 405125 - RNA, 16 nt, Bordetella pertussis
aaguaggcggccaggc

SEQ ID NO: 405126 - RNA, 17 nt, Bordetella pertussis
aaguaggcggccaggcc

SEQ ID NO: 405127 - RNA, 19 nt, Bordetella pertussis
aaguagugcccccacgcug

SEQ ID NO: 405128 - RNA, 19 nt, Bordetella pertussis
aagucaucgauggccaggu

SEQ ID NO: 405129 - RNA, 22 nt, Bordetella pertussis
aaguccagcguggugaugucgg

SEQ ID NO: 405130 - RNA, 16 nt, Bordetella pertussis
aagucgaaccacacga

SEQ ID NO: 405131 - RNA, 13 nt, Bordetella pertussis
aagucgggcacca

SEQ ID NO: 405132 - RNA, 22 nt, Bordetella pertussis
aaguguggcgcaccgcgcuggg

SEQ ID NO: 405133 - RNA, 19 nt, Bordetella pertussis
aauaccuucagcccggcga

SEQ ID NO: 405134 - RNA, 17 nt, Bordetella pertussis
aauccccgcuuccugcu

SEQ ID NO: 405135 - RNA, 14 nt, Bordetella pertussis
aaucgccgccggcg

SEQ ID NO: 405136 - RNA, 16 nt, Bordetella pertussis
aaucgcggcgcugugc

SEQ ID NO: 405137 - RNA, 22 nt, Bordetella pertussis
aaucggccccugcccugcggcu

SEQ ID NO: 405138 - RNA, 22 nt, Bordetella pertussis
aaucgggcagcacgcgcaccag

SEQ ID NO: 405139 - RNA, 23 nt, Bordetella pertussis
aaugaugguggggcuggccgccg

SEQ ID NO: 405140 - RNA, 19 nt, Bordetella pertussis
aaugccccacggguaccag

SEQ ID NO: 405141 - RNA, 21 nt, Bordetella pertussis
aaugccgcccacgaucaccac

SEQ ID NO: 405142 - RNA, 23 nt, Bordetella pertussis
aaugccgccgugaugccgcccgc

SEQ ID NO: 405143 - RNA, 14 nt, Bordetella pertussis
aaugccggccgaua

SEQ ID NO: 405144 - RNA, 20 nt, Bordetella pertussis
aaugccggcgaauaugcccu

SEQ ID NO: 405145 - RNA, 13 nt, Bordetella pertussis
aaugggccgcagc

SEQ ID NO: 405146 - RNA, 18 nt, Bordetella pertussis
aauugacggcgcucuugg

SEQ ID NO: 405147 - RNA, 14 nt, Bordetella pertussis
acaacggcgugcug

SEQ ID NO: 405148 - RNA, 18 nt, Bordetella pertussis
acaccaucaaggccauga

SEQ ID NO: 405149 - RNA, 21 nt, Bordetella pertussis
acaccaugauggccgcgcgca

SEQ ID NO: 405150 - RNA, 15 nt, Bordetella pertussis
acacccggucggccc

SEQ ID NO: 405151 - RNA, 15 nt, Bordetella pertussis
acacuggcccuggca

SEQ ID NO: 405152 - RNA, 17 nt, Bordetella pertussis
acacuuggccggcgauu

SEQ ID NO: 405153 - RNA, 22 nt, Bordetella pertussis
acagacgcugacugcggugccu

SEQ ID NO: 405154 - RNA, 21 nt, Bordetella pertussis
acagauacuguucgccgcacc

SEQ ID NO: 405155 - RNA, 15 nt, Bordetella pertussis
acagaugggcggccu

SEQ ID NO: 405156 - RNA, 23 nt, Bordetella pertussis
acagaugggcggccuagcuguga

SEQ ID NO: 405157 - RNA, 14 nt, Bordetella pertussis
acagcaucagcuug

SEQ ID NO: 405158 - RNA, 20 nt, Bordetella pertussis
acagccauugcccacagcac

SEQ ID NO: 405159 - RNA, 15 nt, Bordetella pertussis
acagccccagcagca

SEQ ID NO: 405160 - RNA, 19 nt, Bordetella pertussis
acagcccgcgcuggcgcag

SEQ ID NO: 405161 - RNA, 15 nt, Bordetella pertussis
acagcggagccgcgc

SEQ ID NO: 405162 - RNA, 22 nt, Bordetella pertussis
acagcggcgcgagcgcacaggc

SEQ ID NO: 405163 - RNA, 20 nt, Bordetella pertussis
acagcuggaagcgcgccagg

SEQ ID NO: 405164 - RNA, 14 nt, Bordetella pertussis
acaggacagccgcu

SEQ ID NO: 405165 - RNA, 14 nt, Bordetella pertussis
acaggcacacucug

SEQ ID NO: 405166 - RNA, 16 nt, Bordetella pertussis
acaggcacacucuguc

SEQ ID NO: 405167 - RNA, 11 nt, Bordetella pertussis
acaggcacccg

SEQ ID NO: 405168 - RNA, 19 nt, Bordetella pertussis
acaggcaccgaacccugcc

SEQ ID NO: 405169 - RNA, 17 nt, Bordetella pertussis
acaggcaccucguucac

SEQ ID NO: 405170 - RNA, 14 nt, Bordetella pertussis
acaggcacucugcc

SEQ ID NO: 405171 - RNA, 12 nt, Bordetella pertussis
acaggcccagcc

SEQ ID NO: 405172 - RNA, 20 nt, Bordetella pertussis
acaggcccagcgccagcagc

SEQ ID NO: 405173 - RNA, 22 nt, Bordetella pertussis
acaggcccaguacggccugcau

SEQ ID NO: 405174 - RNA, 21 nt, Bordetella pertussis
acaggcccucggugcggaaga

SEQ ID NO: 405175 - RNA, 13 nt, Bordetella pertussis
acauagcccggcg

SEQ ID NO: 405176 - RNA, 13 nt, Bordetella pertussis
acaugaugcccag

SEQ ID NO: 405177 - RNA, 22 nt, Bordetella pertussis
acaugaugcccagcgccagggc

SEQ ID NO: 405178 - RNA, 21 nt, Bordetella pertussis
acaugcugcgacagcagggcc

SEQ ID NO: 405179 - RNA, 15 nt, Bordetella pertussis
acaugcuggcccagc

SEQ ID NO: 405180 - RNA, 14 nt, Bordetella pertussis
acauggaaauccuu

SEQ ID NO: 405181 - RNA, 22 nt, Bordetella pertussis
acauggcgcgcgccagcggcug

SEQ ID NO: 405182 - RNA, 12 nt, Bordetella pertussis
acauggcggcga

SEQ ID NO: 405183 - RNA, 14 nt, Bordetella pertussis
acauugcccagcac

SEQ ID NO: 405184 - RNA, 22 nt, Bordetella pertussis
accaacccugccuccaggcgca

SEQ ID NO: 405185 - RNA, 19 nt, Bordetella pertussis
accaacucgaggcggcgca

SEQ ID NO: 405186 - RNA, 15 nt, Bordetella pertussis
accaauacaggaagc

SEQ ID NO: 405187 - RNA, 21 nt, Bordetella pertussis
accaauacgccgccauggugc

SEQ ID NO: 405188 - RNA, 18 nt, Bordetella pertussis
accacaggguggcgccca

SEQ ID NO: 405189 - RNA, 14 nt, Bordetella pertussis
accaccaccgcccg

SEQ ID NO: 405190 - RNA, 12 nt, Bordetella pertussis
accaccagcacc

SEQ ID NO: 405191 - RNA, 14 nt, Bordetella pertussis
accaccagcaccga

SEQ ID NO: 405192 - RNA, 12 nt, Bordetella pertussis
accaccagcagg

SEQ ID NO: 405193 - RNA, 16 nt, Bordetella pertussis
accaccagcaggaugg

SEQ ID NO: 405194 - RNA, 21 nt, Bordetella pertussis
accaccagcgcggccagcacc

SEQ ID NO: 405195 - RNA, 21 nt, Bordetella pertussis
accaccaggccggccagggcc

SEQ ID NO: 405196 - RNA, 13 nt, Bordetella pertussis
accacccgcacgc

SEQ ID NO: 405197 - RNA, 13 nt, Bordetella pertussis
accacccgcgcca

SEQ ID NO: 405198 - RNA, 17 nt, Bordetella pertussis
accacccgcgccaggaa

SEQ ID NO: 405199 - RNA, 20 nt, Bordetella pertussis
accacccgcgccaggaacac

SEQ ID NO: 405200 - RNA, 12 nt, Bordetella pertussis
accaccgcccgc

SEQ ID NO: 405201 - RNA, 22 nt, Bordetella pertussis
accaccgucucgaacgccgcgu

SEQ ID NO: 405202 - RNA, 18 nt, Bordetella pertussis
accaccgucuugcccgcc

SEQ ID NO: 405203 - RNA, 22 nt, Bordetella pertussis
accaccgucuugcccgccagcg

SEQ ID NO: 405204 - RNA, 14 nt, Bordetella pertussis
accaccuugcccca

SEQ ID NO: 405205 - RNA, 14 nt, Bordetella pertussis
accacgaccuuggc

SEQ ID NO: 405206 - RNA, 17 nt, Bordetella pertussis
accacgaccuuggcggc

SEQ ID NO: 405207 - RNA, 16 nt, Bordetella pertussis
accacgcccuggauca

SEQ ID NO: 405208 - RNA, 15 nt, Bordetella pertussis
accacgccggcggcc

SEQ ID NO: 405209 - RNA, 15 nt, Bordetella pertussis
accacgccuucgagc

SEQ ID NO: 405210 - RNA, 16 nt, Bordetella pertussis
accacggccagcagca

SEQ ID NO: 405211 - RNA, 17 nt, Bordetella pertussis
accacggccagcagcac

SEQ ID NO: 405212 - RNA, 23 nt, Bordetella pertussis
accacggcgcgcccgcaggcggc

SEQ ID NO: 405213 - RNA, 16 nt, Bordetella pertussis
accacggcggccaggc

SEQ ID NO: 405214 - RNA, 19 nt, Bordetella pertussis
accacggucuggcgcgaca

SEQ ID NO: 405215 - RNA, 13 nt, Bordetella pertussis
accacguggauga

SEQ ID NO: 405216 - RNA, 17 nt, Bordetella pertussis
accacguggaugauggu

SEQ ID NO: 405217 - RNA, 16 nt, Bordetella pertussis
accacguggucuggaa

SEQ ID NO: 405218 - RNA, 22 nt, Bordetella pertussis
accacuggcagaccgagcgcgc

SEQ ID NO: 405219 - RNA, 22 nt, Bordetella pertussis
accaugccgacgaacugcgagu

SEQ ID NO: 405220 - RNA, 17 nt, Bordetella pertussis
accaugcgcagcaacag

SEQ ID NO: 405221 - RNA, 13 nt, Bordetella pertussis
accaugucccugg

SEQ ID NO: 405222 - RNA, 19 nt, Bordetella pertussis
accaugucccuggccauuc

SEQ ID NO: 405223 - RNA, 16 nt, Bordetella pertussis
accauucucgcccugc

SEQ ID NO: 405224 - RNA, 19 nt, Bordetella pertussis
accauugaaacguacucca

SEQ ID NO: 405225 - RNA, 15 nt, Bordetella pertussis
acccacccccagcag

SEQ ID NO: 405226 - RNA, 16 nt, Bordetella pertussis
acccacccccagcagc

SEQ ID NO: 405227 - RNA, 17 nt, Bordetella pertussis
acccacccccagcagca

SEQ ID NO: 405228 - RNA, 15 nt, Bordetella pertussis
accccaccggcaagc

SEQ ID NO: 405229 - RNA, 17 nt, Bordetella pertussis
accccaguuccagcacg

SEQ ID NO: 405230 - RNA, 13 nt, Bordetella pertussis
acccccagcagca

SEQ ID NO: 405231 - RNA, 14 nt, Bordetella pertussis
acccccagcagcau

SEQ ID NO: 405232 - RNA, 15 nt, Bordetella pertussis
accccugcgcugcau

SEQ ID NO: 405233 - RNA, 15 nt, Bordetella pertussis
acccgcgccaggaac

SEQ ID NO: 405234 - RNA, 16 nt, Bordetella pertussis
acccgcggcgcaugca

SEQ ID NO: 405235 - RNA, 20 nt, Bordetella pertussis
acccgcggcgcaugcagccg

SEQ ID NO: 405236 - RNA, 17 nt, Bordetella pertussis
acccgcuaccccggcag

SEQ ID NO: 405237 - RNA, 18 nt, Bordetella pertussis
acccgcuaccccggcagc

SEQ ID NO: 405238 - RNA, 15 nt, Bordetella pertussis
acccgcucggccacg

SEQ ID NO: 405239 - RNA, 17 nt, Bordetella pertussis
acccgcucggccacgcg

SEQ ID NO: 405240 - RNA, 12 nt, Bordetella pertussis
acccgcugggcc

SEQ ID NO: 405241 - RNA, 17 nt, Bordetella pertussis
acccggacaacgcgcgc

SEQ ID NO: 405242 - RNA, 21 nt, Bordetella pertussis
acccggacaacgcgcgccacu

SEQ ID NO: 405243 - RNA, 13 nt, Bordetella pertussis
acccggagcugcc

SEQ ID NO: 405244 - RNA, 15 nt, Bordetella pertussis
acccggccggcgccg

SEQ ID NO: 405245 - RNA, 23 nt, Bordetella pertussis
acccggccucagcggccgcugcc

SEQ ID NO: 405246 - RNA, 15 nt, Bordetella pertussis
acccggcgaggccgc

SEQ ID NO: 405247 - RNA, 15 nt, Bordetella pertussis
acccggcgcaugcug

SEQ ID NO: 405248 - RNA, 16 nt, Bordetella pertussis
acccggcgcaugcugg

SEQ ID NO: 405249 - RNA, 18 nt, Bordetella pertussis
acccggcgcaugcuggag

SEQ ID NO: 405250 - RNA, 18 nt, Bordetella pertussis
acccgucccugguccagc

SEQ ID NO: 405251 - RNA, 22 nt, Bordetella pertussis
acccuccucgcuuuaccagcug

SEQ ID NO: 405252 - RNA, 21 nt, Bordetella pertussis
acccucgugaucgaccgccag

SEQ ID NO: 405253 - RNA, 21 nt, Bordetella pertussis
acccugaacucuucaaaacca

SEQ ID NO: 405254 - RNA, 17 nt, Bordetella pertussis
accgagccggccagcgc

SEQ ID NO: 405255 - RNA, 19 nt, Bordetella pertussis
accgagccggccagcgccu

SEQ ID NO: 405256 - RNA, 15 nt, Bordetella pertussis
accgagcugagcacc

SEQ ID NO: 405257 - RNA, 23 nt, Bordetella pertussis
accgagcugagcaccagcagccc

SEQ ID NO: 405258 - RNA, 15 nt, Bordetella pertussis
accgagcugccgccu

SEQ ID NO: 405259 - RNA, 17 nt, Bordetella pertussis
accgaucuacgacgccu

SEQ ID NO: 405260 - RNA, 17 nt, Bordetella pertussis
accgcacgauggcgcgc

SEQ ID NO: 405261 - RNA, 19 nt, Bordetella pertussis
accgcagaagcagccgcgc

SEQ ID NO: 405262 - RNA, 16 nt, Bordetella pertussis
accgcaugggccaggc

SEQ ID NO: 405263 - RNA, 17 nt, Bordetella pertussis
accgcaugggccaggcg

SEQ ID NO: 405264 - RNA, 20 nt, Bordetella pertussis
accgccacgugcugcuggag

SEQ ID NO: 405265 - RNA, 12 nt, Bordetella pertussis
accgccagcagg

SEQ ID NO: 405266 - RNA, 20 nt, Bordetella pertussis
accgccagcaggcccugggc

SEQ ID NO: 405267 - RNA, 14 nt, Bordetella pertussis
accgccaugcgcau

SEQ ID NO: 405268 - RNA, 20 nt, Bordetella pertussis
accgccaugugcgccgcgcc

SEQ ID NO: 405269 - RNA, 19 nt, Bordetella pertussis
accgcccgcaugucccagc

SEQ ID NO: 405270 - RNA, 17 nt, Bordetella pertussis
accgccgcccgcaggca

SEQ ID NO: 405271 - RNA, 15 nt, Bordetella pertussis
accgccgcguccucg

SEQ ID NO: 405272 - RNA, 15 nt, Bordetella pertussis
accgccgggacaggc

SEQ ID NO: 405273 - RNA, 16 nt, Bordetella pertussis
accgccguggccggca

SEQ ID NO: 405274 - RNA, 22 nt, Bordetella pertussis
accgccuccaggaugagcgccu

SEQ ID NO: 405275 - RNA, 17 nt, Bordetella pertussis
accgccucgacgcccgg

SEQ ID NO: 405276 - RNA, 20 nt, Bordetella pertussis
accgccucgaucgccagguc

SEQ ID NO: 405277 - RNA, 20 nt, Bordetella pertussis
accgccugcugcgccuggcc

SEQ ID NO: 405278 - RNA, 18 nt, Bordetella pertussis
accgccugugccagcugg

SEQ ID NO: 405279 - RNA, 14 nt, Bordetella pertussis
accgcgaagcgcgc

SEQ ID NO: 405280 - RNA, 16 nt, Bordetella pertussis
accgcgaagcgcgcca

SEQ ID NO: 405281 - RNA, 21 nt, Bordetella pertussis
accgcgacccgauagccgcgc

SEQ ID NO: 405282 - RNA, 17 nt, Bordetella pertussis
accgcgacgcauaucca

SEQ ID NO: 405283 - RNA, 23 nt, Bordetella pertussis
accgcgcagcccggcgugcccag

SEQ ID NO: 405284 - RNA, 21 nt, Bordetella pertussis
accgcgcccuggggcgcgguc

SEQ ID NO: 405285 - RNA, 13 nt, Bordetella pertussis
accgcgcgcacca

SEQ ID NO: 405286 - RNA, 13 nt, Bordetella pertussis
accgcgcggcgcu

SEQ ID NO: 405287 - RNA, 22 nt, Bordetella pertussis
accgcgcggcgcugcacgcggc

SEQ ID NO: 405288 - RNA, 19 nt, Bordetella pertussis
accgcgcgguggccgccgc

SEQ ID NO: 405289 - RNA, 20 nt, Bordetella pertussis
accgcggccgcgcuggcgcu

SEQ ID NO: 405290 - RNA, 17 nt, Bordetella pertussis
accgcgggcgcgcgccc

SEQ ID NO: 405291 - RNA, 18 nt, Bordetella pertussis
accgcgggcgcgcgcccc

SEQ ID NO: 405292 - RNA, 19 nt, Bordetella pertussis
accgcgggcgcgcgccccg

SEQ ID NO: 405293 - RNA, 20 nt, Bordetella pertussis
accgcgggcgcgcgccccgc

SEQ ID NO: 405294 - RNA, 21 nt, Bordetella pertussis
accgcugaucagguccaugaa

SEQ ID NO: 405295 - RNA, 15 nt, Bordetella pertussis
accgcuggccaggcu

SEQ ID NO: 405296 - RNA, 12 nt, Bordetella pertussis
accggaggcgcc

SEQ ID NO: 405297 - RNA, 14 nt, Bordetella pertussis
accggcaagcgcuc

SEQ ID NO: 405298 - RNA, 14 nt, Bordetella pertussis
accggcaaggccgc

SEQ ID NO: 405299 - RNA, 14 nt, Bordetella pertussis
accggcaccagcca

SEQ ID NO: 405300 - RNA, 15 nt, Bordetella pertussis
accggccaggggcgc

SEQ ID NO: 405301 - RNA, 18 nt, Bordetella pertussis
accggccccaccuggcgg

SEQ ID NO: 405302 - RNA, 22 nt, Bordetella pertussis
accggccgccgcaugccgggcu

SEQ ID NO: 405303 - RNA, 21 nt, Bordetella pertussis
accggccgcggguggccgcuc

SEQ ID NO: 405304 - RNA, 14 nt, Bordetella pertussis
accggccuggucau

SEQ ID NO: 405305 - RNA, 15 nt, Bordetella pertussis
accggcgccacggcu

SEQ ID NO: 405306 - RNA, 17 nt, Bordetella pertussis
accggcgcgcgcggcca

SEQ ID NO: 405307 - RNA, 20 nt, Bordetella pertussis
accggcgugcgcuggcuggg

SEQ ID NO: 405308 - RNA, 21 nt, Bordetella pertussis
accggcgugcgcuggcugggc

SEQ ID NO: 405309 - RNA, 22 nt, Bordetella pertussis
accggcguguccagcggcgcca

SEQ ID NO: 405310 - RNA, 19 nt, Bordetella pertussis
accggcucgggcucgagcc

SEQ ID NO: 405311 - RNA, 17 nt, Bordetella pertussis
accgggccggccugcgu

SEQ ID NO: 405312 - RNA, 21 nt, Bordetella pertussis
accgggccggccugcgucgcc

SEQ ID NO: 405313 - RNA, 12 nt, Bordetella pertussis
accggugcuggu

SEQ ID NO: 405314 - RNA, 18 nt, Bordetella pertussis
accgguggccauggacag

SEQ ID NO: 405315 - RNA, 19 nt, Bordetella pertussis
accgguggccauggacagc

SEQ ID NO: 405316 - RNA, 13 nt, Bordetella pertussis
accucgagcaccu

SEQ ID NO: 405317 - RNA, 15 nt, Bordetella pertussis
accucgcgcugcagc

SEQ ID NO: 405318 - RNA, 18 nt, Bordetella pertussis
accucgcgguugcgucuc

SEQ ID NO: 405319 - RNA, 22 nt, Bordetella pertussis
accucggacgagacaggcgcgc

SEQ ID NO: 405320 - RNA, 18 nt, Bordetella pertussis
accucggccggggcgguc

SEQ ID NO: 405321 - RNA, 19 nt, Bordetella pertussis
accucggcgcccagcugcu

SEQ ID NO: 405322 - RNA, 17 nt, Bordetella pertussis
accucggcgcucaggaa

SEQ ID NO: 405323 - RNA, 15 nt, Bordetella pertussis
accucggggugcagc

SEQ ID NO: 405324 - RNA, 21 nt, Bordetella pertussis
accugaauccguaagcgcugg

SEQ ID NO: 405325 - RNA, 17 nt, Bordetella pertussis
accugggaggggccggc

SEQ ID NO: 405326 - RNA, 20 nt, Bordetella pertussis
accugggccaucgggauacc

SEQ ID NO: 405327 - RNA, 18 nt, Bordetella pertussis
accuggucaagggcggcc

SEQ ID NO: 405328 - RNA, 22 nt, Bordetella pertussis
accuggucaagggcggccaugc

SEQ ID NO: 405329 - RNA, 13 nt, Bordetella pertussis
accuggucggccu

SEQ ID NO: 405330 - RNA, 14 nt, Bordetella pertussis
accuggucgggcgu

SEQ ID NO: 405331 - RNA, 21 nt, Bordetella pertussis
accuggucgucggccacgccc

SEQ ID NO: 405332 - RNA, 13 nt, Bordetella pertussis
accugguguucgg

SEQ ID NO: 405333 - RNA, 12 nt, Bordetella pertussis
accuuccugcug

SEQ ID NO: 405334 - RNA, 22 nt, Bordetella pertussis
accuuccugcuggaccugcugu

SEQ ID NO: 405335 - RNA, 13 nt, Bordetella pertussis
accuugcccacgc

SEQ ID NO: 405336 - RNA, 15 nt, Bordetella pertussis
accuugcccacgcca

SEQ ID NO: 405337 - RNA, 15 nt, Bordetella pertussis
accuugccccacuug

SEQ ID NO: 405338 - RNA, 21 nt, Bordetella pertussis
accuugcggccgcgcaccugc

SEQ ID NO: 405339 - RNA, 18 nt, Bordetella pertussis
accuuuccgaucagcugc

SEQ ID NO: 405340 - RNA, 19 nt, Bordetella pertussis
accuuuccgaucagcugcg

SEQ ID NO: 405341 - RNA, 14 nt, Bordetella pertussis
acgaaauagccgac

SEQ ID NO: 405342 - RNA, 16 nt, Bordetella pertussis
acgaacacgcgcgccg

SEQ ID NO: 405343 - RNA, 22 nt, Bordetella pertussis
acgaaccacaggguggcgccca

SEQ ID NO: 405344 - RNA, 21 nt, Bordetella pertussis
acgaacuucggcaucugccag

SEQ ID NO: 405345 - RNA, 18 nt, Bordetella pertussis
acgaagcaaacaggcugc

SEQ ID NO: 405346 - RNA, 18 nt, Bordetella pertussis
acgaaggcauccaggucu

SEQ ID NO: 405347 - RNA, 14 nt, Bordetella pertussis
acgaagggcagcag

SEQ ID NO: 405348 - RNA, 16 nt, Bordetella pertussis
acgaagggcagcagca

SEQ ID NO: 405349 - RNA, 17 nt, Bordetella pertussis
acgaagggcagcagcag

SEQ ID NO: 405350 - RNA, 21 nt, Bordetella pertussis
acgaagguguugaccacgccc

SEQ ID NO: 405351 - RNA, 16 nt, Bordetella pertussis
acgaggcauacaggcu

SEQ ID NO: 405352 - RNA, 12 nt, Bordetella pertussis
acgagggcgcca

SEQ ID NO: 405353 - RNA, 17 nt, Bordetella pertussis
acgaggggguguucucc

SEQ ID NO: 405354 - RNA, 22 nt, Bordetella pertussis
acgaucaggcccuggggccgcg

SEQ ID NO: 405355 - RNA, 22 nt, Bordetella pertussis
acgaucauggucaugcccuccu

SEQ ID NO: 405356 - RNA, 21 nt, Bordetella pertussis
acgaucuucuggacuugcggc

SEQ ID NO: 405357 - RNA, 22 nt, Bordetella pertussis
acgaugcgggcaucgcccugcu

SEQ ID NO: 405358 - RNA, 14 nt, Bordetella pertussis
acgauggccggcgc

SEQ ID NO: 405359 - RNA, 12 nt, Bordetella pertussis
acgauggggccg

SEQ ID NO: 405360 - RNA, 22 nt, Bordetella pertussis
acgaugucguacacaugcuugc

SEQ ID NO: 405361 - RNA, 19 nt, Bordetella pertussis
acgauguugcgcaggcugu

SEQ ID NO: 405362 - RNA, 18 nt, Bordetella pertussis
acgauuccgccuacuggc

SEQ ID NO: 405363 - RNA, 23 nt, Bordetella pertussis
acgauuccgccuacuggcgcgcg

SEQ ID NO: 405364 - RNA, 15 nt, Bordetella pertussis
acgauuucuucgccu

SEQ ID NO: 405365 - RNA, 18 nt, Bordetella pertussis
acgcaacagacccgggcc

SEQ ID NO: 405366 - RNA, 22 nt, Bordetella pertussis
acgcaaccggucggccggcagc

SEQ ID NO: 405367 - RNA, 15 nt, Bordetella pertussis
acgcacagcaccugg

SEQ ID NO: 405368 - RNA, 17 nt, Bordetella pertussis
acgcacaugaugcccag

SEQ ID NO: 405369 - RNA, 17 nt, Bordetella pertussis
acgcaccgcgccagcgc

SEQ ID NO: 405370 - RNA, 21 nt, Bordetella pertussis
acgcagcccuucggagccagu

SEQ ID NO: 405371 - RNA, 19 nt, Bordetella pertussis
acgcaggcccagccagccc

SEQ ID NO: 405372 - RNA, 22 nt, Bordetella pertussis
acgcaggcccagccagcccugg

SEQ ID NO: 405373 - RNA, 20 nt, Bordetella pertussis
acgcauauccaggcggcgcu

SEQ ID NO: 405374 - RNA, 14 nt, Bordetella pertussis
acgccacuuccuug

SEQ ID NO: 405375 - RNA, 15 nt, Bordetella pertussis
acgccacuugcaggc

SEQ ID NO: 405376 - RNA, 17 nt, Bordetella pertussis
acgcucagcaugcgcug

SEQ ID NO: 405377 - RNA, 15 nt, Bordetella pertussis
acgcucauccaggcg

SEQ ID NO: 405378 - RNA, 16 nt, Bordetella pertussis
acgcucauccaggcgc

SEQ ID NO: 405379 - RNA, 18 nt, Bordetella pertussis
acgcucauccaggcgcgu

SEQ ID NO: 405380 - RNA, 23 nt, Bordetella pertussis
acgcugaacuacgaaacucccac

SEQ ID NO: 405381 - RNA, 12 nt, Bordetella pertussis
acgcugacccug

SEQ ID NO: 405382 - RNA, 18 nt, Bordetella pertussis
acgcugaucggccgacug

SEQ ID NO: 405383 - RNA, 23 nt, Bordetella pertussis
acgcugauggccgccagcggcug

SEQ ID NO: 405384 - RNA, 16 nt, Bordetella pertussis
acgcuguucuucggca

SEQ ID NO: 405385 - RNA, 16 nt, Bordetella pertussis
acgcuuccugggccug

SEQ ID NO: 405386 - RNA, 20 nt, Bordetella pertussis
acgcuuccugggccugcggc

SEQ ID NO: 405387 - RNA, 13 nt, Bordetella pertussis
acgcuugccggcg

SEQ ID NO: 405388 - RNA, 21 nt, Bordetella pertussis
acggaauagccuugcucgcgg

SEQ ID NO: 405389 - RNA, 22 nt, Bordetella pertussis
acggaccguuaucugcguuuuc

SEQ ID NO: 405390 - RNA, 12 nt, Bordetella pertussis
acggaucagccg

SEQ ID NO: 405391 - RNA, 18 nt, Bordetella pertussis
acggauugccgccgcgca

SEQ ID NO: 405392 - RNA, 20 nt, Bordetella pertussis
acggcaagguccaggcgcgc

SEQ ID NO: 405393 - RNA, 16 nt, Bordetella pertussis
acggcgcccugcgcgu

SEQ ID NO: 405394 - RNA, 14 nt, Bordetella pertussis
acggcgccuggcgc

SEQ ID NO: 405395 - RNA, 21 nt, Bordetella pertussis
acggcgccuugacgcugcucu

SEQ ID NO: 405396 - RNA, 14 nt, Bordetella pertussis
acggcgcgcccgcc

SEQ ID NO: 405397 - RNA, 19 nt, Bordetella pertussis
acggcggacuggccgcgcc

SEQ ID NO: 405398 - RNA, 17 nt, Bordetella pertussis
acggcgucgaugcgcgc

SEQ ID NO: 405399 - RNA, 19 nt, Bordetella pertussis
acggcgucgccggccaggc

SEQ ID NO: 405400 - RNA, 13 nt, Bordetella pertussis
acggcgucggccu

SEQ ID NO: 405401 - RNA, 14 nt, Bordetella pertussis
acggcuggccgucg

SEQ ID NO: 405402 - RNA, 19 nt, Bordetella pertussis
acggcuggcugggcgcgcc

SEQ ID NO: 405403 - RNA, 16 nt, Bordetella pertussis
acggcuucgcccagcg

SEQ ID NO: 405404 - RNA, 18 nt, Bordetella pertussis
acggcuucgcccagcgcu

SEQ ID NO: 405405 - RNA, 13 nt, Bordetella pertussis
acggcuugaccac

SEQ ID NO: 405406 - RNA, 20 nt, Bordetella pertussis
acgggccagccccggcgcgc

SEQ ID NO: 405407 - RNA, 21 nt, Bordetella pertussis
acgggccagccccggcgcgcc

SEQ ID NO: 405408 - RNA, 19 nt, Bordetella pertussis
acgggccauggaugcgcgc

SEQ ID NO: 405409 - RNA, 18 nt, Bordetella pertussis
acgggcgcugcacgcagc

SEQ ID NO: 405410 - RNA, 12 nt, Bordetella pertussis
acgggcgcugcc

SEQ ID NO: 405411 - RNA, 16 nt, Bordetella pertussis
acgggcggcggcgcgc

SEQ ID NO: 405412 - RNA, 17 nt, Bordetella pertussis
acgggcggcggcgcgcg

SEQ ID NO: 405413 - RNA, 15 nt, Bordetella pertussis
acgggcggggugauc

SEQ ID NO: 405414 - RNA, 20 nt, Bordetella pertussis
acgggcguggcgcagggugc

SEQ ID NO: 405415 - RNA, 16 nt, Bordetella pertussis
acgggucgcgcagcau

SEQ ID NO: 405416 - RNA, 18 nt, Bordetella pertussis
acggguggguggacagga

SEQ ID NO: 405417 - RNA, 17 nt, Bordetella pertussis
acggugccggccagccu

SEQ ID NO: 405418 - RNA, 16 nt, Bordetella pertussis
acguagccggccaggu

SEQ ID NO: 405419 - RNA, 13 nt, Bordetella pertussis
acguagcgcagca

SEQ ID NO: 405420 - RNA, 14 nt, Bordetella pertussis
acguagcgcagcac

SEQ ID NO: 405421 - RNA, 17 nt, Bordetella pertussis
acguagggcacaucggc

SEQ ID NO: 405422 - RNA, 16 nt, Bordetella pertussis
acguagguggucagca

SEQ ID NO: 405423 - RNA, 16 nt, Bordetella pertussis
acguaguacagcagca

SEQ ID NO: 405424 - RNA, 19 nt, Bordetella pertussis
acgugccggauggcgcgga

SEQ ID NO: 405425 - RNA, 18 nt, Bordetella pertussis
acgugcgcgccagcucuu

SEQ ID NO: 405426 - RNA, 22 nt, Bordetella pertussis
acgugcugaccgacgugcgccg

SEQ ID NO: 405427 - RNA, 23 nt, Bordetella pertussis
acgugcugacgguaagcaccagg

SEQ ID NO: 405428 - RNA, 16 nt, Bordetella pertussis
acguggacaggcaccu

SEQ ID NO: 405429 - RNA, 16 nt, Bordetella pertussis
acguugaccuugccga

SEQ ID NO: 405430 - RNA, 16 nt, Bordetella pertussis
acguugauccagcgcu

SEQ ID NO: 405431 - RNA, 16 nt, Bordetella pertussis
acguugcggaucacgc

SEQ ID NO: 405432 - RNA, 21 nt, Bordetella pertussis
acguugcugcagcgucuggca

SEQ ID NO: 405433 - RNA, 18 nt, Bordetella pertussis
acuccggcugcuugccca

SEQ ID NO: 405434 - RNA, 18 nt, Bordetella pertussis
acuccucgacgucgccca

SEQ ID NO: 405435 - RNA, 15 nt, Bordetella pertussis
acucgagccggcucc

SEQ ID NO: 405436 - RNA, 17 nt, Bordetella pertussis
acucgagccggcuccag

SEQ ID NO: 405437 - RNA, 21 nt, Bordetella pertussis
acucgcucaacagcuugccca

SEQ ID NO: 405438 - RNA, 15 nt, Bordetella pertussis
acucggccagcagcu

SEQ ID NO: 405439 - RNA, 13 nt, Bordetella pertussis
acucggccagcgc

SEQ ID NO: 405440 - RNA, 15 nt, Bordetella pertussis
acucggccagcgcgc

SEQ ID NO: 405441 - RNA, 13 nt, Bordetella pertussis
acucggccaggcc

SEQ ID NO: 405442 - RNA, 14 nt, Bordetella pertussis
acucggccauggug

SEQ ID NO: 405443 - RNA, 16 nt, Bordetella pertussis
acucguuggccagcgc

SEQ ID NO: 405444 - RNA, 19 nt, Bordetella pertussis
acucugccgugggacaggc

SEQ ID NO: 405445 - RNA, 19 nt, Bordetella pertussis
acucuguucuaccugaucg

SEQ ID NO: 405446 - RNA, 16 nt, Bordetella pertussis
acugcgagugggugua

SEQ ID NO: 405447 - RNA, 14 nt, Bordetella pertussis
acugcgcauggucg

SEQ ID NO: 405448 - RNA, 12 nt, Bordetella pertussis
acugcggcgccu

SEQ ID NO: 405449 - RNA, 13 nt, Bordetella pertussis
acugcggcgccug

SEQ ID NO: 405450 - RNA, 17 nt, Bordetella pertussis
acugcggcgccugggcc

SEQ ID NO: 405451 - RNA, 21 nt, Bordetella pertussis
acugcggcgccugggccuucu

SEQ ID NO: 405452 - RNA, 14 nt, Bordetella pertussis
acugcugcaaggac

SEQ ID NO: 405453 - RNA, 18 nt, Bordetella pertussis
acuggauauggcgccgca

SEQ ID NO: 405454 - RNA, 21 nt, Bordetella pertussis
acuggaugaagcguucggccu

SEQ ID NO: 405455 - RNA, 17 nt, Bordetella pertussis
acuggcacccgcaagau

SEQ ID NO: 405456 - RNA, 18 nt, Bordetella pertussis
acuucacgccgaggugga

SEQ ID NO: 405457 - RNA, 13 nt, Bordetella pertussis
acuuccagcgccc

SEQ ID NO: 405458 - RNA, 17 nt, Bordetella pertussis
acuuccucgaccagccc

SEQ ID NO: 405459 - RNA, 19 nt, Bordetella pertussis
acuuccucgaccagcccgg

SEQ ID NO: 405460 - RNA, 18 nt, Bordetella pertussis
acuuccucgacccgcgcc

SEQ ID NO: 405461 - RNA, 12 nt, Bordetella pertussis
acuuccuugcca

SEQ ID NO: 405462 - RNA, 14 nt, Bordetella pertussis
acuucgacccggac

SEQ ID NO: 405463 - RNA, 21 nt, Bordetella pertussis
acuucggcggccugcuuggca

SEQ ID NO: 405464 - RNA, 20 nt, Bordetella pertussis
acuucuugcgcaucggcggc

SEQ ID NO: 405465 - RNA, 16 nt, Bordetella pertussis
acuugaccgcaugcug

SEQ ID NO: 405466 - RNA, 17 nt, Bordetella pertussis
acuugaccgcaugcugc

SEQ ID NO: 405467 - RNA, 16 nt, Bordetella pertussis
acuugaucagggccac

SEQ ID NO: 405468 - RNA, 18 nt, Bordetella pertussis
acuugaucagggccacgg

SEQ ID NO: 405469 - RNA, 15 nt, Bordetella pertussis
agaacagcagauggc

SEQ ID NO: 405470 - RNA, 11 nt, Bordetella pertussis
agaaccgccgc

SEQ ID NO: 405471 - RNA, 21 nt, Bordetella pertussis
agaacucggccgcauggcggc

SEQ ID NO: 405472 - RNA, 17 nt, Bordetella pertussis
agaacucgguggcgguc

SEQ ID NO: 405473 - RNA, 13 nt, Bordetella pertussis
agaagauuuccca

SEQ ID NO: 405474 - RNA, 15 nt, Bordetella pertussis
agaagcagccgcgcg

SEQ ID NO: 405475 - RNA, 18 nt, Bordetella pertussis
agaaggcgaacugggucu

SEQ ID NO: 405476 - RNA, 22 nt, Bordetella pertussis
agaaucggggcguagcucagcc

SEQ ID NO: 405477 - RNA, 22 nt, Bordetella pertussis
agaauguauuggcccaguugaa

SEQ ID NO: 405478 - RNA, 19 nt, Bordetella pertussis
agacaggcgcgccauccug

SEQ ID NO: 405479 - RNA, 22 nt, Bordetella pertussis
agacaugcucgaugccggccuc

SEQ ID NO: 405480 - RNA, 20 nt, Bordetella pertussis
agaccaagcugcgcgaggac

SEQ ID NO: 405481 - RNA, 13 nt, Bordetella pertussis
agaccaccagcag

SEQ ID NO: 405482 - RNA, 18 nt, Bordetella pertussis
agaccacgcaaaccccau

SEQ ID NO: 405483 - RNA, 18 nt, Bordetella pertussis
agaccacgccggcgguca

SEQ ID NO: 405484 - RNA, 17 nt, Bordetella pertussis
agaccacgcgcugcgcg

SEQ ID NO: 405485 - RNA, 12 nt, Bordetella pertussis
agaccagcagcu

SEQ ID NO: 405486 - RNA, 14 nt, Bordetella pertussis
agaccaucuugucc

SEQ ID NO: 405487 - RNA, 17 nt, Bordetella pertussis
agacccacagguuggcc

SEQ ID NO: 405488 - RNA, 14 nt, Bordetella pertussis
agaccgccgcgccc

SEQ ID NO: 405489 - RNA, 15 nt, Bordetella pertussis
agaccgcgcgcacca

SEQ ID NO: 405490 - RNA, 21 nt, Bordetella pertussis
agaccgcuuauuuccucagcc

SEQ ID NO: 405491 - RNA, 17 nt, Bordetella pertussis
agaccugcgcgccggca

SEQ ID NO: 405492 - RNA, 21 nt, Bordetella pertussis
agacgccaucuugcaggcgcc

SEQ ID NO: 405493 - RNA, 21 nt, Bordetella pertussis
agacgguaucugucccggcgg

SEQ ID NO: 405494 - RNA, 22 nt, Bordetella pertussis
agacguggcccgcgugacggcc

SEQ ID NO: 405495 - RNA, 19 nt, Bordetella pertussis
agagccugggcgcgcgccc

SEQ ID NO: 405496 - RNA, 14 nt, Bordetella pertussis
agagccuguccccg

SEQ ID NO: 405497 - RNA, 15 nt, Bordetella pertussis
agagccuguccccgu

SEQ ID NO: 405498 - RNA, 20 nt, Bordetella pertussis
agagccugucccgacgggga

SEQ ID NO: 405499 - RNA, 18 nt, Bordetella pertussis
agagcuggcgcugcucga

SEQ ID NO: 405500 - RNA, 20 nt, Bordetella pertussis
agaggcauuggcggcggcgu

SEQ ID NO: 405501 - RNA, 20 nt, Bordetella pertussis
agagggcuuuuugccuuggg

SEQ ID NO: 405502 - RNA, 22 nt, Bordetella pertussis
agaggguguugccgaggucgcc

SEQ ID NO: 405503 - RNA, 14 nt, Bordetella pertussis
agagguugugcccc

SEQ ID NO: 405504 - RNA, 18 nt, Bordetella pertussis
agaguguugacggugguc

SEQ ID NO: 405505 - RNA, 22 nt, Bordetella pertussis
agaguucgcugcgaaacagcag

SEQ ID NO: 405506 - RNA, 23 nt, Bordetella pertussis
agauaccgucuuggccgucaagc

SEQ ID NO: 405507 - RNA, 22 nt, Bordetella pertussis
agauacuugcgcagcgcggcgu

SEQ ID NO: 405508 - RNA, 15 nt, Bordetella pertussis
agauagcccagcacc

SEQ ID NO: 405509 - RNA, 18 nt, Bordetella pertussis
agauagcccuugaucagc

SEQ ID NO: 405510 - RNA, 21 nt, Bordetella pertussis
agauauugggggucagcgccg

SEQ ID NO: 405511 - RNA, 18 nt, Bordetella pertussis
agaucagccgcugcagca

SEQ ID NO: 405512 - RNA, 21 nt, Bordetella pertussis
agaucagcgcgucggcgccga

SEQ ID NO: 405513 - RNA, 21 nt, Bordetella pertussis
agaucagggugggcacgcgcg

SEQ ID NO: 405514 - RNA, 19 nt, Bordetella pertussis
agaucaucgagcaccgccu

SEQ ID NO: 405515 - RNA, 22 nt, Bordetella pertussis
agaucaucgaggcaaucagccc

SEQ ID NO: 405516 - RNA, 16 nt, Bordetella pertussis
agauccacgcccgcgc

SEQ ID NO: 405517 - RNA, 13 nt, Bordetella pertussis
agauccagcgaga

SEQ ID NO: 405518 - RNA, 21 nt, Bordetella pertussis
agauccagcgcggccacggcc

SEQ ID NO: 405519 - RNA, 18 nt, Bordetella pertussis
agauccaggcggccacca

SEQ ID NO: 405520 - RNA, 13 nt, Bordetella pertussis
aaaaccaggcugc

SEQ ID NO: 405521 - RNA, 21 nt, Bordetella pertussis
aaaaccgcucguaucgcccug

SEQ ID NO: 405522 - RNA, 16 nt, Bordetella pertussis
agaugccgaugauggc

SEQ ID NO: 405523 - RNA, 16 nt, Bordetella pertussis
agaugcgcgccaggcg

SEQ ID NO: 405524 - RNA, 19 nt, Bordetella pertussis
agaugcgcgccaggcgcgc

SEQ ID NO: 405525 - RNA, 12 nt, Bordetella pertussis
agaugcgcgccg

SEQ ID NO: 405526 - RNA, 18 nt, Bordetella pertussis
agaugcgcggggccaggc

SEQ ID NO: 405527 - RNA, 12 nt, Bordetella pertussis
agauggccaggu

SEQ ID NO: 405528 - RNA, 20 nt, Bordetella pertussis
agauggccagguggcggcgg

SEQ ID NO: 405529 - RNA, 22 nt, Bordetella pertussis
agauggccagguggcggcggca

SEQ ID NO: 405530 - RNA, 20 nt, Bordetella pertussis
agauggcccagggcagcggc

SEQ ID NO: 405531 - RNA, 13 nt, Bordetella pertussis
agauggccgccuu

SEQ ID NO: 405532 - RNA, 17 nt, Bordetella pertussis
agauggcguaggcggcc

SEQ ID NO: 405533 - RNA, 18 nt, Bordetella pertussis
agauguccauggccugca

SEQ ID NO: 405534 - RNA, 18 nt, Bordetella pertussis
agauugaugcccaugcgc

SEQ ID NO: 405535 - RNA, 15 nt, Bordetella pertussis
agauuguccagcggc

SEQ ID NO: 405536 - RNA, 16 nt, Bordetella pertussis
agauuguccagcggca

SEQ ID NO: 405537 - RNA, 14 nt, Bordetella pertussis
agauugugcagcaa

SEQ ID NO: 405538 - RNA, 20 nt, Bordetella pertussis
agauuucauggcgucugccc

SEQ ID NO: 405539 - RNA, 17 nt, Bordetella pertussis
agcaaaugggccgcagc

SEQ ID NO: 405540 - RNA, 14 nt, Bordetella pertussis
agcaaccccagcag

SEQ ID NO: 405541 - RNA, 15 nt, Bordetella pertussis
agcaaccccagcagc

SEQ ID NO: 405542 - RNA, 22 nt, Bordetella pertussis
agcaaccggaacaccagcaagc

SEQ ID NO: 405543 - RNA, 20 nt, Bordetella pertussis
agcaccggcagcguaucgcc

SEQ ID NO: 405544 - RNA, 20 nt, Bordetella pertussis
agcaccggcacgcgccaggc

SEQ ID NO: 405545 - RNA, 19 nt, Bordetella pertussis
agcaccggccgccgcaugc

SEQ ID NO: 405546 - RNA, 22 nt, Bordetella pertussis
agcaccgggaaguccgccgcgu

SEQ ID NO: 405547 - RNA, 16 nt, Bordetella pertussis
agcaccggggcagggc

SEQ ID NO: 405548 - RNA, 22 nt, Bordetella pertussis
agcaccggguaauggcgcucca

SEQ ID NO: 405549 - RNA, 12 nt, Bordetella pertussis
agcaccugcagg

SEQ ID NO: 405550 - RNA, 13 nt, Bordetella pertussis
agcaccugcaggc

SEQ ID NO: 405551 - RNA, 21 nt, Bordetella pertussis
agcaccuucugccgccaggca

SEQ ID NO: 405552 - RNA, 15 nt, Bordetella pertussis
agcacgaaccaguug

SEQ ID NO: 405553 - RNA, 22 nt, Bordetella pertussis
agcacgaagggcagcagcaguu

SEQ ID NO: 405554 - RNA, 14 nt, Bordetella pertussis
agcacgguggcgcc

SEQ ID NO: 405555 - RNA, 19 nt, Bordetella pertussis
agcacgguggcgcccggcg

SEQ ID NO: 405556 - RNA, 22 nt, Bordetella pertussis
agcacgguugccacggugaaga

SEQ ID NO: 405557 - RNA, 18 nt, Bordetella pertussis
agcacguccaaugccagg

SEQ ID NO: 405558 - RNA, 14 nt, Bordetella pertussis
agcacguccagcgg

SEQ ID NO: 405559 - RNA, 23 nt, Bordetella pertussis
agcacgucguagcgcugcagcca

SEQ ID NO: 405560 - RNA, 14 nt, Bordetella pertussis
agcacuugccggcc

SEQ ID NO: 405561 - RNA, 23 nt, Bordetella pertussis
agcagauaccggcauggcagcag

SEQ ID NO: 405562 - RNA, 15 nt, Bordetella pertussis
agcagaucggcggcc

SEQ ID NO: 405563 - RNA, 19 nt, Bordetella pertussis
agcagaugcaccggccagu

SEQ ID NO: 405564 - RNA, 16 nt, Bordetella pertussis
agcagcaccugguccu

SEQ ID NO: 405565 - RNA, 16 nt, Bordetella pertussis
agcagcacgcccagua

SEQ ID NO: 405566 - RNA, 16 nt, Bordetella pertussis
agcagcacgcccaugg

SEQ ID NO: 405567 - RNA, 16 nt, Bordetella pertussis
agcagcagcgcaucga

SEQ ID NO: 405568 - RNA, 21 nt, Bordetella pertussis
agcagcaggcccuccggcgcc

SEQ ID NO: 405569 - RNA, 13 nt, Bordetella pertussis
agcagcaggccgu

SEQ ID NO: 405570 - RNA, 14 nt, Bordetella pertussis
agcagcaugcggcc

SEQ ID NO: 405571 - RNA, 19 nt, Bordetella pertussis
agcagcauggcgggcgaga

SEQ ID NO: 405572 - RNA, 21 nt, Bordetella pertussis
agcagccccagcguccaggcg

SEQ ID NO: 405573 - RNA, 14 nt, Bordetella pertussis
agcagcgccaggau

SEQ ID NO: 405574 - RNA, 16 nt, Bordetella pertussis
agcagcgccaggauga

SEQ ID NO: 405575 - RNA, 15 nt, Bordetella pertussis
agcagcgccagggcc

SEQ ID NO: 405576 - RNA, 18 nt, Bordetella pertussis
agcagcgccggcugggcg

SEQ ID NO: 405577 - RNA, 13 nt, Bordetella pertussis
agcagcgccugcc

SEQ ID NO: 405578 - RNA, 14 nt, Bordetella pertussis
agcagcgccugccg

SEQ ID NO: 405579 - RNA, 19 nt, Bordetella pertussis
agcagcggcucgagcggca

SEQ ID NO: 405580 - RNA, 12 nt, Bordetella pertussis
agcagcgggcug

SEQ ID NO: 405581 - RNA, 15 nt, Bordetella pertussis
agcagcgggcugggg

SEQ ID NO: 405582 - RNA, 17 nt, Bordetella pertussis
agcagcgggcuggggca

SEQ ID NO: 405583 - RNA, 18 nt, Bordetella pertussis
agcagcguggccaccagg

SEQ ID NO: 405584 - RNA, 15 nt, Bordetella pertussis
agcagcguggccgcc

SEQ ID NO: 405585 - RNA, 12 nt, Bordetella pertussis
agcagcucgcag

SEQ ID NO: 405586 - RNA, 20 nt, Bordetella pertussis
agcagcucggccaccgccgu

SEQ ID NO: 405587 - RNA, 14 nt, Bordetella pertussis
agcaggagcccgcu

SEQ ID NO: 405588 - RNA, 18 nt, Bordetella pertussis
agcaggagcccgcugccg

SEQ ID NO: 405589 - RNA, 12 nt, Bordetella pertussis
agcaggccagga

SEQ ID NO: 405590 - RNA, 15 nt, Bordetella pertussis
agcaggcccaccagg

SEQ ID NO: 405591 - RNA, 17 nt, Bordetella pertussis
agcaggcccaccagggc

SEQ ID NO: 405592 - RNA, 19 nt, Bordetella pertussis
agcaggcccaccagggcca

SEQ ID NO: 405593 - RNA, 16 nt, Bordetella pertussis
agcaggccgcccagcg

SEQ ID NO: 405594 - RNA, 22 nt, Bordetella pertussis
agcaggccguaaccggccaguc

SEQ ID NO: 405595 - RNA, 22 nt, Bordetella pertussis
agcaggcgcaucagcuuggcca

SEQ ID NO: 405596 - RNA, 14 nt, Bordetella pertussis
agcaggcgcgcuca

SEQ ID NO: 405597 - RNA, 21 nt, Bordetella pertussis
agcaggcgcgcucaggccgcc

SEQ ID NO: 405598 - RNA, 18 nt, Bordetella pertussis
agcaggcgcucggccagc

SEQ ID NO: 405599 - RNA, 12 nt, Bordetella pertussis
agcaggcgcugg

SEQ ID NO: 405600 - RNA, 15 nt, Bordetella pertussis
agcaggcgcugguaa

SEQ ID NO: 405601 - RNA, 19 nt, Bordetella pertussis
agcaggcggccgaccagca

SEQ ID NO: 405602 - RNA, 20 nt, Bordetella pertussis
agcaggcgguacagcggaug

SEQ ID NO: 405603 - RNA, 15 nt, Bordetella pertussis
agcaggcuggccacc

SEQ ID NO: 405604 - RNA, 22 nt, Bordetella pertussis
agcagguuggagaucaugacca

SEQ ID NO: 405605 - RNA, 14 nt, Bordetella pertussis
agcaguacacgcgc

SEQ ID NO: 405606 - RNA, 20 nt, Bordetella pertussis
agcaguacacgcgcaacaug

SEQ ID NO: 405607 - RNA, 22 nt, Bordetella pertussis
agcaguacacgcgcaacauggu

SEQ ID NO: 405608 - RNA, 14 nt, Bordetella pertussis
agcauacccugcgc

SEQ ID NO: 405609 - RNA, 20 nt, Bordetella pertussis
agcaucaccagcucgcggcc

SEQ ID NO: 405610 - RNA, 20 nt, Bordetella pertussis
agcaucacggugccgccgau

SEQ ID NO: 405611 - RNA, 17 nt, Bordetella pertussis
agcaucagcagacccug

SEQ ID NO: 405612 - RNA, 17 nt, Bordetella pertussis
agcaucagcggcagcac

SEQ ID NO: 405613 - RNA, 13 nt, Bordetella pertussis
agcaucgccgcca

SEQ ID NO: 405614 - RNA, 15 nt, Bordetella pertussis
agcaucgccgccagc

SEQ ID NO: 405615 - RNA, 13 nt, Bordetella pertussis
agcaucgcgccuu

SEQ ID NO: 405616 - RNA, 18 nt, Bordetella pertussis
agcaucggcacccagccg

SEQ ID NO: 405617 - RNA, 20 nt, Bordetella pertussis
agcaugaagcgguggcggcc

SEQ ID NO: 405618 - RNA, 23 nt, Bordetella pertussis
agcaugacggggucggggcaggc

SEQ ID NO: 405619 - RNA, 20 nt, Bordetella pertussis
agcaugaccgacaggcggcu

SEQ ID NO: 405620 - RNA, 15 nt, Bordetella pertussis
agcaugagcugaugc

SEQ ID NO: 405621 - RNA, 19 nt, Bordetella pertussis
agcaugagcugaugcucgc

SEQ ID NO: 405622 - RNA, 16 nt, Bordetella pertussis
agcaugaucaugccgc

SEQ ID NO: 405623 - RNA, 23 nt, Bordetella pertussis
agcaugcacgacuacggcggacu

SEQ ID NO: 405624 - RNA, 18 nt, Bordetella pertussis
agcaugccguuggagccg

SEQ ID NO: 405625 - RNA, 20 nt, Bordetella pertussis
agcaugcggcccgcgcuguu

SEQ ID NO: 405626 - RNA, 22 nt, Bordetella pertussis
agcauggagcuggggccgcgcg

SEQ ID NO: 405627 - RNA, 20 nt, Bordetella pertussis
agcauggcggccaggcgcgc

SEQ ID NO: 405628 - RNA, 13 nt, Bordetella pertussis
agcauggcggcgc

SEQ ID NO: 405629 - RNA, 21 nt, Bordetella pertussis
agcauggcgucgaaacgcugc

SEQ ID NO: 405630 - RNA, 12 nt, Bordetella pertussis
agccaagcaggg

SEQ ID NO: 405631 - RNA, 16 nt, Bordetella pertussis
agccagaacaugagcc

SEQ ID NO: 405632 - RNA, 20 nt, Bordetella pertussis
agccagauaccguccuugag

SEQ ID NO: 405633 - RNA, 17 nt, Bordetella pertussis
agccagauucccccgca

SEQ ID NO: 405634 - RNA, 13 nt, Bordetella pertussis
agccagcgccgca

SEQ ID NO: 405635 - RNA, 11 nt, Bordetella pertussis
agccagcgccu

SEQ ID NO: 405636 - RNA, 13 nt, Bordetella pertussis
agccagcgccugc

SEQ ID NO: 405637 - RNA, 17 nt, Bordetella pertussis
agccagcggcgcggcgc

SEQ ID NO: 405638 - RNA, 18 nt, Bordetella pertussis
agccaggauuucauggca

SEQ ID NO: 405639 - RNA, 14 nt, Bordetella pertussis
agccagugccucag

SEQ ID NO: 405640 - RNA, 13 nt, Bordetella pertussis
agccaucaucauc

SEQ ID NO: 405641 - RNA, 17 nt, Bordetella pertussis
agccaucaucaucgucg

SEQ ID NO: 405642 - RNA, 21 nt, Bordetella pertussis
agccaugcggacgccagcccu

SEQ ID NO: 405643 - RNA, 20 nt, Bordetella pertussis
agccaugccgucuggcggca

SEQ ID NO: 405644 - RNA, 21 nt, Bordetella pertussis
agccauugcccacagcacgga

SEQ ID NO: 405645 - RNA, 14 nt, Bordetella pertussis
agcccacaagccgu

SEQ ID NO: 405646 - RNA, 14 nt, Bordetella pertussis
agcccaccagcgcc

SEQ ID NO: 405647 - RNA, 12 nt, Bordetella pertussis
agcccacguagg

SEQ ID NO: 405648 - RNA, 17 nt, Bordetella pertussis
agcccagcaccacggca

SEQ ID NO: 405649 - RNA, 15 nt, Bordetella pertussis
agcccagcaccugca

SEQ ID NO: 405650 - RNA, 20 nt, Bordetella pertussis
agcccagcaccugcaggccg

SEQ ID NO: 405651 - RNA, 20 nt, Bordetella pertussis
agcccagcgcgauucccugg

SEQ ID NO: 405652 - RNA, 12 nt, Bordetella pertussis
agcccauggcca

SEQ ID NO: 405653 - RNA, 21 nt, Bordetella pertussis
agcccauggcguaggccucgc

SEQ ID NO: 405654 - RNA, 12 nt, Bordetella pertussis
agcccauguucu

SEQ ID NO: 405655 - RNA, 16 nt, Bordetella pertussis
agcccauguucugguc

SEQ ID NO: 405656 - RNA, 15 nt, Bordetella pertussis
agccccaaugugcug

SEQ ID NO: 405657 - RNA, 21 nt, Bordetella pertussis
agccccaccuugcccagcagc

SEQ ID NO: 405658 - RNA, 14 nt, Bordetella pertussis
agccccaggcaggc

SEQ ID NO: 405659 - RNA, 23 nt, Bordetella pertussis
agccccccguaggcggcccaggc

SEQ ID NO: 405660 - RNA, 18 nt, Bordetella pertussis
agcccccgcgcugcgccc

SEQ ID NO: 405661 - RNA, 20 nt, Bordetella pertussis
agcccccgcgcugcgcccgc

SEQ ID NO: 405662 - RNA, 21 nt, Bordetella pertussis
agccccugccaugccccaucc

SEQ ID NO: 405663 - RNA, 18 nt, Bordetella pertussis
agcccgacgcgaggcaga

SEQ ID NO: 405664 - RNA, 22 nt, Bordetella pertussis
agcccgauaugcagccgcacca

SEQ ID NO: 405665 - RNA, 11 nt, Bordetella pertussis
agcccgaugcc

SEQ ID NO: 405666 - RNA, 18 nt, Bordetella pertussis
agcccgaugcgccaggcc

SEQ ID NO: 405667 - RNA, 16 nt, Bordetella pertussis
agcccgcccgcgccca

SEQ ID NO: 405668 - RNA, 19 nt, Bordetella pertussis
agcccgcccgcgcccagcu

SEQ ID NO: 405669 - RNA, 17 nt, Bordetella pertussis
agcccggcgugcccagg

SEQ ID NO: 405670 - RNA, 11 nt, Bordetella pertussis
agcccguggcg

SEQ ID NO: 405671 - RNA, 20 nt, Bordetella pertussis
agcccuucgacgcggcggcc

SEQ ID NO: 405672 - RNA, 16 nt, Bordetella pertussis
agcccuuguggccgcc

SEQ ID NO: 405673 - RNA, 15 nt, Bordetella pertussis
agccgcagaacagca

SEQ ID NO: 405674 - RNA, 14 nt, Bordetella pertussis
agccgcagcggcag

SEQ ID NO: 405675 - RNA, 21 nt, Bordetella pertussis
agccugacggcuacacccugc

SEQ ID NO: 405676 - RNA, 21 nt, Bordetella pertussis
agccugauucccaggcccggc

SEQ ID NO: 405677 - RNA, 18 nt, Bordetella pertussis
agccugcccgggcagcac

SEQ ID NO: 405678 - RNA, 24 nt, Bordetella pertussis
agccugcccgggcagcaccgcugc

SEQ ID NO: 405679 - RNA, 15 nt, Bordetella pertussis
agccugccggcggcc

SEQ ID NO: 405680 - RNA, 17 nt, Bordetella pertussis
agccugccggcggccua

SEQ ID NO: 405681 - RNA, 22 nt, Bordetella pertussis
agccugcuuauaggcuuucaga

SEQ ID NO: 405682 - RNA, 22 nt, Bordetella pertussis
agccuggcaaugcguggccggc

SEQ ID NO: 405683 - RNA, 14 nt, Bordetella pertussis
agccuggccuugcg

SEQ ID NO: 405684 - RNA, 21 nt, Bordetella pertussis
agccugucccgacggggacag

SEQ ID NO: 405685 - RNA, 22 nt, Bordetella pertussis
agccugucccgacggggacagg

SEQ ID NO: 405686 - RNA, 16 nt, Bordetella pertussis
agccuuuccuccugcc

SEQ ID NO: 405687 - RNA, 20 nt, Bordetella pertussis
agccuuuccuccugccggcg

SEQ ID NO: 405688 - RNA, 20 nt, Bordetella pertussis
agcgaaagcacggcgaugcu

SEQ ID NO: 405689 - RNA, 14 nt, Bordetella pertussis
agcgaaucgcccuu

SEQ ID NO: 405690 - RNA, 16 nt, Bordetella pertussis
agcgacggcagaugga

SEQ ID NO: 405691 - RNA, 18 nt, Bordetella pertussis
agcgacuccggccgggcc

SEQ ID NO: 405692 - RNA, 22 nt, Bordetella pertussis
agcgacuccggccgggccagcg

SEQ ID NO: 405693 - RNA, 14 nt, Bordetella pertussis
agcgagcgaaagcc

SEQ ID NO: 405694 - RNA, 18 nt, Bordetella pertussis
agcgaggacacgcagcug

SEQ ID NO: 405695 - RNA, 22 nt, Bordetella pertussis
agcgaguagacgcagccgcagu

SEQ ID NO: 405696 - RNA, 20 nt, Bordetella pertussis
agcgagucgaccaguucggc

SEQ ID NO: 405697 - RNA, 15 nt, Bordetella pertussis
agcgaugcccuggau

SEQ ID NO: 405698 - RNA, 19 nt, Bordetella pertussis
agcgcaaacgggggcaggc

SEQ ID NO: 405699 - RNA, 13 nt, Bordetella pertussis
agcgcaagcaccg

SEQ ID NO: 405700 - RNA, 19 nt, Bordetella pertussis
agcgcaagcaccgccugcu

SEQ ID NO: 405701 - RNA, 20 nt, Bordetella pertussis
agcgcaagcccaggcggccc

SEQ ID NO: 405702 - RNA, 16 nt, Bordetella pertussis
agcgcaccaccagcac

SEQ ID NO: 405703 - RNA, 21 nt, Bordetella pertussis
agcgcaccaguuucucggcca

SEQ ID NO: 405704 - RNA, 17 nt, Bordetella pertussis
agcgcauagacccacag

SEQ ID NO: 405705 - RNA, 22 nt, Bordetella pertussis
agcgcaucgagcuccugcagga

SEQ ID NO: 405706 - RNA, 23 nt, Bordetella pertussis
agcgcaucgcgaugcgcagcagc

SEQ ID NO: 405707 - RNA, 17 nt, Bordetella pertussis
agcgcaucgccgcaggc

SEQ ID NO: 405708 - RNA, 18 nt, Bordetella pertussis
agcgcaucgccgcaggcg

SEQ ID NO: 405709 - RNA, 16 nt, Bordetella pertussis
agcgccacgccggcca

SEQ ID NO: 405710 - RNA, 13 nt, Bordetella pertussis
agcgccagcagca

SEQ ID NO: 405711 - RNA, 16 nt, Bordetella pertussis
agcgccaggaacagcg

SEQ ID NO: 405712 - RNA, 11 nt, Bordetella pertussis
agcgccaggcc

SEQ ID NO: 405713 - RNA, 11 nt, Bordetella pertussis
agcgccaggcu

SEQ ID NO: 405714 - RNA, 16 nt, Bordetella pertussis
agcgccagggccaggc

SEQ ID NO: 405715 - RNA, 22 nt, Bordetella pertussis
agcgccagggccgccgcgccca

SEQ ID NO: 405716 - RNA, 19 nt, Bordetella pertussis
agcgccaguccgcgcucgc

SEQ ID NO: 405717 - RNA, 18 nt, Bordetella pertussis
agcgccaucggcauuucg

SEQ ID NO: 405718 - RNA, 22 nt, Bordetella pertussis
agcgccgacggcauggccggca

SEQ ID NO: 405719 - RNA, 13 nt, Bordetella pertussis
agcgccgccaccu

SEQ ID NO: 405720 - RNA, 14 nt, Bordetella pertussis
agcgccgccaccuc

SEQ ID NO: 405721 - RNA, 17 nt, Bordetella pertussis
agcgccgccacaggcug

SEQ ID NO: 405722 - RNA, 18 nt, Bordetella pertussis
agcgccucgcaucggccu

SEQ ID NO: 405723 - RNA, 21 nt, Bordetella pertussis
agcgccucgcaucggccugca

SEQ ID NO: 405724 - RNA, 20 nt, Bordetella pertussis
agcgccucgcgcucgagcgc

SEQ ID NO: 405725 - RNA, 21 nt, Bordetella pertussis
agcgccucguuccuguuccug

SEQ ID NO: 405726 - RNA, 20 nt, Bordetella pertussis
agcgccucgucgcgcaacgc

SEQ ID NO: 405727 - RNA, 13 nt, Bordetella pertussis
agcgccugcagcg

SEQ ID NO: 405728 - RNA, 13 nt, Bordetella pertussis
agcgccugcaggc

SEQ ID NO: 405729 - RNA, 14 nt, Bordetella pertussis
agcgccugcaggcg

SEQ ID NO: 405730 - RNA, 13 nt, Bordetella pertussis
agcgccugcaggu

SEQ ID NO: 405731 - RNA, 20 nt, Bordetella pertussis
agcgccugccgaucgugcac

SEQ ID NO: 405732 - RNA, 16 nt, Bordetella pertussis
agcgccugcgcggccu

SEQ ID NO: 405733 - RNA, 16 nt, Bordetella pertussis
agcgccuggcgggccu

SEQ ID NO: 405734 - RNA, 16 nt, Bordetella pertussis
agcgccugggcggcca

SEQ ID NO: 405735 - RNA, 23 nt, Bordetella pertussis
agcgccugggguaggcgcggucc

SEQ ID NO: 405736 - RNA, 19 nt, Bordetella pertussis
agcgcgaaauccagcgcgc

SEQ ID NO: 405737 - RNA, 22 nt, Bordetella pertussis
agcgcgaaaugguguacagccg

SEQ ID NO: 405738 - RNA, 15 nt, Bordetella pertussis
agcgcgaacgccugc

SEQ ID NO: 405739 - RNA, 17 nt, Bordetella pertussis
agcgcgccagcgcgcga

SEQ ID NO: 405740 - RNA, 13 nt, Bordetella pertussis
agcgcgccaggcg

SEQ ID NO: 405741 - RNA, 19 nt, Bordetella pertussis
agcgcgcccgcuuccuugg

SEQ ID NO: 405742 - RNA, 13 nt, Bordetella pertussis
agcgcgccgccga

SEQ ID NO: 405743 - RNA, 14 nt, Bordetella pertussis
agcgcgccgccgau

SEQ ID NO: 405744 - RNA, 23 nt, Bordetella pertussis
agcgcgccgcgaaacguccccac

SEQ ID NO: 405745 - RNA, 17 nt, Bordetella pertussis
agcgcgccggccagggc

SEQ ID NO: 405746 - RNA, 20 nt, Bordetella pertussis
agcgcgccggccagggccac

SEQ ID NO: 405747 - RNA, 18 nt, Bordetella pertussis
agcgcgcgaucgccagca

SEQ ID NO: 405748 - RNA, 19 nt, Bordetella pertussis
agcgcgcgaucgccagcag

SEQ ID NO: 405749 - RNA, 20 nt, Bordetella pertussis
agcgcgcgaucgccagcagg

SEQ ID NO: 405750 - RNA, 22 nt, Bordetella pertussis
agcgcgcgaucgccagcaggcg

SEQ ID NO: 405751 - RNA, 14 nt, Bordetella pertussis
agcgcgcgcagccg

SEQ ID NO: 405752 - RNA, 21 nt, Bordetella pertussis
agcgcgcgcgaggcggcggcc

SEQ ID NO: 405753 - RNA, 22 nt, Bordetella pertussis
agcgcgcgcgaggcggcggccg

SEQ ID NO: 405754 - RNA, 14 nt, Bordetella pertussis
agcgcgcgcgccga

SEQ ID NO: 405755 - RNA, 21 nt, Bordetella pertussis
agcgcggccacggccugcccg

SEQ ID NO: 405756 - RNA, 21 nt, Bordetella pertussis
agcgcggccggcaccaggauc

SEQ ID NO: 405757 - RNA, 12 nt, Bordetella pertussis
agcgcggccucg

SEQ ID NO: 405758 - RNA, 14 nt, Bordetella pertussis
agcgcggccucgcc

SEQ ID NO: 405759 - RNA, 16 nt, Bordetella pertussis
agcgcggcgaaggcgc

SEQ ID NO: 405760 - RNA, 18 nt, Bordetella pertussis
agcgcggcgaaggcgcgg

SEQ ID NO: 405761 - RNA, 17 nt, Bordetella pertussis
agcgcggcgcacagggc

SEQ ID NO: 405762 - RNA, 18 nt, Bordetella pertussis
agcgcggcgccggccucc

SEQ ID NO: 405763 - RNA, 19 nt, Bordetella pertussis
agcgcggcgcgcgccaggg

SEQ ID NO: 405764 - RNA, 21 nt, Bordetella pertussis
agcgcggcgcggccagcagcg

SEQ ID NO: 405765 - RNA, 22 nt, Bordetella pertussis
agcgcggcgcggccagcagcgc

SEQ ID NO: 405766 - RNA, 14 nt, Bordetella pertussis
agcgcgucgagcag

SEQ ID NO: 405767 - RNA, 16 nt, Bordetella pertussis
agcgcgucggccagcg

SEQ ID NO: 405768 - RNA, 19 nt, Bordetella pertussis
agcgcguggaaccgccgcu

SEQ ID NO: 405769 - RNA, 17 nt, Bordetella pertussis
agcgcguggccagcacg

SEQ ID NO: 405770 - RNA, 16 nt, Bordetella pertussis
agcgcgugggccagca

SEQ ID NO: 405771 - RNA, 14 nt, Bordetella pertussis
agcggccagcaagc

SEQ ID NO: 405772 - RNA, 19 nt, Bordetella pertussis
agcggccccagucgcugcu

SEQ ID NO: 405773 - RNA, 17 nt, Bordetella pertussis
agcggcccgcgcccugc

SEQ ID NO: 405774 - RNA, 12 nt, Bordetella pertussis
agcggccgccca

SEQ ID NO: 405775 - RNA, 23 nt, Bordetella pertussis
agcggcggcuucgcgcagcaagu

SEQ ID NO: 405776 - RNA, 20 nt, Bordetella pertussis
agcggcguauaggccacccc

SEQ ID NO: 405777 - RNA, 22 nt, Bordetella pertussis
agcggcgugaugcccaggcccu

SEQ ID NO: 405778 - RNA, 18 nt, Bordetella pertussis
agcggcgugcggcccagc

SEQ ID NO: 405779 - RNA, 20 nt, Bordetella pertussis
agcggcgugcggcccagccg

SEQ ID NO: 405780 - RNA, 16 nt, Bordetella pertussis
agcggcucaggcgcgg

SEQ ID NO: 405781 - RNA, 23 nt, Bordetella pertussis
agcggcuccccuggucagggcug

SEQ ID NO: 405782 - RNA, 22 nt, Bordetella pertussis
agcggcucuggaucgugcccag

SEQ ID NO: 405783 - RNA, 15 nt, Bordetella pertussis
agcgggcaugggccc

SEQ ID NO: 405784 - RNA, 18 nt, Bordetella pertussis
agcgggccugcagcauga

SEQ ID NO: 405785 - RNA, 22 nt, Bordetella pertussis
agcgggcgcgcccggcgcgccu

SEQ ID NO: 405786 - RNA, 13 nt, Bordetella pertussis
agcggggacaggc

SEQ ID NO: 405787 - RNA, 16 nt, Bordetella pertussis
agcggggacaggcgcc

SEQ ID NO: 405788 - RNA, 16 nt, Bordetella pertussis
agcgguugaaauccuu

SEQ ID NO: 405789 - RNA, 16 nt, Bordetella pertussis
agcgucaugcgcaccu

SEQ ID NO: 405790 - RNA, 12 nt, Bordetella pertussis
agcguccaggcg

SEQ ID NO: 405791 - RNA, 20 nt, Bordetella pertussis
agcgugaugccgucgagcgc

SEQ ID NO: 405792 - RNA, 15 nt, Bordetella pertussis
agcgugccgccggcg

SEQ ID NO: 405793 - RNA, 17 nt, Bordetella pertussis
agcgugccggugacgac

SEQ ID NO: 405794 - RNA, 22 nt, Bordetella pertussis
agcgugccgggaugcugcucgg

SEQ ID NO: 405795 - RNA, 14 nt, Bordetella pertussis
agcgugcgccccgc

SEQ ID NO: 405796 - RNA, 19 nt, Bordetella pertussis
agcgugcgccccgccucga

SEQ ID NO: 405797 - RNA, 17 nt, Bordetella pertussis
agcguggccaccaggcg

SEQ ID NO: 405798 - RNA, 20 nt, Bordetella pertussis
agcguggccaccaggcgcgc

SEQ ID NO: 405799 - RNA, 21 nt, Bordetella pertussis
agcguggcgguguuggcgucc

SEQ ID NO: 405800 - RNA, 23 nt, Bordetella pertussis
agcguggggacgcgggccacgcg

SEQ ID NO: 405801 - RNA, 15 nt, Bordetella pertussis
agcguguaggcggcc

SEQ ID NO: 405802 - RNA, 16 nt, Bordetella pertussis
agcguguaggcggccg

SEQ ID NO: 405803 - RNA, 17 nt, Bordetella pertussis
agcgugucgaacaccag

SEQ ID NO: 405804 - RNA, 17 nt, Bordetella pertussis
agcgugugucccggcgg

SEQ ID NO: 405805 - RNA, 20 nt, Bordetella pertussis
agcguucauggcguaugaca

SEQ ID NO: 405806 - RNA, 13 nt, Bordetella pertussis
agcguuccagcag

SEQ ID NO: 405807 - RNA, 21 nt, Bordetella pertussis
agcguucgauagguuuucuca

SEQ ID NO: 405808 - RNA, 14 nt, Bordetella pertussis
agcguucggccacc

SEQ ID NO: 405809 - RNA, 23 nt, Bordetella pertussis
agcguuggcggccggccagccau

SEQ ID NO: 405810 - RNA, 23 nt, Bordetella pertussis
agcuacccccugaccggcggcgu

SEQ ID NO: 405811 - RNA, 16 nt, Bordetella pertussis
agcuccagccgcaggc

SEQ ID NO: 405812 - RNA, 13 nt, Bordetella pertussis
agcuccagcuggc

SEQ ID NO: 405813 - RNA, 19 nt, Bordetella pertussis
agcuccagcuggcgcacca

SEQ ID NO: 405814 - RNA, 21 nt, Bordetella pertussis
agcuccaggaaaaccuccucc

SEQ ID NO: 405815 - RNA, 16 nt, Bordetella pertussis
agcuccaggugccaga

SEQ ID NO: 405816 - RNA, 22 nt, Bordetella pertussis
agcugccaggcuaucguggcug

SEQ ID NO: 405817 - RNA, 15 nt, Bordetella pertussis
agcugcccagcaauu

SEQ ID NO: 405818 - RNA, 21 nt, Bordetella pertussis
agcugccgaaucggccccugc

SEQ ID NO: 405819 - RNA, 14 nt, Bordetella pertussis
agcugccugagcac

SEQ ID NO: 405820 - RNA, 16 nt, Bordetella pertussis
agcugcugcuggaccu

SEQ ID NO: 405821 - RNA, 17 nt, Bordetella pertussis
agcugcugcuggaccug

SEQ ID NO: 405822 - RNA, 20 nt, Bordetella pertussis
agcugcuggcgcgccaggcg

SEQ ID NO: 405823 - RNA, 15 nt, Bordetella pertussis
agcugcugugcgccg

SEQ ID NO: 405824 - RNA, 15 nt, Bordetella pertussis
agcugcuguuggccu

SEQ ID NO: 405825 - RNA, 20 nt, Bordetella pertussis
agcugcuucaguuccaggcg

SEQ ID NO: 405826 - RNA, 19 nt, Bordetella pertussis
agcugcuucaugcgcuccu

SEQ ID NO: 405827 - RNA, 15 nt, Bordetella pertussis
agcuggaagcgcgcc

SEQ ID NO: 405828 - RNA, 20 nt, Bordetella pertussis
agcuggaagcgcgccaggcg

SEQ ID NO: 405829 - RNA, 17 nt, Bordetella pertussis
agcuguagcccuggcgc

SEQ ID NO: 405830 - RNA, 22 nt, Bordetella pertussis
agcuguccacgccgaaguggcu

SEQ ID NO: 405831 - RNA, 19 nt, Bordetella pertussis
agcuguccuucguggcgcc

SEQ ID NO: 405832 - RNA, 22 nt, Bordetella pertussis
agcugucggcgcuggccaucac

SEQ ID NO: 405833 - RNA, 23 nt, Bordetella pertussis
agcuuccagaucgaccaggaccu

SEQ ID NO: 405834 - RNA, 18 nt, Bordetella pertussis
agcuugaccgccagcauc

SEQ ID NO: 405835 - RNA, 16 nt, Bordetella pertussis
agcuugaccgccucca

SEQ ID NO: 405836 - RNA, 15 nt, Bordetella pertussis
agcuugaugccgccg

SEQ ID NO: 405837 - RNA, 15 nt, Bordetella pertussis
agcuugcaggcgccu

SEQ ID NO: 405838 - RNA, 17 nt, Bordetella pertussis
agcuugccgcccagguc

SEQ ID NO: 405839 - RNA, 23 nt, Bordetella pertussis
agcuugccuuacgcgguccgcag

SEQ ID NO: 405840 - RNA, 21 nt, Bordetella pertussis
agcuugggcuugauggccagc

SEQ ID NO: 405841 - RNA, 21 nt, Bordetella pertussis
agcuuggucacggccucggca

SEQ ID NO: 405842 - RNA, 15 nt, Bordetella pertussis
agcuuggugcucagu

SEQ ID NO: 405843 - RNA, 20 nt, Bordetella pertussis
agcuuguagcccucggucgu

SEQ ID NO: 405844 - RNA, 16 nt, Bordetella pertussis
aggaaagaggccaggc

SEQ ID NO: 405845 - RNA, 20 nt, Bordetella pertussis
aggaaagcccggccccaggc

SEQ ID NO: 405846 - RNA, 20 nt, Bordetella pertussis
aggaacaccaccuccaccgc

SEQ ID NO: 405847 - RNA, 15 nt, Bordetella pertussis
aggaacagccugccc

SEQ ID NO: 405848 - RNA, 16 nt, Bordetella pertussis
aggaacaggccggccu

SEQ ID NO: 405849 - RNA, 16 nt, Bordetella pertussis
aggaacgccagcagca

SEQ ID NO: 405850 - RNA, 16 nt, Bordetella pertussis
aggaacgccgcgcuca

SEQ ID NO: 405851 - RNA, 15 nt, Bordetella pertussis
aggaacggcauggca

SEQ ID NO: 405852 - RNA, 17 nt, Bordetella pertussis
aggaacuccggcggcgc

SEQ ID NO: 405853 - RNA, 18 nt, Bordetella pertussis
aggaacucgcacacgcgc

SEQ ID NO: 405854 - RNA, 16 nt, Bordetella pertussis
aggaacuggacggcgc

SEQ ID NO: 405855 - RNA, 20 nt, Bordetella pertussis
aggaagaucggcccggcgcc

SEQ ID NO: 405856 - RNA, 15 nt, Bordetella pertussis
aggaagcagcccagc

SEQ ID NO: 405857 - RNA, 16 nt, Bordetella pertussis
aggaagcagcccagca

SEQ ID NO: 405858 - RNA, 14 nt, Bordetella pertussis
aggaagccugcgcg

SEQ ID NO: 405859 - RNA, 14 nt, Bordetella pertussis
aggaaggcccgcgu

SEQ ID NO: 405860 - RNA, 19 nt, Bordetella pertussis
aggaauuccucgcggcugu

SEQ ID NO: 405861 - RNA, 21 nt, Bordetella pertussis
aggacaaggcgcguaugacgc

SEQ ID NO: 405862 - RNA, 12 nt, Bordetella pertussis
aggacagccgcu

SEQ ID NO: 405863 - RNA, 21 nt, Bordetella pertussis
aggagacaucaugcagaaaca

SEQ ID NO: 405864 - RNA, 21 nt, Bordetella pertussis
aggagacggucaccgcgccca

SEQ ID NO: 405865 - RNA, 13 nt, Bordetella pertussis
aggagcaugcccu

SEQ ID NO: 405866 - RNA, 20 nt, Bordetella pertussis
aggagccggcgggcggcugc

SEQ ID NO: 405867 - RNA, 20 nt, Bordetella pertussis
aggaggauaagccgugaaga

SEQ ID NO: 405868 - RNA, 16 nt, Bordetella pertussis
aggauuccugcgagga

SEQ ID NO: 405869 - RNA, 19 nt, Bordetella pertussis
aggauuccugcgaggacag

SEQ ID NO: 405870 - RNA, 22 nt, Bordetella pertussis
aggcacaccggucuacgccaug

SEQ ID NO: 405871 - RNA, 19 nt, Bordetella pertussis
aggcacaccgugccgcaga

SEQ ID NO: 405872 - RNA, 17 nt, Bordetella pertussis
aggcacaccacgcgaug

SEQ ID NO: 405873 - RNA, 20 nt, Bordetella pertussis
aggcacaccacgcgaugcgg

SEQ ID NO: 405874 - RNA, 20 nt, Bordetella pertussis
aggcacaggaacagccugcc

SEQ ID NO: 405875 - RNA, 20 nt, Bordetella pertussis
aggcacccagggguuacagc

SEQ ID NO: 405876 - RNA, 21 nt, Bordetella pertussis
aggcacccccgaccgagccac

SEQ ID NO: 405877 - RNA, 22 nt, Bordetella pertussis
aggcaccccucccuguggggga

SEQ ID NO: 405878 - RNA, 13 nt, Bordetella pertussis
aggcacccggggu

SEQ ID NO: 405879 - RNA, 13 nt, Bordetella pertussis
aggcacccuugcc

SEQ ID NO: 405880 - RNA, 14 nt, Bordetella pertussis
aggcacccugcccc

SEQ ID NO: 405881 - RNA, 23 nt, Bordetella pertussis
aggcacccugccgugggacaggc

SEQ ID NO: 405882 - RNA, 18 nt, Bordetella pertussis
aggcaccucguucacccc

SEQ ID NO: 405883 - RNA, 20 nt, Bordetella pertussis
aggcacgcggaggagguggc

SEQ ID NO: 405884 - RNA, 19 nt, Bordetella pertussis
aggcacuccggauaccgcc

SEQ ID NO: 405885 - RNA, 22 nt, Bordetella pertussis
aggcagaaguggucgcgcaggc

SEQ ID NO: 405886 - RNA, 17 nt, Bordetella pertussis
aggcagacgaugcccag

SEQ ID NO: 405887 - RNA, 17 nt, Bordetella pertussis
aggcaugcgccagcgcc

SEQ ID NO: 405888 - RNA, 18 nt, Bordetella pertussis
aggcauucccgcccagcg

SEQ ID NO: 405889 - RNA, 21 nt, Bordetella pertussis
aggcauucgugaugccccagg

SEQ ID NO: 405890 - RNA, 18 nt, Bordetella pertussis
aggcauucgaacaacagc

SEQ ID NO: 405891 - RNA, 21 nt, Bordetella pertussis
aggcauuggcgccgcgcucgc

SEQ ID NO: 405892 - RNA, 15 nt, Bordetella pertussis
aggccaccgacggcg

SEQ ID NO: 405893 - RNA, 14 nt, Bordetella pertussis
aggccacggcaaug

SEQ ID NO: 405894 - RNA, 20 nt, Bordetella pertussis
aggcccacaaugccccacgg

SEQ ID NO: 405895 - RNA, 15 nt, Bordetella pertussis
aggcccaccggcaug

SEQ ID NO: 405896 - RNA, 14 nt, Bordetella pertussis
aggcccagccagcg

SEQ ID NO: 405897 - RNA, 16 nt, Bordetella pertussis
aggcccagggccaggu

SEQ ID NO: 405898 - RNA, 15 nt, Bordetella pertussis
aggcccaugaaggcg

SEQ ID NO: 405899 - RNA, 17 nt, Bordetella pertussis
aggccccggcccggcgg

SEQ ID NO: 405900 - RNA, 18 nt, Bordetella pertussis
aggcccgccgcggcaggc

SEQ ID NO: 405901 - RNA, 19 nt, Bordetella pertussis
aggcccgcgucuuggcggg

SEQ ID NO: 405902 - RNA, 19 nt, Bordetella pertussis
aggccgacgaggcgcuguu

SEQ ID NO: 405903 - RNA, 15 nt, Bordetella pertussis
aggccgacuggauga

SEQ ID NO: 405904 - RNA, 13 nt, Bordetella pertussis
aggccgagcgcga

SEQ ID NO: 405905 - RNA, 14 nt, Bordetella pertussis
aggccgaucagcac

SEQ ID NO: 405906 - RNA, 19 nt, Bordetella pertussis
aggccgauucgccguggcu

SEQ ID NO: 405907 - RNA, 22 nt, Bordetella pertussis
aggccgauggcguccagcagca

SEQ ID NO: 405908 - RNA, 20 nt, Bordetella pertussis
aggccgcaacccacccccag

SEQ ID NO: 405909 - RNA, 21 nt, Bordetella pertussis
aggccgccacgaaacccacgg

SEQ ID NO: 405910 - RNA, 16 nt, Bordetella pertussis
aggccggcggcgucuu

SEQ ID NO: 405911 - RNA, 19 nt, Bordetella pertussis
aggccgcccgccccggcgc

SEQ ID NO: 405912 - RNA, 10 nt, Bordetella pertussis
aggccgggcg

SEQ ID NO: 405913 - RNA, 21 nt, Bordetella pertussis
aggccggggaaacggccaagc

SEQ ID NO: 405914 - RNA, 18 nt, Bordetella pertussis
aggccgucgagccgggcg

SEQ ID NO: 405915 - RNA, 13 nt, Bordetella pertussis
aggccgucggcca

SEQ ID NO: 405916 - RNA, 16 nt, Bordetella pertussis
aggccgucggccaggg

SEQ ID NO: 405917 - RNA, 16 nt, Bordetella pertussis
aggccguggcccagcc

SEQ ID NO: 405918 - RNA, 17 nt, Bordetella pertussis
aggccguuuccucugga

SEQ ID NO: 405919 - RNA, 20 nt, Bordetella pertussis
aggccucgaagaucaacaag

SEQ ID NO: 405920 - RNA, 13 nt, Bordetella pertussis
aggccucgggcca

SEQ ID NO: 405921 - RNA, 14 nt, Bordetella pertussis
aggccucggccacc

SEQ ID NO: 405922 - RNA, 18 nt, Bordetella pertussis
aggccucgugcugcugca

SEQ ID NO: 405923 - RNA, 19 nt, Bordetella pertussis
aggccuggcuuggcggcca

SEQ ID NO: 405924 - RNA, 22 nt, Bordetella pertussis
aggccuggcuuggcggccagga

SEQ ID NO: 405925 - RNA, 22 nt, Bordetella pertussis
aggccuggucggggucggccac

SEQ ID NO: 405926 - RNA, 16 nt, Bordetella pertussis
aggccuguucggccgg

SEQ ID NO: 405927 - RNA, 15 nt, Bordetella pertussis
aggcgaacaggcaca

SEQ ID NO: 405928 - RNA, 17 nt, Bordetella pertussis
aggcgaacaggcacagg

SEQ ID NO: 405929 - RNA, 13 nt, Bordetella pertussis
aggcgagcagguc

SEQ ID NO: 405930 - RNA, 19 nt, Bordetella pertussis
aggcgagcagguccauggc

SEQ ID NO: 405931 - RNA, 14 nt, Bordetella pertussis
aggcgauccaggcc

SEQ ID NO: 405932 - RNA, 15 nt, Bordetella pertussis
aggcgaugcccagcg

SEQ ID NO: 405933 - RNA, 14 nt, Bordetella pertussis
aggcgaucugcggc

SEQ ID NO: 405934 - RNA, 15 nt, Bordetella pertussis
aggcgcagcaggcca

SEQ ID NO: 405935 - RNA, 19 nt, Bordetella pertussis
aggcgcauauggagccagg

SEQ ID NO: 405936 - RNA, 21 nt, Bordetella pertussis
aggcgcauauggagccaggcg

SEQ ID NO: 405937 - RNA, 23 nt, Bordetella pertussis
aggcgcauggugagggccacgcg

SEQ ID NO: 405938 - RNA, 21 nt, Bordetella pertussis
aggcgcaucgacagcgcgccc

SEQ ID NO: 405939 - RNA, 12 nt, Bordetella pertussis
aggcgccccagg

SEQ ID NO: 405940 - RNA, 14 nt, Bordetella pertussis
aggcgccccaggcg

SEQ ID NO: 405941 - RNA, 14 nt, Bordetella pertussis
aggcgccgacggcg

SEQ ID NO: 405942 - RNA, 18 nt, Bordetella pertussis
aggcgccgcaacaggcag

SEQ ID NO: 405943 - RNA, 12 nt, Bordetella pertussis
aggcgccgcaga

SEQ ID NO: 405944 - RNA, 22 nt, Bordetella pertussis
aggcgccgccccgucaucgggu

SEQ ID NO: 405945 - RNA, 12 nt, Bordetella pertussis
aggcgccgccgc

SEQ ID NO: 405946 - RNA, 19 nt, Bordetella pertussis
aggcgccgcgcccguccac

SEQ ID NO: 405947 - RNA, 16 nt, Bordetella pertussis
aggcgccggccaggcc

SEQ ID NO: 405948 - RNA, 18 nt, Bordetella pertussis
aggcgccggcgccgggca

SEQ ID NO: 405949 - RNA, 16 nt, Bordetella pertussis
aggcgccgggccgcua

SEQ ID NO: 405950 - RNA, 21 nt, Bordetella pertussis
aggcgccgggccgcuaggccu

SEQ ID NO: 405951 - RNA, 20 nt, Bordetella pertussis
aggcgccgucgaagccggcg

SEQ ID NO: 405952 - RNA, 17 nt, Bordetella pertussis
aggcgcgcaccagcccg

SEQ ID NO: 405953 - RNA, 21 nt, Bordetella pertussis
aggcgcgccaccggucgccgu

SEQ ID NO: 405954 - RNA, 22 nt, Bordetella pertussis
aggcgcgccagcccgccgcugg

SEQ ID NO: 405955 - RNA, 14 nt, Bordetella pertussis
aggcgcgccagccg

SEQ ID NO: 405956 - RNA, 16 nt, Bordetella pertussis
aggcgcgccagccgcu

SEQ ID NO: 405957 - RNA, 16 nt, Bordetella pertussis
aggcgcgcggccucga

SEQ ID NO: 405958 - RNA, 13 nt, Bordetella pertussis
aggcgcgcgguga

SEQ ID NO: 405959 - RNA, 15 nt, Bordetella pertussis
aggcgcggccgggcu

SEQ ID NO: 405960 - RNA, 24 nt, Bordetella pertussis
aggcgcggccgucgugcagcgugg

SEQ ID NO: 405961 - RNA, 12 nt, Bordetella pertussis
aggcgcggcugg

SEQ ID NO: 405962 - RNA, 22 nt, Bordetella pertussis
aggcgcgugcucaucggcaggc

SEQ ID NO: 405963 - RNA, 16 nt, Bordetella pertussis
aggcgcguggccacgg

SEQ ID NO: 405964 - RNA, 22 nt, Bordetella pertussis
aggcgcguggccacggcgucga

SEQ ID NO: 405965 - RNA, 21 nt, Bordetella pertussis
aggcgcgugggcaggugcuug

SEQ ID NO: 405966 - RNA, 14 nt, Bordetella pertussis
aggcgcuccagcac

SEQ ID NO: 405967 - RNA, 22 nt, Bordetella pertussis
aggcgcuccagcaccugcaccg

SEQ ID NO: 405968 - RNA, 19 nt, Bordetella pertussis
aggcgcucgcgcugcagga

SEQ ID NO: 405969 - RNA, 16 nt, Bordetella pertussis
aggcgcucggccagcg

SEQ ID NO: 405970 - RNA, 21 nt, Bordetella pertussis
aggcgcugcagcaauccaucg

SEQ ID NO: 405971 - RNA, 17 nt, Bordetella pertussis
aggcgcuggcguccagc

SEQ ID NO: 405972 - RNA, 16 nt, Bordetella pertussis
aggcgcuguuggccgu

SEQ ID NO: 405973 - RNA, 14 nt, Bordetella pertussis
aggcggcaaacccg

SEQ ID NO: 405974 - RNA, 16 nt, Bordetella pertussis
aggcggcagaaggcga

SEQ ID NO: 405975 - RNA, 14 nt, Bordetella pertussis
aggcggcaggcgcc

SEQ ID NO: 405976 - RNA, 21 nt, Bordetella pertussis
aggcuuucgaagccgccccac

SEQ ID NO: 405977 - RNA, 20 nt, Bordetella pertussis
aggcuuucgcacagccgggg

SEQ ID NO: 405978 - RNA, 19 nt, Bordetella pertussis
aggcuuugcgcgccaugca

SEQ ID NO: 405979 - RNA, 20 nt, Bordetella pertussis
aggcuuuuuuucgccgggcg

SEQ ID NO: 405980 - RNA, 10 nt, Bordetella pertussis
agggacaggc

SEQ ID NO: 405981 - RNA, 14 nt, Bordetella pertussis
agggacaggcaccc

SEQ ID NO: 405982 - RNA, 19 nt, Bordetella pertussis
agggacgggccagccccgg

SEQ ID NO: 405983 - RNA, 18 nt, Bordetella pertussis
agggacuugggcaggccu

SEQ ID NO: 405984 - RNA, 18 nt, Bordetella pertussis
agggagccguucuggcag

SEQ ID NO: 405985 - RNA, 16 nt, Bordetella pertussis
agggaggcuguccccg

SEQ ID NO: 405986 - RNA, 16 nt, Bordetella pertussis
agggcaagcgcgucga

SEQ ID NO: 405987 - RNA, 17 nt, Bordetella pertussis
agggcacaucggccacc

SEQ ID NO: 405988 - RNA, 19 nt, Bordetella pertussis
agggcacaucggccacccg

SEQ ID NO: 405989 - RNA, 12 nt, Bordetella pertussis
agggccagcgcc

SEQ ID NO: 405990 - RNA, 19 nt, Bordetella pertussis
agggccaggcccacggcgc

SEQ ID NO: 405991 - RNA, 14 nt, Bordetella pertussis
agggcccagcugca

SEQ ID NO: 405992 - RNA, 15 nt, Bordetella pertussis
agggccgcagcaauu

SEQ ID NO: 405993 - RNA, 22 nt, Bordetella pertussis
agggcggcgucgaucggcgcgc

SEQ ID NO: 405994 - RNA, 13 nt, Bordetella pertussis
agggcgggcggga

SEQ ID NO: 405995 - RNA, 19 nt, Bordetella pertussis
agggcgggcggugcggccu

SEQ ID NO: 405996 - RNA, 18 nt, Bordetella pertussis
agggcguacgacggggug

SEQ ID NO: 405997 - RNA, 20 nt, Bordetella pertussis
agggcgucgcgaugcgccag

SEQ ID NO: 405998 - RNA, 15 nt, Bordetella pertussis
agggcuccaggcuga

SEQ ID NO: 405999 - RNA, 16 nt, Bordetella pertussis
agggcuucgacucccu

SEQ ID NO: 406000 - RNA, 22 nt, Bordetella pertussis
aggggcagcucggugcagccca

SEQ ID NO: 406001 - RNA, 21 nt, Bordetella pertussis
aggggccggcuuuggacaggc

SEQ ID NO: 406002 - RNA, 11 nt, Bordetella pertussis
aggggcggcgc

SEQ ID NO: 406003 - RNA, 18 nt, Bordetella pertussis
aggggcggcuucaggcgc

SEQ ID NO: 406004 - RNA, 21 nt, Bordetella pertussis
aggggcggcuucaggcgcgcg

SEQ ID NO: 406005 - RNA, 11 nt, Bordetella pertussis
aggggcucgcg

SEQ ID NO: 406006 - RNA, 17 nt, Bordetella pertussis
aggggcucggccaggug

SEQ ID NO: 406007 - RNA, 22 nt, Bordetella pertussis
aggggcugccgugaggcagccu

SEQ ID NO: 406008 - RNA, 17 nt, Bordetella pertussis
aggguacggcgaugccg

SEQ ID NO: 406009 - RNA, 20 nt, Bordetella pertussis
aggguacggcgaugccggcg

SEQ ID NO: 406010 - RNA, 14 nt, Bordetella pertussis
agggugacgggcug

SEQ ID NO: 406011 - RNA, 21 nt, Bordetella pertussis
agggugccgaaacccucguga

SEQ ID NO: 406012 - RNA, 16 nt, Bordetella pertussis
agggugccuguccccg

SEQ ID NO: 406013 - RNA, 13 nt, Bordetella pertussis
agggugcggggug

SEQ ID NO: 406014 - RNA, 22 nt, Bordetella pertussis
agggugcuguucaggcgcucga

SEQ ID NO: 406015 - RNA, 13 nt, Bordetella pertussis
agguaggcggcgc

SEQ ID NO: 406016 - RNA, 16 nt, Bordetella pertussis
agguagggcgcggcca

SEQ ID NO: 406017 - RNA, 19 nt, Bordetella pertussis
agguagucgaugaaggcgc

SEQ ID NO: 406018 - RNA, 20 nt, Bordetella pertussis
agguagucgaugaaggcgcc

SEQ ID NO: 406019 - RNA, 15 nt, Bordetella pertussis
agguagucggucacc

SEQ ID NO: 406020 - RNA, 19 nt, Bordetella pertussis
agguagucgucgaaggcgc

SEQ ID NO: 406021 - RNA, 16 nt, Bordetella pertussis
agguaucggcccgcgc

SEQ ID NO: 406022 - RNA, 13 nt, Bordetella pertussis
aggucgccagcag

SEQ ID NO: 406023 - RNA, 17 nt, Bordetella pertussis
aggucgccagcaggccc

SEQ ID NO: 406024 - RNA, 23 nt, Bordetella pertussis
aggucgcgcgacgugucggccac

SEQ ID NO: 406025 - RNA, 18 nt, Bordetella pertussis
aggucgcugcccagcaug

SEQ ID NO: 406026 - RNA, 13 nt, Bordetella pertussis
aggucggccaccg

SEQ ID NO: 406027 - RNA, 19 nt, Bordetella pertussis
aggucggcgcggggcaccg

SEQ ID NO: 406028 - RNA, 16 nt, Bordetella pertussis
aggucggggcgcucga

SEQ ID NO: 406029 - RNA, 18 nt, Bordetella pertussis
aggucggggcgcucgagc

SEQ ID NO: 406030 - RNA, 18 nt, Bordetella pertussis
aggucgucgagccgggcc

SEQ ID NO: 406031 - RNA, 17 nt, Bordetella pertussis
aggucguggcccagccg

SEQ ID NO: 406032 - RNA, 15 nt, Bordetella pertussis
aggugcaggguuggc

SEQ ID NO: 406033 - RNA, 21 nt, Bordetella pertussis
agguggcauagaugccgaaca

SEQ ID NO: 406034 - RNA, 21 nt, Bordetella pertussis
agguggcccgcaccgggcggc

SEQ ID NO: 406035 - RNA, 16 nt, Bordetella pertussis
agguugagucuggaga

SEQ ID NO: 406036 - RNA, 16 nt, Bordetella pertussis
agguugcaggccaggc

SEQ ID NO: 406037 - RNA, 17 nt, Bordetella pertussis
agguugcaggccaggcu

SEQ ID NO: 406038 - RNA, 23 nt, Bordetella pertussis
agguugcaggccaggcucagcag

SEQ ID NO: 406039 - RNA, 21 nt, Bordetella pertussis
agguugcccgcccgacgagga

SEQ ID NO: 406040 - RNA, 14 nt, Bordetella pertussis
agguugcggccgcc

SEQ ID NO: 406041 - RNA, 19 nt, Bordetella pertussis
agguugggugcgccgccgg

SEQ ID NO: 406042 - RNA, 17 nt, Bordetella pertussis
agguugugccccuugcc

SEQ ID NO: 406043 - RNA, 20 nt, Bordetella pertussis
agguugugccccuugcccaa

SEQ ID NO: 406044 - RNA, 23 nt, Bordetella pertussis
agguuuccuuggggucccacugc

SEQ ID NO: 406045 - RNA, 16 nt, Bordetella pertussis
aguagcgugugcagga

SEQ ID NO: 406046 - RNA, 13 nt, Bordetella pertussis
aguaggcgcccca

SEQ ID NO: 406047 - RNA, 15 nt, Bordetella pertussis
aguagugcccccacg

SEQ ID NO: 406048 - RNA, 17 nt, Bordetella pertussis
aguaucccggccaggcg

SEQ ID NO: 406049 - RNA, 16 nt, Bordetella pertussis
aguauggugaccggcg

SEQ ID NO: 406050 - RNA, 12 nt, Bordetella pertussis
aguauuucagga

SEQ ID NO: 406051 - RNA, 14 nt, Bordetella pertussis
aguccgcagcgcag

SEQ ID NO: 406052 - RNA, 19 nt, Bordetella pertussis
aguccgcagcgcagcgcca

SEQ ID NO: 406053 - RNA, 18 nt, Bordetella pertussis
aguccgcccagccaggcg

SEQ ID NO: 406054 - RNA, 14 nt, Bordetella pertussis
aguccggcgccgcc

SEQ ID NO: 406055 - RNA, 20 nt, Bordetella pertussis
aguccucaugcgggacaggc

SEQ ID NO: 406056 - RNA, 21 nt, Bordetella pertussis
aguccucaugcgggacaggcg

SEQ ID NO: 406057 - RNA, 15 nt, Bordetella pertussis
aguccuccugucaug

SEQ ID NO: 406058 - RNA, 14 nt, Bordetella pertussis
agucgagcaccgcg

SEQ ID NO: 406059 - RNA, 22 nt, Bordetella pertussis
agucgcgcagcaccucggggcg

SEQ ID NO: 406060 - RNA, 14 nt, Bordetella pertussis
agucggcaggagcc

SEQ ID NO: 406061 - RNA, 18 nt, Bordetella pertussis
agucggcaggagccuguc

SEQ ID NO: 406062 - RNA, 12 nt, Bordetella pertussis
agucggccacca

SEQ ID NO: 406063 - RNA, 15 nt, Bordetella pertussis
agucggggcgccggu

SEQ ID NO: 406064 - RNA, 13 nt, Bordetella pertussis
agugcagcgcuca

SEQ ID NO: 406065 - RNA, 22 nt, Bordetella pertussis
agugcaggccgcgcagcacgcc

SEQ ID NO: 406066 - RNA, 11 nt, Bordetella pertussis
agugcaggggg

SEQ ID NO: 406067 - RNA, 20 nt, Bordetella pertussis
agugcaggggguggcggccg

SEQ ID NO: 406068 - RNA, 16 nt, Bordetella pertussis
agugcccccacgcugc

SEQ ID NO: 406069 - RNA, 22 nt, Bordetella pertussis
agugcccccacgcugcgcccgc

SEQ ID NO: 406070 - RNA, 13 nt, Bordetella pertussis
agugcucgggcug

SEQ ID NO: 406071 - RNA, 22 nt, Bordetella pertussis
agugcuucgagauccgccggcg

SEQ ID NO: 406072 - RNA, 16 nt, Bordetella pertussis
agugguaugaccggcg

SEQ ID NO: 406073 - RNA, 19 nt, Bordetella pertussis
agugguggugcagcggcag

SEQ ID NO: 406074 - RNA, 16 nt, Bordetella pertussis
agugguguagccagga

SEQ ID NO: 406075 - RNA, 18 nt, Bordetella pertussis
aguucggccgccagguag

SEQ ID NO: 406076 - RNA, 21 nt, Bordetella pertussis
aguucgggguccagcaaaugg

SEQ ID NO: 406077 - RNA, 21 nt, Bordetella pertussis
aguucgucgucgccaccgccc

SEQ ID NO: 406078 - RNA, 17 nt, Bordetella pertussis
aguucugguagguguga

SEQ ID NO: 406079 - RNA, 16 nt, Bordetella pertussis
aguucuucuuggccag

SEQ ID NO: 406080 - RNA, 15 nt, Bordetella pertussis
aguuguaguggugua

SEQ ID NO: 406081 - RNA, 22 nt, Bordetella pertussis
aguuguagguccaguacaccag

SEQ ID NO: 406082 - RNA, 16 nt, Bordetella pertussis
aguuugcgggugccag

SEQ ID NO: 406083 - RNA, 20 nt, Bordetella pertussis
auaacguggcgcgcaccugg

SEQ ID NO: 406084 - RNA, 15 nt, Bordetella pertussis
auaagucugcgccuu

SEQ ID NO: 406085 - RNA, 12 nt, Bordetella pertussis
auacaaggugcc

SEQ ID NO: 406086 - RNA, 14 nt, Bordetella pertussis
auacaggaagcgcu

SEQ ID NO: 406087 - RNA, 12 nt, Bordetella pertussis
auaccgcgcaca

SEQ ID NO: 406088 - RNA, 19 nt, Bordetella pertussis
auaccucgauggcgguggu

SEQ ID NO: 406089 - RNA, 12 nt, Bordetella pertussis
auacgccgugcu

SEQ ID NO: 406090 - RNA, 19 nt, Bordetella pertussis
auagaucauccagguggcg

SEQ ID NO: 406091 - RNA, 21 nt, Bordetella pertussis
auagcgggccugcagcaugac

SEQ ID NO: 406092 - RNA, 14 nt, Bordetella pertussis
auauagaccagcag

SEQ ID NO: 406093 - RNA, 16 nt, Bordetella pertussis
auauagaccagcagcu

SEQ ID NO: 406094 - RNA, 16 nt, Bordetella pertussis
auauccuugcgcucgc

SEQ ID NO: 406095 - RNA, 22 nt, Bordetella pertussis
auaucgaagacaugcugcgaca

SEQ ID NO: 406096 - RNA, 19 nt, Bordetella pertussis
auaucuggcaaugguccag

SEQ ID NO: 406097 - RNA, 14 nt, Bordetella pertussis
auaugcagccgcac

SEQ ID NO: 406098 - RNA, 18 nt, Bordetella pertussis
auaugcagccgcaccagc

SEQ ID NO: 406099 - RNA, 21 nt, Bordetella pertussis
auaugcagccgcaccagcgca

SEQ ID NO: 406100 - RNA, 18 nt, Bordetella pertussis
aucaaucugaucaucuuc

SEQ ID NO: 406101 - RNA, 23 nt, Bordetella pertussis
aucacgcgcuccggcugcgcgcg

SEQ ID NO: 406102 - RNA, 22 nt, Bordetella pertussis
aucacgggcuguucgcgcagca

SEQ ID NO: 406103 - RNA, 16 nt, Bordetella pertussis
aucacgguaggcgcgu

SEQ ID NO: 406104 - RNA, 20 nt, Bordetella pertussis
aucacuuucccauccuggcc

SEQ ID NO: 406105 - RNA, 16 nt, Bordetella pertussis
aucagcgccugcaggu

SEQ ID NO: 406106 - RNA, 22 nt, Bordetella pertussis
aucagcgcgcccgcuuccuugg

SEQ ID NO: 406107 - RNA, 16 nt, Bordetella pertussis
aucagcuuggccacca

SEQ ID NO: 406108 - RNA, 18 nt, Bordetella pertussis
aucaggaacggcauggca

SEQ ID NO: 406109 - RNA, 13 nt, Bordetella pertussis
aucaggcccagca

SEQ ID NO: 406110 - RNA, 12 nt, Bordetella pertussis
aucaggccgccc

SEQ ID NO: 406111 - RNA, 14 nt, Bordetella pertussis
aucaggccgcccca

SEQ ID NO: 406112 - RNA, 16 nt, Bordetella pertussis
aucaggcccuggggcc

SEQ ID NO: 406113 - RNA, 18 nt, Bordetella pertussis
aucaggcgcaucgacagc

SEQ ID NO: 406114 - RNA, 11 nt, Bordetella pertussis
aucaucaggau

SEQ ID NO: 406115 - RNA, 14 nt, Bordetella pertussis
aucaucaggaugaa

SEQ ID NO: 406116 - RNA, 22 nt, Bordetella pertussis
aucaucagguccacuucaccgc

SEQ ID NO: 406117 - RNA, 18 nt, Bordetella pertussis
aucaucgagcaccgccuc

SEQ ID NO: 406118 - RNA, 20 nt, Bordetella pertussis
auccaccggcgcgcgcaugc

SEQ ID NO: 406119 - RNA, 22 nt, Bordetella pertussis
auccacuugcggguccagcagg

SEQ ID NO: 406120 - RNA, 22 nt, Bordetella pertussis
auccagccguuggcgcccagcg

SEQ ID NO: 406121 - RNA, 13 nt, Bordetella pertussis
auccagcgccugg

SEQ ID NO: 406122 - RNA, 22 nt, Bordetella pertussis
auccagcgcgcgaucgccagca

SEQ ID NO: 406123 - RNA, 23 nt, Bordetella pertussis
auccaggccgugagcgccgccgc

SEQ ID NO: 406124 - RNA, 20 nt, Bordetella pertussis
auccaggcggccaccaccag

SEQ ID NO: 406125 - RNA, 16 nt, Bordetella pertussis
auccagggccacgccc

SEQ ID NO: 406126 - RNA, 19 nt, Bordetella pertussis
auccagggccgccagcacc

SEQ ID NO: 406127 - RNA, 13 nt, Bordetella pertussis
auccagguacgac

SEQ ID NO: 406128 - RNA, 15 nt, Bordetella pertussis
auccauguggccagc

SEQ ID NO: 406129 - RNA, 23 nt, Bordetella pertussis
aucccgcccccgccgcacgggcg

SEQ ID NO: 406130 - RNA, 14 nt, Bordetella pertussis
aucccggccaggcg

SEQ ID NO: 406131 - RNA, 13 nt, Bordetella pertussis
aucccggcgcugg

SEQ ID NO: 406132 - RNA, 19 nt, Bordetella pertussis
auccgaggcccguuuuguu

SEQ ID NO: 406133 - RNA, 18 nt, Bordetella pertussis
auccgaugaugcccagga

SEQ ID NO: 406134 - RNA, 24 nt, Bordetella pertussis
auccgcaaguucggcagcgaggcg

SEQ ID NO: 406135 - RNA, 16 nt, Bordetella pertussis
auccgcaacccagcag

SEQ ID NO: 406136 - RNA, 17 nt, Bordetella pertussis
auccgcaacccagcagc

SEQ ID NO: 406137 - RNA, 21 nt, Bordetella pertussis
auccgcaccggcgugcgcugg

SEQ ID NO: 406138 - RNA, 18 nt, Bordetella pertussis
auccgcgaagugccuguc

SEQ ID NO: 406139 - RNA, 13 nt, Bordetella pertussis
auccgcgcaugga

SEQ ID NO: 406140 - RNA, 14 nt, Bordetella pertussis
auccgcgccaggcg

SEQ ID NO: 406141 - RNA, 21 nt, Bordetella pertussis
auccgcugcgccgaggccugc

SEQ ID NO: 406142 - RNA, 21 nt, Bordetella pertussis
auccuugcgcucgcccagcac

SEQ ID NO: 406143 - RNA, 16 nt, Bordetella pertussis
aucgaacgcggccaga

SEQ ID NO: 406144 - RNA, 14 nt, Bordetella pertussis
aucgaagccgggcg

SEQ ID NO: 406145 - RNA, 17 nt, Bordetella pertussis
aucgacgcgauguccag

SEQ ID NO: 406146 - RNA, 19 nt, Bordetella pertussis
aucgacgggcggcugccag

SEQ ID NO: 406147 - RNA, 14 nt, Bordetella pertussis
aucgacucggccga

SEQ ID NO: 406148 - RNA, 22 nt, Bordetella pertussis
aucgagggcgucaucggcgcgc

SEQ ID NO: 406149 - RNA, 18 nt, Bordetella pertussis
aucgcaugcgguuucuca

SEQ ID NO: 406150 - RNA, 21 nt, Bordetella pertussis
aucgccaacgucggcagccag

SEQ ID NO: 406151 - RNA, 14 nt, Bordetella pertussis
aucgccagcaggcg

SEQ ID NO: 406152 - RNA, 11 nt, Bordetella pertussis
aucgccaggac

SEQ ID NO: 406153 - RNA, 17 nt, Bordetella pertussis
aucgccaggaccaggau

SEQ ID NO: 406154 - RNA, 14 nt, Bordetella pertussis
aucgccaggcgcgu

SEQ ID NO: 406155 - RNA, 14 nt, Bordetella pertussis
aucgcccggcgcca

SEQ ID NO: 406156 - RNA, 17 nt, Bordetella pertussis
aucgcccgggcgccggc

SEQ ID NO: 406157 - RNA, 18 nt, Bordetella pertussis
aucgccgcaugggcgcgc

SEQ ID NO: 406158 - RNA, 23 nt, Bordetella pertussis
aucgccgcaugggcgcgcccggc

SEQ ID NO: 406159 - RNA, 11 nt, Bordetella pertussis
aucgccgccga

SEQ ID NO: 406160 - RNA, 11 nt, Bordetella pertussis
aucgccgccgc

SEQ ID NO: 406161 - RNA, 19 nt, Bordetella pertussis
aucgcgcgccgccgcccgc

SEQ ID NO: 406162 - RNA, 24 nt, Bordetella pertussis
aucgcgcgccgccgcccgcacgaa

SEQ ID NO: 406163 - RNA, 21 nt, Bordetella pertussis
aucgcgcuucucggugcgccg

SEQ ID NO: 406164 - RNA, 18 nt, Bordetella pertussis
aucgcggcagcccggcac

SEQ ID NO: 406165 - RNA, 18 nt, Bordetella pertussis
aucgcggcgcaggcgggc

SEQ ID NO: 406166 - RNA, 23 nt, Bordetella pertussis
aucgcggcuccagcucagcagcg

SEQ ID NO: 406167 - RNA, 12 nt, Bordetella pertussis
aucggcaggccg

SEQ ID NO: 406168 - RNA, 14 nt, Bordetella pertussis
aucggcaggccggc

SEQ ID NO: 406169 - RNA, 15 nt, Bordetella pertussis
aucggcaggccggcg

SEQ ID NO: 406170 - RNA, 21 nt, Bordetella pertussis
aucggccacgcugcccugcug

SEQ ID NO: 406171 - RNA, 21 nt, Bordetella pertussis
aucggccaggccggccugcag

SEQ ID NO: 406172 - RNA, 19 nt, Bordetella pertussis
aucggcccgggcguggcgu

SEQ ID NO: 406173 - RNA, 16 nt, Bordetella pertussis
aucggccgacugcugu

SEQ ID NO: 406174 - RNA, 16 nt, Bordetella pertussis
aucggcgaaguccugc

SEQ ID NO: 406175 - RNA, 12 nt, Bordetella pertussis
aucggcgcgccc

SEQ ID NO: 406176 - RNA, 21 nt, Bordetella pertussis
aucggcggccugggccauggc

SEQ ID NO: 406177 - RNA, 23 nt, Bordetella pertussis
aucggcucgagcaagggccagac

SEQ ID NO: 406178 - RNA, 20 nt, Bordetella pertussis
aucgggcaacaaggccacga

SEQ ID NO: 406179 - RNA, 14 nt, Bordetella pertussis
aucgggcagcuugg

SEQ ID NO: 406180 - RNA, 20 nt, Bordetella pertussis
aucgggcagggcuuccaguu

SEQ ID NO: 406181 - RNA, 22 nt, Bordetella pertussis
aucgguaaugagcccgaugccg

SEQ ID NO: 406182 - RNA, 15 nt, Bordetella pertussis
aucgucaucaccaag

SEQ ID NO: 406183 - RNA, 13 nt, Bordetella pertussis
aucgucaugaacg

SEQ ID NO: 406184 - RNA, 20 nt, Bordetella pertussis
aucgucaugaacgucacccc

SEQ ID NO: 406185 - RNA, 22 nt, Bordetella pertussis
aucgucauuacccauggcaccg

SEQ ID NO: 406186 - RNA, 22 nt, Bordetella pertussis
aucuaggccguuuccucuggag

SEQ ID NO: 406187 - RNA, 13 nt, Bordetella pertussis
aucuccggcgccu

SEQ ID NO: 406188 - RNA, 14 nt, Bordetella pertussis
aucuccggcgccug

SEQ ID NO: 406189 - RNA, 16 nt, Bordetella pertussis
aucuccggcgccuggc

SEQ ID NO: 406190 - RNA, 16 nt, Bordetella pertussis
aucugcgucgccuggu

SEQ ID NO: 406191 - RNA, 21 nt, Bordetella pertussis
aucuggcaaugguccagcagg

SEQ ID NO: 406192 - RNA, 22 nt, Bordetella pertussis
aucuggcccuuggucugcaggc

SEQ ID NO: 406193 - RNA, 20 nt, Bordetella pertussis
aucuggccggcgcugggcag

SEQ ID NO: 406194 - RNA, 21 nt, Bordetella pertussis
aucuggcgcgucaggccgggc

SEQ ID NO: 406195 - RNA, 18 nt, Bordetella pertussis
aucugggccucggccagc

SEQ ID NO: 406196 - RNA, 20 nt, Bordetella pertussis
augaacagcuugcuguccag

SEQ ID NO: 406197 - RNA, 17 nt, Bordetella pertussis
augaacgaccagcacga

SEQ ID NO: 406198 - RNA, 13 nt, Bordetella pertussis
augaagcgcagca

SEQ ID NO: 406199 - RNA, 15 nt, Bordetella pertussis
augaaggcggccagc

SEQ ID NO: 406200 - RNA, 22 nt, Bordetella pertussis
augaaggcggccagcaugcugg

SEQ ID NO: 406201 - RNA, 23 nt, Bordetella pertussis
augaaggucucguagaccggcac

SEQ ID NO: 406202 - RNA, 23 nt, Bordetella pertussis
augaagucgucgauggcccgcag

SEQ ID NO: 406203 - RNA, 23 nt, Bordetella pertussis
augacaucgccgcugcgcagcag

SEQ ID NO: 406204 - RNA, 17 nt, Bordetella pertussis
augacuugaccgcaugc

SEQ ID NO: 406205 - RNA, 20 nt, Bordetella pertussis
augacuugaccgcaugcugc

SEQ ID NO: 406206 - RNA, 22 nt, Bordetella pertussis
augagcugcgcgugcacgaccu

SEQ ID NO: 406207 - RNA, 14 nt, Bordetella pertussis
augaggccagggag

SEQ ID NO: 406208 - RNA, 23 nt, Bordetella pertussis
augaucaugaugaugauguucau

SEQ ID NO: 406209 - RNA, 12 nt, Bordetella pertussis
augauccacagu

SEQ ID NO: 406210 - RNA, 12 nt, Bordetella pertussis
augauccugcug

SEQ ID NO: 406211 - RNA, 14 nt, Bordetella pertussis
augcaccugcaggg

SEQ ID NO: 406212 - RNA, 22 nt, Bordetella pertussis
augcacgaccaggccguggccc

SEQ ID NO: 406213 - RNA, 17 nt, Bordetella pertussis
augcacguagcgcagca

SEQ ID NO: 406214 - RNA, 18 nt, Bordetella pertussis
augcagcuggauggccug

SEQ ID NO: 406215 - RNA, 20 nt, Bordetella pertussis
augcaggcuuugcuggccau

SEQ ID NO: 406216 - RNA, 17 nt, Bordetella pertussis
augcaguacaggcgcgu

SEQ ID NO: 406217 - RNA, 16 nt, Bordetella pertussis
augcaguagcgcucga

SEQ ID NO: 406218 - RNA, 16 nt, Bordetella pertussis
augcauucggcggccg

SEQ ID NO: 406219 - RNA, 23 nt, Bordetella pertussis
augcccagcgccagggccgccgc

SEQ ID NO: 406220 - RNA, 19 nt, Bordetella pertussis
augcccauggggugcuccu

SEQ ID NO: 406221 - RNA, 13 nt, Bordetella pertussis
augccccgcccgc

SEQ ID NO: 406222 - RNA, 15 nt, Bordetella pertussis
augccccuccggguc

SEQ ID NO: 406223 - RNA, 17 nt, Bordetella pertussis
augcccuccucggccag

SEQ ID NO: 406224 - RNA, 19 nt, Bordetella pertussis
augcccuccucggccaggu

SEQ ID NO: 406225 - RNA, 21 nt, Bordetella pertussis
augcccuccucggccaggucg

SEQ ID NO: 406226 - RNA, 16 nt, Bordetella pertussis
augcccugcgccagcg

SEQ ID NO: 406227 - RNA, 20 nt, Bordetella pertussis
augccgcuggcgauggccug

SEQ ID NO: 406228 - RNA, 15 nt, Bordetella pertussis
augccggaacaggcg

SEQ ID NO: 406229 - RNA, 23 nt, Bordetella pertussis
augccggcauaggcggcgcaggc

SEQ ID NO: 406230 - RNA, 13 nt, Bordetella pertussis
augccggccagca

SEQ ID NO: 406231 - RNA, 16 nt, Bordetella pertussis
augccggccagcagcg

SEQ ID NO: 406232 - RNA, 18 nt, Bordetella pertussis
augccggccaugcucagc

SEQ ID NO: 406233 - RNA, 18 nt, Bordetella pertussis
augccggcgcugcgcagc

SEQ ID NO: 406234 - RNA, 15 nt, Bordetella pertussis
augccgguucgggcg

SEQ ID NO: 406235 - RNA, 14 nt, Bordetella pertussis
augccgucgaaggc

SEQ ID NO: 406236 - RNA, 20 nt, Bordetella pertussis
augccgucgccgcccacggc

SEQ ID NO: 406237 - RNA, 16 nt, Bordetella pertussis
augccgucgcgcucgg

SEQ ID NO: 406238 - RNA, 13 nt, Bordetella pertussis
augccgucggccu

SEQ ID NO: 406239 - RNA, 21 nt, Bordetella pertussis
augccgucuggcggcagcucg

SEQ ID NO: 406240 - RNA, 19 nt, Bordetella pertussis
augccguccacgcccagcg

SEQ ID NO: 406241 - RNA, 18 nt, Bordetella pertussis
augccguuggccgcgaag

SEQ ID NO: 406242 - RNA, 13 nt, Bordetella pertussis
augcgaucggccu

SEQ ID NO: 406243 - RNA, 17 nt, Bordetella pertussis
augcgcaccggccaggg

SEQ ID NO: 406244 - RNA, 18 nt, Bordetella pertussis
augcgcaccggccagggg

SEQ ID NO: 406245 - RNA, 13 nt, Bordetella pertussis
augcgcagcagca

SEQ ID NO: 406246 - RNA, 18 nt, Bordetella pertussis
augcgcaggacggcgccg

SEQ ID NO: 406247 - RNA, 12 nt, Bordetella pertussis
augcgcuugccg

SEQ ID NO: 406248 - RNA, 20 nt, Bordetella pertussis
augcgcuuggaccccguggu

SEQ ID NO: 406249 - RNA, 20 nt, Bordetella pertussis
augcggcagcagggccacgc

SEQ ID NO: 406250 - RNA, 13 nt, Bordetella pertussis
augcggccaggcc

SEQ ID NO: 406251 - RNA, 16 nt, Bordetella pertussis
augcggcgcaugcugc

SEQ ID NO: 406252 - RNA, 15 nt, Bordetella pertussis
augcggcgccacgca

SEQ ID NO: 406253 - RNA, 21 nt, Bordetella pertussis
augcggcgcccaggcccagcg

SEQ ID NO: 406254 - RNA, 21 nt, Bordetella pertussis
augcggcgccggugcgcggcg

SEQ ID NO: 406255 - RNA, 13 nt, Bordetella pertussis
augcgggacaggc

SEQ ID NO: 406256 - RNA, 14 nt, Bordetella pertussis
augcgggacaggcg

SEQ ID NO: 406257 - RNA, 16 nt, Bordetella pertussis
augcgggacaggcgcc

SEQ ID NO: 406258 - RNA, 18 nt, Bordetella pertussis
augcgggcaucgcccugc

SEQ ID NO: 406259 - RNA, 13 nt, Bordetella pertussis
augcgggccacgc

SEQ ID NO: 406260 - RNA, 12 nt, Bordetella pertussis
augcggggacag

SEQ ID NO: 406261 - RNA, 19 nt, Bordetella pertussis
augcgggucaggccgccgu

SEQ ID NO: 406262 - RNA, 13 nt, Bordetella pertussis
augcggguuggca

SEQ ID NO: 406263 - RNA, 22 nt, Bordetella pertussis
augcggucggccgcgccgccgc

SEQ ID NO: 406264 - RNA, 20 nt, Bordetella pertussis
augcgucgaacggccgggcg

SEQ ID NO: 406265 - RNA, 17 nt, Bordetella pertussis
augcgugaagcccaugg

SEQ ID NO: 406266 - RNA, 19 nt, Bordetella pertussis
augcguggcgugccgcagc

SEQ ID NO: 406267 - RNA, 23 nt, Bordetella pertussis
augcguucgcccgugccgcagaa

SEQ ID NO: 406268 - RNA, 14 nt, Bordetella pertussis
augcguucggccag

SEQ ID NO: 406269 - RNA, 20 nt, Bordetella pertussis
augcugaauugcgggccggc

SEQ ID NO: 406270 - RNA, 15 nt, Bordetella pertussis
augcuggcgcggacc

SEQ ID NO: 406271 - RNA, 21 nt, Bordetella pertussis
augcuggcgcggaccugcucg

SEQ ID NO: 406272 - RNA, 17 nt, Bordetella pertussis
augcugggcgggcuggu

SEQ ID NO: 406273 - RNA, 13 nt, Bordetella pertussis
augcuggugugaa

SEQ ID NO: 406274 - RNA, 15 nt, Bordetella pertussis
auggcaugcaccgcg

SEQ ID NO: 406275 - RNA, 14 nt, Bordetella pertussis
auggcauggggcag

SEQ ID NO: 406276 - RNA, 17 nt, Bordetella pertussis
auggcauggggcaggcg

SEQ ID NO: 406277 - RNA, 15 nt, Bordetella pertussis
auggcaugaaaaagg

SEQ ID NO: 406278 - RNA, 13 nt, Bordetella pertussis
auggccagcagcg

SEQ ID NO: 406279 - RNA, 20 nt, Bordetella pertussis
auggccagggaggaacuggg

SEQ ID NO: 406280 - RNA, 22 nt, Bordetella pertussis
auggccagguacaggccgccgg

SEQ ID NO: 406281 - RNA, 16 nt, Bordetella pertussis
auggccaucgcggucc

SEQ ID NO: 406282 - RNA, 12 nt, Bordetella pertussis
auggccugcagg

SEQ ID NO: 406283 - RNA, 13 nt, Bordetella pertussis
auggccuggaugu

SEQ ID NO: 406284 - RNA, 16 nt, Bordetella pertussis
auggccuggcccagcu

SEQ ID NO: 406285 - RNA, 21 nt, Bordetella pertussis
auggccuuggaguagccgcuc

SEQ ID NO: 406286 - RNA, 15 nt, Bordetella pertussis
auggcgcaggcgcgc

SEQ ID NO: 406287 - RNA, 22 nt, Bordetella pertussis
auggcgcaugacgaggugccug

SEQ ID NO: 406288 - RNA, 20 nt, Bordetella pertussis
auggcgccgcgccgccgccu

SEQ ID NO: 406289 - RNA, 13 nt, Bordetella pertussis
auggcgcgcagca

SEQ ID NO: 406290 - RNA, 17 nt, Bordetella pertussis
auggcgcgcagcacaua

SEQ ID NO: 406291 - RNA, 15 nt, Bordetella pertussis
auggcgcgcggcugg

SEQ ID NO: 406292 - RNA, 19 nt, Bordetella pertussis
auggcgcgcggcuggggcu

SEQ ID NO: 406293 - RNA, 13 nt, Bordetella pertussis
auggcgcggauga

SEQ ID NO: 406294 - RNA, 18 nt, Bordetella pertussis
auggcgcgcgcacgcugg

SEQ ID NO: 406295 - RNA, 13 nt, Bordetella pertussis
auggcgcgcgcca

SEQ ID NO: 406296 - RNA, 17 nt, Bordetella pertussis
auggcggcaucuugccu

SEQ ID NO: 406297 - RNA, 13 nt, Bordetella pertussis
auggcggccaggg

SEQ ID NO: 406298 - RNA, 14 nt, Bordetella pertussis
auggcggccagggc

SEQ ID NO: 406299 - RNA, 14 nt, Bordetella pertussis
auggcggccgccgc

SEQ ID NO: 406300 - RNA, 13 nt, Bordetella pertussis
auggcggcgcugg

SEQ ID NO: 406301 - RNA, 14 nt, Bordetella pertussis
auggcggcggccac

SEQ ID NO: 406302 - RNA, 15 nt, Bordetella pertussis
auggcggggugccug

SEQ ID NO: 406303 - RNA, 15 nt, Bordetella pertussis
auggcgguggccagc

SEQ ID NO: 406304 - RNA, 15 nt, Bordetella pertussis
auggcguacagcagg

SEQ ID NO: 406305 - RNA, 23 nt, Bordetella pertussis
auggcguaggcggccuugagcau

SEQ ID NO: 406306 - RNA, 15 nt, Bordetella pertussis
auggcguccagcagc

SEQ ID NO: 406307 - RNA, 16 nt, Bordetella pertussis
auggcguccagcagca

SEQ ID NO: 406308 - RNA, 23 nt, Bordetella pertussis
auggcuuucuugucgaacaggcg

SEQ ID NO: 406309 - RNA, 21 nt, Bordetella pertussis
augggagaguucauccacagc

SEQ ID NO: 406310 - RNA, 15 nt, Bordetella pertussis
augggcaccugcuug

SEQ ID NO: 406311 - RNA, 11 nt, Bordetella pertussis
augggccaggc

SEQ ID NO: 406312 - RNA, 14 nt, Bordetella pertussis
augggccgcagcga

SEQ ID NO: 406313 - RNA, 17 nt, Bordetella pertussis
augggccccaagagggc

SEQ ID NO: 406314 - RNA, 21 nt, Bordetella pertussis
augggcccgggcaggcucagc

SEQ ID NO: 406315 - RNA, 20 nt, Bordetella pertussis
auggggugcuccugccaggc

SEQ ID NO: 406316 - RNA, 16 nt, Bordetella pertussis
auggguacagcgcgcc

SEQ ID NO: 406317 - RNA, 17 nt, Bordetella pertussis
auggucgaccagcagcc

SEQ ID NO: 406318 - RNA, 19 nt, Bordetella pertussis
auggucgaccagcagccgg

SEQ ID NO: 406319 - RNA, 14 nt, Bordetella pertussis
auggucgcccagca

SEQ ID NO: 406320 - RNA, 16 nt, Bordetella pertussis
auguacucggccaggc

SEQ ID NO: 406321 - RNA, 17 nt, Bordetella pertussis
auguacucggccaggcc

SEQ ID NO: 406322 - RNA, 17 nt, Bordetella pertussis
auguagaacgccagggu

SEQ ID NO: 406323 - RNA, 19 nt, Bordetella pertussis
auguagaacgccagggucu

SEQ ID NO: 406324 - RNA, 13 nt, Bordetella pertussis
aaaagcaacaacc

SEQ ID NO: 406325 - RNA, 21 nt, Bordetella pertussis
auguaugacuugaccgcaugc

SEQ ID NO: 406326 - RNA, 19 nt, Bordetella pertussis
auguccaccauccugcccc

SEQ ID NO: 406327 - RNA, 13 nt, Bordetella pertussis
auguccagcucca

SEQ ID NO: 406328 - RNA, 14 nt, Bordetella pertussis
augucccacaggcg

SEQ ID NO: 406329 - RNA, 21 nt, Bordetella pertussis
auguccgccacgccggccacg

SEQ ID NO: 406330 - RNA, 13 nt, Bordetella pertussis
auguccugcaggu

SEQ ID NO: 406331 - RNA, 18 nt, Bordetella pertussis
auguucagcuucagccug

SEQ ID NO: 406332 - RNA, 23 nt, Bordetella pertussis
auguucagcuucagccugggccu

SEQ ID NO: 406333 - RNA, 13 nt, Bordetella pertussis
auguugccgccgg

SEQ ID NO: 406334 - RNA, 21 nt, Bordetella pertussis
auguuguuggucgccacgcca

SEQ ID NO: 406335 - RNA, 18 nt, Bordetella pertussis
auuaaugaaacugcaaaa

SEQ ID NO: 406336 - RNA, 12 nt, Bordetella pertussis
auuaccagcaac

SEQ ID NO: 406337 - RNA, 20 nt, Bordetella pertussis
auucacagccauugcccaca

SEQ ID NO: 406338 - RNA, 15 nt, Bordetella pertussis
auucccaggcccggc

SEQ ID NO: 406339 - RNA, 15 nt, Bordetella pertussis
auuccgccuacuggc

SEQ ID NO: 406340 - RNA, 18 nt, Bordetella pertussis
auuccugaacgccgggcc

SEQ ID NO: 406341 - RNA, 17 nt, Bordetella pertussis
auuccugggugcugccg

SEQ ID NO: 406342 - RNA, 22 nt, Bordetella pertussis
auuccugucgcgcugcuuuccc

SEQ ID NO: 406343 - RNA, 18 nt, Bordetella pertussis
auucguuggugcccagcg

SEQ ID NO: 406344 - RNA, 13 nt, Bordetella pertussis
auugaccagcacc

SEQ ID NO: 406345 - RNA, 15 nt, Bordetella pertussis
auugcgcggccaggg

SEQ ID NO: 406346 - RNA, 23 nt, Bordetella pertussis
auugcgcggccagggcugcggcg

SEQ ID NO: 406347 - RNA, 17 nt, Bordetella pertussis
auugcgcguauccagca

SEQ ID NO: 406348 - RNA, 11 nt, Bordetella pertussis
auugcuugccg

SEQ ID NO: 406349 - RNA, 19 nt, Bordetella pertussis
auuggaguaguggcccaag

SEQ ID NO: 406350 - RNA, 12 nt, Bordetella pertussis
auuggccgccgc

SEQ ID NO: 406351 - RNA, 13 nt, Bordetella pertussis
auuggggccgccu

SEQ ID NO: 406352 - RNA, 21 nt, Bordetella pertussis
auuggggccgccuggaccuga

SEQ ID NO: 406353 - RNA, 13 nt, Bordetella pertussis
auuucgccgccgc

SEQ ID NO: 406354 - RNA, 15 nt, Bordetella pertussis
auuuggcggccuggc

SEQ ID NO: 406355 - RNA, 14 nt, Bordetella pertussis
auuuggcguagauc

SEQ ID NO: 406356 - RNA, 20 nt, Bordetella pertussis
auuuuccggacucgcggucu

SEQ ID NO: 406357 - RNA, 19 nt, Bordetella pertussis
auuuucugccacagcguga

SEQ ID NO: 406358 - RNA, 16 nt, Bordetella pertussis
caaaaccgggcccgga

SEQ ID NO: 406359 - RNA, 19 nt, Bordetella pertussis
caacaagccgggcgccggc

SEQ ID NO: 406360 - RNA, 14 nt, Bordetella pertussis
caaccaacaugccg

SEQ ID NO: 406361 - RNA, 14 nt, Bordetella pertussis
caaccacgagcugc

SEQ ID NO: 406362 - RNA, 13 nt, Bordetella pertussis
caacccagcagcg

SEQ ID NO: 406363 - RNA, 18 nt, Bordetella pertussis
caaccccgagggcgcggc

SEQ ID NO: 406364 - RNA, 20 nt, Bordetella pertussis
caaccccgagggcgcggcgc

SEQ ID NO: 406365 - RNA, 18 nt, Bordetella pertussis
caacccgccauccuggcc

SEQ ID NO: 406366 - RNA, 20 nt, Bordetella pertussis
caacccgcccggggccaugg

SEQ ID NO: 406367 - RNA, 17 nt, Bordetella pertussis
caacccggccucagcgg

SEQ ID NO: 406368 - RNA, 22 nt, Bordetella pertussis
caacccggccucagcggccgcu

SEQ ID NO: 406369 - RNA, 21 nt, Bordetella pertussis
caacgacgcaggcgccgcacc

SEQ ID NO: 406370 - RNA, 21 nt, Bordetella pertussis
caacgcaggcgccgccccguc

SEQ ID NO: 406371 - RNA, 13 nt, Bordetella pertussis
caacgccagcagg

SEQ ID NO: 406372 - RNA, 21 nt, Bordetella pertussis
caacgccgccaccagggcgcc

SEQ ID NO: 406373 - RNA, 17 nt, Bordetella pertussis
caacgccgccggcaggg

SEQ ID NO: 406374 - RNA, 16 nt, Bordetella pertussis
caacgccggccgccau

SEQ ID NO: 406375 - RNA, 13 nt, Bordetella pertussis
caacgccggcggc

SEQ ID NO: 406376 - RNA, 22 nt, Bordetella pertussis
caacgccgggccgcgccgccua

SEQ ID NO: 406377 - RNA, 23 nt, Bordetella pertussis
caacugguagugcggcgccagcu

SEQ ID NO: 406378 - RNA, 14 nt, Bordetella pertussis
caacuggugcacga

SEQ ID NO: 406379 - RNA, 19 nt, Bordetella pertussis
caacuggugcacgaugccc

SEQ ID NO: 406380 - RNA, 20 nt, Bordetella pertussis
caagacggcgcucggccucg

SEQ ID NO: 406381 - RNA, 18 nt, Bordetella pertussis
caagacgcggcagggcca

SEQ ID NO: 406382 - RNA, 22 nt, Bordetella pertussis
caagacgcggggacaggcacac

SEQ ID NO: 406383 - RNA, 14 nt, Bordetella pertussis
caagcaagccccag

SEQ ID NO: 406384 - RNA, 18 nt, Bordetella pertussis
caagcagacccgcgccca

SEQ ID NO: 406385 - RNA, 18 nt, Bordetella pertussis
caagcagaccuaccaggc

SEQ ID NO: 406386 - RNA, 20 nt, Bordetella pertussis
caagcagaccuaccaggccg

SEQ ID NO: 406387 - RNA, 17 nt, Bordetella pertussis
caagcagcgccggcugg

SEQ ID NO: 406388 - RNA, 15 nt, Bordetella pertussis
caagcagcgccugcc

SEQ ID NO: 406389 - RNA, 23 nt, Bordetella pertussis
caagcagcgccugccgcgugccc

SEQ ID NO: 406390 - RNA, 22 nt, Bordetella pertussis
caagccagcacguaaucgaagc

SEQ ID NO: 406391 - RNA, 23 nt, Bordetella pertussis
caagccccuccgauuuguccugu

SEQ ID NO: 406392 - RNA, 13 nt, Bordetella pertussis
caagcgcuggaug

SEQ ID NO: 406393 - RNA, 15 nt, Bordetella pertussis
caagcggccccaggu

SEQ ID NO: 406394 - RNA, 20 nt, Bordetella pertussis
caagcggccccagguagacc

SEQ ID NO: 406395 - RNA, 17 nt, Bordetella pertussis
caagcggcccgcgcccu

SEQ ID NO: 406396 - RNA, 14 nt, Bordetella pertussis
caagcggccggccu

SEQ ID NO: 406397 - RNA, 21 nt, Bordetella pertussis
caagcguacguaccaggccgu

SEQ ID NO: 406398 - RNA, 17 nt, Bordetella pertussis
caaggaaagcccggccc

SEQ ID NO: 406399 - RNA, 19 nt, Bordetella pertussis
caaggccaugaucaggccg

SEQ ID NO: 406400 - RNA, 13 nt, Bordetella pertussis
caaggccgacugg

SEQ ID NO: 406401 - RNA, 17 nt, Bordetella pertussis
caaggccgacuggauga

SEQ ID NO: 406402 - RNA, 21 nt, Bordetella pertussis
caaggccgacuggaugaagcg

SEQ ID NO: 406403 - RNA, 23 nt, Bordetella pertussis
caaggccggcgcgucgcgcggcg

SEQ ID NO: 406404 - RNA, 14 nt, Bordetella pertussis
caaggccggcggca

SEQ ID NO: 406405 - RNA, 14 nt, Bordetella pertussis
caaggccugcugca

SEQ ID NO: 406406 - RNA, 15 nt, Bordetella pertussis
caaggcgcgccaccg

SEQ ID NO: 406407 - RNA, 12 nt, Bordetella pertussis
caaggcgcggca

SEQ ID NO: 406408 - RNA, 12 nt, Bordetella pertussis
caaggcgcggcc

SEQ ID NO: 406409 - RNA, 15 nt, Bordetella pertussis
caaggcggcaaaccc

SEQ ID NO: 406410 - RNA, 19 nt, Bordetella pertussis
caaggcggcaaacccggcg

SEQ ID NO: 406411 - RNA, 20 nt, Bordetella pertussis
caaggcggcccggccgccgc

SEQ ID NO: 406412 - RNA, 17 nt, Bordetella pertussis
caaggcgguggccagcg

SEQ ID NO: 406413 - RNA, 12 nt, Bordetella pertussis
caagggcgcgcc

SEQ ID NO: 406414 - RNA, 13 nt, Bordetella pertussis
caagggcgcgcca

SEQ ID NO: 406415 - RNA, 12 nt, Bordetella pertussis
caagggcggcca

SEQ ID NO: 406416 - RNA, 20 nt, Bordetella pertussis
caaggggccagccuggcgcc

SEQ ID NO: 406417 - RNA, 21 nt, Bordetella pertussis
caaggggccagccuggcgcca

SEQ ID NO: 406418 - RNA, 15 nt, Bordetella pertussis
caagggggacuggca

SEQ ID NO: 406419 - RNA, 18 nt, Bordetella pertussis
caagggugccuguccccg

SEQ ID NO: 406420 - RNA, 23 nt, Bordetella pertussis
caaggguuuugggucauggaaaa

SEQ ID NO: 406421 - RNA, 12 nt, Bordetella pertussis
caagguccaggc

SEQ ID NO: 406422 - RNA, 17 nt, Bordetella pertussis
caagguccaggcgcgca

SEQ ID NO: 406423 - RNA, 23 nt, Bordetella pertussis
caagguggcggugguggccaacg

SEQ ID NO: 406424 - RNA, 21 nt, Bordetella pertussis
caagguggcgugcagcaggua

SEQ ID NO: 406425 - RNA, 21 nt, Bordetella pertussis
caaguaaacaugcgggucucg

SEQ ID NO: 406426 - RNA, 13 nt, Bordetella pertussis
caauagaucaucc

SEQ ID NO: 406427 - RNA, 19 nt, Bordetella pertussis
caauagcccgugcgggccu

SEQ ID NO: 406428 - RNA, 15 nt, Bordetella pertussis
caaucaugcgcugcu

SEQ ID NO: 406429 - RNA, 16 nt, Bordetella pertussis
caauccgcccguugcg

SEQ ID NO: 406430 - RNA, 21 nt, Bordetella pertussis
caauccgcccguugcggcgcc

SEQ ID NO: 406431 - RNA, 23 nt, Bordetella pertussis
caaucuugccaggcccggcgcgc

SEQ ID NO: 406432 - RNA, 12 nt, Bordetella pertussis
caaugcgcggcg

SEQ ID NO: 406433 - RNA, 20 nt, Bordetella pertussis
caaugcgcggcgcucagagc

SEQ ID NO: 406434 - RNA, 13 nt, Bordetella pertussis
cacaccagcgcca

SEQ ID NO: 406435 - RNA, 21 nt, Bordetella pertussis
cacaccagguugucggcgcca

SEQ ID NO: 406436 - RNA, 15 nt, Bordetella pertussis
cacaccgcugcggga

SEQ ID NO: 406437 - RNA, 13 nt, Bordetella pertussis
cacacuggccagc

SEQ ID NO: 406438 - RNA, 22 nt, Bordetella pertussis
cacagcccgaucgacggccgca

SEQ ID NO: 406439 - RNA, 18 nt, Bordetella pertussis
cacagcgcgcaacuccag

SEQ ID NO: 406440 - RNA, 19 nt, Bordetella pertussis
cacagcgcgcaacuccagc

SEQ ID NO: 406441 - RNA, 19 nt, Bordetella pertussis
cacaggaacagccugcccu

SEQ ID NO: 406442 - RNA, 14 nt, Bordetella pertussis
cacaggaacaggcc

SEQ ID NO: 406443 - RNA, 18 nt, Bordetella pertussis
cacaggccaucggcgcca

SEQ ID NO: 406444 - RNA, 21 nt, Bordetella pertussis
cacaggccuucguugaccgcu

SEQ ID NO: 406445 - RNA, 16 nt, Bordetella pertussis
cacagggggacuggca

SEQ ID NO: 406446 - RNA, 20 nt, Bordetella pertussis
cacagggucaaggcgcggcc

SEQ ID NO: 406447 - RNA, 16 nt, Bordetella pertussis
cacaggguggcgccca

SEQ ID NO: 406448 - RNA, 22 nt, Bordetella pertussis
cacaggguggcgcccagguaca

SEQ ID NO: 406449 - RNA, 17 nt, Bordetella pertussis
cacaggugcgcggcgcg

SEQ ID NO: 406450 - RNA, 22 nt, Bordetella pertussis
cacaggugcgcggcgcgccguc

SEQ ID NO: 406451 - RNA, 17 nt, Bordetella pertussis
cacaguacuuguugcgu

SEQ ID NO: 406452 - RNA, 23 nt, Bordetella pertussis
cacagugucuaucauggccuugg

SEQ ID NO: 406453 - RNA, 18 nt, Bordetella pertussis
cacaugaugcccagcgcc

SEQ ID NO: 406454 - RNA, 17 nt, Bordetella pertussis
cacaugcccggccacca

SEQ ID NO: 406455 - RNA, 22 nt, Bordetella pertussis
cacaugccgugccagauaccca

SEQ ID NO: 406456 - RNA, 17 nt, Bordetella pertussis
cacauggucgcccagca

SEQ ID NO: 406457 - RNA, 11 nt, Bordetella pertussis
caccaccaucu

SEQ ID NO: 406458 - RNA, 22 nt, Bordetella pertussis
caccaccaugugcuugccgcag

SEQ ID NO: 406459 - RNA, 12 nt, Bordetella pertussis
caccaccgaggg

SEQ ID NO: 406460 - RNA, 13 nt, Bordetella pertussis
caccaccgcccgc

SEQ ID NO: 406461 - RNA, 16 nt, Bordetella pertussis
caccaccggcacgccg

SEQ ID NO: 406462 - RNA, 14 nt, Bordetella pertussis
caccaccuccaccg

SEQ ID NO: 406463 - RNA, 13 nt, Bordetella pertussis
caccaccucggcc

SEQ ID NO: 406464 - RNA, 12 nt, Bordetella pertussis
caccaccuggcu

SEQ ID NO: 406465 - RNA, 23 nt, Bordetella pertussis
caccacggcgcggaugccgucca

SEQ ID NO: 406466 - RNA, 13 nt, Bordetella pertussis
caccacggcggcc

SEQ ID NO: 406467 - RNA, 14 nt, Bordetella pertussis
caccacggcggcca

SEQ ID NO: 406468 - RNA, 19 nt, Bordetella pertussis
caccacggcggccaggccg

SEQ ID NO: 406469 - RNA, 20 nt, Bordetella pertussis
caccacggcgggaucgggca

SEQ ID NO: 406470 - RNA, 23 nt, Bordetella pertussis
caccacgggcacgauggccgcgc

SEQ ID NO: 406471 - RNA, 15 nt, Bordetella pertussis
caccagccggccgcc

SEQ ID NO: 406472 - RNA, 16 nt, Bordetella pertussis
caccagccgggcggcc

SEQ ID NO: 406473 - RNA, 17 nt, Bordetella pertussis
caccagccgggcggcca

SEQ ID NO: 406474 - RNA, 15 nt, Bordetella pertussis
caccagcgaggcggc

SEQ ID NO: 406475 - RNA, 14 nt, Bordetella pertussis
caccagcucgcggc

SEQ ID NO: 406476 - RNA, 17 nt, Bordetella pertussis
caccagcuugcgcgccg

SEQ ID NO: 406477 - RNA, 15 nt, Bordetella pertussis
caccagcuuggccug

SEQ ID NO: 406478 - RNA, 13 nt, Bordetella pertussis
caccaggaacgcc

SEQ ID NO: 406479 - RNA, 21 nt, Bordetella pertussis
caccaggaacgccagcagcac

SEQ ID NO: 406480 - RNA, 17 nt, Bordetella pertussis
caccaggauccccagca

SEQ ID NO: 406481 - RNA, 17 nt, Bordetella pertussis
caccaggaagcgcgccu

SEQ ID NO: 406482 - RNA, 14 nt, Bordetella pertussis
caccaggcccaggg

SEQ ID NO: 406483 - RNA, 21 nt, Bordetella pertussis
caccaggcccaugaaggcggc

SEQ ID NO: 406484 - RNA, 14 nt, Bordetella pertussis
caccaggccggcca

SEQ ID NO: 406485 - RNA, 17 nt, Bordetella pertussis
caccaggccggccaggg

SEQ ID NO: 406486 - RNA, 15 nt, Bordetella pertussis
caccaggccugccug

SEQ ID NO: 406487 - RNA, 18 nt, Bordetella pertussis
caccaggccugccugaug

SEQ ID NO: 406488 - RNA, 15 nt, Bordetella pertussis
caccaggcgcggcgu

SEQ ID NO: 406489 - RNA, 23 nt, Bordetella pertussis
caccaggcgcucgcgcgccagca

SEQ ID NO: 406490 - RNA, 20 nt, Bordetella pertussis
caccagggcgcgcagcaggc

SEQ ID NO: 406491 - RNA, 20 nt, Bordetella pertussis
caccaggguggcgccggcca

SEQ ID NO: 406492 - RNA, 19 nt, Bordetella pertussis
caccaggguggcgggcgcc

SEQ ID NO: 406493 - RNA, 21 nt, Bordetella pertussis
caccagguagggcagcagguc

SEQ ID NO: 406494 - RNA, 21 nt, Bordetella pertussis
caccagguccuggcggccgcc

SEQ ID NO: 406495 - RNA, 20 nt, Bordetella pertussis
caccaggucguacagcgccu

SEQ ID NO: 406496 - RNA, 22 nt, Bordetella pertussis
caccaggucguacagcgccugc

SEQ ID NO: 406497 - RNA, 20 nt, Bordetella pertussis
caccaggucgcggugcgcca

SEQ ID NO: 406498 - RNA, 21 nt, Bordetella pertussis
caccaguuucucggccacuuc

SEQ ID NO: 406499 - RNA, 12 nt, Bordetella pertussis
caccaguuuucu

SEQ ID NO: 406500 - RNA, 23 nt, Bordetella pertussis
caccaucaaggccaugaucaggc

SEQ ID NO: 406501 - RNA, 19 nt, Bordetella pertussis
caccaucagcuggaucugg

SEQ ID NO: 406502 - RNA, 19 nt, Bordetella pertussis
caccaucguugccugggug

SEQ ID NO: 406503 - RNA, 17 nt, Bordetella pertussis
caccaugagcacgcccc

SEQ ID NO: 406504 - RNA, 19 nt, Bordetella pertussis
caccaugccuugcgcgaca

SEQ ID NO: 406505 - RNA, 17 nt, Bordetella pertussis
caccauggcgcccacgg

SEQ ID NO: 406506 - RNA, 17 nt, Bordetella pertussis
cacccacagcagcgcgc

SEQ ID NO: 406507 - RNA, 20 nt, Bordetella pertussis
caccccggugucgccguggc

SEQ ID NO: 406508 - RNA, 20 nt, Bordetella pertussis
caccccgucaucgccgcggc

SEQ ID NO: 406509 - RNA, 21 nt, Bordetella pertussis
caccccgucguccguccuggc

SEQ ID NO: 406510 - RNA, 17 nt, Bordetella pertussis
caccccguugcagccca

SEQ ID NO: 406511 - RNA, 20 nt, Bordetella pertussis
caccccguugcagcccagcg

SEQ ID NO: 406512 - RNA, 22 nt, Bordetella pertussis
cacccgauacgacacgccgcgc

SEQ ID NO: 406513 - RNA, 20 nt, Bordetella pertussis
cacccgauggucacacuguc

SEQ ID NO: 406514 - RNA, 23 nt, Bordetella pertussis
cacccgcaaaccugaugccuguc

SEQ ID NO: 406515 - RNA, 16 nt, Bordetella pertussis
cacccgcacgccggcc

SEQ ID NO: 406516 - RNA, 13 nt, Bordetella pertussis
cacccgcacgggc

SEQ ID NO: 406517 - RNA, 20 nt, Bordetella pertussis
cacccuccuacgccaugaca

SEQ ID NO: 406518 - RNA, 19 nt, Bordetella pertussis
caccgaacgggcguggcgc

SEQ ID NO: 406519 - RNA, 16 nt, Bordetella pertussis
caccgacaagccgguc

SEQ ID NO: 406520 - RNA, 12 nt, Bordetella pertussis
caccgcaaggaa

SEQ ID NO: 406521 - RNA, 14 nt, Bordetella pertussis
caccgccacccgua

SEQ ID NO: 406522 - RNA, 23 nt, Bordetella pertussis
caccgccaggaagaucggcccgg

SEQ ID NO: 406523 - RNA, 18 nt, Bordetella pertussis
caccgccauggcggccgc

SEQ ID NO: 406524 - RNA, 21 nt, Bordetella pertussis
caccgccauggcggccgccgc

SEQ ID NO: 406525 - RNA, 21 nt, Bordetella pertussis
caccgccaugugcgccgcgcc

SEQ ID NO: 406526 - RNA, 12 nt, Bordetella pertussis
caccgcccaggc

SEQ ID NO: 406527 - RNA, 17 nt, Bordetella pertussis
caccgcccccgccgcca

SEQ ID NO: 406528 - RNA, 14 nt, Bordetella pertussis
caccgcccgcaugu

SEQ ID NO: 406529 - RNA, 19 nt, Bordetella pertussis
caccgccgaugccgccauc

SEQ ID NO: 406530 - RNA, 14 nt, Bordetella pertussis
caccgccgccgcca

SEQ ID NO: 406531 - RNA, 22 nt, Bordetella pertussis
caccgccgccgccaccagcggc

SEQ ID NO: 406532 - RNA, 16 nt, Bordetella pertussis
caccgccgccggcccg

SEQ ID NO: 406533 - RNA, 17 nt, Bordetella pertussis
caccgccgccggcccgg

SEQ ID NO: 406534 - RNA, 15 nt, Bordetella pertussis
caccgccgcgccgcc

SEQ ID NO: 406535 - RNA, 21 nt, Bordetella pertussis
caccgccgcgccgcccgcggc

SEQ ID NO: 406536 - RNA, 15 nt, Bordetella pertussis
caccgccgcgccgcu

SEQ ID NO: 406537 - RNA, 23 nt, Bordetella pertussis
caccgccgcguccucggccuggc

SEQ ID NO: 406538 - RNA, 17 nt, Bordetella pertussis
caccgccguggccggca

SEQ ID NO: 406539 - RNA, 15 nt, Bordetella pertussis
caccgcgccgcccac

SEQ ID NO: 406540 - RNA, 20 nt, Bordetella pertussis
caccgcgccgcccacgccgc

SEQ ID NO: 406541 - RNA, 22 nt, Bordetella pertussis
caccgcgccgcccacgccgcug

SEQ ID NO: 406542 - RNA, 16 nt, Bordetella pertussis
caccggaggcgccgcg

SEQ ID NO: 406543 - RNA, 16 nt, Bordetella pertussis
caccggcaagccuugc

SEQ ID NO: 406544 - RNA, 15 nt, Bordetella pertussis
caccggcacgccggc

SEQ ID NO: 406545 - RNA, 13 nt, Bordetella pertussis
caccggcacgcgc

SEQ ID NO: 406546 - RNA, 16 nt, Bordetella pertussis
caccggccagucgcgg

SEQ ID NO: 406547 - RNA, 13 nt, Bordetella pertussis
caccggccgaccc

SEQ ID NO: 406548 - RNA, 16 nt, Bordetella pertussis
caccggcgcgccuggc

SEQ ID NO: 406549 - RNA, 20 nt, Bordetella pertussis
caccgguugcagcgcgccag

SEQ ID NO: 406550 - RNA, 19 nt, Bordetella pertussis
caccgugaugcgcgccgcu

SEQ ID NO: 406551 - RNA, 14 nt, Bordetella pertussis
caccgugaugggcg

SEQ ID NO: 406552 - RNA, 19 nt, Bordetella pertussis
caccguguugucuuuuuuc

SEQ ID NO: 406553 - RNA, 19 nt, Bordetella pertussis
caccucgaucaccaccggc

SEQ ID NO: 406554 - RNA, 14 nt, Bordetella pertussis
caccucgcuugccc

SEQ ID NO: 406555 - RNA, 15 nt, Bordetella pertussis
caccucggcgccgcg

SEQ ID NO: 406556 - RNA, 20 nt, Bordetella pertussis
caccucggcgccgcggcgcu

SEQ ID NO: 406557 - RNA, 18 nt, Bordetella pertussis
caccucggccucgcuggc

SEQ ID NO: 406558 - RNA, 18 nt, Bordetella pertussis
caccucggggcgcggccg

SEQ ID NO: 406559 - RNA, 19 nt, Bordetella pertussis
caccucggggugcagcuuc

SEQ ID NO: 406560 - RNA, 18 nt, Bordetella pertussis
caccucgucguccagcgu

SEQ ID NO: 406561 - RNA, 18 nt, Bordetella pertussis
caccucguucaccccccg

SEQ ID NO: 406562 - RNA, 21 nt, Bordetella pertussis
caccucuucagcccggcgcgc

SEQ ID NO: 406563 - RNA, 20 nt, Bordetella pertussis
caccugcaugcccauuucca

SEQ ID NO: 406564 - RNA, 16 nt, Bordetella pertussis
caccugcgaccgagcc

SEQ ID NO: 406565 - RNA, 17 nt, Bordetella pertussis
caccugcgaccgagcca

SEQ ID NO: 406566 - RNA, 15 nt, Bordetella pertussis
caccugccugccgcc

SEQ ID NO: 406567 - RNA, 21 nt, Bordetella pertussis
caccugccugccgccugccag

SEQ ID NO: 406568 - RNA, 21 nt, Bordetella pertussis
caccuuccugcuggaccugcu

SEQ ID NO: 406569 - RNA, 21 nt, Bordetella pertussis
caccuucgaggaaagcggccu

SEQ ID NO: 406570 - RNA, 21 nt, Bordetella pertussis
caccuucgcgcagcggcgcgc

SEQ ID NO: 406571 - RNA, 13 nt, Bordetella pertussis
caccuucugccgc

SEQ ID NO: 406572 - RNA, 17 nt, Bordetella pertussis
caccuucugccgccagg

SEQ ID NO: 406573 - RNA, 23 nt, Bordetella pertussis
caccuucuuccaggcgcccgcca

SEQ ID NO: 406574 - RNA, 13 nt, Bordetella pertussis
caccuugaccugg

SEQ ID NO: 406575 - RNA, 14 nt, Bordetella pertussis
caccuugacgcgca

SEQ ID NO: 406576 - RNA, 12 nt, Bordetella pertussis
caccuugccugc

SEQ ID NO: 406577 - RNA, 22 nt, Bordetella pertussis
caccuuggccaauggccgcggc

SEQ ID NO: 406578 - RNA, 20 nt, Bordetella pertussis
caccuugggaucgucccagg

SEQ ID NO: 406579 - RNA, 23 nt, Bordetella pertussis
caccuugggaucgucccaggugc

SEQ ID NO: 406580 - RNA, 23 nt, Bordetella pertussis
caccuuguacuggucgcgcagcu

SEQ ID NO: 406581 - RNA, 22 nt, Bordetella pertussis
caccuugucgcgcagcgccgcc

SEQ ID NO: 406582 - RNA, 20 nt, Bordetella pertussis
caccuuguuggcgccggccg

SEQ ID NO: 406583 - RNA, 14 nt, Bordetella pertussis
caccuuucugcugc

SEQ ID NO: 406584 - RNA, 15 nt, Bordetella pertussis
caccuuucugcugcu

SEQ ID NO: 406585 - RNA, 22 nt, Bordetella pertussis
cacgaagccgaugcgccgcgcu

SEQ ID NO: 406586 - RNA, 16 nt, Bordetella pertussis
cacgaaggcagcaccu

SEQ ID NO: 406587 - RNA, 19 nt, Bordetella pertussis
cacgaaggcagcaccucgg

SEQ ID NO: 406588 - RNA, 21 nt, Bordetella pertussis
cacgaaguacucgccggcgcu

SEQ ID NO: 406589 - RNA, 23 nt, Bordetella pertussis
cacgaccgagccggccagcgccu

SEQ ID NO: 406590 - RNA, 14 nt, Bordetella pertussis
cacgacgaacaaca

SEQ ID NO: 406591 - RNA, 15 nt, Bordetella pertussis
cacgacgaacaacac

SEQ ID NO: 406592 - RNA, 21 nt, Bordetella pertussis
cacgacgcguuuggcuuacca

SEQ ID NO: 406593 - RNA, 22 nt, Bordetella pertussis
cacgacggccuccgcgccgacc

SEQ ID NO: 406594 - RNA, 15 nt, Bordetella pertussis
cacgacggucugggc

SEQ ID NO: 406595 - RNA, 23 nt, Bordetella pertussis
cacgauauugguguugccggcca

SEQ ID NO: 406596 - RNA, 15 nt, Bordetella pertussis
cacgaucaccacgcc

SEQ ID NO: 406597 - RNA, 15 nt, Bordetella pertussis
cacgaucaccgccgc

SEQ ID NO: 406598 - RNA, 19 nt, Bordetella pertussis
cacgaucacgaacagcgcc

SEQ ID NO: 406599 - RNA, 20 nt, Bordetella pertussis
cacgcacaugaugcccagcg

SEQ ID NO: 406600 - RNA, 17 nt, Bordetella pertussis
cacgcaccgcgccagcg

SEQ ID NO: 406601 - RNA, 22 nt, Bordetella pertussis
cacgcaccgcgccagcgccggc

SEQ ID NO: 406602 - RNA, 19 nt, Bordetella pertussis
cacgcacgguacgccgaac

SEQ ID NO: 406603 - RNA, 20 nt, Bordetella pertussis
cacgcagaaggcgaacuggg

SEQ ID NO: 406604 - RNA, 16 nt, Bordetella pertussis
cacgcagacuccagga

SEQ ID NO: 406605 - RNA, 16 nt, Bordetella pertussis
cacgcaggcgggcgcc

SEQ ID NO: 406606 - RNA, 18 nt, Bordetella pertussis
cacgccauucauccagcg

SEQ ID NO: 406607 - RNA, 21 nt, Bordetella pertussis
cacgccauucauccagcgcgc

SEQ ID NO: 406608 - RNA, 23 nt, Bordetella pertussis
cacgccauucauccagcgcgcga

SEQ ID NO: 406609 - RNA, 18 nt, Bordetella pertussis
cacgccauggucucgucc

SEQ ID NO: 406610 - RNA, 21 nt, Bordetella pertussis
cacgcccacgcgccgccaggc

SEQ ID NO: 406611 - RNA, 23 nt, Bordetella pertussis
cacgcccacuuccucggcgcgcg

SEQ ID NO: 406612 - RNA, 13 nt, Bordetella pertussis
cacgcccagacug

SEQ ID NO: 406613 - RNA, 14 nt, Bordetella pertussis
cacgcccagauggc

SEQ ID NO: 406614 - RNA, 13 nt, Bordetella pertussis
cacgcccagccgc

SEQ ID NO: 406615 - RNA, 19 nt, Bordetella pertussis
cacgcccagcgccggcacg

SEQ ID NO: 406616 - RNA, 15 nt, Bordetella pertussis
cacgcccaucugcca

SEQ ID NO: 406617 - RNA, 18 nt, Bordetella pertussis
cacgcccaugauggugcc

SEQ ID NO: 406618 - RNA, 12 nt, Bordetella pertussis
cacgccccgccc

SEQ ID NO: 406619 - RNA, 14 nt, Bordetella pertussis
cacgcccgccugca

SEQ ID NO: 406620 - RNA, 23 nt, Bordetella pertussis
cacgcccgccugcagcagcgccu

SEQ ID NO: 406621 - RNA, 18 nt, Bordetella pertussis
cacgcccgcgacgcuggc

SEQ ID NO: 406622 - RNA, 14 nt, Bordetella pertussis
cacgcccgcgccgc

SEQ ID NO: 406623 - RNA, 15 nt, Bordetella pertussis
cacgcccgcggcgcc

SEQ ID NO: 406624 - RNA, 13 nt, Bordetella pertussis
cacgccgccuggc

SEQ ID NO: 406625 - RNA, 17 nt, Bordetella pertussis
cacgccggccgccuggc

SEQ ID NO: 406626 - RNA, 22 nt, Bordetella pertussis
cacgccggccugcgccagcucc

SEQ ID NO: 406627 - RNA, 14 nt, Bordetella pertussis
cacgccggcgcgcc

SEQ ID NO: 406628 - RNA, 15 nt, Bordetella pertussis
cacgccggcgcgccg

SEQ ID NO: 406629 - RNA, 17 nt, Bordetella pertussis
cacgccggcggccauga

SEQ ID NO: 406630 - RNA, 14 nt, Bordetella pertussis
cacgccggcggcgc

SEQ ID NO: 406631 - RNA, 17 nt, Bordetella pertussis
cacgccggcggucacgc

SEQ ID NO: 406632 - RNA, 13 nt, Bordetella pertussis
cacgccgggcgcg

SEQ ID NO: 406633 - RNA, 15 nt, Bordetella pertussis
cacgccgggcgcgcu

SEQ ID NO: 406634 - RNA, 17 nt, Bordetella pertussis
cacgccgggcgcgcugc

SEQ ID NO: 406635 - RNA, 21 nt, Bordetella pertussis
cacgcucuacacggccgccac

SEQ ID NO: 406636 - RNA, 19 nt, Bordetella pertussis
cacgcucuggagccaccag

SEQ ID NO: 406637 - RNA, 17 nt, Bordetella pertussis
cacgcucuugagcgcgg

SEQ ID NO: 406638 - RNA, 14 nt, Bordetella pertussis
cacgcugaagcgcc

SEQ ID NO: 406639 - RNA, 18 nt, Bordetella pertussis
cacgcugaagcgccgcca

SEQ ID NO: 406640 - RNA, 22 nt, Bordetella pertussis
cacgcugaucgccggcgccccc

SEQ ID NO: 406641 - RNA, 14 nt, Bordetella pertussis
cacgcugcccugcu

SEQ ID NO: 406642 - RNA, 15 nt, Bordetella pertussis
cacgcugcccugcug

SEQ ID NO: 406643 - RNA, 16 nt, Bordetella pertussis
cacgcugcgcaggcgc

SEQ ID NO: 406644 - RNA, 14 nt, Bordetella pertussis
cacgcugcgcggcg

SEQ ID NO: 406645 - RNA, 15 nt, Bordetella pertussis
cacgcuggccgcgcc

SEQ ID NO: 406646 - RNA, 24 nt, Bordetella pertussis
cacgcuggccgcgcuggcggcgca

SEQ ID NO: 406647 - RNA, 16 nt, Bordetella pertussis
cacgcuggcgcccgcc

SEQ ID NO: 406648 - RNA, 18 nt, Bordetella pertussis
cacgcuggcgcccgccug

SEQ ID NO: 406649 - RNA, 22 nt, Bordetella pertussis
cacgcuggcggacacgcccugg

SEQ ID NO: 406650 - RNA, 14 nt, Bordetella pertussis
cacgcugggccaga

SEQ ID NO: 406651 - RNA, 23 nt, Bordetella pertussis
cacgcugggccagaccgcgcgca

SEQ ID NO: 406652 - RNA, 20 nt, Bordetella pertussis
cacgcuguuuucggccgacu

SEQ ID NO: 406653 - RNA, 23 nt, Bordetella pertussis
cacggaacgugccgucgggcgcc

SEQ ID NO: 406654 - RNA, 23 nt, Bordetella pertussis
cacggcaugucccgaggcgcccc

SEQ ID NO: 406655 - RNA, 14 nt, Bordetella pertussis
cacggccagcacca

SEQ ID NO: 406656 - RNA, 14 nt, Bordetella pertussis
cacggcccuggucu

SEQ ID NO: 406657 - RNA, 14 nt, Bordetella pertussis
cacggccgcaugcg

SEQ ID NO: 406658 - RNA, 14 nt, Bordetella pertussis
cacggccgccaccu

SEQ ID NO: 406659 - RNA, 15 nt, Bordetella pertussis
cacggccggccaggc

SEQ ID NO: 406660 - RNA, 17 nt, Bordetella pertussis
cacggcggugccgcgca

SEQ ID NO: 406661 - RNA, 22 nt, Bordetella pertussis
cacggcgucgccggccaggcaa

SEQ ID NO: 406662 - RNA, 16 nt, Bordetella pertussis
cacggcguggcgcgca

SEQ ID NO: 406663 - RNA, 16 nt, Bordetella pertussis
cacggcguggcgcgcc

SEQ ID NO: 406664 - RNA, 17 nt, Bordetella pertussis
cacggcguggcgcgccc

SEQ ID NO: 406665 - RNA, 21 nt, Bordetella pertussis
cacggcuggguucaggccugu

SEQ ID NO: 406666 - RNA, 15 nt, Bordetella pertussis
cacggcuucgcccag

SEQ ID NO: 406667 - RNA, 16 nt, Bordetella pertussis
cacggcuucgcccagc

SEQ ID NO: 406668 - RNA, 17 nt, Bordetella pertussis
cacggcuucgcccagcg

SEQ ID NO: 406669 - RNA, 16 nt, Bordetella pertussis
cacggcuugcgcgccu

SEQ ID NO: 406670 - RNA, 17 nt, Bordetella pertussis
cacggcuugcgcgccug

SEQ ID NO: 406671 - RNA, 22 nt, Bordetella pertussis
cacggcuugcgcgccugcuggu

SEQ ID NO: 406672 - RNA, 14 nt, Bordetella pertussis
cacggucagcaacc

SEQ ID NO: 406673 - RNA, 17 nt, Bordetella pertussis
cacggucuggcgcgaca

SEQ ID NO: 406674 - RNA, 15 nt, Bordetella pertussis
cacggucugcaccug

SEQ ID NO: 406675 - RNA, 15 nt, Bordetella pertussis
cacggucugcacgcc

SEQ ID NO: 406676 - RNA, 21 nt, Bordetella pertussis
cacggugaccggguggcugcg

SEQ ID NO: 406677 - RNA, 16 nt, Bordetella pertussis
cacggugccgcgcgcu

SEQ ID NO: 406678 - RNA, 17 nt, Bordetella pertussis
cacgguggcgaaggccg

SEQ ID NO: 406679 - RNA, 21 nt, Bordetella pertussis
cacgguggcgaaggccgccgc

SEQ ID NO: 406680 - RNA, 22 nt, Bordetella pertussis
cacgguggcggugcucgaggug

SEQ ID NO: 406681 - RNA, 23 nt, Bordetella pertussis
cacgguggcguaguagcccaggc

SEQ ID NO: 406682 - RNA, 16 nt, Bordetella pertussis
cacguagcgcagcacc

SEQ ID NO: 406683 - RNA, 17 nt, Bordetella pertussis
cacguagcgcagcaccg

SEQ ID NO: 406684 - RNA, 12 nt, Bordetella pertussis
cacgucauugca

SEQ ID NO: 406685 - RNA, 13 nt, Bordetella pertussis
cacguccagcacg

SEQ ID NO: 406686 - RNA, 20 nt, Bordetella pertussis
cacguccagcacggccgcgg

SEQ ID NO: 406687 - RNA, 11 nt, Bordetella pertussis
cacguccagcg

SEQ ID NO: 406688 - RNA, 13 nt, Bordetella pertussis
cacgucccagucg

SEQ ID NO: 406689 - RNA, 21 nt, Bordetella pertussis
cacgucccagucgccgcgccc

SEQ ID NO: 406690 - RNA, 22 nt, Bordetella pertussis
cacgucccagucgccgcgcccg

SEQ ID NO: 406691 - RNA, 23 nt, Bordetella pertussis
cacgucccagucgccgcgcccgc

SEQ ID NO: 406692 - RNA, 20 nt, Bordetella pertussis
cacgucgaccucgagcaccu

SEQ ID NO: 406693 - RNA, 21 nt, Bordetella pertussis
cacgucgccggcguucuucag

SEQ ID NO: 406694 - RNA, 15 nt, Bordetella pertussis
cacgucguagcgcug

SEQ ID NO: 406695 - RNA, 20 nt, Bordetella pertussis
cacgucguagcgcugcagcc

SEQ ID NO: 406696 - RNA, 20 nt, Bordetella pertussis
cacgucggucgcuuccagcg

SEQ ID NO: 406697 - RNA, 23 nt, Bordetella pertussis
cacgucggugggaaucggcaccu

SEQ ID NO: 406698 - RNA, 18 nt, Bordetella pertussis
cacgugaagcgccgcgcc

SEQ ID NO: 406699 - RNA, 19 nt, Bordetella pertussis
cacuuucaucaaacgcggc

SEQ ID NO: 406700 - RNA, 23 nt, Bordetella pertussis
cagaaaccccaggggacggcgca

SEQ ID NO: 406701 - RNA, 14 nt, Bordetella pertussis
cagaaaccgccaca

SEQ ID NO: 406702 - RNA, 19 nt, Bordetella pertussis
cagaaaccgccacagcgcc

SEQ ID NO: 406703 - RNA, 22 nt, Bordetella pertussis
cagaaaccgccacagcgccgcg

SEQ ID NO: 406704 - RNA, 16 nt, Bordetella pertussis
cagaacagcagcguga

SEQ ID NO: 406705 - RNA, 18 nt, Bordetella pertussis
cagaagcagccgcgcggc

SEQ ID NO: 406706 - RNA, 23 nt, Bordetella pertussis
cagaagcagccgcgcggccgggc

SEQ ID NO: 406707 - RNA, 20 nt, Bordetella pertussis
cagaagcgccauggcagggu

SEQ ID NO: 406708 - RNA, 22 nt, Bordetella pertussis
cagaagcgccauggcagggucc

SEQ ID NO: 406709 - RNA, 19 nt, Bordetella pertussis
cagaauguauuggcccagu

SEQ ID NO: 406710 - RNA, 14 nt, Bordetella pertussis
cagacaggccggca

SEQ ID NO: 406711 - RNA, 16 nt, Bordetella pertussis
cagacuccaggagcuc

SEQ ID NO: 406712 - RNA, 18 nt, Bordetella pertussis
cagacuguucagaaaccu

SEQ ID NO: 406713 - RNA, 19 nt, Bordetella pertussis
cagagcaccacggcgcgcg

SEQ ID NO: 406714 - RNA, 22 nt, Bordetella pertussis
cagagcccuucgacgcggcggc

SEQ ID NO: 406715 - RNA, 12 nt, Bordetella pertussis
cagagcuggggc

SEQ ID NO: 406716 - RNA, 16 nt, Bordetella pertussis
cagaggaacgccgcgc

SEQ ID NO: 406717 - RNA, 17 nt, Bordetella pertussis
cagaggaacgccgcgcu

SEQ ID NO: 406718 - RNA, 22 nt, Bordetella pertussis
cagagucugccuggcgaacagu

SEQ ID NO: 406719 - RNA, 13 nt, Bordetella pertussis
cagaucgauccag

SEQ ID NO: 406720 - RNA, 15 nt, Bordetella pertussis
cagaucgccuggggg

SEQ ID NO: 406721 - RNA, 18 nt, Bordetella pertussis
cagaucggcggccugggc

SEQ ID NO: 406722 - RNA, 21 nt, Bordetella pertussis
cagaucuccggauccagccgc

SEQ ID NO: 406723 - RNA, 16 nt, Bordetella pertussis
cagaucugcacgcugu

SEQ ID NO: 406724 - RNA, 21 nt, Bordetella pertussis
cagaugccguccuggccguca

SEQ ID NO: 406725 - RNA, 14 nt, Bordetella pertussis
cagaugcgcagcag

SEQ ID NO: 406726 - RNA, 16 nt, Bordetella pertussis
cagaugcgcagcaggc

SEQ ID NO: 406727 - RNA, 16 nt, Bordetella pertussis
cagaugcgcgccaggc

SEQ ID NO: 406728 - RNA, 19 nt, Bordetella pertussis
cagauggccagcagcgccg

SEQ ID NO: 406729 - RNA, 16 nt, Bordetella pertussis
cagcaaccccagcagc

SEQ ID NO: 406730 - RNA, 16 nt, Bordetella pertussis
cagcaacccgcccggg

SEQ ID NO: 406731 - RNA, 17 nt, Bordetella pertussis
cagcaacccgcccgggu

SEQ ID NO: 406732 - RNA, 15 nt, Bordetella pertussis
cagcaacgcgccgcu

SEQ ID NO: 406733 - RNA, 16 nt, Bordetella pertussis
cagcaagcccaccggg

SEQ ID NO: 406734 - RNA, 20 nt, Bordetella pertussis
cagcaagcccaccgggccgg

SEQ ID NO: 406735 - RNA, 19 nt, Bordetella pertussis
cagcaagccgaucaaccug

SEQ ID NO: 406736 - RNA, 14 nt, Bordetella pertussis
cagcaagcgcgcca

SEQ ID NO: 406737 - RNA, 17 nt, Bordetella pertussis
cagcaagcgcgccauga

SEQ ID NO: 406738 - RNA, 21 nt, Bordetella pertussis
cagcaagcgcgccaugaacuc

SEQ ID NO: 406739 - RNA, 17 nt, Bordetella pertussis
cagcaagcgcucggcca

SEQ ID NO: 406740 - RNA, 21 nt, Bordetella pertussis
cagcaagcgcucggccacgcu

SEQ ID NO: 406741 - RNA, 15 nt, Bordetella pertussis
cagcaagcugcugcu

SEQ ID NO: 406742 - RNA, 17 nt, Bordetella pertussis
cagcaagcugcugcugg

SEQ ID NO: 406743 - RNA, 15 nt, Bordetella pertussis
cagcaaggcgcgcca

SEQ ID NO: 406744 - RNA, 14 nt, Bordetella pertussis
cagcaagggcccca

SEQ ID NO: 406745 - RNA, 17 nt, Bordetella pertussis
cagcaagggccccagca

SEQ ID NO: 406746 - RNA, 18 nt, Bordetella pertussis
cagcaagggccccagcau

SEQ ID NO: 406747 - RNA, 14 nt, Bordetella pertussis
cagcaagggcgucu

SEQ ID NO: 406748 - RNA, 19 nt, Bordetella pertussis
cagcaagggguccguggcg

SEQ ID NO: 406749 - RNA, 16 nt, Bordetella pertussis
cagcaagucagcccgc

SEQ ID NO: 406750 - RNA, 20 nt, Bordetella pertussis
cagcaauucaagccgcacca

SEQ ID NO: 406751 - RNA, 13 nt, Bordetella pertussis
cagcaauugcccc

SEQ ID NO: 406752 - RNA, 17 nt, Bordetella pertussis
cagcaauugccccagca

SEQ ID NO: 406753 - RNA, 18 nt, Bordetella pertussis
cagcaauugccccagcac

SEQ ID NO: 406754 - RNA, 17 nt, Bordetella pertussis
cagcacaagggccccuc

SEQ ID NO: 406755 - RNA, 13 nt, Bordetella pertussis
cagcacacgguca

SEQ ID NO: 406756 - RNA, 15 nt, Bordetella pertussis
cagcacacggucagc

SEQ ID NO: 406757 - RNA, 23 nt, Bordetella pertussis
cagcacaugggcgcgguagcgcc

SEQ ID NO: 406758 - RNA, 20 nt, Bordetella pertussis
cagcaccccgucggcucagu

SEQ ID NO: 406759 - RNA, 18 nt, Bordetella pertussis
cagcaccggauccugcgg

SEQ ID NO: 406760 - RNA, 19 nt, Bordetella pertussis
cagcaccggauccugcggc

SEQ ID NO: 406761 - RNA, 21 nt, Bordetella pertussis
cagcaccggauccugcggcgc

SEQ ID NO: 406762 - RNA, 21 nt, Bordetella pertussis
cagcaccggcacgcgccaggc

SEQ ID NO: 406763 - RNA, 21 nt, Bordetella pertussis
cagcaccggcagcguaucgcc

SEQ ID NO: 406764 - RNA, 15 nt, Bordetella pertussis
cagcaccggccgccg

SEQ ID NO: 406765 - RNA, 23 nt, Bordetella pertussis
cagcaccggcgugagcgccaccg

SEQ ID NO: 406766 - RNA, 22 nt, Bordetella pertussis
cagcaccgggaaguccgccgcg

SEQ ID NO: 406767 - RNA, 21 nt, Bordetella pertussis
cagcaccggggcagggcgggc

SEQ ID NO: 406768 - RNA, 17 nt, Bordetella pertussis
cagcaccgugccggcgu

SEQ ID NO: 406769 - RNA, 21 nt, Bordetella pertussis
cagcacgagauguccauggcc

SEQ ID NO: 406770 - RNA, 17 nt, Bordetella pertussis
cagcacgaucacgaaca

SEQ ID NO: 406771 - RNA, 18 nt, Bordetella pertussis
cagcacgaucgcggcgcu

SEQ ID NO: 406772 - RNA, 17 nt, Bordetella pertussis
cagcacgauggcgccca

SEQ ID NO: 406773 - RNA, 23 nt, Bordetella pertussis
cagcacgauggcgcccacggccu

SEQ ID NO: 406774 - RNA, 19 nt, Bordetella pertussis
cagcacgaugguguucagg

SEQ ID NO: 406775 - RNA, 16 nt, Bordetella pertussis
cagcacgcaccaggcg

SEQ ID NO: 406776 - RNA, 14 nt, Bordetella pertussis
cagcacgcccgcca

SEQ ID NO: 406777 - RNA, 20 nt, Bordetella pertussis
cagcacgcccgccagcagcu

SEQ ID NO: 406778 - RNA, 17 nt, Bordetella pertussis
cagcacgcccgcgcgcg

SEQ ID NO: 406779 - RNA, 18 nt, Bordetella pertussis
cagcacgcccgcgcgcga

SEQ ID NO: 406780 - RNA, 15 nt, Bordetella pertussis
cagcacgcccauggu

SEQ ID NO: 406781 - RNA, 15 nt, Bordetella pertussis
cagcacgcccuggcu

SEQ ID NO: 406782 - RNA, 15 nt, Bordetella pertussis
cagcacgccgcgcca

SEQ ID NO: 406783 - RNA, 16 nt, Bordetella pertussis
cagcacgccggccagg

SEQ ID NO: 406784 - RNA, 21 nt, Bordetella pertussis
cagcacgccuugcucgaccag

SEQ ID NO: 406785 - RNA, 13 nt, Bordetella pertussis
cagcacgcgcgcc

SEQ ID NO: 406786 - RNA, 17 nt, Bordetella pertussis
cagcacgcgcgccagcu

SEQ ID NO: 406787 - RNA, 14 nt, Bordetella pertussis
cagcacgcgcacca

SEQ ID NO: 406788 - RNA, 16 nt, Bordetella pertussis
cagcacgcgcaccagg

SEQ ID NO: 406789 - RNA, 13 nt, Bordetella pertussis
cagcacgcggcgc

SEQ ID NO: 406790 - RNA, 14 nt, Bordetella pertussis
cagcacgcggcgca

SEQ ID NO: 406791 - RNA, 15 nt, Bordetella pertussis
cagcacuucgaugcg

SEQ ID NO: 406792 - RNA, 18 nt, Bordetella pertussis
cagcacuugccggccgcc

SEQ ID NO: 406793 - RNA, 19 nt, Bordetella pertussis
cagcacuugccggccgccc

SEQ ID NO: 406794 - RNA, 19 nt, Bordetella pertussis
cagcagacccuggcgcgcg

SEQ ID NO: 406795 - RNA, 14 nt, Bordetella pertussis
cagcagacgcuuca

SEQ ID NO: 406796 - RNA, 19 nt, Bordetella pertussis
cagcagacgcuucaggccg

SEQ ID NO: 406797 - RNA, 23 nt, Bordetella pertussis
cagcagcgcaucgagcuccugca

SEQ ID NO: 406798 - RNA, 14 nt, Bordetella pertussis
cagcagcgccacga

SEQ ID NO: 406799 - RNA, 20 nt, Bordetella pertussis
cagcagcgccagggccaggc

SEQ ID NO: 406800 - RNA, 13 nt, Bordetella pertussis
cagcagcgccgga

SEQ ID NO: 406801 - RNA, 14 nt, Bordetella pertussis
cagcagcgcggcgc

SEQ ID NO: 406802 - RNA, 14 nt, Bordetella pertussis
cagcagcggcagca

SEQ ID NO: 406803 - RNA, 14 nt, Bordetella pertussis
cagcagcggcagcu

SEQ ID NO: 406804 - RNA, 12 nt, Bordetella pertussis
cagcagcgggcu

SEQ ID NO: 406805 - RNA, 16 nt, Bordetella pertussis
cagcagcgugaugcgg

SEQ ID NO: 406806 - RNA, 22 nt, Bordetella pertussis
cagcagcgugcggucguccucg

SEQ ID NO: 406807 - RNA, 14 nt, Bordetella pertussis
cagcagcuccucgg

SEQ ID NO: 406808 - RNA, 20 nt, Bordetella pertussis
cagcagcuccucggccugcc

SEQ ID NO: 406809 - RNA, 12 nt, Bordetella pertussis
cagcagcuggcg

SEQ ID NO: 406810 - RNA, 17 nt, Bordetella pertussis
cagcagcuggcgcagca

SEQ ID NO: 406811 - RNA, 16 nt, Bordetella pertussis
cagcaggaacaggcug

SEQ ID NO: 406812 - RNA, 16 nt, Bordetella pertussis
cagcaggagcccgcug

SEQ ID NO: 406813 - RNA, 15 nt, Bordetella pertussis
cagcaggcccaccag

SEQ ID NO: 406814 - RNA, 17 nt, Bordetella pertussis
cagcaggcccaccaggg

SEQ ID NO: 406815 - RNA, 14 nt, Bordetella pertussis
cagcaggcccuggg

SEQ ID NO: 406816 - RNA, 23 nt, Bordetella pertussis
cagcaggcccugggccagcagcu

SEQ ID NO: 406817 - RNA, 13 nt, Bordetella pertussis
cagcaggcgcgcg

SEQ ID NO: 406818 - RNA, 19 nt, Bordetella pertussis
cagcaggcgcgcggccucg

SEQ ID NO: 406819 - RNA, 20 nt, Bordetella pertussis
cagcaggcgcgcggccucga

SEQ ID NO: 406820 - RNA, 14 nt, Bordetella pertussis
cagcaggcgcguga

SEQ ID NO: 406821 - RNA, 18 nt, Bordetella pertussis
cagcaggcgcgugagguc

SEQ ID NO: 406822 - RNA, 19 nt, Bordetella pertussis
cagcaggcgcucggccagc

SEQ ID NO: 406823 - RNA, 17 nt, Bordetella pertussis
cagcaggcgcucggcuu

SEQ ID NO: 406824 - RNA, 18 nt, Bordetella pertussis
cagcaggcgcucggcuuc

SEQ ID NO: 406825 - RNA, 19 nt, Bordetella pertussis
cagcaggcggccgaccagc

SEQ ID NO: 406826 - RNA, 22 nt, Bordetella pertussis
cagcaggcggccgaccagcacg

SEQ ID NO: 406827 - RNA, 21 nt, Bordetella pertussis
cagcaggcgcaccagcgcgcc

SEQ ID NO: 406828 - RNA, 15 nt, Bordetella pertussis
cagcaggcucagcgg

SEQ ID NO: 406829 - RNA, 18 nt, Bordetella pertussis
cagcaggcucagcgggcu

SEQ ID NO: 406830 - RNA, 22 nt, Bordetella pertussis
cagcaggcuuucgcacagccgg

SEQ ID NO: 406831 - RNA, 23 nt, Bordetella pertussis
cagcaggcuuucgcacagccggg

SEQ ID NO: 406832 - RNA, 14 nt, Bordetella pertussis
cagcagggccaggc

SEQ ID NO: 406833 - RNA, 16 nt, Bordetella pertussis
cagcagggccaggccg

SEQ ID NO: 406834 - RNA, 22 nt, Bordetella pertussis
cagcagggccacgcccaggccg

SEQ ID NO: 406835 - RNA, 12 nt, Bordetella pertussis
cagcagggcgcc

SEQ ID NO: 406836 - RNA, 14 nt, Bordetella pertussis
cagcagggcgccga

SEQ ID NO: 406837 - RNA, 19 nt, Bordetella pertussis
cagcagggucugcaggccg

SEQ ID NO: 406838 - RNA, 19 nt, Bordetella pertussis
cagcaggguggccacgccc

SEQ ID NO: 406839 - RNA, 21 nt, Bordetella pertussis
cagcaggucgcgcacgcuggc

SEQ ID NO: 406840 - RNA, 20 nt, Bordetella pertussis
cagcaggucggagucggcgc

SEQ ID NO: 406841 - RNA, 23 nt, Bordetella pertussis
cagcaggucggagucggcgccgc

SEQ ID NO: 406842 - RNA, 18 nt, Bordetella pertussis
cagcaggucggcgcggcc

SEQ ID NO: 406843 - RNA, 13 nt, Bordetella pertussis
cagcaggucgguc

SEQ ID NO: 406844 - RNA, 17 nt, Bordetella pertussis
cagcagguggcgcuguc

SEQ ID NO: 406845 - RNA, 16 nt, Bordetella pertussis
cagcaguucggcgucg

SEQ ID NO: 406846 - RNA, 20 nt, Bordetella pertussis
cagcaguucggcgucggugc

SEQ ID NO: 406847 - RNA, 18 nt, Bordetella pertussis
cagcauacccugcgcgcc

SEQ ID NO: 406848 - RNA, 19 nt, Bordetella pertussis
cagcauacccugcgcgccg

SEQ ID NO: 406849 - RNA, 20 nt, Bordetella pertussis
cagcauauccgcgugcguuu

SEQ ID NO: 406850 - RNA, 15 nt, Bordetella pertussis
cagcaucagcggcag

SEQ ID NO: 406851 - RNA, 17 nt, Bordetella pertussis
cagcaucagcggcagca

SEQ ID NO: 406852 - RNA, 19 nt, Bordetella pertussis
cagcaucagcggcagcacg

SEQ ID NO: 406853 - RNA, 14 nt, Bordetella pertussis
cagcaucagcuugg

SEQ ID NO: 406854 - RNA, 20 nt, Bordetella pertussis
cagcauccgcgccaggaugg

SEQ ID NO: 406855 - RNA, 22 nt, Bordetella pertussis
cagcauccgcgccaggauggcc

SEQ ID NO: 406856 - RNA, 14 nt, Bordetella pertussis
cagcauccucacgu

SEQ ID NO: 406857 - RNA, 14 nt, Bordetella pertussis
cagcaucgccgcca

SEQ ID NO: 406858 - RNA, 15 nt, Bordetella pertussis
cagcaucuugcgccg

SEQ ID NO: 406859 - RNA, 17 nt, Bordetella pertussis
cagcaucuugcgccgcu

SEQ ID NO: 406860 - RNA, 17 nt, Bordetella pertussis
cagcaucuuggccgcca

SEQ ID NO: 406861 - RNA, 13 nt, Bordetella pertussis
cagcaugaaaugc

SEQ ID NO: 406862 - RNA, 16 nt, Bordetella pertussis
cagcaugaacggcagc

SEQ ID NO: 406863 - RNA, 17 nt, Bordetella pertussis
cagcaugaacggcagcg

SEQ ID NO: 406864 - RNA, 19 nt, Bordetella pertussis
cagcaugaccucggccugc

SEQ ID NO: 406865 - RNA, 13 nt, Bordetella pertussis
cagcaugccgcgg

SEQ ID NO: 406866 - RNA, 14 nt, Bordetella pertussis
cagcaugcgcgcga

SEQ ID NO: 406867 - RNA, 23 nt, Bordetella pertussis
cagcaugcgcgcgacuuccucga

SEQ ID NO: 406868 - RNA, 15 nt, Bordetella pertussis
cagcaugcgcgcggc

SEQ ID NO: 406869 - RNA, 16 nt, Bordetella pertussis
cagcaugcgcgcggcc

SEQ ID NO: 406870 - RNA, 17 nt, Bordetella pertussis
cagcaugcgcgcggccu

SEQ ID NO: 406871 - RNA, 21 nt, Bordetella pertussis
cagcaugcgcgucuccagcgc

SEQ ID NO: 406872 - RNA, 14 nt, Bordetella pertussis
cagcaugcggcccg

SEQ ID NO: 406873 - RNA, 21 nt, Bordetella pertussis
cagcauggacgagcucgucgg

SEQ ID NO: 406874 - RNA, 17 nt, Bordetella pertussis
cagcauggccaccaggu

SEQ ID NO: 406875 - RNA, 19 nt, Bordetella pertussis
cagcauggcgccaugcgac

SEQ ID NO: 406876 - RNA, 22 nt, Bordetella pertussis
cagcauggcgccaugcgacagc

SEQ ID NO: 406877 - RNA, 19 nt, Bordetella pertussis
cagcauggcggccaggcgc

SEQ ID NO: 406878 - RNA, 16 nt, Bordetella pertussis
cagcauggcggcgccc

SEQ ID NO: 406879 - RNA, 19 nt, Bordetella pertussis
cagcauggcggcgcccgcu

SEQ ID NO: 406880 - RNA, 15 nt, Bordetella pertussis
cagcauggcgggcga

SEQ ID NO: 406881 - RNA, 21 nt, Bordetella pertussis
cagcauguauucaucacgggc

SEQ ID NO: 406882 - RNA, 17 nt, Bordetella pertussis
cagcaugugcgcggcgu

SEQ ID NO: 406883 - RNA, 17 nt, Bordetella pertussis
cagcauuucgcgugcgu

SEQ ID NO: 406884 - RNA, 20 nt, Bordetella pertussis
cagccacacgaucagcgccc

SEQ ID NO: 406885 - RNA, 21 nt, Bordetella pertussis
cagccacacgcugaagcgccg

SEQ ID NO: 406886 - RNA, 24 nt, Bordetella pertussis
cagccacacgcugaagcgccgcca

SEQ ID NO: 406887 - RNA, 13 nt, Bordetella pertussis
cagccacaggccc

SEQ ID NO: 406888 - RNA, 21 nt, Bordetella pertussis
cagccaccgguugcagcgcgc

SEQ ID NO: 406889 - RNA, 14 nt, Bordetella pertussis
cagccacgcgcgcu

SEQ ID NO: 406890 - RNA, 24 nt, Bordetella pertussis
cagccacgcgcgcuggcgcccggc

SEQ ID NO: 406891 - RNA, 18 nt, Bordetella pertussis
cagccacgugaagcgccg

SEQ ID NO: 406892 - RNA, 17 nt, Bordetella pertussis
cagccagccggcggcca

SEQ ID NO: 406893 - RNA, 20 nt, Bordetella pertussis
cagccagccggcggccagcu

SEQ ID NO: 406894 - RNA, 13 nt, Bordetella pertussis
cagccagccgcuu

SEQ ID NO: 406895 - RNA, 20 nt, Bordetella pertussis
cagccagccgcuugcggcca

SEQ ID NO: 406896 - RNA, 13 nt, Bordetella pertussis
cagccagcgccgc

SEQ ID NO: 406897 - RNA, 13 nt, Bordetella pertussis
cagccaggccagc

SEQ ID NO: 406898 - RNA, 14 nt, Bordetella pertussis
cagccaggccagca

SEQ ID NO: 406899 - RNA, 23 nt, Bordetella pertussis
cagccaggccagcagcucggcca

SEQ ID NO: 406900 - RNA, 16 nt, Bordetella pertussis
cagccaggccagcgcc

SEQ ID NO: 406901 - RNA, 13 nt, Bordetella pertussis
cagccaggcgcca

SEQ ID NO: 406902 - RNA, 16 nt, Bordetella pertussis
cagccaggcgccagcg

SEQ ID NO: 406903 - RNA, 16 nt, Bordetella pertussis
cagccaggcgcgcagu

SEQ ID NO: 406904 - RNA, 21 nt, Bordetella pertussis
cagccaggcgguggccucguc

SEQ ID NO: 406905 - RNA, 19 nt, Bordetella pertussis
cagccauccucgcccagcg

SEQ ID NO: 406906 - RNA, 18 nt, Bordetella pertussis
cagccauguucgaccagg

SEQ ID NO: 406907 - RNA, 19 nt, Bordetella pertussis
cagccauguucgaccagga

SEQ ID NO: 406908 - RNA, 14 nt, Bordetella pertussis
cagccauucggcca

SEQ ID NO: 406909 - RNA, 19 nt, Bordetella pertussis
cagccauucggccaggucc

SEQ ID NO: 406910 - RNA, 17 nt, Bordetella pertussis
cagcccgugggcggcgu

SEQ ID NO: 406911 - RNA, 16 nt, Bordetella pertussis
cagcccuucggagcca

SEQ ID NO: 406912 - RNA, 21 nt, Bordetella pertussis
cagcccuucggagccaguccc

SEQ ID NO: 406913 - RNA, 17 nt, Bordetella pertussis
cagccgacaggcgcgca

SEQ ID NO: 406914 - RNA, 18 nt, Bordetella pertussis
cagccgaugauggugaac

SEQ ID NO: 406915 - RNA, 15 nt, Bordetella pertussis
cagccgaugccgcuu

SEQ ID NO: 406916 - RNA, 17 nt, Bordetella pertussis
cagccgcaagcuggcgg

SEQ ID NO: 406917 - RNA, 14 nt, Bordetella pertussis
cagccgcaccagcg

SEQ ID NO: 406918 - RNA, 12 nt, Bordetella pertussis
cagccgcagcag

SEQ ID NO: 406919 - RNA, 23 nt, Bordetella pertussis
cagccgcagcaggcgcucggcca

SEQ ID NO: 406920 - RNA, 23 nt, Bordetella pertussis
cagccgcaguauuccugcuggua

SEQ ID NO: 406921 - RNA, 14 nt, Bordetella pertussis
cagccgccagcgcc

SEQ ID NO: 406922 - RNA, 15 nt, Bordetella pertussis
cagccgccagcgccu

SEQ ID NO: 406923 - RNA, 17 nt, Bordetella pertussis
cagccgccagcgccugg

SEQ ID NO: 406924 - RNA, 18 nt, Bordetella pertussis
cagccgccagcgccugga

SEQ ID NO: 406925 - RNA, 22 nt, Bordetella pertussis
cagccgccagcgccuggaccug

SEQ ID NO: 406926 - RNA, 22 nt, Bordetella pertussis
cagccgccauaggcgcgcacca

SEQ ID NO: 406927 - RNA, 15 nt, Bordetella pertussis
cagccgccccagcag

SEQ ID NO: 406928 - RNA, 17 nt, Bordetella pertussis
cagccgccccagcagca

SEQ ID NO: 406929 - RNA, 23 nt, Bordetella pertussis
cagccgcgccaagggcgugcgcu

SEQ ID NO: 406930 - RNA, 14 nt, Bordetella pertussis
cagccgcgccaggg

SEQ ID NO: 406931 - RNA, 12 nt, Bordetella pertussis
cagccgcuugaa

SEQ ID NO: 406932 - RNA, 14 nt, Bordetella pertussis
cagccgcuugcccg

SEQ ID NO: 406933 - RNA, 23 nt, Bordetella pertussis
cagccggaaacggaaacugccau

SEQ ID NO: 406934 - RNA, 21 nt, Bordetella pertussis
cagccggccauggcccuugcc

SEQ ID NO: 406935 - RNA, 19 nt, Bordetella pertussis
cagccggccauggccgcca

SEQ ID NO: 406936 - RNA, 20 nt, Bordetella pertussis
cagccggccauggccgccac

SEQ ID NO: 406937 - RNA, 16 nt, Bordetella pertussis
cagccggcccagcaug

SEQ ID NO: 406938 - RNA, 16 nt, Bordetella pertussis
cagccggccgccgaac

SEQ ID NO: 406939 - RNA, 14 nt, Bordetella pertussis
cagccucgaggugg

SEQ ID NO: 406940 - RNA, 19 nt, Bordetella pertussis
cagccugauucccaggccc

SEQ ID NO: 406941 - RNA, 20 nt, Bordetella pertussis
cagccugauucccaggcccg

SEQ ID NO: 406942 - RNA, 20 nt, Bordetella pertussis
cagccugccgcggccgcccc

SEQ ID NO: 406943 - RNA, 21 nt, Bordetella pertussis
cagccugccgcggccgccccc

SEQ ID NO: 406944 - RNA, 22 nt, Bordetella pertussis
cagccugccggcgcgcccaggg

SEQ ID NO: 406945 - RNA, 15 nt, Bordetella pertussis
cagccugccggcggc

SEQ ID NO: 406946 - RNA, 16 nt, Bordetella pertussis
cagccuggcaaugcgu

SEQ ID NO: 406947 - RNA, 14 nt, Bordetella pertussis
cagccuggccuugc

SEQ ID NO: 406948 - RNA, 24 nt, Bordetella pertussis
cagccuggcgccaacccgccaucc

SEQ ID NO: 406949 - RNA, 14 nt, Bordetella pertussis
cagccugggcgccu

SEQ ID NO: 406950 - RNA, 24 nt, Bordetella pertussis
cagccuggucagguugcgccggcu

SEQ ID NO: 406951 - RNA, 19 nt, Bordetella pertussis
cagcgaauacggcaagcag

SEQ ID NO: 406952 - RNA, 18 nt, Bordetella pertussis
cagcgaaucguaggcgcu

SEQ ID NO: 406953 - RNA, 22 nt, Bordetella pertussis
cagcgacaacagcuugcccggc

SEQ ID NO: 406954 - RNA, 14 nt, Bordetella pertussis
cagcgacagcaggg

SEQ ID NO: 406955 - RNA, 20 nt, Bordetella pertussis
cagcgacggccccagcgccg

SEQ ID NO: 406956 - RNA, 22 nt, Bordetella pertussis
cagcgacggccccagcgccgcg

SEQ ID NO: 406957 - RNA, 16 nt, Bordetella pertussis
cagcgacuucuaccug

SEQ ID NO: 406958 - RNA, 18 nt, Bordetella pertussis
cagcgacuugucgcgccc

SEQ ID NO: 406959 - RNA, 20 nt, Bordetella pertussis
cagcgcaccaccaccaugug

SEQ ID NO: 406960 - RNA, 23 nt, Bordetella pertussis
cagcgcaccaccaccaugugcuu

SEQ ID NO: 406961 - RNA, 21 nt, Bordetella pertussis
cagcgcacugaucgccgccuu

SEQ ID NO: 406962 - RNA, 21 nt, Bordetella pertussis
cagcgccacgcccaggccgcu

SEQ ID NO: 406963 - RNA, 14 nt, Bordetella pertussis
cagcgccacgcccu

SEQ ID NO: 406964 - RNA, 15 nt, Bordetella pertussis
cagcgccagcacgau

SEQ ID NO: 406965 - RNA, 13 nt, Bordetella pertussis
cagcgccagcagg

SEQ ID NO: 406966 - RNA, 13 nt, Bordetella pertussis
cagcgccagccgc

SEQ ID NO: 406967 - RNA, 14 nt, Bordetella pertussis
cagcgccagcguca

SEQ ID NO: 406968 - RNA, 22 nt, Bordetella pertussis
cagcgccaggaacagcgccggc

SEQ ID NO: 406969 - RNA, 23 nt, Bordetella pertussis
cagcgccagggccaggccgccgc

SEQ ID NO: 406970 - RNA, 17 nt, Bordetella pertussis
cagcgccaguccgcgcu

SEQ ID NO: 406971 - RNA, 13 nt, Bordetella pertussis
cagcgccaucauc

SEQ ID NO: 406972 - RNA, 16 nt, Bordetella pertussis
cagcgccaucgcgcgc

SEQ ID NO: 406973 - RNA, 14 nt, Bordetella pertussis
cagcgccaucggca

SEQ ID NO: 406974 - RNA, 23 nt, Bordetella pertussis
cagcgccaugaugucgcgcgccu

SEQ ID NO: 406975 - RNA, 22 nt, Bordetella pertussis
cagcgcccaaucgggcagcacg

SEQ ID NO: 406976 - RNA, 13 nt, Bordetella pertussis
cagcgcccccagc

SEQ ID NO: 406977 - RNA, 20 nt, Bordetella pertussis
cagcgccccgaucagcaagg

SEQ ID NO: 406978 - RNA, 22 nt, Bordetella pertussis
cagcgccccgaucagcaagggc

SEQ ID NO: 406979 - RNA, 15 nt, Bordetella pertussis
cagcgccgagcgcca

SEQ ID NO: 406980 - RNA, 13 nt, Bordetella pertussis
cagcgccgccagc

SEQ ID NO: 406981 - RNA, 16 nt, Bordetella pertussis
cagcgccgccagcaug

SEQ ID NO: 406982 - RNA, 20 nt, Bordetella pertussis
cagcgccgccagccgcuggc

SEQ ID NO: 406983 - RNA, 20 nt, Bordetella pertussis
cagcgccgccauggcggcgc

SEQ ID NO: 406984 - RNA, 16 nt, Bordetella pertussis
cagcgccgcgccgcgu

SEQ ID NO: 406985 - RNA, 15 nt, Bordetella pertussis
cagcgccgcgccgga

SEQ ID NO: 406986 - RNA, 15 nt, Bordetella pertussis
cagcgccgcgcgcgu

SEQ ID NO: 406987 - RNA, 16 nt, Bordetella pertussis
cagcgccgcggccggc

SEQ ID NO: 406988 - RNA, 17 nt, Bordetella pertussis
cagcgccggcacgcuga

SEQ ID NO: 406989 - RNA, 19 nt, Bordetella pertussis
cagcgccggcacgcugauc

SEQ ID NO: 406990 - RNA, 13 nt, Bordetella pertussis
cagcgccggcagc

SEQ ID NO: 406991 - RNA, 16 nt, Bordetella pertussis
cagcgccggcagcccc

SEQ ID NO: 406992 - RNA, 22 nt, Bordetella pertussis
cagcgccggcaugaagcgcagc

SEQ ID NO: 406993 - RNA, 14 nt, Bordetella pertussis
cagcgccggcuggg

SEQ ID NO: 406994 - RNA, 15 nt, Bordetella pertussis
cagcgccggcugggc

SEQ ID NO: 406995 - RNA, 14 nt, Bordetella pertussis
cagcgccggggggc

SEQ ID NO: 406996 - RNA, 22 nt, Bordetella pertussis
cagcgccggggucagcgccggc

SEQ ID NO: 406997 - RNA, 14 nt, Bordetella pertussis
cagcgccgucagca

SEQ ID NO: 406998 - RNA, 17 nt, Bordetella pertussis
cagcgccgucagcagcg

SEQ ID NO: 406999 - RNA, 19 nt, Bordetella pertussis
cagcgccucgucgcgcaac

SEQ ID NO: 407000 - RNA, 22 nt, Bordetella pertussis
cagcgcgaaaacccgcggcagu

SEQ ID NO: 407001 - RNA, 21 nt, Bordetella pertussis
cagcgcgaaguaccagcgcac

SEQ ID NO: 407002 - RNA, 19 nt, Bordetella pertussis
cagcgcgaccggcgcgaac

SEQ ID NO: 407003 - RNA, 23 nt, Bordetella pertussis
cagcgcgacgaagccggaaccgc

SEQ ID NO: 407004 - RNA, 12 nt, Bordetella pertussis
cagcgcgacgaa

SEQ ID NO: 407005 - RNA, 19 nt, Bordetella pertussis
cagcgcgaucucgcgcagg

SEQ ID NO: 407006 - RNA, 20 nt, Bordetella pertussis
cagcgcgaucucgcgcaggg

SEQ ID NO: 407007 - RNA, 23 nt, Bordetella pertussis
cagcgcgauucccuggcgcgcca

SEQ ID NO: 407008 - RNA, 16 nt, Bordetella pertussis
cagcgcgcaggaucag

SEQ ID NO: 407009 - RNA, 16 nt, Bordetella pertussis
cagcgcgcccgaugcc

SEQ ID NO: 407010 - RNA, 16 nt, Bordetella pertussis
cagcgcgccaggcgcu

SEQ ID NO: 407011 - RNA, 12 nt, Bordetella pertussis
cagcgcgccgcc

SEQ ID NO: 407012 - RNA, 16 nt, Bordetella pertussis
cagcgcgccgcgaaac

SEQ ID NO: 407013 - RNA, 17 nt, Bordetella pertussis
cagcgcgccgcgccggg

SEQ ID NO: 407014 - RNA, 14 nt, Bordetella pertussis
cagcgcgccgcgcg

SEQ ID NO: 407015 - RNA, 19 nt, Bordetella pertussis
cagcgcgccgcgcgcggcg

SEQ ID NO: 407016 - RNA, 12 nt, Bordetella pertussis
cagcgcgccgga

SEQ ID NO: 407017 - RNA, 12 nt, Bordetella pertussis
cagcgcgccggg

SEQ ID NO: 407018 - RNA, 18 nt, Bordetella pertussis
cagcgcgccugcccaggc

SEQ ID NO: 407019 - RNA, 20 nt, Bordetella pertussis
cagcgcgcgauagauggcca

SEQ ID NO: 407020 - RNA, 16 nt, Bordetella pertussis
cagcgcgcgaucgcca

SEQ ID NO: 407021 - RNA, 19 nt, Bordetella pertussis
cagcgcgcgcagccgcgcc

SEQ ID NO: 407022 - RNA, 21 nt, Bordetella pertussis
cagcgcgcggccggccgcgcc

SEQ ID NO: 407023 - RNA, 12 nt, Bordetella pertussis
cagcgcgcggcg

SEQ ID NO: 407024 - RNA, 19 nt, Bordetella pertussis
cagcgcggcgcggccagca

SEQ ID NO: 407025 - RNA, 22 nt, Bordetella pertussis
cagcgcggcggacugcgccgca

SEQ ID NO: 407026 - RNA, 17 nt, Bordetella pertussis
cagcgcggcggcagcgc

SEQ ID NO: 407027 - RNA, 17 nt, Bordetella pertussis
cagcgcggcggccaugc

SEQ ID NO: 407028 - RNA, 23 nt, Bordetella pertussis
cagcgcggcggcgaccggcgccg

SEQ ID NO: 407029 - RNA, 14 nt, Bordetella pertussis
cagcgcggcgggcg

SEQ ID NO: 407030 - RNA, 12 nt, Bordetella pertussis
cagcgcgggcca

SEQ ID NO: 407031 - RNA, 18 nt, Bordetella pertussis
cagcgcgggccacugcgc

SEQ ID NO: 407032 - RNA, 17 nt, Bordetella pertussis
cagcgcgguggccagcg

SEQ ID NO: 407033 - RNA, 18 nt, Bordetella pertussis
cagcgcgguguugcggua

SEQ ID NO: 407034 - RNA, 21 nt, Bordetella pertussis
cagcgcucgggcucgcgcgcg

SEQ ID NO: 407035 - RNA, 18 nt, Bordetella pertussis
cagcgcugguucgaccug

SEQ ID NO: 407036 - RNA, 17 nt, Bordetella pertussis
cagcgcuucgugcagcg

SEQ ID NO: 407037 - RNA, 22 nt, Bordetella pertussis
cagcucaagaagaagccgggcu

SEQ ID NO: 407038 - RNA, 23 nt, Bordetella pertussis
cagcucauggcacagcgcggcga

SEQ ID NO: 407039 - RNA, 15 nt, Bordetella pertussis
cagcuccagccgcag

SEQ ID NO: 407040 - RNA, 17 nt, Bordetella pertussis
cagcuccagcgcgccga

SEQ ID NO: 407041 - RNA, 23 nt, Bordetella pertussis
cagcuccagcuggcgcaccaggc

SEQ ID NO: 407042 - RNA, 13 nt, Bordetella pertussis
cagcuccaggugc

SEQ ID NO: 407043 - RNA, 18 nt, Bordetella pertussis
cagcuccguauccugguc

SEQ ID NO: 407044 - RNA, 18 nt, Bordetella pertussis
cagcucgaucaggcgcuc

SEQ ID NO: 407045 - RNA, 20 nt, Bordetella pertussis
cagcucgaucaggcgcucca

SEQ ID NO: 407046 - RNA, 22 nt, Bordetella pertussis
cagcucgcagucuugcuugagg

SEQ ID NO: 407047 - RNA, 15 nt, Bordetella pertussis
cagcucgcgccaggg

SEQ ID NO: 407048 - RNA, 21 nt, Bordetella pertussis
cagcucgcgcugcgcgccgcc

SEQ ID NO: 407049 - RNA, 23 nt, Bordetella pertussis
cagcucgcgcugcgcgccgccgc

SEQ ID NO: 407050 - RNA, 19 nt, Bordetella pertussis
cagcucgcguugcaccgcg

SEQ ID NO: 407051 - RNA, 20 nt, Bordetella pertussis
cagcucgcguugcaccgcgu

SEQ ID NO: 407052 - RNA, 17 nt, Bordetella pertussis
cagcucgcuaacaaggg

SEQ ID NO: 407053 - RNA, 19 nt, Bordetella pertussis
cagcucggcccauugcggc

SEQ ID NO: 407054 - RNA, 21 nt, Bordetella pertussis
cagcucguugaccugcugggg

SEQ ID NO: 407055 - RNA, 17 nt, Bordetella pertussis
cagcucuucgagcgcgg

SEQ ID NO: 407056 - RNA, 15 nt, Bordetella pertussis
cagcuguagcccugg

SEQ ID NO: 407057 - RNA, 14 nt, Bordetella pertussis
cagcuucagccugg

SEQ ID NO: 407058 - RNA, 18 nt, Bordetella pertussis
cagcuucagccugggccu

SEQ ID NO: 407059 - RNA, 16 nt, Bordetella pertussis
cagcuugaccgccucc

SEQ ID NO: 407060 - RNA, 18 nt, Bordetella pertussis
cagcuugaccgccuccag

SEQ ID NO: 407061 - RNA, 21 nt, Bordetella pertussis
cagcuugaccuugagcacgcu

SEQ ID NO: 407062 - RNA, 17 nt, Bordetella pertussis
cagcuugaugccggcgu

SEQ ID NO: 407063 - RNA, 13 nt, Bordetella pertussis
cagcuugcccacg

SEQ ID NO: 407064 - RNA, 18 nt, Bordetella pertussis
cagcuugcccacgcgcuc

SEQ ID NO: 407065 - RNA, 13 nt, Bordetella pertussis
cagcuugcccggc

SEQ ID NO: 407066 - RNA, 16 nt, Bordetella pertussis
cagcuugcgcgccgca

SEQ ID NO: 407067 - RNA, 14 nt, Bordetella pertussis
cagcuugcgcgccu

SEQ ID NO: 407068 - RNA, 17 nt, Bordetella pertussis
cagcuugcgcgccuugg

SEQ ID NO: 407069 - RNA, 15 nt, Bordetella pertussis
cagcuugcgucccac

SEQ ID NO: 407070 - RNA, 19 nt, Bordetella pertussis
caggaacauguccaccagc

SEQ ID NO: 407071 - RNA, 23 nt, Bordetella pertussis
caggaacauguccaccagccggc

SEQ ID NO: 407072 - RNA, 15 nt, Bordetella pertussis
caggaacgccagcag

SEQ ID NO: 407073 - RNA, 16 nt, Bordetella pertussis
caggaacgccagcagc

SEQ ID NO: 407074 - RNA, 22 nt, Bordetella pertussis
caggaaguugcccaccgacaug

SEQ ID NO: 407075 - RNA, 17 nt, Bordetella pertussis
caggaauccuggugcca

SEQ ID NO: 407076 - RNA, 22 nt, Bordetella pertussis
caggaauccuggugccaguccc

SEQ ID NO: 407077 - RNA, 15 nt, Bordetella pertussis
caggacgacaggcau

SEQ ID NO: 407078 - RNA, 16 nt, Bordetella pertussis
caggacgacaggcaug

SEQ ID NO: 407079 - RNA, 22 nt, Bordetella pertussis
caggacgcgaagaucccgccgg

SEQ ID NO: 407080 - RNA, 14 nt, Bordetella pertussis
caggacggcgccgu

SEQ ID NO: 407081 - RNA, 16 nt, Bordetella pertussis
caggacggggaacagg

SEQ ID NO: 407082 - RNA, 17 nt, Bordetella pertussis
caggacggggaacaggc

SEQ ID NO: 407083 - RNA, 23 nt, Bordetella pertussis
caggacggggaacaggcgcgcca

SEQ ID NO: 407084 - RNA, 16 nt, Bordetella pertussis
caggagcaacuggggc

SEQ ID NO: 407085 - RNA, 17 nt, Bordetella pertussis
caggaugaacaucggca

SEQ ID NO: 407086 - RNA, 16 nt, Bordetella pertussis
caggaugagcgccugc

SEQ ID NO: 407087 - RNA, 14 nt, Bordetella pertussis
caggaugcccuugg

SEQ ID NO: 407088 - RNA, 16 nt, Bordetella pertussis
caggcaucagguuugc

SEQ ID NO: 407089 - RNA, 13 nt, Bordetella pertussis
caggcaugcagca

SEQ ID NO: 407090 - RNA, 15 nt, Bordetella pertussis
caggcaugcagcaug

SEQ ID NO: 407091 - RNA, 23 nt, Bordetella pertussis
caggcauucgugaugccccaggu

SEQ ID NO: 407092 - RNA, 18 nt, Bordetella pertussis
caggcauugaagcuggcg

SEQ ID NO: 407093 - RNA, 19 nt, Bordetella pertussis
caggccacgaugauggagg

SEQ ID NO: 407094 - RNA, 17 nt, Bordetella pertussis
caggccagcccgcgcgc

SEQ ID NO: 407095 - RNA, 14 nt, Bordetella pertussis
caggccagcgccgc

SEQ ID NO: 407096 - RNA, 14 nt, Bordetella pertussis
caggccagcugcgc

SEQ ID NO: 407097 - RNA, 16 nt, Bordetella pertussis
caggccagcugcgccc

SEQ ID NO: 407098 - RNA, 16 nt, Bordetella pertussis
caggccagcgccagaa

SEQ ID NO: 407099 - RNA, 13 nt, Bordetella pertussis
caggccaggcuca

SEQ ID NO: 407100 - RNA, 21 nt, Bordetella pertussis
caggccagugauggccugcuu

SEQ ID NO: 407101 - RNA, 13 nt, Bordetella pertussis
caggccagugccu

SEQ ID NO: 407102 - RNA, 16 nt, Bordetella pertussis
caggccagugccugga

SEQ ID NO: 407103 - RNA, 22 nt, Bordetella pertussis
caggccagugccuggacgcgcu

SEQ ID NO: 407104 - RNA, 13 nt, Bordetella pertussis
caggcccagccag

SEQ ID NO: 407105 - RNA, 17 nt, Bordetella pertussis
caggcccagccagcccu

SEQ ID NO: 407106 - RNA, 14 nt, Bordetella pertussis
caggcccagcccgc

SEQ ID NO: 407107 - RNA, 16 nt, Bordetella pertussis
caggcccacgaugcgg

SEQ ID NO: 407108 - RNA, 22 nt, Bordetella pertussis
caggcccaugaaggcggccagc

SEQ ID NO: 407109 - RNA, 18 nt, Bordetella pertussis
caggcccaugacgccggu

SEQ ID NO: 407110 - RNA, 16 nt, Bordetella pertussis
caggcccaugccgccc

SEQ ID NO: 407111 - RNA, 18 nt, Bordetella pertussis
caggcccaugccgcggac

SEQ ID NO: 407112 - RNA, 14 nt, Bordetella pertussis
caggccccggcccg

SEQ ID NO: 407113 - RNA, 16 nt, Bordetella pertussis
caggccccggcccggc

SEQ ID NO: 407114 - RNA, 19 nt, Bordetella pertussis
caggcccgacuuggugggc

SEQ ID NO: 407115 - RNA, 18 nt, Bordetella pertussis
caggcccgccagggccau

SEQ ID NO: 407116 - RNA, 14 nt, Bordetella pertussis
caggcccgcgcggc

SEQ ID NO: 407117 - RNA, 14 nt, Bordetella pertussis
caggcccgcggcgc

SEQ ID NO: 407118 - RNA, 19 nt, Bordetella pertussis
caggcccgggcgccugcgc

SEQ ID NO: 407119 - RNA, 14 nt, Bordetella pertussis
caggcccuggcggc

SEQ ID NO: 407120 - RNA, 13 nt, Bordetella pertussis
caggcccuggcug

SEQ ID NO: 407121 - RNA, 14 nt, Bordetella pertussis
caggcccugggcca

SEQ ID NO: 407122 - RNA, 22 nt, Bordetella pertussis
caggcccugggccagcagcugg

SEQ ID NO: 407123 - RNA, 13 nt, Bordetella pertussis
caggcccugggcg

SEQ ID NO: 407124 - RNA, 16 nt, Bordetella pertussis
caggcccuggggccgc

SEQ ID NO: 407125 - RNA, 21 nt, Bordetella pertussis
caggcccuggggccgcggcgc

SEQ ID NO: 407126 - RNA, 11 nt, Bordetella pertussis
caggcccugua

SEQ ID NO: 407127 - RNA, 16 nt, Bordetella pertussis
caggcccuugaucagg

SEQ ID NO: 407128 - RNA, 23 nt, Bordetella pertussis
caggccgaaauggcggcgguagc

SEQ ID NO: 407129 - RNA, 20 nt, Bordetella pertussis
caggccgaacugggacaggc

SEQ ID NO: 407130 - RNA, 21 nt, Bordetella pertussis
caggccgaacuucagcccggg

SEQ ID NO: 407131 - RNA, 18 nt, Bordetella pertussis
caggccgacgcgcugucc

SEQ ID NO: 407132 - RNA, 19 nt, Bordetella pertussis
caggccgaucagcgacagc

SEQ ID NO: 407133 - RNA, 15 nt, Bordetella pertussis
caggccgaugccgaa

SEQ ID NO: 407134 - RNA, 20 nt, Bordetella pertussis
caggccgaugcguccgccgu

SEQ ID NO: 407135 - RNA, 12 nt, Bordetella pertussis
caggccgaugcu

SEQ ID NO: 407136 - RNA, 23 nt, Bordetella pertussis
caggccgauguagcccauggcca

SEQ ID NO: 407137 - RNA, 17 nt, Bordetella pertussis
caggccgcagcgggccc

SEQ ID NO: 407138 - RNA, 17 nt, Bordetella pertussis
caggccgccccaacggc

SEQ ID NO: 407139 - RNA, 16 nt, Bordetella pertussis
caggccgaugaauugc

SEQ ID NO: 407140 - RNA, 19 nt, Bordetella pertussis
caggccgccggccagcgcc

SEQ ID NO: 407141 - RNA, 19 nt, Bordetella pertussis
caggccgccggggaggccu

SEQ ID NO: 407142 - RNA, 20 nt, Bordetella pertussis
caggccgccggucacugccg

SEQ ID NO: 407143 - RNA, 18 nt, Bordetella pertussis
caggccgccguguaggcg

SEQ ID NO: 407144 - RNA, 20 nt, Bordetella pertussis
caggccgccuauguaggcgc

SEQ ID NO: 407145 - RNA, 19 nt, Bordetella pertussis
caggccgcgcagcacgccc

SEQ ID NO: 407146 - RNA, 15 nt, Bordetella pertussis
caggccgcgcagggc

SEQ ID NO: 407147 - RNA, 17 nt, Bordetella pertussis
caggccgcgccacaggc

SEQ ID NO: 407148 - RNA, 17 nt, Bordetella pertussis
caggccgcgccggcucc

SEQ ID NO: 407149 - RNA, 17 nt, Bordetella pertussis
caggccgcgcugccagc

SEQ ID NO: 407150 - RNA, 18 nt, Bordetella pertussis
caggccgcggccaggccc

SEQ ID NO: 407151 - RNA, 21 nt, Bordetella pertussis
caggccgcggcgcccggugcg

SEQ ID NO: 407152 - RNA, 23 nt, Bordetella pertussis
caggccgcugggcacauccagcg

SEQ ID NO: 407153 - RNA, 14 nt, Bordetella pertussis
caggccggccagca

SEQ ID NO: 407154 - RNA, 16 nt, Bordetella pertussis
caggccggccagcaag

SEQ ID NO: 407155 - RNA, 17 nt, Bordetella pertussis
caggccggccagcaagg

SEQ ID NO: 407156 - RNA, 14 nt, Bordetella pertussis
caggccggccugca

SEQ ID NO: 407157 - RNA, 15 nt, Bordetella pertussis
caggccggccugcaa

SEQ ID NO: 407158 - RNA, 14 nt, Bordetella pertussis
caggccggccuugg

SEQ ID NO: 407159 - RNA, 17 nt, Bordetella pertussis
caggccggcgccugggg

SEQ ID NO: 407160 - RNA, 18 nt, Bordetella pertussis
caggccggcgccuggggc

SEQ ID NO: 407161 - RNA, 15 nt, Bordetella pertussis
caggccggcgcgccg

SEQ ID NO: 407162 - RNA, 17 nt, Bordetella pertussis
caggccggcgcgccggc

SEQ ID NO: 407163 - RNA, 15 nt, Bordetella pertussis
caggccggcgcgcgc

SEQ ID NO: 407164 - RNA, 14 nt, Bordetella pertussis
caggccggcgcgcu

SEQ ID NO: 407165 - RNA, 16 nt, Bordetella pertussis
caggccggcggccagc

SEQ ID NO: 407166 - RNA, 20 nt, Bordetella pertussis
caggccggcggccagcgcgc

SEQ ID NO: 407167 - RNA, 18 nt, Bordetella pertussis
caggccggcgccagccgc

SEQ ID NO: 407168 - RNA, 19 nt, Bordetella pertussis
caggccggggaaacggcca

SEQ ID NO: 407169 - RNA, 16 nt, Bordetella pertussis
caggccggggccgccc

SEQ ID NO: 407170 - RNA, 18 nt, Bordetella pertussis
caggccgguggaccaggg

SEQ ID NO: 407171 - RNA, 23 nt, Bordetella pertussis
caggccgguggaccagggcacgg

SEQ ID NO: 407172 - RNA, 22 nt, Bordetella pertussis
caggccguaaccggccaguccc

SEQ ID NO: 407173 - RNA, 21 nt, Bordetella pertussis
caggccucgcccgaucggccg

SEQ ID NO: 407174 - RNA, 17 nt, Bordetella pertussis
caggccucggucgccuc

SEQ ID NO: 407175 - RNA, 16 nt, Bordetella pertussis
caggccugcacguccc

SEQ ID NO: 407176 - RNA, 14 nt, Bordetella pertussis
caggccugccugau

SEQ ID NO: 407177 - RNA, 14 nt, Bordetella pertussis
caggccugcggcgc

SEQ ID NO: 407178 - RNA, 19 nt, Bordetella pertussis
caggccugcggcgccagcg

SEQ ID NO: 407179 - RNA, 23 nt, Bordetella pertussis
caggccuggcuuggcggccagga

SEQ ID NO: 407180 - RNA, 17 nt, Bordetella pertussis
caggccuggucgagcgg

SEQ ID NO: 407181 - RNA, 13 nt, Bordetella pertussis
caggcgaugccca

SEQ ID NO: 407182 - RNA, 14 nt, Bordetella pertussis
caggcgaugcccag

SEQ ID NO: 407183 - RNA, 14 nt, Bordetella pertussis
caggcgcacgccgc

SEQ ID NO: 407184 - RNA, 13 nt, Bordetella pertussis
caggcgcacggcg

SEQ ID NO: 407185 - RNA, 17 nt, Bordetella pertussis
caggcgcaggccgcgcg

SEQ ID NO: 407186 - RNA, 14 nt, Bordetella pertussis
caggcgguacaggc

SEQ ID NO: 407187 - RNA, 14 nt, Bordetella pertussis
caggcgguccuggu

SEQ ID NO: 407188 - RNA, 20 nt, Bordetella pertussis
caggcggugccccggccucg

SEQ ID NO: 407189 - RNA, 23 nt, Bordetella pertussis
caggcuaucguggcuggcgagga

SEQ ID NO: 407190 - RNA, 15 nt, Bordetella pertussis
caggcucagcccggc

SEQ ID NO: 407191 - RNA, 22 nt, Bordetella pertussis
caggcucaggcggccagggccu

SEQ ID NO: 407192 - RNA, 22 nt, Bordetella pertussis
caggcuccaguggugcucccag

SEQ ID NO: 407193 - RNA, 14 nt, Bordetella pertussis
caggcugccgucgg

SEQ ID NO: 407194 - RNA, 16 nt, Bordetella pertussis
caggcugccgucggcc

SEQ ID NO: 407195 - RNA, 14 nt, Bordetella pertussis
caggcugccgucgu

SEQ ID NO: 407196 - RNA, 18 nt, Bordetella pertussis
caggcugcgcgccggcgc

SEQ ID NO: 407197 - RNA, 19 nt, Bordetella pertussis
caggcugcgcgccggcgcc

SEQ ID NO: 407198 - RNA, 16 nt, Bordetella pertussis
caggcugcugugccug

SEQ ID NO: 407199 - RNA, 22 nt, Bordetella pertussis
caggcugcugugccugccaagc

SEQ ID NO: 407200 - RNA, 14 nt, Bordetella pertussis
caggcuggcaugga

SEQ ID NO: 407201 - RNA, 13 nt, Bordetella pertussis
caggcuggccacc

SEQ ID NO: 407202 - RNA, 19 nt, Bordetella pertussis
caggcuggaagucagccgg

SEQ ID NO: 407203 - RNA, 22 nt, Bordetella pertussis
caggcuggaagucagccggugc

SEQ ID NO: 407204 - RNA, 20 nt, Bordetella pertussis
caggcugggagagccggcca

SEQ ID NO: 407205 - RNA, 23 nt, Bordetella pertussis
caggcugggagagccggccacgc

SEQ ID NO: 407206 - RNA, 23 nt, Bordetella pertussis
caggcuggccggcguggccugcc

SEQ ID NO: 407207 - RNA, 24 nt, Bordetella pertussis
caggcugucgucgucggcaccuuc

SEQ ID NO: 407208 - RNA, 22 nt, Bordetella pertussis
caggcuguggccgcggcccagc

SEQ ID NO: 407209 - RNA, 20 nt, Bordetella pertussis
cagggaccaauacgccgcca

SEQ ID NO: 407210 - RNA, 22 nt, Bordetella pertussis
cagggaccaauacgccgccaug

SEQ ID NO: 407211 - RNA, 17 nt, Bordetella pertussis
cagggaccaccccgaga

SEQ ID NO: 407212 - RNA, 21 nt, Bordetella pertussis
cagggagccguucuggcagug

SEQ ID NO: 407213 - RNA, 21 nt, Bordetella pertussis
cagggaggcuguccccgcaug

SEQ ID NO: 407214 - RNA, 13 nt, Bordetella pertussis
cagggcagcggcc

SEQ ID NO: 407215 - RNA, 14 nt, Bordetella pertussis
cagggcagcggcca

SEQ ID NO: 407216 - RNA, 15 nt, Bordetella pertussis
cagggcaggaggcgc

SEQ ID NO: 407217 - RNA, 15 nt, Bordetella pertussis
cagggcaugggcccg

SEQ ID NO: 407218 - RNA, 15 nt, Bordetella pertussis
cagggccaccacgcc

SEQ ID NO: 407219 - RNA, 14 nt, Bordetella pertussis
cagggccagcgcca

SEQ ID NO: 407220 - RNA, 15 nt, Bordetella pertussis
cagggccagcuugac

SEQ ID NO: 407221 - RNA, 20 nt, Bordetella pertussis
cagggccagcuugacgucca

SEQ ID NO: 407222 - RNA, 19 nt, Bordetella pertussis
cagggccaggcccacggcg

SEQ ID NO: 407223 - RNA, 16 nt, Bordetella pertussis
cagggccgcagcaccu

SEQ ID NO: 407224 - RNA, 22 nt, Bordetella pertussis
cagggccgccagggcggcugcc

SEQ ID NO: 407225 - RNA, 23 nt, Bordetella pertussis
cagggccgcccagucguccagca

SEQ ID NO: 407226 - RNA, 21 nt, Bordetella pertussis
cagggccgccgcgcccagccg

SEQ ID NO: 407227 - RNA, 22 nt, Bordetella pertussis
cagggccgccgcgcccagccgc

SEQ ID NO: 407228 - RNA, 11 nt, Bordetella pertussis
cagggccgcga

SEQ ID NO: 407229 - RNA, 11 nt, Bordetella pertussis
cagggccgcca

SEQ ID NO: 407230 - RNA, 12 nt, Bordetella pertussis
cagggccgccag

SEQ ID NO: 407231 - RNA, 17 nt, Bordetella pertussis
cagggccgccagcaccu

SEQ ID NO: 407232 - RNA, 21 nt, Bordetella pertussis
cagggccggccgggcgcggcg

SEQ ID NO: 407233 - RNA, 16 nt, Bordetella pertussis
cagggccuccugcagc

SEQ ID NO: 407234 - RNA, 17 nt, Bordetella pertussis
cagggccucgcgggccu

SEQ ID NO: 407235 - RNA, 20 nt, Bordetella pertussis
cagggcggaaaacagcacca

SEQ ID NO: 407236 - RNA, 19 nt, Bordetella pertussis
cagggcggccucgacggcc

SEQ ID NO: 407237 - RNA, 20 nt, Bordetella pertussis
cagggcgggcgggauuaugc

SEQ ID NO: 407238 - RNA, 23 nt, Bordetella pertussis
cagggcgucggccgcgcccaggu

SEQ ID NO: 407239 - RNA, 17 nt, Bordetella pertussis
cagggcgucugcucgcc

SEQ ID NO: 407240 - RNA, 17 nt, Bordetella pertussis
caggggcaggcgcacgc

SEQ ID NO: 407241 - RNA, 21 nt, Bordetella pertussis
caggggcaggugccccacgcc

SEQ ID NO: 407242 - RNA, 17 nt, Bordetella pertussis
caggggccggcgcgccg

SEQ ID NO: 407243 - RNA, 19 nt, Bordetella pertussis
caggggcucggccaggugc

SEQ ID NO: 407244 - RNA, 19 nt, Bordetella pertussis
cagggggacuggcacccgc

SEQ ID NO: 407245 - RNA, 19 nt, Bordetella pertussis
cagggggcgccccaacgcg

SEQ ID NO: 407246 - RNA, 20 nt, Bordetella pertussis
cagguauugcggggcggcgu

SEQ ID NO: 407247 - RNA, 22 nt, Bordetella pertussis
cagguccacauccgcgcugcug

SEQ ID NO: 407248 - RNA, 16 nt, Bordetella pertussis
cagguccaccgccacg

SEQ ID NO: 407249 - RNA, 17 nt, Bordetella pertussis
cagguccacuucaccgc

SEQ ID NO: 407250 - RNA, 14 nt, Bordetella pertussis
cagguccaggccug

SEQ ID NO: 407251 - RNA, 15 nt, Bordetella pertussis
cagguccauggccag

SEQ ID NO: 407252 - RNA, 17 nt, Bordetella pertussis
cagguccugcgccagcu

SEQ ID NO: 407253 - RNA, 18 nt, Bordetella pertussis
cagguccuugagguacca

SEQ ID NO: 407254 - RNA, 19 nt, Bordetella pertussis
caggucgaacaggcuggug

SEQ ID NO: 407255 - RNA, 18 nt, Bordetella pertussis
caggucgaccugcuugcc

SEQ ID NO: 407256 - RNA, 15 nt, Bordetella pertussis
caggucgccagcagg

SEQ ID NO: 407257 - RNA, 16 nt, Bordetella pertussis
caggucgccagcaggc

SEQ ID NO: 407258 - RNA, 14 nt, Bordetella pertussis
caggucgccgccgc

SEQ ID NO: 407259 - RNA, 18 nt, Bordetella pertussis
caggucgccgaagggcag

SEQ ID NO: 407260 - RNA, 15 nt, Bordetella pertussis
caggucgcgcacgcu

SEQ ID NO: 407261 - RNA, 18 nt, Bordetella pertussis
caggucgcggugcgccac

SEQ ID NO: 407262 - RNA, 14 nt, Bordetella pertussis
caggucgcugccca

SEQ ID NO: 407263 - RNA, 19 nt, Bordetella pertussis
caggucggagucggcgccg

SEQ ID NO: 407264 - RNA, 21 nt, Bordetella pertussis
caggucggagucggcgccgcg

SEQ ID NO: 407265 - RNA, 14 nt, Bordetella pertussis
caggucggccaccg

SEQ ID NO: 407266 - RNA, 13 nt, Bordetella pertussis
caggucggccagg

SEQ ID NO: 407267 - RNA, 15 nt, Bordetella pertussis
caggucggcgaugcg

SEQ ID NO: 407268 - RNA, 18 nt, Bordetella pertussis
caggucggcggccagcgc

SEQ ID NO: 407269 - RNA, 15 nt, Bordetella pertussis
caggucggugcacac

SEQ ID NO: 407270 - RNA, 14 nt, Bordetella pertussis
caggucugcacgag

SEQ ID NO: 407271 - RNA, 22 nt, Bordetella pertussis
caggugaugcgcgcggccagcg

SEQ ID NO: 407272 - RNA, 23 nt, Bordetella pertussis
caggugcaggguuggcgcgccgu

SEQ ID NO: 407273 - RNA, 23 nt, Bordetella pertussis
caggugccgccggcgcggcugcu

SEQ ID NO: 407274 - RNA, 17 nt, Bordetella pertussis
caggugccuguccccac

SEQ ID NO: 407275 - RNA, 17 nt, Bordetella pertussis
caggugcgcggcgcgcc

SEQ ID NO: 407276 - RNA, 14 nt, Bordetella pertussis
caggugcggccgca

SEQ ID NO: 407277 - RNA, 15 nt, Bordetella pertussis
caggugcgggccgcu

SEQ ID NO: 407278 - RNA, 16 nt, Bordetella pertussis
caggugcgggccgcuc

SEQ ID NO: 407279 - RNA, 19 nt, Bordetella pertussis
caggugcgggccgcucagu

SEQ ID NO: 407280 - RNA, 19 nt, Bordetella pertussis
caggugcgucacgcacagc

SEQ ID NO: 407281 - RNA, 20 nt, Bordetella pertussis
caggugcgucacgcacagca

SEQ ID NO: 407282 - RNA, 21 nt, Bordetella pertussis
caggugcuuggcggucugggc

SEQ ID NO: 407283 - RNA, 23 nt, Bordetella pertussis
cagguggcccgcaccgggcggcc

SEQ ID NO: 407284 - RNA, 18 nt, Bordetella pertussis
cagguggcggacaggccc

SEQ ID NO: 407285 - RNA, 20 nt, Bordetella pertussis
cagguggcggacaggcccuc

SEQ ID NO: 407286 - RNA, 15 nt, Bordetella pertussis
cagguggcggcggca

SEQ ID NO: 407287 - RNA, 16 nt, Bordetella pertussis
caggugggccgagccc

SEQ ID NO: 407288 - RNA, 17 nt, Bordetella pertussis
cagguguucgcgcacca

SEQ ID NO: 407289 - RNA, 15 nt, Bordetella pertussis
cagguuagcggcagu

SEQ ID NO: 407290 - RNA, 16 nt, Bordetella pertussis
cagguucugcgcgucc

SEQ ID NO: 407291 - RNA, 18 nt, Bordetella pertussis
cagguugagucuggagau

SEQ ID NO: 407292 - RNA, 17 nt, Bordetella pertussis
cagguugaucuucuucg

SEQ ID NO: 407293 - RNA, 18 nt, Bordetella pertussis
cagguugcauccggcccg

SEQ ID NO: 407294 - RNA, 21 nt, Bordetella pertussis
cagguugcggccgccacccag

SEQ ID NO: 407295 - RNA, 22 nt, Bordetella pertussis
cagguugcgguaguucagcagc

SEQ ID NO: 407296 - RNA, 14 nt, Bordetella pertussis
cagguuggccgcga

SEQ ID NO: 407297 - RNA, 14 nt, Bordetella pertussis
cagguuggcgaugg

SEQ ID NO: 407298 - RNA, 17 nt, Bordetella pertussis
cagguugggcaccacca

SEQ ID NO: 407299 - RNA, 21 nt, Bordetella pertussis
cagguugggcaccaccaccgc

SEQ ID NO: 407300 - RNA, 18 nt, Bordetella pertussis
cagguugggugcgccgcc

SEQ ID NO: 407301 - RNA, 17 nt, Bordetella pertussis
cagguuuuccacagcca

SEQ ID NO: 407302 - RNA, 13 nt, Bordetella pertussis
caguacaggcugc

SEQ ID NO: 407303 - RNA, 17 nt, Bordetella pertussis
caguacccggugcagcg

SEQ ID NO: 407304 - RNA, 16 nt, Bordetella pertussis
caguaccugacccugc

SEQ ID NO: 407305 - RNA, 20 nt, Bordetella pertussis
caguacgagaacgcgucgcu

SEQ ID NO: 407306 - RNA, 18 nt, Bordetella pertussis
caguacguacgcccggcc

SEQ ID NO: 407307 - RNA, 19 nt, Bordetella pertussis
caguaucccggccaggcgc

SEQ ID NO: 407308 - RNA, 14 nt, Bordetella pertussis
caguaugggcuguc

SEQ ID NO: 407309 - RNA, 18 nt, Bordetella pertussis
caguauggugaccggcgu

SEQ ID NO: 407310 - RNA, 16 nt, Bordetella pertussis
caguccaaggaaagcc

SEQ ID NO: 407311 - RNA, 22 nt, Bordetella pertussis
caguccaaggaaagcccggccc

SEQ ID NO: 407312 - RNA, 19 nt, Bordetella pertussis
caguccagcuggcccuggc

SEQ ID NO: 407313 - RNA, 22 nt, Bordetella pertussis
caguccaggccggccugcaaug

SEQ ID NO: 407314 - RNA, 13 nt, Bordetella pertussis
caguccagggugu

SEQ ID NO: 407315 - RNA, 17 nt, Bordetella pertussis
caguccaggguguccug

SEQ ID NO: 407316 - RNA, 13 nt, Bordetella pertussis
cagucccaguccg

SEQ ID NO: 407317 - RNA, 20 nt, Bordetella pertussis
caguccccaugcggccccuc

SEQ ID NO: 407318 - RNA, 22 nt, Bordetella pertussis
caguccccauguggggacaggc

SEQ ID NO: 407319 - RNA, 18 nt, Bordetella pertussis
caguccccgcagggacag

SEQ ID NO: 407320 - RNA, 22 nt, Bordetella pertussis
caguccccgcauggggacuggc

SEQ ID NO: 407321 - RNA, 22 nt, Bordetella pertussis
caguccccguucggggacaggc

SEQ ID NO: 407322 - RNA, 16 nt, Bordetella pertussis
caguccccugcgggga

SEQ ID NO: 407323 - RNA, 21 nt, Bordetella pertussis
caguccccugcggggacaggc

SEQ ID NO: 407324 - RNA, 15 nt, Bordetella pertussis
cagucccgcaccggg

SEQ ID NO: 407325 - RNA, 16 nt, Bordetella pertussis
cagucccgcaccgggc

SEQ ID NO: 407326 - RNA, 17 nt, Bordetella pertussis
cagucccgcaccgggca

SEQ ID NO: 407327 - RNA, 19 nt, Bordetella pertussis
caguccgcgcucgcccagc

SEQ ID NO: 407328 - RNA, 20 nt, Bordetella pertussis
caguccgcgcucgcccagcc

SEQ ID NO: 407329 - RNA, 23 nt, Bordetella pertussis
cagucgcgcacgaagccgaugcg

SEQ ID NO: 407330 - RNA, 20 nt, Bordetella pertussis
cagucggccuggcgcuccuc

SEQ ID NO: 407331 - RNA, 16 nt, Bordetella pertussis
cagucguccagcacgc

SEQ ID NO: 407332 - RNA, 13 nt, Bordetella pertussis
cagucguccuccg

SEQ ID NO: 407333 - RNA, 14 nt, Bordetella pertussis
cagucuccaggcuc

SEQ ID NO: 407334 - RNA, 20 nt, Bordetella pertussis
cauagacggcgucgggcagc

SEQ ID NO: 407335 - RNA, 12 nt, Bordetella pertussis
cauagcgccggu

SEQ ID NO: 407336 - RNA, 13 nt, Bordetella pertussis
cauaggccggcac

SEQ ID NO: 407337 - RNA, 18 nt, Bordetella pertussis
cauaggcgcgcaccagcc

SEQ ID NO: 407338 - RNA, 20 nt, Bordetella pertussis
cauaggcuucgcccgccacc

SEQ ID NO: 407339 - RNA, 16 nt, Bordetella pertussis
caucaccagcucgcgg

SEQ ID NO: 407340 - RNA, 17 nt, Bordetella pertussis
caucaccuucccgcuuu

SEQ ID NO: 407341 - RNA, 23 nt, Bordetella pertussis
caucagcacgaucuggcgcgcga

SEQ ID NO: 407342 - RNA, 17 nt, Bordetella pertussis
caucagcagacccuggc

SEQ ID NO: 407343 - RNA, 14 nt, Bordetella pertussis
caucagcagcaccu

SEQ ID NO: 407344 - RNA, 14 nt, Bordetella pertussis
caucauggccaggg

SEQ ID NO: 407345 - RNA, 14 nt, Bordetella pertussis
cauccacggcgcca

SEQ ID NO: 407346 - RNA, 21 nt, Bordetella pertussis
cauccagcgccagcaccggca

SEQ ID NO: 407347 - RNA, 22 nt, Bordetella pertussis
cauccaggcgcucaagggccug

SEQ ID NO: 407348 - RNA, 15 nt, Bordetella pertussis
cauccagguacgacc

SEQ ID NO: 407349 - RNA, 14 nt, Bordetella pertussis
cauccagguggcgg

SEQ ID NO: 407350 - RNA, 14 nt, Bordetella pertussis
caucccaauuggcc

SEQ ID NO: 407351 - RNA, 18 nt, Bordetella pertussis
caucccagacagccacgc

SEQ ID NO: 407352 - RNA, 16 nt, Bordetella pertussis
caucccauccgcgcca

SEQ ID NO: 407353 - RNA, 14 nt, Bordetella pertussis
cauccccagcgccg

SEQ ID NO: 407354 - RNA, 15 nt, Bordetella pertussis
caucccgcccccgcc

SEQ ID NO: 407355 - RNA, 13 nt, Bordetella pertussis
cauccgcauacaa

SEQ ID NO: 407356 - RNA, 14 nt, Bordetella pertussis
cauccgcgccacac

SEQ ID NO: 407357 - RNA, 19 nt, Bordetella pertussis
cauccggcccggugcagcc

SEQ ID NO: 407358 - RNA, 15 nt, Bordetella pertussis
cauccggcgcaugau

SEQ ID NO: 407359 - RNA, 23 nt, Bordetella pertussis
caucgaacgugcugacgguaagc

SEQ ID NO: 407360 - RNA, 18 nt, Bordetella pertussis
caucgagaaaccagccgc

SEQ ID NO: 407361 - RNA, 12 nt, Bordetella pertussis
caucgagcaccg

SEQ ID NO: 407362 - RNA, 20 nt, Bordetella pertussis
caucgagcgccugggcggcc

SEQ ID NO: 407363 - RNA, 21 nt, Bordetella pertussis
caucgagcgccugggcggcca

SEQ ID NO: 407364 - RNA, 17 nt, Bordetella pertussis
caucgagcuccugcagg

SEQ ID NO: 407365 - RNA, 17 nt, Bordetella pertussis
caucgccaugccggccc

SEQ ID NO: 407366 - RNA, 18 nt, Bordetella pertussis
caucgccaugccggcccc

SEQ ID NO: 407367 - RNA, 13 nt, Bordetella pertussis
caucgccaugcug

SEQ ID NO: 407368 - RNA, 16 nt, Bordetella pertussis
caucggcaggccggcg

SEQ ID NO: 407369 - RNA, 23 nt, Bordetella pertussis
caucggccggcggucgcgcuggc

SEQ ID NO: 407370 - RNA, 15 nt, Bordetella pertussis
caucggccugcaccg

SEQ ID NO: 407371 - RNA, 15 nt, Bordetella pertussis
caucggcgccgcgcg

SEQ ID NO: 407372 - RNA, 23 nt, Bordetella pertussis
caucggcuggcgcaagacgcggc

SEQ ID NO: 407373 - RNA, 23 nt, Bordetella pertussis
caucgggauccgugcggcgcgca

SEQ ID NO: 407374 - RNA, 15 nt, Bordetella pertussis
caucgggcagggcuu

SEQ ID NO: 407375 - RNA, 18 nt, Bordetella pertussis
caucgggcagggcuucca

SEQ ID NO: 407376 - RNA, 16 nt, Bordetella pertussis
caucgggccggcggca

SEQ ID NO: 407377 - RNA, 22 nt, Bordetella pertussis
caucggggggcaggcuggaagu

SEQ ID NO: 407378 - RNA, 19 nt, Bordetella pertussis
caucgugcgcgaucuugcc

SEQ ID NO: 407379 - RNA, 15 nt, Bordetella pertussis
caucguggccgcgca

SEQ ID NO: 407380 - RNA, 16 nt, Bordetella pertussis
caucuugccggccugu

SEQ ID NO: 407381 - RNA, 14 nt, Bordetella pertussis
caucuugccuuggc

SEQ ID NO: 407382 - RNA, 17 nt, Bordetella pertussis
caugaaagcgaacaggg

SEQ ID NO: 407383 - RNA, 18 nt, Bordetella pertussis
caugaacacuugacggcc

SEQ ID NO: 407384 - RNA, 19 nt, Bordetella pertussis
caugaacacuugacggcca

SEQ ID NO: 407385 - RNA, 17 nt, Bordetella pertussis
caugaaccgcagcgcca

SEQ ID NO: 407386 - RNA, 20 nt, Bordetella pertussis
caugaaccgcagcgccaccg

SEQ ID NO: 407387 - RNA, 19 nt, Bordetella pertussis
caugaacgcuugacggcca

SEQ ID NO: 407388 - RNA, 22 nt, Bordetella pertussis
caugaacgcuugacggccagga

SEQ ID NO: 407389 - RNA, 16 nt, Bordetella pertussis
caugaacggcagcgcg

SEQ ID NO: 407390 - RNA, 23 nt, Bordetella pertussis
caugaacgccgcgcccgcccccu

SEQ ID NO: 407391 - RNA, 16 nt, Bordetella pertussis
caugaaggcggccagc

SEQ ID NO: 407392 - RNA, 15 nt, Bordetella pertussis
caugaagcugcccag

SEQ ID NO: 407393 - RNA, 19 nt, Bordetella pertussis
caugacaugcgggccucga

SEQ ID NO: 407394 - RNA, 23 nt, Bordetella pertussis
caugaccagcggcgugaugccca

SEQ ID NO: 407395 - RNA, 12 nt, Bordetella pertussis
caugaccgccgc

SEQ ID NO: 407396 - RNA, 14 nt, Bordetella pertussis
caugaccgccgcca

SEQ ID NO: 407397 - RNA, 18 nt, Bordetella pertussis
caugaccgccgccagcag

SEQ ID NO: 407398 - RNA, 15 nt, Bordetella pertussis
caugaccgccgcgcc

SEQ ID NO: 407399 - RNA, 18 nt, Bordetella pertussis
caugaccgccgcgccggu

SEQ ID NO: 407400 - RNA, 20 nt, Bordetella pertussis
caugaccggcguguccagcg

SEQ ID NO: 407401 - RNA, 16 nt, Bordetella pertussis
caugaccucggccugc

SEQ ID NO: 407402 - RNA, 18 nt, Bordetella pertussis
caugaccugcgacagcac

SEQ ID NO: 407403 - RNA, 20 nt, Bordetella pertussis
caugaccugcgacagcaccg

SEQ ID NO: 407404 - RNA, 16 nt, Bordetella pertussis
caugacggggccuuca

SEQ ID NO: 407405 - RNA, 18 nt, Bordetella pertussis
caugacggugccgagcag

SEQ ID NO: 407406 - RNA, 17 nt, Bordetella pertussis
caugacguccagcgcca

SEQ ID NO: 407407 - RNA, 16 nt, Bordetella pertussis
caugacguccggcggg

SEQ ID NO: 407408 - RNA, 20 nt, Bordetella pertussis
caugagcgccucguuccugu

SEQ ID NO: 407409 - RNA, 19 nt, Bordetella pertussis
caugagcugaugcucgccc

SEQ ID NO: 407410 - RNA, 22 nt, Bordetella pertussis
caugaggaacggcaccagccgg

SEQ ID NO: 407411 - RNA, 21 nt, Bordetella pertussis
caugaggcggcgguaccaggc

SEQ ID NO: 407412 - RNA, 22 nt, Bordetella pertussis
caugauccgcaccggugggagc

SEQ ID NO: 407413 - RNA, 21 nt, Bordetella pertussis
caugaucgccggcaacguggu

SEQ ID NO: 407414 - RNA, 12 nt, Bordetella pertussis
caugaugcccag

SEQ ID NO: 407415 - RNA, 22 nt, Bordetella pertussis
caugaugcccagcgccagggcc

SEQ ID NO: 407416 - RNA, 20 nt, Bordetella pertussis
caugaugcgcugggccaggc

SEQ ID NO: 407417 - RNA, 21 nt, Bordetella pertussis
caugauuccugucgcgcugcu

SEQ ID NO: 407418 - RNA, 23 nt, Bordetella pertussis
caugauuucgaucacggcgcgcg

SEQ ID NO: 407419 - RNA, 22 nt, Bordetella pertussis
caugcaacacgaccagcaggcc

SEQ ID NO: 407420 - RNA, 15 nt, Bordetella pertussis
caugcaccagcacau

SEQ ID NO: 407421 - RNA, 14 nt, Bordetella pertussis
caugcaccaggcgu

SEQ ID NO: 407422 - RNA, 17 nt, Bordetella pertussis
caugcagaacagggugc

SEQ ID NO: 407423 - RNA, 21 nt, Bordetella pertussis
caugcagaacagggugccgcc

SEQ ID NO: 407424 - RNA, 21 nt, Bordetella pertussis
caugccauggccgcgcggcgc

SEQ ID NO: 407425 - RNA, 14 nt, Bordetella pertussis
caugcccaggccca

SEQ ID NO: 407426 - RNA, 16 nt, Bordetella pertussis
caugcccaggcccagu

SEQ ID NO: 407427 - RNA, 16 nt, Bordetella pertussis
caugccccauccagcg

SEQ ID NO: 407428 - RNA, 23 nt, Bordetella pertussis
caugcccgccggcacccggcuca

SEQ ID NO: 407429 - RNA, 15 nt, Bordetella pertussis
caugcccggccacca

SEQ ID NO: 407430 - RNA, 15 nt, Bordetella pertussis
caugcccuccucggc

SEQ ID NO: 407431 - RNA, 18 nt, Bordetella pertussis
caugccgaccaccagcac

SEQ ID NO: 407432 - RNA, 19 nt, Bordetella pertussis
caugccgaccaccagcacc

SEQ ID NO: 407433 - RNA, 12 nt, Bordetella pertussis
caugccgccaug

SEQ ID NO: 407434 - RNA, 14 nt, Bordetella pertussis
caugccgcgcgcgc

SEQ ID NO: 407435 - RNA, 18 nt, Bordetella pertussis
caugccgcggacccaggc

SEQ ID NO: 407436 - RNA, 21 nt, Bordetella pertussis
caugccgcgggcggcgccggc

SEQ ID NO: 407437 - RNA, 17 nt, Bordetella pertussis
caugccgcugcccagcg

SEQ ID NO: 407438 - RNA, 19 nt, Bordetella pertussis
caugccggcaagcacgaac

SEQ ID NO: 407439 - RNA, 18 nt, Bordetella pertussis
caugccggacaagccccu

SEQ ID NO: 407440 - RNA, 20 nt, Bordetella pertussis
caugccggccaugcucagca

SEQ ID NO: 407441 - RNA, 22 nt, Bordetella pertussis
caugccguccacgcccagcgcc

SEQ ID NO: 407442 - RNA, 16 nt, Bordetella pertussis
caugccguccugcugc

SEQ ID NO: 407443 - RNA, 17 nt, Bordetella pertussis
caugccgucgagcgcga

SEQ ID NO: 407444 - RNA, 18 nt, Bordetella pertussis
caugccgucuggcggcag

SEQ ID NO: 407445 - RNA, 16 nt, Bordetella pertussis
caugcgaaagccggcc

SEQ ID NO: 407446 - RNA, 16 nt, Bordetella pertussis
caugcgaaagcggcca

SEQ ID NO: 407447 - RNA, 21 nt, Bordetella pertussis
caugcgaaugaucucgcgcuu

SEQ ID NO: 407448 - RNA, 13 nt, Bordetella pertussis
caugcgacagccc

SEQ ID NO: 407449 - RNA, 16 nt, Bordetella pertussis
caugcgauagcgggcc

SEQ ID NO: 407450 - RNA, 16 nt, Bordetella pertussis
caugcgcaccaccgcc

SEQ ID NO: 407451 - RNA, 16 nt, Bordetella pertussis
caugcgcaccuugucg

SEQ ID NO: 407452 - RNA, 16 nt, Bordetella pertussis
caugcgcacggacagc

SEQ ID NO: 407453 - RNA, 18 nt, Bordetella pertussis
caugcgcacggacagccc

SEQ ID NO: 407454 - RNA, 14 nt, Bordetella pertussis
caugcgccagcagg

SEQ ID NO: 407455 - RNA, 18 nt, Bordetella pertussis
caugcgccagcaggaugu

SEQ ID NO: 407456 - RNA, 19 nt, Bordetella pertussis
caugcgccagcaggauguc

SEQ ID NO: 407457 - RNA, 14 nt, Bordetella pertussis
caugcgccagccag

SEQ ID NO: 407458 - RNA, 15 nt, Bordetella pertussis
caugcgccagcgccu

SEQ ID NO: 407459 - RNA, 19 nt, Bordetella pertussis
caugcgccagcgccugggc

SEQ ID NO: 407460 - RNA, 13 nt, Bordetella pertussis
caugcgcaugcug

SEQ ID NO: 407461 - RNA, 15 nt, Bordetella pertussis
caugcgccgcaccag

SEQ ID NO: 407462 - RNA, 14 nt, Bordetella pertussis
caugcgcugcuggc

SEQ ID NO: 407463 - RNA, 16 nt, Bordetella pertussis
caugcgcugcuggcca

SEQ ID NO: 407464 - RNA, 21 nt, Bordetella pertussis
caugcgcuggucgcgcagcac

SEQ ID NO: 407465 - RNA, 15 nt, Bordetella pertussis
caugcgcuuggaccc

SEQ ID NO: 407466 - RNA, 20 nt, Bordetella pertussis
caugcgcuugucgccgcugc

SEQ ID NO: 407467 - RNA, 20 nt, Bordetella pertussis
caugcggacgccagcccugg

SEQ ID NO: 407468 - RNA, 13 nt, Bordetella pertussis
caugcggggacag

SEQ ID NO: 407469 - RNA, 17 nt, Bordetella pertussis
caugcggggacaggcac

SEQ ID NO: 407470 - RNA, 18 nt, Bordetella pertussis
caugcggggacaggcacu

SEQ ID NO: 407471 - RNA, 18 nt, Bordetella pertussis
caugcggucgaugaccuc

SEQ ID NO: 407472 - RNA, 18 nt, Bordetella pertussis
caugcgugaagcccaugg

SEQ ID NO: 407473 - RNA, 16 nt, Bordetella pertussis
caugcgugcgcaucag

SEQ ID NO: 407474 - RNA, 22 nt, Bordetella pertussis
cauggccgcgcccagcgcggcc

SEQ ID NO: 407475 - RNA, 17 nt, Bordetella pertussis
caugcucagcagcaccg

SEQ ID NO: 407476 - RNA, 19 nt, Bordetella pertussis
cauggccugggugcgguag

SEQ ID NO: 407477 - RNA, 21 nt, Bordetella pertussis
cauggcgccagcuggaccgcc

SEQ ID NO: 407478 - RNA, 14 nt, Bordetella pertussis
cauggcgccgcgcc

SEQ ID NO: 407479 - RNA, 14 nt, Bordetella pertussis
cauggcggccaggc

SEQ ID NO: 407480 - RNA, 19 nt, Bordetella pertussis
cauggcggccaggcgcgcc

SEQ ID NO: 407481 - RNA, 16 nt, Bordetella pertussis
caugggacgacuucga

SEQ ID NO: 407482 - RNA, 14 nt, Bordetella pertussis
caugggcaagccga

SEQ ID NO: 407483 - RNA, 18 nt, Bordetella pertussis
caugggcacauacagcgg

SEQ ID NO: 407484 - RNA, 12 nt, Bordetella pertussis
caugggccaggc

SEQ ID NO: 407485 - RNA, 15 nt, Bordetella pertussis
caugggccugggcgc

SEQ ID NO: 407486 - RNA, 16 nt, Bordetella pertussis
caugggccugggcgcc

SEQ ID NO: 407487 - RNA, 19 nt, Bordetella pertussis
caugggcgaagccacggcc

SEQ ID NO: 407488 - RNA, 19 nt, Bordetella pertussis
caugggcgcaggccgccac

SEQ ID NO: 407489 - RNA, 19 nt, Bordetella pertussis
caugggcgccgagggccgc

SEQ ID NO: 407490 - RNA, 22 nt, Bordetella pertussis
caugggcgccgagggccgcgcg

SEQ ID NO: 407491 - RNA, 18 nt, Bordetella pertussis
caugggcccgggcgcgcu

SEQ ID NO: 407492 - RNA, 21 nt, Bordetella pertussis
caugggcggcccgcuccaggc

SEQ ID NO: 407493 - RNA, 19 nt, Bordetella pertussis
caugggcucgcgcgagccc

SEQ ID NO: 407494 - RNA, 19 nt, Bordetella pertussis
cauggggacuggcacccgc

SEQ ID NO: 407495 - RNA, 20 nt, Bordetella pertussis
caugguuucgucaccgaacu

SEQ ID NO: 407496 - RNA, 18 nt, Bordetella pertussis
cauguaggccucgggcca

SEQ ID NO: 407497 - RNA, 12 nt, Bordetella pertussis
cauguagucguc

SEQ ID NO: 407498 - RNA, 17 nt, Bordetella pertussis
caugucagcgccuggcu

SEQ ID NO: 407499 - RNA, 15 nt, Bordetella pertussis
cauguugcgcgaguu

SEQ ID NO: 407500 - RNA, 15 nt, Bordetella pertussis
cauuccagcuccggc

SEQ ID NO: 407501 - RNA, 18 nt, Bordetella pertussis
cauuccauaugcugaagg

SEQ ID NO: 407502 - RNA, 16 nt, Bordetella pertussis
cauucccgcccagcga

SEQ ID NO: 407503 - RNA, 23 nt, Bordetella pertussis
cauucucggacaggucggcgccc

SEQ ID NO: 407504 - RNA, 18 nt, Bordetella pertussis
ccaaaaggcagcaggcug

SEQ ID NO: 407505 - RNA, 18 nt, Bordetella pertussis
ccaacaugccggacaagc

SEQ ID NO: 407506 - RNA, 23 nt, Bordetella pertussis
ccaacaugccggacaagccccuc

SEQ ID NO: 407507 - RNA, 15 nt, Bordetella pertussis
ccaacccgccauccu

SEQ ID NO: 407508 - RNA, 19 nt, Bordetella pertussis
ccaacccggcgaggccgcc

SEQ ID NO: 407509 - RNA, 21 nt, Bordetella pertussis
ccaacccguuccccaucaucu

SEQ ID NO: 407510 - RNA, 19 nt, Bordetella pertussis
ccaaccgggacaggcaccu

SEQ ID NO: 407511 - RNA, 15 nt, Bordetella pertussis
ccaaccugaccgccu

SEQ ID NO: 407512 - RNA, 18 nt, Bordetella pertussis
ccaagacgcggggacagg

SEQ ID NO: 407513 - RNA, 12 nt, Bordetella pertussis
ccaagcagggac

SEQ ID NO: 407514 - RNA, 14 nt, Bordetella pertussis
ccaagcgcacgcgc

SEQ ID NO: 407515 - RNA, 14 nt, Bordetella pertussis
ccaagcgccgcggc

SEQ ID NO: 407516 - RNA, 13 nt, Bordetella pertussis
ccaagcuccagga

SEQ ID NO: 407517 - RNA, 19 nt, Bordetella pertussis
ccaaucuugccaggcccgg

SEQ ID NO: 407518 - RNA, 15 nt, Bordetella pertussis
ccacaagcggcccca

SEQ ID NO: 407519 - RNA, 18 nt, Bordetella pertussis
ccacacgaucgucagcag

SEQ ID NO: 407520 - RNA, 21 nt, Bordetella pertussis
ccacacgaucgucagcagcac

SEQ ID NO: 407521 - RNA, 21 nt, Bordetella pertussis
ccacaggguggcgcccaggua

SEQ ID NO: 407522 - RNA, 22 nt, Bordetella pertussis
ccacagguauucgggaugggcc

SEQ ID NO: 407523 - RNA, 20 nt, Bordetella pertussis
ccacaggugcgcggcgcgcc

SEQ ID NO: 407524 - RNA, 18 nt, Bordetella pertussis
ccacaucgccggcggcgu

SEQ ID NO: 407525 - RNA, 12 nt, Bordetella pertussis
ccaccaccagcg

SEQ ID NO: 407526 - RNA, 13 nt, Bordetella pertussis
ccaccaccagcgg

SEQ ID NO: 407527 - RNA, 12 nt, Bordetella pertussis
ccaccaccaggc

SEQ ID NO: 407528 - RNA, 15 nt, Bordetella pertussis
ccaccagccgcccgg

SEQ ID NO: 407529 - RNA, 16 nt, Bordetella pertussis
ccaccagccggccgcc

SEQ ID NO: 407530 - RNA, 22 nt, Bordetella pertussis
ccaccagccgggcggccacggc

SEQ ID NO: 407531 - RNA, 21 nt, Bordetella pertussis
ccaccaggaacgccagcagca

SEQ ID NO: 407532 - RNA, 16 nt, Bordetella pertussis
ccacccagcucagcgg

SEQ ID NO: 407533 - RNA, 16 nt, Bordetella pertussis
ccacccccagcagcau

SEQ ID NO: 407534 - RNA, 23 nt, Bordetella pertussis
ccaccccgguguaggcgggcagc

SEQ ID NO: 407535 - RNA, 23 nt, Bordetella pertussis
ccaccccgucaucgccgcggcgg

SEQ ID NO: 407536 - RNA, 20 nt, Bordetella pertussis
ccaccccguugcagcccagc

SEQ ID NO: 407537 - RNA, 20 nt, Bordetella pertussis
ccacccgccguaccgggcgg

SEQ ID NO: 407538 - RNA, 14 nt, Bordetella pertussis
ccacccggccaucg

SEQ ID NO: 407539 - RNA, 15 nt, Bordetella pertussis
ccaccgagggccgga

SEQ ID NO: 407540 - RNA, 21 nt, Bordetella pertussis
ccaccgcgccgcccacgccgc

SEQ ID NO: 407541 - RNA, 13 nt, Bordetella pertussis
ccaccggcaagcc

SEQ ID NO: 407542 - RNA, 22 nt, Bordetella pertussis
ccaccggcaagccuugcggccc

SEQ ID NO: 407543 - RNA, 17 nt, Bordetella pertussis
ccaccggcgcgcgcaug

SEQ ID NO: 407544 - RNA, 19 nt, Bordetella pertussis
ccaccgucucgaacgccgc

SEQ ID NO: 407545 - RNA, 18 nt, Bordetella pertussis
ccaccgucuugcccgcca

SEQ ID NO: 407546 - RNA, 15 nt, Bordetella pertussis
ccaccgucuggcgua

SEQ ID NO: 407547 - RNA, 16 nt, Bordetella pertussis
ccaccugggccgccug

SEQ ID NO: 407548 - RNA, 20 nt, Bordetella pertussis
ccaccuggucgucggccacg

SEQ ID NO: 407549 - RNA, 22 nt, Bordetella pertussis
ccaccuggucgucggccacgcc

SEQ ID NO: 407550 - RNA, 23 nt, Bordetella pertussis
ccaccuggucgucggccacgccc

SEQ ID NO: 407551 - RNA, 18 nt, Bordetella pertussis
ccaccuugcccagcagcu

SEQ ID NO: 407552 - RNA, 15 nt, Bordetella pertussis
ccacgaaacccagga

SEQ ID NO: 407553 - RNA, 22 nt, Bordetella pertussis
ccacgcaggcgggcgccgcgcc

SEQ ID NO: 407554 - RNA, 13 nt, Bordetella pertussis
ccacgccaaggag

SEQ ID NO: 407555 - RNA, 17 nt, Bordetella pertussis
ccacgccagcggcgagc

SEQ ID NO: 407556 - RNA, 18 nt, Bordetella pertussis
ccacugcagcaguucggc

SEQ ID NO: 407557 - RNA, 23 nt, Bordetella pertussis
ccacugccaggcgagcgccgcgc

SEQ ID NO: 407558 - RNA, 22 nt, Bordetella pertussis
ccacugccaguaggcgccccag

SEQ ID NO: 407559 - RNA, 18 nt, Bordetella pertussis
ccacugcggcccgagcca

SEQ ID NO: 407560 - RNA, 21 nt, Bordetella pertussis
ccacuggaagcugcggccggu

SEQ ID NO: 407561 - RNA, 21 nt, Bordetella pertussis
ccacuggccuugugcgccguc

SEQ ID NO: 407562 - RNA, 11 nt, Bordetella pertussis
ccacuuccuug

SEQ ID NO: 407563 - RNA, 16 nt, Bordetella pertussis
ccacuugagcagcgcc

SEQ ID NO: 407564 - RNA, 22 nt, Bordetella pertussis
ccacuuucgcgcgcgccugccc

SEQ ID NO: 407565 - RNA, 15 nt, Bordetella pertussis
ccagaaacuggcgcu

SEQ ID NO: 407566 - RNA, 12 nt, Bordetella pertussis
ccagaacggcgc

SEQ ID NO: 407567 - RNA, 23 nt, Bordetella pertussis
ccagacauugucaagcagcgccg

SEQ ID NO: 407568 - RNA, 23 nt, Bordetella pertussis
ccagauaaggcgggugucccagc

SEQ ID NO: 407569 - RNA, 11 nt, Bordetella pertussis
ccagaucaggu

SEQ ID NO: 407570 - RNA, 18 nt, Bordetella pertussis
ccagaucaggucgaugcc

SEQ ID NO: 407571 - RNA, 22 nt, Bordetella pertussis
ccagauccgcaaguucggcagc

SEQ ID NO: 407572 - RNA, 17 nt, Bordetella pertussis
ccagauccgguaugccu

SEQ ID NO: 407573 - RNA, 12 nt, Bordetella pertussis
ccagaucgacca

SEQ ID NO: 407574 - RNA, 18 nt, Bordetella pertussis
ccagaucgauaccgucgc

SEQ ID NO: 407575 - RNA, 18 nt, Bordetella pertussis
ccagaucgauccagaaga

SEQ ID NO: 407576 - RNA, 15 nt, Bordetella pertussis
ccagaucgccugggg

SEQ ID NO: 407577 - RNA, 21 nt, Bordetella pertussis
ccagaucucgcguccggugcg

SEQ ID NO: 407578 - RNA, 20 nt, Bordetella pertussis
ccagaugauggucggugccg

SEQ ID NO: 407579 - RNA, 15 nt, Bordetella pertussis
ccagaugcgccgcac

SEQ ID NO: 407580 - RNA, 20 nt, Bordetella pertussis
ccagaugcgccgcacgucgg

SEQ ID NO: 407581 - RNA, 18 nt, Bordetella pertussis
ccagaugcgcagcaggcg

SEQ ID NO: 407582 - RNA, 13 nt, Bordetella pertussis
ccagauucccccg

SEQ ID NO: 407583 - RNA, 19 nt, Bordetella pertussis
ccagcaaaugggccgcagc

SEQ ID NO: 407584 - RNA, 23 nt, Bordetella pertussis
ccagcaaaugggccgcagcgaac

SEQ ID NO: 407585 - RNA, 18 nt, Bordetella pertussis
ccagcaacuggugcccgu

SEQ ID NO: 407586 - RNA, 12 nt, Bordetella pertussis
ccagcaagccgg

SEQ ID NO: 407587 - RNA, 15 nt, Bordetella pertussis
ccagcaagccggcgg

SEQ ID NO: 407588 - RNA, 15 nt, Bordetella pertussis
ccagcaagcgcgcca

SEQ ID NO: 407589 - RNA, 21 nt, Bordetella pertussis
ccagcaagcgcucggccacgc

SEQ ID NO: 407590 - RNA, 15 nt, Bordetella pertussis
ccagcaaggcgucgg

SEQ ID NO: 407591 - RNA, 18 nt, Bordetella pertussis
ccagcaaggcgucggcca

SEQ ID NO: 407592 - RNA, 22 nt, Bordetella pertussis
ccagcaaggcgucggccaggcc

SEQ ID NO: 407593 - RNA, 22 nt, Bordetella pertussis
ccagcaauuaugcguggccgcc

SEQ ID NO: 407594 - RNA, 18 nt, Bordetella pertussis
ccagcacaucgacgucgg

SEQ ID NO: 407595 - RNA, 17 nt, Bordetella pertussis
ccagcaccacggcaucg

SEQ ID NO: 407596 - RNA, 21 nt, Bordetella pertussis
ccagcaccacggcaucggcgc

SEQ ID NO: 407597 - RNA, 17 nt, Bordetella pertussis
ccagcaccacgggcucg

SEQ ID NO: 407598 - RNA, 17 nt, Bordetella pertussis
ccagcaccagcgccugc

SEQ ID NO: 407599 - RNA, 14 nt, Bordetella pertussis
ccagcaccaggccg

SEQ ID NO: 407600 - RNA, 20 nt, Bordetella pertussis
ccagcaccgaugcgccggcc

SEQ ID NO: 407601 - RNA, 14 nt, Bordetella pertussis
ccagcaccggcagc

SEQ ID NO: 407602 - RNA, 12 nt, Bordetella pertussis
ccagcaccggcu

SEQ ID NO: 407603 - RNA, 22 nt, Bordetella pertussis
ccagcaccggcugccagggccg

SEQ ID NO: 407604 - RNA, 17 nt, Bordetella pertussis
ccagcaccugcuugacg

SEQ ID NO: 407605 - RNA, 15 nt, Bordetella pertussis
ccagcaccugcaccg

SEQ ID NO: 407606 - RNA, 17 nt, Bordetella pertussis
ccagcaccugcaggccg

SEQ ID NO: 407607 - RNA, 18 nt, Bordetella pertussis
ccagcacgaaccacaggg

SEQ ID NO: 407608 - RNA, 15 nt, Bordetella pertussis
ccagcacgaaccagu

SEQ ID NO: 407609 - RNA, 16 nt, Bordetella pertussis
ccagcacgaagggcag

SEQ ID NO: 407610 - RNA, 21 nt, Bordetella pertussis
ccagcacgaagggcagcagca

SEQ ID NO: 407611 - RNA, 22 nt, Bordetella pertussis
ccagcacgaagggcagcagcag

SEQ ID NO: 407612 - RNA, 17 nt, Bordetella pertussis
ccagcacgauccagccg

SEQ ID NO: 407613 - RNA, 21 nt, Bordetella pertussis
ccagcacgccggccaggucgg

SEQ ID NO: 407614 - RNA, 22 nt, Bordetella pertussis
ccagcacgccggcgggcaggcu

SEQ ID NO: 407615 - RNA, 16 nt, Bordetella pertussis
ccagcacgcggcgcag

SEQ ID NO: 407616 - RNA, 15 nt, Bordetella pertussis
ccagcacggccgcgg

SEQ ID NO: 407617 - RNA, 15 nt, Bordetella pertussis
ccagcacggcgagga

SEQ ID NO: 407618 - RNA, 20 nt, Bordetella pertussis
ccagcacggcgcacaccauc

SEQ ID NO: 407619 - RNA, 22 nt, Bordetella pertussis
ccagcacgguggcgcccggcgg

SEQ ID NO: 407620 - RNA, 23 nt, Bordetella pertussis
ccagcacgguggcgcccggcggc

SEQ ID NO: 407621 - RNA, 21 nt, Bordetella pertussis
ccagcagcacgaucgcggcgc

SEQ ID NO: 407622 - RNA, 14 nt, Bordetella pertussis
ccagcagcacgccc

SEQ ID NO: 407623 - RNA, 15 nt, Bordetella pertussis
ccagcagcagcgccg

SEQ ID NO: 407624 - RNA, 16 nt, Bordetella pertussis
ccagcagcagcgccgc

SEQ ID NO: 407625 - RNA, 18 nt, Bordetella pertussis
ccagcagccgguuggcgc

SEQ ID NO: 407626 - RNA, 19 nt, Bordetella pertussis
ccagcagcgacggccccag

SEQ ID NO: 407627 - RNA, 20 nt, Bordetella pertussis
ccagcagcgacggccccagc

SEQ ID NO: 407628 - RNA, 11 nt, Bordetella pertussis
ccagcagcgcc

SEQ ID NO: 407629 - RNA, 15 nt, Bordetella pertussis
ccagcagcgccagga

SEQ ID NO: 407630 - RNA, 18 nt, Bordetella pertussis
ccagcagcgccaggauga

SEQ ID NO: 407631 - RNA, 12 nt, Bordetella pertussis
ccagcagcgccg

SEQ ID NO: 407632 - RNA, 15 nt, Bordetella pertussis
ccagcagcgccgcca

SEQ ID NO: 407633 - RNA, 18 nt, Bordetella pertussis
ccagcagcgccggaaagc

SEQ ID NO: 407634 - RNA, 12 nt, Bordetella pertussis
ccagcagcgccu

SEQ ID NO: 407635 - RNA, 15 nt, Bordetella pertussis
ccagcagcgccuggg

SEQ ID NO: 407636 - RNA, 23 nt, Bordetella pertussis
ccagcagcgcgugcagccagcgg

SEQ ID NO: 407637 - RNA, 16 nt, Bordetella pertussis
ccagcagcgggcuggg

SEQ ID NO: 407638 - RNA, 22 nt, Bordetella pertussis
ccagcagcguggccaccaggcg

SEQ ID NO: 407639 - RNA, 24 nt, Bordetella pertussis
ccagcaggauggaucccuggucga

SEQ ID NO: 407640 - RNA, 19 nt, Bordetella pertussis
ccagcaggcccaccagggc

SEQ ID NO: 407641 - RNA, 19 nt, Bordetella pertussis
ccagcaggcccugggccag

SEQ ID NO: 407642 - RNA, 21 nt, Bordetella pertussis
ccagcaggcgcuggucgucgc

SEQ ID NO: 407643 - RNA, 23 nt, Bordetella pertussis
ccagcagggacuugggcaggccu

SEQ ID NO: 407644 - RNA, 16 nt, Bordetella pertussis
ccagcaggcucagcgg

SEQ ID NO: 407645 - RNA, 14 nt, Bordetella pertussis
ccagcagggcggcg

SEQ ID NO: 407646 - RNA, 15 nt, Bordetella pertussis
ccagcagggcggcgu

SEQ ID NO: 407647 - RNA, 18 nt, Bordetella pertussis
ccagcagggucagcggcc

SEQ ID NO: 407648 - RNA, 22 nt, Bordetella pertussis
ccagcagggucagcggccggcc

SEQ ID NO: 407649 - RNA, 14 nt, Bordetella pertussis
ccagcagguggcgc

SEQ ID NO: 407650 - RNA, 19 nt, Bordetella pertussis
ccagcaguguuucggccug

SEQ ID NO: 407651 - RNA, 20 nt, Bordetella pertussis
ccagcauacccugcgcgccg

SEQ ID NO: 407652 - RNA, 21 nt, Bordetella pertussis
ccagcaucaccagcucgcggc

SEQ ID NO: 407653 - RNA, 13 nt, Bordetella pertussis
ccagcaucaggcc

SEQ ID NO: 407654 - RNA, 14 nt, Bordetella pertussis
ccagcaucaggccc

SEQ ID NO: 407655 - RNA, 18 nt, Bordetella pertussis
ccagcauccgcgccagga

SEQ ID NO: 407656 - RNA, 21 nt, Bordetella pertussis
ccagcauccgcgccaggaugg

SEQ ID NO: 407657 - RNA, 13 nt, Bordetella pertussis
ccagcaucgccgc

SEQ ID NO: 407658 - RNA, 20 nt, Bordetella pertussis
ccagcaucgccgccagcuug

SEQ ID NO: 407659 - RNA, 21 nt, Bordetella pertussis
ccagcaucggcacccagccgg

SEQ ID NO: 407660 - RNA, 19 nt, Bordetella pertussis
ccagcaucugccccagcuu

SEQ ID NO: 407661 - RNA, 19 nt, Bordetella pertussis
ccagcaugacggggucggg

SEQ ID NO: 407662 - RNA, 21 nt, Bordetella pertussis
ccagcaugacggggucggggc

SEQ ID NO: 407663 - RNA, 20 nt, Bordetella pertussis
ccagcaugcgcgcggccucg

SEQ ID NO: 407664 - RNA, 21 nt, Bordetella pertussis
ccagcaugcgcgucuccagcg

SEQ ID NO: 407665 - RNA, 18 nt, Bordetella pertussis
ccagcauggcggccaggc

SEQ ID NO: 407666 - RNA, 20 nt, Bordetella pertussis
ccagcauggcggccaggcgc

SEQ ID NO: 407667 - RNA, 21 nt, Bordetella pertussis
ccagcauggucggcauggcca

SEQ ID NO: 407668 - RNA, 14 nt, Bordetella pertussis
ccagcauguccgcc

SEQ ID NO: 407669 - RNA, 19 nt, Bordetella pertussis
ccagccacaccagguuguc

SEQ ID NO: 407670 - RNA, 14 nt, Bordetella pertussis
ccagccaccacugc

SEQ ID NO: 407671 - RNA, 15 nt, Bordetella pertussis
ccagccaccccguca

SEQ ID NO: 407672 - RNA, 23 nt, Bordetella pertussis
ccagccacgccggcgcgccggcc

SEQ ID NO: 407673 - RNA, 18 nt, Bordetella pertussis
ccagccagauaccguccu

SEQ ID NO: 407674 - RNA, 14 nt, Bordetella pertussis
ccagccagccgccg

SEQ ID NO: 407675 - RNA, 17 nt, Bordetella pertussis
ccagccagcgcaugccg

SEQ ID NO: 407676 - RNA, 11 nt, Bordetella pertussis
ccagccagcgg

SEQ ID NO: 407677 - RNA, 17 nt, Bordetella pertussis
ccagccagcgccgcagc

SEQ ID NO: 407678 - RNA, 13 nt, Bordetella pertussis
ccagccaggccgc

SEQ ID NO: 407679 - RNA, 18 nt, Bordetella pertussis
ccagccaggcgccagcgg

SEQ ID NO: 407680 - RNA, 22 nt, Bordetella pertussis
ccagccaggguuguccgaacca

SEQ ID NO: 407681 - RNA, 18 nt, Bordetella pertussis
ccagccaguacaggcugc

SEQ ID NO: 407682 - RNA, 17 nt, Bordetella pertussis
ccagccauguucgacca

SEQ ID NO: 407683 - RNA, 21 nt, Bordetella pertussis
ccagccauucgauggcggcgc

SEQ ID NO: 407684 - RNA, 16 nt, Bordetella pertussis
ccagcccacaagccgu

SEQ ID NO: 407685 - RNA, 15 nt, Bordetella pertussis
ccagcccagcccgcc

SEQ ID NO: 407686 - RNA, 22 nt, Bordetella pertussis
ccagcccaccgcgaaccaggcc

SEQ ID NO: 407687 - RNA, 11 nt, Bordetella pertussis
ccagcccccug

SEQ ID NO: 407688 - RNA, 13 nt, Bordetella pertussis
ccagcccccugcg

SEQ ID NO: 407689 - RNA, 21 nt, Bordetella pertussis
ccagcccccugcggggucugc

SEQ ID NO: 407690 - RNA, 22 nt, Bordetella pertussis
ccagcccgaugcgccaggccuc

SEQ ID NO: 407691 - RNA, 21 nt, Bordetella pertussis
ccagcccuucgcccgcauaga

SEQ ID NO: 407692 - RNA, 14 nt, Bordetella pertussis
ccagccgcccggcg

SEQ ID NO: 407693 - RNA, 14 nt, Bordetella pertussis
ccagccgccgccau

SEQ ID NO: 407694 - RNA, 14 nt, Bordetella pertussis
ccagccgcucggcc

SEQ ID NO: 407695 - RNA, 20 nt, Bordetella pertussis
ccagccggacccgcgccgca

SEQ ID NO: 407696 - RNA, 18 nt, Bordetella pertussis
ccagggugcaccaggugg

SEQ ID NO: 407697 - RNA, 16 nt, Bordetella pertussis
ccaggguggccaguuc

SEQ ID NO: 407698 - RNA, 18 nt, Bordetella pertussis
ccaggguggccaguuccg

SEQ ID NO: 407699 - RNA, 20 nt, Bordetella pertussis
ccaggguggcgccggccacc

SEQ ID NO: 407700 - RNA, 15 nt, Bordetella pertussis
ccaggguguccuggu

SEQ ID NO: 407701 - RNA, 14 nt, Bordetella pertussis
ccagguacaggccg

SEQ ID NO: 407702 - RNA, 16 nt, Bordetella pertussis
ccagguacaggccgcc

SEQ ID NO: 407703 - RNA, 21 nt, Bordetella pertussis
ccagguacaucauccccagcg

SEQ ID NO: 407704 - RNA, 14 nt, Bordetella pertussis
ccagguacccggcu

SEQ ID NO: 407705 - RNA, 16 nt, Bordetella pertussis
ccagguagcgccucgc

SEQ ID NO: 407706 - RNA, 19 nt, Bordetella pertussis
ccagguaggcggcgcgccc

SEQ ID NO: 407707 - RNA, 15 nt, Bordetella pertussis
ccagguagggcagca

SEQ ID NO: 407708 - RNA, 16 nt, Bordetella pertussis
ccaggugcgggccgcu

SEQ ID NO: 407709 - RNA, 17 nt, Bordetella pertussis
ccagguggacagcgcca

SEQ ID NO: 407710 - RNA, 18 nt, Bordetella pertussis
ccagguggacagcgccag

SEQ ID NO: 407711 - RNA, 18 nt, Bordetella pertussis
ccaggugguuggcgugcc

SEQ ID NO: 407712 - RNA, 21 nt, Bordetella pertussis
ccagguucuggucgaacuggc

SEQ ID NO: 407713 - RNA, 19 nt, Bordetella pertussis
ccagguugaaggccgcgau

SEQ ID NO: 407714 - RNA, 19 nt, Bordetella pertussis
ccagguuggcgauggcguc

SEQ ID NO: 407715 - RNA, 15 nt, Bordetella pertussis
ccagguugucggcca

SEQ ID NO: 407716 - RNA, 18 nt, Bordetella pertussis
ccagguuuuccacagcca

SEQ ID NO: 407717 - RNA, 18 nt, Bordetella pertussis
ccaguacaccaggucguc

SEQ ID NO: 407718 - RNA, 24 nt, Bordetella pertussis
ccaguacaccggcgugcagagcac

SEQ ID NO: 407719 - RNA, 13 nt, Bordetella pertussis
ccaguacaggcug

SEQ ID NO: 407720 - RNA, 17 nt, Bordetella pertussis
ccaguacgucggacagg

SEQ ID NO: 407721 - RNA, 20 nt, Bordetella pertussis
ccaguaggcgccccaggcgu

SEQ ID NO: 407722 - RNA, 14 nt, Bordetella pertussis
ccaguccaccuuga

SEQ ID NO: 407723 - RNA, 12 nt, Bordetella pertussis
ccaguccaggcc

SEQ ID NO: 407724 - RNA, 13 nt, Bordetella pertussis
ccaguccaggccg

SEQ ID NO: 407725 - RNA, 16 nt, Bordetella pertussis
ccaguccaggccggcc

SEQ ID NO: 407726 - RNA, 18 nt, Bordetella pertussis
ccaguccaggccggccug

SEQ ID NO: 407727 - RNA, 15 nt, Bordetella pertussis
ccaguccccaugugg

SEQ ID NO: 407728 - RNA, 19 nt, Bordetella pertussis
ccagucccccgcggggaca

SEQ ID NO: 407729 - RNA, 18 nt, Bordetella pertussis
ccaguccccgcagggaca

SEQ ID NO: 407730 - RNA, 23 nt, Bordetella pertussis
ccaguccccgcggggacaggcuc

SEQ ID NO: 407731 - RNA, 13 nt, Bordetella pertussis
ccaguccggcagc

SEQ ID NO: 407732 - RNA, 19 nt, Bordetella pertussis
ccaguccggcagcacccag

SEQ ID NO: 407733 - RNA, 16 nt, Bordetella pertussis
ccagucgacccaccug

SEQ ID NO: 407734 - RNA, 12 nt, Bordetella pertussis
ccagucgccgcg

SEQ ID NO: 407735 - RNA, 13 nt, Bordetella pertussis
ccagucgccgcgc

SEQ ID NO: 407736 - RNA, 18 nt, Bordetella pertussis
ccagucgccgcgcccgcg

SEQ ID NO: 407737 - RNA, 21 nt, Bordetella pertussis
ccagugaaacgcgacgcgccg

SEQ ID NO: 407738 - RNA, 19 nt, Bordetella pertussis
ccaguuccacgcggccgug

SEQ ID NO: 407739 - RNA, 18 nt, Bordetella pertussis
ccaguugcgcgccgucgg

SEQ ID NO: 407740 - RNA, 15 nt, Bordetella pertussis
ccaguugcgggcgca

SEQ ID NO: 407741 - RNA, 18 nt, Bordetella pertussis
ccaguugcuggcccagga

SEQ ID NO: 407742 - RNA, 22 nt, Bordetella pertussis
ccaguuuucucauggccgcgcc

SEQ ID NO: 407743 - RNA, 21 nt, Bordetella pertussis
ccauacaacgaguaccugcug

SEQ ID NO: 407744 - RNA, 20 nt, Bordetella pertussis
ccauacagcaaggacaaggc

SEQ ID NO: 407745 - RNA, 14 nt, Bordetella pertussis
ccauaggccagcgc

SEQ ID NO: 407746 - RNA, 19 nt, Bordetella pertussis
ccauaggcgcgcaccagcc

SEQ ID NO: 407747 - RNA, 19 nt, Bordetella pertussis
ccauagggcgacugcagca

SEQ ID NO: 407748 - RNA, 16 nt, Bordetella pertussis
ccauauugaugcagca

SEQ ID NO: 407749 - RNA, 16 nt, Bordetella pertussis
ccauccagccaggccg

SEQ ID NO: 407750 - RNA, 16 nt, Bordetella pertussis
ccauccguccgccagg

SEQ ID NO: 407751 - RNA, 16 nt, Bordetella pertussis
ccauccucaucgugcu

SEQ ID NO: 407752 - RNA, 16 nt, Bordetella pertussis
ccauccugaacgccgc

SEQ ID NO: 407753 - RNA, 13 nt, Bordetella pertussis
ccaucgccgccac

SEQ ID NO: 407754 - RNA, 23 nt, Bordetella pertussis
ccaucgcggucgaugaccagcca

SEQ ID NO: 407755 - RNA, 24 nt, Bordetella pertussis
ccaucgcggucgaugaccagccag

SEQ ID NO: 407756 - RNA, 15 nt, Bordetella pertussis
ccaucgcguccaggc

SEQ ID NO: 407757 - RNA, 20 nt, Bordetella pertussis
ccaucuugcaggcgccaguc

SEQ ID NO: 407758 - RNA, 14 nt, Bordetella pertussis
ccaucuugccggcc

SEQ ID NO: 407759 - RNA, 18 nt, Bordetella pertussis
ccaucuuggugcgcgcca

SEQ ID NO: 407760 - RNA, 21 nt, Bordetella pertussis
ccaugaacgcuugacggccag

SEQ ID NO: 407761 - RNA, 18 nt, Bordetella pertussis
ccaugaaggcggccagca

SEQ ID NO: 407762 - RNA, 20 nt, Bordetella pertussis
ccaugacaugcgggccucga

SEQ ID NO: 407763 - RNA, 18 nt, Bordetella pertussis
ccaugaccacgucgacca

SEQ ID NO: 407764 - RNA, 19 nt, Bordetella pertussis
ccaugaccaugccggccug

SEQ ID NO: 407765 - RNA, 16 nt, Bordetella pertussis
ccaugacguccagcgc

SEQ ID NO: 407766 - RNA, 17 nt, Bordetella pertussis
ccaugacguccagcgcc

SEQ ID NO: 407767 - RNA, 18 nt, Bordetella pertussis
ccaugcacgggccaugga

SEQ ID NO: 407768 - RNA, 19 nt, Bordetella pertussis
ccauggacagcaccgacag

SEQ ID NO: 407769 - RNA, 23 nt, Bordetella pertussis
ccauggcacaggccaucggcgcc

SEQ ID NO: 407770 - RNA, 15 nt, Bordetella pertussis
ccauggcagggcgcc

SEQ ID NO: 407771 - RNA, 16 nt, Bordetella pertussis
ccauggcaugcaccgc

SEQ ID NO: 407772 - RNA, 19 nt, Bordetella pertussis
ccauggccagggaggaacu

SEQ ID NO: 407773 - RNA, 23 nt, Bordetella pertussis
ccauggccagggaggaacugggc

SEQ ID NO: 407774 - RNA, 12 nt, Bordetella pertussis
ccauggcgcgca

SEQ ID NO: 407775 - RNA, 17 nt, Bordetella pertussis
ccauggcgcuggcaggc

SEQ ID NO: 407776 - RNA, 15 nt, Bordetella pertussis
ccauggcggccggcg

SEQ ID NO: 407777 - RNA, 18 nt, Bordetella pertussis
ccaugggcucgugcagca

SEQ ID NO: 407778 - RNA, 22 nt, Bordetella pertussis
ccaugggcucgugcagcagggg

SEQ ID NO: 407779 - RNA, 22 nt, Bordetella pertussis
ccauggggugcuccugccaggc

SEQ ID NO: 407780 - RNA, 21 nt, Bordetella pertussis
ccauggugccgcgcaggcccu

SEQ ID NO: 407781 - RNA, 14 nt, Bordetella pertussis
ccauggugggcagg

SEQ ID NO: 407782 - RNA, 14 nt, Bordetella pertussis
ccaugugcgccgcg

SEQ ID NO: 407783 - RNA, 20 nt, Bordetella pertussis
ccaugugcguugccagccca

SEQ ID NO: 407784 - RNA, 23 nt, Bordetella pertussis
ccauguugaacugcaggccgccg

SEQ ID NO: 407785 - RNA, 18 nt, Bordetella pertussis
ccauuagggcccagcugc

SEQ ID NO: 407786 - RNA, 20 nt, Bordetella pertussis
ccauuagggcccagcugcag

SEQ ID NO: 407787 - RNA, 14 nt, Bordetella pertussis
ccauucggccaggu

SEQ ID NO: 407788 - RNA, 22 nt, Bordetella pertussis
ccauugccacggcgggccggcu

SEQ ID NO: 407789 - RNA, 20 nt, Bordetella pertussis
ccauugcggcaccugcugcu

SEQ ID NO: 407790 - RNA, 21 nt, Bordetella pertussis
cccaaccgggacaggcaccuu

SEQ ID NO: 407791 - RNA, 13 nt, Bordetella pertussis
cccaacgcggcca

SEQ ID NO: 407792 - RNA, 13 nt, Bordetella pertussis
cccaacgcggcgu

SEQ ID NO: 407793 - RNA, 21 nt, Bordetella pertussis
cccaacgcggcgucgacgccc

SEQ ID NO: 407794 - RNA, 19 nt, Bordetella pertussis
cccaacggggacgggcgcc

SEQ ID NO: 407795 - RNA, 16 nt, Bordetella pertussis
cccaagcccguggcgg

SEQ ID NO: 407796 - RNA, 22 nt, Bordetella pertussis
cccaaggccccgcgacccagaa

SEQ ID NO: 407797 - RNA, 18 nt, Bordetella pertussis
cccagaacccggccggcg

SEQ ID NO: 407798 - RNA, 19 nt, Bordetella pertussis
cccagaacccggccggcgc

SEQ ID NO: 407799 - RNA, 18 nt, Bordetella pertussis
cccagaugccggucagga

SEQ ID NO: 407800 - RNA, 21 nt, Bordetella pertussis
cccagaugccggucaggaugc

SEQ ID NO: 407801 - RNA, 19 nt, Bordetella pertussis
cccagcacauagcgcaagc

SEQ ID NO: 407802 - RNA, 12 nt, Bordetella pertussis
cccagcaccacg

SEQ ID NO: 407803 - RNA, 15 nt, Bordetella pertussis
cccagcaccacgggc

SEQ ID NO: 407804 - RNA, 16 nt, Bordetella pertussis
cccagcaccaggccga

SEQ ID NO: 407805 - RNA, 21 nt, Bordetella pertussis
cccagcaccugcaggccgccg

SEQ ID NO: 407806 - RNA, 18 nt, Bordetella pertussis
cccagcacgaagggcagc

SEQ ID NO: 407807 - RNA, 21 nt, Bordetella pertussis
cccagcacgaagggcagcagc

SEQ ID NO: 407808 - RNA, 16 nt, Bordetella pertussis
cccagcacgcgcgcca

SEQ ID NO: 407809 - RNA, 17 nt, Bordetella pertussis
cccagcacgcgcgccag

SEQ ID NO: 407810 - RNA, 15 nt, Bordetella pertussis
cccagcagcacgccc

SEQ ID NO: 407811 - RNA, 13 nt, Bordetella pertussis
cccagcagcgcca

SEQ ID NO: 407812 - RNA, 13 nt, Bordetella pertussis
cccagcagcgccg

SEQ ID NO: 407813 - RNA, 13 nt, Bordetella pertussis
cccagcagcuccu

SEQ ID NO: 407814 - RNA, 12 nt, Bordetella pertussis
cccagcagcggc

SEQ ID NO: 407815 - RNA, 14 nt, Bordetella pertussis
cccagccccgcggc

SEQ ID NO: 407816 - RNA, 16 nt, Bordetella pertussis
cccagccccgcggccg

SEQ ID NO: 407817 - RNA, 22 nt, Bordetella pertussis
cccagcccgccuuugccgcugg

SEQ ID NO: 407818 - RNA, 14 nt, Bordetella pertussis
cccagcccugcccg

SEQ ID NO: 407819 - RNA, 18 nt, Bordetella pertussis
cccagccgcagcaggcgc

SEQ ID NO: 407820 - RNA, 15 nt, Bordetella pertussis
cccagccgcucggcc

SEQ ID NO: 407821 - RNA, 17 nt, Bordetella pertussis
cccagccggcccccuca

SEQ ID NO: 407822 - RNA, 14 nt, Bordetella pertussis
cccagccgucgcgc

SEQ ID NO: 407823 - RNA, 18 nt, Bordetella pertussis
cccagcgacgagggcgcc

SEQ ID NO: 407824 - RNA, 12 nt, Bordetella pertussis
cccagcgagccg

SEQ ID NO: 407825 - RNA, 15 nt, Bordetella pertussis
cccagcgagccggcc

SEQ ID NO: 407826 - RNA, 17 nt, Bordetella pertussis
cccagcgcauaggacgc

SEQ ID NO: 407827 - RNA, 23 nt, Bordetella pertussis
cccagcgcauaggacgccaccag

SEQ ID NO: 407828 - RNA, 24 nt, Bordetella pertussis
cccagcgcauaggacgccaccagu

SEQ ID NO: 407829 - RNA, 13 nt, Bordetella pertussis
cccagcgccagca

SEQ ID NO: 407830 - RNA, 17 nt, Bordetella pertussis
cccagcgccagggccgc

SEQ ID NO: 407831 - RNA, 19 nt, Bordetella pertussis
cccagcgccagggccgccg

SEQ ID NO: 407832 - RNA, 13 nt, Bordetella pertussis
cccagcgccgcca

SEQ ID NO: 407833 - RNA, 19 nt, Bordetella pertussis
cccagcgccgccauggcgg

SEQ ID NO: 407834 - RNA, 13 nt, Bordetella pertussis
cccagcgccgccg

SEQ ID NO: 407835 - RNA, 12 nt, Bordetella pertussis
cccagcgccgcg

SEQ ID NO: 407836 - RNA, 18 nt, Bordetella pertussis
cccagcgcgaugucgccc

SEQ ID NO: 407837 - RNA, 19 nt, Bordetella pertussis
cccagcgcgauucccuggc

SEQ ID NO: 407838 - RNA, 12 nt, Bordetella pertussis
cccagcgcgccg

SEQ ID NO: 407839 - RNA, 18 nt, Bordetella pertussis
cccagcgcgccgggggcg

SEQ ID NO: 407840 - RNA, 12 nt, Bordetella pertussis
cccagcgcgccu

SEQ ID NO: 407841 - RNA, 19 nt, Bordetella pertussis
cccagcgcgugggccagca

SEQ ID NO: 407842 - RNA, 13 nt, Bordetella pertussis
cccagcggcgccg

SEQ ID NO: 407843 - RNA, 12 nt, Bordetella pertussis
cccagcggcgca

SEQ ID NO: 407844 - RNA, 15 nt, Bordetella pertussis
cccagcggcgcaccg

SEQ ID NO: 407845 - RNA, 17 nt, Bordetella pertussis
cccagcggggacaggca

SEQ ID NO: 407846 - RNA, 18 nt, Bordetella pertussis
cccagcggggacaggcac

SEQ ID NO: 407847 - RNA, 21 nt, Bordetella pertussis
cccagcggggacaggcacccc

SEQ ID NO: 407848 - RNA, 23 nt, Bordetella pertussis
cccagcggggacaggcaccccuc

SEQ ID NO: 407849 - RNA, 14 nt, Bordetella pertussis
cccagcguccaggc

SEQ ID NO: 407850 - RNA, 19 nt, Bordetella pertussis
cccagcguccaggcggcca

SEQ ID NO: 407851 - RNA, 22 nt, Bordetella pertussis
cccagcguguaggcggccggcu

SEQ ID NO: 407852 - RNA, 23 nt, Bordetella pertussis
cccagcucauggcacagcgcggc

SEQ ID NO: 407853 - RNA, 15 nt, Bordetella pertussis
cccagcuccagcugg

SEQ ID NO: 407854 - RNA, 17 nt, Bordetella pertussis
cccagcucugguccagg

SEQ ID NO: 407855 - RNA, 17 nt, Bordetella pertussis
cccagcuggcgccccuu

SEQ ID NO: 407856 - RNA, 18 nt, Bordetella pertussis
cccagcuggcgccccuuc

SEQ ID NO: 407857 - RNA, 16 nt, Bordetella pertussis
cccagcugggccacag

SEQ ID NO: 407858 - RNA, 20 nt, Bordetella pertussis
cccagcuucucgcaagugcu

SEQ ID NO: 407859 - RNA, 20 nt, Bordetella pertussis
cccagcuguccaagcgcgug

SEQ ID NO: 407860 - RNA, 15 nt, Bordetella pertussis
cccagcuugucggcc

SEQ ID NO: 407861 - RNA, 22 nt, Bordetella pertussis
cccagcuugucggccgcgcgca

SEQ ID NO: 407862 - RNA, 16 nt, Bordetella pertussis
cccaggaucaccgccg

SEQ ID NO: 407863 - RNA, 19 nt, Bordetella pertussis
cccaggaucgucgucauga

SEQ ID NO: 407864 - RNA, 18 nt, Bordetella pertussis
cccaggaugcgcaccggc

SEQ ID NO: 407865 - RNA, 15 nt, Bordetella pertussis
cccaggauggcgcca

SEQ ID NO: 407866 - RNA, 19 nt, Bordetella pertussis
cccaggccagcgccgcggc

SEQ ID NO: 407867 - RNA, 14 nt, Bordetella pertussis
cccaggccagcugc

SEQ ID NO: 407868 - RNA, 12 nt, Bordetella pertussis
cccaggcccagc

SEQ ID NO: 407869 - RNA, 18 nt, Bordetella pertussis
cccaggcccagcgcgcca

SEQ ID NO: 407870 - RNA, 15 nt, Bordetella pertussis
cccaggcccuggcug

SEQ ID NO: 407871 - RNA, 16 nt, Bordetella pertussis
cccaggcccuggcugg

SEQ ID NO: 407872 - RNA, 13 nt, Bordetella pertussis
cccaggcccgcca

SEQ ID NO: 407873 - RNA, 15 nt, Bordetella pertussis
cccaggccgccggcg

SEQ ID NO: 407874 - RNA, 18 nt, Bordetella pertussis
cccaggccgggcgagccg

SEQ ID NO: 407875 - RNA, 19 nt, Bordetella pertussis
cccaggccguggcgcacca

SEQ ID NO: 407876 - RNA, 22 nt, Bordetella pertussis
cccaggccguggcgcaccaggu

SEQ ID NO: 407877 - RNA, 21 nt, Bordetella pertussis
cccaggcgaggcuggcgccca

SEQ ID NO: 407878 - RNA, 20 nt, Bordetella pertussis
cccaggcgcucagccgugcc

SEQ ID NO: 407879 - RNA, 14 nt, Bordetella pertussis
cccaggcggcaggc

SEQ ID NO: 407880 - RNA, 19 nt, Bordetella pertussis
cccaggcggcaggcgccgc

SEQ ID NO: 407881 - RNA, 14 nt, Bordetella pertussis
cccaggcggcccag

SEQ ID NO: 407882 - RNA, 15 nt, Bordetella pertussis
cccaggcggcccagc

SEQ ID NO: 407883 - RNA, 16 nt, Bordetella pertussis
cccaggcgggccaggu

SEQ ID NO: 407884 - RNA, 22 nt, Bordetella pertussis
cccaggcgucggcggcccacag

SEQ ID NO: 407885 - RNA, 23 nt, Bordetella pertussis
cccaggcgucggcggcccacagc

SEQ ID NO: 407886 - RNA, 17 nt, Bordetella pertussis
cccaggcgugaacgccc

SEQ ID NO: 407887 - RNA, 19 nt, Bordetella pertussis
cccaggcgugaacgccccg

SEQ ID NO: 407888 - RNA, 19 nt, Bordetella pertussis
cccaggcugggccagaugg

SEQ ID NO: 407889 - RNA, 19 nt, Bordetella pertussis
cccagggcagcggccagau

SEQ ID NO: 407890 - RNA, 14 nt, Bordetella pertussis
cccagggcgcgccg

SEQ ID NO: 407891 - RNA, 19 nt, Bordetella pertussis
cccaggggccggcgcgccg

SEQ ID NO: 407892 - RNA, 18 nt, Bordetella pertussis
cccaggguguagaccugc

SEQ ID NO: 407893 - RNA, 14 nt, Bordetella pertussis
cccagguccagcgc

SEQ ID NO: 407894 - RNA, 15 nt, Bordetella pertussis
cccaggucgccgccg

SEQ ID NO: 407895 - RNA, 18 nt, Bordetella pertussis
cccaggucggacgcgccg

SEQ ID NO: 407896 - RNA, 16 nt, Bordetella pertussis
cccagguugaaggccg

SEQ ID NO: 407897 - RNA, 21 nt, Bordetella pertussis
cccaguacggccugcaugucg

SEQ ID NO: 407898 - RNA, 16 nt, Bordetella pertussis
cccaguccaggccggc

SEQ ID NO: 407899 - RNA, 14 nt, Bordetella pertussis
cccaguccggcagc

SEQ ID NO: 407900 - RNA, 17 nt, Bordetella pertussis
cccagucgcugcucgac

SEQ ID NO: 407901 - RNA, 13 nt, Bordetella pertussis
cccagucgccgcg

SEQ ID NO: 407902 - RNA, 14 nt, Bordetella pertussis
cccagucgccgcgc

SEQ ID NO: 407903 - RNA, 21 nt, Bordetella pertussis
cccagucguccagcacgcggc

SEQ ID NO: 407904 - RNA, 16 nt, Bordetella pertussis
cccaguuccacgcggc

SEQ ID NO: 407905 - RNA, 14 nt, Bordetella pertussis
cccaguuccagcac

SEQ ID NO: 407906 - RNA, 15 nt, Bordetella pertussis
cccaguucgcggccg

SEQ ID NO: 407907 - RNA, 18 nt, Bordetella pertussis
cccaguucgcggccggcc

SEQ ID NO: 407908 - RNA, 19 nt, Bordetella pertussis
cccaguucgcgcagcagcu

SEQ ID NO: 407909 - RNA, 16 nt, Bordetella pertussis
cccaguucugcagcgu

SEQ ID NO: 407910 - RNA, 17 nt, Bordetella pertussis
cccaguugaaucggcgc

SEQ ID NO: 407911 - RNA, 13 nt, Bordetella pertussis
cccaguuuuuccu

SEQ ID NO: 407912 - RNA, 19 nt, Bordetella pertussis
cccaguuuuuccuucagca

SEQ ID NO: 407913 - RNA, 13 nt, Bordetella pertussis
cccauaccagccc

SEQ ID NO: 407914 - RNA, 14 nt, Bordetella pertussis
cccauaccagcccg

SEQ ID NO: 407915 - RNA, 16 nt, Bordetella pertussis
cccauaccagcccggc

SEQ ID NO: 407916 - RNA, 24 nt, Bordetella pertussis
cccaucaggccgaugcguccgccg

SEQ ID NO: 407917 - RNA, 20 nt, Bordetella pertussis
cccauccagcggacgggcca

SEQ ID NO: 407918 - RNA, 23 nt, Bordetella pertussis
cccauccagcggacgggccaggc

SEQ ID NO: 407919 - RNA, 18 nt, Bordetella pertussis
cccaucccauccgcgcca

SEQ ID NO: 407920 - RNA, 22 nt, Bordetella pertussis
cccaucugguugagcagcaccu

SEQ ID NO: 407921 - RNA, 22 nt, Bordetella pertussis
cccaugccgcggacccaggccu

SEQ ID NO: 407922 - RNA, 15 nt, Bordetella pertussis
cccaugcgcugcgcc

SEQ ID NO: 407923 - RNA, 19 nt, Bordetella pertussis
cccaugcgcugcgccuugg

SEQ ID NO: 407924 - RNA, 14 nt, Bordetella pertussis
cccaugcggggaca

SEQ ID NO: 407925 - RNA, 17 nt, Bordetella pertussis
cccaugcggggacaggc

SEQ ID NO: 407926 - RNA, 19 nt, Bordetella pertussis
cccaugcggggacaggcac

SEQ ID NO: 407927 - RNA, 20 nt, Bordetella pertussis
cccaugcggggacaggcacu

SEQ ID NO: 407928 - RNA, 18 nt, Bordetella pertussis
cccaugcgcauggccagc

SEQ ID NO: 407929 - RNA, 19 nt, Bordetella pertussis
cccaugcgcauggccagca

SEQ ID NO: 407930 - RNA, 23 nt, Bordetella pertussis
cccauggccaaugaccgacgccg

SEQ ID NO: 407931 - RNA, 13 nt, Bordetella pertussis
cccauggccaggg

SEQ ID NO: 407932 - RNA, 14 nt, Bordetella pertussis
cccauggccgugcg

SEQ ID NO: 407933 - RNA, 21 nt, Bordetella pertussis
cccauggggugcuccugccag

SEQ ID NO: 407934 - RNA, 17 nt, Bordetella pertussis
cccauguggggacaggc

SEQ ID NO: 407935 - RNA, 17 nt, Bordetella pertussis
ccccacagggggacugg

SEQ ID NO: 407936 - RNA, 20 nt, Bordetella pertussis
ccccacagggggacuggcac

SEQ ID NO: 407937 - RNA, 23 nt, Bordetella pertussis
ccccacagggggucuggcaccug

SEQ ID NO: 407938 - RNA, 21 nt, Bordetella pertussis
ccccacauggggacuggcacc

SEQ ID NO: 407939 - RNA, 21 nt, Bordetella pertussis
ccccaccacgucgcggcuggg

SEQ ID NO: 407940 - RNA, 17 nt, Bordetella pertussis
ccccaccgggacaggca

SEQ ID NO: 407941 - RNA, 13 nt, Bordetella pertussis
ccccaccuccacc

SEQ ID NO: 407942 - RNA, 16 nt, Bordetella pertussis
ccccagauccgcaagu

SEQ ID NO: 407943 - RNA, 13 nt, Bordetella pertussis
ccccagcagcgcc

SEQ ID NO: 407944 - RNA, 14 nt, Bordetella pertussis
ccccagcagcgccg

SEQ ID NO: 407945 - RNA, 18 nt, Bordetella pertussis
ccccagcaugugcgcggc

SEQ ID NO: 407946 - RNA, 20 nt, Bordetella pertussis
ccccagcgccagcguggccg

SEQ ID NO: 407947 - RNA, 17 nt, Bordetella pertussis
cccccacgcugcgcccg

SEQ ID NO: 407948 - RNA, 12 nt, Bordetella pertussis
cccccagcgccg

SEQ ID NO: 407949 - RNA, 13 nt, Bordetella pertussis
cccccagcggcgc

SEQ ID NO: 407950 - RNA, 21 nt, Bordetella pertussis
cccccgggcgcaagcgcgccg

SEQ ID NO: 407951 - RNA, 16 nt, Bordetella pertussis
cccccguaggcggccc

SEQ ID NO: 407952 - RNA, 14 nt, Bordetella pertussis
cccccuacugcccu

SEQ ID NO: 407953 - RNA, 18 nt, Bordetella pertussis
cccccuacugcccucgcc

SEQ ID NO: 407954 - RNA, 14 nt, Bordetella pertussis
cccccucggccugc

SEQ ID NO: 407955 - RNA, 23 nt, Bordetella pertussis
cccccugcggggacaggcacccu

SEQ ID NO: 407956 - RNA, 21 nt, Bordetella pertussis
ccccgagauaggcggccaggc

SEQ ID NO: 407957 - RNA, 22 nt, Bordetella pertussis
ccccgagauaggcggccaggcu

SEQ ID NO: 407958 - RNA, 22 nt, Bordetella pertussis
ccccgagggggcuuuuuugccu

SEQ ID NO: 407959 - RNA, 21 nt, Bordetella pertussis
ccccgaucagcaagggcccca

SEQ ID NO: 407960 - RNA, 22 nt, Bordetella pertussis
ccccgaucagcaagggccccag

SEQ ID NO: 407961 - RNA, 17 nt, Bordetella pertussis
ccccgauccgcgggcgg

SEQ ID NO: 407962 - RNA, 15 nt, Bordetella pertussis
ccccgaucggcgccg

SEQ ID NO: 407963 - RNA, 18 nt, Bordetella pertussis
ccccgcaagggggacugg

SEQ ID NO: 407964 - RNA, 22 nt, Bordetella pertussis
ccccgcaagggggacuggcacc

SEQ ID NO: 407965 - RNA, 16 nt, Bordetella pertussis
ccccgcacggggacug

SEQ ID NO: 407966 - RNA, 21 nt, Bordetella pertussis
ccccgccguggcguugacggc

SEQ ID NO: 407967 - RNA, 15 nt, Bordetella pertussis
ccccgccugcgccag

SEQ ID NO: 407968 - RNA, 21 nt, Bordetella pertussis
ccccgcgacccagaacccggc

SEQ ID NO: 407969 - RNA, 13 nt, Bordetella pertussis
ccccgcggcgccc

SEQ ID NO: 407970 - RNA, 13 nt, Bordetella pertussis
ccccgcggggaca

SEQ ID NO: 407971 - RNA, 17 nt, Bordetella pertussis
ccccgcggggacaggca

SEQ ID NO: 407972 - RNA, 23 nt, Bordetella pertussis
ccccgcggggacaggcacccugu

SEQ ID NO: 407973 - RNA, 23 nt, Bordetella pertussis
ccccgcggggacuggcucccacc

SEQ ID NO: 407974 - RNA, 18 nt, Bordetella pertussis
ccccgcgcugcgcccgcu

SEQ ID NO: 407975 - RNA, 22 nt, Bordetella pertussis
ccccgcggaggagguuuuccug

SEQ ID NO: 407976 - RNA, 17 nt, Bordetella pertussis
ccccgcuggccgucgcc

SEQ ID NO: 407977 - RNA, 21 nt, Bordetella pertussis
ccccgcuggccgucgccgccc

SEQ ID NO: 407978 - RNA, 17 nt, Bordetella pertussis
ccccgcugggacaggca

SEQ ID NO: 407979 - RNA, 20 nt, Bordetella pertussis
ccccgguguaggcgggcagc

SEQ ID NO: 407980 - RNA, 15 nt, Bordetella pertussis
ccccgucggccgucu

SEQ ID NO: 407981 - RNA, 17 nt, Bordetella pertussis
ccccuccggcgccgccu

SEQ ID NO: 407982 - RNA, 15 nt, Bordetella pertussis
ccccuugcggccgcc

SEQ ID NO: 407983 - RNA, 14 nt, Bordetella pertussis
cccgacaccuggac

SEQ ID NO: 407984 - RNA, 18 nt, Bordetella pertussis
cccgacaccuggacccgc

SEQ ID NO: 407985 - RNA, 15 nt, Bordetella pertussis
cccgacagcgccccg

SEQ ID NO: 407986 - RNA, 21 nt, Bordetella pertussis
cccgaccgcaugggcgccgag

SEQ ID NO: 407987 - RNA, 19 nt, Bordetella pertussis
cccgacgaggagccggcgg

SEQ ID NO: 407988 - RNA, 17 nt, Bordetella pertussis
cccgacgaugaucauga

SEQ ID NO: 407989 - RNA, 13 nt, Bordetella pertussis
cccgacgccgcgc

SEQ ID NO: 407990 - RNA, 15 nt, Bordetella pertussis
cccgagcgcucccgc

SEQ ID NO: 407991 - RNA, 13 nt, Bordetella pertussis
cccgagcggcgcc

SEQ ID NO: 407992 - RNA, 17 nt, Bordetella pertussis
cccgaggcgcgcagcac

SEQ ID NO: 407993 - RNA, 20 nt, Bordetella pertussis
cccgaggcgcgcagcacgcc

SEQ ID NO: 407994 - RNA, 20 nt, Bordetella pertussis
cccgaguccuugacgccgcc

SEQ ID NO: 407995 - RNA, 15 nt, Bordetella pertussis
cccgcaacgccgccc

SEQ ID NO: 407996 - RNA, 17 nt, Bordetella pertussis
cccgcaacgggccggcc

SEQ ID NO: 407997 - RNA, 20 nt, Bordetella pertussis
cccgcaagauuucauggcgu

SEQ ID NO: 407998 - RNA, 15 nt, Bordetella pertussis
cccgcaaggaccaug

SEQ ID NO: 407999 - RNA, 14 nt, Bordetella pertussis
cccgcaccgggcgg

SEQ ID NO: 408000 - RNA, 14 nt, Bordetella pertussis
cccgcacgccggcc

SEQ ID NO: 408001 - RNA, 22 nt, Bordetella pertussis
cccgcacgccggccugcgccag

SEQ ID NO: 408002 - RNA, 23 nt, Bordetella pertussis
cccgcacggggacuggcaccggc

SEQ ID NO: 408003 - RNA, 19 nt, Bordetella pertussis
cccgcauggaccgccgccg

SEQ ID NO: 408004 - RNA, 22 nt, Bordetella pertussis
cccgcauugaucgaucagccag

SEQ ID NO: 408005 - RNA, 14 nt, Bordetella pertussis
cccgccaccacggc

SEQ ID NO: 408006 - RNA, 14 nt, Bordetella pertussis
cccgccaccaggaa

SEQ ID NO: 408007 - RNA, 17 nt, Bordetella pertussis
cccgccaccgcccccgc

SEQ ID NO: 408008 - RNA, 22 nt, Bordetella pertussis
cccgccaccgcccccgccgcca

SEQ ID NO: 408009 - RNA, 16 nt, Bordetella pertussis
cccgccacgcaggcgg

SEQ ID NO: 408010 - RNA, 20 nt, Bordetella pertussis
cccgccacgucgccggcguu

SEQ ID NO: 408011 - RNA, 16 nt, Bordetella pertussis
cccgccagcaaggcgg

SEQ ID NO: 408012 - RNA, 13 nt, Bordetella pertussis
cccgccagcgcgg

SEQ ID NO: 408013 - RNA, 15 nt, Bordetella pertussis
cccgccagcgcggcu

SEQ ID NO: 408014 - RNA, 18 nt, Bordetella pertussis
cccgccagggcggggccg

SEQ ID NO: 408015 - RNA, 21 nt, Bordetella pertussis
cccgccagguucgccuggcgg

SEQ ID NO: 408016 - RNA, 16 nt, Bordetella pertussis
cccgccauccuggccg

SEQ ID NO: 408017 - RNA, 13 nt, Bordetella pertussis
cccgccgccgccc

SEQ ID NO: 408018 - RNA, 23 nt, Bordetella pertussis
cccgccggcgcgcgcgcgccgca

SEQ ID NO: 408019 - RNA, 18 nt, Bordetella pertussis
cccgccgggcuccucgcc

SEQ ID NO: 408020 - RNA, 12 nt, Bordetella pertussis
cccgccgugccg

SEQ ID NO: 408021 - RNA, 16 nt, Bordetella pertussis
cccggcuccaggccgc

SEQ ID NO: 408022 - RNA, 18 nt, Bordetella pertussis
cccggcuccaggccgccc

SEQ ID NO: 408023 - RNA, 22 nt, Bordetella pertussis
cccggcuucugggucagcuucc

SEQ ID NO: 408024 - RNA, 20 nt, Bordetella pertussis
cccgggaaacucgcgcagcg

SEQ ID NO: 408025 - RNA, 17 nt, Bordetella pertussis
cccgggcaggagcgccg

SEQ ID NO: 408026 - RNA, 15 nt, Bordetella pertussis
cccgguagucgccgg

SEQ ID NO: 408027 - RNA, 23 nt, Bordetella pertussis
cccggugaucgaguaggccggca

SEQ ID NO: 408028 - RNA, 18 nt, Bordetella pertussis
cccggugccagucccccg

SEQ ID NO: 408029 - RNA, 19 nt, Bordetella pertussis
cccggugccagucccccgc

SEQ ID NO: 408030 - RNA, 14 nt, Bordetella pertussis
cccggugccugccc

SEQ ID NO: 408031 - RNA, 14 nt, Bordetella pertussis
cccgucagcggcgc

SEQ ID NO: 408032 - RNA, 14 nt, Bordetella pertussis
cccgucaggguacg

SEQ ID NO: 408033 - RNA, 17 nt, Bordetella pertussis
cccgucaugcgccgcag

SEQ ID NO: 408034 - RNA, 18 nt, Bordetella pertussis
cccgucaugcgccgcagc

SEQ ID NO: 408035 - RNA, 17 nt, Bordetella pertussis
cccgucauggcggcagg

SEQ ID NO: 408036 - RNA, 21 nt, Bordetella pertussis
cccgucauggcggcaggcgcg

SEQ ID NO: 408037 - RNA, 13 nt, Bordetella pertussis
cccgucucgcgcg

SEQ ID NO: 408038 - RNA, 16 nt, Bordetella pertussis
cccgucucgcgcgcca

SEQ ID NO: 408039 - RNA, 12 nt, Bordetella pertussis
cccgucuuggcg

SEQ ID NO: 408040 - RNA, 20 nt, Bordetella pertussis
cccgugccgcggcgcggccc

SEQ ID NO: 408041 - RNA, 15 nt, Bordetella pertussis
cccgugcgggccugc

SEQ ID NO: 408042 - RNA, 17 nt, Bordetella pertussis
cccgugcggggaccggc

SEQ ID NO: 408043 - RNA, 16 nt, Bordetella pertussis
cccgugcgugcgccug

SEQ ID NO: 408044 - RNA, 22 nt, Bordetella pertussis
cccgugcgugugccuguccccg

SEQ ID NO: 408045 - RNA, 12 nt, Bordetella pertussis
cccguggcggga

SEQ ID NO: 408046 - RNA, 17 nt, Bordetella pertussis
cccguggggacaggcac

SEQ ID NO: 408047 - RNA, 22 nt, Bordetella pertussis
cccguggggacgagcuccugga

SEQ ID NO: 408048 - RNA, 15 nt, Bordetella pertussis
cccgugucgccgucg

SEQ ID NO: 408049 - RNA, 19 nt, Bordetella pertussis
cccguugcucuuggcaacc

SEQ ID NO: 408050 - RNA, 13 nt, Bordetella pertussis
cccguuggcaggc

SEQ ID NO: 408051 - RNA, 19 nt, Bordetella pertussis
cccguuugcgcagcucgug

SEQ ID NO: 408052 - RNA, 17 nt, Bordetella pertussis
cccuacccgccgggcgg

SEQ ID NO: 408053 - RNA, 12 nt, Bordetella pertussis
cccuacccugau

SEQ ID NO: 408054 - RNA, 16 nt, Bordetella pertussis
cccuagagcaugcggc

SEQ ID NO: 408055 - RNA, 18 nt, Bordetella pertussis
cccuagagcaugcggcgu

SEQ ID NO: 408056 - RNA, 18 nt, Bordetella pertussis
cccucacgcuuccccgaa

SEQ ID NO: 408057 - RNA, 16 nt, Bordetella pertussis
cccucagcccgcaccg

SEQ ID NO: 408058 - RNA, 19 nt, Bordetella pertussis
cccucaguccagcuggccc

SEQ ID NO: 408059 - RNA, 16 nt, Bordetella pertussis
cccucauuggcgcgcu

SEQ ID NO: 408060 - RNA, 21 nt, Bordetella pertussis
cccucauuggcgcgcuugagc

SEQ ID NO: 408061 - RNA, 20 nt, Bordetella pertussis
cccucccugugggggacagg

SEQ ID NO: 408062 - RNA, 15 nt, Bordetella pertussis
cccuccggcgccagc

SEQ ID NO: 408063 - RNA, 14 nt, Bordetella pertussis
cccuccggcgccgc

SEQ ID NO: 408064 - RNA, 15 nt, Bordetella pertussis
cccuccggcgccgcc

SEQ ID NO: 408065 - RNA, 13 nt, Bordetella pertussis
cccuccucggcca

SEQ ID NO: 408066 - RNA, 18 nt, Bordetella pertussis
cccucgaugaggccaggg

SEQ ID NO: 408067 - RNA, 20 nt, Bordetella pertussis
cccucgaugaggccagggag

SEQ ID NO: 408068 - RNA, 12 nt, Bordetella pertussis
cccucgcacggc

SEQ ID NO: 408069 - RNA, 15 nt, Bordetella pertussis
cccucgcccagcgag

SEQ ID NO: 408070 - RNA, 17 nt, Bordetella pertussis
cccucgcggaugaccug

SEQ ID NO: 408071 - RNA, 12 nt, Bordetella pertussis
cccucgcggccg

SEQ ID NO: 408072 - RNA, 22 nt, Bordetella pertussis
cccucgggcgacaggcgcgccc

SEQ ID NO: 408073 - RNA, 18 nt, Bordetella pertussis
cccucggucagcgccagg

SEQ ID NO: 408074 - RNA, 15 nt, Bordetella pertussis
cccucggugcugcug

SEQ ID NO: 408075 - RNA, 18 nt, Bordetella pertussis
cccucgugaucgaccgcc

SEQ ID NO: 408076 - RNA, 18 nt, Bordetella pertussis
cccucguugacgccgacg

SEQ ID NO: 408077 - RNA, 18 nt, Bordetella pertussis
cccucuucggcggccagc

SEQ ID NO: 408078 - RNA, 18 nt, Bordetella pertussis
cccucuuucgccgcgcgc

SEQ ID NO: 408079 - RNA, 18 nt, Bordetella pertussis
cccugaacuauggcgcgc

SEQ ID NO: 408080 - RNA, 14 nt, Bordetella pertussis
cccugacccgcugg

SEQ ID NO: 408081 - RNA, 15 nt, Bordetella pertussis
cccugacccgcuggc

SEQ ID NO: 408082 - RNA, 20 nt, Bordetella pertussis
cccugaccggcggcgucugg

SEQ ID NO: 408083 - RNA, 20 nt, Bordetella pertussis
cccugcaugaccgccgccag

SEQ ID NO: 408084 - RNA, 19 nt, Bordetella pertussis
cccugcccauucccgcccu

SEQ ID NO: 408085 - RNA, 12 nt, Bordetella pertussis
cccugcccggca

SEQ ID NO: 408086 - RNA, 14 nt, Bordetella pertussis
cccugcccugcggc

SEQ ID NO: 408087 - RNA, 16 nt, Bordetella pertussis
cccugcccugcggcuu

SEQ ID NO: 408088 - RNA, 22 nt, Bordetella pertussis
cccugccgccaagggcgcgcca

SEQ ID NO: 408089 - RNA, 23 nt, Bordetella pertussis
cccugccgccaagggcgcgccag

SEQ ID NO: 408090 - RNA, 15 nt, Bordetella pertussis
cccugccgccucagc

SEQ ID NO: 408091 - RNA, 16 nt, Bordetella pertussis
cccugcggcgcggcca

SEQ ID NO: 408092 - RNA, 18 nt, Bordetella pertussis
cccugcggcgcggccagc

SEQ ID NO: 408093 - RNA, 13 nt, Bordetella pertussis
cccugcggggaca

SEQ ID NO: 408094 - RNA, 15 nt, Bordetella pertussis
cccugcggggacagg

SEQ ID NO: 408095 - RNA, 22 nt, Bordetella pertussis
cccugcguggcgcagugggcca

SEQ ID NO: 408096 - RNA, 14 nt, Bordetella pertussis
cccuggcuggcggc

SEQ ID NO: 408097 - RNA, 14 nt, Bordetella pertussis
cccugggccagcag

SEQ ID NO: 408098 - RNA, 15 nt, Bordetella pertussis
cccugggccagccag

SEQ ID NO: 408099 - RNA, 22 nt, Bordetella pertussis
cccugggccagccagcgccgca

SEQ ID NO: 408100 - RNA, 13 nt, Bordetella pertussis
cccuggggccgcg

SEQ ID NO: 408101 - RNA, 18 nt, Bordetella pertussis
cccuggggccgcggcgcg

SEQ ID NO: 408102 - RNA, 19 nt, Bordetella pertussis
cccuggguggcggggcgca

SEQ ID NO: 408103 - RNA, 13 nt, Bordetella pertussis
cccugguccagca

SEQ ID NO: 408104 - RNA, 22 nt, Bordetella pertussis
aaacagcaucagcggcagcacg

SEQ ID NO: 408105 - RNA, 13 nt, Bordetella pertussis
ccgaaccacagca

SEQ ID NO: 408106 - RNA, 20 nt, Bordetella pertussis
ccgaacggggacuggcacca

SEQ ID NO: 408107 - RNA, 16 nt, Bordetella pertussis
ccgaacggggccgccu

SEQ ID NO: 408108 - RNA, 14 nt, Bordetella pertussis
ccgaacggcagcag

SEQ ID NO: 408109 - RNA, 13 nt, Bordetella pertussis
ccgaagaggagcu

SEQ ID NO: 408110 - RNA, 16 nt, Bordetella pertussis
ccgaauccggccagca

SEQ ID NO: 408111 - RNA, 14 nt, Bordetella pertussis
ccgacaccuggacc

SEQ ID NO: 408112 - RNA, 18 nt, Bordetella pertussis
ccgacagcaagggcagau

SEQ ID NO: 408113 - RNA, 18 nt, Bordetella pertussis
ccgacagcacauggcgcg

SEQ ID NO: 408114 - RNA, 23 nt, Bordetella pertussis
ccgacaggaaggcgagcgcggca

SEQ ID NO: 408115 - RNA, 23 nt, Bordetella pertussis
ccgacaggaugaagaccacgugg

SEQ ID NO: 408116 - RNA, 15 nt, Bordetella pertussis
ccgacaggccuggcu

SEQ ID NO: 408117 - RNA, 21 nt, Bordetella pertussis
ccgacaggcgcgcaggcgggc

SEQ ID NO: 408118 - RNA, 19 nt, Bordetella pertussis
ccgacaugucgugcuggcu

SEQ ID NO: 408119 - RNA, 13 nt, Bordetella pertussis
ccgaccaccagca

SEQ ID NO: 408120 - RNA, 21 nt, Bordetella pertussis
ccgaccaccugcaccgccgcg

SEQ ID NO: 408121 - RNA, 20 nt, Bordetella pertussis
ccgaccagcgcgcgccggcc

SEQ ID NO: 408122 - RNA, 15 nt, Bordetella pertussis
ccgaccaggccggcg

SEQ ID NO: 408123 - RNA, 20 nt, Bordetella pertussis
ccgaccagguaucgacccag

SEQ ID NO: 408124 - RNA, 16 nt, Bordetella pertussis
ccgacccccggcccgc

SEQ ID NO: 408125 - RNA, 14 nt, Bordetella pertussis
ccgacccgcggccc

SEQ ID NO: 408126 - RNA, 13 nt, Bordetella pertussis
ccgacccugcccg

SEQ ID NO: 408127 - RNA, 14 nt, Bordetella pertussis
ccgaccgaagagga

SEQ ID NO: 408128 - RNA, 17 nt, Bordetella pertussis
ccgaccgaagaggagcu

SEQ ID NO: 408129 - RNA, 20 nt, Bordetella pertussis
ccgaccgcaugggcgccgag

SEQ ID NO: 408130 - RNA, 12 nt, Bordetella pertussis
ccgaccgcuucc

SEQ ID NO: 408131 - RNA, 19 nt, Bordetella pertussis
ccgaccgcuuccgccaccg

SEQ ID NO: 408132 - RNA, 20 nt, Bordetella pertussis
ccgaccggccccaccuggcg

SEQ ID NO: 408133 - RNA, 14 nt, Bordetella pertussis
ccgaccggcgcgcg

SEQ ID NO: 408134 - RNA, 14 nt, Bordetella pertussis
ccgaccgggccgac

SEQ ID NO: 408135 - RNA, 18 nt, Bordetella pertussis
ccgaccgggccgaccagg

SEQ ID NO: 408136 - RNA, 18 nt, Bordetella pertussis
ccgaccugaucgcgcagc

SEQ ID NO: 408137 - RNA, 24 nt, Bordetella pertussis
ccgaccugaucgcgcagcgccugg

SEQ ID NO: 408138 - RNA, 12 nt, Bordetella pertussis
ccgaccuccagg

SEQ ID NO: 408139 - RNA, 15 nt, Bordetella pertussis
ccgaccuccaggccc

SEQ ID NO: 408140 - RNA, 14 nt, Bordetella pertussis
ccgacgaugccgcc

SEQ ID NO: 408141 - RNA, 16 nt, Bordetella pertussis
ccgacgaugccgccgc

SEQ ID NO: 408142 - RNA, 17 nt, Bordetella pertussis
ccgacgaugccgccgcc

SEQ ID NO: 408143 - RNA, 18 nt, Bordetella pertussis
ccgacgaugccgccgccg

SEQ ID NO: 408144 - RNA, 19 nt, Bordetella pertussis
ccgacgaugucgccgccgc

SEQ ID NO: 408145 - RNA, 12 nt, Bordetella pertussis
ccgacgccgcca

SEQ ID NO: 408146 - RNA, 16 nt, Bordetella pertussis
ccgacgcgcccgggcu

SEQ ID NO: 408147 - RNA, 17 nt, Bordetella pertussis
ccgacgcgccgggccac

SEQ ID NO: 408148 - RNA, 17 nt, Bordetella pertussis
ccgacgcgcuuccagga

SEQ ID NO: 408149 - RNA, 15 nt, Bordetella pertussis
ccgacgcggccagcg

SEQ ID NO: 408150 - RNA, 17 nt, Bordetella pertussis
ccgacgcggccagcggc

SEQ ID NO: 408151 - RNA, 22 nt, Bordetella pertussis
ccgacuucucuuucucgggcgu

SEQ ID NO: 408152 - RNA, 18 nt, Bordetella pertussis
ccgacuuggugggcaccu

SEQ ID NO: 408153 - RNA, 19 nt, Bordetella pertussis
ccgagaaaccgauggugcc

SEQ ID NO: 408154 - RNA, 20 nt, Bordetella pertussis
ccgagaaauccagcgcgccc

SEQ ID NO: 408155 - RNA, 21 nt, Bordetella pertussis
ccgagaagauuucccagagcu

SEQ ID NO: 408156 - RNA, 22 nt, Bordetella pertussis
ccgagaagauuucccagagcug

SEQ ID NO: 408157 - RNA, 13 nt, Bordetella pertussis
ccgagcccuggcu

SEQ ID NO: 408158 - RNA, 21 nt, Bordetella pertussis
ccgagccgcagguccaggccu

SEQ ID NO: 408159 - RNA, 16 nt, Bordetella pertussis
ccgagccggccagcgc

SEQ ID NO: 408160 - RNA, 14 nt, Bordetella pertussis
ccgagcggggccgc

SEQ ID NO: 408161 - RNA, 17 nt, Bordetella pertussis
ccgagcugagcaccagc

SEQ ID NO: 408162 - RNA, 21 nt, Bordetella pertussis
ccgagcugagcaccagcagcc

SEQ ID NO: 408163 - RNA, 20 nt, Bordetella pertussis
ccgauguccacgaaggcgcc

SEQ ID NO: 408164 - RNA, 18 nt, Bordetella pertussis
ccgaugucgaccaugucc

SEQ ID NO: 408165 - RNA, 16 nt, Bordetella pertussis
ccgauugaggccagca

SEQ ID NO: 408166 - RNA, 16 nt, Bordetella pertussis
ccgauuucgcgcgcca

SEQ ID NO: 408167 - RNA, 16 nt, Bordetella pertussis
ccgauuuucaccaucc

SEQ ID NO: 408168 - RNA, 20 nt, Bordetella pertussis
ccgcaaaccugaugccuguc

SEQ ID NO: 408169 - RNA, 20 nt, Bordetella pertussis
ccgcacaguuugucggcgau

SEQ ID NO: 408170 - RNA, 19 nt, Bordetella pertussis
ccgcacauacaaggcgcgg

SEQ ID NO: 408171 - RNA, 13 nt, Bordetella pertussis
ccgcaccagccug

SEQ ID NO: 408172 - RNA, 18 nt, Bordetella pertussis
ccgcaccagcgccgacgg

SEQ ID NO: 408173 - RNA, 13 nt, Bordetella pertussis
ccgcaccaggccg

SEQ ID NO: 408174 - RNA, 16 nt, Bordetella pertussis
ccgcaccaggccgcgg

SEQ ID NO: 408175 - RNA, 21 nt, Bordetella pertussis
ccgcaccaggccgcggcgccc

SEQ ID NO: 408176 - RNA, 13 nt, Bordetella pertussis
ccgcaccaugcgg

SEQ ID NO: 408177 - RNA, 16 nt, Bordetella pertussis
ccgcaccaugcggucu

SEQ ID NO: 408178 - RNA, 17 nt, Bordetella pertussis
ccgcacuucgggccacc

SEQ ID NO: 408179 - RNA, 16 nt, Bordetella pertussis
ccgcagaacagcagcg

SEQ ID NO: 408180 - RNA, 16 nt, Bordetella pertussis
ccgcagagggagcgac

SEQ ID NO: 408181 - RNA, 20 nt, Bordetella pertussis
ccgcagcgggcccgucgcgc

SEQ ID NO: 408182 - RNA, 16 nt, Bordetella pertussis
ccgcagcggggacagg

SEQ ID NO: 408183 - RNA, 14 nt, Bordetella pertussis
ccgcagcguggcgu

SEQ ID NO: 408184 - RNA, 23 nt, Bordetella pertussis
ccgcaggcaagcugcuggcgcgc

SEQ ID NO: 408185 - RNA, 18 nt, Bordetella pertussis
ccgcaggcggcggccucc

SEQ ID NO: 408186 - RNA, 15 nt, Bordetella pertussis
ccgcaggcggcuggu

SEQ ID NO: 408187 - RNA, 14 nt, Bordetella pertussis
ccgcagggcgugcg

SEQ ID NO: 408188 - RNA, 17 nt, Bordetella pertussis
ccgcagguccaggccug

SEQ ID NO: 408189 - RNA, 14 nt, Bordetella pertussis
ccgcaguauuccug

SEQ ID NO: 408190 - RNA, 18 nt, Bordetella pertussis
ccgcauaccuuggcgccc

SEQ ID NO: 408191 - RNA, 22 nt, Bordetella pertussis
ccgcauagcgcaugaugcugcc

SEQ ID NO: 408192 - RNA, 13 nt, Bordetella pertussis
ccgcaucaccgau

SEQ ID NO: 408193 - RNA, 16 nt, Bordetella pertussis
ccgcaucccgcccccg

SEQ ID NO: 408194 - RNA, 16 nt, Bordetella pertussis
ccgcauccgacuccca

SEQ ID NO: 408195 - RNA, 20 nt, Bordetella pertussis
ccgcaucgcgcaagggccag

SEQ ID NO: 408196 - RNA, 22 nt, Bordetella pertussis
ccgcaucgcgcaagggccaguc

SEQ ID NO: 408197 - RNA, 18 nt, Bordetella pertussis
ccgcaucgcgcagcgugc

SEQ ID NO: 408198 - RNA, 18 nt, Bordetella pertussis
ccgcaucggcguaccagg

SEQ ID NO: 408199 - RNA, 15 nt, Bordetella pertussis
ccgcaugcggcggcu

SEQ ID NO: 408200 - RNA, 23 nt, Bordetella pertussis
ccgcaugcgugaagcccauggcg

SEQ ID NO: 408201 - RNA, 15 nt, Bordetella pertussis
ccgcauggggcgagg

SEQ ID NO: 408202 - RNA, 14 nt, Bordetella pertussis
ccgcaugguggcgc

SEQ ID NO: 408203 - RNA, 14 nt, Bordetella pertussis
ccgcaugucccagc

SEQ ID NO: 408204 - RNA, 15 nt, Bordetella pertussis
ccgcaugucccagcg

SEQ ID NO: 408205 - RNA, 14 nt, Bordetella pertussis
ccgcaugggccagg

SEQ ID NO: 408206 - RNA, 15 nt, Bordetella pertussis
ccgcaugggccaggc

SEQ ID NO: 408207 - RNA, 16 nt, Bordetella pertussis
ccgcaugggccaggcg

SEQ ID NO: 408208 - RNA, 15 nt, Bordetella pertussis
ccgcaugggcgcgcc

SEQ ID NO: 408209 - RNA, 23 nt, Bordetella pertussis
ccgcauuuccucgaccagcgcgc

SEQ ID NO: 408210 - RNA, 15 nt, Bordetella pertussis
ccgccaacgcggcgc

SEQ ID NO: 408211 - RNA, 14 nt, Bordetella pertussis
ccgccaacgccaag

SEQ ID NO: 408212 - RNA, 21 nt, Bordetella pertussis
ccgccaacucgcuccagcgga

SEQ ID NO: 408213 - RNA, 19 nt, Bordetella pertussis
ccgccaagggcgcgccagc

SEQ ID NO: 408214 - RNA, 14 nt, Bordetella pertussis
ccgccacagcgccg

SEQ ID NO: 408215 - RNA, 17 nt, Bordetella pertussis
ccgccacagcgccgcgg

SEQ ID NO: 408216 - RNA, 18 nt, Bordetella pertussis
ccgccacacgaggaccgc

SEQ ID NO: 408217 - RNA, 14 nt, Bordetella pertussis
ccgccacccaggcg

SEQ ID NO: 408218 - RNA, 15 nt, Bordetella pertussis
ccgccacccagggcu

SEQ ID NO: 408219 - RNA, 19 nt, Bordetella pertussis
ccgccaccagggcgcccgc

SEQ ID NO: 408220 - RNA, 19 nt, Bordetella pertussis
ccgccaccugggccgccug

SEQ ID NO: 408221 - RNA, 22 nt, Bordetella pertussis
ccgccacgaaacccacggcgau

SEQ ID NO: 408222 - RNA, 18 nt, Bordetella pertussis
ccgccacgcgggccggcc

SEQ ID NO: 408223 - RNA, 18 nt, Bordetella pertussis
ccgccacgcgguccagcc

SEQ ID NO: 408224 - RNA, 14 nt, Bordetella pertussis
ccgccacggcgccc

SEQ ID NO: 408225 - RNA, 12 nt, Bordetella pertussis
ccgccacggucg

SEQ ID NO: 408226 - RNA, 17 nt, Bordetella pertussis
ccgccacggucgcgagc

SEQ ID NO: 408227 - RNA, 20 nt, Bordetella pertussis
ccgccacgugcugcuggaga

SEQ ID NO: 408228 - RNA, 17 nt, Bordetella pertussis
ccgccacuugcggcagg

SEQ ID NO: 408229 - RNA, 13 nt, Bordetella pertussis
ccgccagaucguu

SEQ ID NO: 408230 - RNA, 23 nt, Bordetella pertussis
ccgccagcaaggcgucggccagg

SEQ ID NO: 408231 - RNA, 17 nt, Bordetella pertussis
ccgccagcaccugcuug

SEQ ID NO: 408232 - RNA, 20 nt, Bordetella pertussis
ccgccagcauggcggccagg

SEQ ID NO: 408233 - RNA, 14 nt, Bordetella pertussis
ccgccagccggccc

SEQ ID NO: 408234 - RNA, 13 nt, Bordetella pertussis
aaaccauggaagc

SEQ ID NO: 408235 - RNA, 18 nt, Bordetella pertussis
ccgccagcgccuggaccu

SEQ ID NO: 408236 - RNA, 14 nt, Bordetella pertussis
ccgccagcgcgucg

SEQ ID NO: 408237 - RNA, 22 nt, Bordetella pertussis
ccgccagcgcgucguccagcgu

SEQ ID NO: 408238 - RNA, 13 nt, Bordetella pertussis
ccgccagcggcug

SEQ ID NO: 408239 - RNA, 14 nt, Bordetella pertussis
ccgccagcgggagc

SEQ ID NO: 408240 - RNA, 13 nt, Bordetella pertussis
ccgccaggccagg

SEQ ID NO: 408241 - RNA, 16 nt, Bordetella pertussis
ccgccaggccagguag

SEQ ID NO: 408242 - RNA, 15 nt, Bordetella pertussis
ccgccaggccgucga

SEQ ID NO: 408243 - RNA, 15 nt, Bordetella pertussis
ccgccagggccgagc

SEQ ID NO: 408244 - RNA, 20 nt, Bordetella pertussis
ccgccagggccauguggcgc

SEQ ID NO: 408245 - RNA, 17 nt, Bordetella pertussis
ccgccagggcggggccg

SEQ ID NO: 408246 - RNA, 18 nt, Bordetella pertussis
ccgccaguucgucgucgg

SEQ ID NO: 408247 - RNA, 15 nt, Bordetella pertussis
ccgccauagcugcgc

SEQ ID NO: 408248 - RNA, 17 nt, Bordetella pertussis
ccgccauaggcgcgcac

SEQ ID NO: 408249 - RNA, 22 nt, Bordetella pertussis
ccgccaucauccuggucgacgc

SEQ ID NO: 408250 - RNA, 20 nt, Bordetella pertussis
ccgccaucauggcgucggcc

SEQ ID NO: 408251 - RNA, 15 nt, Bordetella pertussis
ccgccauccuggccg

SEQ ID NO: 408252 - RNA, 19 nt, Bordetella pertussis
ccgccauccuggccgccgc

SEQ ID NO: 408253 - RNA, 20 nt, Bordetella pertussis
ccgccauccuggccgccgcg

SEQ ID NO: 408254 - RNA, 17 nt, Bordetella pertussis
ccgccaucgccaggacc

SEQ ID NO: 408255 - RNA, 22 nt, Bordetella pertussis
ccgccaucgucguagcgccagc

SEQ ID NO: 408256 - RNA, 19 nt, Bordetella pertussis
ccgccaugcacgggccaug

SEQ ID NO: 408257 - RNA, 18 nt, Bordetella pertussis
ccgccauggaggcgcagc

SEQ ID NO: 408258 - RNA, 17 nt, Bordetella pertussis
ccgccauggcggccgcc

SEQ ID NO: 408259 - RNA, 18 nt, Bordetella pertussis
ccgccauggcggccgccg

SEQ ID NO: 408260 - RNA, 13 nt, Bordetella pertussis
ccgccauugcgcc

SEQ ID NO: 408261 - RNA, 24 nt, Bordetella pertussis
ccgcccaccaccagcgcggccagc

SEQ ID NO: 408262 - RNA, 13 nt, Bordetella pertussis
ccgcccaccguga

SEQ ID NO: 408263 - RNA, 14 nt, Bordetella pertussis
ccgcccaccgugac

SEQ ID NO: 408264 - RNA, 12 nt, Bordetella pertussis
ccgcccacgcca

SEQ ID NO: 408265 - RNA, 15 nt, Bordetella pertussis
ccgcccacgcggcgc

SEQ ID NO: 408266 - RNA, 21 nt, Bordetella pertussis
ccgcccagcauccgcgccagg

SEQ ID NO: 408267 - RNA, 14 nt, Bordetella pertussis
ccgcccagccaggc

SEQ ID NO: 408268 - RNA, 20 nt, Bordetella pertussis
ccgcccagccaggcgccagc

SEQ ID NO: 408269 - RNA, 23 nt, Bordetella pertussis
ccgcccagccaggcgccagcggc

SEQ ID NO: 408270 - RNA, 18 nt, Bordetella pertussis
ccgcccagccgcgccagg

SEQ ID NO: 408271 - RNA, 13 nt, Bordetella pertussis
ccgcccagcgagu

SEQ ID NO: 408272 - RNA, 21 nt, Bordetella pertussis
ccgcccagcgcgugggccagc

SEQ ID NO: 408273 - RNA, 15 nt, Bordetella pertussis
ccgcccaggcgcagc

SEQ ID NO: 408274 - RNA, 19 nt, Bordetella pertussis
ccgcccagucguccagcac

SEQ ID NO: 408275 - RNA, 21 nt, Bordetella pertussis
ccgcccaugcgcauggccagc

SEQ ID NO: 408276 - RNA, 16 nt, Bordetella pertussis
ccgccccagcagcagc

SEQ ID NO: 408277 - RNA, 22 nt, Bordetella pertussis
ccgccccaguugcgcguccagg

SEQ ID NO: 408278 - RNA, 22 nt, Bordetella pertussis
ccgccccccuacgaauccccgc

SEQ ID NO: 408279 - RNA, 17 nt, Bordetella pertussis
ccgccccggcgcggcgc

SEQ ID NO: 408280 - RNA, 21 nt, Bordetella pertussis
ccgccccgggcaggagcgccg

SEQ ID NO: 408281 - RNA, 20 nt, Bordetella pertussis
ccgcccgacgaggagccggc

SEQ ID NO: 408282 - RNA, 21 nt, Bordetella pertussis
ccgcccgcacgaagcggcauc

SEQ ID NO: 408283 - RNA, 12 nt, Bordetella pertussis
ccgcccgccagg

SEQ ID NO: 408284 - RNA, 19 nt, Bordetella pertussis
ccgcccgcgagcggccagc

SEQ ID NO: 408285 - RNA, 14 nt, Bordetella pertussis
ccgcccgcggccug

SEQ ID NO: 408286 - RNA, 14 nt, Bordetella pertussis
ccgcccgcggcggc

SEQ ID NO: 408287 - RNA, 17 nt, Bordetella pertussis
ccgcccgcggcggcccg

SEQ ID NO: 408288 - RNA, 15 nt, Bordetella pertussis
ccgcccgcuccacca

SEQ ID NO: 408289 - RNA, 24 nt, Bordetella pertussis
ccgcccgcuccaccagcaccggca

SEQ ID NO: 408290 - RNA, 17 nt, Bordetella pertussis
ccgcccggccggcccgc

SEQ ID NO: 408291 - RNA, 23 nt, Bordetella pertussis
ccgcccggccggcccgcgcgccu

SEQ ID NO: 408292 - RNA, 18 nt, Bordetella pertussis
ccgcccggcaacccgccc

SEQ ID NO: 408293 - RNA, 12 nt, Bordetella pertussis
ccgcccggggcc

SEQ ID NO: 408294 - RNA, 21 nt, Bordetella pertussis
ccgcccggguuggcguccagg

SEQ ID NO: 408295 - RNA, 17 nt, Bordetella pertussis
ccgcccguccgggcggc

SEQ ID NO: 408296 - RNA, 14 nt, Bordetella pertussis
ccgcccgugccagu

SEQ ID NO: 408297 - RNA, 16 nt, Bordetella pertussis
ccgcccguugcggcgc

SEQ ID NO: 408298 - RNA, 19 nt, Bordetella pertussis
ccgcccuggcgcgaggcgg

SEQ ID NO: 408299 - RNA, 14 nt, Bordetella pertussis
ccgcccugggcagc

SEQ ID NO: 408300 - RNA, 12 nt, Bordetella pertussis
ccgcccuggccg

SEQ ID NO: 408301 - RNA, 21 nt, Bordetella pertussis
ccgcccuugccagggccuggc

SEQ ID NO: 408302 - RNA, 15 nt, Bordetella pertussis
ccgccgaacggcagc

SEQ ID NO: 408303 - RNA, 18 nt, Bordetella pertussis
ccgccgaacggggccgcc

SEQ ID NO: 408304 - RNA, 18 nt, Bordetella pertussis
ccgccgaagccgccgccg

SEQ ID NO: 408305 - RNA, 17 nt, Bordetella pertussis
ccgccgacgccgccacg

SEQ ID NO: 408306 - RNA, 18 nt, Bordetella pertussis
ccgccgacgccgccacgc

SEQ ID NO: 408307 - RNA, 24 nt, Bordetella pertussis
ccgccgagaaauccagcgcgccca

SEQ ID NO: 408308 - RNA, 15 nt, Bordetella pertussis
aaacccggcaauccc

SEQ ID NO: 408309 - RNA, 15 nt, Bordetella pertussis
ccgccgagucggcga

SEQ ID NO: 408310 - RNA, 21 nt, Bordetella pertussis
ccgccgaugccgccaucaucc

SEQ ID NO: 408311 - RNA, 17 nt, Bordetella pertussis
ccgccgcagccgccagc

SEQ ID NO: 408312 - RNA, 13 nt, Bordetella pertussis
ccgccgcaugccg

SEQ ID NO: 408313 - RNA, 12 nt, Bordetella pertussis
ccgccgccacca

SEQ ID NO: 408314 - RNA, 20 nt, Bordetella pertussis
ccgccgccaccaccucggcc

SEQ ID NO: 408315 - RNA, 15 nt, Bordetella pertussis
ccgccgccaccagcg

SEQ ID NO: 408316 - RNA, 14 nt, Bordetella pertussis
ccgccgccagcacg

SEQ ID NO: 408317 - RNA, 19 nt, Bordetella pertussis
ccgccgccauagcugcgcc

SEQ ID NO: 408318 - RNA, 15 nt, Bordetella pertussis
ccgccgcccgcccgc

SEQ ID NO: 408319 - RNA, 16 nt, Bordetella pertussis
ccgccgcccgccucag

SEQ ID NO: 408320 - RNA, 13 nt, Bordetella pertussis
ccgccgcccggca

SEQ ID NO: 408321 - RNA, 13 nt, Bordetella pertussis
ccgccgcccggcc

SEQ ID NO: 408322 - RNA, 17 nt, Bordetella pertussis
ccgccgccggcccgcca

SEQ ID NO: 408323 - RNA, 20 nt, Bordetella pertussis
ccgccgccggcccgccacgc

SEQ ID NO: 408324 - RNA, 22 nt, Bordetella pertussis
ccgccgccggucaccgccgccg

SEQ ID NO: 408325 - RNA, 20 nt, Bordetella pertussis
ccgccgcgaccaccagcacc

SEQ ID NO: 408326 - RNA, 17 nt, Bordetella pertussis
ccgccgcgaccgggccg

SEQ ID NO: 408327 - RNA, 20 nt, Bordetella pertussis
ccgccgcgaccgggccgaag

SEQ ID NO: 408328 - RNA, 12 nt, Bordetella pertussis
ccgccgcgcagc

SEQ ID NO: 408329 - RNA, 14 nt, Bordetella pertussis
ccgccgcgcccagc

SEQ ID NO: 408330 - RNA, 17 nt, Bordetella pertussis
ccgccgcgcccagccgc

SEQ ID NO: 408331 - RNA, 14 nt, Bordetella pertussis
ccgccgcgccgccc

SEQ ID NO: 408332 - RNA, 15 nt, Bordetella pertussis
ccgccgcgccgcccg

SEQ ID NO: 408333 - RNA, 16 nt, Bordetella pertussis
ccgccgcgccgcccgc

SEQ ID NO: 408334 - RNA, 13 nt, Bordetella pertussis
ccgccgcgcgccg

SEQ ID NO: 408335 - RNA, 14 nt, Bordetella pertussis
ccgccgcggccagc

SEQ ID NO: 408336 - RNA, 13 nt, Bordetella pertussis
ccgccgcggccug

SEQ ID NO: 408337 - RNA, 24 nt, Bordetella pertussis
ccgccgcgggcggccacgcgccgc

SEQ ID NO: 408338 - RNA, 21 nt, Bordetella pertussis
ccgccgcguggcggcgcagcg

SEQ ID NO: 408339 - RNA, 14 nt, Bordetella pertussis
ccgccgcguccucg

SEQ ID NO: 408340 - RNA, 15 nt, Bordetella pertussis
ccgccgcgucggcgc

SEQ ID NO: 408341 - RNA, 14 nt, Bordetella pertussis
ccgccgcugccggc

SEQ ID NO: 408342 - RNA, 18 nt, Bordetella pertussis
ccgccggcaccagcgcca

SEQ ID NO: 408343 - RNA, 17 nt, Bordetella pertussis
ccgccggcagggccagc

SEQ ID NO: 408344 - RNA, 13 nt, Bordetella pertussis
ccgccggccagcc

SEQ ID NO: 408345 - RNA, 13 nt, Bordetella pertussis
ccgccggccagcu

SEQ ID NO: 408346 - RNA, 22 nt, Bordetella pertussis
ccgccggcgcgguauggccgcc

SEQ ID NO: 408347 - RNA, 13 nt, Bordetella pertussis
ccgccggcgcguu

SEQ ID NO: 408348 - RNA, 21 nt, Bordetella pertussis
ccgccggcggccuggaccuga

SEQ ID NO: 408349 - RNA, 13 nt, Bordetella pertussis
ccgccggcggcgc

SEQ ID NO: 408350 - RNA, 21 nt, Bordetella pertussis
ccgccggcggcgccggccuca

SEQ ID NO: 408351 - RNA, 17 nt, Bordetella pertussis
ccgccgggacaggcacc

SEQ ID NO: 408352 - RNA, 19 nt, Bordetella pertussis
ccgccgggcaugcaccagg

SEQ ID NO: 408353 - RNA, 13 nt, Bordetella pertussis
ccgccgggccaag

SEQ ID NO: 408354 - RNA, 18 nt, Bordetella pertussis
ccgccgggccgcgcccac

SEQ ID NO: 408355 - RNA, 17 nt, Bordetella pertussis
ccgccgggccugcccgc

SEQ ID NO: 408356 - RNA, 14 nt, Bordetella pertussis
ccgccgggcgcgcg

SEQ ID NO: 408357 - RNA, 12 nt, Bordetella pertussis
ccgccgggcggc

SEQ ID NO: 408358 - RNA, 13 nt, Bordetella pertussis
ccgccgggcggcg

SEQ ID NO: 408359 - RNA, 18 nt, Bordetella pertussis
ccgccgggcuccucgccc

SEQ ID NO: 408360 - RNA, 22 nt, Bordetella pertussis
ccgccgggcuccucgcccgacc

SEQ ID NO: 408361 - RNA, 15 nt, Bordetella pertussis
ccgccggguuucucg

SEQ ID NO: 408362 - RNA, 17 nt, Bordetella pertussis
ccgccggucaccgccgc

SEQ ID NO: 408363 - RNA, 21 nt, Bordetella pertussis
ccgccggugcaccaggccacc

SEQ ID NO: 408364 - RNA, 23 nt, Bordetella pertussis
ccgccggugcaccaggccacccg

SEQ ID NO: 408365 - RNA, 16 nt, Bordetella pertussis
ccgccggugucggggc

SEQ ID NO: 408366 - RNA, 17 nt, Bordetella pertussis
ccgccggugucggggcc

SEQ ID NO: 408367 - RNA, 18 nt, Bordetella pertussis
ccgccggugucggggccg

SEQ ID NO: 408368 - RNA, 18 nt, Bordetella pertussis
ccgccguaaucggcgucg

SEQ ID NO: 408369 - RNA, 14 nt, Bordetella pertussis
ccgccguagcgcgc

SEQ ID NO: 408370 - RNA, 18 nt, Bordetella pertussis
ccgccguagcgcgccagc

SEQ ID NO: 408371 - RNA, 21 nt, Bordetella pertussis
ccgccguagcgcgccagccgc

SEQ ID NO: 408372 - RNA, 16 nt, Bordetella pertussis
ccgccguaggacagcc

SEQ ID NO: 408373 - RNA, 20 nt, Bordetella pertussis
ccgccgugacuucggccgcc

SEQ ID NO: 408374 - RNA, 16 nt, Bordetella pertussis
ccgccgugccgggccu

SEQ ID NO: 408375 - RNA, 15 nt, Bordetella pertussis
ccgccgugcgcgggc

SEQ ID NO: 408376 - RNA, 20 nt, Bordetella pertussis
ccgccgugcgcgggcgcggc

SEQ ID NO: 408377 - RNA, 19 nt, Bordetella pertussis
ccgccgugaugccgcccgc

SEQ ID NO: 408378 - RNA, 18 nt, Bordetella pertussis
ccgccguguaggcggucu

SEQ ID NO: 408379 - RNA, 22 nt, Bordetella pertussis
ccgccguguaggcggucuugac

SEQ ID NO: 408380 - RNA, 18 nt, Bordetella pertussis
ccgccguugcucgcgcgc

SEQ ID NO: 408381 - RNA, 17 nt, Bordetella pertussis
ccgccuaccaggugggc

SEQ ID NO: 408382 - RNA, 18 nt, Bordetella pertussis
ccgccuacuggcgcgcgc

SEQ ID NO: 408383 - RNA, 21 nt, Bordetella pertussis
ccgccuauguaggcgccgcgc

SEQ ID NO: 408384 - RNA, 13 nt, Bordetella pertussis
ccgccucaggccg

SEQ ID NO: 408385 - RNA, 14 nt, Bordetella pertussis
ccgccucaggccgg

SEQ ID NO: 408386 - RNA, 21 nt, Bordetella pertussis
ccgccucgacgaugcccugcg

SEQ ID NO: 408387 - RNA, 14 nt, Bordetella pertussis
ccgccucgacgccc

SEQ ID NO: 408388 - RNA, 20 nt, Bordetella pertussis
ccgccucgaucgccaggucg

SEQ ID NO: 408389 - RNA, 18 nt, Bordetella pertussis
ccgccucgcgcuccagca

SEQ ID NO: 408390 - RNA, 20 nt, Bordetella pertussis
ccgccucgggcacggccagc

SEQ ID NO: 408391 - RNA, 21 nt, Bordetella pertussis
ccgcugucgcugaucugcuug

SEQ ID NO: 408392 - RNA, 22 nt, Bordetella pertussis
ccgcugucgcugaucugcuuga

SEQ ID NO: 408393 - RNA, 17 nt, Bordetella pertussis
ccgcuguggacgccgcc

SEQ ID NO: 408394 - RNA, 18 nt, Bordetella pertussis
ccgcuguggacgccgccg

SEQ ID NO: 408395 - RNA, 14 nt, Bordetella pertussis
ccgcuguggcgcgc

SEQ ID NO: 408396 - RNA, 15 nt, Bordetella pertussis
ccgcuguggcgcgcc

SEQ ID NO: 408397 - RNA, 18 nt, Bordetella pertussis
ccgcuuauuuccucagcc

SEQ ID NO: 408398 - RNA, 23 nt, Bordetella pertussis
ccgcuucaggaacauguccacca

SEQ ID NO: 408399 - RNA, 15 nt, Bordetella pertussis
ccgcuuccaccgucu

SEQ ID NO: 408400 - RNA, 21 nt, Bordetella pertussis
ccgcuuccgccaccgcgccgc

SEQ ID NO: 408401 - RNA, 22 nt, Bordetella pertussis
ccgcuuccgccaccgcgccgcc

SEQ ID NO: 408402 - RNA, 18 nt, Bordetella pertussis
ccgcuuccggccggaacu

SEQ ID NO: 408403 - RNA, 17 nt, Bordetella pertussis
ccgcuuccggccgggcc

SEQ ID NO: 408404 - RNA, 18 nt, Bordetella pertussis
ccgcuuccggccgggcca

SEQ ID NO: 408405 - RNA, 19 nt, Bordetella pertussis
ccgcuuccggccgggccag

SEQ ID NO: 408406 - RNA, 14 nt, Bordetella pertussis
ccgcuuccugcugc

SEQ ID NO: 408407 - RNA, 15 nt, Bordetella pertussis
ccgcuuccugcugcg

SEQ ID NO: 408408 - RNA, 19 nt, Bordetella pertussis
ccgcuucgaugcuggcggc

SEQ ID NO: 408409 - RNA, 14 nt, Bordetella pertussis
ccgcuucggacagc

SEQ ID NO: 408410 - RNA, 18 nt, Bordetella pertussis
ccgcuucggacagcaguu

SEQ ID NO: 408411 - RNA, 15 nt, Bordetella pertussis
ccggacccgcgccgc

SEQ ID NO: 408412 - RNA, 23 nt, Bordetella pertussis
ccggaccgcgcugcggucagcug

SEQ ID NO: 408413 - RNA, 14 nt, Bordetella pertussis
ccggaccugggcau

SEQ ID NO: 408414 - RNA, 21 nt, Bordetella pertussis
ccggaccuugcgaggcccggc

SEQ ID NO: 408415 - RNA, 16 nt, Bordetella pertussis
ccggacgcggccggca

SEQ ID NO: 408416 - RNA, 18 nt, Bordetella pertussis
ccggauaccgccgccgcu

SEQ ID NO: 408417 - RNA, 23 nt, Bordetella pertussis
ccggauaccgccgccgcucgucc

SEQ ID NO: 408418 - RNA, 18 nt, Bordetella pertussis
ccggaucauugggucugc

SEQ ID NO: 408419 - RNA, 13 nt, Bordetella pertussis
ccggaucccaggc

SEQ ID NO: 408420 - RNA, 16 nt, Bordetella pertussis
ccggauccugcggcgc

SEQ ID NO: 408421 - RNA, 18 nt, Bordetella pertussis
ccggaucgacaggaacag

SEQ ID NO: 408422 - RNA, 15 nt, Bordetella pertussis
ccggaucgcacacac

SEQ ID NO: 408423 - RNA, 18 nt, Bordetella pertussis
ccggaucgcacacaccgc

SEQ ID NO: 408424 - RNA, 21 nt, Bordetella pertussis
ccggaugccgaacugucgcgc

SEQ ID NO: 408425 - RNA, 19 nt, Bordetella pertussis
ccggaugcgcguggcgcga

SEQ ID NO: 408426 - RNA, 14 nt, Bordetella pertussis
ccggauggcgcgga

SEQ ID NO: 408427 - RNA, 15 nt, Bordetella pertussis
ccggauggcgucccg

SEQ ID NO: 408428 - RNA, 12 nt, Bordetella pertussis
ccggcaaacccg

SEQ ID NO: 408429 - RNA, 15 nt, Bordetella pertussis
ccggcaaacccggca

SEQ ID NO: 408430 - RNA, 21 nt, Bordetella pertussis
ccggcaagcgcucgccggcgc

SEQ ID NO: 408431 - RNA, 20 nt, Bordetella pertussis
ccggcaaggggccagccugg

SEQ ID NO: 408432 - RNA, 14 nt, Bordetella pertussis
ccggcaaucccggc

SEQ ID NO: 408433 - RNA, 14 nt, Bordetella pertussis
ccggcaccacgacc

SEQ ID NO: 408434 - RNA, 23 nt, Bordetella pertussis
ccggcaccagcgccacgcccagg

SEQ ID NO: 408435 - RNA, 20 nt, Bordetella pertussis
ccggcaccaucgccgccugc

SEQ ID NO: 408436 - RNA, 12 nt, Bordetella pertussis
ccggcaccuggg

SEQ ID NO: 408437 - RNA, 14 nt, Bordetella pertussis
ccggcaccugggcc

SEQ ID NO: 408438 - RNA, 15 nt, Bordetella pertussis
ccggcaccugggccu

SEQ ID NO: 408439 - RNA, 20 nt, Bordetella pertussis
ccggcaccuucuuccaggcg

SEQ ID NO: 408440 - RNA, 18 nt, Bordetella pertussis
ccggcacgacggccuccg

SEQ ID NO: 408441 - RNA, 15 nt, Bordetella pertussis
ccggcacgccggcgg

SEQ ID NO: 408442 - RNA, 18 nt, Bordetella pertussis
ccggcacgccggcggcgc

SEQ ID NO: 408443 - RNA, 20 nt, Bordetella pertussis
ccggcacgccugccgcgccc

SEQ ID NO: 408444 - RNA, 15 nt, Bordetella pertussis
ccggcacgcgccagg

SEQ ID NO: 408445 - RNA, 18 nt, Bordetella pertussis
ccggcacgcgccaggcgu

SEQ ID NO: 408446 - RNA, 20 nt, Bordetella pertussis
ccggcacggccggccaggcg

SEQ ID NO: 408447 - RNA, 21 nt, Bordetella pertussis
ccggcacggccggccaggcgc

SEQ ID NO: 408448 - RNA, 17 nt, Bordetella pertussis
ccggcacgguucagaac

SEQ ID NO: 408449 - RNA, 15 nt, Bordetella pertussis
ccggcacguaccagg

SEQ ID NO: 408450 - RNA, 17 nt, Bordetella pertussis
ccggcacguaccaggcg

SEQ ID NO: 408451 - RNA, 18 nt, Bordetella pertussis
ccggcacguaccaggcgc

SEQ ID NO: 408452 - RNA, 15 nt, Bordetella pertussis
ccggcagaucggcgc

SEQ ID NO: 408453 - RNA, 15 nt, Bordetella pertussis
ccggcagcacccagc

SEQ ID NO: 408454 - RNA, 12 nt, Bordetella pertussis
ccggcagcagca

SEQ ID NO: 408455 - RNA, 21 nt, Bordetella pertussis
ccggcagccccagcgcccagg

SEQ ID NO: 408456 - RNA, 23 nt, Bordetella pertussis
ccggcagccccagcgcccaggcg

SEQ ID NO: 408457 - RNA, 16 nt, Bordetella pertussis
ccggcagcgcgaccgg

SEQ ID NO: 408458 - RNA, 19 nt, Bordetella pertussis
ccggcagcggccagcgcgg

SEQ ID NO: 408459 - RNA, 15 nt, Bordetella pertussis
ccggcaggccgcgcu

SEQ ID NO: 408460 - RNA, 15 nt, Bordetella pertussis
ccggcaggcgcgcca

SEQ ID NO: 408461 - RNA, 22 nt, Bordetella pertussis
ccggcaggcgcgccagcccgcc

SEQ ID NO: 408462 - RNA, 15 nt, Bordetella pertussis
ccggcagggugccca

SEQ ID NO: 408463 - RNA, 17 nt, Bordetella pertussis
ccggcagggugcccagu

SEQ ID NO: 408464 - RNA, 20 nt, Bordetella pertussis
ccggcagggugcccaguucg

SEQ ID NO: 408465 - RNA, 21 nt, Bordetella pertussis
ccggcaggucgaugcccuccc

SEQ ID NO: 408466 - RNA, 16 nt, Bordetella pertussis
ccggcauaggcggcgc

SEQ ID NO: 408467 - RNA, 19 nt, Bordetella pertussis
ccggcaucaguucaggcug

SEQ ID NO: 408468 - RNA, 18 nt, Bordetella pertussis
ccggcaugcgccggcccg

SEQ ID NO: 408469 - RNA, 21 nt, Bordetella pertussis
ccggcauggcagcagaucggc

SEQ ID NO: 408470 - RNA, 21 nt, Bordetella pertussis
ccggcaugguguaccgggccg

SEQ ID NO: 408471 - RNA, 23 nt, Bordetella pertussis
ccggcaugguguaccgggccgac

SEQ ID NO: 408472 - RNA, 24 nt, Bordetella pertussis
ccggcauguugccgcuggugcuga

SEQ ID NO: 408473 - RNA, 22 nt, Bordetella pertussis
ccggcauuucgcugggcgcgca

SEQ ID NO: 408474 - RNA, 22 nt, Bordetella pertussis
ccggccaacagcucgcgccagg

SEQ ID NO: 408475 - RNA, 21 nt, Bordetella pertussis
ccggccagcgccaguccgcgc

SEQ ID NO: 408476 - RNA, 14 nt, Bordetella pertussis
ccggccagcgccug

SEQ ID NO: 408477 - RNA, 21 nt, Bordetella pertussis
ccggccaggacgaucccggcc

SEQ ID NO: 408478 - RNA, 14 nt, Bordetella pertussis
ccggccaggaugag

SEQ ID NO: 408479 - RNA, 21 nt, Bordetella pertussis
ccggccagcgccaccaccggc

SEQ ID NO: 408480 - RNA, 21 nt, Bordetella pertussis
ccggccaggucggcggccagc

SEQ ID NO: 408481 - RNA, 14 nt, Bordetella pertussis
ccggccagucccag

SEQ ID NO: 408482 - RNA, 18 nt, Bordetella pertussis
ccggccaucaggugcagg

SEQ ID NO: 408483 - RNA, 13 nt, Bordetella pertussis
ccggcccgccacg

SEQ ID NO: 408484 - RNA, 13 nt, Bordetella pertussis
ccggcccgccucg

SEQ ID NO: 408485 - RNA, 20 nt, Bordetella pertussis
ccggcccggaauaccgccag

SEQ ID NO: 408486 - RNA, 17 nt, Bordetella pertussis
ccggccgaaaccgccgc

SEQ ID NO: 408487 - RNA, 18 nt, Bordetella pertussis
ccggccgaaaccgccgcg

SEQ ID NO: 408488 - RNA, 20 nt, Bordetella pertussis
ccggccggcaaggggccagc

SEQ ID NO: 408489 - RNA, 19 nt, Bordetella pertussis
ccggccggcacggccggcc

SEQ ID NO: 408490 - RNA, 14 nt, Bordetella pertussis
ccggccgggccagc

SEQ ID NO: 408491 - RNA, 15 nt, Bordetella pertussis
ccggccgggccagcg

SEQ ID NO: 408492 - RNA, 15 nt, Bordetella pertussis
ccggccgggccagua

SEQ ID NO: 408493 - RNA, 17 nt, Bordetella pertussis
ccggccgggcgcggcgc

SEQ ID NO: 408494 - RNA, 21 nt, Bordetella pertussis
ccggccgggcgcggcgcccgc

SEQ ID NO: 408495 - RNA, 18 nt, Bordetella pertussis
ccggccguauggccguug

SEQ ID NO: 408496 - RNA, 15 nt, Bordetella pertussis
ccggccgugccgccc

SEQ ID NO: 408497 - RNA, 16 nt, Bordetella pertussis
ccggccgugccgcccg

SEQ ID NO: 408498 - RNA, 17 nt, Bordetella pertussis
ccggccgugccgcccgg

SEQ ID NO: 408499 - RNA, 21 nt, Bordetella pertussis
ccggccguggccgggcccggc

SEQ ID NO: 408500 - RNA, 17 nt, Bordetella pertussis
ccggccugggcggcggc

SEQ ID NO: 408501 - RNA, 21 nt, Bordetella pertussis
ccggccuggggacgggcgcac

SEQ ID NO: 408502 - RNA, 19 nt, Bordetella pertussis
ccggccuugcugaaccugc

SEQ ID NO: 408503 - RNA, 16 nt, Bordetella pertussis
ccggcgaaagcgucgg

SEQ ID NO: 408504 - RNA, 16 nt, Bordetella pertussis
ccggcgauauggccag

SEQ ID NO: 408505 - RNA, 18 nt, Bordetella pertussis
ccggcgaucacgccgaag

SEQ ID NO: 408506 - RNA, 22 nt, Bordetella pertussis
ccggcgaugauggggucgccgg

SEQ ID NO: 408507 - RNA, 21 nt, Bordetella pertussis
ccggcgauugcgccagcgcug

SEQ ID NO: 408508 - RNA, 16 nt, Bordetella pertussis
ccggcggccuggaccu

SEQ ID NO: 408509 - RNA, 15 nt, Bordetella pertussis
ccggcggccugcagg

SEQ ID NO: 408510 - RNA, 16 nt, Bordetella pertussis
ccggcggccugcaggc

SEQ ID NO: 408511 - RNA, 19 nt, Bordetella pertussis
ccggcggcgagcgcggcgc

SEQ ID NO: 408512 - RNA, 15 nt, Bordetella pertussis
ccggcggcgcgccgc

SEQ ID NO: 408513 - RNA, 13 nt, Bordetella pertussis
ccggcggcgcgcu

SEQ ID NO: 408514 - RNA, 18 nt, Bordetella pertussis
ccggcggcgcggcgagca

SEQ ID NO: 408515 - RNA, 14 nt, Bordetella pertussis
ccggcggcgggcgu

SEQ ID NO: 408516 - RNA, 19 nt, Bordetella pertussis
ccggcggcguggccgugcu

SEQ ID NO: 408517 - RNA, 12 nt, Bordetella pertussis
ccggcgggccgc

SEQ ID NO: 408518 - RNA, 22 nt, Bordetella pertussis
ccggcgggcaggcgggccaggc

SEQ ID NO: 408519 - RNA, 14 nt, Bordetella pertussis
ccggcgggcggcug

SEQ ID NO: 408520 - RNA, 23 nt, Bordetella pertussis
ccggcgggcggcugcccgggcug

SEQ ID NO: 408521 - RNA, 17 nt, Bordetella pertussis
ccggcggggcaggcgcc

SEQ ID NO: 408522 - RNA, 23 nt, Bordetella pertussis
ccggcggucccgagcgcucccgc

SEQ ID NO: 408523 - RNA, 21 nt, Bordetella pertussis
ccggcguauggcccgccacca

SEQ ID NO: 408524 - RNA, 18 nt, Bordetella pertussis
ccggcgucgcucagggua

SEQ ID NO: 408525 - RNA, 15 nt, Bordetella pertussis
ccggcgugacgcuga

SEQ ID NO: 408526 - RNA, 20 nt, Bordetella pertussis
ccggcgugcagagcaccacg

SEQ ID NO: 408527 - RNA, 15 nt, Bordetella pertussis
ccggcgugccaugga

SEQ ID NO: 408528 - RNA, 14 nt, Bordetella pertussis
ccggcgugcccagg

SEQ ID NO: 408529 - RNA, 15 nt, Bordetella pertussis
ccggcguggccugcc

SEQ ID NO: 408530 - RNA, 17 nt, Bordetella pertussis
ccggcguggccugcccg

SEQ ID NO: 408531 - RNA, 12 nt, Bordetella pertussis
ccggcguggcgc

SEQ ID NO: 408532 - RNA, 15 nt, Bordetella pertussis
ccggcguggcgcgca

SEQ ID NO: 408533 - RNA, 21 nt, Bordetella pertussis
ccggcgugguaucgcgccagc

SEQ ID NO: 408534 - RNA, 18 nt, Bordetella pertussis
ccggcguguccagcggcg

SEQ ID NO: 408535 - RNA, 23 nt, Bordetella pertussis
ccggcguguccagcggcgccagc

SEQ ID NO: 408536 - RNA, 17 nt, Bordetella pertussis
ccggcguucuggcgcag

SEQ ID NO: 408537 - RNA, 18 nt, Bordetella pertussis
ccggcguucuggcgcagc

SEQ ID NO: 408538 - RNA, 20 nt, Bordetella pertussis
ccggcguucuggucagccgu

SEQ ID NO: 408539 - RNA, 21 nt, Bordetella pertussis
ccggcguuggccgggucgcgc

SEQ ID NO: 408540 - RNA, 16 nt, Bordetella pertussis
ccggcuauaccgggcu

SEQ ID NO: 408541 - RNA, 19 nt, Bordetella pertussis
ccggcucauucggcgcgcu

SEQ ID NO: 408542 - RNA, 14 nt, Bordetella pertussis
ccggcuccaggccg

SEQ ID NO: 408543 - RNA, 14 nt, Bordetella pertussis
ccggcuccaguccc

SEQ ID NO: 408544 - RNA, 14 nt, Bordetella pertussis
ccggcuccggccgc

SEQ ID NO: 408545 - RNA, 23 nt, Bordetella pertussis
ccggcugcaccagcgcgccgcgc

SEQ ID NO: 408546 - RNA, 15 nt, Bordetella pertussis
ccggcugccagggcc

SEQ ID NO: 408547 - RNA, 21 nt, Bordetella pertussis
ccggcugccgcggauugccgu

SEQ ID NO: 408548 - RNA, 17 nt, Bordetella pertussis
ccgggcaagcagauggc

SEQ ID NO: 408549 - RNA, 17 nt, Bordetella pertussis
ccgggcaccgagccgca

SEQ ID NO: 408550 - RNA, 22 nt, Bordetella pertussis
ccgggcacguaguacagcagca

SEQ ID NO: 408551 - RNA, 20 nt, Bordetella pertussis
ccgggcagcccgcgcacgcc

SEQ ID NO: 408552 - RNA, 19 nt, Bordetella pertussis
ccgggcagcgggccgcagc

SEQ ID NO: 408553 - RNA, 19 nt, Bordetella pertussis
ccgggcaguucgggcacgc

SEQ ID NO: 408554 - RNA, 21 nt, Bordetella pertussis
ccgggcaugcgaaagccggcc

SEQ ID NO: 408555 - RNA, 21 nt, Bordetella pertussis
ccgggcauggcccggcucgcc

SEQ ID NO: 408556 - RNA, 15 nt, Bordetella pertussis
ccgggcccggcgcgc

SEQ ID NO: 408557 - RNA, 13 nt, Bordetella pertussis
ccgggccuggccu

SEQ ID NO: 408558 - RNA, 13 nt, Bordetella pertussis
ccgggcgcccagc

SEQ ID NO: 408559 - RNA, 22 nt, Bordetella pertussis
ccgggcgccgcgccccaucacc

SEQ ID NO: 408560 - RNA, 17 nt, Bordetella pertussis
ccgggcgugaccagcug

SEQ ID NO: 408561 - RNA, 23 nt, Bordetella pertussis
ccgggcuaucccaacccguuccc

SEQ ID NO: 408562 - RNA, 22 nt, Bordetella pertussis
ccgggcuccggucguggccagc

SEQ ID NO: 408563 - RNA, 15 nt, Bordetella pertussis
ccgggcuccucgccc

SEQ ID NO: 408564 - RNA, 21 nt, Bordetella pertussis
ccgggcucgaaguacagcuug

SEQ ID NO: 408565 - RNA, 13 nt, Bordetella pertussis
ccgggcucggcca

SEQ ID NO: 408566 - RNA, 18 nt, Bordetella pertussis
ccgggcucggccaccaug

SEQ ID NO: 408567 - RNA, 17 nt, Bordetella pertussis
ccgggcucaggcugcgc

SEQ ID NO: 408568 - RNA, 18 nt, Bordetella pertussis
ccgggcugauccgcaccg

SEQ ID NO: 408569 - RNA, 16 nt, Bordetella pertussis
ccgggucaucgaggug

SEQ ID NO: 408570 - RNA, 17 nt, Bordetella pertussis
ccgggucaucgaggugg

SEQ ID NO: 408571 - RNA, 17 nt, Bordetella pertussis
ccggguccggccgcgca

SEQ ID NO: 408572 - RNA, 13 nt, Bordetella pertussis
ccgggucgcggca

SEQ ID NO: 408573 - RNA, 21 nt, Bordetella pertussis
ccgggucgggcgucugcccgc

SEQ ID NO: 408574 - RNA, 21 nt, Bordetella pertussis
ccgggucgucgggcggcgcga

SEQ ID NO: 408575 - RNA, 20 nt, Bordetella pertussis
ccgggucuggccggccgcgu

SEQ ID NO: 408576 - RNA, 14 nt, Bordetella pertussis
ccggguggccgcgg

SEQ ID NO: 408577 - RNA, 14 nt, Bordetella pertussis
ccggguggucgcgc

SEQ ID NO: 408578 - RNA, 20 nt, Bordetella pertussis
ccggguggucgcgcccgccg

SEQ ID NO: 408579 - RNA, 19 nt, Bordetella pertussis
ccggguguuccggcgcgcg

SEQ ID NO: 408580 - RNA, 22 nt, Bordetella pertussis
ccggguugcaggaugcgcggca

SEQ ID NO: 408581 - RNA, 19 nt, Bordetella pertussis
ccggguugcccggcaggca

SEQ ID NO: 408582 - RNA, 20 nt, Bordetella pertussis
ccgguaaccgacgcagcgca

SEQ ID NO: 408583 - RNA, 15 nt, Bordetella pertussis
ccgguacagccaggc

SEQ ID NO: 408584 - RNA, 16 nt, Bordetella pertussis
ccgguacagccaggcc

SEQ ID NO: 408585 - RNA, 19 nt, Bordetella pertussis
ccgguacgccugcaccgcc

SEQ ID NO: 408586 - RNA, 12 nt, Bordetella pertussis
ccgguagcgcug

SEQ ID NO: 408587 - RNA, 22 nt, Bordetella pertussis
ccgguagcgcugggcgccagca

SEQ ID NO: 408588 - RNA, 18 nt, Bordetella pertussis
ccgguauccgcgcaugga

SEQ ID NO: 408589 - RNA, 15 nt, Bordetella pertussis
ccgguauccuggcgc

SEQ ID NO: 408590 - RNA, 21 nt, Bordetella pertussis
ccgguauuccucgacgauggc

SEQ ID NO: 408591 - RNA, 15 nt, Bordetella pertussis
ccggucagcagggcg

SEQ ID NO: 408592 - RNA, 18 nt, Bordetella pertussis
ccggucagcagggcgccg

SEQ ID NO: 408593 - RNA, 12 nt, Bordetella pertussis
ccggucaugaag

SEQ ID NO: 408594 - RNA, 14 nt, Bordetella pertussis
ccggucgccagcga

SEQ ID NO: 408595 - RNA, 14 nt, Bordetella pertussis
ccggucgcccgccg

SEQ ID NO: 408596 - RNA, 17 nt, Bordetella pertussis
ccggucgcccgccgcgu

SEQ ID NO: 408597 - RNA, 12 nt, Bordetella pertussis
ccggucgccgcg

SEQ ID NO: 408598 - RNA, 16 nt, Bordetella pertussis
ccggucggccgcuccg

SEQ ID NO: 408599 - RNA, 23 nt, Bordetella pertussis
ccggucggccggcagcggcgcca

SEQ ID NO: 408600 - RNA, 22 nt, Bordetella pertussis
ccggucguccccaauacccgcc

SEQ ID NO: 408601 - RNA, 21 nt, Bordetella pertussis
ccggugauaugcgccaggccc

SEQ ID NO: 408602 - RNA, 22 nt, Bordetella pertussis
ccggugaugcccgaggcggcgc

SEQ ID NO: 408603 - RNA, 19 nt, Bordetella pertussis
ccggugaugcggcgcgccg

SEQ ID NO: 408604 - RNA, 22 nt, Bordetella pertussis
ccggugauguacgcaucggcgc

SEQ ID NO: 408605 - RNA, 16 nt, Bordetella pertussis
ccggugauuucggcgc

SEQ ID NO: 408606 - RNA, 15 nt, Bordetella pertussis
ccggugcaccaggcc

SEQ ID NO: 408607 - RNA, 21 nt, Bordetella pertussis
ccggugcaccaggccacccgc

SEQ ID NO: 408608 - RNA, 14 nt, Bordetella pertussis
ccggugccagucuc

SEQ ID NO: 408609 - RNA, 17 nt, Bordetella pertussis
ccggugcguaccagccc

SEQ ID NO: 408610 - RNA, 17 nt, Bordetella pertussis
ccgguggacggccagca

SEQ ID NO: 408611 - RNA, 15 nt, Bordetella pertussis
ccgguggccagcagc

SEQ ID NO: 408612 - RNA, 20 nt, Bordetella pertussis
ccgguucgcccaccaccagc

SEQ ID NO: 408613 - RNA, 20 nt, Bordetella pertussis
ccgguucggcgcggcgcguu

SEQ ID NO: 408614 - RNA, 24 nt, Bordetella pertussis
ccgguugcagcgcgccaggcgcug

SEQ ID NO: 408615 - RNA, 14 nt, Bordetella pertussis
ccgguugcgcgccg

SEQ ID NO: 408616 - RNA, 16 nt, Bordetella pertussis
ccgguuggggucgcgc

SEQ ID NO: 408617 - RNA, 17 nt, Bordetella pertussis
ccgguuggggucgcgcu

SEQ ID NO: 408618 - RNA, 14 nt, Bordetella pertussis
ccgucgaccgcggc

SEQ ID NO: 408619 - RNA, 16 nt, Bordetella pertussis
ccgucgaccggcccgc

SEQ ID NO: 408620 - RNA, 16 nt, Bordetella pertussis
ccgucgacgcagcagc

SEQ ID NO: 408621 - RNA, 18 nt, Bordetella pertussis
ccgucgacuucgacccgg

SEQ ID NO: 408622 - RNA, 20 nt, Bordetella pertussis
ccgucgacuucgacccggac

SEQ ID NO: 408623 - RNA, 22 nt, Bordetella pertussis
ccgucgagccgguccgccucgc

SEQ ID NO: 408624 - RNA, 18 nt, Bordetella pertussis
ccgucgagcgcggccagg

SEQ ID NO: 408625 - RNA, 21 nt, Bordetella pertussis
ccgucgagcgcggccaggcgc

SEQ ID NO: 408626 - RNA, 17 nt, Bordetella pertussis
ccgucgccgcccaugcg

SEQ ID NO: 408627 - RNA, 15 nt, Bordetella pertussis
ccgucgccgcccugc

SEQ ID NO: 408628 - RNA, 18 nt, Bordetella pertussis
ccgucgccgcccugcugc

SEQ ID NO: 408629 - RNA, 19 nt, Bordetella pertussis
ccgucgccgcccugcugcc

SEQ ID NO: 408630 - RNA, 17 nt, Bordetella pertussis
ccgucgcggaccuccug

SEQ ID NO: 408631 - RNA, 16 nt, Bordetella pertussis
ccgucgcuggcgcguu

SEQ ID NO: 408632 - RNA, 18 nt, Bordetella pertussis
ccgucuauggccugcagg

SEQ ID NO: 408633 - RNA, 13 nt, Bordetella pertussis
ccgugcagauggc

SEQ ID NO: 408634 - RNA, 14 nt, Bordetella pertussis
ccgugcagggccag

SEQ ID NO: 408635 - RNA, 12 nt, Bordetella pertussis
ccgugcccggcg

SEQ ID NO: 408636 - RNA, 18 nt, Bordetella pertussis
ccgugcccggcgggccgc

SEQ ID NO: 408637 - RNA, 17 nt, Bordetella pertussis
ccgugcgguucgucagg

SEQ ID NO: 408638 - RNA, 18 nt, Bordetella pertussis
ccgugcuguaccucagcc

SEQ ID NO: 408639 - RNA, 20 nt, Bordetella pertussis
ccguggccaagugggcauag

SEQ ID NO: 408640 - RNA, 18 nt, Bordetella pertussis
ccguggccgggcccggcg

SEQ ID NO: 408641 - RNA, 14 nt, Bordetella pertussis
ccguggcgcaccag

SEQ ID NO: 408642 - RNA, 19 nt, Bordetella pertussis
ccguggcgggaggaagggu

SEQ ID NO: 408643 - RNA, 15 nt, Bordetella pertussis
ccguggcguccaugc

SEQ ID NO: 408644 - RNA, 22 nt, Bordetella pertussis
ccguggcguccaugcagguggc

SEQ ID NO: 408645 - RNA, 15 nt, Bordetella pertussis
ccguggcgugcaggc

SEQ ID NO: 408646 - RNA, 16 nt, Bordetella pertussis
ccguggggacaggcac

SEQ ID NO: 408647 - RNA, 16 nt, Bordetella pertussis
ccgugguggggccggg

SEQ ID NO: 408648 - RNA, 15 nt, Bordetella pertussis
ccgugucgccgucgg

SEQ ID NO: 408649 - RNA, 19 nt, Bordetella pertussis
ccgugucggcaaccugcac

SEQ ID NO: 408650 - RNA, 20 nt, Bordetella pertussis
ccguguucgagcaggcgcgc

SEQ ID NO: 408651 - RNA, 12 nt, Bordetella pertussis
ccguuauauaua

SEQ ID NO: 408652 - RNA, 21 nt, Bordetella pertussis
ccguuaugguucggccucgcc

SEQ ID NO: 408653 - RNA, 21 nt, Bordetella pertussis
ccguucagggacgggccagcc

SEQ ID NO: 408654 - RNA, 13 nt, Bordetella pertussis
ccguucauggcgu

SEQ ID NO: 408655 - RNA, 17 nt, Bordetella pertussis
ccguuccaguccagcgu

SEQ ID NO: 408656 - RNA, 15 nt, Bordetella pertussis
ccguucggggacagg

SEQ ID NO: 408657 - RNA, 18 nt, Bordetella pertussis
ccguucggggacaggcac

SEQ ID NO: 408658 - RNA, 19 nt, Bordetella pertussis
ccguucggggacaggcacc

SEQ ID NO: 408659 - RNA, 21 nt, Bordetella pertussis
ccguucggggacaggcaccga

SEQ ID NO: 408660 - RNA, 20 nt, Bordetella pertussis
ccguucuggcugcgcgccug

SEQ ID NO: 408661 - RNA, 16 nt, Bordetella pertussis
ccguucuuccgcacgc

SEQ ID NO: 408662 - RNA, 18 nt, Bordetella pertussis
ccguugcagcccagcgcg

SEQ ID NO: 408663 - RNA, 13 nt, Bordetella pertussis
ccguugccgcgcg

SEQ ID NO: 408664 - RNA, 18 nt, Bordetella pertussis
ccguugccgcgcgcgacu

SEQ ID NO: 408665 - RNA, 21 nt, Bordetella pertussis
ccguuggcaggccagcauggc

SEQ ID NO: 408666 - RNA, 19 nt, Bordetella pertussis
ccguuggccagcgccgcca

SEQ ID NO: 408667 - RNA, 14 nt, Bordetella pertussis
ccguuggccgcgcg

SEQ ID NO: 408668 - RNA, 16 nt, Bordetella pertussis
ccguuggcgauggcgc

SEQ ID NO: 408669 - RNA, 22 nt, Bordetella pertussis
ccguugucggucaucacgcggu

SEQ ID NO: 408670 - RNA, 18 nt, Bordetella pertussis
ccguuucgucggcgcgcg

SEQ ID NO: 408671 - RNA, 23 nt, Bordetella pertussis
ccguuucgucggcgcgcgccagg

SEQ ID NO: 408672 - RNA, 20 nt, Bordetella pertussis
ccguuugccccucggcgggc

SEQ ID NO: 408673 - RNA, 18 nt, Bordetella pertussis
ccguuuucagcgcaggcu

SEQ ID NO: 408674 - RNA, 13 nt, Bordetella pertussis
ccguuuugcagga

SEQ ID NO: 408675 - RNA, 23 nt, Bordetella pertussis
ccguuuuggcaggcuggcauuga

SEQ ID NO: 408676 - RNA, 14 nt, Bordetella pertussis
ccuacauccuggau

SEQ ID NO: 408677 - RNA, 23 nt, Bordetella pertussis
ccuaccaaguaaacaugcggguc

SEQ ID NO: 408678 - RNA, 16 nt, Bordetella pertussis
ccuacccgccgggcgg

SEQ ID NO: 408679 - RNA, 13 nt, Bordetella pertussis
ccuaccggcgccg

SEQ ID NO: 408680 - RNA, 17 nt, Bordetella pertussis
ccuacuucggcagcuug

SEQ ID NO: 408681 - RNA, 13 nt, Bordetella pertussis
ccuagcccggcgc

SEQ ID NO: 408682 - RNA, 15 nt, Bordetella pertussis
ccuagcccggcgcca

SEQ ID NO: 408683 - RNA, 14 nt, Bordetella pertussis
ccuagcgccgcgcc

SEQ ID NO: 408684 - RNA, 15 nt, Bordetella pertussis
ccuagcgccgcgcca

SEQ ID NO: 408685 - RNA, 14 nt, Bordetella pertussis
ccuaggcugcagcc

SEQ ID NO: 408686 - RNA, 16 nt, Bordetella pertussis
ccuaggcugcagccag

SEQ ID NO: 408687 - RNA, 17 nt, Bordetella pertussis
ccuauuuggcggccugg

SEQ ID NO: 408688 - RNA, 14 nt, Bordetella pertussis
ccucagaccacgac

SEQ ID NO: 408689 - RNA, 13 nt, Bordetella pertussis
ccucagcauggcg

SEQ ID NO: 408690 - RNA, 14 nt, Bordetella pertussis
ccucagcauggcgg

SEQ ID NO: 408691 - RNA, 21 nt, Bordetella pertussis
ccucagccugguauugccugu

SEQ ID NO: 408692 - RNA, 23 nt, Bordetella pertussis
ccucaucgagcgccugggcggcc

SEQ ID NO: 408693 - RNA, 23 nt, Bordetella pertussis
ccucaucgugcucgugcugggca

SEQ ID NO: 408694 - RNA, 15 nt, Bordetella pertussis
aaacgcacgauuuca

SEQ ID NO: 408695 - RNA, 13 nt, Bordetella pertussis
ccuccaccgccag

SEQ ID NO: 408696 - RNA, 20 nt, Bordetella pertussis
ccuccaggaugagcgccugc

SEQ ID NO: 408697 - RNA, 21 nt, Bordetella pertussis
ccuccaggcccaggcgaccca

SEQ ID NO: 408698 - RNA, 18 nt, Bordetella pertussis
ccucccacgaccugcaac

SEQ ID NO: 408699 - RNA, 19 nt, Bordetella pertussis
ccucccacgaccugcaacc

SEQ ID NO: 408700 - RNA, 14 nt, Bordetella pertussis
ccucccagaaacug

SEQ ID NO: 408701 - RNA, 16 nt, Bordetella pertussis
ccucccagaccugcgc

SEQ ID NO: 408702 - RNA, 22 nt, Bordetella pertussis
ccucccagaccugcgcgccggc

SEQ ID NO: 408703 - RNA, 17 nt, Bordetella pertussis
ccuccggcaggaucugc

SEQ ID NO: 408704 - RNA, 13 nt, Bordetella pertussis
ccuccggcgccag

SEQ ID NO: 408705 - RNA, 19 nt, Bordetella pertussis
ccucgaacgcauugcgcgu

SEQ ID NO: 408706 - RNA, 15 nt, Bordetella pertussis
ccucgaagaccucgg

SEQ ID NO: 408707 - RNA, 14 nt, Bordetella pertussis
ccucgaagaucucg

SEQ ID NO: 408708 - RNA, 15 nt, Bordetella pertussis
ccucgaagaucucga

SEQ ID NO: 408709 - RNA, 16 nt, Bordetella pertussis
ccucgaagcccggcag

SEQ ID NO: 408710 - RNA, 13 nt, Bordetella pertussis
ccucgaccagccc

SEQ ID NO: 408711 - RNA, 22 nt, Bordetella pertussis
ccucgaccagcccggccgccag

SEQ ID NO: 408712 - RNA, 15 nt, Bordetella pertussis
ccucgacccgcgccu

SEQ ID NO: 408713 - RNA, 15 nt, Bordetella pertussis
ccucgacgauggcgg

SEQ ID NO: 408714 - RNA, 16 nt, Bordetella pertussis
ccucgacgcagccuuc

SEQ ID NO: 408715 - RNA, 14 nt, Bordetella pertussis
ccucgacggccgcc

SEQ ID NO: 408716 - RNA, 15 nt, Bordetella pertussis
ccucgacggccgccg

SEQ ID NO: 408717 - RNA, 21 nt, Bordetella pertussis
ccucgacgggauccucgcucu

SEQ ID NO: 408718 - RNA, 21 nt, Bordetella pertussis
ccucgacggggaaccccgcau

SEQ ID NO: 408719 - RNA, 18 nt, Bordetella pertussis
ccucgaucgcguucgugg

SEQ ID NO: 408720 - RNA, 20 nt, Bordetella pertussis
ccucgaugaccgggucgucg

SEQ ID NO: 408721 - RNA, 18 nt, Bordetella pertussis
ccucgauggcgguggugg

SEQ ID NO: 408722 - RNA, 19 nt, Bordetella pertussis
ccucgccgcgccagcugcg

SEQ ID NO: 408723 - RNA, 14 nt, Bordetella pertussis
ccucgcgcaccagc

SEQ ID NO: 408724 - RNA, 13 nt, Bordetella pertussis
ccucgcugccggc

SEQ ID NO: 408725 - RNA, 16 nt, Bordetella pertussis
ccucgcugccggcgcc

SEQ ID NO: 408726 - RNA, 20 nt, Bordetella pertussis
ccucgcugccggcgcccuug

SEQ ID NO: 408727 - RNA, 21 nt, Bordetella pertussis
ccucggacgagacaggcgcgc

SEQ ID NO: 408728 - RNA, 15 nt, Bordetella pertussis
ccucggacgccuggc

SEQ ID NO: 408729 - RNA, 16 nt, Bordetella pertussis
ccucggcauggcgcgc

SEQ ID NO: 408730 - RNA, 13 nt, Bordetella pertussis
ccucggccagccg

SEQ ID NO: 408731 - RNA, 15 nt, Bordetella pertussis
ccucggccagcuggg

SEQ ID NO: 408732 - RNA, 14 nt, Bordetella pertussis
ccucggcggccucc

SEQ ID NO: 408733 - RNA, 20 nt, Bordetella pertussis
ccucgggcgacaggcgcgcc

SEQ ID NO: 408734 - RNA, 18 nt, Bordetella pertussis
ccucggggcgcggccggu

SEQ ID NO: 408735 - RNA, 14 nt, Bordetella pertussis
ccucggggugcagc

SEQ ID NO: 408736 - RNA, 22 nt, Bordetella pertussis
ccugcacgaagcggaugcgccg

SEQ ID NO: 408737 - RNA, 23 nt, Bordetella pertussis
ccugcacgauggcgccggcuucg

SEQ ID NO: 408738 - RNA, 20 nt, Bordetella pertussis
ccugcacggugggcagcagc

SEQ ID NO: 408739 - RNA, 22 nt, Bordetella pertussis
ccugcacggugggcagcagcac

SEQ ID NO: 408740 - RNA, 21 nt, Bordetella pertussis
ccugcacgucccagucgccgc

SEQ ID NO: 408741 - RNA, 15 nt, Bordetella pertussis
ccugcacgcgggcca

SEQ ID NO: 408742 - RNA, 14 nt, Bordetella pertussis
ccugcaggcggcgc

SEQ ID NO: 408743 - RNA, 15 nt, Bordetella pertussis
ccugcaggcucuuga

SEQ ID NO: 408744 - RNA, 23 nt, Bordetella pertussis
ccugcaggcucuugaccagcuug

SEQ ID NO: 408745 - RNA, 11 nt, Bordetella pertussis
ccugcagggca

SEQ ID NO: 408746 - RNA, 12 nt, Bordetella pertussis
ccugcagggcau

SEQ ID NO: 408747 - RNA, 19 nt, Bordetella pertussis
ccugcagggucagcccgcc

SEQ ID NO: 408748 - RNA, 18 nt, Bordetella pertussis
ccugcagguccugguaga

SEQ ID NO: 408749 - RNA, 15 nt, Bordetella pertussis
ccugcaggugccgcc

SEQ ID NO: 408750 - RNA, 20 nt, Bordetella pertussis
ccugcaggugccgccggcgc

SEQ ID NO: 408751 - RNA, 18 nt, Bordetella pertussis
ccugcaguucggccgcca

SEQ ID NO: 408752 - RNA, 19 nt, Bordetella pertussis
ccugcaguucggccgccag

SEQ ID NO: 408753 - RNA, 24 nt, Bordetella pertussis
ccugcaguucggccgccaggucgg

SEQ ID NO: 408754 - RNA, 20 nt, Bordetella pertussis
ccugccagaacagccgcgag

SEQ ID NO: 408755 - RNA, 12 nt, Bordetella pertussis
ccugccaggcgc

SEQ ID NO: 408756 - RNA, 12 nt, Bordetella pertussis
ccugccaguucg

SEQ ID NO: 408757 - RNA, 17 nt, Bordetella pertussis
ccugccaguugccgccg

SEQ ID NO: 408758 - RNA, 16 nt, Bordetella pertussis
ccugccauucggacac

SEQ ID NO: 408759 - RNA, 19 nt, Bordetella pertussis
ccugccauugcgcggccug

SEQ ID NO: 408760 - RNA, 17 nt, Bordetella pertussis
ccugcccgagaccgccc

SEQ ID NO: 408761 - RNA, 15 nt, Bordetella pertussis
ccugcccgcaacgcc

SEQ ID NO: 408762 - RNA, 24 nt, Bordetella pertussis
ccugcccgcaacgccgcccguccg

SEQ ID NO: 408763 - RNA, 15 nt, Bordetella pertussis
ccugcccggcagggu

SEQ ID NO: 408764 - RNA, 15 nt, Bordetella pertussis
ccugcccucgggcga

SEQ ID NO: 408765 - RNA, 22 nt, Bordetella pertussis
ccugccgaucaagagccuggag

SEQ ID NO: 408766 - RNA, 23 nt, Bordetella pertussis
ccugccgaucaagagccuggagc

SEQ ID NO: 408767 - RNA, 19 nt, Bordetella pertussis
ccugccugccgagcgcugc

SEQ ID NO: 408768 - RNA, 14 nt, Bordetella pertussis
ccugccugccgccu

SEQ ID NO: 408769 - RNA, 19 nt, Bordetella pertussis
ccugcgaacccgccgcgau

SEQ ID NO: 408770 - RNA, 22 nt, Bordetella pertussis
ccugcgaacgcccggcccaggc

SEQ ID NO: 408771 - RNA, 21 nt, Bordetella pertussis
ccugcgagagauagcccagca

SEQ ID NO: 408772 - RNA, 24 nt, Bordetella pertussis
ccugcgagagauagcccagcaccu

SEQ ID NO: 408773 - RNA, 14 nt, Bordetella pertussis
ccugcggcagcgac

SEQ ID NO: 408774 - RNA, 17 nt, Bordetella pertussis
ccugcggcaggccgcag

SEQ ID NO: 408775 - RNA, 23 nt, Bordetella pertussis
ccugcggcaggccgcagcgggcc

SEQ ID NO: 408776 - RNA, 13 nt, Bordetella pertussis
ccugcggcgccag

SEQ ID NO: 408777 - RNA, 12 nt, Bordetella pertussis
ccugcgggccgc

SEQ ID NO: 408778 - RNA, 16 nt, Bordetella pertussis
ccugcgggccgcacag

SEQ ID NO: 408779 - RNA, 17 nt, Bordetella pertussis
ccugcggggucugcagg

SEQ ID NO: 408780 - RNA, 20 nt, Bordetella pertussis
ccugcgggugcgccugcagc

SEQ ID NO: 408781 - RNA, 15 nt, Bordetella pertussis
ccugcucacgccccg

SEQ ID NO: 408782 - RNA, 15 nt, Bordetella pertussis
ccugcugcccgccgc

SEQ ID NO: 408783 - RNA, 17 nt, Bordetella pertussis
ccugcugcccgccgccg

SEQ ID NO: 408784 - RNA, 21 nt, Bordetella pertussis
ccugcugcgccuggccgcgcu

SEQ ID NO: 408785 - RNA, 17 nt, Bordetella pertussis
ccugcugcgccuggcgg

SEQ ID NO: 408786 - RNA, 17 nt, Bordetella pertussis
ccugcugcggcacggcc

SEQ ID NO: 408787 - RNA, 21 nt, Bordetella pertussis
ccugcugcuugaccuuggcuu

SEQ ID NO: 408788 - RNA, 18 nt, Bordetella pertussis
ccugcuggccaccgucgc

SEQ ID NO: 408789 - RNA, 15 nt, Bordetella pertussis
ccugcuggccgccgg

SEQ ID NO: 408790 - RNA, 18 nt, Bordetella pertussis
ccugcuggccgccggcgc

SEQ ID NO: 408791 - RNA, 19 nt, Bordetella pertussis
ccugcuggcgcgcaccauc

SEQ ID NO: 408792 - RNA, 17 nt, Bordetella pertussis
ccugcuggucggccucg

SEQ ID NO: 408793 - RNA, 15 nt, Bordetella pertussis
ccugcuggucggcgu

SEQ ID NO: 408794 - RNA, 15 nt, Bordetella pertussis
ccugcugucgcuggg

SEQ ID NO: 408795 - RNA, 14 nt, Bordetella pertussis
ccugcugugcccca

SEQ ID NO: 408796 - RNA, 17 nt, Bordetella pertussis
ccugcuguucaccuuca

SEQ ID NO: 408797 - RNA, 14 nt, Bordetella pertussis
ccugcuugaagacg

SEQ ID NO: 408798 - RNA, 14 nt, Bordetella pertussis
ccugcuuggcagcc

SEQ ID NO: 408799 - RNA, 15 nt, Bordetella pertussis
ccugcuuggcagccu

SEQ ID NO: 408800 - RNA, 15 nt, Bordetella pertussis
ccugcuuggccgcgu

SEQ ID NO: 408801 - RNA, 23 nt, Bordetella pertussis
ccugcuuggcgcgcagcagcgca

SEQ ID NO: 408802 - RNA, 13 nt, Bordetella pertussis
ccugcuugcagga

SEQ ID NO: 408803 - RNA, 21 nt, Bordetella pertussis
ccuggaacuugggaucggcca

SEQ ID NO: 408804 - RNA, 12 nt, Bordetella pertussis
ccuggaagcugg

SEQ ID NO: 408805 - RNA, 15 nt, Bordetella pertussis
ccuggaccugagcca

SEQ ID NO: 408806 - RNA, 16 nt, Bordetella pertussis
ccuggacgagggccgc

SEQ ID NO: 408807 - RNA, 17 nt, Bordetella pertussis
ccuggagcucggguggg

SEQ ID NO: 408808 - RNA, 14 nt, Bordetella pertussis
ccuggagcuuggcc

SEQ ID NO: 408809 - RNA, 22 nt, Bordetella pertussis
ccuggagucugcgugugccgcc

SEQ ID NO: 408810 - RNA, 19 nt, Bordetella pertussis
ccuggaugugcgcgggcgc

SEQ ID NO: 408811 - RNA, 18 nt, Bordetella pertussis
ccuggcaaugcguggccg

SEQ ID NO: 408812 - RNA, 22 nt, Bordetella pertussis
ccuggcaaugcguggccggcgg

SEQ ID NO: 408813 - RNA, 19 nt, Bordetella pertussis
ccuggcagacguacuugau

SEQ ID NO: 408814 - RNA, 19 nt, Bordetella pertussis
ccuggcagaugcgcgccag

SEQ ID NO: 408815 - RNA, 13 nt, Bordetella pertussis
ccuggcagcuggc

SEQ ID NO: 408816 - RNA, 17 nt, Bordetella pertussis
ccuggcagucagccguu

SEQ ID NO: 408817 - RNA, 17 nt, Bordetella pertussis
ccuggccacaagcggcc

SEQ ID NO: 408818 - RNA, 22 nt, Bordetella pertussis
ccuggccacaagcggccccagg

SEQ ID NO: 408819 - RNA, 15 nt, Bordetella pertussis
ccuggccacgcugcu

SEQ ID NO: 408820 - RNA, 14 nt, Bordetella pertussis
ccuggccagauagc

SEQ ID NO: 408821 - RNA, 13 nt, Bordetella pertussis
ccuggccagcgug

SEQ ID NO: 408822 - RNA, 21 nt, Bordetella pertussis
ccuggcccacaucgucgcgcu

SEQ ID NO: 408823 - RNA, 20 nt, Bordetella pertussis
ccuggccggggaagccgccg

SEQ ID NO: 408824 - RNA, 16 nt, Bordetella pertussis
ccuggccugcgccgcc

SEQ ID NO: 408825 - RNA, 14 nt, Bordetella pertussis
ccuggcgcagggca

SEQ ID NO: 408826 - RNA, 15 nt, Bordetella pertussis
ccuggcgcagggcau

SEQ ID NO: 408827 - RNA, 21 nt, Bordetella pertussis
ccuggcgcccggcggcgcgcu

SEQ ID NO: 408828 - RNA, 16 nt, Bordetella pertussis
ccuggcgcgacgccug

SEQ ID NO: 408829 - RNA, 21 nt, Bordetella pertussis
ccuggcgcgacgccugcgcca

SEQ ID NO: 408830 - RNA, 18 nt, Bordetella pertussis
ccuggcgcgcgaacgggg

SEQ ID NO: 408831 - RNA, 15 nt, Bordetella pertussis
ccuggcgcuccucgc

SEQ ID NO: 408832 - RNA, 16 nt, Bordetella pertussis
ccuggcgcugcagcgu

SEQ ID NO: 408833 - RNA, 16 nt, Bordetella pertussis
ccuggcgcggcgccug

SEQ ID NO: 408834 - RNA, 16 nt, Bordetella pertussis
ccuggcggacgauggc

SEQ ID NO: 408835 - RNA, 21 nt, Bordetella pertussis
ccuggcggaucucggccagca

SEQ ID NO: 408836 - RNA, 12 nt, Bordetella pertussis
ccuggcggccgc

SEQ ID NO: 408837 - RNA, 13 nt, Bordetella pertussis
ccuggcggccgcc

SEQ ID NO: 408838 - RNA, 16 nt, Bordetella pertussis
ccuggcggccgcccag

SEQ ID NO: 408839 - RNA, 18 nt, Bordetella pertussis
ccuggcggccgcccagca

SEQ ID NO: 408840 - RNA, 13 nt, Bordetella pertussis
ccuggcgggccga

SEQ ID NO: 408841 - RNA, 13 nt, Bordetella pertussis
ccuggcgggccgg

SEQ ID NO: 408842 - RNA, 15 nt, Bordetella pertussis
ccuggcgggccuggg

SEQ ID NO: 408843 - RNA, 19 nt, Bordetella pertussis
ccuggcguaugcccacucc

SEQ ID NO: 408844 - RNA, 19 nt, Bordetella pertussis
ccuggcguggcgcgcgccg

SEQ ID NO: 408845 - RNA, 20 nt, Bordetella pertussis
ccuggcguucaaucgcgcuu

SEQ ID NO: 408846 - RNA, 15 nt, Bordetella pertussis
ccuggcucaggccug

SEQ ID NO: 408847 - RNA, 22 nt, Bordetella pertussis
ccuggcuugcgccacgcccguc

SEQ ID NO: 408848 - RNA, 14 nt, Bordetella pertussis
ccuggcuuggcggc

SEQ ID NO: 408849 - RNA, 17 nt, Bordetella pertussis
ccuggcuuggcggccag

SEQ ID NO: 408850 - RNA, 13 nt, Bordetella pertussis
ccugggccagcca

SEQ ID NO: 408851 - RNA, 19 nt, Bordetella pertussis
ccugggccagccagcgccg

SEQ ID NO: 408852 - RNA, 11 nt, Bordetella pertussis
ccugggccgcc

SEQ ID NO: 408853 - RNA, 16 nt, Bordetella pertussis
ccugggcgcgguccag

SEQ ID NO: 408854 - RNA, 17 nt, Bordetella pertussis
ccugggcggcgcagucg

SEQ ID NO: 408855 - RNA, 13 nt, Bordetella pertussis
ccugggcggcgcg

SEQ ID NO: 408856 - RNA, 15 nt, Bordetella pertussis
ccugggcggcgcgcu

SEQ ID NO: 408857 - RNA, 19 nt, Bordetella pertussis
ccuggggcaguuuccaggg

SEQ ID NO: 408858 - RNA, 12 nt, Bordetella pertussis
ccuggggccgcg

SEQ ID NO: 408859 - RNA, 14 nt, Bordetella pertussis
ccuggggcgugccc

SEQ ID NO: 408860 - RNA, 17 nt, Bordetella pertussis
ccuggucgaucagcccc

SEQ ID NO: 408861 - RNA, 19 nt, Bordetella pertussis
ccuggucgucggccacgcc

SEQ ID NO: 408862 - RNA, 21 nt, Bordetella pertussis
ccuggugcaccacgcgcucca

SEQ ID NO: 408863 - RNA, 14 nt, Bordetella pertussis
ccuguaccagauga

SEQ ID NO: 408864 - RNA, 13 nt, Bordetella pertussis
ccuuacgcggcgc

SEQ ID NO: 408865 - RNA, 15 nt, Bordetella pertussis
ccuucaccccgccac

SEQ ID NO: 408866 - RNA, 13 nt, Bordetella pertussis
ccuucaccggccc

SEQ ID NO: 408867 - RNA, 14 nt, Bordetella pertussis
ccuucaccggcccc

SEQ ID NO: 408868 - RNA, 18 nt, Bordetella pertussis
ccuucagcagcucguuga

SEQ ID NO: 408869 - RNA, 12 nt, Bordetella pertussis
ccuuccggcccc

SEQ ID NO: 408870 - RNA, 15 nt, Bordetella pertussis
ccuuccuccgacagg

SEQ ID NO: 408871 - RNA, 12 nt, Bordetella pertussis
ccuuccugcuga

SEQ ID NO: 408872 - RNA, 18 nt, Bordetella pertussis
ccuuccugcuggaccugc

SEQ ID NO: 408873 - RNA, 20 nt, Bordetella pertussis
ccuuccugcuggaccugcug

SEQ ID NO: 408874 - RNA, 21 nt, Bordetella pertussis
ccuuccuggccaaugccuauu

SEQ ID NO: 408875 - RNA, 17 nt, Bordetella pertussis
ccuucgacgcggcggcc

SEQ ID NO: 408876 - RNA, 18 nt, Bordetella pertussis
ccuucgaggaaagcggcc

SEQ ID NO: 408877 - RNA, 15 nt, Bordetella pertussis
ccuucgaggccggcg

SEQ ID NO: 408878 - RNA, 13 nt, Bordetella pertussis
ccuucgccgcgca

SEQ ID NO: 408879 - RNA, 14 nt, Bordetella pertussis
ccuucgcggcuggu

SEQ ID NO: 408880 - RNA, 21 nt, Bordetella pertussis
ccuucggagccaguccccgca

SEQ ID NO: 408881 - RNA, 13 nt, Bordetella pertussis
ccuucggccggcu

SEQ ID NO: 408882 - RNA, 22 nt, Bordetella pertussis
ccuucggcgaucugggccucgg

SEQ ID NO: 408883 - RNA, 18 nt, Bordetella pertussis
ccuugaaccccggcugcg

SEQ ID NO: 408884 - RNA, 15 nt, Bordetella pertussis
ccuugaccuggucgg

SEQ ID NO: 408885 - RNA, 20 nt, Bordetella pertussis
ccuugacggucacggucugg

SEQ ID NO: 408886 - RNA, 19 nt, Bordetella pertussis
ccuugagcacguccagcgg

SEQ ID NO: 408887 - RNA, 15 nt, Bordetella pertussis
ccuugcgggccggcu

SEQ ID NO: 408888 - RNA, 22 nt, Bordetella pertussis
ccuugcucagucgggcagcgcc

SEQ ID NO: 408889 - RNA, 17 nt, Bordetella pertussis
ccuugcucccaguucug

SEQ ID NO: 408890 - RNA, 15 nt, Bordetella pertussis
ccuugcuccggcgug

SEQ ID NO: 408891 - RNA, 13 nt, Bordetella pertussis
ccuugcucgccca

SEQ ID NO: 408892 - RNA, 20 nt, Bordetella pertussis
ccuuggaguucuucuuggcc

SEQ ID NO: 408893 - RNA, 22 nt, Bordetella pertussis
ccuuggaguucuucuuggccag

SEQ ID NO: 408894 - RNA, 22 nt, Bordetella pertussis
ccuuggccauguccuggcaggc

SEQ ID NO: 408895 - RNA, 23 nt, Bordetella pertussis
ccuuggccauguccuggcaggcc

SEQ ID NO: 408896 - RNA, 16 nt, Bordetella pertussis
ccuuggcgcccagcuu

SEQ ID NO: 408897 - RNA, 22 nt, Bordetella pertussis
ccuugguggggucgaugccagu

SEQ ID NO: 408898 - RNA, 17 nt, Bordetella pertussis
ccuugucgcgcagcgcc

SEQ ID NO: 408899 - RNA, 18 nt, Bordetella pertussis
ccuugucgcgcagcgccg

SEQ ID NO: 408900 - RNA, 15 nt, Bordetella pertussis
ccuugucgcgggcag

SEQ ID NO: 408901 - RNA, 22 nt, Bordetella pertussis
ccuugugcacgugcgacgugac

SEQ ID NO: 408902 - RNA, 15 nt, Bordetella pertussis
ccuuuauugcuuuuc

SEQ ID NO: 408903 - RNA, 22 nt, Bordetella pertussis
ccuuucauuucggcgccgcgcu

SEQ ID NO: 408904 - RNA, 14 nt, Bordetella pertussis
cgaacgacuuggcg

SEQ ID NO: 408905 - RNA, 16 nt, Bordetella pertussis
cgaacggggacuggca

SEQ ID NO: 408906 - RNA, 18 nt, Bordetella pertussis
cgaacgggguggccggcg

SEQ ID NO: 408907 - RNA, 18 nt, Bordetella pertussis
cgaacgugcgcgccagcu

SEQ ID NO: 408908 - RNA, 15 nt, Bordetella pertussis
cgaacuccugcagca

SEQ ID NO: 408909 - RNA, 18 nt, Bordetella pertussis
cgaacugggacaggccca

SEQ ID NO: 408910 - RNA, 18 nt, Bordetella pertussis
cgaacugguacagcguga

SEQ ID NO: 408911 - RNA, 16 nt, Bordetella pertussis
cgaacuucagcccggg

SEQ ID NO: 408912 - RNA, 17 nt, Bordetella pertussis
cgaacuuggccaugcca

SEQ ID NO: 408913 - RNA, 17 nt, Bordetella pertussis
cgaagcaaugcagcgcg

SEQ ID NO: 408914 - RNA, 18 nt, Bordetella pertussis
cgaagcaaugcagcgcga

SEQ ID NO: 408915 - RNA, 21 nt, Bordetella pertussis
cgaagcaggcgguacagcgga

SEQ ID NO: 408916 - RNA, 16 nt, Bordetella pertussis
cgaagccacggcccgc

SEQ ID NO: 408917 - RNA, 16 nt, Bordetella pertussis
cgaaggcaaucagccc

SEQ ID NO: 408918 - RNA, 17 nt, Bordetella pertussis
cgaauccaccggcgcgc

SEQ ID NO: 408919 - RNA, 22 nt, Bordetella pertussis
cgaauccaucaucagcauggcg

SEQ ID NO: 408920 - RNA, 20 nt, Bordetella pertussis
cgaauccgcaacccagcagc

SEQ ID NO: 408921 - RNA, 15 nt, Bordetella pertussis
cgaauccucucgccc

SEQ ID NO: 408922 - RNA, 16 nt, Bordetella pertussis
cgaaucguucacgccc

SEQ ID NO: 408923 - RNA, 17 nt, Bordetella pertussis
cgaaucguucacgcccg

SEQ ID NO: 408924 - RNA, 19 nt, Bordetella pertussis
cgaaugcguguuccagcgc

SEQ ID NO: 408925 - RNA, 19 nt, Bordetella pertussis
cgacaacaagccgggcgcc

SEQ ID NO: 408926 - RNA, 14 nt, Bordetella pertussis
cgacacccccaggg

SEQ ID NO: 408927 - RNA, 16 nt, Bordetella pertussis
cgacacccccagggcg

SEQ ID NO: 408928 - RNA, 15 nt, Bordetella pertussis
cgacacccgcggcca

SEQ ID NO: 408929 - RNA, 18 nt, Bordetella pertussis
cgacacccgcggccaggg

SEQ ID NO: 408930 - RNA, 14 nt, Bordetella pertussis
cgacacgcagcaac

SEQ ID NO: 408931 - RNA, 15 nt, Bordetella pertussis
cgacacgcccagcag

SEQ ID NO: 408932 - RNA, 16 nt, Bordetella pertussis
cgacacgcccagcagg

SEQ ID NO: 408933 - RNA, 19 nt, Bordetella pertussis
cgacacggcggugccgcgc

SEQ ID NO: 408934 - RNA, 20 nt, Bordetella pertussis
cgacacggggcaaccggccu

SEQ ID NO: 408935 - RNA, 16 nt, Bordetella pertussis
cgacagcaaugacgac

SEQ ID NO: 408936 - RNA, 15 nt, Bordetella pertussis
cgacagcacauggcg

SEQ ID NO: 408937 - RNA, 14 nt, Bordetella pertussis
cgacagcagggcca

SEQ ID NO: 408938 - RNA, 17 nt, Bordetella pertussis
cgacagcagggccaggc

SEQ ID NO: 408939 - RNA, 21 nt, Bordetella pertussis
cgacagcagggucggccccau

SEQ ID NO: 408940 - RNA, 22 nt, Bordetella pertussis
cgacagcagggucggccccaug

SEQ ID NO: 408941 - RNA, 14 nt, Bordetella pertussis
cgacagccaggcca

SEQ ID NO: 408942 - RNA, 21 nt, Bordetella pertussis
cgacagccaggccagcgccag

SEQ ID NO: 408943 - RNA, 22 nt, Bordetella pertussis
cgacagccuuuccuccugccgg

SEQ ID NO: 408944 - RNA, 15 nt, Bordetella pertussis
cgacagcgacagcca

SEQ ID NO: 408945 - RNA, 16 nt, Bordetella pertussis
cgacagcgcgcccgcu

SEQ ID NO: 408946 - RNA, 17 nt, Bordetella pertussis
cgacagcuugcgcuggc

SEQ ID NO: 408947 - RNA, 22 nt, Bordetella pertussis
cgacaggaaggcgagcgcggca

SEQ ID NO: 408948 - RNA, 23 nt, Bordetella pertussis
cgacaggccuggcuuggcggcca

SEQ ID NO: 408949 - RNA, 18 nt, Bordetella pertussis
cgacaggcgcagcucgac

SEQ ID NO: 408950 - RNA, 23 nt, Bordetella pertussis
cgacauagagauuguccagcggc

SEQ ID NO: 408951 - RNA, 13 nt, Bordetella pertussis
cgacaugagcugc

SEQ ID NO: 408952 - RNA, 16 nt, Bordetella pertussis
cgacaugucgccgcgg

SEQ ID NO: 408953 - RNA, 12 nt, Bordetella pertussis
cgacauugcgcc

SEQ ID NO: 408954 - RNA, 16 nt, Bordetella pertussis
cgaccaccagcaccau

SEQ ID NO: 408955 - RNA, 15 nt, Bordetella pertussis
cgaccaccagcgcac

SEQ ID NO: 408956 - RNA, 14 nt, Bordetella pertussis
cgaccaccagcggc

SEQ ID NO: 408957 - RNA, 13 nt, Bordetella pertussis
cgaccaccggcuu

SEQ ID NO: 408958 - RNA, 19 nt, Bordetella pertussis
cgaccacgccggcggccau

SEQ ID NO: 408959 - RNA, 17 nt, Bordetella pertussis
cgaccacgcgcgcgccg

SEQ ID NO: 408960 - RNA, 15 nt, Bordetella pertussis
cgaccacgcggcggu

SEQ ID NO: 408961 - RNA, 20 nt, Bordetella pertussis
cgaccacgcugggccagacc

SEQ ID NO: 408962 - RNA, 16 nt, Bordetella pertussis
cgaccacuggcagacc

SEQ ID NO: 408963 - RNA, 17 nt, Bordetella pertussis
cgaccagcacgagaugu

SEQ ID NO: 408964 - RNA, 18 nt, Bordetella pertussis
cgaccagcacgauccagc

SEQ ID NO: 408965 - RNA, 16 nt, Bordetella pertussis
cgaccagcccggccgc

SEQ ID NO: 408966 - RNA, 18 nt, Bordetella pertussis
cgaccagcccggccgcca

SEQ ID NO: 408967 - RNA, 16 nt, Bordetella pertussis
cgaccagcgcgcgccg

SEQ ID NO: 408968 - RNA, 18 nt, Bordetella pertussis
cgaccagcucgacgccau

SEQ ID NO: 408969 - RNA, 16 nt, Bordetella pertussis
cgaccaggccggcggc

SEQ ID NO: 408970 - RNA, 19 nt, Bordetella pertussis
cgaccaggccggcggcggg

SEQ ID NO: 408971 - RNA, 20 nt, Bordetella pertussis
cgaccaggccguggcccagc

SEQ ID NO: 408972 - RNA, 12 nt, Bordetella pertussis
cgaccaggcggg

SEQ ID NO: 408973 - RNA, 18 nt, Bordetella pertussis
cgaccaggcugcgcgccg

SEQ ID NO: 408974 - RNA, 20 nt, Bordetella pertussis
cgaccaggcugcgcgccggc

SEQ ID NO: 408975 - RNA, 12 nt, Bordetella pertussis
cgaccaggcugg

SEQ ID NO: 408976 - RNA, 22 nt, Bordetella pertussis
cgaccaggugcgggccgcucag

SEQ ID NO: 408977 - RNA, 18 nt, Bordetella pertussis
cgacccauaguugcauga

SEQ ID NO: 408978 - RNA, 19 nt, Bordetella pertussis
cgacccgaaggcgcggccg

SEQ ID NO: 408979 - RNA, 16 nt, Bordetella pertussis
cgacccgagcccuggc

SEQ ID NO: 408980 - RNA, 19 nt, Bordetella pertussis
cgacccgagcccuggcuug

SEQ ID NO: 408981 - RNA, 17 nt, Bordetella pertussis
cgacccgcaccgacggg

SEQ ID NO: 408982 - RNA, 13 nt, Bordetella pertussis
cgacccgcgccuc

SEQ ID NO: 408983 - RNA, 14 nt, Bordetella pertussis
cgacccgcggcccu

SEQ ID NO: 408984 - RNA, 15 nt, Bordetella pertussis
cgacccgcucggcca

SEQ ID NO: 408985 - RNA, 20 nt, Bordetella pertussis
cgacccucagcccgcaccgc

SEQ ID NO: 408986 - RNA, 15 nt, Bordetella pertussis
cgaccgagccggcca

SEQ ID NO: 408987 - RNA, 15 nt, Bordetella pertussis
cgaccgccggccggu

SEQ ID NO: 408988 - RNA, 23 nt, Bordetella pertussis
cgaccgcgcggcgcugcacgcgg

SEQ ID NO: 408989 - RNA, 19 nt, Bordetella pertussis
cgaccgcgggcgcgcgccc

SEQ ID NO: 408990 - RNA, 23 nt, Bordetella pertussis
cgaccgcguaguugucggcgcag

SEQ ID NO: 408991 - RNA, 17 nt, Bordetella pertussis
cgaccgcuacccugccc

SEQ ID NO: 408992 - RNA, 21 nt, Bordetella pertussis
cgaccgcuuccgccaccgcgc

SEQ ID NO: 408993 - RNA, 16 nt, Bordetella pertussis
cgaccggcgccggcuc

SEQ ID NO: 408994 - RNA, 14 nt, Bordetella pertussis
cgaccggcucgauc

SEQ ID NO: 408995 - RNA, 20 nt, Bordetella pertussis
cgaccggcucgggcucgagc

SEQ ID NO: 408996 - RNA, 14 nt, Bordetella pertussis
cgaccgggccgacc

SEQ ID NO: 408997 - RNA, 15 nt, Bordetella pertussis
cgaccuccaggccca

SEQ ID NO: 408998 - RNA, 18 nt, Bordetella pertussis
cgaccuccaggcccaggc

SEQ ID NO: 408999 - RNA, 17 nt, Bordetella pertussis
cgaccucggcaccgagg

SEQ ID NO: 409000 - RNA, 17 nt, Bordetella pertussis
cgaccucgggacggccc

SEQ ID NO: 409001 - RNA, 21 nt, Bordetella pertussis
cgaccucgggacggcccugca

SEQ ID NO: 409002 - RNA, 16 nt, Bordetella pertussis
cgaccucgucgggcug

SEQ ID NO: 409003 - RNA, 16 nt, Bordetella pertussis
cgaccugaucgcgcag

SEQ ID NO: 409004 - RNA, 20 nt, Bordetella pertussis
cgaccugaucgcgcagcgcc

SEQ ID NO: 409005 - RNA, 23 nt, Bordetella pertussis
cgaccugaucgcgcagcgccugg

SEQ ID NO: 409006 - RNA, 19 nt, Bordetella pertussis
cgaccugcgcgaccgccgc

SEQ ID NO: 409007 - RNA, 20 nt, Bordetella pertussis
cgaccugcgggcgcagcgcc

SEQ ID NO: 409008 - RNA, 21 nt, Bordetella pertussis
cgaccugcgggcgcagcgccg

SEQ ID NO: 409009 - RNA, 23 nt, Bordetella pertussis
cgaccugcuggcgcgcaccaucg

SEQ ID NO: 409010 - RNA, 21 nt, Bordetella pertussis
cgaccuugcuggaccgcgccu

SEQ ID NO: 409011 - RNA, 22 nt, Bordetella pertussis
cgaccuugcuggaccgcgccug

SEQ ID NO: 409012 - RNA, 23 nt, Bordetella pertussis
cgacgaaauagccgaccacccgc

SEQ ID NO: 409013 - RNA, 12 nt, Bordetella pertussis
cgacgaaaugcc

SEQ ID NO: 409014 - RNA, 16 nt, Bordetella pertussis
cgacgaaaugccggcg

SEQ ID NO: 409015 - RNA, 17 nt, Bordetella pertussis
cgacgaacacgcgcgcc

SEQ ID NO: 409016 - RNA, 20 nt, Bordetella pertussis
cgacgaacacgcgcgccgcg

SEQ ID NO: 409017 - RNA, 15 nt, Bordetella pertussis
cgacgacuacuggca

SEQ ID NO: 409018 - RNA, 14 nt, Bordetella pertussis
cgacgagaucgcgc

SEQ ID NO: 409019 - RNA, 17 nt, Bordetella pertussis
cgacgaggggguguucu

SEQ ID NO: 409020 - RNA, 23 nt, Bordetella pertussis
cgacgcaacagacccgggccgcu

SEQ ID NO: 409021 - RNA, 16 nt, Bordetella pertussis
cgacgcagcagccgcu

SEQ ID NO: 409022 - RNA, 13 nt, Bordetella pertussis
cgacgccaucucg

SEQ ID NO: 409023 - RNA, 18 nt, Bordetella pertussis
cgacgccaucucgcgcgc

SEQ ID NO: 409024 - RNA, 13 nt, Bordetella pertussis
cgacgcccgggcg

SEQ ID NO: 409025 - RNA, 14 nt, Bordetella pertussis
cgacgccgcgcgcg

SEQ ID NO: 409026 - RNA, 19 nt, Bordetella pertussis
cgacgccggcucaggccag

SEQ ID NO: 409027 - RNA, 12 nt, Bordetella pertussis
cgacgccggcuu

SEQ ID NO: 409028 - RNA, 13 nt, Bordetella pertussis
cgacgccggcagc

SEQ ID NO: 409029 - RNA, 19 nt, Bordetella pertussis
cgacgccugcgccauggcg

SEQ ID NO: 409030 - RNA, 21 nt, Bordetella pertussis
cgacgccugcgccauggcgcg

SEQ ID NO: 409031 - RNA, 13 nt, Bordetella pertussis
cgacgccuggacc

SEQ ID NO: 409032 - RNA, 22 nt, Bordetella pertussis
cgacgccuggaccggcuccggc

SEQ ID NO: 409033 - RNA, 16 nt, Bordetella pertussis
cgacgcgacacgcagc

SEQ ID NO: 409034 - RNA, 15 nt, Bordetella pertussis
cgacgcgacgcgggc

SEQ ID NO: 409035 - RNA, 19 nt, Bordetella pertussis
cgacgcgaggcagaagugg

SEQ ID NO: 409036 - RNA, 13 nt, Bordetella pertussis
cgacgcggcggcc

SEQ ID NO: 409037 - RNA, 11 nt, Bordetella pertussis
cgacgcggcgu

SEQ ID NO: 409038 - RNA, 14 nt, Bordetella pertussis
cgacgcggccgacc

SEQ ID NO: 409039 - RNA, 15 nt, Bordetella pertussis
cgacgcggccgaccc

SEQ ID NO: 409040 - RNA, 17 nt, Bordetella pertussis
cgacgcugaucggccga

SEQ ID NO: 409041 - RNA, 21 nt, Bordetella pertussis
cgacgcugaugcccagcccgg

SEQ ID NO: 409042 - RNA, 21 nt, Bordetella pertussis
cgacgcuguagaggcgcggcu

SEQ ID NO: 409043 - RNA, 15 nt, Bordetella pertussis
cgacgcuugccggcg

SEQ ID NO: 409044 - RNA, 14 nt, Bordetella pertussis
cgacggcagcaagc

SEQ ID NO: 409045 - RNA, 19 nt, Bordetella pertussis
cgacggcauggcggccagc

SEQ ID NO: 409046 - RNA, 12 nt, Bordetella pertussis
cgacggccggcg

SEQ ID NO: 409047 - RNA, 14 nt, Bordetella pertussis
cgacggccggcgcg

SEQ ID NO: 409048 - RNA, 12 nt, Bordetella pertussis
cgacggccgggg

SEQ ID NO: 409049 - RNA, 20 nt, Bordetella pertussis
cgacggccuccgcgccgacc

SEQ ID NO: 409050 - RNA, 20 nt, Bordetella pertussis
cgacggccucggccaggaaa

SEQ ID NO: 409051 - RNA, 18 nt, Bordetella pertussis
cgacggcgauguccuggu

SEQ ID NO: 409052 - RNA, 17 nt, Bordetella pertussis
cgacggcgggaccggcg

SEQ ID NO: 409053 - RNA, 23 nt, Bordetella pertussis
cgacggcuggagauacuggccga

SEQ ID NO: 409054 - RNA, 17 nt, Bordetella pertussis
cgacgggcaggcccagc

SEQ ID NO: 409055 - RNA, 14 nt, Bordetella pertussis
cgacggggacacaa

SEQ ID NO: 409056 - RNA, 20 nt, Bordetella pertussis
cgacgguaucucagcgcgcc

SEQ ID NO: 409057 - RNA, 14 nt, Bordetella pertussis
cgacggugcgcgcc

SEQ ID NO: 409058 - RNA, 15 nt, Bordetella pertussis
cgacggugcgcgcca

SEQ ID NO: 409059 - RNA, 16 nt, Bordetella pertussis
cgacguaagugcccag

SEQ ID NO: 409060 - RNA, 17 nt, Bordetella pertussis
cgacguaagugcccagg

SEQ ID NO: 409061 - RNA, 15 nt, Bordetella pertussis
cgacguagucggcgc

SEQ ID NO: 409062 - RNA, 12 nt, Bordetella pertussis
cgacgucccagg

SEQ ID NO: 409063 - RNA, 14 nt, Bordetella pertussis
cgacguccuggugg

SEQ ID NO: 409064 - RNA, 15 nt, Bordetella pertussis
cgacguccuggugga

SEQ ID NO: 409065 - RNA, 14 nt, Bordetella pertussis
cgauaccaguagcg

SEQ ID NO: 409066 - RNA, 19 nt, Bordetella pertussis
cgaucaacgugcgccaggc

SEQ ID NO: 409067 - RNA, 19 nt, Bordetella pertussis
cgaucaagggguggcuguc

SEQ ID NO: 409068 - RNA, 20 nt, Bordetella pertussis
cgaucacgaacagcgccagg

SEQ ID NO: 409069 - RNA, 13 nt, Bordetella pertussis
cgaucacggccaa

SEQ ID NO: 409070 - RNA, 20 nt, Bordetella pertussis
cgaucagcaagggccccagc

SEQ ID NO: 409071 - RNA, 14 nt, Bordetella pertussis
cgaucagcaccgcg

SEQ ID NO: 409072 - RNA, 20 nt, Bordetella pertussis
cgaucagcaccacggcggcc

SEQ ID NO: 409073 - RNA, 21 nt, Bordetella pertussis
cgaucagccacgugaagcgcc

SEQ ID NO: 409074 - RNA, 21 nt, Bordetella pertussis
cgaucagcgaaugcgacagcg

SEQ ID NO: 409075 - RNA, 20 nt, Bordetella pertussis
cgaucagccagccggcggcc

SEQ ID NO: 409076 - RNA, 16 nt, Bordetella pertussis
cgaucagcgggcuggc

SEQ ID NO: 409077 - RNA, 11 nt, Bordetella pertussis
cgaucagcugc

SEQ ID NO: 409078 - RNA, 18 nt, Bordetella pertussis
cgaucaggcccuggggcc

SEQ ID NO: 409079 - RNA, 19 nt, Bordetella pertussis
cgaucaggcccuggggccg

SEQ ID NO: 409080 - RNA, 17 nt, Bordetella pertussis
cgaucaggcgcuccaug

SEQ ID NO: 409081 - RNA, 15 nt, Bordetella pertussis
cgaucaugccgccga

SEQ ID NO: 409082 - RNA, 15 nt, Bordetella pertussis
cgauccagaagauau

SEQ ID NO: 409083 - RNA, 15 nt, Bordetella pertussis
cgauccagcccaccg

SEQ ID NO: 409084 - RNA, 16 nt, Bordetella pertussis
cgauccaggccaccgc

SEQ ID NO: 409085 - RNA, 18 nt, Bordetella pertussis
cgauccagggccgccagc

SEQ ID NO: 409086 - RNA, 23 nt, Bordetella pertussis
cgauccagggccgccagcaccug

SEQ ID NO: 409087 - RNA, 20 nt, Bordetella pertussis
cgauccauccgcauacaacu

SEQ ID NO: 409088 - RNA, 20 nt, Bordetella pertussis
cgauccgaugaugcccagga

SEQ ID NO: 409089 - RNA, 18 nt, Bordetella pertussis
cgauccgaugcccgguuc

SEQ ID NO: 409090 - RNA, 16 nt, Bordetella pertussis
cgauccgccgcggcca

SEQ ID NO: 409091 - RNA, 18 nt, Bordetella pertussis
cgauccgccgcggccagc

SEQ ID NO: 409092 - RNA, 22 nt, Bordetella pertussis
cgauccgcggguauucgaaggc

SEQ ID NO: 409093 - RNA, 16 nt, Bordetella pertussis
cgauccggcgcagauc

SEQ ID NO: 409094 - RNA, 15 nt, Bordetella pertussis
cgauccgggccuggc

SEQ ID NO: 409095 - RNA, 19 nt, Bordetella pertussis
cgauccugcccaccgccgc

SEQ ID NO: 409096 - RNA, 20 nt, Bordetella pertussis
cgaucgaauggucggccucg

SEQ ID NO: 409097 - RNA, 23 nt, Bordetella pertussis
cgaucgagaaguuggcgggcgcu

SEQ ID NO: 409098 - RNA, 22 nt, Bordetella pertussis
cgaucgccuguaucugcgccgu

SEQ ID NO: 409099 - RNA, 14 nt, Bordetella pertussis
cgaucgccuggggc

SEQ ID NO: 409100 - RNA, 19 nt, Bordetella pertussis
cgaucgcgccggccugggc

SEQ ID NO: 409101 - RNA, 21 nt, Bordetella pertussis
cgaucggagaaaucgccgccg

SEQ ID NO: 409102 - RNA, 16 nt, Bordetella pertussis
cgaucggcgccgcgcg

SEQ ID NO: 409103 - RNA, 18 nt, Bordetella pertussis
cgaucgggagccucugga

SEQ ID NO: 409104 - RNA, 14 nt, Bordetella pertussis
cgaucgucagcagc

SEQ ID NO: 409105 - RNA, 20 nt, Bordetella pertussis
cgaucuacgacgccuggacc

SEQ ID NO: 409106 - RNA, 17 nt, Bordetella pertussis
cgaucucagccaucauc

SEQ ID NO: 409107 - RNA, 15 nt, Bordetella pertussis
cgaucucgcccugcu

SEQ ID NO: 409108 - RNA, 13 nt, Bordetella pertussis
cgaucugcugggc

SEQ ID NO: 409109 - RNA, 22 nt, Bordetella pertussis
cgaucuuguaggcgauccaggc

SEQ ID NO: 409110 - RNA, 16 nt, Bordetella pertussis
cgaugaacgacagggu

SEQ ID NO: 409111 - RNA, 22 nt, Bordetella pertussis
cgaugaacgacccggucgugua

SEQ ID NO: 409112 - RNA, 15 nt, Bordetella pertussis
cgaugaacgcgcgca

SEQ ID NO: 409113 - RNA, 19 nt, Bordetella pertussis
cgaugaaggugcgcagcag

SEQ ID NO: 409114 - RNA, 17 nt, Bordetella pertussis
cgaugaccagcgccggc

SEQ ID NO: 409115 - RNA, 21 nt, Bordetella pertussis
cgaugaccagcgccggcgcau

SEQ ID NO: 409116 - RNA, 20 nt, Bordetella pertussis
cgaugaccagggcgccgacc

SEQ ID NO: 409117 - RNA, 13 nt, Bordetella pertussis
cgaugaccaucac

SEQ ID NO: 409118 - RNA, 19 nt, Bordetella pertussis
cgaugaccucgcgcugcag

SEQ ID NO: 409119 - RNA, 20 nt, Bordetella pertussis
cgaugaccucggcgagcgcc

SEQ ID NO: 409120 - RNA, 14 nt, Bordetella pertussis
cgaugaccugggcc

SEQ ID NO: 409121 - RNA, 18 nt, Bordetella pertussis
cgaugacgcgccgcgccu

SEQ ID NO: 409122 - RNA, 18 nt, Bordetella pertussis
cgaugacggcuucgacca

SEQ ID NO: 409123 - RNA, 18 nt, Bordetella pertussis
cgaugacgugucccccgg

SEQ ID NO: 409124 - RNA, 21 nt, Bordetella pertussis
cgaugcaugaaccgcagcgcc

SEQ ID NO: 409125 - RNA, 11 nt, Bordetella pertussis
cgaugcccagc

SEQ ID NO: 409126 - RNA, 12 nt, Bordetella pertussis
cgaugcccacca

SEQ ID NO: 409127 - RNA, 19 nt, Bordetella pertussis
cgaugcccaccagccgccc

SEQ ID NO: 409128 - RNA, 14 nt, Bordetella pertussis
cgaugcccgcgcac

SEQ ID NO: 409129 - RNA, 13 nt, Bordetella pertussis
cgaugcccuggau

SEQ ID NO: 409130 - RNA, 16 nt, Bordetella pertussis
cgaugccgcagauggc

SEQ ID NO: 409131 - RNA, 22 nt, Bordetella pertussis
cgaugccgccaugcgccagcag

SEQ ID NO: 409132 - RNA, 20 nt, Bordetella pertussis
cgaugccgauacgucgcagc

SEQ ID NO: 409133 - RNA, 21 nt, Bordetella pertussis
cgaugccgauacgucgcagca

SEQ ID NO: 409134 - RNA, 23 nt, Bordetella pertussis
cgauggacucauaggcaucgacc

SEQ ID NO: 409135 - RNA, 21 nt, Bordetella pertussis
cgauggagucggucagccuga

SEQ ID NO: 409136 - RNA, 19 nt, Bordetella pertussis
cgauggccucggcauggcg

SEQ ID NO: 409137 - RNA, 21 nt, Bordetella pertussis
cgauggccucggcauggcgcg

SEQ ID NO: 409138 - RNA, 17 nt, Bordetella pertussis
cgauggcgauguaggcc

SEQ ID NO: 409139 - RNA, 15 nt, Bordetella pertussis
cgauggcgcgcggcu

SEQ ID NO: 409140 - RNA, 16 nt, Bordetella pertussis
cgauggcggcaucuug

SEQ ID NO: 409141 - RNA, 15 nt, Bordetella pertussis
cgauggcggccaggg

SEQ ID NO: 409142 - RNA, 20 nt, Bordetella pertussis
cgaugguggcguucucgacc

SEQ ID NO: 409143 - RNA, 15 nt, Bordetella pertussis
cgauguccagcgagc

SEQ ID NO: 409144 - RNA, 15 nt, Bordetella pertussis
cgauguccagcgcca

SEQ ID NO: 409145 - RNA, 20 nt, Bordetella pertussis
cgauguuguuggccgccagc

SEQ ID NO: 409146 - RNA, 23 nt, Bordetella pertussis
cgauguuguuggccgccagccgg

SEQ ID NO: 409147 - RNA, 16 nt, Bordetella pertussis
cgauuaugccgcccgc

SEQ ID NO: 409148 - RNA, 18 nt, Bordetella pertussis
cgauuccagcgccgccuu

SEQ ID NO: 409149 - RNA, 20 nt, Bordetella pertussis
cgauucccuggcgcgccagc

SEQ ID NO: 409150 - RNA, 19 nt, Bordetella pertussis
cgauugugcaugacggcca

SEQ ID NO: 409151 - RNA, 15 nt, Bordetella pertussis
cgauuuccgaggccu

SEQ ID NO: 409152 - RNA, 18 nt, Bordetella pertussis
cgcaagcauuugcgcgac

SEQ ID NO: 409153 - RNA, 18 nt, Bordetella pertussis
cgcaagcccaggcggccc

SEQ ID NO: 409154 - RNA, 15 nt, Bordetella pertussis
cgcaagccgcccgcg

SEQ ID NO: 409155 - RNA, 15 nt, Bordetella pertussis
cgcaagccgccgccc

SEQ ID NO: 409156 - RNA, 15 nt, Bordetella pertussis
cgcaagccggccgcg

SEQ ID NO: 409157 - RNA, 13 nt, Bordetella pertussis
cgcaagcgcgccg

SEQ ID NO: 409158 - RNA, 15 nt, Bordetella pertussis
cgcaagcggccccag

SEQ ID NO: 409159 - RNA, 17 nt, Bordetella pertussis
cgcaagcuggcggcgcg

SEQ ID NO: 409160 - RNA, 18 nt, Bordetella pertussis
cgcaaggccgacuggaug

SEQ ID NO: 409161 - RNA, 20 nt, Bordetella pertussis
cgcaaggccugcucgggcgc

SEQ ID NO: 409162 - RNA, 13 nt, Bordetella pertussis
cgcaaggcggccc

SEQ ID NO: 409163 - RNA, 20 nt, Bordetella pertussis
cgcaaggcggcccggccgcc

SEQ ID NO: 409164 - RNA, 21 nt, Bordetella pertussis
cgcaaggcggcccggccgccg

SEQ ID NO: 409165 - RNA, 14 nt, Bordetella pertussis
cgcaagggggacug

SEQ ID NO: 409166 - RNA, 22 nt, Bordetella pertussis
cgcaagggggacuggcaccggc

SEQ ID NO: 409167 - RNA, 17 nt, Bordetella pertussis
cgcaaguucggcagcga

SEQ ID NO: 409168 - RNA, 15 nt, Bordetella pertussis
cgcaauacgccgccg

SEQ ID NO: 409169 - RNA, 14 nt, Bordetella pertussis
cgcaauaggccgcg

SEQ ID NO: 409170 - RNA, 19 nt, Bordetella pertussis
cgcaccaggccgcggcgcc

SEQ ID NO: 409171 - RNA, 17 nt, Bordetella pertussis
cgcaccaggccugccug

SEQ ID NO: 409172 - RNA, 12 nt, Bordetella pertussis
cgcaccaggcug

SEQ ID NO: 409173 - RNA, 22 nt, Bordetella pertussis
cgcaccaggcuggggccgagcg

SEQ ID NO: 409174 - RNA, 19 nt, Bordetella pertussis
cgcaccagucccgcaccga

SEQ ID NO: 409175 - RNA, 21 nt, Bordetella pertussis
cgcaccaguuucucggccacu

SEQ ID NO: 409176 - RNA, 13 nt, Bordetella pertussis
cgcacccaggccc

SEQ ID NO: 409177 - RNA, 16 nt, Bordetella pertussis
cgcacccgcaggccgu

SEQ ID NO: 409178 - RNA, 20 nt, Bordetella pertussis
cgcacccgguauccgcgcau

SEQ ID NO: 409179 - RNA, 23 nt, Bordetella pertussis
cgcacccggugaucaugccgcug

SEQ ID NO: 409180 - RNA, 15 nt, Bordetella pertussis
cgcacccgucccugg

SEQ ID NO: 409181 - RNA, 14 nt, Bordetella pertussis
cgcaccgaccagcg

SEQ ID NO: 409182 - RNA, 17 nt, Bordetella pertussis
cgcaccgaccagcgcgc

SEQ ID NO: 409183 - RNA, 19 nt, Bordetella pertussis
cgcaccgaccagcgcgcgc

SEQ ID NO: 409184 - RNA, 18 nt, Bordetella pertussis
cgcaccgacggcagcccc

SEQ ID NO: 409185 - RNA, 21 nt, Bordetella pertussis
cgcaccgacggcagccccggg

SEQ ID NO: 409186 - RNA, 15 nt, Bordetella pertussis
cgcaccgccgccggc

SEQ ID NO: 409187 - RNA, 17 nt, Bordetella pertussis
cgcaccgccgccggccc

SEQ ID NO: 409188 - RNA, 19 nt, Bordetella pertussis
cgcaccggaggcgccgcgg

SEQ ID NO: 409189 - RNA, 19 nt, Bordetella pertussis
cgcaccggcacgcgccagc

SEQ ID NO: 409190 - RNA, 21 nt, Bordetella pertussis
cgcaccggcgugcgcuggcug

SEQ ID NO: 409191 - RNA, 22 nt, Bordetella pertussis
cgcaccggcgugcgcuggcugg

SEQ ID NO: 409192 - RNA, 22 nt, Bordetella pertussis
cgcaccgggcaaucggcgugca

SEQ ID NO: 409193 - RNA, 18 nt, Bordetella pertussis
cgcaccgggcggcccggc

SEQ ID NO: 409194 - RNA, 19 nt, Bordetella pertussis
cgcaccgggcggcccggcg

SEQ ID NO: 409195 - RNA, 21 nt, Bordetella pertussis
cgcaccgggcggcccggcgga

SEQ ID NO: 409196 - RNA, 18 nt, Bordetella pertussis
cgcacgcucuacacggcc

SEQ ID NO: 409197 - RNA, 15 nt, Bordetella pertussis
cgcacgcucugcacc

SEQ ID NO: 409198 - RNA, 19 nt, Bordetella pertussis
cgcacggacagcccgcgcu

SEQ ID NO: 409199 - RNA, 23 nt, Bordetella pertussis
cgcacgcugggcuacgacccgcu

SEQ ID NO: 409200 - RNA, 15 nt, Bordetella pertussis
cgcacgggcgccugu

SEQ ID NO: 409201 - RNA, 16 nt, Bordetella pertussis
cgcacggggacuggca

SEQ ID NO: 409202 - RNA, 14 nt, Bordetella pertussis
cgcacgguccaggc

SEQ ID NO: 409203 - RNA, 16 nt, Bordetella pertussis
cgcacgguccaggcgg

SEQ ID NO: 409204 - RNA, 18 nt, Bordetella pertussis
cgcacggucgaagaucuu

SEQ ID NO: 409205 - RNA, 21 nt, Bordetella pertussis
cgcacuggguggccagcgccg

SEQ ID NO: 409206 - RNA, 24 nt, Bordetella pertussis
cgcacuggguggccagcgccgcca

SEQ ID NO: 409207 - RNA, 14 nt, Bordetella pertussis
cgcacuggguuuuu

SEQ ID NO: 409208 - RNA, 21 nt, Bordetella pertussis
cgcacugggugacgcuggagc

SEQ ID NO: 409209 - RNA, 17 nt, Bordetella pertussis
cgcacuucgggccaccc

SEQ ID NO: 409210 - RNA, 18 nt, Bordetella pertussis
cgcacuucgggccacccg

SEQ ID NO: 409211 - RNA, 19 nt, Bordetella pertussis
cgcagaccacgccggcggu

SEQ ID NO: 409212 - RNA, 16 nt, Bordetella pertussis
cgcagacuccaggagc

SEQ ID NO: 409213 - RNA, 14 nt, Bordetella pertussis
cgcagcaacccgcc

SEQ ID NO: 409214 - RNA, 15 nt, Bordetella pertussis
cgcagcaacccgccc

SEQ ID NO: 409215 - RNA, 18 nt, Bordetella pertussis
cgcagcaacccgcccggg

SEQ ID NO: 409216 - RNA, 13 nt, Bordetella pertussis
cgcagcaacggug

SEQ ID NO: 409217 - RNA, 17 nt, Bordetella pertussis
cgcagcaagcugcugcu

SEQ ID NO: 409218 - RNA, 18 nt, Bordetella pertussis
cgcagcaagucagcccgc

SEQ ID NO: 409219 - RNA, 21 nt, Bordetella pertussis
cgcagcaagucagcccgcguc

SEQ ID NO: 409220 - RNA, 24 nt, Bordetella pertussis
cgcagcaagucagcccgcgucgcu

SEQ ID NO: 409221 - RNA, 18 nt, Bordetella pertussis
cgcagcaauugccccagc

SEQ ID NO: 409222 - RNA, 21 nt, Bordetella pertussis
cgcagcaauugccccagcacg

SEQ ID NO: 409223 - RNA, 13 nt, Bordetella pertussis
cgcagcaccaggc

SEQ ID NO: 409224 - RNA, 14 nt, Bordetella pertussis
cgcagcaccgccag

SEQ ID NO: 409225 - RNA, 18 nt, Bordetella pertussis
cgcagcaccgccagcgcg

SEQ ID NO: 409226 - RNA, 15 nt, Bordetella pertussis
cgcagcaccggcgug

SEQ ID NO: 409227 - RNA, 18 nt, Bordetella pertussis
cgcagcaccucggggcgc

SEQ ID NO: 409228 - RNA, 13 nt, Bordetella pertussis
cgcagcacgccca

SEQ ID NO: 409229 - RNA, 18 nt, Bordetella pertussis
cgcagcacgcccagaugg

SEQ ID NO: 409230 - RNA, 20 nt, Bordetella pertussis
cgcagcacgcccagauggcc

SEQ ID NO: 409231 - RNA, 15 nt, Bordetella pertussis
cgcagcacgcccgcg

SEQ ID NO: 409232 - RNA, 20 nt, Bordetella pertussis
cgcagcacggcuugcgcgcc

SEQ ID NO: 409233 - RNA, 10 nt, Bordetella pertussis
cgcagcagcg

SEQ ID NO: 409234 - RNA, 13 nt, Bordetella pertussis
cgcagcagcgccg

SEQ ID NO: 409235 - RNA, 14 nt, Bordetella pertussis
cgcagcagcuugcc

SEQ ID NO: 409236 - RNA, 21 nt, Bordetella pertussis
cgcagcagcuugccgaccgcu

SEQ ID NO: 409237 - RNA, 17 nt, Bordetella pertussis
cgcagcaggccgcgcgu

SEQ ID NO: 409238 - RNA, 19 nt, Bordetella pertussis
cgcagcaggcgcgcggccu

SEQ ID NO: 409239 - RNA, 17 nt, Bordetella pertussis
cgcagcaggcgcgugcu

SEQ ID NO: 409240 - RNA, 19 nt, Bordetella pertussis
cgcagcaucuugcgccgcu

SEQ ID NO: 409241 - RNA, 15 nt, Bordetella pertussis
cgcagcaugagcuga

SEQ ID NO: 409242 - RNA, 23 nt, Bordetella pertussis
cgcagcauggcgccagcuggacc

SEQ ID NO: 409243 - RNA, 15 nt, Bordetella pertussis
cgcagcauuucuucc

SEQ ID NO: 409244 - RNA, 20 nt, Bordetella pertussis
cgcagccagguaagcuggcg

SEQ ID NO: 409245 - RNA, 22 nt, Bordetella pertussis
cgcagccagguaagcuggcgcu

SEQ ID NO: 409246 - RNA, 14 nt, Bordetella pertussis
cgcagcccggcgug

SEQ ID NO: 409247 - RNA, 22 nt, Bordetella pertussis
cgcagccgccagcgccuggacc

SEQ ID NO: 409248 - RNA, 17 nt, Bordetella pertussis
cgcagccgcccggcagc

SEQ ID NO: 409249 - RNA, 14 nt, Bordetella pertussis
cgcagccgcgcgcc

SEQ ID NO: 409250 - RNA, 21 nt, Bordetella pertussis
cgcagccgcuccagccaccac

SEQ ID NO: 409251 - RNA, 13 nt, Bordetella pertussis
cgcagccgcuuca

SEQ ID NO: 409252 - RNA, 15 nt, Bordetella pertussis
cgcagccgggcugcc

SEQ ID NO: 409253 - RNA, 17 nt, Bordetella pertussis
cgcagcgaacggcccac

SEQ ID NO: 409254 - RNA, 13 nt, Bordetella pertussis
cgcagcgcccagg

SEQ ID NO: 409255 - RNA, 14 nt, Bordetella pertussis
cgcagcgcccaggc

SEQ ID NO: 409256 - RNA, 16 nt, Bordetella pertussis
cgcagcgcccaggcga

SEQ ID NO: 409257 - RNA, 14 nt, Bordetella pertussis
cgcagcgccgcgau

SEQ ID NO: 409258 - RNA, 21 nt, Bordetella pertussis
cgcagcgccuggccgagcgcg

SEQ ID NO: 409259 - RNA, 19 nt, Bordetella pertussis
cgcagcggaugccgcccgu

SEQ ID NO: 409260 - RNA, 15 nt, Bordetella pertussis
cgcagcggcagcgca

SEQ ID NO: 409261 - RNA, 15 nt, Bordetella pertussis
cgcagcggcaggccc

SEQ ID NO: 409262 - RNA, 16 nt, Bordetella pertussis
cgcagcggcaggcccu

SEQ ID NO: 409263 - RNA, 15 nt, Bordetella pertussis
cgcagcggcaggcgg

SEQ ID NO: 409264 - RNA, 21 nt, Bordetella pertussis
cgcagcucccccacgccgccg

SEQ ID NO: 409265 - RNA, 20 nt, Bordetella pertussis
cgcagcuccgggucgagcgc

SEQ ID NO: 409266 - RNA, 18 nt, Bordetella pertussis
cgcagcucguggcgcgcc

SEQ ID NO: 409267 - RNA, 19 nt, Bordetella pertussis
cgcagcucguggcgcgccu

SEQ ID NO: 409268 - RNA, 19 nt, Bordetella pertussis
cgcagcugccugagcaccg

SEQ ID NO: 409269 - RNA, 22 nt, Bordetella pertussis
cgcagcugccugagcaccgccg

SEQ ID NO: 409270 - RNA, 22 nt, Bordetella pertussis
cgcagcuggacuauggccugga

SEQ ID NO: 409271 - RNA, 21 nt, Bordetella pertussis
cgcagcuucuaucugccgcgc

SEQ ID NO: 409272 - RNA, 19 nt, Bordetella pertussis
cgcagcuucuucuuugccc

SEQ ID NO: 409273 - RNA, 19 nt, Bordetella pertussis
cgcagcuugcccgcgcgca

SEQ ID NO: 409274 - RNA, 20 nt, Bordetella pertussis
cgcagcuugcccgcgcgcac

SEQ ID NO: 409275 - RNA, 15 nt, Bordetella pertussis
cgcagggcggccucg

SEQ ID NO: 409276 - RNA, 20 nt, Bordetella pertussis
cgcagggugcggggugccug

SEQ ID NO: 409277 - RNA, 16 nt, Bordetella pertussis
cgcaggucggccagga

SEQ ID NO: 409278 - RNA, 16 nt, Bordetella pertussis
cgcaggugccuguccc

SEQ ID NO: 409279 - RNA, 17 nt, Bordetella pertussis
cgcaggugugccagccg

SEQ ID NO: 409280 - RNA, 19 nt, Bordetella pertussis
cgcaguacccggugcagcg

SEQ ID NO: 409281 - RNA, 15 nt, Bordetella pertussis
cgcaguaucccggcc

SEQ ID NO: 409282 - RNA, 19 nt, Bordetella pertussis
cgcaguaucccggccaggc

SEQ ID NO: 409283 - RNA, 17 nt, Bordetella pertussis
cgcaguauuccugcugg

SEQ ID NO: 409284 - RNA, 21 nt, Bordetella pertussis
cgcagucccaguccggcagca

SEQ ID NO: 409285 - RNA, 14 nt, Bordetella pertussis
cgcagucggggccg

SEQ ID NO: 409286 - RNA, 16 nt, Bordetella pertussis
cgcagucggggccgca

SEQ ID NO: 409287 - RNA, 18 nt, Bordetella pertussis
cgcagucggggccgcagc

SEQ ID NO: 409288 - RNA, 18 nt, Bordetella pertussis
cgcaguugcgucuccagc

SEQ ID NO: 409289 - RNA, 20 nt, Bordetella pertussis
cgcaguugcgucuccagcgc

SEQ ID NO: 409290 - RNA, 21 nt, Bordetella pertussis
cgcauacaacuucagccagcg

SEQ ID NO: 409291 - RNA, 13 nt, Bordetella pertussis
cgcaucccgcccc

SEQ ID NO: 409292 - RNA, 16 nt, Bordetella pertussis
cgcaucccgcccccgc

SEQ ID NO: 409293 - RNA, 19 nt, Bordetella pertussis
cgcaucccgcccccgccgc

SEQ ID NO: 409294 - RNA, 22 nt, Bordetella pertussis
cgcauccgguggugcugggcgg

SEQ ID NO: 409295 - RNA, 19 nt, Bordetella pertussis
cgccaccagcagcgccagg

SEQ ID NO: 409296 - RNA, 12 nt, Bordetella pertussis
cgccaccagcgc

SEQ ID NO: 409297 - RNA, 13 nt, Bordetella pertussis
cgccaccagcgcg

SEQ ID NO: 409298 - RNA, 14 nt, Bordetella pertussis
cgccaccagcggcg

SEQ ID NO: 409299 - RNA, 15 nt, Bordetella pertussis
cgccaccagcggcgu

SEQ ID NO: 409300 - RNA, 21 nt, Bordetella pertussis
cgccaccagcuugcgcgccgc

SEQ ID NO: 409301 - RNA, 19 nt, Bordetella pertussis
cgccaccaggaacgccagc

SEQ ID NO: 409302 - RNA, 21 nt, Bordetella pertussis
cgccaccagggcgcccgccga

SEQ ID NO: 409303 - RNA, 16 nt, Bordetella pertussis
cgccaccaugccuugc

SEQ ID NO: 409304 - RNA, 24 nt, Bordetella pertussis
cgccaccaugccuugcgcgacagc

SEQ ID NO: 409305 - RNA, 14 nt, Bordetella pertussis
cgccacccaggcgg

SEQ ID NO: 409306 - RNA, 18 nt, Bordetella pertussis
cgccaccuggcgcccggc

SEQ ID NO: 409307 - RNA, 16 nt, Bordetella pertussis
cgccaccugggccgcc

SEQ ID NO: 409308 - RNA, 22 nt, Bordetella pertussis
cgccacgacguagucggcgccc

SEQ ID NO: 409309 - RNA, 23 nt, Bordetella pertussis
cgccacgccagcggcgagcaauc

SEQ ID NO: 409310 - RNA, 15 nt, Bordetella pertussis
cgccacgcccguccc

SEQ ID NO: 409311 - RNA, 16 nt, Bordetella pertussis
cgccacgggcccgcgc

SEQ ID NO: 409312 - RNA, 18 nt, Bordetella pertussis
cgccacgggcccgcgcag

SEQ ID NO: 409313 - RNA, 12 nt, Bordetella pertussis
cgccacgggcgu

SEQ ID NO: 409314 - RNA, 23 nt, Bordetella pertussis
cgccacgucacggaucagccgcu

SEQ ID NO: 409315 - RNA, 23 nt, Bordetella pertussis
cgccacgucgaccucgagcaccu

SEQ ID NO: 409316 - RNA, 13 nt, Bordetella pertussis
cgccacuggccuu

SEQ ID NO: 409317 - RNA, 18 nt, Bordetella pertussis
cgccacuucgccucggcg

SEQ ID NO: 409318 - RNA, 16 nt, Bordetella pertussis
cgccacuugcaggccg

SEQ ID NO: 409319 - RNA, 16 nt, Bordetella pertussis
cgccagaaagcgcggc

SEQ ID NO: 409320 - RNA, 15 nt, Bordetella pertussis
cgccagaugcgccgc

SEQ ID NO: 409321 - RNA, 14 nt, Bordetella pertussis
cgccagcaaggcgg

SEQ ID NO: 409322 - RNA, 15 nt, Bordetella pertussis
cgccagcaaggcggc

SEQ ID NO: 409323 - RNA, 16 nt, Bordetella pertussis
cgccagcacagugucu

SEQ ID NO: 409324 - RNA, 14 nt, Bordetella pertussis
cgccagcaccugcu

SEQ ID NO: 409325 - RNA, 22 nt, Bordetella pertussis
cgccagcacgcgcagcuugccc

SEQ ID NO: 409326 - RNA, 19 nt, Bordetella pertussis
cgccagcacgguggcgccc

SEQ ID NO: 409327 - RNA, 14 nt, Bordetella pertussis
cgccagcagcgccg

SEQ ID NO: 409328 - RNA, 14 nt, Bordetella pertussis
cgccagcaggcccu

SEQ ID NO: 409329 - RNA, 17 nt, Bordetella pertussis
cgccagcauccagccga

SEQ ID NO: 409330 - RNA, 11 nt, Bordetella pertussis
cgccagcaugc

SEQ ID NO: 409331 - RNA, 17 nt, Bordetella pertussis
cgccagcauggcggcca

SEQ ID NO: 409332 - RNA, 16 nt, Bordetella pertussis
cgccagccaccccguc

SEQ ID NO: 409333 - RNA, 15 nt, Bordetella pertussis
cgccagcccgcccgc

SEQ ID NO: 409334 - RNA, 15 nt, Bordetella pertussis
cgccagcccgccgcu

SEQ ID NO: 409335 - RNA, 14 nt, Bordetella pertussis
cgccagcccgccgg

SEQ ID NO: 409336 - RNA, 21 nt, Bordetella pertussis
cgccagcccgacggccagcgc

SEQ ID NO: 409337 - RNA, 17 nt, Bordetella pertussis
cgccagccgcgcgaccu

SEQ ID NO: 409338 - RNA, 14 nt, Bordetella pertussis
cgccagccgcucca

SEQ ID NO: 409339 - RNA, 15 nt, Bordetella pertussis
cgccagccgcugcag

SEQ ID NO: 409340 - RNA, 23 nt, Bordetella pertussis
cgccagccgcuggcgcgccgccu

SEQ ID NO: 409341 - RNA, 16 nt, Bordetella pertussis
cgccagccgcuugccc

SEQ ID NO: 409342 - RNA, 19 nt, Bordetella pertussis
cgccagccgcuugcccguc

SEQ ID NO: 409343 - RNA, 13 nt, Bordetella pertussis
cgccagccggccc

SEQ ID NO: 409344 - RNA, 15 nt, Bordetella pertussis
cgccagccggcccga

SEQ ID NO: 409345 - RNA, 17 nt, Bordetella pertussis
cgccagcgccacgcccu

SEQ ID NO: 409346 - RNA, 13 nt, Bordetella pertussis
cgccagcgccgcg

SEQ ID NO: 409347 - RNA, 15 nt, Bordetella pertussis
cgccagcgccgcguc

SEQ ID NO: 409348 - RNA, 20 nt, Bordetella pertussis
cgccagcgccggcgcgucca

SEQ ID NO: 409349 - RNA, 13 nt, Bordetella pertussis
cgccagcgccucg

SEQ ID NO: 409350 - RNA, 22 nt, Bordetella pertussis
cgccagcgcgaaaacccgcggc

SEQ ID NO: 409351 - RNA, 21 nt, Bordetella pertussis
cgccagcgcgccgcccaccac

SEQ ID NO: 409352 - RNA, 14 nt, Bordetella pertussis
cgccagcgcggcca

SEQ ID NO: 409353 - RNA, 14 nt, Bordetella pertussis
cgccagcgcggcgg

SEQ ID NO: 409354 - RNA, 13 nt, Bordetella pertussis
cgccagcgcggcu

SEQ ID NO: 409355 - RNA, 19 nt, Bordetella pertussis
cgccagcgcuucgggcagc

SEQ ID NO: 409356 - RNA, 20 nt, Bordetella pertussis
cgccagcgcuucgggcagcu

SEQ ID NO: 409357 - RNA, 13 nt, Bordetella pertussis
cgccagcggcagc

SEQ ID NO: 409358 - RNA, 18 nt, Bordetella pertussis
cgccagcggcagcgcgca

SEQ ID NO: 409359 - RNA, 19 nt, Bordetella pertussis
cgccagcggcgacugcccc

SEQ ID NO: 409360 - RNA, 22 nt, Bordetella pertussis
cgccagcggcgacugccccagc

SEQ ID NO: 409361 - RNA, 13 nt, Bordetella pertussis
cgccagcgggagc

SEQ ID NO: 409362 - RNA, 23 nt, Bordetella pertussis
cgccagcguaucgccgccgccgg

SEQ ID NO: 409363 - RNA, 18 nt, Bordetella pertussis
cgccagcguucggccacc

SEQ ID NO: 409364 - RNA, 19 nt, Bordetella pertussis
cgccagcguucggccaccc

SEQ ID NO: 409365 - RNA, 18 nt, Bordetella pertussis
cgccagcucggccaaggc

SEQ ID NO: 409366 - RNA, 14 nt, Bordetella pertussis
cgccagcugcgcag

SEQ ID NO: 409367 - RNA, 20 nt, Bordetella pertussis
cgccagcugaccucgcccag

SEQ ID NO: 409368 - RNA, 16 nt, Bordetella pertussis
cgccagcuggaccgcc

SEQ ID NO: 409369 - RNA, 17 nt, Bordetella pertussis
cgccagcuggaccgccu

SEQ ID NO: 409370 - RNA, 12 nt, Bordetella pertussis
cgccagcugggc

SEQ ID NO: 409371 - RNA, 20 nt, Bordetella pertussis
cgccagcuugcgcgccuugg

SEQ ID NO: 409372 - RNA, 22 nt, Bordetella pertussis
cgccaggcauucucggacaggu

SEQ ID NO: 409373 - RNA, 16 nt, Bordetella pertussis
cgccaggcccagggcc

SEQ ID NO: 409374 - RNA, 13 nt, Bordetella pertussis
cgccaggccccgc

SEQ ID NO: 409375 - RNA, 17 nt, Bordetella pertussis
cgccaggccccgccggg

SEQ ID NO: 409376 - RNA, 16 nt, Bordetella pertussis
cgccaggcgccgggcc

SEQ ID NO: 409377 - RNA, 19 nt, Bordetella pertussis
cgccaggcgccgggccgcu

SEQ ID NO: 409378 - RNA, 21 nt, Bordetella pertussis
cgccaggcgccgggccgcuag

SEQ ID NO: 409379 - RNA, 17 nt, Bordetella pertussis
cgccaggcgcucggcgu

SEQ ID NO: 409380 - RNA, 21 nt, Bordetella pertussis
cgccaggcgguacaggccggc

SEQ ID NO: 409381 - RNA, 19 nt, Bordetella pertussis
cgccaggcguagaccaccu

SEQ ID NO: 409382 - RNA, 22 nt, Bordetella pertussis
cgccaggcguagaccaccugcu

SEQ ID NO: 409383 - RNA, 15 nt, Bordetella pertussis
cgccaggcguugacc

SEQ ID NO: 409384 - RNA, 22 nt, Bordetella pertussis
cgccaggcugucgucgucggca

SEQ ID NO: 409385 - RNA, 19 nt, Bordetella pertussis
cgccagggccaggccgccg

SEQ ID NO: 409386 - RNA, 21 nt, Bordetella pertussis
cgccagggccauguggcgcag

SEQ ID NO: 409387 - RNA, 20 nt, Bordetella pertussis
cgccagggccgccgcgccca

SEQ ID NO: 409388 - RNA, 12 nt, Bordetella pertussis
cgccagggcggc

SEQ ID NO: 409389 - RNA, 22 nt, Bordetella pertussis
cgccagggcguuuuccagcauc

SEQ ID NO: 409390 - RNA, 20 nt, Bordetella pertussis
cgccagguaggccggcgcga

SEQ ID NO: 409391 - RNA, 17 nt, Bordetella pertussis
cgccaggucgcgcacca

SEQ ID NO: 409392 - RNA, 18 nt, Bordetella pertussis
cgccaggucggccaccgc

SEQ ID NO: 409393 - RNA, 21 nt, Bordetella pertussis
cgccaggucggccagccggcc

SEQ ID NO: 409394 - RNA, 23 nt, Bordetella pertussis
cgccaguccccaugcggggacug

SEQ ID NO: 409395 - RNA, 18 nt, Bordetella pertussis
cgccaguugcgcaccgcu

SEQ ID NO: 409396 - RNA, 13 nt, Bordetella pertussis
cgccaguugcggg

SEQ ID NO: 409397 - RNA, 13 nt, Bordetella pertussis
cgccauacugcca

SEQ ID NO: 409398 - RNA, 21 nt, Bordetella pertussis
cgccauauugaugcagcacgu

SEQ ID NO: 409399 - RNA, 24 nt, Bordetella pertussis
cgccauauugaugcagcacgucgg

SEQ ID NO: 409400 - RNA, 13 nt, Bordetella pertussis
cgccaucauccug

SEQ ID NO: 409401 - RNA, 18 nt, Bordetella pertussis
cgccaucauggcgucggc

SEQ ID NO: 409402 - RNA, 15 nt, Bordetella pertussis
cgccauccagguacg

SEQ ID NO: 409403 - RNA, 15 nt, Bordetella pertussis
cgccauccggcgcau

SEQ ID NO: 409404 - RNA, 20 nt, Bordetella pertussis
cgccauccugaacgccgcgc

SEQ ID NO: 409405 - RNA, 19 nt, Bordetella pertussis
cgcccacgccgccuggccc

SEQ ID NO: 409406 - RNA, 14 nt, Bordetella pertussis
cgcccacgcgccgc

SEQ ID NO: 409407 - RNA, 18 nt, Bordetella pertussis
cgcccacgcggcgcugcu

SEQ ID NO: 409408 - RNA, 17 nt, Bordetella pertussis
cgcccacggcaaaagcc

SEQ ID NO: 409409 - RNA, 14 nt, Bordetella pertussis
cgcccacggccgca

SEQ ID NO: 409410 - RNA, 12 nt, Bordetella pertussis
cgcccagcaccu

SEQ ID NO: 409411 - RNA, 20 nt, Bordetella pertussis
cgcccagcaccuuggcauug

SEQ ID NO: 409412 - RNA, 14 nt, Bordetella pertussis
cgcccagcgccggc

SEQ ID NO: 409413 - RNA, 14 nt, Bordetella pertussis
cgcccagcgccugc

SEQ ID NO: 409414 - RNA, 15 nt, Bordetella pertussis
cgcccagcggcgccg

SEQ ID NO: 409415 - RNA, 16 nt, Bordetella pertussis
cgcccagcggcgccga

SEQ ID NO: 409416 - RNA, 15 nt, Bordetella pertussis
cgcccagcgcggccu

SEQ ID NO: 409417 - RNA, 14 nt, Bordetella pertussis
cgcccagcugcuuc

SEQ ID NO: 409418 - RNA, 21 nt, Bordetella pertussis
cgcccagcuugaugccgccga

SEQ ID NO: 409419 - RNA, 23 nt, Bordetella pertussis
cgcccagcuugaugccgccgaac

SEQ ID NO: 409420 - RNA, 23 nt, Bordetella pertussis
cgcccaggagcaacuggggcgcu

SEQ ID NO: 409421 - RNA, 16 nt, Bordetella pertussis
cgcccaggccgggcga

SEQ ID NO: 409422 - RNA, 15 nt, Bordetella pertussis
cgcccaggccguggc

SEQ ID NO: 409423 - RNA, 14 nt, Bordetella pertussis
cgcccaugccgccg

SEQ ID NO: 409424 - RNA, 15 nt, Bordetella pertussis
cgcccaugcgggcgu

SEQ ID NO: 409425 - RNA, 21 nt, Bordetella pertussis
cgccccaggcgucggcggccc

SEQ ID NO: 409426 - RNA, 14 nt, Bordetella pertussis
cgcccccagcgccg

SEQ ID NO: 409427 - RNA, 23 nt, Bordetella pertussis
cgcccccagcacgguugccacgg

SEQ ID NO: 409428 - RNA, 20 nt, Bordetella pertussis
cgcccccgaaggccgcgccu

SEQ ID NO: 409429 - RNA, 21 nt, Bordetella pertussis
cgcccccgaaggccgcgccua

SEQ ID NO: 409430 - RNA, 20 nt, Bordetella pertussis
cgcccccgauccccugcccg

SEQ ID NO: 409431 - RNA, 14 nt, Bordetella pertussis
cgcccccgcggcgc

SEQ ID NO: 409432 - RNA, 18 nt, Bordetella pertussis
cgcccccgcggcgccccg

SEQ ID NO: 409433 - RNA, 13 nt, Bordetella pertussis
cgccccggcgcau

SEQ ID NO: 409434 - RNA, 15 nt, Bordetella pertussis
cgccccggcgcgcag

SEQ ID NO: 409435 - RNA, 18 nt, Bordetella pertussis
cgccccuuccacccgcau

SEQ ID NO: 409436 - RNA, 15 nt, Bordetella pertussis
cgcccgccugcgcca

SEQ ID NO: 409437 - RNA, 20 nt, Bordetella pertussis
cgcccgccugcgccagccgc

SEQ ID NO: 409438 - RNA, 20 nt, Bordetella pertussis
cgcccgccuucagcgggccg

SEQ ID NO: 409439 - RNA, 14 nt, Bordetella pertussis
cgcccgcgcccagc

SEQ ID NO: 409440 - RNA, 12 nt, Bordetella pertussis
cgcccgcggccu

SEQ ID NO: 409441 - RNA, 19 nt, Bordetella pertussis
cgcccgcggccugcagacc

SEQ ID NO: 409442 - RNA, 13 nt, Bordetella pertussis
cgcccgcuccacc

SEQ ID NO: 409443 - RNA, 17 nt, Bordetella pertussis
cgcccggccaccgcguu

SEQ ID NO: 409444 - RNA, 14 nt, Bordetella pertussis
cgcccggcccaggc

SEQ ID NO: 409445 - RNA, 21 nt, Bordetella pertussis
cgcccggccgccucaccgcgc

SEQ ID NO: 409446 - RNA, 14 nt, Bordetella pertussis
cgcccggccggcac

SEQ ID NO: 409447 - RNA, 18 nt, Bordetella pertussis
cgcccggccggcccgcgc

SEQ ID NO: 409448 - RNA, 15 nt, Bordetella pertussis
cgcccggccugcggg

SEQ ID NO: 409449 - RNA, 16 nt, Bordetella pertussis
cgcccggcgcgccuuc

SEQ ID NO: 409450 - RNA, 18 nt, Bordetella pertussis
cgcccggcggcgcgccgc

SEQ ID NO: 409451 - RNA, 21 nt, Bordetella pertussis
cgcccggcgcggugaggcggc

SEQ ID NO: 409452 - RNA, 15 nt, Bordetella pertussis
cgcccgucccgaccc

SEQ ID NO: 409453 - RNA, 16 nt, Bordetella pertussis
cgcccgucucgcgcgc

SEQ ID NO: 409454 - RNA, 16 nt, Bordetella pertussis
cgcccgugcgcggcga

SEQ ID NO: 409455 - RNA, 23 nt, Bordetella pertussis
cgcccgugcgcggcgagccgcgc

SEQ ID NO: 409456 - RNA, 15 nt, Bordetella pertussis
cgcccguugcggcgc

SEQ ID NO: 409457 - RNA, 12 nt, Bordetella pertussis
cgcccugcaggg

SEQ ID NO: 409458 - RNA, 21 nt, Bordetella pertussis
cgcccugccaauagcgguggc

SEQ ID NO: 409459 - RNA, 22 nt, Bordetella pertussis
cgcccugcgaacccgccgcgau

SEQ ID NO: 409460 - RNA, 14 nt, Bordetella pertussis
cgcccuugaugccg

SEQ ID NO: 409461 - RNA, 17 nt, Bordetella pertussis
cgcccuugauggccucg

SEQ ID NO: 409462 - RNA, 20 nt, Bordetella pertussis
cgcccuugccagggccuggc

SEQ ID NO: 409463 - RNA, 22 nt, Bordetella pertussis
cgcccuugagcacggcgcggcu

SEQ ID NO: 409464 - RNA, 17 nt, Bordetella pertussis
cgccgaacggcagcagc

SEQ ID NO: 409465 - RNA, 20 nt, Bordetella pertussis
cgccgaacggggccgccucg

SEQ ID NO: 409466 - RNA, 22 nt, Bordetella pertussis
cgccgaacggggccgccucggc

SEQ ID NO: 409467 - RNA, 14 nt, Bordetella pertussis
cgccgaccaccugc

SEQ ID NO: 409468 - RNA, 15 nt, Bordetella pertussis
cgccgaccagcucga

SEQ ID NO: 409469 - RNA, 20 nt, Bordetella pertussis
cgccgacccgagcccuggcu

SEQ ID NO: 409470 - RNA, 16 nt, Bordetella pertussis
cgccgacccgggcggg

SEQ ID NO: 409471 - RNA, 22 nt, Bordetella pertussis
cgccgacgcuucguucagcuuc

SEQ ID NO: 409472 - RNA, 13 nt, Bordetella pertussis
cgccgacggcaug

SEQ ID NO: 409473 - RNA, 15 nt, Bordetella pertussis
cgccgacggcgcccu

SEQ ID NO: 409474 - RNA, 16 nt, Bordetella pertussis
cgccgacggcggcgcg

SEQ ID NO: 409475 - RNA, 20 nt, Bordetella pertussis
cgccgacguagucgcgccag

SEQ ID NO: 409476 - RNA, 17 nt, Bordetella pertussis
cgccgaucaccacgggc

SEQ ID NO: 409477 - RNA, 16 nt, Bordetella pertussis
cgccgaucagcagguc

SEQ ID NO: 409478 - RNA, 19 nt, Bordetella pertussis
cgccgauccagcccaccgc

SEQ ID NO: 409479 - RNA, 21 nt, Bordetella pertussis
cgccgauccagggccgcagca

SEQ ID NO: 409480 - RNA, 17 nt, Bordetella pertussis
cgccgaucgcgcacagc

SEQ ID NO: 409481 - RNA, 14 nt, Bordetella pertussis
cgccgaucgcggcu

SEQ ID NO: 409482 - RNA, 17 nt, Bordetella pertussis
cgccgaucgcggcucca

SEQ ID NO: 409483 - RNA, 23 nt, Bordetella pertussis
cgccgaugaccagggcgccgacc

SEQ ID NO: 409484 - RNA, 16 nt, Bordetella pertussis
cgccgauggcgcggcc

SEQ ID NO: 409485 - RNA, 20 nt, Bordetella pertussis
cgccgauggcgcggccgcca

SEQ ID NO: 409486 - RNA, 18 nt, Bordetella pertussis
cgccgauuucgccgccgc

SEQ ID NO: 409487 - RNA, 14 nt, Bordetella pertussis
cgccgcaacgccgc

SEQ ID NO: 409488 - RNA, 19 nt, Bordetella pertussis
cgccgcaacgccgggccgc

SEQ ID NO: 409489 - RNA, 14 nt, Bordetella pertussis
cgccgcaccaggcc

SEQ ID NO: 409490 - RNA, 22 nt, Bordetella pertussis
cgccgccacgcgcacggccagc

SEQ ID NO: 409491 - RNA, 21 nt, Bordetella pertussis
cgccgccacgcuggccgcgcu

SEQ ID NO: 409492 - RNA, 12 nt, Bordetella pertussis
cgccgccagcac

SEQ ID NO: 409493 - RNA, 13 nt, Bordetella pertussis
cgccgccagcagc

SEQ ID NO: 409494 - RNA, 12 nt, Bordetella pertussis
cgccgccagcgc

SEQ ID NO: 409495 - RNA, 17 nt, Bordetella pertussis
cgccgccagcgcgcgcg

SEQ ID NO: 409496 - RNA, 14 nt, Bordetella pertussis
cgccgccagcuugg

SEQ ID NO: 409497 - RNA, 19 nt, Bordetella pertussis
cgccgcccggcaacccgcc

SEQ ID NO: 409498 - RNA, 23 nt, Bordetella pertussis
cgccgcccggcaacccgcccacg

SEQ ID NO: 409499 - RNA, 12 nt, Bordetella pertussis
cgccgcccugcu

SEQ ID NO: 409500 - RNA, 13 nt, Bordetella pertussis
cgccgcccugcug

SEQ ID NO: 409501 - RNA, 18 nt, Bordetella pertussis
cgccgcccugcugcccgc

SEQ ID NO: 409502 - RNA, 11 nt, Bordetella pertussis
cgccgccgaac

SEQ ID NO: 409503 - RNA, 20 nt, Bordetella pertussis
cgccgccgaagccgccgccg

SEQ ID NO: 409504 - RNA, 20 nt, Bordetella pertussis
cgccgccgauggcgcgcggc

SEQ ID NO: 409505 - RNA, 17 nt, Bordetella pertussis
cgccgccgcccgcccgc

SEQ ID NO: 409506 - RNA, 14 nt, Bordetella pertussis
cgccgccgcccggc

SEQ ID NO: 409507 - RNA, 15 nt, Bordetella pertussis
cgccgccgccggcaa

SEQ ID NO: 409508 - RNA, 13 nt, Bordetella pertussis
cgccgccgccggg

SEQ ID NO: 409509 - RNA, 16 nt, Bordetella pertussis
cgccgccgccggucga

SEQ ID NO: 409510 - RNA, 15 nt, Bordetella pertussis
cgccgccgccgcggc

SEQ ID NO: 409511 - RNA, 13 nt, Bordetella pertussis
cgccgccgcgcac

SEQ ID NO: 409512 - RNA, 15 nt, Bordetella pertussis
cgccgccgcgcacca

SEQ ID NO: 409513 - RNA, 13 nt, Bordetella pertussis
cgccgccgcgccg

SEQ ID NO: 409514 - RNA, 14 nt, Bordetella pertussis
cgccgccgcgccga

SEQ ID NO: 409515 - RNA, 15 nt, Bordetella pertussis
cgccgccgcgccgcu

SEQ ID NO: 409516 - RNA, 13 nt, Bordetella pertussis
cgccgccgcgcgc

SEQ ID NO: 409517 - RNA, 14 nt, Bordetella pertussis
cgccgccgcgcgcg

SEQ ID NO: 409518 - RNA, 16 nt, Bordetella pertussis
cgccgccgcgcgcggc

SEQ ID NO: 409519 - RNA, 14 nt, Bordetella pertussis
cgccgccgcgcgcu

SEQ ID NO: 409520 - RNA, 16 nt, Bordetella pertussis
cgccgccgcgcgcugg

SEQ ID NO: 409521 - RNA, 14 nt, Bordetella pertussis
cgccgccgcggccu

SEQ ID NO: 409522 - RNA, 15 nt, Bordetella pertussis
cgccgccgcggccug

SEQ ID NO: 409523 - RNA, 18 nt, Bordetella pertussis
cgccgccgcucguccccc

SEQ ID NO: 409524 - RNA, 13 nt, Bordetella pertussis
cgccggggcggcu

SEQ ID NO: 409525 - RNA, 21 nt, Bordetella pertussis
cgccggggucagcgccggcac

SEQ ID NO: 409526 - RNA, 20 nt, Bordetella pertussis
cgccggggggcgcacgccgc

SEQ ID NO: 409527 - RNA, 16 nt, Bordetella pertussis
cgccggguccggccgc

SEQ ID NO: 409528 - RNA, 14 nt, Bordetella pertussis
cgccgggucgccgg

SEQ ID NO: 409529 - RNA, 20 nt, Bordetella pertussis
cgccggguggguucgggcgu

SEQ ID NO: 409530 - RNA, 19 nt, Bordetella pertussis
cgccggguguuccggcgcg

SEQ ID NO: 409531 - RNA, 23 nt, Bordetella pertussis
cgccggguuuuuacaugccgcgc

SEQ ID NO: 409532 - RNA, 16 nt, Bordetella pertussis
cgccgguagcgcuggg

SEQ ID NO: 409533 - RNA, 17 nt, Bordetella pertussis
cgccggugcgcggcgcc

SEQ ID NO: 409534 - RNA, 18 nt, Bordetella pertussis
cgccggugcgcggcgccc

SEQ ID NO: 409535 - RNA, 13 nt, Bordetella pertussis
cgccggugggcag

SEQ ID NO: 409536 - RNA, 15 nt, Bordetella pertussis
cgccggugucggccc

SEQ ID NO: 409537 - RNA, 15 nt, Bordetella pertussis
cgccggugucggggc

SEQ ID NO: 409538 - RNA, 22 nt, Bordetella pertussis
cgccgguucggucgacgacggc

SEQ ID NO: 409539 - RNA, 23 nt, Bordetella pertussis
cgccgguucggucgacgacggca

SEQ ID NO: 409540 - RNA, 19 nt, Bordetella pertussis
cgccgugaaugcgccuggc

SEQ ID NO: 409541 - RNA, 15 nt, Bordetella pertussis
cgccguccucaggcc

SEQ ID NO: 409542 - RNA, 18 nt, Bordetella pertussis
cgccgugaugccgcccgc

SEQ ID NO: 409543 - RNA, 23 nt, Bordetella pertussis
cgccgugaugccgcccgcaugca

SEQ ID NO: 409544 - RNA, 16 nt, Bordetella pertussis
cgccgugcccggcggg

SEQ ID NO: 409545 - RNA, 15 nt, Bordetella pertussis
cgccgugccgggccu

SEQ ID NO: 409546 - RNA, 13 nt, Bordetella pertussis
cgccgugcuggag

SEQ ID NO: 409547 - RNA, 15 nt, Bordetella pertussis
cgccguggccaaggg

SEQ ID NO: 409548 - RNA, 22 nt, Bordetella pertussis
cgccguggccaagggcgccgcg

SEQ ID NO: 409549 - RNA, 20 nt, Bordetella pertussis
cgccguggcguugacggccc

SEQ ID NO: 409550 - RNA, 23 nt, Bordetella pertussis
cgccguggugcugaccggcuucc

SEQ ID NO: 409551 - RNA, 19 nt, Bordetella pertussis
cgccguucgucgcgcagca

SEQ ID NO: 409552 - RNA, 14 nt, Bordetella pertussis
cgccguugcggccc

SEQ ID NO: 409553 - RNA, 16 nt, Bordetella pertussis
cgccguugcucgcgcg

SEQ ID NO: 409554 - RNA, 18 nt, Bordetella pertussis
cgccguugcucgcgcgca

SEQ ID NO: 409555 - RNA, 19 nt, Bordetella pertussis
cgccguuuccaccaucagc

SEQ ID NO: 409556 - RNA, 24 nt, Bordetella pertussis
cgccguuuuuuucguugcauugca

SEQ ID NO: 409557 - RNA, 21 nt, Bordetella pertussis
cgccguuuucagcgcaggcug

SEQ ID NO: 409558 - RNA, 21 nt, Bordetella pertussis
cgccuacggcggcggccaucg

SEQ ID NO: 409559 - RNA, 13 nt, Bordetella pertussis
cgccuagguguga

SEQ ID NO: 409560 - RNA, 19 nt, Bordetella pertussis
cgccuauguaggcgccgcg

SEQ ID NO: 409561 - RNA, 21 nt, Bordetella pertussis
cgccuauugcgacgccgccga

SEQ ID NO: 409562 - RNA, 18 nt, Bordetella pertussis
cgccucaccgcgccgggc

SEQ ID NO: 409563 - RNA, 14 nt, Bordetella pertussis
cgccucagcccgcg

SEQ ID NO: 409564 - RNA, 19 nt, Bordetella pertussis
cgccucagcguuuccaggg

SEQ ID NO: 409565 - RNA, 22 nt, Bordetella pertussis
cgccucccauugcgcggccagg

SEQ ID NO: 409566 - RNA, 17 nt, Bordetella pertussis
cgccuccccaggccagc

SEQ ID NO: 409567 - RNA, 20 nt, Bordetella pertussis
cgccucgaacguccgcccca

SEQ ID NO: 409568 - RNA, 17 nt, Bordetella pertussis
cgccucgacgcccgggc

SEQ ID NO: 409569 - RNA, 21 nt, Bordetella pertussis
cgccucgaugcccucgcgcac

SEQ ID NO: 409570 - RNA, 21 nt, Bordetella pertussis
cgccucgauugaccagcacca

SEQ ID NO: 409571 - RNA, 16 nt, Bordetella pertussis
cgccucgcgacggccu

SEQ ID NO: 409572 - RNA, 16 nt, Bordetella pertussis
cgccucgcgcuccagc

SEQ ID NO: 409573 - RNA, 24 nt, Bordetella pertussis
cgccucggacgccuggcgcggccc

SEQ ID NO: 409574 - RNA, 14 nt, Bordetella pertussis
cgccucggcggcca

SEQ ID NO: 409575 - RNA, 16 nt, Bordetella pertussis
cgccucggcggccagc

SEQ ID NO: 409576 - RNA, 22 nt, Bordetella pertussis
cgccucggcggccagcgcgccc

SEQ ID NO: 409577 - RNA, 21 nt, Bordetella pertussis
cgccucggcgguugcccgccc

SEQ ID NO: 409578 - RNA, 16 nt, Bordetella pertussis
cgccucgguccagcgg

SEQ ID NO: 409579 - RNA, 21 nt, Bordetella pertussis
cgccucggucugcuucaucca

SEQ ID NO: 409580 - RNA, 15 nt, Bordetella pertussis
cgccucgucgcgcaa

SEQ ID NO: 409581 - RNA, 22 nt, Bordetella pertussis
cgccugagcacaugcccggcca

SEQ ID NO: 409582 - RNA, 12 nt, Bordetella pertussis
cgccugagcugc

SEQ ID NO: 409583 - RNA, 15 nt, Bordetella pertussis
cgccugcaccgccgc

SEQ ID NO: 409584 - RNA, 14 nt, Bordetella pertussis
cgccugcagcagcg

SEQ ID NO: 409585 - RNA, 18 nt, Bordetella pertussis
cgccugcagcagcggcag

SEQ ID NO: 409586 - RNA, 14 nt, Bordetella pertussis
cgccugcagcgccg

SEQ ID NO: 409587 - RNA, 22 nt, Bordetella pertussis
cgccugcauccggcccagcgcc

SEQ ID NO: 409588 - RNA, 17 nt, Bordetella pertussis
cgccugcacgaccugcg

SEQ ID NO: 409589 - RNA, 16 nt, Bordetella pertussis
cgccugccccggcaga

SEQ ID NO: 409590 - RNA, 22 nt, Bordetella pertussis
cgccugccgcgcccggcggcca

SEQ ID NO: 409591 - RNA, 17 nt, Bordetella pertussis
cgccugcgccagccgcg

SEQ ID NO: 409592 - RNA, 14 nt, Bordetella pertussis
cgccugcgccaggu

SEQ ID NO: 409593 - RNA, 23 nt, Bordetella pertussis
cgccugcgccaggugggccaggu

SEQ ID NO: 409594 - RNA, 21 nt, Bordetella pertussis
cgccugcgccauggcgcgcag

SEQ ID NO: 409595 - RNA, 16 nt, Bordetella pertussis
cgccuggaccggcucc

SEQ ID NO: 409596 - RNA, 13 nt, Bordetella pertussis
cgccuggaccugg

SEQ ID NO: 409597 - RNA, 14 nt, Bordetella pertussis
cgccuggccgccca

SEQ ID NO: 409598 - RNA, 15 nt, Bordetella pertussis
cgccuggccgcgcug

SEQ ID NO: 409599 - RNA, 15 nt, Bordetella pertussis
cgccuggcgcggccc

SEQ ID NO: 409600 - RNA, 20 nt, Bordetella pertussis
cgccuggcgggccugggcgu

SEQ ID NO: 409601 - RNA, 14 nt, Bordetella pertussis
cgccuggcugcaag

SEQ ID NO: 409602 - RNA, 20 nt, Bordetella pertussis
cgccuggcuuucgccgcggg

SEQ ID NO: 409603 - RNA, 23 nt, Bordetella pertussis
cgccuggggcgggcgcugcgcga

SEQ ID NO: 409604 - RNA, 17 nt, Bordetella pertussis
cgccugggggcuggagg

SEQ ID NO: 409605 - RNA, 18 nt, Bordetella pertussis
cgccugggggcuggaggc

SEQ ID NO: 409606 - RNA, 23 nt, Bordetella pertussis
cgccugguaguaaucgcgcgcca

SEQ ID NO: 409607 - RNA, 18 nt, Bordetella pertussis
cgccuggucgacgccggc

SEQ ID NO: 409608 - RNA, 16 nt, Bordetella pertussis
cgccuucaccggcccc

SEQ ID NO: 409609 - RNA, 14 nt, Bordetella pertussis
cgccuucccaggcg

SEQ ID NO: 409610 - RNA, 14 nt, Bordetella pertussis
cgccuuccgggcga

SEQ ID NO: 409611 - RNA, 21 nt, Bordetella pertussis
cgccuuccuugaacugcgcgg

SEQ ID NO: 409612 - RNA, 15 nt, Bordetella pertussis
cgccuucgagcacca

SEQ ID NO: 409613 - RNA, 22 nt, Bordetella pertussis
cgccuucgagcaccaugccggg

SEQ ID NO: 409614 - RNA, 16 nt, Bordetella pertussis
cgccuucgagcugcac

SEQ ID NO: 409615 - RNA, 19 nt, Bordetella pertussis
cgcgaaauccagcgcgccc

SEQ ID NO: 409616 - RNA, 16 nt, Bordetella pertussis
cgcgaaaugcccagcg

SEQ ID NO: 409617 - RNA, 19 nt, Bordetella pertussis
cgcgaaaugcccagcgagc

SEQ ID NO: 409618 - RNA, 22 nt, Bordetella pertussis
cgcgaaaugcccagcgagcugg

SEQ ID NO: 409619 - RNA, 16 nt, Bordetella pertussis
cgcgaaccccuccggc

SEQ ID NO: 409620 - RNA, 17 nt, Bordetella pertussis
cgcgaaccccuccggcg

SEQ ID NO: 409621 - RNA, 20 nt, Bordetella pertussis
cgcgaacgcgccggcccagg

SEQ ID NO: 409622 - RNA, 15 nt, Bordetella pertussis
cgcgaacgcgcgccg

SEQ ID NO: 409623 - RNA, 21 nt, Bordetella pertussis
cgcgaacgcgcgccggccagc

SEQ ID NO: 409624 - RNA, 18 nt, Bordetella pertussis
cgcgacagcaccaacugg

SEQ ID NO: 409625 - RNA, 22 nt, Bordetella pertussis
cgcgacaggcggugcgcgcggc

SEQ ID NO: 409626 - RNA, 16 nt, Bordetella pertussis
cgcgacgcccuggccu

SEQ ID NO: 409627 - RNA, 14 nt, Bordetella pertussis
cgcgacgggcaccg

SEQ ID NO: 409628 - RNA, 20 nt, Bordetella pertussis
cgcgagcgaugcccuggaug

SEQ ID NO: 409629 - RNA, 16 nt, Bordetella pertussis
cgcgagcggccagccu

SEQ ID NO: 409630 - RNA, 14 nt, Bordetella pertussis
cgcgagcggcggcc

SEQ ID NO: 409631 - RNA, 22 nt, Bordetella pertussis
cgcgaggcgcaggccgacgcgc

SEQ ID NO: 409632 - RNA, 15 nt, Bordetella pertussis
cgcgaggcggcggcc

SEQ ID NO: 409633 - RNA, 22 nt, Bordetella pertussis
cgcgaggcggcggccggggccg

SEQ ID NO: 409634 - RNA, 21 nt, Bordetella pertussis
cgcgagguggcgcucgcgccc

SEQ ID NO: 409635 - RNA, 16 nt, Bordetella pertussis
cgcgaggugggcggca

SEQ ID NO: 409636 - RNA, 21 nt, Bordetella pertussis
cgcgaguaucccuaccgccuu

SEQ ID NO: 409637 - RNA, 23 nt, Bordetella pertussis
cgcgcaagagcgugugucccggc

SEQ ID NO: 409638 - RNA, 17 nt, Bordetella pertussis
cgcgcaagccgccgccc

SEQ ID NO: 409639 - RNA, 15 nt, Bordetella pertussis
cgcgcaagccgcugg

SEQ ID NO: 409640 - RNA, 15 nt, Bordetella pertussis
cgcgcaacucggcca

SEQ ID NO: 409641 - RNA, 18 nt, Bordetella pertussis
cgcgcaacucggccaccu

SEQ ID NO: 409642 - RNA, 14 nt, Bordetella pertussis
cgcgcaaggccugc

SEQ ID NO: 409643 - RNA, 19 nt, Bordetella pertussis
cgcgcaaggcggcccggcc

SEQ ID NO: 409644 - RNA, 14 nt, Bordetella pertussis
cgcgcacagcccga

SEQ ID NO: 409645 - RNA, 22 nt, Bordetella pertussis
cgcgcacaggucgccgaagggc

SEQ ID NO: 409646 - RNA, 15 nt, Bordetella pertussis
cgcgcacauccagcc

SEQ ID NO: 409647 - RNA, 17 nt, Bordetella pertussis
cgcgcacauccagccga

SEQ ID NO: 409648 - RNA, 14 nt, Bordetella pertussis
cgcgcaccaccugg

SEQ ID NO: 409649 - RNA, 14 nt, Bordetella pertussis
cgcgcaccagcccg

SEQ ID NO: 409650 - RNA, 15 nt, Bordetella pertussis
cgcgcaccagcccgc

SEQ ID NO: 409651 - RNA, 13 nt, Bordetella pertussis
cgcgcaccagcgg

SEQ ID NO: 409652 - RNA, 13 nt, Bordetella pertussis
cgcgcaccaggcg

SEQ ID NO: 409653 - RNA, 23 nt, Bordetella pertussis
cgcgcaccaggucgcggugcgcc

SEQ ID NO: 409654 - RNA, 12 nt, Bordetella pertussis
cgcgcaccaucg

SEQ ID NO: 409655 - RNA, 19 nt, Bordetella pertussis
cgcgcaccauucucgcccu

SEQ ID NO: 409656 - RNA, 15 nt, Bordetella pertussis
cgcgcacccaggccc

SEQ ID NO: 409657 - RNA, 21 nt, Bordetella pertussis
cgcgcagaucccaggcgcuca

SEQ ID NO: 409658 - RNA, 13 nt, Bordetella pertussis
cgcgcagcaaccc

SEQ ID NO: 409659 - RNA, 12 nt, Bordetella pertussis
cgcgcagcaagu

SEQ ID NO: 409660 - RNA, 23 nt, Bordetella pertussis
cgcgcagcaccggcgugagcgcc

SEQ ID NO: 409661 - RNA, 18 nt, Bordetella pertussis
cgcgcagcaccucggggc

SEQ ID NO: 409662 - RNA, 13 nt, Bordetella pertussis
cgcgcagcacgcc

SEQ ID NO: 409663 - RNA, 21 nt, Bordetella pertussis
cgcgcagcagacgcuucaggc

SEQ ID NO: 409664 - RNA, 13 nt, Bordetella pertussis
cgcgcagcaggcc

SEQ ID NO: 409665 - RNA, 19 nt, Bordetella pertussis
cgcgcagcaggccgcgcgu

SEQ ID NO: 409666 - RNA, 21 nt, Bordetella pertussis
cgcgcagcaggccguugccgc

SEQ ID NO: 409667 - RNA, 14 nt, Bordetella pertussis
cgcgcagcaccgcc

SEQ ID NO: 409668 - RNA, 14 nt, Bordetella pertussis
cgcgcagcccggcg

SEQ ID NO: 409669 - RNA, 22 nt, Bordetella pertussis
cgcgcagcccggcgugcccagg

SEQ ID NO: 409670 - RNA, 14 nt, Bordetella pertussis
cgcgcagcgccgcc

SEQ ID NO: 409671 - RNA, 16 nt, Bordetella pertussis
cgcgcagcggcgcgcg

SEQ ID NO: 409672 - RNA, 14 nt, Bordetella pertussis
cgcgcagcgucugc

SEQ ID NO: 409673 - RNA, 22 nt, Bordetella pertussis
cgcgcagcgugcggaccagcgg

SEQ ID NO: 409674 - RNA, 15 nt, Bordetella pertussis
cgcgcagcguggcgg

SEQ ID NO: 409675 - RNA, 21 nt, Bordetella pertussis
cgcgcaguugcgucuccagcg

SEQ ID NO: 409676 - RNA, 19 nt, Bordetella pertussis
cgcgcaguuguucgcgcaa

SEQ ID NO: 409677 - RNA, 17 nt, Bordetella pertussis
cgcgcaucgcgcggcau

SEQ ID NO: 409678 - RNA, 17 nt, Bordetella pertussis
cgcgcaucgucaggcag

SEQ ID NO: 409679 - RNA, 22 nt, Bordetella pertussis
cgcgccacacgggcgccugccg

SEQ ID NO: 409680 - RNA, 23 nt, Bordetella pertussis
cgcgcaugauuccugucgcgcug

SEQ ID NO: 409681 - RNA, 13 nt, Bordetella pertussis
cgcgccaccaccg

SEQ ID NO: 409682 - RNA, 15 nt, Bordetella pertussis
cgcgccaccgccaga

SEQ ID NO: 409683 - RNA, 15 nt, Bordetella pertussis
cgcgccagcagcgcc

SEQ ID NO: 409684 - RNA, 12 nt, Bordetella pertussis
cgcgccagcagu

SEQ ID NO: 409685 - RNA, 15 nt, Bordetella pertussis
cgcgccagccgcgcg

SEQ ID NO: 409686 - RNA, 18 nt, Bordetella pertussis
cgcgccagccgcgcgaac

SEQ ID NO: 409687 - RNA, 23 nt, Bordetella pertussis
cgcgccagcgccgcgcgcgugcc

SEQ ID NO: 409688 - RNA, 14 nt, Bordetella pertussis
cgcgccagcggcug

SEQ ID NO: 409689 - RNA, 15 nt, Bordetella pertussis
cgcgccagcggcugc

SEQ ID NO: 409690 - RNA, 12 nt, Bordetella pertussis
cgcgccagcucg

SEQ ID NO: 409691 - RNA, 18 nt, Bordetella pertussis
cgcgccagcucgcgcagc

SEQ ID NO: 409692 - RNA, 14 nt, Bordetella pertussis
cgcgccagcugcgc

SEQ ID NO: 409693 - RNA, 17 nt, Bordetella pertussis
cgcgccagcugcgcagc

SEQ ID NO: 409694 - RNA, 13 nt, Bordetella pertussis
cgcgccagcgcca

SEQ ID NO: 409695 - RNA, 20 nt, Bordetella pertussis
cgcgccaggaagcgcgccgc

SEQ ID NO: 409696 - RNA, 15 nt, Bordetella pertussis
cgcgccaggccccgc

SEQ ID NO: 409697 - RNA, 18 nt, Bordetella pertussis
cgcgccaggcgccgggcc

SEQ ID NO: 409698 - RNA, 21 nt, Bordetella pertussis
cgcgccaggcgccgggccgcu

SEQ ID NO: 409699 - RNA, 14 nt, Bordetella pertussis
cgcgccagggcccc

SEQ ID NO: 409700 - RNA, 17 nt, Bordetella pertussis
cgcgccagggccccucc

SEQ ID NO: 409701 - RNA, 21 nt, Bordetella pertussis
cgcgccagggccccuccggcg

SEQ ID NO: 409702 - RNA, 17 nt, Bordetella pertussis
cgcgccaggggaugacg

SEQ ID NO: 409703 - RNA, 14 nt, Bordetella pertussis
cgcgccaggcgcgc

SEQ ID NO: 409704 - RNA, 23 nt, Bordetella pertussis
cgcgccauccugaacgccgcgcu

SEQ ID NO: 409705 - RNA, 15 nt, Bordetella pertussis
cgcgccaugcucgcg

SEQ ID NO: 409706 - RNA, 18 nt, Bordetella pertussis
cgcgccaugcucgcgcac

SEQ ID NO: 409707 - RNA, 21 nt, Bordetella pertussis
cgcgccaugcucgcgcacagc

SEQ ID NO: 409708 - RNA, 17 nt, Bordetella pertussis
cgcgccaugucggggcu

SEQ ID NO: 409709 - RNA, 13 nt, Bordetella pertussis
cgcgcccuugccg

SEQ ID NO: 409710 - RNA, 16 nt, Bordetella pertussis
cgcgccgaacgcgcag

SEQ ID NO: 409711 - RNA, 16 nt, Bordetella pertussis
cgcgccgaccaccugc

SEQ ID NO: 409712 - RNA, 13 nt, Bordetella pertussis
cgcgccgaccagg

SEQ ID NO: 409713 - RNA, 15 nt, Bordetella pertussis
cgcgccgaccggccc

SEQ ID NO: 409714 - RNA, 16 nt, Bordetella pertussis
cgcgccgaccggcccc

SEQ ID NO: 409715 - RNA, 15 nt, Bordetella pertussis
cgcgccgagcggggc

SEQ ID NO: 409716 - RNA, 16 nt, Bordetella pertussis
cgcgccgagcggggcc

SEQ ID NO: 409717 - RNA, 22 nt, Bordetella pertussis
cgcgccgcuggcggccgcgggc

SEQ ID NO: 409718 - RNA, 13 nt, Bordetella pertussis
cgcgccggcaggg

SEQ ID NO: 409719 - RNA, 17 nt, Bordetella pertussis
cgcgccggcagggcggc

SEQ ID NO: 409720 - RNA, 14 nt, Bordetella pertussis
cgcgccggccaggg

SEQ ID NO: 409721 - RNA, 18 nt, Bordetella pertussis
cgcgccggcccaggcgcg

SEQ ID NO: 409722 - RNA, 19 nt, Bordetella pertussis
cgcgccggaugcgcguggc

SEQ ID NO: 409723 - RNA, 16 nt, Bordetella pertussis
cgcgccggccgccagc

SEQ ID NO: 409724 - RNA, 13 nt, Bordetella pertussis
cgcgccggccggu

SEQ ID NO: 409725 - RNA, 13 nt, Bordetella pertussis
cgcgccggccugc

SEQ ID NO: 409726 - RNA, 12 nt, Bordetella pertussis
cgcgccggcggc

SEQ ID NO: 409727 - RNA, 19 nt, Bordetella pertussis
cgcgccgggccacgagcag

SEQ ID NO: 409728 - RNA, 21 nt, Bordetella pertussis
cgcgccgggccuagcccggcg

SEQ ID NO: 409729 - RNA, 13 nt, Bordetella pertussis
cgcgccgggcgcg

SEQ ID NO: 409730 - RNA, 15 nt, Bordetella pertussis
cgcgccgggcgcgcc

SEQ ID NO: 409731 - RNA, 18 nt, Bordetella pertussis
cgcgccgggcgcgccggc

SEQ ID NO: 409732 - RNA, 18 nt, Bordetella pertussis
cgcgccgggcgggucggc

SEQ ID NO: 409733 - RNA, 19 nt, Bordetella pertussis
cgcgccggggcggcgcagc

SEQ ID NO: 409734 - RNA, 21 nt, Bordetella pertussis
cgcgccggggcggcucggccc

SEQ ID NO: 409735 - RNA, 13 nt, Bordetella pertussis
cgcgccugcagca

SEQ ID NO: 409736 - RNA, 19 nt, Bordetella pertussis
cgcgccugcagcacggcca

SEQ ID NO: 409737 - RNA, 15 nt, Bordetella pertussis
cgcgccugcagcagc

SEQ ID NO: 409738 - RNA, 15 nt, Bordetella pertussis
cgcgccugcccaggc

SEQ ID NO: 409739 - RNA, 15 nt, Bordetella pertussis
cgcgccugccccgcc

SEQ ID NO: 409740 - RNA, 16 nt, Bordetella pertussis
cgcgccugcgcgccgc

SEQ ID NO: 409741 - RNA, 15 nt, Bordetella pertussis
cgcgccugcgcgcgg

SEQ ID NO: 409742 - RNA, 17 nt, Bordetella pertussis
cgcgccuuacgcggcgc

SEQ ID NO: 409743 - RNA, 14 nt, Bordetella pertussis
cgcgccuggcgcgc

SEQ ID NO: 409744 - RNA, 16 nt, Bordetella pertussis
cgcgccuggcgcgccc

SEQ ID NO: 409745 - RNA, 23 nt, Bordetella pertussis
cgcgccugggggcuggaggcgca

SEQ ID NO: 409746 - RNA, 18 nt, Bordetella pertussis
cgcgccuucggcgcgcac

SEQ ID NO: 409747 - RNA, 14 nt, Bordetella pertussis
cgcgccuucuaccc

SEQ ID NO: 409748 - RNA, 16 nt, Bordetella pertussis
cgcgccuucuacccgc

SEQ ID NO: 409749 - RNA, 13 nt, Bordetella pertussis
cgcgcgaccaggc

SEQ ID NO: 409750 - RNA, 20 nt, Bordetella pertussis
cgcgcgacuccaccggcguc

SEQ ID NO: 409751 - RNA, 23 nt, Bordetella pertussis
cgcgcgacuuccucgacccgcgc

SEQ ID NO: 409752 - RNA, 24 nt, Bordetella pertussis
cgcgcgacuuccucgacccgcgcc

SEQ ID NO: 409753 - RNA, 17 nt, Bordetella pertussis
cgcgcgaucgccagcag

SEQ ID NO: 409754 - RNA, 22 nt, Bordetella pertussis
cgcgcgaucgccagcaggcgcu

SEQ ID NO: 409755 - RNA, 17 nt, Bordetella pertussis
cgcgcgagaccagcgga

SEQ ID NO: 409756 - RNA, 19 nt, Bordetella pertussis
cgcgcgauguucaggccgg

SEQ ID NO: 409757 - RNA, 17 nt, Bordetella pertussis
cgcgcgcaagccgccgc

SEQ ID NO: 409758 - RNA, 19 nt, Bordetella pertussis
cgcgcgcaagccgccgccc

SEQ ID NO: 409759 - RNA, 16 nt, Bordetella pertussis
cgcgcgcacggcgccc

SEQ ID NO: 409760 - RNA, 12 nt, Bordetella pertussis
cgcgcgcagccg

SEQ ID NO: 409761 - RNA, 13 nt, Bordetella pertussis
cgcgcgccacuau

SEQ ID NO: 409762 - RNA, 14 nt, Bordetella pertussis
cgcgcgccagcggc

SEQ ID NO: 409763 - RNA, 14 nt, Bordetella pertussis
cgcgcgccaggccc

SEQ ID NO: 409764 - RNA, 19 nt, Bordetella pertussis
cgcgcgccagggcgccgcg

SEQ ID NO: 409765 - RNA, 14 nt, Bordetella pertussis
cgcgcgccaggugc

SEQ ID NO: 409766 - RNA, 18 nt, Bordetella pertussis
cgcgcgccauccggcgca

SEQ ID NO: 409767 - RNA, 20 nt, Bordetella pertussis
cgcgcggccauguccagcag

SEQ ID NO: 409768 - RNA, 16 nt, Bordetella pertussis
cgcgcggccugggcgg

SEQ ID NO: 409769 - RNA, 14 nt, Bordetella pertussis
cgcgcggcgcagcg

SEQ ID NO: 409770 - RNA, 14 nt, Bordetella pertussis
cgcgcggcgcugca

SEQ ID NO: 409771 - RNA, 23 nt, Bordetella pertussis
cgcgcgggcgauggccacgcgcu

SEQ ID NO: 409772 - RNA, 14 nt, Bordetella pertussis
cgcgcgggcgcgca

SEQ ID NO: 409773 - RNA, 16 nt, Bordetella pertussis
cgcgcgggcgcgcagc

SEQ ID NO: 409774 - RNA, 22 nt, Bordetella pertussis
cgcgcgggaagcugucggcgcu

SEQ ID NO: 409775 - RNA, 20 nt, Bordetella pertussis
cgcgcgguauugcgccaccc

SEQ ID NO: 409776 - RNA, 21 nt, Bordetella pertussis
cgcgcgguauugcgccacccc

SEQ ID NO: 409777 - RNA, 16 nt, Bordetella pertussis
cgcgcggugccgccug

SEQ ID NO: 409778 - RNA, 19 nt, Bordetella pertussis
cgcgcguaucggcgcgagc

SEQ ID NO: 409779 - RNA, 14 nt, Bordetella pertussis
cgcgcgucgccgcu

SEQ ID NO: 409780 - RNA, 18 nt, Bordetella pertussis
cgcgcgucgugcccgcca

SEQ ID NO: 409781 - RNA, 18 nt, Bordetella pertussis
cgcgcgugcagcgccgcg

SEQ ID NO: 409782 - RNA, 15 nt, Bordetella pertussis
cgcgcgugcagguag

SEQ ID NO: 409783 - RNA, 20 nt, Bordetella pertussis
cgcgcguugaucaucggccc

SEQ ID NO: 409784 - RNA, 23 nt, Bordetella pertussis
cgcgcuaagcacaagcgcguggc

SEQ ID NO: 409785 - RNA, 24 nt, Bordetella pertussis
cgcgcuaagcacaagcgcguggcc

SEQ ID NO: 409786 - RNA, 14 nt, Bordetella pertussis
cgcgcucaccgagg

SEQ ID NO: 409787 - RNA, 12 nt, Bordetella pertussis
cgcgcucagcac

SEQ ID NO: 409788 - RNA, 19 nt, Bordetella pertussis
cgcgcucagcaccaggccg

SEQ ID NO: 409789 - RNA, 14 nt, Bordetella pertussis
cgcgcucagcgcca

SEQ ID NO: 409790 - RNA, 19 nt, Bordetella pertussis
cgcgcucaggccgcugggc

SEQ ID NO: 409791 - RNA, 23 nt, Bordetella pertussis
cgcgcucgaauggcugcgcgccg

SEQ ID NO: 409792 - RNA, 18 nt, Bordetella pertussis
cgcgcucgagcgcggcgc

SEQ ID NO: 409793 - RNA, 17 nt, Bordetella pertussis
cgcgcucggccagcgcg

SEQ ID NO: 409794 - RNA, 19 nt, Bordetella pertussis
cgcgcucggccagcgcgcg

SEQ ID NO: 409795 - RNA, 17 nt, Bordetella pertussis
cgcgcucggcgccgggc

SEQ ID NO: 409796 - RNA, 14 nt, Bordetella pertussis
cgcgcucgggcagc

SEQ ID NO: 409797 - RNA, 17 nt, Bordetella pertussis
cgcgcucgggcagcucg

SEQ ID NO: 409798 - RNA, 13 nt, Bordetella pertussis
cgcgcucgcgcgc

SEQ ID NO: 409799 - RNA, 14 nt, Bordetella pertussis
cgcgcucgcgcgcg

SEQ ID NO: 409800 - RNA, 18 nt, Bordetella pertussis
cgcgcucggacgccgcgc

SEQ ID NO: 409801 - RNA, 12 nt, Bordetella pertussis
cgcgcugauucg

SEQ ID NO: 409802 - RNA, 14 nt, Bordetella pertussis
cgcgcugcacggcc

SEQ ID NO: 409803 - RNA, 15 nt, Bordetella pertussis
cgcgcugcagcagca

SEQ ID NO: 409804 - RNA, 23 nt, Bordetella pertussis
cgcgcugcaggaucgcggccagc

SEQ ID NO: 409805 - RNA, 16 nt, Bordetella pertussis
cgcgcugcccagccac

SEQ ID NO: 409806 - RNA, 19 nt, Bordetella pertussis
cgcgcugcccagccacacc

SEQ ID NO: 409807 - RNA, 15 nt, Bordetella pertussis
cgcgcugcgacagca

SEQ ID NO: 409808 - RNA, 18 nt, Bordetella pertussis
cgcgcugcgacagcagca

SEQ ID NO: 409809 - RNA, 14 nt, Bordetella pertussis
cgcgcugcgcgccg

SEQ ID NO: 409810 - RNA, 19 nt, Bordetella pertussis
cgcgcugcucuccaugcug

SEQ ID NO: 409811 - RNA, 14 nt, Bordetella pertussis
cgcgcugcugccgu

SEQ ID NO: 409812 - RNA, 18 nt, Bordetella pertussis
cgcgcugcuuucccuguc

SEQ ID NO: 409813 - RNA, 13 nt, Bordetella pertussis
cgcgcuggcgcag

SEQ ID NO: 409814 - RNA, 14 nt, Bordetella pertussis
cgcgcuggcgcagc

SEQ ID NO: 409815 - RNA, 20 nt, Bordetella pertussis
cgcgcuggcgcagcaggcgc

SEQ ID NO: 409816 - RNA, 22 nt, Bordetella pertussis
cgcgcuggcgguggccgcgcau

SEQ ID NO: 409817 - RNA, 20 nt, Bordetella pertussis
cgcgcuggcugugcccgccc

SEQ ID NO: 409818 - RNA, 22 nt, Bordetella pertussis
cgcgcuggcugugcccgcccca

SEQ ID NO: 409819 - RNA, 15 nt, Bordetella pertussis
cgcgcuggggcagca

SEQ ID NO: 409820 - RNA, 17 nt, Bordetella pertussis
cgcgcuggggcaggacg

SEQ ID NO: 409821 - RNA, 17 nt, Bordetella pertussis
cgcgcuuuuccccgccc

SEQ ID NO: 409822 - RNA, 16 nt, Bordetella pertussis
cgcggaucgugcgcca

SEQ ID NO: 409823 - RNA, 22 nt, Bordetella pertussis
cgcggaugaccugcgccaggug

SEQ ID NO: 409824 - RNA, 17 nt, Bordetella pertussis
cgcggaugaucgcgcag

SEQ ID NO: 409825 - RNA, 21 nt, Bordetella pertussis
cgcggaugccguccacgccgc

SEQ ID NO: 409826 - RNA, 19 nt, Bordetella pertussis
cgcggccccaugcgcggca

SEQ ID NO: 409827 - RNA, 12 nt, Bordetella pertussis
cgcggcccggcg

SEQ ID NO: 409828 - RNA, 14 nt, Bordetella pertussis
cgcggcccggcguc

SEQ ID NO: 409829 - RNA, 21 nt, Bordetella pertussis
cgcggcccugggccagccagc

SEQ ID NO: 409830 - RNA, 22 nt, Bordetella pertussis
cgcggcccugggccagccagcg

SEQ ID NO: 409831 - RNA, 17 nt, Bordetella pertussis
cgcggccgagcgggcca

SEQ ID NO: 409832 - RNA, 18 nt, Bordetella pertussis
cgcggccgccagcccgag

SEQ ID NO: 409833 - RNA, 13 nt, Bordetella pertussis
cgcggccgcgcag

SEQ ID NO: 409834 - RNA, 14 nt, Bordetella pertussis
cgcggccgcgcagg

SEQ ID NO: 409835 - RNA, 22 nt, Bordetella pertussis
cgcggcgacacccccagggcgc

SEQ ID NO: 409836 - RNA, 16 nt, Bordetella pertussis
cgcggccggaggccgc

SEQ ID NO: 409837 - RNA, 14 nt, Bordetella pertussis
cgcggccggcacca

SEQ ID NO: 409838 - RNA, 15 nt, Bordetella pertussis
cgcggccggcaccau

SEQ ID NO: 409839 - RNA, 15 nt, Bordetella pertussis
cgcggccgcgcgcuu

SEQ ID NO: 409840 - RNA, 16 nt, Bordetella pertussis
cgcggccgcgggccgc

SEQ ID NO: 409841 - RNA, 20 nt, Bordetella pertussis
cgcggcgagcacggccugcu

SEQ ID NO: 409842 - RNA, 13 nt, Bordetella pertussis
cgcggcgagccgc

SEQ ID NO: 409843 - RNA, 15 nt, Bordetella pertussis
cgcggcgagccgcgc

SEQ ID NO: 409844 - RNA, 17 nt, Bordetella pertussis
cgcggcgagcgccgcca

SEQ ID NO: 409845 - RNA, 21 nt, Bordetella pertussis
cgcggcgaggcguccagcccc

SEQ ID NO: 409846 - RNA, 20 nt, Bordetella pertussis
cgcggcgauacgcgccgccu

SEQ ID NO: 409847 - RNA, 20 nt, Bordetella pertussis
cgcggcgaugccggccagca

SEQ ID NO: 409848 - RNA, 17 nt, Bordetella pertussis
cgcggcgauugcggccc

SEQ ID NO: 409849 - RNA, 13 nt, Bordetella pertussis
cgcggcgcagcau

SEQ ID NO: 409850 - RNA, 15 nt, Bordetella pertussis
cgcggcgcaggccug

SEQ ID NO: 409851 - RNA, 14 nt, Bordetella pertussis
cgcggcgcaggcgg

SEQ ID NO: 409852 - RNA, 14 nt, Bordetella pertussis
cgcggcgccagcgc

SEQ ID NO: 409853 - RNA, 19 nt, Bordetella pertussis
cgcggcgccaugccgcgcc

SEQ ID NO: 409854 - RNA, 20 nt, Bordetella pertussis
cgcggcgccaugccgcgccc

SEQ ID NO: 409855 - RNA, 20 nt, Bordetella pertussis
cgcggcgcccggugcgcgca

SEQ ID NO: 409856 - RNA, 21 nt, Bordetella pertussis
cgcggcgccgcauuuccucga

SEQ ID NO: 409857 - RNA, 19 nt, Bordetella pertussis
cgcggcgccgccggcggcc

SEQ ID NO: 409858 - RNA, 12 nt, Bordetella pertussis
cgcggcgccgcu

SEQ ID NO: 409859 - RNA, 15 nt, Bordetella pertussis
cgcggcgccggccgu

SEQ ID NO: 409860 - RNA, 19 nt, Bordetella pertussis
cgcggcgccggccuccagc

SEQ ID NO: 409861 - RNA, 15 nt, Bordetella pertussis
cgcggcgccugccug

SEQ ID NO: 409862 - RNA, 20 nt, Bordetella pertussis
cgcggcgccuggggcgugcc

SEQ ID NO: 409863 - RNA, 13 nt, Bordetella pertussis
cgcggcgcgcgcc

SEQ ID NO: 409864 - RNA, 14 nt, Bordetella pertussis
cgcggcgcgcgccu

SEQ ID NO: 409865 - RNA, 17 nt, Bordetella pertussis
cgcggcgcgcgcgcgca

SEQ ID NO: 409866 - RNA, 20 nt, Bordetella pertussis
cgcggcgcgcgcggcgccug

SEQ ID NO: 409867 - RNA, 16 nt, Bordetella pertussis
cgcggcgcggccagca

SEQ ID NO: 409868 - RNA, 18 nt, Bordetella pertussis
cgcggcgcggccagcagc

SEQ ID NO: 409869 - RNA, 16 nt, Bordetella pertussis
cgcggcgcggccggcu

SEQ ID NO: 409870 - RNA, 12 nt, Bordetella pertussis
cgcggcgcggcg

SEQ ID NO: 409871 - RNA, 13 nt, Bordetella pertussis
cgcggcgcggcgc

SEQ ID NO: 409872 - RNA, 23 nt, Bordetella pertussis
cgcggcgcguucagcagcaggcc

SEQ ID NO: 409873 - RNA, 22 nt, Bordetella pertussis
cgcggcgcguucagggcgccgc

SEQ ID NO: 409874 - RNA, 23 nt, Bordetella pertussis
cgcggcgcuggcgccgcgcgcca

SEQ ID NO: 409875 - RNA, 14 nt, Bordetella pertussis
cgcggcgcuggcgu

SEQ ID NO: 409876 - RNA, 15 nt, Bordetella pertussis
cgcggcggcaccagc

SEQ ID NO: 409877 - RNA, 13 nt, Bordetella pertussis
cgcggcggcagcg

SEQ ID NO: 409878 - RNA, 22 nt, Bordetella pertussis
cgcggcguacuggcgcggcggc

SEQ ID NO: 409879 - RNA, 16 nt, Bordetella pertussis
cgcggcguauggcgcg

SEQ ID NO: 409880 - RNA, 15 nt, Bordetella pertussis
cgcggcgugcugccc

SEQ ID NO: 409881 - RNA, 19 nt, Bordetella pertussis
cgcggcgugcugcccgcgu

SEQ ID NO: 409882 - RNA, 17 nt, Bordetella pertussis
cgcggcguccgcgccga

SEQ ID NO: 409883 - RNA, 16 nt, Bordetella pertussis
cgcggcgucgacgccc

SEQ ID NO: 409884 - RNA, 22 nt, Bordetella pertussis
cgcggcguugcggcagcggccc

SEQ ID NO: 409885 - RNA, 16 nt, Bordetella pertussis
cgcggcguugcggcgc

SEQ ID NO: 409886 - RNA, 18 nt, Bordetella pertussis
cgcggcguugcggcgcca

SEQ ID NO: 409887 - RNA, 15 nt, Bordetella pertussis
cgcggcucgccgcgc

SEQ ID NO: 409888 - RNA, 12 nt, Bordetella pertussis
cgcgggcagcaa

SEQ ID NO: 409889 - RNA, 12 nt, Bordetella pertussis
cgcgggccacug

SEQ ID NO: 409890 - RNA, 18 nt, Bordetella pertussis
cgcgggccacugcgccug

SEQ ID NO: 409891 - RNA, 14 nt, Bordetella pertussis
cgcgggccagcaga

SEQ ID NO: 409892 - RNA, 12 nt, Bordetella pertussis
cgcgggccaggc

SEQ ID NO: 409893 - RNA, 14 nt, Bordetella pertussis
cgcgggccaggccg

SEQ ID NO: 409894 - RNA, 19 nt, Bordetella pertussis
cgcgggccuuggccagcag

SEQ ID NO: 409895 - RNA, 22 nt, Bordetella pertussis
cgcgggccuuggccagcagcgc

SEQ ID NO: 409896 - RNA, 19 nt, Bordetella pertussis
cgcgggcgcccgcgcgcga

SEQ ID NO: 409897 - RNA, 12 nt, Bordetella pertussis
cgcgggcgcgca

SEQ ID NO: 409898 - RNA, 20 nt, Bordetella pertussis
cgcgggcgcgcagcgcgacc

SEQ ID NO: 409899 - RNA, 13 nt, Bordetella pertussis
cgcgggcgcgccg

SEQ ID NO: 409900 - RNA, 13 nt, Bordetella pertussis
cgcgggcgcgcgc

SEQ ID NO: 409901 - RNA, 15 nt, Bordetella pertussis
cgcgggcgcgcgccc

SEQ ID NO: 409902 - RNA, 14 nt, Bordetella pertussis
cgcgucagacgcgc

SEQ ID NO: 409903 - RNA, 14 nt, Bordetella pertussis
cgcgucaggccggg

SEQ ID NO: 409904 - RNA, 18 nt, Bordetella pertussis
cgcgucaggcgagcgcgg

SEQ ID NO: 409905 - RNA, 16 nt, Bordetella pertussis
cgcguccagcgcgcgg

SEQ ID NO: 409906 - RNA, 17 nt, Bordetella pertussis
cgcguccagcgcgcggc
